United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 67

SEQ ID NO: 3050260 - RNA, 22 nt, Human
uuuuuguuccacaaguuaaaua

SEQ ID NO: 3050261 - RNA, 20 nt, Human
auuaagagagucuauuuacg

SEQ ID NO: 3050262 - RNA, 23 nt, Human
uuuuuuaaaaaagaaacauuugg

SEQ ID NO: 3050263 - RNA, 19 nt, Human
auuaccacagacauacuaa

SEQ ID NO: 3050264 - RNA, 15 nt, Human
auuacauuuguauaa

SEQ ID NO: 3050265 - RNA, 20 nt, Human
auuacauuuguauaaaauaa

SEQ ID NO: 3050266 - RNA, 13 nt, Human
auuacauuuguau

SEQ ID NO: 3050267 - RNA, 22 nt, Human
auuaccugaauuuuggcugugu

SEQ ID NO: 3050268 - RNA, 15 nt, Human
auuauauuuacaaau

SEQ ID NO: 3050269 - RNA, 23 nt, Human
auuaucucaaaacugcacuguca

SEQ ID NO: 3050270 - RNA, 18 nt, Human
auuaucucaaaacugcac

SEQ ID NO: 3050271 - RNA, 18 nt, Human
auuauuuuauguugcaua

SEQ ID NO: 3050272 - RNA, 16 nt, Human
auuauuuuauguugca

SEQ ID NO: 3050273 - RNA, 23 nt, Human
auuauuuauuaaaugcccagccc

SEQ ID NO: 3050274 - RNA, 16 nt, Human
auuauauuuacaaaug

SEQ ID NO: 3050275 - RNA, 13 nt, Human
auuagagaagaga

SEQ ID NO: 3050276 - RNA, 13 nt, Human
aucuuuuuauuca

SEQ ID NO: 3050277 - RNA, 13 nt, Human
aucuuuuucuaac

SEQ ID NO: 3050278 - RNA, 23 nt, Human
aucuuuggacagaagcagcucuu

SEQ ID NO: 3050279 - RNA, 12 nt, Human
augaaagauuca

SEQ ID NO: 3050280 - RNA, 15 nt, Human
augaaagcagggacu

SEQ ID NO: 3050281 - RNA, 21 nt, Human
aucuuuaauuuuacauuuccu

SEQ ID NO: 3050282 - RNA, 16 nt, Human
aucuuuaauuuuacau

SEQ ID NO: 3050283 - RNA, 22 nt, Human
aucuuuaauuuuacauuuccua

SEQ ID NO: 3050284 - RNA, 18 nt, Human
aucuuugcagacaggcaa

SEQ ID NO: 3050285 - RNA, 22 nt, Human
aucuuuggacagaagcagcucu

SEQ ID NO: 3050286 - RNA, 22 nt, Human
uuggcgcugccccuggcagccc

SEQ ID NO: 3050287 - RNA, 23 nt, Human
uuggcgcugccccuggcagcccc

SEQ ID NO: 3050288 - RNA, 18 nt, Human
uuggcuagagguucaaag

SEQ ID NO: 3050289 - RNA, 14 nt, Human
uuggggauauuuuu

SEQ ID NO: 3050290 - RNA, 22 nt, Human
uuggggggcugaggugggagga

SEQ ID NO: 3050291 - RNA, 18 nt, Human
uuggggcucccagccagg

SEQ ID NO: 3050292 - RNA, 22 nt, Human
uuggggcucccagccaggcccu

SEQ ID NO: 3050293 - RNA, 13 nt, Human
uuggggcucccag

SEQ ID NO: 3050294 - RNA, 14 nt, Human
uuggggcucccagc

SEQ ID NO: 3050295 - RNA, 15 nt, Human
uuggggcucccagcc

SEQ ID NO: 3050296 - RNA, 20 nt, Human
augaaugucagugugacuga

SEQ ID NO: 3050297 - RNA, 18 nt, Human
augaagauguagaggaga

SEQ ID NO: 3050298 - RNA, 13 nt, Human
augaaugaauggc

SEQ ID NO: 3050299 - RNA, 16 nt, Human
augaagauacugaaau

SEQ ID NO: 3050300 - RNA, 17 nt, Human
augaagauacugaaaua

SEQ ID NO: 3050301 - RNA, 15 nt, Human
augaagauacugaaa

SEQ ID NO: 3050302 - RNA, 18 nt, Human
augaaauauuauguuaaa

SEQ ID NO: 3050303 - RNA, 13 nt, Human
augaaauauuaug

SEQ ID NO: 3050304 - RNA, 17 nt, Human
augaaauauuauguuaa

SEQ ID NO: 3050305 - RNA, 23 nt, Human
augagaaaucuaaaaaacgaaaa

SEQ ID NO: 3050306 - RNA, 18 nt, Human
augagaaaucuaaaaaac

SEQ ID NO: 3050307 - RNA, 15 nt, Human
augagaaaucuaaaa

SEQ ID NO: 3050308 - RNA, 22 nt, Human
augagaaagguugaagcaccaa

SEQ ID NO: 3050309 - RNA, 21 nt, Human
augagaaagguugaagcacca

SEQ ID NO: 3050310 - RNA, 13 nt, Human
augagagacacac

SEQ ID NO: 3050311 - RNA, 14 nt, Human
augagagacacacu

SEQ ID NO: 3050312 - RNA, 17 nt, Human
augagagacacacugaa

SEQ ID NO: 3050313 - RNA, 19 nt, Human
augagagacacacugaaga

SEQ ID NO: 3050314 - RNA, 14 nt, Human
augacuuacuguac

SEQ ID NO: 3050315 - RNA, 22 nt, Human
augacuuaagcacacuugacau

SEQ ID NO: 3050316 - RNA, 18 nt, Human
augacacgaauauugcug

SEQ ID NO: 3050317 - RNA, 17 nt, Human
augacuuacuguacaug

SEQ ID NO: 3050318 - RNA, 16 nt, Human
augacuuacuguacau

SEQ ID NO: 3050319 - RNA, 22 nt, Human
augacacaugcaaggucauuuu

SEQ ID NO: 3050320 - RNA, 14 nt, Human
augacacaugcaag

SEQ ID NO: 3050321 - RNA, 16 nt, Human
uuguaucacaaaucuu

SEQ ID NO: 3050322 - RNA, 17 nt, Human
uuguauaaaauaauuuu

SEQ ID NO: 3050323 - RNA, 16 nt, Human
uuguauaaaauaauuu

SEQ ID NO: 3050324 - RNA, 15 nt, Human
uuguauaaaauaauu

SEQ ID NO: 3050325 - RNA, 14 nt, Human
uugcaucugaaaau

SEQ ID NO: 3050326 - RNA, 15 nt, Human
uugauucagacagcu

SEQ ID NO: 3050327 - RNA, 16 nt, Human
uugauucagacagcug

SEQ ID NO: 3050328 - RNA, 21 nt, Human
uugcacacuuuggcccagggu

SEQ ID NO: 3050329 - RNA, 15 nt, Human
uugaugggauuuggu

SEQ ID NO: 3050330 - RNA, 18 nt, Human
uugauggugguauguuuu

SEQ ID NO: 3050331 - RNA, 12 nt, Human
uugaugccuggc

SEQ ID NO: 3050332 - RNA, 11 nt, Human
uugauguguuu

SEQ ID NO: 3050333 - RNA, 14 nt, Human
uugauucagacagc

SEQ ID NO: 3050334 - RNA, 19 nt, Human
uugauggugguauguuuuc

SEQ ID NO: 3050335 - RNA, 17 nt, Human
aucucauaauuuauaca

SEQ ID NO: 3050336 - RNA, 18 nt, Human
aucucauaauuuauacag

SEQ ID NO: 3050337 - RNA, 21 nt, Human
aucucauuuccaagcaaguau

SEQ ID NO: 3050338 - RNA, 14 nt, Human
aucucauuuccaag

SEQ ID NO: 3050339 - RNA, 23 nt, Human
aucucauuuccaagcaaguauua

SEQ ID NO: 3050340 - RNA, 16 nt, Human
aucuccccaucauugg

SEQ ID NO: 3050341 - RNA, 12 nt, Human
aucucccccagc

SEQ ID NO: 3050342 - RNA, 13 nt, Human
aucucccccagcc

SEQ ID NO: 3050343 - RNA, 15 nt, Human
aucucacacaugagc

SEQ ID NO: 3050344 - RNA, 13 nt, Human
aucucaauauuuc

SEQ ID NO: 3050345 - RNA, 16 nt, Human
aucucacacaugagca

SEQ ID NO: 3050346 - RNA, 15 nt, Human
auccuaguuccacca

SEQ ID NO: 3050347 - RNA, 19 nt, Human
auccuaguuccaccaucaa

SEQ ID NO: 3050348 - RNA, 13 nt, Human
uugccgucuaccu

SEQ ID NO: 3050349 - RNA, 13 nt, Human
uugcccuguuaaa

SEQ ID NO: 3050350 - RNA, 14 nt, Human
uugccguuauuaaa

SEQ ID NO: 3050351 - RNA, 19 nt, Human
uugccgucuaccugagggg

SEQ ID NO: 3050352 - RNA, 15 nt, Human
uugccgucuaccuga

SEQ ID NO: 3050353 - RNA, 18 nt, Human
uugccgucuaccugaggg

SEQ ID NO: 3050354 - RNA, 23 nt, Human
aucugugaaaggaaagagggagg

SEQ ID NO: 3050355 - RNA, 17 nt, Human
aucuggguucacugcaa

SEQ ID NO: 3050356 - RNA, 19 nt, Human
aucuggguucacugcaacc

SEQ ID NO: 3050357 - RNA, 19 nt, Human
aucuugcucugcugacaga

SEQ ID NO: 3050358 - RNA, 17 nt, Human
aucuugcucugcugaca

SEQ ID NO: 3050359 - RNA, 17 nt, Human
aucuugaauuguaagga

SEQ ID NO: 3050360 - RNA, 18 nt, Human
aucuugaauuguaaggaa

SEQ ID NO: 3050361 - RNA, 16 nt, Human
uuuaguaucuuuuuau

SEQ ID NO: 3050362 - RNA, 15 nt, Human
uuuaguagagacagg

SEQ ID NO: 3050363 - RNA, 22 nt, Human
uuuagcuggaaaaguauguuag

SEQ ID NO: 3050364 - RNA, 15 nt, Human
augcccccuguggau

SEQ ID NO: 3050365 - RNA, 19 nt, Human
augcccccuguggaugcug

SEQ ID NO: 3050366 - RNA, 20 nt, Human
uuuagcuggaaaaguauguu

SEQ ID NO: 3050367 - RNA, 20 nt, Human
uuuauggcuuuugugcauua

SEQ ID NO: 3050368 - RNA, 13 nt, Human
uuuauauaagcuu

SEQ ID NO: 3050369 - RNA, 24 nt, Human
uuuauggcuuuugugcauuaucua

SEQ ID NO: 3050370 - RNA, 23 nt, Human
augcugucccuuacgugaguccu

SEQ ID NO: 3050371 - RNA, 22 nt, Human
augcugucuacacuaagagaga

SEQ ID NO: 3050372 - RNA, 19 nt, Human
augcugucccuuacgugag

SEQ ID NO: 3050373 - RNA, 11 nt, Human
auggaacacuc

SEQ ID NO: 3050374 - RNA, 14 nt, Human
auggaacacucuga

SEQ ID NO: 3050375 - RNA, 15 nt, Human
auggaacacucugag

SEQ ID NO: 3050376 - RNA, 16 nt, Human
auggaacacucugaga

SEQ ID NO: 3050377 - RNA, 15 nt, Human
auggaagacagcucu

SEQ ID NO: 3050378 - RNA, 19 nt, Human
augcuccuggcccacugca

SEQ ID NO: 3050379 - RNA, 16 nt, Human
augcuagaacucccuu

SEQ ID NO: 3050380 - RNA, 15 nt, Human
augcuagaacucccu

SEQ ID NO: 3050381 - RNA, 22 nt, Human
augcuguaacuuucugaaauaa

SEQ ID NO: 3050382 - RNA, 16 nt, Human
auggaaugcuguguua

SEQ ID NO: 3050383 - RNA, 17 nt, Human
auggaauacucuuauau

SEQ ID NO: 3050384 - RNA, 16 nt, Human
auggaagacagcucuu

SEQ ID NO: 3050385 - RNA, 16 nt, Human
auggaauacucuuaua

SEQ ID NO: 3050386 - RNA, 13 nt, Human
uuucagaaaugug

SEQ ID NO: 3050387 - RNA, 15 nt, Human
uuucauaugcuguau

SEQ ID NO: 3050388 - RNA, 14 nt, Human
auggacaugaucuu

SEQ ID NO: 3050389 - RNA, 20 nt, Human
auggccuuugcuugaaagaa

SEQ ID NO: 3050390 - RNA, 20 nt, Human
auggcuaguaucaaaagaaa

SEQ ID NO: 3050391 - RNA, 18 nt, Human
auggcuaauguacugcau

SEQ ID NO: 3050392 - RNA, 21 nt, Human
auggccgggcgcgguggcuca

SEQ ID NO: 3050393 - RNA, 18 nt, Human
auggauuuccagccaaag

SEQ ID NO: 3050394 - RNA, 23 nt, Human
auggacguguuaugacuccagaa

SEQ ID NO: 3050395 - RNA, 19 nt, Human
auggacguguuaugacucc

SEQ ID NO: 3050396 - RNA, 20 nt, Human
auggacguguuaugacucca

SEQ ID NO: 3050397 - RNA, 23 nt, Human
auggcacaucagcacgauuucug

SEQ ID NO: 3050398 - RNA, 17 nt, Human
auggcacaucagcacga

SEQ ID NO: 3050399 - RNA, 12 nt, Human
uuuaauuuuaca

SEQ ID NO: 3050400 - RNA, 12 nt, Human
uuuaauucaguu

SEQ ID NO: 3050401 - RNA, 16 nt, Human
uuuaagugcugcauuu

SEQ ID NO: 3050402 - RNA, 15 nt, Human
uuuaagugcugcauu

SEQ ID NO: 3050403 - RNA, 17 nt, Human
uuuaagugcugcauuua

SEQ ID NO: 3050404 - RNA, 14 nt, Human
uuuaaauguuuuuu

SEQ ID NO: 3050405 - RNA, 14 nt, Human
uuguuuucauuauc

SEQ ID NO: 3050406 - RNA, 16 nt, Human
uuguuuucaguguaca

SEQ ID NO: 3050407 - RNA, 13 nt, Human
uuguuuucagugu

SEQ ID NO: 3050408 - RNA, 15 nt, Human
augcacuuuguucug

SEQ ID NO: 3050409 - RNA, 14 nt, Human
uuuaagaggcaggg

SEQ ID NO: 3050410 - RNA, 13 nt, Human
augcagccucaca

SEQ ID NO: 3050411 - RNA, 14 nt, Human
augcagccucacag

SEQ ID NO: 3050412 - RNA, 15 nt, Human
augcagccucacagu

SEQ ID NO: 3050413 - RNA, 15 nt, Human
augcaguucugaaga

SEQ ID NO: 3050414 - RNA, 17 nt, Human
augcaguucugaagaag

SEQ ID NO: 3050415 - RNA, 18 nt, Human
augcaguucugaagaaga

SEQ ID NO: 3050416 - RNA, 19 nt, Human
augcaguucugaagaagau

SEQ ID NO: 3050417 - RNA, 15 nt, Human
augccacuaaauuga

SEQ ID NO: 3050418 - RNA, 17 nt, Human
augccacuaaauugaca

SEQ ID NO: 3050419 - RNA, 12 nt, Human
augauucccagc

SEQ ID NO: 3050420 - RNA, 21 nt, Human
augauucaacagguuuuccug

SEQ ID NO: 3050421 - RNA, 21 nt, Human
augauucaaaugucuauaaac

SEQ ID NO: 3050422 - RNA, 20 nt, Human
augauuaaccacuucagcug

SEQ ID NO: 3050423 - RNA, 21 nt, Human
augauuaaccacuucagcuga

SEQ ID NO: 3050424 - RNA, 22 nt, Human
augauuaugaauuacauuugua

SEQ ID NO: 3050425 - RNA, 19 nt, Human
augauuaaccacuucagcu

SEQ ID NO: 3050426 - RNA, 15 nt, Human
uuguugucugcaacu

SEQ ID NO: 3050427 - RNA, 13 nt, Human
augcaccagcccu

SEQ ID NO: 3050428 - RNA, 12 nt, Human
augcacuuuguu

SEQ ID NO: 3050429 - RNA, 15 nt, Human
augcaaagcacugac

SEQ ID NO: 3050430 - RNA, 13 nt, Human
uugugguuaaucu

SEQ ID NO: 3050431 - RNA, 23 nt, Human
uugugugaaagguacuucaaauc

SEQ ID NO: 3050432 - RNA, 17 nt, Human
uuguguguuuauuguca

SEQ ID NO: 3050433 - RNA, 19 nt, Human
uuguucuggcucuuccagg

SEQ ID NO: 3050434 - RNA, 20 nt, Human
uuguucuggcucuuccaggc

SEQ ID NO: 3050435 - RNA, 22 nt, Human
uuguucuggcucuuccaggcug

SEQ ID NO: 3050436 - RNA, 18 nt, Human
uugugauacaaugcugug

SEQ ID NO: 3050437 - RNA, 21 nt, Human
uugugaggaagccgcuggggc

SEQ ID NO: 3050438 - RNA, 20 nt, Human
augagagacacacugaagaa

SEQ ID NO: 3050439 - RNA, 21 nt, Human
augagagacacacugaagaag

SEQ ID NO: 3050440 - RNA, 14 nt, Human
auaucuaguaugaa

SEQ ID NO: 3050441 - RNA, 15 nt, Human
auaucuaguaugaaa

SEQ ID NO: 3050442 - RNA, 17 nt, Human
auaucuaguaugaaauu

SEQ ID NO: 3050443 - RNA, 14 nt, Human
auauauuuuaagac

SEQ ID NO: 3050444 - RNA, 19 nt, Human
auaucuccgucaacucaua

SEQ ID NO: 3050445 - RNA, 20 nt, Human
auaucuccgucaacucauau

SEQ ID NO: 3050446 - RNA, 21 nt, Human
auaucuccgucaacucauauu

SEQ ID NO: 3050447 - RNA, 13 nt, Human
auaucuuguagcu

SEQ ID NO: 3050448 - RNA, 20 nt, Human
auaucugaaaauguaugugu

SEQ ID NO: 3050449 - RNA, 17 nt, Human
auaucugaaaauguaug

SEQ ID NO: 3050450 - RNA, 16 nt, Human
auaucugaaaauguau

SEQ ID NO: 3050451 - RNA, 16 nt, Human
auauguaacaagccac

SEQ ID NO: 3050452 - RNA, 17 nt, Human
auauguaacaagccacc

SEQ ID NO: 3050453 - RNA, 15 nt, Human
auaugcacacauuuu

SEQ ID NO: 3050454 - RNA, 14 nt, Human
auaugcacacauuu

SEQ ID NO: 3050455 - RNA, 16 nt, Human
auaugcacacauuuuu

SEQ ID NO: 3050456 - RNA, 13 nt, Human
auaugcacacauu

SEQ ID NO: 3050457 - RNA, 13 nt, Human
auauauuuuaaga

SEQ ID NO: 3050458 - RNA, 12 nt, Human
auauauuuuaag

SEQ ID NO: 3050459 - RNA, 13 nt, Human
auauauuuaauga

SEQ ID NO: 3050460 - RNA, 15 nt, Human
auauauuuaaugaua

SEQ ID NO: 3050461 - RNA, 21 nt, Human
uucaucccucuggggcuguuc

SEQ ID NO: 3050462 - RNA, 17 nt, Human
uucaucccucuggggcu

SEQ ID NO: 3050463 - RNA, 13 nt, Human
uucauacauugua

SEQ ID NO: 3050464 - RNA, 19 nt, Human
uucauacauuguacgaaga

SEQ ID NO: 3050465 - RNA, 13 nt, Human
uucauaugcugua

SEQ ID NO: 3050466 - RNA, 12 nt, Human
uucauacauauu

SEQ ID NO: 3050467 - RNA, 23 nt, Human
uucauacauauuuuuguagcacu

SEQ ID NO: 3050468 - RNA, 19 nt, Human
uucauaauuauuauuuggc

SEQ ID NO: 3050469 - RNA, 13 nt, Human
uucagaaaugugu

SEQ ID NO: 3050470 - RNA, 11 nt, Human
uucagaaaugu

SEQ ID NO: 3050471 - RNA, 16 nt, Human
uucagugccaaaaaca

SEQ ID NO: 3050472 - RNA, 12 nt, Human
uucagugccuua

SEQ ID NO: 3050473 - RNA, 13 nt, Human
uucagugccuuau

SEQ ID NO: 3050474 - RNA, 17 nt, Human
uuccaaggguacuaagg

SEQ ID NO: 3050475 - RNA, 15 nt, Human
uuccaaggguacuaa

SEQ ID NO: 3050476 - RNA, 15 nt, Human
auauguggaguucau

SEQ ID NO: 3050477 - RNA, 16 nt, Human
auauguggaguucauc

SEQ ID NO: 3050478 - RNA, 19 nt, Human
uuccaccaucaagccacca

SEQ ID NO: 3050479 - RNA, 22 nt, Human
uuccacaagagcccaggccucc

SEQ ID NO: 3050480 - RNA, 18 nt, Human
uuccaccaucaagccacc

SEQ ID NO: 3050481 - RNA, 17 nt, Human
uuccaggggugggacac

SEQ ID NO: 3050482 - RNA, 16 nt, Human
uucccaagcucugcuc

SEQ ID NO: 3050483 - RNA, 15 nt, Human
uucccaagcucugcu

SEQ ID NO: 3050484 - RNA, 14 nt, Human
uucccaagcucugc

SEQ ID NO: 3050485 - RNA, 13 nt, Human
uucccaagcucug

SEQ ID NO: 3050486 - RNA, 18 nt, Human
uucccaacuccagaaagu

SEQ ID NO: 3050487 - RNA, 12 nt, Human
uucccaaauuuc

SEQ ID NO: 3050488 - RNA, 12 nt, Human
uucccaccucuc

SEQ ID NO: 3050489 - RNA, 22 nt, Human
uucccaccucucucacuccuug

SEQ ID NO: 3050490 - RNA, 18 nt, Human
uucccaagcucugcuccu

SEQ ID NO: 3050491 - RNA, 21 nt, Human
uuccaggggugggacacccug

SEQ ID NO: 3050492 - RNA, 17 nt, Human
uuccagugaggcucugc

SEQ ID NO: 3050493 - RNA, 19 nt, Human
uuccagugaggcucugccc

SEQ ID NO: 3050494 - RNA, 20 nt, Human
uuccagugaggcucugcccu

SEQ ID NO: 3050495 - RNA, 21 nt, Human
uuccagugaggcucugcccuu

SEQ ID NO: 3050496 - RNA, 22 nt, Human
uuccagugaggcucugcccuug

SEQ ID NO: 3050497 - RNA, 23 nt, Human
uucccaaagcagugcaugcuguc

SEQ ID NO: 3050498 - RNA, 21 nt, Human
uucaaaauuguuacaaauugu

SEQ ID NO: 3050499 - RNA, 16 nt, Human
uucaaaauuguuacaa

SEQ ID NO: 3050500 - RNA, 18 nt, Human
uucaaacagucucaggaa

SEQ ID NO: 3050501 - RNA, 21 nt, Human
uucaagcgauucuucugcuuc

SEQ ID NO: 3050502 - RNA, 17 nt, Human
uuauuuuuuucugaauu

SEQ ID NO: 3050503 - RNA, 13 nt, Human
uuauuuuuuucug

SEQ ID NO: 3050504 - RNA, 17 nt, Human
uuauuuuguucauacau

SEQ ID NO: 3050505 - RNA, 21 nt, Human
uuauuuuguucauacauauuu

SEQ ID NO: 3050506 - RNA, 17 nt, Human
uuauuuuuagacagagu

SEQ ID NO: 3050507 - RNA, 18 nt, Human
uuauuuuuagacagaguc

SEQ ID NO: 3050508 - RNA, 17 nt, Human
auaggcguaacuaauuu

SEQ ID NO: 3050509 - RNA, 22 nt, Human
auaggaauugacccacaagaaa

SEQ ID NO: 3050510 - RNA, 22 nt, Human
auagcuuuucccuuuuuuuaag

SEQ ID NO: 3050511 - RNA, 15 nt, Human
auagcuuuuuucucu

SEQ ID NO: 3050512 - RNA, 12 nt, Human
auaggaaaaacu

SEQ ID NO: 3050513 - RNA, 14 nt, Human
auaggaaaaacuga

SEQ ID NO: 3050514 - RNA, 16 nt, Human
auaggaaaaacugauu

SEQ ID NO: 3050515 - RNA, 17 nt, Human
auaggaaaaacugauuu

SEQ ID NO: 3050516 - RNA, 20 nt, Human
uucacagaugggugcuugga

SEQ ID NO: 3050517 - RNA, 15 nt, Human
uucacaguucucucc

SEQ ID NO: 3050518 - RNA, 20 nt, Human
uucacaguucucuccuucuu

SEQ ID NO: 3050519 - RNA, 13 nt, Human
uucacaguucucu

SEQ ID NO: 3050520 - RNA, 22 nt, Human
uucacaagacccaaaaggcaga

SEQ ID NO: 3050521 - RNA, 23 nt, Human
uucacaagacccaaaaggcagaa

SEQ ID NO: 3050522 - RNA, 13 nt, Human
auagucuuucagu

SEQ ID NO: 3050523 - RNA, 17 nt, Human
auaguggcuuaaaacaa

SEQ ID NO: 3050524 - RNA, 15 nt, Human
auaguggugugauuu

SEQ ID NO: 3050525 - RNA, 22 nt, Human
auaguuggcuaggaccccucca

SEQ ID NO: 3050526 - RNA, 20 nt, Human
auaguuguaccgcaauguga

SEQ ID NO: 3050527 - RNA, 22 nt, Human
auaguuaagcgugcauaaguua

SEQ ID NO: 3050528 - RNA, 21 nt, Human
auauauauuuuuuucugaaau

SEQ ID NO: 3050529 - RNA, 17 nt, Human
auauaacaaugcuguau

SEQ ID NO: 3050530 - RNA, 13 nt, Human
auauauaaccagu

SEQ ID NO: 3050531 - RNA, 12 nt, Human
auauauaaccag

SEQ ID NO: 3050532 - RNA, 19 nt, Human
auauauaacaaugcuguau

SEQ ID NO: 3050533 - RNA, 21 nt, Human
aucauugaaaucuuuuugcuu

SEQ ID NO: 3050534 - RNA, 21 nt, Human
aucaggccaggcccucugccc

SEQ ID NO: 3050535 - RNA, 22 nt, Human
aucaggccaggcccucugccca

SEQ ID NO: 3050536 - RNA, 23 nt, Human
aucaggccaggcccucugcccac

SEQ ID NO: 3050537 - RNA, 20 nt, Human
aucauugaaaucuuuuugcu

SEQ ID NO: 3050538 - RNA, 20 nt, Human
aucaggccaggcccucugcc

SEQ ID NO: 3050539 - RNA, 17 nt, Human
uucucuacucuagggaa

SEQ ID NO: 3050540 - RNA, 16 nt, Human
uucucuuuucaaaaca

SEQ ID NO: 3050541 - RNA, 14 nt, Human
uucugacccaugcu

SEQ ID NO: 3050542 - RNA, 13 nt, Human
uucugccgcagcc

SEQ ID NO: 3050543 - RNA, 21 nt, Human
auccaagcuggucccacucag

SEQ ID NO: 3050544 - RNA, 20 nt, Human
uucuggcuaugcauuugaaa

SEQ ID NO: 3050545 - RNA, 18 nt, Human
uucuggcuaugcauuuga

SEQ ID NO: 3050546 - RNA, 14 nt, Human
uucugccgcagccc

SEQ ID NO: 3050547 - RNA, 15 nt, Human
uucugccgcagcccu

SEQ ID NO: 3050548 - RNA, 16 nt, Human
uucuggcuaugcauuu

SEQ ID NO: 3050549 - RNA, 20 nt, Human
auccuagucacuaccuucau

SEQ ID NO: 3050550 - RNA, 13 nt, Human
auccuaguuccac

SEQ ID NO: 3050551 - RNA, 21 nt, Human
auccuaggcauuugcugaaua

SEQ ID NO: 3050552 - RNA, 21 nt, Human
auccuaagcuauucaguaaua

SEQ ID NO: 3050553 - RNA, 11 nt, Human
uugaaaucuuu

SEQ ID NO: 3050554 - RNA, 20 nt, Human
uugaaauauaggaacuuaaa

SEQ ID NO: 3050555 - RNA, 19 nt, Human
uugaaauauugacuuuuua

SEQ ID NO: 3050556 - RNA, 21 nt, Human
uugaaauuuuuauuaaauuau

SEQ ID NO: 3050557 - RNA, 16 nt, Human
uucuuuguaaugaaaa

SEQ ID NO: 3050558 - RNA, 22 nt, Human
uucuuucuggcuaugcauuuga

SEQ ID NO: 3050559 - RNA, 12 nt, Human
uucuugcaaagu

SEQ ID NO: 3050560 - RNA, 23 nt, Human
uucuuccucccucccucuuuccc

SEQ ID NO: 3050561 - RNA, 13 nt, Human
uucuuaauucuua

SEQ ID NO: 3050562 - RNA, 18 nt, Human
uucuguucuuucuggcua

SEQ ID NO: 3050563 - RNA, 11 nt, Human
uucuguucuuu

SEQ ID NO: 3050564 - RNA, 20 nt, Human
uucuguuuuucuaggccugg

SEQ ID NO: 3050565 - RNA, 14 nt, Human
auauuuuaagacga

SEQ ID NO: 3050566 - RNA, 15 nt, Human
auauuuuacauaaau

SEQ ID NO: 3050567 - RNA, 16 nt, Human
auauuuuacauaaauu

SEQ ID NO: 3050568 - RNA, 20 nt, Human
auauuuuacauaaauuuagu

SEQ ID NO: 3050569 - RNA, 19 nt, Human
uucccuuuuuuggcugcug

SEQ ID NO: 3050570 - RNA, 20 nt, Human
uucccuuuuuuggcugcuga

SEQ ID NO: 3050571 - RNA, 18 nt, Human
uucccuuuuuuggcugcu

SEQ ID NO: 3050572 - RNA, 22 nt, Human
aucaaccccuucgcuccugugu

SEQ ID NO: 3050573 - RNA, 20 nt, Human
aucaaccccuucgcuccugu

SEQ ID NO: 3050574 - RNA, 19 nt, Human
aucaaccccuucgcuccug

SEQ ID NO: 3050575 - RNA, 14 nt, Human
aucaaguuauuuuu

SEQ ID NO: 3050576 - RNA, 20 nt, Human
aucaaauaugcaaagcacug

SEQ ID NO: 3050577 - RNA, 20 nt, Human
uucuaacaaaaaaauauauu

SEQ ID NO: 3050578 - RNA, 19 nt, Human
uucuaacaaaaaaauauau

SEQ ID NO: 3050579 - RNA, 15 nt, Human
uucuaaaguaaaaac

SEQ ID NO: 3050580 - RNA, 13 nt, Human
uucuaaaguaaaa

SEQ ID NO: 3050581 - RNA, 13 nt, Human
uucgcuccugugu

SEQ ID NO: 3050582 - RNA, 17 nt, Human
uucuaaguaaaaccaca

SEQ ID NO: 3050583 - RNA, 20 nt, Human
uucuaaguaaaaccacagca

SEQ ID NO: 3050584 - RNA, 19 nt, Human
uucuaaguaaaaccacagc

SEQ ID NO: 3050585 - RNA, 21 nt, Human
uucgcaggauucuuccucccu

SEQ ID NO: 3050586 - RNA, 19 nt, Human
aucagacuaugaaguuuuu

SEQ ID NO: 3050587 - RNA, 13 nt, Human
aucaggccaggcc

SEQ ID NO: 3050588 - RNA, 13 nt, Human
uucuauaauuuaa

SEQ ID NO: 3050589 - RNA, 14 nt, Human
uucuauaauuuaaa

SEQ ID NO: 3050590 - RNA, 21 nt, Human
uucucacugccaugccagcuu

SEQ ID NO: 3050591 - RNA, 21 nt, Human
uucuaaguaaaaccacagcag

SEQ ID NO: 3050592 - RNA, 13 nt, Human
auaaaagccuguu

SEQ ID NO: 3050593 - RNA, 18 nt, Human
auaaaagccuguuuaaga

SEQ ID NO: 3050594 - RNA, 12 nt, Human
auaaaauaauuu

SEQ ID NO: 3050595 - RNA, 20 nt, Human
uuaagaaaaaggaugcacag

SEQ ID NO: 3050596 - RNA, 19 nt, Human
uuaagaaaaaggaugcaca

SEQ ID NO: 3050597 - RNA, 21 nt, Human
uuaagaaaaaggaugcacaga

SEQ ID NO: 3050598 - RNA, 22 nt, Human
auaaaauaauuuuuauauuuga

SEQ ID NO: 3050599 - RNA, 23 nt, Human
aguuuuuauggcuuuugugcauu

SEQ ID NO: 3050600 - RNA, 23 nt, Human
aguuuucugagaaagacuauuca

SEQ ID NO: 3050601 - RNA, 18 nt, Human
aguuuucugagaaagacu

SEQ ID NO: 3050602 - RNA, 19 nt, Human
aguuuucugagaaagacua

SEQ ID NO: 3050603 - RNA, 14 nt, Human
uuaaguauguguaa

SEQ ID NO: 3050604 - RNA, 14 nt, Human
uuaagugcugcauu

SEQ ID NO: 3050605 - RNA, 16 nt, Human
uuaagugcugcauuua

SEQ ID NO: 3050606 - RNA, 15 nt, Human
uuaagugcugcauuu

SEQ ID NO: 3050607 - RNA, 19 nt, Human
uuaagugcugcauuuaaaa

SEQ ID NO: 3050608 - RNA, 9 nt, Human
uuaaggugg

SEQ ID NO: 3050609 - RNA, 22 nt, Human
uuaagaaagacuaucuaaaugu

SEQ ID NO: 3050610 - RNA, 18 nt, Human
uuaaugaaagacuguaca

SEQ ID NO: 3050611 - RNA, 22 nt, Human
uuaaucugguuuauuuuuguuc

SEQ ID NO: 3050612 - RNA, 19 nt, Human
uuaaugaaagacuguacaa

SEQ ID NO: 3050613 - RNA, 13 nt, Human
uuaaucauuaggu

SEQ ID NO: 3050614 - RNA, 23 nt, Human
uuaaucauuaggugugacugaau

SEQ ID NO: 3050615 - RNA, 22 nt, Human
uuaaucauuaggugugacugaa

SEQ ID NO: 3050616 - RNA, 14 nt, Human
aguuuaaauuguaa

SEQ ID NO: 3050617 - RNA, 11 nt, Human
aguuggucccc

SEQ ID NO: 3050618 - RNA, 13 nt, Human
aguuggucccccu

SEQ ID NO: 3050619 - RNA, 17 nt, Human
aguuggucccccuucca

SEQ ID NO: 3050620 - RNA, 13 nt, Human
uuaaaaaaaaucc

SEQ ID NO: 3050621 - RNA, 23 nt, Human
aguugccagucaccccggccacc

SEQ ID NO: 3050622 - RNA, 13 nt, Human
uguuucaaacaua

SEQ ID NO: 3050623 - RNA, 19 nt, Human
aguugggcuuccucauagu

SEQ ID NO: 3050624 - RNA, 13 nt, Human
aguugggcuuccu

SEQ ID NO: 3050625 - RNA, 16 nt, Human
uuaacagaaauguaca

SEQ ID NO: 3050626 - RNA, 19 nt, Human
uuaacagaaauguacagca

SEQ ID NO: 3050627 - RNA, 20 nt, Human
uuaacagaaauguacagcaa

SEQ ID NO: 3050628 - RNA, 18 nt, Human
uuaaauaaugugaaacug

SEQ ID NO: 3050629 - RNA, 16 nt, Human
uuaaauaaugugaaac

SEQ ID NO: 3050630 - RNA, 13 nt, Human
uuaaauaauguga

SEQ ID NO: 3050631 - RNA, 15 nt, Human
uuaaauaaugugaaa

SEQ ID NO: 3050632 - RNA, 15 nt, Human
uuaaaaaucucaaau

SEQ ID NO: 3050633 - RNA, 14 nt, Human
uuaaaaaucucaaa

SEQ ID NO: 3050634 - RNA, 16 nt, Human
uuaaaaaucucaaauu

SEQ ID NO: 3050635 - RNA, 17 nt, Human
auaaagguucaugcaaa

SEQ ID NO: 3050636 - RNA, 13 nt, Human
auaaauaaaaaua

SEQ ID NO: 3050637 - RNA, 15 nt, Human
auaaagguucaugca

SEQ ID NO: 3050638 - RNA, 18 nt, Human
auaaauauuuuugccaua

SEQ ID NO: 3050639 - RNA, 15 nt, Human
auaaauaguuuauga

SEQ ID NO: 3050640 - RNA, 13 nt, Human
auaacugugaagu

SEQ ID NO: 3050641 - RNA, 14 nt, Human
auaacguauaaaag

SEQ ID NO: 3050642 - RNA, 22 nt, Human
auaacgauaaaagacagugaaa

SEQ ID NO: 3050643 - RNA, 11 nt, Human
auaaauuauuu

SEQ ID NO: 3050644 - RNA, 20 nt, Human
auaaccaguguuguggauuu

SEQ ID NO: 3050645 - RNA, 20 nt, Human
uuaccuuugacaaagguaaa

SEQ ID NO: 3050646 - RNA, 13 nt, Human
uuaccuuugacaa

SEQ ID NO: 3050647 - RNA, 19 nt, Human
uuacccucauguucuuaau

SEQ ID NO: 3050648 - RNA, 13 nt, Human
uuagacagucccu

SEQ ID NO: 3050649 - RNA, 20 nt, Human
uuagacagagucucacuguu

SEQ ID NO: 3050650 - RNA, 13 nt, Human
uuagacagagucu

SEQ ID NO: 3050651 - RNA, 19 nt, Human
uuagaaacacaacuauauu

SEQ ID NO: 3050652 - RNA, 18 nt, Human
uuagccaagugugguaga

SEQ ID NO: 3050653 - RNA, 18 nt, Human
uuagcaaauucuguuuuu

SEQ ID NO: 3050654 - RNA, 15 nt, Human
uuaggugaggaagca

SEQ ID NO: 3050655 - RNA, 20 nt, Human
uuagggaaggauacaaaagc

SEQ ID NO: 3050656 - RNA, 16 nt, Human
uuaggugugacugaau

SEQ ID NO: 3050657 - RNA, 16 nt, Human
uuaggugaggaagcaa

SEQ ID NO: 3050658 - RNA, 18 nt, Human
uuagguuggcaaaaaggc

SEQ ID NO: 3050659 - RNA, 22 nt, Human
uuaguuugcaguuacacuaaaa

SEQ ID NO: 3050660 - RNA, 15 nt, Human
uuaguuucuccaagc

SEQ ID NO: 3050661 - RNA, 18 nt, Human
auaauccuaaacauauga

SEQ ID NO: 3050662 - RNA, 22 nt, Human
auaauugacaggauuauuggaa

SEQ ID NO: 3050663 - RNA, 15 nt, Human
auaaugaaugaaaca

SEQ ID NO: 3050664 - RNA, 15 nt, Human
auaaugcgugcauac

SEQ ID NO: 3050665 - RNA, 19 nt, Human
auaauacuugcuuuggaaa

SEQ ID NO: 3050666 - RNA, 20 nt, Human
auaauacaccacuacauucu

SEQ ID NO: 3050667 - RNA, 18 nt, Human
auaauacaccacuacauu

SEQ ID NO: 3050668 - RNA, 12 nt, Human
auaauacaccac

SEQ ID NO: 3050669 - RNA, 20 nt, Human
uguugugauguauucuagcu

SEQ ID NO: 3050670 - RNA, 14 nt, Human
uguugugauguauu

SEQ ID NO: 3050671 - RNA, 13 nt, Human
uguugugaauguu

SEQ ID NO: 3050672 - RNA, 12 nt, Human
uguugugaaugu

SEQ ID NO: 3050673 - RNA, 13 nt, Human
uguugucugcaac

SEQ ID NO: 3050674 - RNA, 16 nt, Human
uguugucugcaacucu

SEQ ID NO: 3050675 - RNA, 20 nt, Human
uguuuagauaauacaccacu

SEQ ID NO: 3050676 - RNA, 17 nt, Human
uguuuaguaaucauauu

SEQ ID NO: 3050677 - RNA, 14 nt, Human
uguuuaguaaucau

SEQ ID NO: 3050678 - RNA, 13 nt, Human
uguuuaguaauca

SEQ ID NO: 3050679 - RNA, 14 nt, Human
uguuuauugucaaa

SEQ ID NO: 3050680 - RNA, 15 nt, Human
aguucuacauaagua

SEQ ID NO: 3050681 - RNA, 19 nt, Human
aguucggugagcuacaaau

SEQ ID NO: 3050682 - RNA, 23 nt, Human
aguuccucauuagcauuuugcua

SEQ ID NO: 3050683 - RNA, 16 nt, Human
aguucaauucucauuu

SEQ ID NO: 3050684 - RNA, 18 nt, Human
uguucuagcauggcugcc

SEQ ID NO: 3050685 - RNA, 18 nt, Human
uguucuuaguuugcaguu

SEQ ID NO: 3050686 - RNA, 19 nt, Human
aguguguguuuuucauaaa

SEQ ID NO: 3050687 - RNA, 22 nt, Human
uguucuugguuuguaaauuaac

SEQ ID NO: 3050688 - RNA, 20 nt, Human
uguucuugguuuguaaauua

SEQ ID NO: 3050689 - RNA, 19 nt, Human
uguucuugguuuguaaauu

SEQ ID NO: 3050690 - RNA, 13 nt, Human
uguugcccaggcu

SEQ ID NO: 3050691 - RNA, 15 nt, Human
uguugcccaggcugg

SEQ ID NO: 3050692 - RNA, 17 nt, Human
aguguuggagaagaacu

SEQ ID NO: 3050693 - RNA, 18 nt, Human
aguguuggagaagaacug

SEQ ID NO: 3050694 - RNA, 14 nt, Human
aguguuggagaaga

SEQ ID NO: 3050695 - RNA, 16 nt, Human
aguguuggagaagaac

SEQ ID NO: 3050696 - RNA, 20 nt, Human
ugugguguuuccuggcacug

SEQ ID NO: 3050697 - RNA, 19 nt, Human
ugugucagcauagaaguaa

SEQ ID NO: 3050698 - RNA, 12 nt, Human
ugugguuucauu

SEQ ID NO: 3050699 - RNA, 16 nt, Human
agugcuuccaaggaug

SEQ ID NO: 3050700 - RNA, 16 nt, Human
uguggucccaccccac

SEQ ID NO: 3050701 - RNA, 20 nt, Human
agugcugcauuuaaaagaua

SEQ ID NO: 3050702 - RNA, 17 nt, Human
agugccuuacacaaugg

SEQ ID NO: 3050703 - RNA, 15 nt, Human
agugccuuacacaau

SEQ ID NO: 3050704 - RNA, 21 nt, Human
agugccuguaaucacagcuac

SEQ ID NO: 3050705 - RNA, 22 nt, Human
agugccucucccugcugcuccu

SEQ ID NO: 3050706 - RNA, 23 nt, Human
agugccucucccugcugcuccua

SEQ ID NO: 3050707 - RNA, 19 nt, Human
agugccucucccugcugcu

SEQ ID NO: 3050708 - RNA, 20 nt, Human
agugccucucccugcugcuc

SEQ ID NO: 3050709 - RNA, 19 nt, Human
agugcugggauuacaggug

SEQ ID NO: 3050710 - RNA, 22 nt, Human
agugcugcauuuaaaagauaca

SEQ ID NO: 3050711 - RNA, 20 nt, Human
agugcugggauuacaagcgu

SEQ ID NO: 3050712 - RNA, 13 nt, Human
uguguugugaaug

SEQ ID NO: 3050713 - RNA, 21 nt, Human
uguuaacauggacaugaucuu

SEQ ID NO: 3050714 - RNA, 18 nt, Human
aguggaaaaauagccugc

SEQ ID NO: 3050715 - RNA, 19 nt, Human
aguggaaaaauagccugcc

SEQ ID NO: 3050716 - RNA, 11 nt, Human
aguggaaaaau

SEQ ID NO: 3050717 - RNA, 19 nt, Human
uguuaaugauagcuacugu

SEQ ID NO: 3050718 - RNA, 23 nt, Human
uguguuaucacccagaagaaaau

SEQ ID NO: 3050719 - RNA, 14 nt, Human
uguguuaugaagca

SEQ ID NO: 3050720 - RNA, 19 nt, Human
ugugucagguggggcagcu

SEQ ID NO: 3050721 - RNA, 17 nt, Human
ugugucagguggggcag

SEQ ID NO: 3050722 - RNA, 13 nt, Human
ugugucucuuggu

SEQ ID NO: 3050723 - RNA, 18 nt, Human
ugugcucuggacaggcau

SEQ ID NO: 3050724 - RNA, 16 nt, Human
ugugcucuggacaggc

SEQ ID NO: 3050725 - RNA, 19 nt, Human
ugugcucuggacaggcaug

SEQ ID NO: 3050726 - RNA, 12 nt, Human
ugugcugcccug

SEQ ID NO: 3050727 - RNA, 13 nt, Human
ugugcugcccugc

SEQ ID NO: 3050728 - RNA, 14 nt, Human
ugugcugcccugcc

SEQ ID NO: 3050729 - RNA, 15 nt, Human
ugugcugcccugccc

SEQ ID NO: 3050730 - RNA, 21 nt, Human
ugugcccuaaaguguauuuuu

SEQ ID NO: 3050731 - RNA, 20 nt, Human
ugugcccuaaaguguauuuu

SEQ ID NO: 3050732 - RNA, 19 nt, Human
agucucacuguugcccagg

SEQ ID NO: 3050733 - RNA, 18 nt, Human
agucucacuguugcccag

SEQ ID NO: 3050734 - RNA, 20 nt, Human
agucucacuguugcccaggc

SEQ ID NO: 3050735 - RNA, 15 nt, Human
ugugcucuggacagg

SEQ ID NO: 3050736 - RNA, 23 nt, Human
ugugcucugaucauccacugugc

SEQ ID NO: 3050737 - RNA, 12 nt, Human
ugugcucugauc

SEQ ID NO: 3050738 - RNA, 22 nt, Human
ugugcucugaucauccacugug

SEQ ID NO: 3050739 - RNA, 14 nt, Human
agugcccacaggau

SEQ ID NO: 3050740 - RNA, 16 nt, Human
agugccaaaaacaaca

SEQ ID NO: 3050741 - RNA, 14 nt, Human
agugccaaaaacaa

SEQ ID NO: 3050742 - RNA, 21 nt, Human
agugccaaagaagcagaccau

SEQ ID NO: 3050743 - RNA, 24 nt, Human
agugauucuccugccucagccucc

SEQ ID NO: 3050744 - RNA, 22 nt, Human
agugauucuccugccucagccu

SEQ ID NO: 3050745 - RNA, 16 nt, Human
agugagucgaggacag

SEQ ID NO: 3050746 - RNA, 14 nt, Human
agugcaaauuguca

SEQ ID NO: 3050747 - RNA, 18 nt, Human
agugcaaauugucacagg

SEQ ID NO: 3050748 - RNA, 21 nt, Human
agugcaaauugucacaggaca

SEQ ID NO: 3050749 - RNA, 19 nt, Human
aguagaacagauaaucagu

SEQ ID NO: 3050750 - RNA, 13 nt, Human
aguagaacagaua

SEQ ID NO: 3050751 - RNA, 12 nt, Human
aguagagacagg

SEQ ID NO: 3050752 - RNA, 18 nt, Human
uguaggaagguuaauguu

SEQ ID NO: 3050753 - RNA, 19 nt, Human
aguagauaggccaugggca

SEQ ID NO: 3050754 - RNA, 20 nt, Human
uguaggaagguuaauguuca

SEQ ID NO: 3050755 - RNA, 15 nt, Human
aguaauccaagcaaa

SEQ ID NO: 3050756 - RNA, 21 nt, Human
aguaauccaagcaaaugugaa

SEQ ID NO: 3050757 - RNA, 19 nt, Human
aguacuuuuggcauuuuac

SEQ ID NO: 3050758 - RNA, 14 nt, Human
aguacacuguuuca

SEQ ID NO: 3050759 - RNA, 16 nt, Human
aguacacuguuucaaa

SEQ ID NO: 3050760 - RNA, 14 nt, Human
uguaauuugugaua

SEQ ID NO: 3050761 - RNA, 13 nt, Human
uguagagugggag

SEQ ID NO: 3050762 - RNA, 18 nt, Human
uguagaggagaaacugga

SEQ ID NO: 3050763 - RNA, 16 nt, Human
uguagaggagaaacug

SEQ ID NO: 3050764 - RNA, 23 nt, Human
aguaaggaauuuuauuuuuuucu

SEQ ID NO: 3050765 - RNA, 19 nt, Human
aguaauaugcacacauuuu

SEQ ID NO: 3050766 - RNA, 18 nt, Human
aguaauaugcacacauuu

SEQ ID NO: 3050767 - RNA, 20 nt, Human
aguaauaugcacacauuuuu

SEQ ID NO: 3050768 - RNA, 17 nt, Human
aguaauaugcacacauu

SEQ ID NO: 3050769 - RNA, 20 nt, Human
aguaagccgugauuuucauu

SEQ ID NO: 3050770 - RNA, 15 nt, Human
aguaaaaccacagca

SEQ ID NO: 3050771 - RNA, 11 nt, Human
agguuuuccug

SEQ ID NO: 3050772 - RNA, 23 nt, Human
uguaauuaaguacuauguaucaa

SEQ ID NO: 3050773 - RNA, 15 nt, Human
uguaaguaaacgguc

SEQ ID NO: 3050774 - RNA, 17 nt, Human
aggugguuauggagagg

SEQ ID NO: 3050775 - RNA, 14 nt, Human
agguuggugggggc

SEQ ID NO: 3050776 - RNA, 17 nt, Human
uguaacuuucugaaaua

SEQ ID NO: 3050777 - RNA, 10 nt, Human
aggucccuaa

SEQ ID NO: 3050778 - RNA, 22 nt, Human
aggucuugaacuccuggccuca

SEQ ID NO: 3050779 - RNA, 23 nt, Human
aggucuugaacuccuggccucaa

SEQ ID NO: 3050780 - RNA, 16 nt, Human
aggugcacaagcucca

SEQ ID NO: 3050781 - RNA, 17 nt, Human
aggugcacaagcuccaa

SEQ ID NO: 3050782 - RNA, 18 nt, Human
aggugcacaagcuccaag

SEQ ID NO: 3050783 - RNA, 20 nt, Human
aggugcacaagcuccaagcu

SEQ ID NO: 3050784 - RNA, 15 nt, Human
aggugcacaagcucc

SEQ ID NO: 3050785 - RNA, 21 nt, Human
aggugcacaagcuccaagcuc

SEQ ID NO: 3050786 - RNA, 18 nt, Human
aggugggauccuccaggu

SEQ ID NO: 3050787 - RNA, 20 nt, Human
aggugggauccuccaggugc

SEQ ID NO: 3050788 - RNA, 23 nt, Human
ugucauuugcuggagcucugccc

SEQ ID NO: 3050789 - RNA, 19 nt, Human
ugucagcugaaccugggua

SEQ ID NO: 3050790 - RNA, 19 nt, Human
agucacugagacagcccgg

SEQ ID NO: 3050791 - RNA, 18 nt, Human
agucacugagacagcccg

SEQ ID NO: 3050792 - RNA, 16 nt, Human
ugucagcugaaccugg

SEQ ID NO: 3050793 - RNA, 13 nt, Human
aguauuucuauga

SEQ ID NO: 3050794 - RNA, 15 nt, Human
aguauuucuaugaaa

SEQ ID NO: 3050795 - RNA, 16 nt, Human
aguauuugagaguucu

SEQ ID NO: 3050796 - RNA, 22 nt, Human
aguauuucuaugaaauauuaug

SEQ ID NO: 3050797 - RNA, 13 nt, Human
agucaccaagccc

SEQ ID NO: 3050798 - RNA, 19 nt, Human
agucacauuccugaacagg

SEQ ID NO: 3050799 - RNA, 18 nt, Human
agucacauuccugaacag

SEQ ID NO: 3050800 - RNA, 20 nt, Human
agucacauuccugaacagga

SEQ ID NO: 3050801 - RNA, 15 nt, Human
ugucaagccauaauu

SEQ ID NO: 3050802 - RNA, 19 nt, Human
ugucaagagggucugagga

SEQ ID NO: 3050803 - RNA, 21 nt, Human
ugucaauaaaauccauacauu

SEQ ID NO: 3050804 - RNA, 14 nt, Human
uguauuuuuuuacu

SEQ ID NO: 3050805 - RNA, 11 nt, Human
uguauuaugug

SEQ ID NO: 3050806 - RNA, 17 nt, Human
aguaggaagacuuugga

SEQ ID NO: 3050807 - RNA, 18 nt, Human
aguaggaagacuuuggaa

SEQ ID NO: 3050808 - RNA, 19 nt, Human
aguaggaagacuuuggaaa

SEQ ID NO: 3050809 - RNA, 22 nt, Human
aguaggaagacuuuggaaagac

SEQ ID NO: 3050810 - RNA, 16 nt, Human
aguaggaagacuuugg

SEQ ID NO: 3050811 - RNA, 20 nt, Human
ugucaaucagccuaguugau

SEQ ID NO: 3050812 - RNA, 13 nt, Human
aguagucagacug

SEQ ID NO: 3050813 - RNA, 22 nt, Human
aguccaggcuuuuuuaucaugu

SEQ ID NO: 3050814 - RNA, 12 nt, Human
agucccugccaa

SEQ ID NO: 3050815 - RNA, 23 nt, Human
aguccgaaagggacuuggaagcu

SEQ ID NO: 3050816 - RNA, 17 nt, Human
agucucacuguugccca

SEQ ID NO: 3050817 - RNA, 16 nt, Human
agucucacuguugccc

SEQ ID NO: 3050818 - RNA, 17 nt, Human
ugucccuuuuccuuuuu

SEQ ID NO: 3050819 - RNA, 13 nt, Human
uguccgagcuuug

SEQ ID NO: 3050820 - RNA, 14 nt, Human
uguccgagcuuuga

SEQ ID NO: 3050821 - RNA, 12 nt, Human
ugucgggcauga

SEQ ID NO: 3050822 - RNA, 15 nt, Human
ugucgcccagucugg

SEQ ID NO: 3050823 - RNA, 14 nt, Human
ugucgcccagucug

SEQ ID NO: 3050824 - RNA, 14 nt, Human
ugucgggcaugaca

SEQ ID NO: 3050825 - RNA, 15 nt, Human
ugucgggcaugacac

SEQ ID NO: 3050826 - RNA, 22 nt, Human
agucagaaguuucugccgcagc

SEQ ID NO: 3050827 - RNA, 23 nt, Human
agucagacuggauaguccgucuc

SEQ ID NO: 3050828 - RNA, 16 nt, Human
agucaggaaagagaac

SEQ ID NO: 3050829 - RNA, 15 nt, Human
agucaggaaagagaa

SEQ ID NO: 3050830 - RNA, 14 nt, Human
uggggaccagagcu

SEQ ID NO: 3050831 - RNA, 15 nt, Human
uggggaccagagcug

SEQ ID NO: 3050832 - RNA, 17 nt, Human
uggggaccagagcugcc

SEQ ID NO: 3050833 - RNA, 18 nt, Human
uggggaccagagcugcca

SEQ ID NO: 3050834 - RNA, 13 nt, Human
uggggaccucagg

SEQ ID NO: 3050835 - RNA, 18 nt, Human
ugggcuggguucuaccca

SEQ ID NO: 3050836 - RNA, 19 nt, Human
ugggcuggguucuacccag

SEQ ID NO: 3050837 - RNA, 14 nt, Human
uggggaaugaagau

SEQ ID NO: 3050838 - RNA, 15 nt, Human
uggggaaugaagaua

SEQ ID NO: 3050839 - RNA, 20 nt, Human
ugggcucccuucccaccucu

SEQ ID NO: 3050840 - RNA, 18 nt, Human
ugggcucccuucccaccu

SEQ ID NO: 3050841 - RNA, 19 nt, Human
ugggcucccuucccaccuc

SEQ ID NO: 3050842 - RNA, 15 nt, Human
ugggcucccuuccca

SEQ ID NO: 3050843 - RNA, 23 nt, Human
agggcuucugccauuucugagau

SEQ ID NO: 3050844 - RNA, 20 nt, Human
uggggcugcaccggcuggcc

SEQ ID NO: 3050845 - RNA, 14 nt, Human
ugggguacccacug

SEQ ID NO: 3050846 - RNA, 17 nt, Human
uggggucacucuggcag

SEQ ID NO: 3050847 - RNA, 18 nt, Human
uggggucacucuggcagc

SEQ ID NO: 3050848 - RNA, 20 nt, Human
ugggguacccacugcucugg

SEQ ID NO: 3050849 - RNA, 16 nt, Human
ugggguacccacugcu

SEQ ID NO: 3050850 - RNA, 15 nt, Human
ugggguacccacugc

SEQ ID NO: 3050851 - RNA, 14 nt, Human
uggggcccugccuc

SEQ ID NO: 3050852 - RNA, 12 nt, Human
uggggagaaagu

SEQ ID NO: 3050853 - RNA, 23 nt, Human
uggggaccucaggccugggggcu

SEQ ID NO: 3050854 - RNA, 18 nt, Human
uggggcggugagagggga

SEQ ID NO: 3050855 - RNA, 15 nt, Human
uggggcccugccucc

SEQ ID NO: 3050856 - RNA, 16 nt, Human
uggggcccugccuccu

SEQ ID NO: 3050857 - RNA, 18 nt, Human
agggcccagagagggugg

SEQ ID NO: 3050858 - RNA, 23 nt, Human
agggcccagagaggguggugacc

SEQ ID NO: 3050859 - RNA, 17 nt, Human
agggcagggacaggaua

SEQ ID NO: 3050860 - RNA, 15 nt, Human
agggagggcuucugc

SEQ ID NO: 3050861 - RNA, 19 nt, Human
agggagugacagaggcagc

SEQ ID NO: 3050862 - RNA, 18 nt, Human
agggagugacagaggcag

SEQ ID NO: 3050863 - RNA, 17 nt, Human
agggagugacagaggca

SEQ ID NO: 3050864 - RNA, 17 nt, Human
agggaggugaccccagg

SEQ ID NO: 3050865 - RNA, 16 nt, Human
ugggcaacccccagcc

SEQ ID NO: 3050866 - RNA, 18 nt, Human
ugggaggucaaggcugca

SEQ ID NO: 3050867 - RNA, 19 nt, Human
ugggaggucaaggcugcag

SEQ ID NO: 3050868 - RNA, 20 nt, Human
ugggaggucaaggcugcagu

SEQ ID NO: 3050869 - RNA, 23 nt, Human
ugggaggucaaggcugcagugag

SEQ ID NO: 3050870 - RNA, 17 nt, Human
ugggaggucaaggcugc

SEQ ID NO: 3050871 - RNA, 19 nt, Human
aggccuuccccuggcacug

SEQ ID NO: 3050872 - RNA, 17 nt, Human
aggccuuccccuggcac

SEQ ID NO: 3050873 - RNA, 13 nt, Human
ugggccaggagcc

SEQ ID NO: 3050874 - RNA, 14 nt, Human
ugggccaggagccu

SEQ ID NO: 3050875 - RNA, 16 nt, Human
ugggccaggagccucc

SEQ ID NO: 3050876 - RNA, 20 nt, Human
ugggcccaaugcacuuuguu

SEQ ID NO: 3050877 - RNA, 16 nt, Human
ugggccaccgccuugc

SEQ ID NO: 3050878 - RNA, 17 nt, Human
ugggccaccgccuugcc

SEQ ID NO: 3050879 - RNA, 23 nt, Human
ugggccaccgccuugcccagccu

SEQ ID NO: 3050880 - RNA, 20 nt, Human
ugggcaacccccagccugcu

SEQ ID NO: 3050881 - RNA, 17 nt, Human
ugggcaacccccagccu

SEQ ID NO: 3050882 - RNA, 23 nt, Human
agguauaauucacauuguauuca

SEQ ID NO: 3050883 - RNA, 17 nt, Human
agguaugcaaucaaauc

SEQ ID NO: 3050884 - RNA, 21 nt, Human
agguaugcaaucaaaucugcu

SEQ ID NO: 3050885 - RNA, 23 nt, Human
agguagaaauaucugaaaaugua

SEQ ID NO: 3050886 - RNA, 19 nt, Human
agguagaaauaucugaaaa

SEQ ID NO: 3050887 - RNA, 17 nt, Human
agguagaaauaucugaa

SEQ ID NO: 3050888 - RNA, 23 nt, Human
agguacuucaaauccuugaagau

SEQ ID NO: 3050889 - RNA, 17 nt, Human
aggguuggccccugccc

SEQ ID NO: 3050890 - RNA, 23 nt, Human
aggguuggccccugcccggcugc

SEQ ID NO: 3050891 - RNA, 18 nt, Human
aggguuggccccugcccg

SEQ ID NO: 3050892 - RNA, 18 nt, Human
aggucauauuaauauauu

SEQ ID NO: 3050893 - RNA, 19 nt, Human
aggucauauuaauauauuu

SEQ ID NO: 3050894 - RNA, 16 nt, Human
aggucauauuaauaua

SEQ ID NO: 3050895 - RNA, 12 nt, Human
aggucagagccu

SEQ ID NO: 3050896 - RNA, 17 nt, Human
aggucauuuuuuuuaag

SEQ ID NO: 3050897 - RNA, 22 nt, Human
uggucagauuugaacucuucaa

SEQ ID NO: 3050898 - RNA, 18 nt, Human
uggucaccaaaucagcug

SEQ ID NO: 3050899 - RNA, 14 nt, Human
uggucccaccccac

SEQ ID NO: 3050900 - RNA, 15 nt, Human
uggucccaccccaca

SEQ ID NO: 3050901 - RNA, 23 nt, Human
uggucucaaacucuugaccucag

SEQ ID NO: 3050902 - RNA, 17 nt, Human
uggucucaaacucuuga

SEQ ID NO: 3050903 - RNA, 16 nt, Human
uggucccaccccacac

SEQ ID NO: 3050904 - RNA, 19 nt, Human
uggucuacacugugcugag

SEQ ID NO: 3050905 - RNA, 16 nt, Human
uggucucaaacucuug

SEQ ID NO: 3050906 - RNA, 13 nt, Human
uggucccacccca

SEQ ID NO: 3050907 - RNA, 13 nt, Human
aggguuauaauaa

SEQ ID NO: 3050908 - RNA, 22 nt, Human
aggguguccggucccuguccca

SEQ ID NO: 3050909 - RNA, 21 nt, Human
aggguggugaccucugccuga

SEQ ID NO: 3050910 - RNA, 17 nt, Human
uggucugacccacugcu

SEQ ID NO: 3050911 - RNA, 16 nt, Human
uggucugacccacugc

SEQ ID NO: 3050912 - RNA, 21 nt, Human
ugggucgcccuggacugugug

SEQ ID NO: 3050913 - RNA, 15 nt, Human
ugggugcuuggagga

SEQ ID NO: 3050914 - RNA, 19 nt, Human
ugggugcuuggaggaagga

SEQ ID NO: 3050915 - RNA, 22 nt, Human
ugggugcuuggaggaaggaaac

SEQ ID NO: 3050916 - RNA, 22 nt, Human
uggguggcaccagcagccugga

SEQ ID NO: 3050917 - RNA, 21 nt, Human
agggucucacucugucgccca

SEQ ID NO: 3050918 - RNA, 22 nt, Human
agggucucacucugucgcccag

SEQ ID NO: 3050919 - RNA, 22 nt, Human
aggguggccacaccucuauccc

SEQ ID NO: 3050920 - RNA, 20 nt, Human
ugguaaggggaauugaggac

SEQ ID NO: 3050921 - RNA, 16 nt, Human
ugguacuaacuuuccu

SEQ ID NO: 3050922 - RNA, 23 nt, Human
aggggagcaaaaucgaugcagug

SEQ ID NO: 3050923 - RNA, 19 nt, Human
uggggucacucuggcagcu

SEQ ID NO: 3050924 - RNA, 18 nt, Human
aggggugggacacccugu

SEQ ID NO: 3050925 - RNA, 20 nt, Human
aggggugggacacccuguga

SEQ ID NO: 3050926 - RNA, 22 nt, Human
aggggugggacacccugugaug

SEQ ID NO: 3050927 - RNA, 17 nt, Human
aggggguggccucccaa

SEQ ID NO: 3050928 - RNA, 18 nt, Human
aggggguggccucccaac

SEQ ID NO: 3050929 - RNA, 15 nt, Human
aggggguggccuccc

SEQ ID NO: 3050930 - RNA, 23 nt, Human
agggucucacuauguugcccagg

SEQ ID NO: 3050931 - RNA, 22 nt, Human
agggucucacuauguugcccag

SEQ ID NO: 3050932 - RNA, 21 nt, Human
agggucucacuauguugccca

SEQ ID NO: 3050933 - RNA, 20 nt, Human
agggucucacuauguugccc

SEQ ID NO: 3050934 - RNA, 24 nt, Human
agggguucccuuuuuuggcugcug

SEQ ID NO: 3050935 - RNA, 13 nt, Human
ugcuguauuuuaa

SEQ ID NO: 3050936 - RNA, 21 nt, Human
ugcuguauuuuaaaagaauga

SEQ ID NO: 3050937 - RNA, 22 nt, Human
ugcuguauuuuaaaagaaugau

SEQ ID NO: 3050938 - RNA, 17 nt, Human
ugcugggauuacaggug

SEQ ID NO: 3050939 - RNA, 21 nt, Human
ugcugggauuacaagcgugag

SEQ ID NO: 3050940 - RNA, 21 nt, Human
ugcuggcuguuggcugggggc

SEQ ID NO: 3050941 - RNA, 19 nt, Human
ugcuggcuguuggcugggg

SEQ ID NO: 3050942 - RNA, 19 nt, Human
ugcugggauuacaagcgug

SEQ ID NO: 3050943 - RNA, 18 nt, Human
ugcuggcuguuggcuggg

SEQ ID NO: 3050944 - RNA, 11 nt, Human
ugcugcccugu

SEQ ID NO: 3050945 - RNA, 12 nt, Human
ugcugcccugcc

SEQ ID NO: 3050946 - RNA, 19 nt, Human
ugcugcccugcccaccugg

SEQ ID NO: 3050947 - RNA, 21 nt, Human
ugcugcccugcccaccuggcc

SEQ ID NO: 3050948 - RNA, 13 nt, Human
ugcugcccugccc

SEQ ID NO: 3050949 - RNA, 16 nt, Human
ugcugcccugcccacc

SEQ ID NO: 3050950 - RNA, 17 nt, Human
ugcugcccugcccaccu

SEQ ID NO: 3050951 - RNA, 18 nt, Human
ugcugcccugcccaccug

SEQ ID NO: 3050952 - RNA, 14 nt, Human
ugcuucaucccuuu

SEQ ID NO: 3050953 - RNA, 20 nt, Human
ugcuucaaggauccugagcc

SEQ ID NO: 3050954 - RNA, 21 nt, Human
ugcuucaaggauccugagcca

SEQ ID NO: 3050955 - RNA, 23 nt, Human
ugcuucaaggauccugagccaga

SEQ ID NO: 3050956 - RNA, 16 nt, Human
ugcuuccagugaggcu

SEQ ID NO: 3050957 - RNA, 18 nt, Human
aggacacuaaccacgcug

SEQ ID NO: 3050958 - RNA, 17 nt, Human
aggacacugauaugggu

SEQ ID NO: 3050959 - RNA, 17 nt, Human
ugcugucccuuuuccuu

SEQ ID NO: 3050960 - RNA, 19 nt, Human
ugcugucccuuacgugagu

SEQ ID NO: 3050961 - RNA, 15 nt, Human
ugcugucccuuuucc

SEQ ID NO: 3050962 - RNA, 17 nt, Human
ugcugucccuuacguga

SEQ ID NO: 3050963 - RNA, 23 nt, Human
agcuuuaucaaagggugaaaauu

SEQ ID NO: 3050964 - RNA, 19 nt, Human
ugcuaucucccccagcccc

SEQ ID NO: 3050965 - RNA, 20 nt, Human
ugcuaucucccccagcccca

SEQ ID NO: 3050966 - RNA, 18 nt, Human
ugcuaucucccccagccc

SEQ ID NO: 3050967 - RNA, 11 nt, Human
ugcucauggaa

SEQ ID NO: 3050968 - RNA, 16 nt, Human
ugcucuggacaggcau

SEQ ID NO: 3050969 - RNA, 15 nt, Human
ugcucuggacaggca

SEQ ID NO: 3050970 - RNA, 14 nt, Human
ugcucuggacaggc

SEQ ID NO: 3050971 - RNA, 22 nt, Human
ugcuccuaggacccgucuccag

SEQ ID NO: 3050972 - RNA, 14 nt, Human
ugcucauggaauug

SEQ ID NO: 3050973 - RNA, 15 nt, Human
aggaaaucaccgaaa

SEQ ID NO: 3050974 - RNA, 19 nt, Human
aggaaaucaccgaaaacgu

SEQ ID NO: 3050975 - RNA, 23 nt, Human
aggaaaucaaauaugcaaagcac

SEQ ID NO: 3050976 - RNA, 16 nt, Human
aggaagcacaugccuc

SEQ ID NO: 3050977 - RNA, 17 nt, Human
aggaagcacaugccucu

SEQ ID NO: 3050978 - RNA, 11 nt, Human
aggaagcacau

SEQ ID NO: 3050979 - RNA, 15 nt, Human
aggaaaggcuccagg

SEQ ID NO: 3050980 - RNA, 12 nt, Human
aggaaauauuua

SEQ ID NO: 3050981 - RNA, 13 nt, Human
aggaaaggcucca

SEQ ID NO: 3050982 - RNA, 14 nt, Human
aggaaaggcuccag

SEQ ID NO: 3050983 - RNA, 20 nt, Human
aggaaggaaacccagcucug

SEQ ID NO: 3050984 - RNA, 22 nt, Human
aggaaggaaacccagcucuggu

SEQ ID NO: 3050985 - RNA, 23 nt, Human
aggaaggaaacccagcucugguc

SEQ ID NO: 3050986 - RNA, 18 nt, Human
aggaagccagcaggcucu

SEQ ID NO: 3050987 - RNA, 18 nt, Human
aggaagccgcuggggcca

SEQ ID NO: 3050988 - RNA, 19 nt, Human
aggaagccgcuggggccag

SEQ ID NO: 3050989 - RNA, 20 nt, Human
aggaagccgcuggggccagu

SEQ ID NO: 3050990 - RNA, 22 nt, Human
aggaagccagcaggcucucagg

SEQ ID NO: 3050991 - RNA, 23 nt, Human
aggaagccagcaggcucucaggc

SEQ ID NO: 3050992 - RNA, 21 nt, Human
aggaagccagcaggcucucag

SEQ ID NO: 3050993 - RNA, 14 nt, Human
agcuugaggguugg

SEQ ID NO: 3050994 - RNA, 18 nt, Human
agcuugaggguugggcug

SEQ ID NO: 3050995 - RNA, 17 nt, Human
agcuugaaacugagaug

SEQ ID NO: 3050996 - RNA, 14 nt, Human
agcuguucagcugg

SEQ ID NO: 3050997 - RNA, 20 nt, Human
ugcuacaaaaacacagcaag

SEQ ID NO: 3050998 - RNA, 15 nt, Human
ugcuacaaaaacaca

SEQ ID NO: 3050999 - RNA, 19 nt, Human
ugcuacaaaaacacagcaa

SEQ ID NO: 3051000 - RNA, 18 nt, Human
ugcuacaaaaacacagca

SEQ ID NO: 3051001 - RNA, 17 nt, Human
ugcuacaaaaacacagc

SEQ ID NO: 3051002 - RNA, 16 nt, Human
ugcuacaaaaacacag

SEQ ID NO: 3051003 - RNA, 20 nt, Human
ugcgggcuuccuccuggugu

SEQ ID NO: 3051004 - RNA, 17 nt, Human
ugcggccuuuggcuuca

SEQ ID NO: 3051005 - RNA, 19 nt, Human
ugcggccuuuggcuucacg

SEQ ID NO: 3051006 - RNA, 17 nt, Human
ugcgguccacccaggag

SEQ ID NO: 3051007 - RNA, 17 nt, Human
ugcggugcuaucucccc

SEQ ID NO: 3051008 - RNA, 18 nt, Human
ugcgguccacccaggagc

SEQ ID NO: 3051009 - RNA, 22 nt, Human
ugcggacagccacggccaggcc

SEQ ID NO: 3051010 - RNA, 21 nt, Human
ugcggacagccacggccaggc

SEQ ID NO: 3051011 - RNA, 23 nt, Human
ugcggacagccacggccaggcca

SEQ ID NO: 3051012 - RNA, 13 nt, Human
ugcggagcacacu

SEQ ID NO: 3051013 - RNA, 15 nt, Human
ugcggagcacacugg

SEQ ID NO: 3051014 - RNA, 15 nt, Human
ugccugcccuauucu

SEQ ID NO: 3051015 - RNA, 16 nt, Human
ugccugcccaggcccc

SEQ ID NO: 3051016 - RNA, 24 nt, Human
ugccugcccaggccccugccaccc

SEQ ID NO: 3051017 - RNA, 12 nt, Human
ugccucugccuc

SEQ ID NO: 3051018 - RNA, 15 nt, Human
ugccugcccaggccc

SEQ ID NO: 3051019 - RNA, 14 nt, Human
ugccugcccaggcc

SEQ ID NO: 3051020 - RNA, 15 nt, Human
ugccucugccucuga

SEQ ID NO: 3051021 - RNA, 13 nt, Human
ugccugcccaggc

SEQ ID NO: 3051022 - RNA, 14 nt, Human
ugccucugccucug

SEQ ID NO: 3051023 - RNA, 13 nt, Human
ugccucugccucu

SEQ ID NO: 3051024 - RNA, 14 nt, Human
ugcccaggcagguc

SEQ ID NO: 3051025 - RNA, 13 nt, Human
ugcccaggcaggu

SEQ ID NO: 3051026 - RNA, 12 nt, Human
ugcccaggcagg

SEQ ID NO: 3051027 - RNA, 20 nt, Human
agcugccuguucagcuccag

SEQ ID NO: 3051028 - RNA, 14 nt, Human
ugccuggauggggc

SEQ ID NO: 3051029 - RNA, 15 nt, Human
ugccuggauggggcu

SEQ ID NO: 3051030 - RNA, 20 nt, Human
agcugcuugggcuucauccu

SEQ ID NO: 3051031 - RNA, 21 nt, Human
agcugccuguucagcuccagc

SEQ ID NO: 3051032 - RNA, 21 nt, Human
agcugcuugggcuucauccuc

SEQ ID NO: 3051033 - RNA, 19 nt, Human
agcugccuguucagcucca

SEQ ID NO: 3051034 - RNA, 21 nt, Human
agcugcuuuugucuaugggac

SEQ ID NO: 3051035 - RNA, 19 nt, Human
agcuguucacagccagacu

SEQ ID NO: 3051036 - RNA, 16 nt, Human
agcuguucacagccag

SEQ ID NO: 3051037 - RNA, 20 nt, Human
ugccuguucagcuccagcuc

SEQ ID NO: 3051038 - RNA, 18 nt, Human
ugccuguucagcuccagc

SEQ ID NO: 3051039 - RNA, 13 nt, Human
agcuguucagcug

SEQ ID NO: 3051040 - RNA, 17 nt, Human
ugccuguucagcuccag

SEQ ID NO: 3051041 - RNA, 15 nt, Human
ugccuuauggaacac

SEQ ID NO: 3051042 - RNA, 16 nt, Human
ugccuuauggaacacu

SEQ ID NO: 3051043 - RNA, 20 nt, Human
ugccuguugggccaggagcc

SEQ ID NO: 3051044 - RNA, 19 nt, Human
ugccuguugggccaggagc

SEQ ID NO: 3051045 - RNA, 21 nt, Human
ugccuguucagcuccagcuca

SEQ ID NO: 3051046 - RNA, 16 nt, Human
agcuguguggcagucu

SEQ ID NO: 3051047 - RNA, 14 nt, Human
agcuguguggcagu

SEQ ID NO: 3051048 - RNA, 21 nt, Human
agcugugcucuggacaggcau

SEQ ID NO: 3051049 - RNA, 20 nt, Human
agcugugcucuggacaggca

SEQ ID NO: 3051050 - RNA, 19 nt, Human
agcugugcucuggacaggc

SEQ ID NO: 3051051 - RNA, 15 nt, Human
uggacugugugcuca

SEQ ID NO: 3051052 - RNA, 17 nt, Human
uggacuuugcacacuuu

SEQ ID NO: 3051053 - RNA, 13 nt, Human
uggagaagaacug

SEQ ID NO: 3051054 - RNA, 13 nt, Human
uggagaagcggcu

SEQ ID NO: 3051055 - RNA, 22 nt, Human
uggagaagcggcuggcagccca

SEQ ID NO: 3051056 - RNA, 13 nt, Human
aggcaaucauggu

SEQ ID NO: 3051057 - RNA, 22 nt, Human
aggcacccaccaucaugucugg

SEQ ID NO: 3051058 - RNA, 21 nt, Human
aggcacccaccaucaugucug

SEQ ID NO: 3051059 - RNA, 20 nt, Human
aggcacccaccaucaugucu

SEQ ID NO: 3051060 - RNA, 14 nt, Human
aggcaaugcuggcu

SEQ ID NO: 3051061 - RNA, 15 nt, Human
aggcacccaccauca

SEQ ID NO: 3051062 - RNA, 17 nt, Human
aggaucucuugagccug

SEQ ID NO: 3051063 - RNA, 18 nt, Human
aggaucucuugagccugg

SEQ ID NO: 3051064 - RNA, 19 nt, Human
aggaucucuugagccuggg

SEQ ID NO: 3051065 - RNA, 12 nt, Human
aggaucucuuga

SEQ ID NO: 3051066 - RNA, 14 nt, Human
uggacacagcucuu

SEQ ID NO: 3051067 - RNA, 13 nt, Human
uggacacagcucu

SEQ ID NO: 3051068 - RNA, 22 nt, Human
uggacacagcucuucuccaggc

SEQ ID NO: 3051069 - RNA, 21 nt, Human
uggacacagcucuucuccagg

SEQ ID NO: 3051070 - RNA, 20 nt, Human
uggaccuugaacuggguacu

SEQ ID NO: 3051071 - RNA, 15 nt, Human
uggacccugaggccc

SEQ ID NO: 3051072 - RNA, 23 nt, Human
uggacccuguggaugauaaaaca

SEQ ID NO: 3051073 - RNA, 21 nt, Human
uggacccugaggcccagaggg

SEQ ID NO: 3051074 - RNA, 19 nt, Human
uggacccugaggcccagag

SEQ ID NO: 3051075 - RNA, 20 nt, Human
uggacccugaggcccagagg

SEQ ID NO: 3051076 - RNA, 16 nt, Human
uggacccugaggccca

SEQ ID NO: 3051077 - RNA, 18 nt, Human
uggacccugaggcccaga

SEQ ID NO: 3051078 - RNA, 23 nt, Human
uggacacagcucuucuccaggcu

SEQ ID NO: 3051079 - RNA, 21 nt, Human
ugcuugaggcaacucaucuua

SEQ ID NO: 3051080 - RNA, 13 nt, Human
ugcuuguacauaa

SEQ ID NO: 3051081 - RNA, 12 nt, Human
ugcuuguacaua

SEQ ID NO: 3051082 - RNA, 15 nt, Human
ugcuuggaggaagga

SEQ ID NO: 3051083 - RNA, 16 nt, Human
ugcuuggaggaaggaa

SEQ ID NO: 3051084 - RNA, 14 nt, Human
ugcuuggaggaagg

SEQ ID NO: 3051085 - RNA, 17 nt, Human
ugcuuuuggucugugug

SEQ ID NO: 3051086 - RNA, 14 nt, Human
ugcuuuuggucugu

SEQ ID NO: 3051087 - RNA, 13 nt, Human
uggaaaggcagcu

SEQ ID NO: 3051088 - RNA, 16 nt, Human
ugcuuugugauuuuug

SEQ ID NO: 3051089 - RNA, 14 nt, Human
ugcuuugugauuuu

SEQ ID NO: 3051090 - RNA, 12 nt, Human
ugcuuugugauu

SEQ ID NO: 3051091 - RNA, 16 nt, Human
ugcuuguacauaaugc

SEQ ID NO: 3051092 - RNA, 14 nt, Human
ugcuuguacauaau

SEQ ID NO: 3051093 - RNA, 22 nt, Human
ugcuuguacauaaugcgugcau

SEQ ID NO: 3051094 - RNA, 13 nt, Human
uggaagguauuua

SEQ ID NO: 3051095 - RNA, 17 nt, Human
uggaagguauuuaauag

SEQ ID NO: 3051096 - RNA, 17 nt, Human
uggaaaugggcagagca

SEQ ID NO: 3051097 - RNA, 13 nt, Human
aggauccugagcc

SEQ ID NO: 3051098 - RNA, 14 nt, Human
aggauccugagcca

SEQ ID NO: 3051099 - RNA, 17 nt, Human
uggauuauauuaugaag

SEQ ID NO: 3051100 - RNA, 13 nt, Human
uggauuguccccg

SEQ ID NO: 3051101 - RNA, 14 nt, Human
uggaguauauguca

SEQ ID NO: 3051102 - RNA, 16 nt, Human
aggccaaaggaagcac

SEQ ID NO: 3051103 - RNA, 18 nt, Human
aggccaaaggaagcacau

SEQ ID NO: 3051104 - RNA, 19 nt, Human
aggccaaaggaagcacaug

SEQ ID NO: 3051105 - RNA, 15 nt, Human
aggccaaaggaagca

SEQ ID NO: 3051106 - RNA, 17 nt, Human
aggcagccccauucugc

SEQ ID NO: 3051107 - RNA, 16 nt, Human
aggcagccccauucug

SEQ ID NO: 3051108 - RNA, 18 nt, Human
aggcagccaggccacaag

SEQ ID NO: 3051109 - RNA, 16 nt, Human
aggccaaggugggagg

SEQ ID NO: 3051110 - RNA, 13 nt, Human
uggcagccuuggc

SEQ ID NO: 3051111 - RNA, 19 nt, Human
uggcacaguuuucugagaa

SEQ ID NO: 3051112 - RNA, 18 nt, Human
uggcacaguuuucugaga

SEQ ID NO: 3051113 - RNA, 17 nt, Human
aggccacaagacccuug

SEQ ID NO: 3051114 - RNA, 18 nt, Human
aggccacaagacccuugu

SEQ ID NO: 3051115 - RNA, 19 nt, Human
aggccacaagacccuugug

SEQ ID NO: 3051116 - RNA, 14 nt, Human
aggccagagggagu

SEQ ID NO: 3051117 - RNA, 16 nt, Human
aggccacaagacccuu

SEQ ID NO: 3051118 - RNA, 19 nt, Human
uggcagcucaccucucccu

SEQ ID NO: 3051119 - RNA, 15 nt, Human
uggcagcucaccucu

SEQ ID NO: 3051120 - RNA, 17 nt, Human
uggcagccuuggcaaac

SEQ ID NO: 3051121 - RNA, 20 nt, Human
aggccagagggagugacaga

SEQ ID NO: 3051122 - RNA, 21 nt, Human
aggcccagagggccugcaagg

SEQ ID NO: 3051123 - RNA, 16 nt, Human
aggccccgcccaggcu

SEQ ID NO: 3051124 - RNA, 16 nt, Human
uggcauauuuuucaca

SEQ ID NO: 3051125 - RNA, 17 nt, Human
uggcauauuuuucacau

SEQ ID NO: 3051126 - RNA, 17 nt, Human
aggccccgcccaggcuu

SEQ ID NO: 3051127 - RNA, 23 nt, Human
uggccagugugacaaggauugcu

SEQ ID NO: 3051128 - RNA, 23 nt, Human
uggccaaagccaaagcuaggccu

SEQ ID NO: 3051129 - RNA, 21 nt, Human
uggccaaagccaaagcuaggc

SEQ ID NO: 3051130 - RNA, 18 nt, Human
uggccuggccccucaggg

SEQ ID NO: 3051131 - RNA, 21 nt, Human
uggccuggccccucagggucc

SEQ ID NO: 3051132 - RNA, 12 nt, Human
uggccuggcccc

SEQ ID NO: 3051133 - RNA, 12 nt, Human
aggccuggggac

SEQ ID NO: 3051134 - RNA, 18 nt, Human
aggccugggggcugggca

SEQ ID NO: 3051135 - RNA, 20 nt, Human
aggccugggggcugggcaga

SEQ ID NO: 3051136 - RNA, 13 nt, Human
uggccucuucaga

SEQ ID NO: 3051137 - RNA, 23 nt, Human
uggccgggcgcgguggcucacgc

SEQ ID NO: 3051138 - RNA, 13 nt, Human
agccuguuuaaga

SEQ ID NO: 3051139 - RNA, 22 nt, Human
agccuuagaagucacacaguau

SEQ ID NO: 3051140 - RNA, 21 nt, Human
agccugugccucugggacugg

SEQ ID NO: 3051141 - RNA, 19 nt, Human
agccugugccucugggacu

SEQ ID NO: 3051142 - RNA, 22 nt, Human
agccugggugacagagcaagug

SEQ ID NO: 3051143 - RNA, 19 nt, Human
agccugcuccagcuguuca

SEQ ID NO: 3051144 - RNA, 22 nt, Human
agccugcuccagcuguucagcu

SEQ ID NO: 3051145 - RNA, 12 nt, Human
ugcauaccacuu

SEQ ID NO: 3051146 - RNA, 14 nt, Human
agccugcuccagcu

SEQ ID NO: 3051147 - RNA, 15 nt, Human
agccugcuccagcug

SEQ ID NO: 3051148 - RNA, 16 nt, Human
agccugcuccagcugu

SEQ ID NO: 3051149 - RNA, 17 nt, Human
agccugcuccagcuguu

SEQ ID NO: 3051150 - RNA, 11 nt, Human
agccuuccagg

SEQ ID NO: 3051151 - RNA, 14 nt, Human
agccuuccaggggu

SEQ ID NO: 3051152 - RNA, 16 nt, Human
agccuuccaggggugg

SEQ ID NO: 3051153 - RNA, 17 nt, Human
agccuuccagggguggg

SEQ ID NO: 3051154 - RNA, 20 nt, Human
agccuuggggcugaugcagu

SEQ ID NO: 3051155 - RNA, 16 nt, Human
agcggagaaaggaagg

SEQ ID NO: 3051156 - RNA, 20 nt, Human
agcggagaaaggaagggcug

SEQ ID NO: 3051157 - RNA, 18 nt, Human
agcggagacggaguccca

SEQ ID NO: 3051158 - RNA, 20 nt, Human
ugcauuaucuagauacugua

SEQ ID NO: 3051159 - RNA, 22 nt, Human
ugcauuaucuagauacuguauc

SEQ ID NO: 3051160 - RNA, 21 nt, Human
ugcauuaucuagauacuguau

SEQ ID NO: 3051161 - RNA, 18 nt, Human
ugcauuaucuagauacug

SEQ ID NO: 3051162 - RNA, 18 nt, Human
ugccaaugggagcucaug

SEQ ID NO: 3051163 - RNA, 15 nt, Human
agcgugcauaaguua

SEQ ID NO: 3051164 - RNA, 22 nt, Human
agcgugagccacugcaccgggc

SEQ ID NO: 3051165 - RNA, 19 nt, Human
agcgugagccacugcaccg

SEQ ID NO: 3051166 - RNA, 18 nt, Human
agcuagacgagcaggcuu

SEQ ID NO: 3051167 - RNA, 13 nt, Human
agcuagaauuuga

SEQ ID NO: 3051168 - RNA, 16 nt, Human
agcuagaauuugauau

SEQ ID NO: 3051169 - RNA, 17 nt, Human
agcuacuugggaggcug

SEQ ID NO: 3051170 - RNA, 18 nt, Human
agcuacuugggaggcuga

SEQ ID NO: 3051171 - RNA, 18 nt, Human
agcuaggaauuguguuua

SEQ ID NO: 3051172 - RNA, 12 nt, Human
agcuaggccugg

SEQ ID NO: 3051173 - RNA, 15 nt, Human
agcuaggccuggcca

SEQ ID NO: 3051174 - RNA, 14 nt, Human
agcuaggccuggcc

SEQ ID NO: 3051175 - RNA, 17 nt, Human
agcucaggugucccugc

SEQ ID NO: 3051176 - RNA, 18 nt, Human
agcucaggugucccugca

SEQ ID NO: 3051177 - RNA, 21 nt, Human
agcucaggugucccugcacuu

SEQ ID NO: 3051178 - RNA, 20 nt, Human
agcucaggugucccugcacu

SEQ ID NO: 3051179 - RNA, 22 nt, Human
agcucaggugucccugcacuug

SEQ ID NO: 3051180 - RNA, 21 nt, Human
ugcccagccccuucugaccca

SEQ ID NO: 3051181 - RNA, 20 nt, Human
ugcccagccccuucugaccc

SEQ ID NO: 3051182 - RNA, 21 nt, Human
ugcccagccuggaugccaucc

SEQ ID NO: 3051183 - RNA, 18 nt, Human
ugcccagccuggaugcca

SEQ ID NO: 3051184 - RNA, 20 nt, Human
ugcccagccuggaugccauc

SEQ ID NO: 3051185 - RNA, 14 nt, Human
ugcccagccuggau

SEQ ID NO: 3051186 - RNA, 16 nt, Human
ugcccagccuggaugc

SEQ ID NO: 3051187 - RNA, 17 nt, Human
ugcccagccuggaugcc

SEQ ID NO: 3051188 - RNA, 16 nt, Human
ugcccacaggaucagu

SEQ ID NO: 3051189 - RNA, 19 nt, Human
ugcccacaggaucagucug

SEQ ID NO: 3051190 - RNA, 20 nt, Human
ugcccacaggaucagucuga

SEQ ID NO: 3051191 - RNA, 21 nt, Human
agcucauucuccuuguguuac

SEQ ID NO: 3051192 - RNA, 20 nt, Human
agcucauucuccuuguguua

SEQ ID NO: 3051193 - RNA, 20 nt, Human
ugauucuccugccucagccu

SEQ ID NO: 3051194 - RNA, 13 nt, Human
ugauucuccugcc

SEQ ID NO: 3051195 - RNA, 15 nt, Human
ugauucuccugccuc

SEQ ID NO: 3051196 - RNA, 19 nt, Human
ugauucuccugccucagcc

SEQ ID NO: 3051197 - RNA, 21 nt, Human
agccccaaaacucuccucugc

SEQ ID NO: 3051198 - RNA, 22 nt, Human
agccccaaaacucuccucugcu

SEQ ID NO: 3051199 - RNA, 20 nt, Human
agccccaaaacucuccucug

SEQ ID NO: 3051200 - RNA, 18 nt, Human
agcccauggcacucuaug

SEQ ID NO: 3051201 - RNA, 19 nt, Human
agccccuggaugcagccuc

SEQ ID NO: 3051202 - RNA, 17 nt, Human
agccccuggaugcagcc

SEQ ID NO: 3051203 - RNA, 18 nt, Human
agccccuggaugcagccu

SEQ ID NO: 3051204 - RNA, 18 nt, Human
agccccgugggguuccuc

SEQ ID NO: 3051205 - RNA, 23 nt, Human
agccccauucugccugcccaggc

SEQ ID NO: 3051206 - RNA, 16 nt, Human
agccccgaggccuucu

SEQ ID NO: 3051207 - RNA, 22 nt, Human
agccccgaggccuucucugaag

SEQ ID NO: 3051208 - RNA, 17 nt, Human
agccccgaggccuucuc

SEQ ID NO: 3051209 - RNA, 21 nt, Human
agcccugguggcagugggagc

SEQ ID NO: 3051210 - RNA, 20 nt, Human
agccccuucugacccaugcu

SEQ ID NO: 3051211 - RNA, 24 nt, Human
agccccuucugacccaugcugccc

SEQ ID NO: 3051212 - RNA, 18 nt, Human
ugcacaagcugcacccuc

SEQ ID NO: 3051213 - RNA, 21 nt, Human
ugcacaagcugcacccucagg

SEQ ID NO: 3051214 - RNA, 22 nt, Human
ugcacacaccagagcccaccuu

SEQ ID NO: 3051215 - RNA, 14 nt, Human
ugcacaagcugcac

SEQ ID NO: 3051216 - RNA, 15 nt, Human
ugcacaagcugcacc

SEQ ID NO: 3051217 - RNA, 23 nt, Human
agcccugguggcagugggagcug

SEQ ID NO: 3051218 - RNA, 22 nt, Human
agcccugguggcagugggagcu

SEQ ID NO: 3051219 - RNA, 15 nt, Human
ugcacgugugugcac

SEQ ID NO: 3051220 - RNA, 14 nt, Human
ugcacgugugugca

SEQ ID NO: 3051221 - RNA, 16 nt, Human
ugcacccucaggcagg

SEQ ID NO: 3051222 - RNA, 17 nt, Human
ugcacccucaggcaggu

SEQ ID NO: 3051223 - RNA, 20 nt, Human
ugcacacauuuuuuaaaugc

SEQ ID NO: 3051224 - RNA, 10 nt, Human
ugcacacauu

SEQ ID NO: 3051225 - RNA, 16 nt, Human
ugcaggucccuaauaa

SEQ ID NO: 3051226 - RNA, 15 nt, Human
ugcaggucccuaaua

SEQ ID NO: 3051227 - RNA, 14 nt, Human
ugcaggucccuaau

SEQ ID NO: 3051228 - RNA, 12 nt, Human
ugcaggucccua

SEQ ID NO: 3051229 - RNA, 23 nt, Human
ugcauaacguauaaaagccuguu

SEQ ID NO: 3051230 - RNA, 22 nt, Human
ugcauaacguauaaaagccugu

SEQ ID NO: 3051231 - RNA, 17 nt, Human
ugcauaaguuaacuucc

SEQ ID NO: 3051232 - RNA, 14 nt, Human
ugcauaaguuaacu

SEQ ID NO: 3051233 - RNA, 11 nt, Human
ugcaggucccu

SEQ ID NO: 3051234 - RNA, 16 nt, Human
ugcagccucacagucc

SEQ ID NO: 3051235 - RNA, 13 nt, Human
ugcagccucacag

SEQ ID NO: 3051236 - RNA, 15 nt, Human
ugcagccucacaguc

SEQ ID NO: 3051237 - RNA, 22 nt, Human
agccugaaagaggaaugaagua

SEQ ID NO: 3051238 - RNA, 23 nt, Human
ugcagccucaaccuccugggcua

SEQ ID NO: 3051239 - RNA, 23 nt, Human
agcccuucuaccuuccugcaaca

SEQ ID NO: 3051240 - RNA, 23 nt, Human
ugcacuauagccuaggugacaga

SEQ ID NO: 3051241 - RNA, 22 nt, Human
ugcacuauagccuaggugacag

SEQ ID NO: 3051242 - RNA, 23 nt, Human
agccucagcauccuggcacccgg

SEQ ID NO: 3051243 - RNA, 22 nt, Human
agccucagcauccuggcacccg

SEQ ID NO: 3051244 - RNA, 15 nt, Human
agccucauguccacu

SEQ ID NO: 3051245 - RNA, 16 nt, Human
agccucccaaagugcu

SEQ ID NO: 3051246 - RNA, 20 nt, Human
agccucauguccacugguuc

SEQ ID NO: 3051247 - RNA, 16 nt, Human
agccucagcauccugg

SEQ ID NO: 3051248 - RNA, 21 nt, Human
agccucagcauccuggcaccc

SEQ ID NO: 3051249 - RNA, 20 nt, Human
agccucagcauccuggcacc

SEQ ID NO: 3051250 - RNA, 19 nt, Human
agccucagcauccuggcac

SEQ ID NO: 3051251 - RNA, 17 nt, Human
agccucagcauccuggc

SEQ ID NO: 3051252 - RNA, 15 nt, Human
agccacggccaggcc

SEQ ID NO: 3051253 - RNA, 17 nt, Human
ugaugaagaaguugaua

SEQ ID NO: 3051254 - RNA, 14 nt, Human
agccacauuccuga

SEQ ID NO: 3051255 - RNA, 18 nt, Human
agccacauuccugaugcu

SEQ ID NO: 3051256 - RNA, 20 nt, Human
agccaccaacauacucccau

SEQ ID NO: 3051257 - RNA, 23 nt, Human
agccaccaacauacucccaucug

SEQ ID NO: 3051258 - RNA, 19 nt, Human
agccaccaacauacuccca

SEQ ID NO: 3051259 - RNA, 14 nt, Human
agccacggccaggc

SEQ ID NO: 3051260 - RNA, 15 nt, Human
ugauuaauuaaaaca

SEQ ID NO: 3051261 - RNA, 12 nt, Human
ugauuaaaccaa

SEQ ID NO: 3051262 - RNA, 14 nt, Human
ugauuaccagggac

SEQ ID NO: 3051263 - RNA, 22 nt, Human
agccacugcaccgggccacaga

SEQ ID NO: 3051264 - RNA, 21 nt, Human
agccacugcaccgggccacag

SEQ ID NO: 3051265 - RNA, 13 nt, Human
agccacugcaccg

SEQ ID NO: 3051266 - RNA, 20 nt, Human
agccacugcaccgggccaca

SEQ ID NO: 3051267 - RNA, 14 nt, Human
ugaugauccuaggc

SEQ ID NO: 3051268 - RNA, 20 nt, Human
ugaugauccuaggcauuugc

SEQ ID NO: 3051269 - RNA, 14 nt, Human
ugaugaucuuuaaa

SEQ ID NO: 3051270 - RNA, 17 nt, Human
ugauggugcaaugaccu

SEQ ID NO: 3051271 - RNA, 23 nt, Human
ugauggugcaaugaccuuucaau

SEQ ID NO: 3051272 - RNA, 16 nt, Human
ugauggugcaaugacc

SEQ ID NO: 3051273 - RNA, 18 nt, Human
ugauguuuuaaggaugcu

SEQ ID NO: 3051274 - RNA, 17 nt, Human
ugauguuuuaaggaugc

SEQ ID NO: 3051275 - RNA, 23 nt, Human
ugauguuuuccaugaguccccug

SEQ ID NO: 3051276 - RNA, 22 nt, Human
ugauguuuagaaacacaacuau

SEQ ID NO: 3051277 - RNA, 22 nt, Human
agccaggcccuugucggcccca

SEQ ID NO: 3051278 - RNA, 21 nt, Human
agccaggccacaagacccuug

SEQ ID NO: 3051279 - RNA, 22 nt, Human
agccaggccacaagacccuugu

SEQ ID NO: 3051280 - RNA, 12 nt, Human
agccagggucuc

SEQ ID NO: 3051281 - RNA, 22 nt, Human
agccaguaaaugggggugcauu

SEQ ID NO: 3051282 - RNA, 23 nt, Human
agccaguaaaugggggugcauuu

SEQ ID NO: 3051283 - RNA, 12 nt, Human
agccaggccaca

SEQ ID NO: 3051284 - RNA, 14 nt, Human
agccaggccacaag

SEQ ID NO: 3051285 - RNA, 14 nt, Human
agccagacuggcac

SEQ ID NO: 3051286 - RNA, 22 nt, Human
agcccacuucugccauauucug

SEQ ID NO: 3051287 - RNA, 19 nt, Human
agcccaggaaaggcuccag

SEQ ID NO: 3051288 - RNA, 20 nt, Human
agcccaggaaaggcuccagg

SEQ ID NO: 3051289 - RNA, 21 nt, Human
agcccaggaaaggcuccagga

SEQ ID NO: 3051290 - RNA, 21 nt, Human
ugauucccaagcucugcuccu

SEQ ID NO: 3051291 - RNA, 19 nt, Human
ugauucccaagcucugcuc

SEQ ID NO: 3051292 - RNA, 18 nt, Human
ugauucccaagcucugcu

SEQ ID NO: 3051293 - RNA, 16 nt, Human
ugauucccaagcucug

SEQ ID NO: 3051294 - RNA, 15 nt, Human
ugauucccaagcucu

SEQ ID NO: 3051295 - RNA, 22 nt, Human
agcccaggaaaggcuccaggag

SEQ ID NO: 3051296 - RNA, 23 nt, Human
agcccaggaaaggcuccaggagc

SEQ ID NO: 3051297 - RNA, 24 nt, Human
agcccaggaaaggcuccaggagca

SEQ ID NO: 3051298 - RNA, 18 nt, Human
agcccaggaaaggcucca

SEQ ID NO: 3051299 - RNA, 13 nt, Human
ugauucagcucug

SEQ ID NO: 3051300 - RNA, 14 nt, Human
ugauucagcucugc

SEQ ID NO: 3051301 - RNA, 23 nt, Human
ugagugggggaucacagccucug

SEQ ID NO: 3051302 - RNA, 21 nt, Human
ugagugggugaauaauacagu

SEQ ID NO: 3051303 - RNA, 16 nt, Human
ugagugccuuacacaa

SEQ ID NO: 3051304 - RNA, 17 nt, Human
ugagugccuuacacaau

SEQ ID NO: 3051305 - RNA, 20 nt, Human
ugagugccuuacacaauggu

SEQ ID NO: 3051306 - RNA, 17 nt, Human
ugagucaccaagcccag

SEQ ID NO: 3051307 - RNA, 16 nt, Human
ugagucaccaagccca

SEQ ID NO: 3051308 - RNA, 14 nt, Human
ugagucaccaagcc

SEQ ID NO: 3051309 - RNA, 19 nt, Human
ugauacgcaacauaauuaa

SEQ ID NO: 3051310 - RNA, 17 nt, Human
ugauacuacaguuuguu

SEQ ID NO: 3051311 - RNA, 14 nt, Human
ugauacuacaguuu

SEQ ID NO: 3051312 - RNA, 21 nt, Human
ugauacaaugcugugcccuaa

SEQ ID NO: 3051313 - RNA, 12 nt, Human
ugauacagaaaa

SEQ ID NO: 3051314 - RNA, 20 nt, Human
ugauacaaugcugugcccua

SEQ ID NO: 3051315 - RNA, 18 nt, Human
ugauacaaugcugugccc

SEQ ID NO: 3051316 - RNA, 12 nt, Human
ugauaaguaaau

SEQ ID NO: 3051317 - RNA, 20 nt, Human
ugauaagaaccuuuugagug

SEQ ID NO: 3051318 - RNA, 17 nt, Human
ugaguucauacccuguu

SEQ ID NO: 3051319 - RNA, 21 nt, Human
agcauaauacuugcuuuggaa

SEQ ID NO: 3051320 - RNA, 15 nt, Human
agcauacguacacau

SEQ ID NO: 3051321 - RNA, 23 nt, Human
agcauaaauguugacaugggaca

SEQ ID NO: 3051322 - RNA, 12 nt, Human
ugagaauuaccc

SEQ ID NO: 3051323 - RNA, 19 nt, Human
agcauacguacacauuuua

SEQ ID NO: 3051324 - RNA, 18 nt, Human
agcauacguacacauuuu

SEQ ID NO: 3051325 - RNA, 17 nt, Human
agcauacguacacauuu

SEQ ID NO: 3051326 - RNA, 16 nt, Human
agcauacguacacauu

SEQ ID NO: 3051327 - RNA, 21 nt, Human
agcauacguacacauuuuauu

SEQ ID NO: 3051328 - RNA, 20 nt, Human
agcauacguacacauuuuau

SEQ ID NO: 3051329 - RNA, 22 nt, Human
ugaguaacugauuuguaacaag

SEQ ID NO: 3051330 - RNA, 15 nt, Human
ugaguacuacagucc

SEQ ID NO: 3051331 - RNA, 14 nt, Human
agcauauucaggaa

SEQ ID NO: 3051332 - RNA, 17 nt, Human
ugaguacuacaguccuc

SEQ ID NO: 3051333 - RNA, 21 nt, Human
ugaguacuacaguccucccau

SEQ ID NO: 3051334 - RNA, 22 nt, Human
ugaguacuacaguccucccauc

SEQ ID NO: 3051335 - RNA, 23 nt, Human
ugaguacuacaguccucccaucu

SEQ ID NO: 3051336 - RNA, 14 nt, Human
ugaguacuacaguc

SEQ ID NO: 3051337 - RNA, 15 nt, Human
ugauaugugaacagu

SEQ ID NO: 3051338 - RNA, 16 nt, Human
ugauaugugaacaguu

SEQ ID NO: 3051339 - RNA, 12 nt, Human
ugauaugggucu

SEQ ID NO: 3051340 - RNA, 19 nt, Human
ugaucacggcucacugcag

SEQ ID NO: 3051341 - RNA, 18 nt, Human
ugaucacggcucacugca

SEQ ID NO: 3051342 - RNA, 13 nt, Human
agcaucaggccag

SEQ ID NO: 3051343 - RNA, 12 nt, Human
agcaucaggcca

SEQ ID NO: 3051344 - RNA, 21 nt, Human
ugaucacggcucacugcagcc

SEQ ID NO: 3051345 - RNA, 20 nt, Human
ugaucacggcucacugcagc

SEQ ID NO: 3051346 - RNA, 22 nt, Human
agcauauucaggaagcucaggg

SEQ ID NO: 3051347 - RNA, 17 nt, Human
agcaugucgucaaagcu

SEQ ID NO: 3051348 - RNA, 20 nt, Human
agcaugucgucaaagcugaa

SEQ ID NO: 3051349 - RNA, 12 nt, Human
agcauggcugcc

SEQ ID NO: 3051350 - RNA, 18 nt, Human
agcauggcauauuuuuca

SEQ ID NO: 3051351 - RNA, 19 nt, Human
agcauggcauauuuuucac

SEQ ID NO: 3051352 - RNA, 21 nt, Human
agcauggcauauuuuucacau

SEQ ID NO: 3051353 - RNA, 22 nt, Human
agcauggcauauuuuucacaua

SEQ ID NO: 3051354 - RNA, 19 nt, Human
agcaucaggccaggcccuc

SEQ ID NO: 3051355 - RNA, 20 nt, Human
agcaucaggccaggcccucu

SEQ ID NO: 3051356 - RNA, 14 nt, Human
agcaucaggccagg

SEQ ID NO: 3051357 - RNA, 16 nt, Human
agcaucaggccaggcc

SEQ ID NO: 3051358 - RNA, 17 nt, Human
agcaucaggccaggccc

SEQ ID NO: 3051359 - RNA, 18 nt, Human
agcaucaggccaggcccu

SEQ ID NO: 3051360 - RNA, 18 nt, Human
agcauuguaaaugugcuu

SEQ ID NO: 3051361 - RNA, 17 nt, Human
agcauuguaaaugugcu

SEQ ID NO: 3051362 - RNA, 18 nt, Human
ugaccugaggcccuucuc

SEQ ID NO: 3051363 - RNA, 19 nt, Human
ugaccugaggcccuucucu

SEQ ID NO: 3051364 - RNA, 17 nt, Human
ugaccugaggcccuucu

SEQ ID NO: 3051365 - RNA, 13 nt, Human
ugacuuacuguac

SEQ ID NO: 3051366 - RNA, 16 nt, Human
ugacuuacuguacaug

SEQ ID NO: 3051367 - RNA, 15 nt, Human
ugacuuacuguacau

SEQ ID NO: 3051368 - RNA, 15 nt, Human
agauggaaugcugug

SEQ ID NO: 3051369 - RNA, 13 nt, Human
agauggaaugcug

SEQ ID NO: 3051370 - RNA, 18 nt, Human
agauggaaugcuguguua

SEQ ID NO: 3051371 - RNA, 14 nt, Human
ugacccaugcugcc

SEQ ID NO: 3051372 - RNA, 15 nt, Human
ugacccaugcugccc

SEQ ID NO: 3051373 - RNA, 12 nt, Human
ugacccaugcug

SEQ ID NO: 3051374 - RNA, 16 nt, Human
ugacccaugcugcccu

SEQ ID NO: 3051375 - RNA, 21 nt, Human
ugacccaugcugcccugugag

SEQ ID NO: 3051376 - RNA, 16 nt, Human
agaugccgcauuugga

SEQ ID NO: 3051377 - RNA, 16 nt, Human
agaugcaguucugaag

SEQ ID NO: 3051378 - RNA, 17 nt, Human
ugacacuuaaaaauggu

SEQ ID NO: 3051379 - RNA, 16 nt, Human
ugacacuuaaaaaugg

SEQ ID NO: 3051380 - RNA, 13 nt, Human
agauuggaaggaa

SEQ ID NO: 3051381 - RNA, 15 nt, Human
agauucccugagcag

SEQ ID NO: 3051382 - RNA, 15 nt, Human
ugacuucuaaguaaa

SEQ ID NO: 3051383 - RNA, 23 nt, Human
ugacuucuaaguaaaaccacagc

SEQ ID NO: 3051384 - RNA, 22 nt, Human
ugacuucuaaguaaaaccacag

SEQ ID NO: 3051385 - RNA, 22 nt, Human
agauucauauuuacuucuuaua

SEQ ID NO: 3051386 - RNA, 19 nt, Human
agauucauauuuacuucuu

SEQ ID NO: 3051387 - RNA, 21 nt, Human
agauuuugaaauuuuuauuaa

SEQ ID NO: 3051388 - RNA, 17 nt, Human
agauuugaacucuucaa

SEQ ID NO: 3051389 - RNA, 17 nt, Human
agcaagacgcugugcug

SEQ ID NO: 3051390 - RNA, 20 nt, Human
agcaagacgcugugcugccc

SEQ ID NO: 3051391 - RNA, 21 nt, Human
agcaagacgcugugcugcccu

SEQ ID NO: 3051392 - RNA, 22 nt, Human
agcaagacgcugugcugcccug

SEQ ID NO: 3051393 - RNA, 23 nt, Human
agcaagacgcugugcugcccugc

SEQ ID NO: 3051394 - RNA, 13 nt, Human
agcaagacgcugu

SEQ ID NO: 3051395 - RNA, 16 nt, Human
agcaagacgcugugcu

SEQ ID NO: 3051396 - RNA, 23 nt, Human
agcaacgcaggcccccaggugcc

SEQ ID NO: 3051397 - RNA, 23 nt, Human
ugaauuugugaagguggaaauaa

SEQ ID NO: 3051398 - RNA, 21 nt, Human
ugaauuugugaagguggaaau

SEQ ID NO: 3051399 - RNA, 13 nt, Human
ugaauuugugaag

SEQ ID NO: 3051400 - RNA, 23 nt, Human
ugaauuucuuuugccguuauuaa

SEQ ID NO: 3051401 - RNA, 20 nt, Human
ugacacaugcaaggucauuu

SEQ ID NO: 3051402 - RNA, 12 nt, Human
ugacacaugcaa

SEQ ID NO: 3051403 - RNA, 18 nt, Human
ugacacacagcucugucc

SEQ ID NO: 3051404 - RNA, 16 nt, Human
ugacacacagcucugu

SEQ ID NO: 3051405 - RNA, 19 nt, Human
ugacaaagacugaguacgu

SEQ ID NO: 3051406 - RNA, 19 nt, Human
ugacacacagcucuguccu

SEQ ID NO: 3051407 - RNA, 20 nt, Human
agaguauuuuugacagaaua

SEQ ID NO: 3051408 - RNA, 15 nt, Human
agagucacuggaaca

SEQ ID NO: 3051409 - RNA, 17 nt, Human
agaguuguuacauuuuu

SEQ ID NO: 3051410 - RNA, 16 nt, Human
agaguuguuacauuuu

SEQ ID NO: 3051411 - RNA, 20 nt, Human
agaguuguuacauuuuuaag

SEQ ID NO: 3051412 - RNA, 19 nt, Human
agaguuguuacauuuuuaa

SEQ ID NO: 3051413 - RNA, 18 nt, Human
agauaauacaccacuaca

SEQ ID NO: 3051414 - RNA, 16 nt, Human
agauacuguaucauga

SEQ ID NO: 3051415 - RNA, 15 nt, Human
agauacuguaucaug

SEQ ID NO: 3051416 - RNA, 21 nt, Human
agauauuuugcuuugugauuu

SEQ ID NO: 3051417 - RNA, 20 nt, Human
agauauuuugcuuugugauu

SEQ ID NO: 3051418 - RNA, 18 nt, Human
agaucaaaagguuaauaa

SEQ ID NO: 3051419 - RNA, 18 nt, Human
agauaauauuaaggaaga

SEQ ID NO: 3051420 - RNA, 22 nt, Human
agauaauauuaaggaagacaau

SEQ ID NO: 3051421 - RNA, 13 nt, Human
agauacaguuacu

SEQ ID NO: 3051422 - RNA, 20 nt, Human
agauacaggaaaagcugcug

SEQ ID NO: 3051423 - RNA, 11 nt, Human
agauacuguau

SEQ ID NO: 3051424 - RNA, 22 nt, Human
agauacaguuacucagaauucu

SEQ ID NO: 3051425 - RNA, 17 nt, Human
agaguauuuuugacaga

SEQ ID NO: 3051426 - RNA, 18 nt, Human
agaguauuuuugacagaa

SEQ ID NO: 3051427 - RNA, 15 nt, Human
ugaauacuuuauaaa

SEQ ID NO: 3051428 - RNA, 14 nt, Human
ugaauaccccaaga

SEQ ID NO: 3051429 - RNA, 22 nt, Human
ugaauaccccaagacucccaug

SEQ ID NO: 3051430 - RNA, 14 nt, Human
ugaagucacacagu

SEQ ID NO: 3051431 - RNA, 22 nt, Human
ugaaggguaauuauauaguuac

SEQ ID NO: 3051432 - RNA, 14 nt, Human
ugaaaguacauuug

SEQ ID NO: 3051433 - RNA, 23 nt, Human
ugaaaguacauuuggagacacaa

SEQ ID NO: 3051434 - RNA, 16 nt, Human
agagggagggagggcu

SEQ ID NO: 3051435 - RNA, 20 nt, Human
ugaagcuaucguaaaauuaa

SEQ ID NO: 3051436 - RNA, 14 nt, Human
agaguauuuuugac

SEQ ID NO: 3051437 - RNA, 15 nt, Human
agaguauuuuugaca

SEQ ID NO: 3051438 - RNA, 16 nt, Human
agagguggggagcaga

SEQ ID NO: 3051439 - RNA, 15 nt, Human
agagguuaagguggg

SEQ ID NO: 3051440 - RNA, 23 nt, Human
ugaaaaaauauauaucaaauaua

SEQ ID NO: 3051441 - RNA, 22 nt, Human
ugaaaaagaccuuuggagcaaa

SEQ ID NO: 3051442 - RNA, 16 nt, Human
ugaaaaaggaggaaga

SEQ ID NO: 3051443 - RNA, 21 nt, Human
ucuuucuggcuaugcauuuga

SEQ ID NO: 3051444 - RNA, 19 nt, Human
ucuuucuggcuaugcauuu

SEQ ID NO: 3051445 - RNA, 20 nt, Human
ucuuucuggcuaugcauuug

SEQ ID NO: 3051446 - RNA, 22 nt, Human
ucuuuggucuacacugugcuga

SEQ ID NO: 3051447 - RNA, 14 nt, Human
ucuuuguggcuucc

SEQ ID NO: 3051448 - RNA, 19 nt, Human
ugaaacucguuaauuugua

SEQ ID NO: 3051449 - RNA, 16 nt, Human
ugaaacgcaaccacca

SEQ ID NO: 3051450 - RNA, 19 nt, Human
ugaaaaucgugacaacacu

SEQ ID NO: 3051451 - RNA, 17 nt, Human
ugaaaauguauguguaa

SEQ ID NO: 3051452 - RNA, 16 nt, Human
ugaaaaucgugacaac

SEQ ID NO: 3051453 - RNA, 20 nt, Human
ugaaaagcuccauuuuuagu

SEQ ID NO: 3051454 - RNA, 20 nt, Human
ugaaaaaggaggaagagaaa

SEQ ID NO: 3051455 - RNA, 22 nt, Human
ugaaaaaggaggaagagaaaaa

SEQ ID NO: 3051456 - RNA, 22 nt, Human
ugaaaaaguucugcagauaaac

SEQ ID NO: 3051457 - RNA, 20 nt, Human
agagcaaaauugauguguuu

SEQ ID NO: 3051458 - RNA, 19 nt, Human
agagcaagacgcugugcug

SEQ ID NO: 3051459 - RNA, 23 nt, Human
agagcaagacgcugugcugcccu

SEQ ID NO: 3051460 - RNA, 14 nt, Human
agagagaaaauaaa

SEQ ID NO: 3051461 - RNA, 23 nt, Human
agagacuccugcaggcagccagg

SEQ ID NO: 3051462 - RNA, 22 nt, Human
agagaucaaccccuucgcuccu

SEQ ID NO: 3051463 - RNA, 15 nt, Human
ugaaagacuguacaa

SEQ ID NO: 3051464 - RNA, 13 nt, Human
ugaaagacuguac

SEQ ID NO: 3051465 - RNA, 19 nt, Human
agagacuccugcaggcagc

SEQ ID NO: 3051466 - RNA, 20 nt, Human
agagacuccugcaggcagcc

SEQ ID NO: 3051467 - RNA, 21 nt, Human
agagacuccugcaggcagcca

SEQ ID NO: 3051468 - RNA, 22 nt, Human
agagacuccugcaggcagccag

SEQ ID NO: 3051469 - RNA, 17 nt, Human
agagacuccugcaggca

SEQ ID NO: 3051470 - RNA, 18 nt, Human
agagacuccugcaggcag

SEQ ID NO: 3051471 - RNA, 15 nt, Human
agagacuccugcagg

SEQ ID NO: 3051472 - RNA, 14 nt, Human
agagcugccaccug

SEQ ID NO: 3051473 - RNA, 13 nt, Human
agagccuuccagg

SEQ ID NO: 3051474 - RNA, 15 nt, Human
agagccuuccagggg

SEQ ID NO: 3051475 - RNA, 17 nt, Human
agagccuuccaggggug

SEQ ID NO: 3051476 - RNA, 22 nt, Human
agagccuuccaggggugggaca

SEQ ID NO: 3051477 - RNA, 20 nt, Human
agagcuagcagcagggaggg

SEQ ID NO: 3051478 - RNA, 22 nt, Human
agagcaccuuagacagucccug

SEQ ID NO: 3051479 - RNA, 21 nt, Human
agagcaccuuagacagucccu

SEQ ID NO: 3051480 - RNA, 23 nt, Human
agagcaccuuagacagucccugc

SEQ ID NO: 3051481 - RNA, 23 nt, Human
agagcaguuugguuucuagcaug

SEQ ID NO: 3051482 - RNA, 21 nt, Human
agagcaguuugguuucuagca

SEQ ID NO: 3051483 - RNA, 19 nt, Human
agacauucuuccaaaaaga

SEQ ID NO: 3051484 - RNA, 19 nt, Human
agacauacuaaccagcaga

SEQ ID NO: 3051485 - RNA, 14 nt, Human
agacauagaauuaa

SEQ ID NO: 3051486 - RNA, 21 nt, Human
agacauagaauuaacacauga

SEQ ID NO: 3051487 - RNA, 17 nt, Human
agacaucaacagauaaa

SEQ ID NO: 3051488 - RNA, 18 nt, Human
agacaucaacagauaaau

SEQ ID NO: 3051489 - RNA, 21 nt, Human
ucuucugaacuuggcgcugcc

SEQ ID NO: 3051490 - RNA, 12 nt, Human
ucuucugcuuca

SEQ ID NO: 3051491 - RNA, 23 nt, Human
ucuucuguacgucugacaggcaa

SEQ ID NO: 3051492 - RNA, 15 nt, Human
ucuucuguacgucug

SEQ ID NO: 3051493 - RNA, 20 nt, Human
ucuucuguggguuucuaaag

SEQ ID NO: 3051494 - RNA, 17 nt, Human
ucuucagagacuccugc

SEQ ID NO: 3051495 - RNA, 18 nt, Human
ucuucagagacuccugca

SEQ ID NO: 3051496 - RNA, 12 nt, Human
ucuucagagacu

SEQ ID NO: 3051497 - RNA, 14 nt, Human
agaaucacuugaac

SEQ ID NO: 3051498 - RNA, 20 nt, Human
ucuucagagacuccugcagg

SEQ ID NO: 3051499 - RNA, 15 nt, Human
ucuuccaggcuggga

SEQ ID NO: 3051500 - RNA, 17 nt, Human
ucuuccaggcugggaga

SEQ ID NO: 3051501 - RNA, 20 nt, Human
ucuuccaggcugggagagcc

SEQ ID NO: 3051502 - RNA, 19 nt, Human
ucuucccuacaguugaaaa

SEQ ID NO: 3051503 - RNA, 14 nt, Human
ucuuccucccuccc

SEQ ID NO: 3051504 - RNA, 15 nt, Human
ucuuccucccucccu

SEQ ID NO: 3051505 - RNA, 21 nt, Human
ucuugaugccuggcggggugg

SEQ ID NO: 3051506 - RNA, 13 nt, Human
ucuugauucauaa

SEQ ID NO: 3051507 - RNA, 13 nt, Human
ucuugagccuggg

SEQ ID NO: 3051508 - RNA, 16 nt, Human
ucuugagccugggagg

SEQ ID NO: 3051509 - RNA, 20 nt, Human
ucuugagccuugaacuuuga

SEQ ID NO: 3051510 - RNA, 21 nt, Human
agaccuucuccuucaccuuug

SEQ ID NO: 3051511 - RNA, 23 nt, Human
agaccuucuccuucaccuuuguc

SEQ ID NO: 3051512 - RNA, 15 nt, Human
agacuauucaaacag

SEQ ID NO: 3051513 - RNA, 14 nt, Human
agacuauucaaaca

SEQ ID NO: 3051514 - RNA, 12 nt, Human
agacuauucaaa

SEQ ID NO: 3051515 - RNA, 15 nt, Human
agaccuucuccuuca

SEQ ID NO: 3051516 - RNA, 18 nt, Human
agaccuucuccuucaccu

SEQ ID NO: 3051517 - RNA, 11 nt, Human
agaccuucucc

SEQ ID NO: 3051518 - RNA, 15 nt, Human
ucuuuaacucauaaa

SEQ ID NO: 3051519 - RNA, 15 nt, Human
ucuugguccugcugc

SEQ ID NO: 3051520 - RNA, 17 nt, Human
ucuugguccugcugcag

SEQ ID NO: 3051521 - RNA, 19 nt, Human
ucuugguccugcugcaguu

SEQ ID NO: 3051522 - RNA, 17 nt, Human
ucuuuccugaggcuggg

SEQ ID NO: 3051523 - RNA, 16 nt, Human
ucuuuccugaggcugg

SEQ ID NO: 3051524 - RNA, 17 nt, Human
ucuuggucagauuugaa

SEQ ID NO: 3051525 - RNA, 14 nt, Human
ucuugguccugcug

SEQ ID NO: 3051526 - RNA, 22 nt, Human
ucuugcaauggcagccuuggca

SEQ ID NO: 3051527 - RNA, 18 nt, Human
ucuugcaauggcagccuu

SEQ ID NO: 3051528 - RNA, 19 nt, Human
ucuugcaauggcagccuug

SEQ ID NO: 3051529 - RNA, 19 nt, Human
acuuuguauaaaagggacu

SEQ ID NO: 3051530 - RNA, 23 nt, Human
acuuuggaaagaguaggaagacu

SEQ ID NO: 3051531 - RNA, 13 nt, Human
acuuuggaaagag

SEQ ID NO: 3051532 - RNA, 14 nt, Human
acuuuggaaagagu

SEQ ID NO: 3051533 - RNA, 23 nt, Human
acuuuggaaagacuuuuccaacc

SEQ ID NO: 3051534 - RNA, 22 nt, Human
acuuugcacacuuuggcccagg

SEQ ID NO: 3051535 - RNA, 21 nt, Human
acuuugcacacuuuggcccag

SEQ ID NO: 3051536 - RNA, 23 nt, Human
acuuuaccuuuuuuauacauaaa

SEQ ID NO: 3051537 - RNA, 16 nt, Human
acuuuaaaaggagcca

SEQ ID NO: 3051538 - RNA, 22 nt, Human
acuuguuuuauuuaaccucuaa

SEQ ID NO: 3051539 - RNA, 14 nt, Human
acuuguggacacag

SEQ ID NO: 3051540 - RNA, 16 nt, Human
acuuuguguucaccuu

SEQ ID NO: 3051541 - RNA, 21 nt, Human
ucuccuuggugucgggcauga

SEQ ID NO: 3051542 - RNA, 23 nt, Human
ucuccuuggugucgggcaugaca

SEQ ID NO: 3051543 - RNA, 19 nt, Human
ucuccuguaccucuugagc

SEQ ID NO: 3051544 - RNA, 12 nt, Human
ucucucaggcca

SEQ ID NO: 3051545 - RNA, 21 nt, Human
ucucucacuuguuuuauuuaa

SEQ ID NO: 3051546 - RNA, 22 nt, Human
ucucucacuuguuuuauuuaac

SEQ ID NO: 3051547 - RNA, 18 nt, Human
ucucugcaggucccuaau

SEQ ID NO: 3051548 - RNA, 19 nt, Human
agaaaaaauauuuucccua

SEQ ID NO: 3051549 - RNA, 17 nt, Human
agaaaaaauauuuuccu

SEQ ID NO: 3051550 - RNA, 23 nt, Human
agaaaaaauauuuuccugccagg

SEQ ID NO: 3051551 - RNA, 17 nt, Human
agaaaaaugagccuggc

SEQ ID NO: 3051552 - RNA, 18 nt, Human
agaaaaaugagccuggca

SEQ ID NO: 3051553 - RNA, 21 nt, Human
ucucugcaggucccuaauaaa

SEQ ID NO: 3051554 - RNA, 20 nt, Human
ucucugcaggucccuaauaa

SEQ ID NO: 3051555 - RNA, 19 nt, Human
ucucugcaggucccuaaua

SEQ ID NO: 3051556 - RNA, 22 nt, Human
ucucugcaggucccuaauaaag

SEQ ID NO: 3051557 - RNA, 16 nt, Human
ucucuugguccugcug

SEQ ID NO: 3051558 - RNA, 17 nt, Human
ucucuugguccugcugc

SEQ ID NO: 3051559 - RNA, 18 nt, Human
ucucuugguccugcugca

SEQ ID NO: 3051560 - RNA, 15 nt, Human
agaaacuggaacucu

SEQ ID NO: 3051561 - RNA, 16 nt, Human
agaaacacaacuauau

SEQ ID NO: 3051562 - RNA, 15 nt, Human
agaaaucuaaaaaac

SEQ ID NO: 3051563 - RNA, 13 nt, Human
agaaaugaaaaaa

SEQ ID NO: 3051564 - RNA, 12 nt, Human
agaaaugaaaaa

SEQ ID NO: 3051565 - RNA, 15 nt, Human
agaaaugccuuaccc

SEQ ID NO: 3051566 - RNA, 18 nt, Human
ucugaaggcuggguucug

SEQ ID NO: 3051567 - RNA, 20 nt, Human
ucugaaggguaauuauauag

SEQ ID NO: 3051568 - RNA, 22 nt, Human
ucugaaggacauugcggacagc

SEQ ID NO: 3051569 - RNA, 22 nt, Human
agaaagacuaucuaaauguuga

SEQ ID NO: 3051570 - RNA, 20 nt, Human
agaaagacuaucuaaauguu

SEQ ID NO: 3051571 - RNA, 16 nt, Human
agaaagacuauucaaa

SEQ ID NO: 3051572 - RNA, 17 nt, Human
agaaagcagaacaguga

SEQ ID NO: 3051573 - RNA, 18 nt, Human
agaaagcagaacagugau

SEQ ID NO: 3051574 - RNA, 20 nt, Human
agaaagcagaacagugauua

SEQ ID NO: 3051575 - RNA, 23 nt, Human
ucugcaggucccuaauaaagcug

SEQ ID NO: 3051576 - RNA, 22 nt, Human
ucugcaggucccuaauaaagcu

SEQ ID NO: 3051577 - RNA, 19 nt, Human
ucugcaggucccuaauaaa

SEQ ID NO: 3051578 - RNA, 21 nt, Human
ucugcaggucccuaauaaagc

SEQ ID NO: 3051579 - RNA, 19 nt, Human
agaaccuuuugagugccuu

SEQ ID NO: 3051580 - RNA, 23 nt, Human
agaaccuuuugagugccuuacac

SEQ ID NO: 3051581 - RNA, 17 nt, Human
agaacucccuuucaaca

SEQ ID NO: 3051582 - RNA, 15 nt, Human
agaacucccuuucaa

SEQ ID NO: 3051583 - RNA, 16 nt, Human
agaacucccuuucaac

SEQ ID NO: 3051584 - RNA, 12 nt, Human
ucugcccuuggu

SEQ ID NO: 3051585 - RNA, 23 nt, Human
ucugcccuugguuaggcauugug

SEQ ID NO: 3051586 - RNA, 23 nt, Human
ucugcccacucccugcaaccuga

SEQ ID NO: 3051587 - RNA, 20 nt, Human
ucugcccauccugccccuga

SEQ ID NO: 3051588 - RNA, 23 nt, Human
agaagcccaggaaaggcuccagg

SEQ ID NO: 3051589 - RNA, 16 nt, Human
agaagcagaggaagga

SEQ ID NO: 3051590 - RNA, 19 nt, Human
agaagcaccaaucaugaau

SEQ ID NO: 3051591 - RNA, 19 nt, Human
agaagcaacccaaauguuc

SEQ ID NO: 3051592 - RNA, 13 nt, Human
agaagcagcucuu

SEQ ID NO: 3051593 - RNA, 12 nt, Human
agaagcagcucu

SEQ ID NO: 3051594 - RNA, 16 nt, Human
agaaggaucuucaucu

SEQ ID NO: 3051595 - RNA, 22 nt, Human
agaaguuugagaucagccuggg

SEQ ID NO: 3051596 - RNA, 13 nt, Human
agaaguugauaug

SEQ ID NO: 3051597 - RNA, 16 nt, Human
ucuggcagcucagaga

SEQ ID NO: 3051598 - RNA, 17 nt, Human
ucuggcagcucagagag

SEQ ID NO: 3051599 - RNA, 20 nt, Human
ucuggcagaguugaagacag

SEQ ID NO: 3051600 - RNA, 23 nt, Human
ucuggcagaguugaagacagagc

SEQ ID NO: 3051601 - RNA, 18 nt, Human
ucuggcagcucagagagg

SEQ ID NO: 3051602 - RNA, 21 nt, Human
ucuggcagcucagagagggug

SEQ ID NO: 3051603 - RNA, 14 nt, Human
agaagcuccaggua

SEQ ID NO: 3051604 - RNA, 22 nt, Human
ucugcuuugggguuuaucagaa

SEQ ID NO: 3051605 - RNA, 18 nt, Human
acuguacagacagaaaaa

SEQ ID NO: 3051606 - RNA, 16 nt, Human
acuguacaugaaaaca

SEQ ID NO: 3051607 - RNA, 19 nt, Human
acuguacaugaaaacacau

SEQ ID NO: 3051608 - RNA, 22 nt, Human
acuguacaaaguagaagucuua

SEQ ID NO: 3051609 - RNA, 16 nt, Human
acuguacaaaguagaa

SEQ ID NO: 3051610 - RNA, 17 nt, Human
acuggguacuuguggac

SEQ ID NO: 3051611 - RNA, 23 nt, Human
acuguacuugcucuugaugccug

SEQ ID NO: 3051612 - RNA, 14 nt, Human
acuguaucaugaca

SEQ ID NO: 3051613 - RNA, 15 nt, Human
acuguacuugcucuu

SEQ ID NO: 3051614 - RNA, 21 nt, Human
acuguacaugaaaacacauuu

SEQ ID NO: 3051615 - RNA, 20 nt, Human
acuguacaugaaaacacauu

SEQ ID NO: 3051616 - RNA, 20 nt, Human
acuguaucaugacaaagacu

SEQ ID NO: 3051617 - RNA, 16 nt, Human
acuguaucaugacaaa

SEQ ID NO: 3051618 - RNA, 23 nt, Human
acuguccuacccacccuccuuuc

SEQ ID NO: 3051619 - RNA, 23 nt, Human
acugucagcuccccucggagaag

SEQ ID NO: 3051620 - RNA, 22 nt, Human
acugucagcuccccucggagaa

SEQ ID NO: 3051621 - RNA, 18 nt, Human
ucgcccuggacugugugc

SEQ ID NO: 3051622 - RNA, 14 nt, Human
ucgcuccugugucu

SEQ ID NO: 3051623 - RNA, 12 nt, Human
acugaagaagca

SEQ ID NO: 3051624 - RNA, 22 nt, Human
acugaagaagcaccaaucauga

SEQ ID NO: 3051625 - RNA, 21 nt, Human
acugggcuuggggaccagagc

SEQ ID NO: 3051626 - RNA, 15 nt, Human
acuggguacuugugg

SEQ ID NO: 3051627 - RNA, 21 nt, Human
ucuaagauaguaacaaugaag

SEQ ID NO: 3051628 - RNA, 22 nt, Human
ucuaacuucaccauauuaccac

SEQ ID NO: 3051629 - RNA, 16 nt, Human
ucuaaaggcuaccuuu

SEQ ID NO: 3051630 - RNA, 13 nt, Human
ucuaaaggcuacc

SEQ ID NO: 3051631 - RNA, 16 nt, Human
ucuaaagcugccagcc

SEQ ID NO: 3051632 - RNA, 17 nt, Human
ucuaaagcugccagccg

SEQ ID NO: 3051633 - RNA, 21 nt, Human
ucuacccucuuagaaaaacca

SEQ ID NO: 3051634 - RNA, 17 nt, Human
acuguuaauaguucagg

SEQ ID NO: 3051635 - RNA, 21 nt, Human
acuguuaauaguucagguaac

SEQ ID NO: 3051636 - RNA, 14 nt, Human
acuucccuuucugc

SEQ ID NO: 3051637 - RNA, 22 nt, Human
acuucccuuucugcuuguguua

SEQ ID NO: 3051638 - RNA, 17 nt, Human
acuucgggaggucgagg

SEQ ID NO: 3051639 - RNA, 20 nt, Human
acuucgggaggucgaggcag

SEQ ID NO: 3051640 - RNA, 18 nt, Human
acuucuccacccugcucu

SEQ ID NO: 3051641 - RNA, 13 nt, Human
acuucuaaguaaa

SEQ ID NO: 3051642 - RNA, 19 nt, Human
acuucuaaguaaaaccaca

SEQ ID NO: 3051643 - RNA, 18 nt, Human
acuucuaaguaaaaccac

SEQ ID NO: 3051644 - RNA, 16 nt, Human
ucucaaaaaaagaaaa

SEQ ID NO: 3051645 - RNA, 16 nt, Human
ucuauuguuucuuuca

SEQ ID NO: 3051646 - RNA, 21 nt, Human
ucucacagcuccaagaauuuc

SEQ ID NO: 3051647 - RNA, 17 nt, Human
ucucaaaacugcacugu

SEQ ID NO: 3051648 - RNA, 14 nt, Human
acuuguauuaugug

SEQ ID NO: 3051649 - RNA, 13 nt, Human
acuuguauuaugu

SEQ ID NO: 3051650 - RNA, 14 nt, Human
acuugucuuuggac

SEQ ID NO: 3051651 - RNA, 14 nt, Human
acuuggaagcuccg

SEQ ID NO: 3051652 - RNA, 18 nt, Human
acuugaaaauuaacauga

SEQ ID NO: 3051653 - RNA, 16 nt, Human
acuugaaaauuaacau

SEQ ID NO: 3051654 - RNA, 17 nt, Human
acuugaaaauuaacaug

SEQ ID NO: 3051655 - RNA, 21 nt, Human
acuugaacccgggaggcagag

SEQ ID NO: 3051656 - RNA, 23 nt, Human
acuugaacccgggaggcagaggu

SEQ ID NO: 3051657 - RNA, 12 nt, Human
ucuaccugaggg

SEQ ID NO: 3051658 - RNA, 19 nt, Human
ucuaccugaggggccucuu

SEQ ID NO: 3051659 - RNA, 20 nt, Human
acuuagagguggggagcaga

SEQ ID NO: 3051660 - RNA, 15 nt, Human
acuuacuguacauga

SEQ ID NO: 3051661 - RNA, 14 nt, Human
acuuacuguacaug

SEQ ID NO: 3051662 - RNA, 13 nt, Human
acuuacuguacau

SEQ ID NO: 3051663 - RNA, 16 nt, Human
acuucaucccucuggg

SEQ ID NO: 3051664 - RNA, 17 nt, Human
acuuccacugccauccu

SEQ ID NO: 3051665 - RNA, 18 nt, Human
acuuccaauuuacauacu

SEQ ID NO: 3051666 - RNA, 20 nt, Human
acuuccagauccuggaaauc

SEQ ID NO: 3051667 - RNA, 18 nt, Human
ucuagcauggcauauuuu

SEQ ID NO: 3051668 - RNA, 13 nt, Human
ucuagccagagga

SEQ ID NO: 3051669 - RNA, 17 nt, Human
ucuagcauggcauauuu

SEQ ID NO: 3051670 - RNA, 12 nt, Human
ucuagcaugaag

SEQ ID NO: 3051671 - RNA, 17 nt, Human
acuucccagugaauucu

SEQ ID NO: 3051672 - RNA, 13 nt, Human
ucuagauacugua

SEQ ID NO: 3051673 - RNA, 24 nt, Human
ucuagauacuguaucaugacaaag

SEQ ID NO: 3051674 - RNA, 13 nt, Human
ucuauaauuuaaa

SEQ ID NO: 3051675 - RNA, 23 nt, Human
ucuaguuugauuaaauucuugca

SEQ ID NO: 3051676 - RNA, 22 nt, Human
ucuaguuugauuaaauucuugc

SEQ ID NO: 3051677 - RNA, 21 nt, Human
acauuguaaauaguauuugag

SEQ ID NO: 3051678 - RNA, 19 nt, Human
acauuguaaauaguauuug

SEQ ID NO: 3051679 - RNA, 17 nt, Human
acauuguaaauaguauu

SEQ ID NO: 3051680 - RNA, 22 nt, Human
acauugcggacagccacggcca

SEQ ID NO: 3051681 - RNA, 21 nt, Human
acauugcggacagccacggcc

SEQ ID NO: 3051682 - RNA, 16 nt, Human
acauuggaaacaaguc

SEQ ID NO: 3051683 - RNA, 18 nt, Human
acauuuuuaagugcugca

SEQ ID NO: 3051684 - RNA, 15 nt, Human
acauuuuuaagugcu

SEQ ID NO: 3051685 - RNA, 23 nt, Human
acauuuuucuuagggaaggauac

SEQ ID NO: 3051686 - RNA, 13 nt, Human
acauuuuucuuag

SEQ ID NO: 3051687 - RNA, 21 nt, Human
acauuuuuuaaaugcaccugg

SEQ ID NO: 3051688 - RNA, 22 nt, Human
ucaauaggaaaaacugauuuuu

SEQ ID NO: 3051689 - RNA, 23 nt, Human
ucaauauuucagauaaucacaau

SEQ ID NO: 3051690 - RNA, 18 nt, Human
ucaauaggaaaaacugau

SEQ ID NO: 3051691 - RNA, 19 nt, Human
ucaauaggaaaaacugauu

SEQ ID NO: 3051692 - RNA, 17 nt, Human
ucaauaggaaaaacuga

SEQ ID NO: 3051693 - RNA, 17 nt, Human
ucaagugauucuccugc

SEQ ID NO: 3051694 - RNA, 16 nt, Human
ucaagugauucuccug

SEQ ID NO: 3051695 - RNA, 17 nt, Human
ucaagagggucugagga

SEQ ID NO: 3051696 - RNA, 23 nt, Human
ucaaggauccugagccagauuuc

SEQ ID NO: 3051697 - RNA, 18 nt, Human
accaaauaaaaauauugu

SEQ ID NO: 3051698 - RNA, 16 nt, Human
accaaauaaaaauauu

SEQ ID NO: 3051699 - RNA, 19 nt, Human
accaaaucagcugcuacua

SEQ ID NO: 3051700 - RNA, 16 nt, Human
accaaaucagcugcua

SEQ ID NO: 3051701 - RNA, 20 nt, Human
accaaccacugcgaccacaa

SEQ ID NO: 3051702 - RNA, 16 nt, Human
accaacauacucccau

SEQ ID NO: 3051703 - RNA, 19 nt, Human
accaacacgagcaggcuac

SEQ ID NO: 3051704 - RNA, 14 nt, Human
accaacacgagcag

SEQ ID NO: 3051705 - RNA, 23 nt, Human
accacacccagcccacuucugcc

SEQ ID NO: 3051706 - RNA, 21 nt, Human
accacacccagcccacuucug

SEQ ID NO: 3051707 - RNA, 20 nt, Human
accacacccagcccacuucu

SEQ ID NO: 3051708 - RNA, 16 nt, Human
accacacccagcccac

SEQ ID NO: 3051709 - RNA, 15 nt, Human
accacacccagccca

SEQ ID NO: 3051710 - RNA, 17 nt, Human
accacacagaggcugcc

SEQ ID NO: 3051711 - RNA, 16 nt, Human
accacaagacugcaca

SEQ ID NO: 3051712 - RNA, 16 nt, Human
ucaccagccccagugc

SEQ ID NO: 3051713 - RNA, 17 nt, Human
ucaccagccccagugcc

SEQ ID NO: 3051714 - RNA, 13 nt, Human
ucacauuccugaa

SEQ ID NO: 3051715 - RNA, 17 nt, Human
ucacauuccugaacagg

SEQ ID NO: 3051716 - RNA, 20 nt, Human
ucacauauugauuuccguua

SEQ ID NO: 3051717 - RNA, 18 nt, Human
ucacauauugauuuccgu

SEQ ID NO: 3051718 - RNA, 16 nt, Human
ucacauauugauuucc

SEQ ID NO: 3051719 - RNA, 22 nt, Human
ucacagcuuauuuccucauuuu

SEQ ID NO: 3051720 - RNA, 14 nt, Human
ucacagaugggugc

SEQ ID NO: 3051721 - RNA, 15 nt, Human
ucacagaugggugcu

SEQ ID NO: 3051722 - RNA, 23 nt, Human
ucacagccagacuggcacaguuu

SEQ ID NO: 3051723 - RNA, 17 nt, Human
ucacagccagacuggca

SEQ ID NO: 3051724 - RNA, 19 nt, Human
ucacagcuccaagaauuuc

SEQ ID NO: 3051725 - RNA, 12 nt, Human
ucaauuuaaaaa

SEQ ID NO: 3051726 - RNA, 13 nt, Human
ucaauuuaaaaaa

SEQ ID NO: 3051727 - RNA, 16 nt, Human
ucacagaccuuugaac

SEQ ID NO: 3051728 - RNA, 14 nt, Human
uauuuuaauaaaca

SEQ ID NO: 3051729 - RNA, 17 nt, Human
uauuuuaauaaacacuc

SEQ ID NO: 3051730 - RNA, 19 nt, Human
uauuuuaauaauguuucaa

SEQ ID NO: 3051731 - RNA, 13 nt, Human
uauuuuacauaaa

SEQ ID NO: 3051732 - RNA, 22 nt, Human
uauuuuaauaauguuucaaaca

SEQ ID NO: 3051733 - RNA, 15 nt, Human
uauuuugcuuuguga

SEQ ID NO: 3051734 - RNA, 13 nt, Human
uauuuugcuuugu

SEQ ID NO: 3051735 - RNA, 20 nt, Human
uauuuugcuuugugauuuuu

SEQ ID NO: 3051736 - RNA, 20 nt, Human
uauuuuguguuuaggaacua

SEQ ID NO: 3051737 - RNA, 15 nt, Human
uauuuuguucauaca

SEQ ID NO: 3051738 - RNA, 16 nt, Human
uauuuuguucauacau

SEQ ID NO: 3051739 - RNA, 17 nt, Human
uauuuuguguuuaggaa

SEQ ID NO: 3051740 - RNA, 12 nt, Human
uauuuuucacau

SEQ ID NO: 3051741 - RNA, 13 nt, Human
uauuuuucacaua

SEQ ID NO: 3051742 - RNA, 13 nt, Human
uauuuuuguagca

SEQ ID NO: 3051743 - RNA, 17 nt, Human
uauuuuuguagagccag

SEQ ID NO: 3051744 - RNA, 19 nt, Human
uaugugccagauuuaugca

SEQ ID NO: 3051745 - RNA, 14 nt, Human
uaugugccagauuu

SEQ ID NO: 3051746 - RNA, 14 nt, Human
uauguguaaaaugu

SEQ ID NO: 3051747 - RNA, 16 nt, Human
acaucuugcucugcug

SEQ ID NO: 3051748 - RNA, 15 nt, Human
acaucuugcucugcu

SEQ ID NO: 3051749 - RNA, 17 nt, Human
acaucuugcucugcuga

SEQ ID NO: 3051750 - RNA, 22 nt, Human
acaucuugcucugcugacagac

SEQ ID NO: 3051751 - RNA, 19 nt, Human
acaucuuggucagauuuga

SEQ ID NO: 3051752 - RNA, 14 nt, Human
acaucuugcucugc

SEQ ID NO: 3051753 - RNA, 22 nt, Human
uauuuuaagacgaaacauuugu

SEQ ID NO: 3051754 - RNA, 14 nt, Human
uauuuuaagacgaa

SEQ ID NO: 3051755 - RNA, 18 nt, Human
uauuuuaaaagaaugauu

SEQ ID NO: 3051756 - RNA, 14 nt, Human
uauuuuaaaagaau

SEQ ID NO: 3051757 - RNA, 15 nt, Human
acaugaaaacacauu

SEQ ID NO: 3051758 - RNA, 13 nt, Human
ucaaauauauuca

SEQ ID NO: 3051759 - RNA, 23 nt, Human
ucaaauacgugggcauucaaaug

SEQ ID NO: 3051760 - RNA, 20 nt, Human
ucaaauacgugggcauucaa

SEQ ID NO: 3051761 - RNA, 21 nt, Human
ucaaauacgugggcauucaaa

SEQ ID NO: 3051762 - RNA, 22 nt, Human
ucaaauacgugggcauucaaau

SEQ ID NO: 3051763 - RNA, 22 nt, Human
acaugaaaacacauuuuucuua

SEQ ID NO: 3051764 - RNA, 23 nt, Human
acaugaaaacacauuuuucuuag

SEQ ID NO: 3051765 - RNA, 13 nt, Human
acaugagcaucag

SEQ ID NO: 3051766 - RNA, 15 nt, Human
uauuuuuguagcacu

SEQ ID NO: 3051767 - RNA, 19 nt, Human
uauuuuuguagcacugaca

SEQ ID NO: 3051768 - RNA, 16 nt, Human
ucaaaagcugggcagg

SEQ ID NO: 3051769 - RNA, 13 nt, Human
ucaaacagucuca

SEQ ID NO: 3051770 - RNA, 21 nt, Human
ucaaacagucucaggaaauca

SEQ ID NO: 3051771 - RNA, 20 nt, Human
ucaaacagucucaggaaauc

SEQ ID NO: 3051772 - RNA, 20 nt, Human
ucaaagauauuuugcuuugu

SEQ ID NO: 3051773 - RNA, 13 nt, Human
ucaaagauauuuu

SEQ ID NO: 3051774 - RNA, 22 nt, Human
ucaaagauauuuugcuuuguga

SEQ ID NO: 3051775 - RNA, 21 nt, Human
acaugucuuuucuugcaugag

SEQ ID NO: 3051776 - RNA, 18 nt, Human
acauggaauaacauguaa

SEQ ID NO: 3051777 - RNA, 14 nt, Human
acauggaaguacua

SEQ ID NO: 3051778 - RNA, 20 nt, Human
acauggaauaacauguaauu

SEQ ID NO: 3051779 - RNA, 20 nt, Human
acaugagcaucaggccaggc

SEQ ID NO: 3051780 - RNA, 23 nt, Human
acaugagcaucaggccaggcccu

SEQ ID NO: 3051781 - RNA, 19 nt, Human
acauggaguauaugucaag

SEQ ID NO: 3051782 - RNA, 15 nt, Human
acauggaguauaugu

SEQ ID NO: 3051783 - RNA, 14 nt, Human
acauggccuuugcu

SEQ ID NO: 3051784 - RNA, 22 nt, Human
accccagcuggggccaggcugg

SEQ ID NO: 3051785 - RNA, 19 nt, Human
accccagcuggggccaggc

SEQ ID NO: 3051786 - RNA, 11 nt, Human
acccaggugcu

SEQ ID NO: 3051787 - RNA, 23 nt, Human
acccaggugcuaggaacacuccu

SEQ ID NO: 3051788 - RNA, 13 nt, Human
accccagguuucu

SEQ ID NO: 3051789 - RNA, 15 nt, Human
acccaggagccccga

SEQ ID NO: 3051790 - RNA, 13 nt, Human
acccaggagcccc

SEQ ID NO: 3051791 - RNA, 17 nt, Human
acccagcgagcccuggu

SEQ ID NO: 3051792 - RNA, 16 nt, Human
acccagcgagcccugg

SEQ ID NO: 3051793 - RNA, 13 nt, Human
acccagcgagccc

SEQ ID NO: 3051794 - RNA, 12 nt, Human
ucagcccucaga

SEQ ID NO: 3051795 - RNA, 16 nt, Human
ucagaauagaaauuag

SEQ ID NO: 3051796 - RNA, 23 nt, Human
ucagaaguuucugccgcagcccu

SEQ ID NO: 3051797 - RNA, 12 nt, Human
ucagaauucuca

SEQ ID NO: 3051798 - RNA, 10 nt, Human
ucagaauucu

SEQ ID NO: 3051799 - RNA, 20 nt, Human
ucagaauucucagaaucuca

SEQ ID NO: 3051800 - RNA, 22 nt, Human
ucagagacuccugcaggcagcc

SEQ ID NO: 3051801 - RNA, 16 nt, Human
ucagaucucuaacuuc

SEQ ID NO: 3051802 - RNA, 15 nt, Human
ucagaucucuaacuu

SEQ ID NO: 3051803 - RNA, 23 nt, Human
ucagagacuccugcaggcagcca

SEQ ID NO: 3051804 - RNA, 23 nt, Human
ucacugagacagcccgggcucug

SEQ ID NO: 3051805 - RNA, 21 nt, Human
ucacuauguugcccaggcagg

SEQ ID NO: 3051806 - RNA, 20 nt, Human
ucacuauguugcccaggcag

SEQ ID NO: 3051807 - RNA, 22 nt, Human
ucaccagccccagugcccacag

SEQ ID NO: 3051808 - RNA, 19 nt, Human
ucacauuccugaacaggau

SEQ ID NO: 3051809 - RNA, 14 nt, Human
ucacuguugcccag

SEQ ID NO: 3051810 - RNA, 18 nt, Human
ucacugcaaccuccgccu

SEQ ID NO: 3051811 - RNA, 15 nt, Human
ucacuguugcccagg

SEQ ID NO: 3051812 - RNA, 21 nt, Human
acccagauaaagguucaugca

SEQ ID NO: 3051813 - RNA, 20 nt, Human
acccacugcuuuuggucugu

SEQ ID NO: 3051814 - RNA, 16 nt, Human
acccaaauguucauca

SEQ ID NO: 3051815 - RNA, 20 nt, Human
acccaaauguucaucaauga

SEQ ID NO: 3051816 - RNA, 20 nt, Human
accauucuccaccugccagg

SEQ ID NO: 3051817 - RNA, 21 nt, Human
accauucuccaccugccaggg

SEQ ID NO: 3051818 - RNA, 19 nt, Human
accauucuccaccugccag

SEQ ID NO: 3051819 - RNA, 22 nt, Human
accauuuugcugucccuuuucc

SEQ ID NO: 3051820 - RNA, 23 nt, Human
accauuuugcugucccuuuuccu

SEQ ID NO: 3051821 - RNA, 21 nt, Human
accauuuugggguacccacug

SEQ ID NO: 3051822 - RNA, 24 nt, Human
ucauaaagcaggcagaacucaucu

SEQ ID NO: 3051823 - RNA, 18 nt, Human
ucauaaauaaaguuuguu

SEQ ID NO: 3051824 - RNA, 19 nt, Human
ucaguuguuagugugucuu

SEQ ID NO: 3051825 - RNA, 13 nt, Human
ucaguggcagcug

SEQ ID NO: 3051826 - RNA, 18 nt, Human
ucagugccuuauggaaca

SEQ ID NO: 3051827 - RNA, 16 nt, Human
ucaguggcagcugcuu

SEQ ID NO: 3051828 - RNA, 17 nt, Human
ucaguuguuaguguguc

SEQ ID NO: 3051829 - RNA, 15 nt, Human
ucaguggcagcugcu

SEQ ID NO: 3051830 - RNA, 14 nt, Human
ucaguggcagcugc

SEQ ID NO: 3051831 - RNA, 19 nt, Human
ucagugccuuauggaacac

SEQ ID NO: 3051832 - RNA, 20 nt, Human
ucagugccuuauggaacacu

SEQ ID NO: 3051833 - RNA, 22 nt, Human
ucagugccuuauggaacacucu

SEQ ID NO: 3051834 - RNA, 23 nt, Human
ucagugccuuauggaacacucug

SEQ ID NO: 3051835 - RNA, 13 nt, Human
ucaguagucagac

SEQ ID NO: 3051836 - RNA, 21 nt, Human
ucagguggggucacucuggca

SEQ ID NO: 3051837 - RNA, 22 nt, Human
ucagguggggucacucuggcag

SEQ ID NO: 3051838 - RNA, 21 nt, Human
accgaaaacguggcugcuuca

SEQ ID NO: 3051839 - RNA, 22 nt, Human
accgaaaacguggcugcuucaa

SEQ ID NO: 3051840 - RNA, 18 nt, Human
ucaggugucccugcacuu

SEQ ID NO: 3051841 - RNA, 17 nt, Human
ucaggugucccugcacu

SEQ ID NO: 3051842 - RNA, 23 nt, Human
ucagguggggucacucuggcagc

SEQ ID NO: 3051843 - RNA, 15 nt, Human
ucaggugucccugca

SEQ ID NO: 3051844 - RNA, 20 nt, Human
accgaaaacguggcugcuuc

SEQ ID NO: 3051845 - RNA, 20 nt, Human
acccuugccgucuaccugag

SEQ ID NO: 3051846 - RNA, 13 nt, Human
ucaguaauaacuc

SEQ ID NO: 3051847 - RNA, 13 nt, Human
ucaguaagccgug

SEQ ID NO: 3051848 - RNA, 22 nt, Human
ucaggugucccugcacuugcag

SEQ ID NO: 3051849 - RNA, 19 nt, Human
ucaggccaggcccucugcc

SEQ ID NO: 3051850 - RNA, 17 nt, Human
ucaggccaggcccucug

SEQ ID NO: 3051851 - RNA, 18 nt, Human
ucaggccaggcccucugc

SEQ ID NO: 3051852 - RNA, 12 nt, Human
ucaggggugugc

SEQ ID NO: 3051853 - RNA, 19 nt, Human
ucaggggugugcggccuuu

SEQ ID NO: 3051854 - RNA, 17 nt, Human
ucaggguuggccccugc

SEQ ID NO: 3051855 - RNA, 19 nt, Human
ucaggguuggccccugccc

SEQ ID NO: 3051856 - RNA, 18 nt, Human
ucaggguuggccccugcc

SEQ ID NO: 3051857 - RNA, 19 nt, Human
acccgcuaagagggaggga

SEQ ID NO: 3051858 - RNA, 13 nt, Human
ucaggccagcugc

SEQ ID NO: 3051859 - RNA, 12 nt, Human
ucaggccaggcc

SEQ ID NO: 3051860 - RNA, 13 nt, Human
ucaggccaggccc

SEQ ID NO: 3051861 - RNA, 14 nt, Human
ucaggccaggcccu

SEQ ID NO: 3051862 - RNA, 15 nt, Human
ucaggccaggcccuc

SEQ ID NO: 3051863 - RNA, 16 nt, Human
ucaggccaggcccucu

SEQ ID NO: 3051864 - RNA, 12 nt, Human
acccccagccug

SEQ ID NO: 3051865 - RNA, 13 nt, Human
acccccagccugc

SEQ ID NO: 3051866 - RNA, 18 nt, Human
ucaggcaggugggaugga

SEQ ID NO: 3051867 - RNA, 17 nt, Human
ucaggcaggugggaugg

SEQ ID NO: 3051868 - RNA, 23 nt, Human
acccugaggcccagagggccugc

SEQ ID NO: 3051869 - RNA, 11 nt, Human
acccugaggcc

SEQ ID NO: 3051870 - RNA, 17 nt, Human
acccugaggcccagagg

SEQ ID NO: 3051871 - RNA, 19 nt, Human
acccugaggcccagagggc

SEQ ID NO: 3051872 - RNA, 21 nt, Human
acccugaggcccagagggccu

SEQ ID NO: 3051873 - RNA, 14 nt, Human
acccucgaggcgga

SEQ ID NO: 3051874 - RNA, 19 nt, Human
acccgggaagggggcuggg

SEQ ID NO: 3051875 - RNA, 20 nt, Human
acccgggaagggggcuggga

SEQ ID NO: 3051876 - RNA, 17 nt, Human
acccucauguucuuaau

SEQ ID NO: 3051877 - RNA, 15 nt, Human
acccucauguucuua

SEQ ID NO: 3051878 - RNA, 14 nt, Human
acccucauguucuu

SEQ ID NO: 3051879 - RNA, 22 nt, Human
acccgggaagggggcugggaca

SEQ ID NO: 3051880 - RNA, 21 nt, Human
acccuccuuucaccacaugug

SEQ ID NO: 3051881 - RNA, 14 nt, Human
acucagaauauugc

SEQ ID NO: 3051882 - RNA, 14 nt, Human
acucagaauucucu

SEQ ID NO: 3051883 - RNA, 22 nt, Human
acucagaauucucuaguuugau

SEQ ID NO: 3051884 - RNA, 21 nt, Human
acucagaauucucuaguuuga

SEQ ID NO: 3051885 - RNA, 18 nt, Human
acucagaagacacugaug

SEQ ID NO: 3051886 - RNA, 17 nt, Human
acucagaagacacugau

SEQ ID NO: 3051887 - RNA, 16 nt, Human
acucagaagacacuga

SEQ ID NO: 3051888 - RNA, 15 nt, Human
acucagaagacacug

SEQ ID NO: 3051889 - RNA, 14 nt, Human
acucagaagacacu

SEQ ID NO: 3051890 - RNA, 14 nt, Human
acucaccugccccu

SEQ ID NO: 3051891 - RNA, 19 nt, Human
acucaccugccccucaacu

SEQ ID NO: 3051892 - RNA, 21 nt, Human
acucaccugccccucaacucu

SEQ ID NO: 3051893 - RNA, 23 nt, Human
acucaucuagguaaauuacaguu

SEQ ID NO: 3051894 - RNA, 21 nt, Human
acucaucuagguaaauuacag

SEQ ID NO: 3051895 - RNA, 12 nt, Human
acucaucuuagg

SEQ ID NO: 3051896 - RNA, 16 nt, Human
acucauugaccugagg

SEQ ID NO: 3051897 - RNA, 17 nt, Human
acucauugaccugaggc

SEQ ID NO: 3051898 - RNA, 21 nt, Human
acuccaaacugacucuuaaga

SEQ ID NO: 3051899 - RNA, 18 nt, Human
acucauugaccugaggcc

SEQ ID NO: 3051900 - RNA, 20 nt, Human
acucauuuuaaaaaauggaa

SEQ ID NO: 3051901 - RNA, 13 nt, Human
ucccucuuucccu

SEQ ID NO: 3051902 - RNA, 11 nt, Human
ucccucuuucc

SEQ ID NO: 3051903 - RNA, 18 nt, Human
ucccucagucuggcccuu

SEQ ID NO: 3051904 - RNA, 21 nt, Human
ucccugaaggccccgcccagg

SEQ ID NO: 3051905 - RNA, 22 nt, Human
ucccugaaggccccgcccaggc

SEQ ID NO: 3051906 - RNA, 18 nt, Human
ucccugaaggccccgccc

SEQ ID NO: 3051907 - RNA, 17 nt, Human
ucccugaaggccccgcc

SEQ ID NO: 3051908 - RNA, 17 nt, Human
acucaccccagccccaa

SEQ ID NO: 3051909 - RNA, 23 nt, Human
ucccugaaggccccgcccaggcu

SEQ ID NO: 3051910 - RNA, 22 nt, Human
acuaugacauaaaaacaacuuu

SEQ ID NO: 3051911 - RNA, 14 nt, Human
acuauaauguaagc

SEQ ID NO: 3051912 - RNA, 13 nt, Human
acuauaauguaag

SEQ ID NO: 3051913 - RNA, 12 nt, Human
acuauaauguaa

SEQ ID NO: 3051914 - RNA, 12 nt, Human
acuauguaucaa

SEQ ID NO: 3051915 - RNA, 16 nt, Human
acuauucaaacagucu

SEQ ID NO: 3051916 - RNA, 14 nt, Human
acuauucaaacagu

SEQ ID NO: 3051917 - RNA, 13 nt, Human
acuauucaaacag

SEQ ID NO: 3051918 - RNA, 14 nt, Human
acucaaugcacuga

SEQ ID NO: 3051919 - RNA, 20 nt, Human
acucacauuuauucugcuca

SEQ ID NO: 3051920 - RNA, 19 nt, Human
acucacauuuauucugcuc

SEQ ID NO: 3051921 - RNA, 18 nt, Human
acuacggaauaguuggcu

SEQ ID NO: 3051922 - RNA, 20 nt, Human
acuagaguuuagcuggaaaa

SEQ ID NO: 3051923 - RNA, 14 nt, Human
acguacacauuuua

SEQ ID NO: 3051924 - RNA, 13 nt, Human
acguacacauuuu

SEQ ID NO: 3051925 - RNA, 12 nt, Human
acguacacauuu

SEQ ID NO: 3051926 - RNA, 13 nt, Human
acguacacacaca

SEQ ID NO: 3051927 - RNA, 13 nt, Human
acugaaacuuccc

SEQ ID NO: 3051928 - RNA, 19 nt, Human
acucuuucuauuguuucuu

SEQ ID NO: 3051929 - RNA, 15 nt, Human
uccugaagaauugaa

SEQ ID NO: 3051930 - RNA, 23 nt, Human
uccucuuuggucuacacugugcu

SEQ ID NO: 3051931 - RNA, 21 nt, Human
uccugaaaacccuugccaugu

SEQ ID NO: 3051932 - RNA, 19 nt, Human
acucuugaaaaaugcaugu

SEQ ID NO: 3051933 - RNA, 14 nt, Human
acucuugaaaaaug

SEQ ID NO: 3051934 - RNA, 14 nt, Human
uccucccaccucag

SEQ ID NO: 3051935 - RNA, 13 nt, Human
uccucccaccuca

SEQ ID NO: 3051936 - RNA, 20 nt, Human
uccucccaccucagccuccc

SEQ ID NO: 3051937 - RNA, 18 nt, Human
uccucccaccucagccuc

SEQ ID NO: 3051938 - RNA, 16 nt, Human
uccucccaccucagcc

SEQ ID NO: 3051939 - RNA, 15 nt, Human
uccucccaccucagc

SEQ ID NO: 3051940 - RNA, 21 nt, Human
uccucccaccucagccucccg

SEQ ID NO: 3051941 - RNA, 17 nt, Human
uccucuccccaugaugu

SEQ ID NO: 3051942 - RNA, 20 nt, Human
uccuagcacuuugggaggcc

SEQ ID NO: 3051943 - RNA, 21 nt, Human
uccuagccugugccucuggga

SEQ ID NO: 3051944 - RNA, 16 nt, Human
acucgaguuacagaca

SEQ ID NO: 3051945 - RNA, 13 nt, Human
uccguuaaaauac

SEQ ID NO: 3051946 - RNA, 15 nt, Human
uccguuaaaauacca

SEQ ID NO: 3051947 - RNA, 18 nt, Human
uccggcccuccagagccc

SEQ ID NO: 3051948 - RNA, 14 nt, Human
uccggcccuccaga

SEQ ID NO: 3051949 - RNA, 14 nt, Human
acuccagaaaguga

SEQ ID NO: 3051950 - RNA, 13 nt, Human
acucuugaaaaau

SEQ ID NO: 3051951 - RNA, 19 nt, Human
acucuggcagcucagagag

SEQ ID NO: 3051952 - RNA, 20 nt, Human
acucuggcagcucagagagg

SEQ ID NO: 3051953 - RNA, 21 nt, Human
acucuuauugcccacgcugga

SEQ ID NO: 3051954 - RNA, 16 nt, Human
acucuggcagcucaga

SEQ ID NO: 3051955 - RNA, 17 nt, Human
acucuggcagcucagag

SEQ ID NO: 3051956 - RNA, 15 nt, Human
acucgcgacaaugca

SEQ ID NO: 3051957 - RNA, 16 nt, Human
acucgcgacaaugcaa

SEQ ID NO: 3051958 - RNA, 16 nt, Human
ucauaauaaguugcau

SEQ ID NO: 3051959 - RNA, 12 nt, Human
ucauaaugacuu

SEQ ID NO: 3051960 - RNA, 19 nt, Human
accugaauuuuggcugugu

SEQ ID NO: 3051961 - RNA, 18 nt, Human
accugaagacucauucuu

SEQ ID NO: 3051962 - RNA, 23 nt, Human
accugaggcccuucucuccagcc

SEQ ID NO: 3051963 - RNA, 12 nt, Human
accugagcccca

SEQ ID NO: 3051964 - RNA, 17 nt, Human
accugagccccaaaagg

SEQ ID NO: 3051965 - RNA, 14 nt, Human
accugaggggccuc

SEQ ID NO: 3051966 - RNA, 15 nt, Human
accugccaggaagcc

SEQ ID NO: 3051967 - RNA, 18 nt, Human
accugccaggaagccagc

SEQ ID NO: 3051968 - RNA, 16 nt, Human
accugccaggaagcca

SEQ ID NO: 3051969 - RNA, 17 nt, Human
accugccaggaagccag

SEQ ID NO: 3051970 - RNA, 19 nt, Human
uccaaaaagauuuucagaa

SEQ ID NO: 3051971 - RNA, 17 nt, Human
ucauuuuuuuuaagaaa

SEQ ID NO: 3051972 - RNA, 18 nt, Human
ucauuuuuuuuaagaaaa

SEQ ID NO: 3051973 - RNA, 19 nt, Human
ucauuuuuaguagagacag

SEQ ID NO: 3051974 - RNA, 14 nt, Human
ucauuugucacaca

SEQ ID NO: 3051975 - RNA, 16 nt, Human
ucauuugucacacacu

SEQ ID NO: 3051976 - RNA, 23 nt, Human
accugccuguugggccaggagcc

SEQ ID NO: 3051977 - RNA, 21 nt, Human
accugcgucucauacucaccu

SEQ ID NO: 3051978 - RNA, 16 nt, Human
accugcggugcuaucu

SEQ ID NO: 3051979 - RNA, 20 nt, Human
accuggaauauauaaccagu

SEQ ID NO: 3051980 - RNA, 20 nt, Human
uccaaaaagauuuucagaaa

SEQ ID NO: 3051981 - RNA, 12 nt, Human
accuggccucug

SEQ ID NO: 3051982 - RNA, 13 nt, Human
accuggccucugc

SEQ ID NO: 3051983 - RNA, 17 nt, Human
uccacccaggagccccg

SEQ ID NO: 3051984 - RNA, 13 nt, Human
uccacccaccuca

SEQ ID NO: 3051985 - RNA, 18 nt, Human
uccaccaucaagccacca

SEQ ID NO: 3051986 - RNA, 12 nt, Human
uccacccaccuc

SEQ ID NO: 3051987 - RNA, 20 nt, Human
uccacccaggagccccgagg

SEQ ID NO: 3051988 - RNA, 21 nt, Human
accuggguaacuagggaagau

SEQ ID NO: 3051989 - RNA, 18 nt, Human
accuuuuuuauacauaaa

SEQ ID NO: 3051990 - RNA, 17 nt, Human
accuuuuuuauacauaa

SEQ ID NO: 3051991 - RNA, 16 nt, Human
accuuuuuuauacaua

SEQ ID NO: 3051992 - RNA, 14 nt, Human
accuuuguccccac

SEQ ID NO: 3051993 - RNA, 15 nt, Human
accuuuguccccacc

SEQ ID NO: 3051994 - RNA, 16 nt, Human
accuuuguccccaccg

SEQ ID NO: 3051995 - RNA, 14 nt, Human
accuuuuuuauaca

SEQ ID NO: 3051996 - RNA, 13 nt, Human
accuuugucccca

SEQ ID NO: 3051997 - RNA, 16 nt, Human
accuugacagggcaca

SEQ ID NO: 3051998 - RNA, 22 nt, Human
accuucuccuucaccuuugucc

SEQ ID NO: 3051999 - RNA, 14 nt, Human
accuucuccuucac

SEQ ID NO: 3052000 - RNA, 22 nt, Human
acgaagaguauuuuugacagaa

SEQ ID NO: 3052001 - RNA, 20 nt, Human
acgaagaguauuuuugacag

SEQ ID NO: 3052002 - RNA, 14 nt, Human
uccaggcugggaga

SEQ ID NO: 3052003 - RNA, 17 nt, Human
uccaggcugggagagcc

SEQ ID NO: 3052004 - RNA, 18 nt, Human
uccaggcugggagagccu

SEQ ID NO: 3052005 - RNA, 22 nt, Human
uccaggcuccuuuagcgcccag

SEQ ID NO: 3052006 - RNA, 18 nt, Human
acgccaggggaaaaucag

SEQ ID NO: 3052007 - RNA, 15 nt, Human
acgacugcccggcag

SEQ ID NO: 3052008 - RNA, 23 nt, Human
acgccaggggaaaaucagccugc

SEQ ID NO: 3052009 - RNA, 11 nt, Human
acgccauccca

SEQ ID NO: 3052010 - RNA, 14 nt, Human
acgccaucccagcc

SEQ ID NO: 3052011 - RNA, 15 nt, Human
acgccaucccagccc

SEQ ID NO: 3052012 - RNA, 16 nt, Human
acgccaucccagcccc

SEQ ID NO: 3052013 - RNA, 17 nt, Human
acgccaucccagcccca

SEQ ID NO: 3052014 - RNA, 18 nt, Human
acgccaucccagccccaa

SEQ ID NO: 3052015 - RNA, 16 nt, Human
acggccaggccagagg

SEQ ID NO: 3052016 - RNA, 13 nt, Human
acggccaggccag

SEQ ID NO: 3052017 - RNA, 19 nt, Human
acggagucccaccuuggcu

SEQ ID NO: 3052018 - RNA, 17 nt, Human
acgcucucuggccuucg

SEQ ID NO: 3052019 - RNA, 13 nt, Human
acgcuacccggga

SEQ ID NO: 3052020 - RNA, 17 nt, Human
acgcuacccgggaaggg

SEQ ID NO: 3052021 - RNA, 14 nt, Human
acgcucucuggccu

SEQ ID NO: 3052022 - RNA, 15 nt, Human
acgcucucuggccuu

SEQ ID NO: 3052023 - RNA, 16 nt, Human
acgcucucuggccuuc

SEQ ID NO: 3052024 - RNA, 14 nt, Human
acgcccccacuggu

SEQ ID NO: 3052025 - RNA, 23 nt, Human
acgcgugcacacaccagagccca

SEQ ID NO: 3052026 - RNA, 20 nt, Human
acgcgugcacacaccagagc

SEQ ID NO: 3052027 - RNA, 20 nt, Human
uccaucucuuguuuaaauuc

SEQ ID NO: 3052028 - RNA, 22 nt, Human
uccaugaagauguagaggagaa

SEQ ID NO: 3052029 - RNA, 15 nt, Human
uccaugaguccccug

SEQ ID NO: 3052030 - RNA, 16 nt, Human
uccaugaguccccugu

SEQ ID NO: 3052031 - RNA, 17 nt, Human
uccaugaguccccuguu

SEQ ID NO: 3052032 - RNA, 20 nt, Human
uccagugaggcucugcccuu

SEQ ID NO: 3052033 - RNA, 18 nt, Human
uccagugaggcucugccc

SEQ ID NO: 3052034 - RNA, 19 nt, Human
uccagugaggcucugcccu

SEQ ID NO: 3052035 - RNA, 17 nt, Human
uccagugaggcucugcc

SEQ ID NO: 3052036 - RNA, 14 nt, Human
uccagugagacagc

SEQ ID NO: 3052037 - RNA, 14 nt, Human
acggcucacugcag

SEQ ID NO: 3052038 - RNA, 16 nt, Human
ucccaaagugcuggga

SEQ ID NO: 3052039 - RNA, 15 nt, Human
ucccaaagugcuggg

SEQ ID NO: 3052040 - RNA, 14 nt, Human
ucccacaaaggaga

SEQ ID NO: 3052041 - RNA, 11 nt, Human
ucccaccccac

SEQ ID NO: 3052042 - RNA, 14 nt, Human
ucccaccccacaca

SEQ ID NO: 3052043 - RNA, 14 nt, Human
uagaggguguguaa

SEQ ID NO: 3052044 - RNA, 15 nt, Human
uagcacagacccugc

SEQ ID NO: 3052045 - RNA, 20 nt, Human
uagcacagacccugcccugu

SEQ ID NO: 3052046 - RNA, 21 nt, Human
uagcacagacccugcccugug

SEQ ID NO: 3052047 - RNA, 14 nt, Human
uagcacagacccug

SEQ ID NO: 3052048 - RNA, 14 nt, Human
uagcacugacagau

SEQ ID NO: 3052049 - RNA, 19 nt, Human
uagcacugacagauuucca

SEQ ID NO: 3052050 - RNA, 22 nt, Human
uagcacagacccugcccugugg

SEQ ID NO: 3052051 - RNA, 12 nt, Human
uagccaaggcca

SEQ ID NO: 3052052 - RNA, 13 nt, Human
uagccaaggccaa

SEQ ID NO: 3052053 - RNA, 18 nt, Human
acaaaaggauaaugaaua

SEQ ID NO: 3052054 - RNA, 12 nt, Human
aauuuuacauuu

SEQ ID NO: 3052055 - RNA, 20 nt, Human
aauuuuacauggcuggagcu

SEQ ID NO: 3052056 - RNA, 13 nt, Human
acaaaaacacagc

SEQ ID NO: 3052057 - RNA, 16 nt, Human
acaaaaagcauaaaaa

SEQ ID NO: 3052058 - RNA, 16 nt, Human
acaaaaagcuacuuau

SEQ ID NO: 3052059 - RNA, 15 nt, Human
acaaaaacacagcaa

SEQ ID NO: 3052060 - RNA, 14 nt, Human
acaaaaacacagca

SEQ ID NO: 3052061 - RNA, 22 nt, Human
uagagcggagaaaggaagggcu

SEQ ID NO: 3052062 - RNA, 14 nt, Human
uagagccagggucu

SEQ ID NO: 3052063 - RNA, 17 nt, Human
aauuccaauuauaugag

SEQ ID NO: 3052064 - RNA, 15 nt, Human
uagaacucccuuuca

SEQ ID NO: 3052065 - RNA, 16 nt, Human
uagaacucccuuucaa

SEQ ID NO: 3052066 - RNA, 17 nt, Human
uagaacucccuuucaac

SEQ ID NO: 3052067 - RNA, 15 nt, Human
uagaaacacaacuau

SEQ ID NO: 3052068 - RNA, 16 nt, Human
aauuuggauugcuaau

SEQ ID NO: 3052069 - RNA, 14 nt, Human
aauuugugauacaa

SEQ ID NO: 3052070 - RNA, 18 nt, Human
aauuugugauacaaugcu

SEQ ID NO: 3052071 - RNA, 17 nt, Human
aauuugugauacaaugc

SEQ ID NO: 3052072 - RNA, 17 nt, Human
uagacagucccugccaa

SEQ ID NO: 3052073 - RNA, 21 nt, Human
uagacagucccugccaaugga

SEQ ID NO: 3052074 - RNA, 18 nt, Human
uagacaauuuauuauggc

SEQ ID NO: 3052075 - RNA, 13 nt, Human
uagacacacauga

SEQ ID NO: 3052076 - RNA, 16 nt, Human
uagacagucccugcca

SEQ ID NO: 3052077 - RNA, 10 nt, Human
uagacagagu

SEQ ID NO: 3052078 - RNA, 20 nt, Human
uagaauuugauaugugaaca

SEQ ID NO: 3052079 - RNA, 19 nt, Human
uagaauuugauaugugaac

SEQ ID NO: 3052080 - RNA, 22 nt, Human
uagaauuugauaugugaacagu

SEQ ID NO: 3052081 - RNA, 12 nt, Human
uaguaaucauau

SEQ ID NO: 3052082 - RNA, 14 nt, Human
uaguagagacaggg

SEQ ID NO: 3052083 - RNA, 14 nt, Human
uagucacugagaca

SEQ ID NO: 3052084 - RNA, 22 nt, Human
uaguagagacaggguuuugcca

SEQ ID NO: 3052085 - RNA, 15 nt, Human
uaguagagacagggu

SEQ ID NO: 3052086 - RNA, 22 nt, Human
uagguuuggacaaaauggaaua

SEQ ID NO: 3052087 - RNA, 16 nt, Human
acacaggcccggcucc

SEQ ID NO: 3052088 - RNA, 18 nt, Human
acacaggcccggcuccag

SEQ ID NO: 3052089 - RNA, 17 nt, Human
acacaggcccggcucca

SEQ ID NO: 3052090 - RNA, 22 nt, Human
acacaggcccggcuccaggcuc

SEQ ID NO: 3052091 - RNA, 21 nt, Human
acacaggcccggcuccaggcu

SEQ ID NO: 3052092 - RNA, 20 nt, Human
acacaggcccggcuccaggc

SEQ ID NO: 3052093 - RNA, 19 nt, Human
acacaggcccggcuccagg

SEQ ID NO: 3052094 - RNA, 24 nt, Human
acacaggcccggcuccaggcuccu

SEQ ID NO: 3052095 - RNA, 23 nt, Human
acacaggcccggcuccaggcucc

SEQ ID NO: 3052096 - RNA, 19 nt, Human
acaaugcaaaccaucauug

SEQ ID NO: 3052097 - RNA, 21 nt, Human
acaaugcaaaccaucauugaa

SEQ ID NO: 3052098 - RNA, 23 nt, Human
acaaugcaaaccaucauugaaau

SEQ ID NO: 3052099 - RNA, 13 nt, Human
acacaacuauauu

SEQ ID NO: 3052100 - RNA, 15 nt, Human
uaggguuauaauaau

SEQ ID NO: 3052101 - RNA, 17 nt, Human
uaggguuauaauaaugu

SEQ ID NO: 3052102 - RNA, 19 nt, Human
uaggguaagugagagaggg

SEQ ID NO: 3052103 - RNA, 11 nt, Human
acaaugcaaac

SEQ ID NO: 3052104 - RNA, 16 nt, Human
acaaugcaaaccauca

SEQ ID NO: 3052105 - RNA, 17 nt, Human
acaaugcaaaccaucau

SEQ ID NO: 3052106 - RNA, 18 nt, Human
acaaugcaaaccaucauu

SEQ ID NO: 3052107 - RNA, 22 nt, Human
acaaugacuuacuguacaugaa

SEQ ID NO: 3052108 - RNA, 20 nt, Human
acaaugacuuacuguacaug

SEQ ID NO: 3052109 - RNA, 19 nt, Human
acaaugacuuacuguacau

SEQ ID NO: 3052110 - RNA, 13 nt, Human
uaggaaaaacuga

SEQ ID NO: 3052111 - RNA, 14 nt, Human
uaggaaaaacugau

SEQ ID NO: 3052112 - RNA, 13 nt, Human
uagcuuuuuucuc

SEQ ID NO: 3052113 - RNA, 23 nt, Human
uagcuuuuuucucugauacagaa

SEQ ID NO: 3052114 - RNA, 21 nt, Human
uagccuuagaagucacacagu

SEQ ID NO: 3052115 - RNA, 20 nt, Human
uagccugugccucugggacu

SEQ ID NO: 3052116 - RNA, 14 nt, Human
uagcgcccaguugg

SEQ ID NO: 3052117 - RNA, 17 nt, Human
uagcgcccaguugggug

SEQ ID NO: 3052118 - RNA, 20 nt, Human
uagccuuagaagucacacag

SEQ ID NO: 3052119 - RNA, 16 nt, Human
uaggaaaaacugauuu

SEQ ID NO: 3052120 - RNA, 17 nt, Human
uaggaaaaacugauuuu

SEQ ID NO: 3052121 - RNA, 13 nt, Human
uaggauguugaaa

SEQ ID NO: 3052122 - RNA, 13 nt, Human
uagggaagauaau

SEQ ID NO: 3052123 - RNA, 20 nt, Human
uauauccuuucuaacaaaaa

SEQ ID NO: 3052124 - RNA, 17 nt, Human
uauauccuuucuaacaa

SEQ ID NO: 3052125 - RNA, 19 nt, Human
uauauauuuuuuucugaaa

SEQ ID NO: 3052126 - RNA, 16 nt, Human
acacucaguuguucaa

SEQ ID NO: 3052127 - RNA, 16 nt, Human
acacucauugaccuga

SEQ ID NO: 3052128 - RNA, 23 nt, Human
uauaggaacuuaaauaaugugaa

SEQ ID NO: 3052129 - RNA, 19 nt, Human
uauaggaauugacccacaa

SEQ ID NO: 3052130 - RNA, 16 nt, Human
uauaggugcuacaaaa

SEQ ID NO: 3052131 - RNA, 15 nt, Human
uauacaggucauauu

SEQ ID NO: 3052132 - RNA, 16 nt, Human
uauacaggucauauua

SEQ ID NO: 3052133 - RNA, 21 nt, Human
uauacaggucauauuaauaua

SEQ ID NO: 3052134 - RNA, 22 nt, Human
uauacacuuacacuuuaugcac

SEQ ID NO: 3052135 - RNA, 21 nt, Human
uauacacuuacacuuuaugca

SEQ ID NO: 3052136 - RNA, 18 nt, Human
uauaauuuaccugaaguc

SEQ ID NO: 3052137 - RNA, 19 nt, Human
uauaagugauugcugguuu

SEQ ID NO: 3052138 - RNA, 17 nt, Human
acacucaaaucaagaaa

SEQ ID NO: 3052139 - RNA, 15 nt, Human
acacuaaugaggaaa

SEQ ID NO: 3052140 - RNA, 22 nt, Human
acacuaaugaggaaacugcacu

SEQ ID NO: 3052141 - RNA, 21 nt, Human
acacucaaaagcugggcaggu

SEQ ID NO: 3052142 - RNA, 13 nt, Human
acacucaaaucaa

SEQ ID NO: 3052143 - RNA, 17 nt, Human
uagucacugagacagcc

SEQ ID NO: 3052144 - RNA, 20 nt, Human
uagucacugagacagcccgg

SEQ ID NO: 3052145 - RNA, 19 nt, Human
acacuaagagagaaugaga

SEQ ID NO: 3052146 - RNA, 17 nt, Human
uaucagaauucucagaa

SEQ ID NO: 3052147 - RNA, 10 nt, Human
uaucagaauu

SEQ ID NO: 3052148 - RNA, 19 nt, Human
uauccaacaucaacaucuu

SEQ ID NO: 3052149 - RNA, 22 nt, Human
uaucaaagggugaaaauuauuu

SEQ ID NO: 3052150 - RNA, 18 nt, Human
uaucaaagggugaaaauu

SEQ ID NO: 3052151 - RNA, 19 nt, Human
uaucaaagggugaaaauua

SEQ ID NO: 3052152 - RNA, 14 nt, Human
acagaccuuugaac

SEQ ID NO: 3052153 - RNA, 22 nt, Human
uaucacccagaagaaaauagug

SEQ ID NO: 3052154 - RNA, 19 nt, Human
uaucacccagaagaaaaua

SEQ ID NO: 3052155 - RNA, 20 nt, Human
uaucacaaaucuuaacuuga

SEQ ID NO: 3052156 - RNA, 16 nt, Human
uaucacaaaucuuaac

SEQ ID NO: 3052157 - RNA, 14 nt, Human
uaucacaaaucuua

SEQ ID NO: 3052158 - RNA, 19 nt, Human
acagaaagcagaacaguga

SEQ ID NO: 3052159 - RNA, 19 nt, Human
acagacauacuaaccagca

SEQ ID NO: 3052160 - RNA, 18 nt, Human
acagacauacuaaccagc

SEQ ID NO: 3052161 - RNA, 21 nt, Human
acacuuacacuuuaugcacaa

SEQ ID NO: 3052162 - RNA, 18 nt, Human
acacuuacacuuuaugca

SEQ ID NO: 3052163 - RNA, 18 nt, Human
acacuguuucaaacuuua

SEQ ID NO: 3052164 - RNA, 17 nt, Human
acacuguuucaaacuuu

SEQ ID NO: 3052165 - RNA, 16 nt, Human
acacuguuucaaacuu

SEQ ID NO: 3052166 - RNA, 17 nt, Human
acacucauugaccugag

SEQ ID NO: 3052167 - RNA, 16 nt, Human
acacuuacacuuuaug

SEQ ID NO: 3052168 - RNA, 20 nt, Human
acacuguuucaaacuuuacu

SEQ ID NO: 3052169 - RNA, 22 nt, Human
uaugaagcuuuuaugugaaaca

SEQ ID NO: 3052170 - RNA, 20 nt, Human
uaugaagcuuuuaugugaaa

SEQ ID NO: 3052171 - RNA, 23 nt, Human
uaugaagcuuuuaugugaaacau

SEQ ID NO: 3052172 - RNA, 15 nt, Human
uaugaggcauuuguu

SEQ ID NO: 3052173 - RNA, 14 nt, Human
uaugaggcauuugu

SEQ ID NO: 3052174 - RNA, 21 nt, Human
uaugaggcauuuguuugaacu

SEQ ID NO: 3052175 - RNA, 16 nt, Human
acagcccgggcucugc

SEQ ID NO: 3052176 - RNA, 15 nt, Human
acagcccgggcucug

SEQ ID NO: 3052177 - RNA, 18 nt, Human
acagcaagggugauggga

SEQ ID NO: 3052178 - RNA, 23 nt, Human
uaugggacucaaugcacugacau

SEQ ID NO: 3052179 - RNA, 16 nt, Human
uaugggacucaaugca

SEQ ID NO: 3052180 - RNA, 21 nt, Human
uauggcccuggccuagcauac

SEQ ID NO: 3052181 - RNA, 23 nt, Human
uauggcuuuugugcauuaucuag

SEQ ID NO: 3052182 - RNA, 20 nt, Human
uauggcccuggccuagcaua

SEQ ID NO: 3052183 - RNA, 17 nt, Human
uaugauacuugaaaauu

SEQ ID NO: 3052184 - RNA, 18 nt, Human
uaugcaugaaguaauaug

SEQ ID NO: 3052185 - RNA, 22 nt, Human
uaugcaugaaguaauaugcaca

SEQ ID NO: 3052186 - RNA, 19 nt, Human
acagcuaaugggacacuaa

SEQ ID NO: 3052187 - RNA, 17 nt, Human
acagcuaaugggacacu

SEQ ID NO: 3052188 - RNA, 16 nt, Human
acagcuaaugggacac

SEQ ID NO: 3052189 - RNA, 15 nt, Human
acagcuaaugggaca

SEQ ID NO: 3052190 - RNA, 14 nt, Human
acagcuguaugauu

SEQ ID NO: 3052191 - RNA, 19 nt, Human
acagcuguaugauucccag

SEQ ID NO: 3052192 - RNA, 20 nt, Human
acagcuguaugauucccagc

SEQ ID NO: 3052193 - RNA, 23 nt, Human
acagcuguaugauucccagccag

SEQ ID NO: 3052194 - RNA, 21 nt, Human
acagcuucauuuccugugucu

SEQ ID NO: 3052195 - RNA, 19 nt, Human
acagcuucauuuccugugu

SEQ ID NO: 3052196 - RNA, 17 nt, Human
acagcuucauuuccugu

SEQ ID NO: 3052197 - RNA, 20 nt, Human
acagcuugaccgugaggcca

SEQ ID NO: 3052198 - RNA, 21 nt, Human
acagcuugaccgugaggccag

SEQ ID NO: 3052199 - RNA, 17 nt, Human
acagcuugaccgugagg

SEQ ID NO: 3052200 - RNA, 21 nt, Human
acaggaaaagcugcugacagu

SEQ ID NO: 3052201 - RNA, 20 nt, Human
acaggaaaagcugcugacag

SEQ ID NO: 3052202 - RNA, 19 nt, Human
acaggaaaagcugcugaca

SEQ ID NO: 3052203 - RNA, 18 nt, Human
acaggaaaagcugcugac

SEQ ID NO: 3052204 - RNA, 22 nt, Human
acagcuugaccgugaggccaga

SEQ ID NO: 3052205 - RNA, 23 nt, Human
acagcuugaccgugaggccagag

SEQ ID NO: 3052206 - RNA, 17 nt, Human
acaggcccggcuccagg

SEQ ID NO: 3052207 - RNA, 16 nt, Human
acaggcccggcuccag

SEQ ID NO: 3052208 - RNA, 15 nt, Human
acaggcagauacagg

SEQ ID NO: 3052209 - RNA, 20 nt, Human
acaggaaaauuuuaaaaaua

SEQ ID NO: 3052210 - RNA, 22 nt, Human
acaggcccggcuccaggcuccu

SEQ ID NO: 3052211 - RNA, 21 nt, Human
acaggcccggcuccaggcucc

SEQ ID NO: 3052212 - RNA, 20 nt, Human
acaggcccggcuccaggcuc

SEQ ID NO: 3052213 - RNA, 18 nt, Human
acaggcccggcuccaggc

SEQ ID NO: 3052214 - RNA, 22 nt, Human
uaaggaauuuuauuuuuuucug

SEQ ID NO: 3052215 - RNA, 17 nt, Human
uaaggaauaccuguccc

SEQ ID NO: 3052216 - RNA, 18 nt, Human
uaaggaauaccugucccc

SEQ ID NO: 3052217 - RNA, 13 nt, Human
uaaggaagacaau

SEQ ID NO: 3052218 - RNA, 9 nt, Human
uaaggaaua

SEQ ID NO: 3052219 - RNA, 22 nt, Human
uaagcagauggaaugcuguguu

SEQ ID NO: 3052220 - RNA, 21 nt, Human
uaagcuauucaguaauaacuc

SEQ ID NO: 3052221 - RNA, 14 nt, Human
uaagcuauucagua

SEQ ID NO: 3052222 - RNA, 14 nt, Human
uaagauucauauuu

SEQ ID NO: 3052223 - RNA, 14 nt, Human
uaagcaaaauguga

SEQ ID NO: 3052224 - RNA, 15 nt, Human
uaagcaaaaugugau

SEQ ID NO: 3052225 - RNA, 11 nt, Human
aaucagccugc

SEQ ID NO: 3052226 - RNA, 16 nt, Human
aaucagccuaguugau

SEQ ID NO: 3052227 - RNA, 13 nt, Human
aaucagccugcuc

SEQ ID NO: 3052228 - RNA, 18 nt, Human
aaucagccugcuccagcu

SEQ ID NO: 3052229 - RNA, 19 nt, Human
aaucagccugcuccagcug

SEQ ID NO: 3052230 - RNA, 16 nt, Human
uaaguaauucaagaaa

SEQ ID NO: 3052231 - RNA, 20 nt, Human
uaaguaaugauaacuggaaa

SEQ ID NO: 3052232 - RNA, 18 nt, Human
uaaguaaaaccacagcag

SEQ ID NO: 3052233 - RNA, 17 nt, Human
uaaguaaaaccacagca

SEQ ID NO: 3052234 - RNA, 16 nt, Human
uaaguaaaaccacagc

SEQ ID NO: 3052235 - RNA, 18 nt, Human
uaagguuaccuuuguucc

SEQ ID NO: 3052236 - RNA, 15 nt, Human
uaaguaaaaccacag

SEQ ID NO: 3052237 - RNA, 13 nt, Human
uaaguaaaaccac

SEQ ID NO: 3052238 - RNA, 17 nt, Human
uaaguguguguuuuuca

SEQ ID NO: 3052239 - RNA, 21 nt, Human
uaaguauucuuauuuaaugaa

SEQ ID NO: 3052240 - RNA, 18 nt, Human
uaaguuuuuuuuuaaaaa

SEQ ID NO: 3052241 - RNA, 20 nt, Human
aauccucaguuuuugugaaa

SEQ ID NO: 3052242 - RNA, 22 nt, Human
aaucagugugucuaaauuugaa

SEQ ID NO: 3052243 - RNA, 18 nt, Human
aaucagugugucuaaauu

SEQ ID NO: 3052244 - RNA, 17 nt, Human
aaucagugugucuaaau

SEQ ID NO: 3052245 - RNA, 14 nt, Human
aaucagugugucua

SEQ ID NO: 3052246 - RNA, 17 nt, Human
aaucccauuuaaaaaaa

SEQ ID NO: 3052247 - RNA, 17 nt, Human
uaacguauaaaagccug

SEQ ID NO: 3052248 - RNA, 13 nt, Human
uaacguauaaaag

SEQ ID NO: 3052249 - RNA, 16 nt, Human
uaacuugucuuuggac

SEQ ID NO: 3052250 - RNA, 20 nt, Human
uaacuugucuuuggacccug

SEQ ID NO: 3052251 - RNA, 21 nt, Human
uaacuuccuuggacucauuuu

SEQ ID NO: 3052252 - RNA, 23 nt, Human
uaagacaaaaagcuacuuauugu

SEQ ID NO: 3052253 - RNA, 13 nt, Human
uaagaagugaaaa

SEQ ID NO: 3052254 - RNA, 21 nt, Human
aauauauucagccuggcuuca

SEQ ID NO: 3052255 - RNA, 21 nt, Human
aauauauuuuaagacgaaaca

SEQ ID NO: 3052256 - RNA, 14 nt, Human
aauauauuuaauga

SEQ ID NO: 3052257 - RNA, 19 nt, Human
aauagucaaauugugugaa

SEQ ID NO: 3052258 - RNA, 18 nt, Human
aauauauuuuaagacgaa

SEQ ID NO: 3052259 - RNA, 19 nt, Human
uaacaugaauauuuagugu

SEQ ID NO: 3052260 - RNA, 21 nt, Human
uaacaugaauauuuaguguuc

SEQ ID NO: 3052261 - RNA, 20 nt, Human
uaacaugaauauuuaguguu

SEQ ID NO: 3052262 - RNA, 14 nt, Human
uaacaugaauauuu

SEQ ID NO: 3052263 - RNA, 19 nt, Human
uaacauguaauuaaguacu

SEQ ID NO: 3052264 - RNA, 17 nt, Human
uaacauguaauuaagua

SEQ ID NO: 3052265 - RNA, 17 nt, Human
uaacaaugaagauaaaa

SEQ ID NO: 3052266 - RNA, 13 nt, Human
aauacagaggcaa

SEQ ID NO: 3052267 - RNA, 21 nt, Human
aauacaccacuacauucuguu

SEQ ID NO: 3052268 - RNA, 21 nt, Human
uaaauuaacuuuuauaaacuu

SEQ ID NO: 3052269 - RNA, 20 nt, Human
uaaauuaacuuuuauaaacu

SEQ ID NO: 3052270 - RNA, 19 nt, Human
uaaauuaacuuuuauaaac

SEQ ID NO: 3052271 - RNA, 18 nt, Human
uaaauuaacuuuuauaaa

SEQ ID NO: 3052272 - RNA, 16 nt, Human
uaaaugugcuuuuaaa

SEQ ID NO: 3052273 - RNA, 21 nt, Human
aaguguauuuuuuuacuaaua

SEQ ID NO: 3052274 - RNA, 18 nt, Human
aaguguauuuuuuuacua

SEQ ID NO: 3052275 - RNA, 18 nt, Human
uaaaugaaaaucgugaca

SEQ ID NO: 3052276 - RNA, 22 nt, Human
aauagagcaaaauugauguguu

SEQ ID NO: 3052277 - RNA, 20 nt, Human
aauagagcaaaauugaugug

SEQ ID NO: 3052278 - RNA, 20 nt, Human
aauagccugccucuucucua

SEQ ID NO: 3052279 - RNA, 15 nt, Human
aauaccugucccccu

SEQ ID NO: 3052280 - RNA, 18 nt, Human
aauaccugucccccugac

SEQ ID NO: 3052281 - RNA, 19 nt, Human
aauaccugucccccugaca

SEQ ID NO: 3052282 - RNA, 20 nt, Human
aauaccccaagacucccaug

SEQ ID NO: 3052283 - RNA, 12 nt, Human
aauaccaaggaa

SEQ ID NO: 3052284 - RNA, 23 nt, Human
aauaccacaggaaccacaagacu

SEQ ID NO: 3052285 - RNA, 19 nt, Human
aauaccagccaguaaaugg

SEQ ID NO: 3052286 - RNA, 18 nt, Human
aauaccaugccauuuaaa

SEQ ID NO: 3052287 - RNA, 17 nt, Human
aauaccagccaguaaau

SEQ ID NO: 3052288 - RNA, 23 nt, Human
aauacaucccuuaccugggaaag

SEQ ID NO: 3052289 - RNA, 13 nt, Human
uacagaauuuuau

SEQ ID NO: 3052290 - RNA, 17 nt, Human
uacagagacagaaagca

SEQ ID NO: 3052291 - RNA, 23 nt, Human
uacagagcagacaguuaagagaa

SEQ ID NO: 3052292 - RNA, 19 nt, Human
uacagagcccacgccccca

SEQ ID NO: 3052293 - RNA, 22 nt, Human
uacagagcccacgcccccacug

SEQ ID NO: 3052294 - RNA, 14 nt, Human
uacagacaaagcgu

SEQ ID NO: 3052295 - RNA, 15 nt, Human
uacagacaaagcgug

SEQ ID NO: 3052296 - RNA, 13 nt, Human
uacagacaaagcg

SEQ ID NO: 3052297 - RNA, 16 nt, Human
aaugguuuucaaaaua

SEQ ID NO: 3052298 - RNA, 20 nt, Human
aauguaagggaaacugccag

SEQ ID NO: 3052299 - RNA, 16 nt, Human
aauggaagacagcucu

SEQ ID NO: 3052300 - RNA, 14 nt, Human
aaugguuuucaaaa

SEQ ID NO: 3052301 - RNA, 18 nt, Human
uaauuuuuuugagacaga

SEQ ID NO: 3052302 - RNA, 21 nt, Human
uacaaaaaaaaaaaaaaauua

SEQ ID NO: 3052303 - RNA, 17 nt, Human
uaauuuuuauauuugaa

SEQ ID NO: 3052304 - RNA, 16 nt, Human
uacaaugcugugcccu

SEQ ID NO: 3052305 - RNA, 14 nt, Human
uacaaugcugugcc

SEQ ID NO: 3052306 - RNA, 13 nt, Human
uacaaugcugugc

SEQ ID NO: 3052307 - RNA, 22 nt, Human
aaugcuggcuguuggcuggggg

SEQ ID NO: 3052308 - RNA, 20 nt, Human
aaugcuguauuuuaaaagaa

SEQ ID NO: 3052309 - RNA, 21 nt, Human
aaugcuguauuuuaaaagaau

SEQ ID NO: 3052310 - RNA, 21 nt, Human
aaugcuggcuguuggcugggg

SEQ ID NO: 3052311 - RNA, 13 nt, Human
aauggaagacagc

SEQ ID NO: 3052312 - RNA, 22 nt, Human
aaugcuguauuuuaaaagaaug

SEQ ID NO: 3052313 - RNA, 20 nt, Human
aaugacucagaauauugcuu

SEQ ID NO: 3052314 - RNA, 21 nt, Human
aaugaccuuucaauaggaaaa

SEQ ID NO: 3052315 - RNA, 20 nt, Human
aaugaccuuucaauaggaaa

SEQ ID NO: 3052316 - RNA, 22 nt, Human
aaugagaaaucuaaaaaacgaa

SEQ ID NO: 3052317 - RNA, 12 nt, Human
aaugagaaaucu

SEQ ID NO: 3052318 - RNA, 22 nt, Human
aaugagagacacacugaagaag

SEQ ID NO: 3052319 - RNA, 11 nt, Human
aaugagccugg

SEQ ID NO: 3052320 - RNA, 18 nt, Human
aaugaggucagagccugc

SEQ ID NO: 3052321 - RNA, 16 nt, Human
aaugaggucagagccu

SEQ ID NO: 3052322 - RNA, 12 nt, Human
aaugagccuggc

SEQ ID NO: 3052323 - RNA, 13 nt, Human
aaugagccuggca

SEQ ID NO: 3052324 - RNA, 23 nt, Human
aaugauuaugaauuacauuugua

SEQ ID NO: 3052325 - RNA, 22 nt, Human
uaauuccguagguuauuuucag

SEQ ID NO: 3052326 - RNA, 16 nt, Human
uaauuuauacagguca

SEQ ID NO: 3052327 - RNA, 18 nt, Human
uaauuuuuauauuugaaa

SEQ ID NO: 3052328 - RNA, 19 nt, Human
uaauuuuuauauuugaaau

SEQ ID NO: 3052329 - RNA, 21 nt, Human
uaauuuuuauauuugaaauau

SEQ ID NO: 3052330 - RNA, 11 nt, Human
aaugcaaacca

SEQ ID NO: 3052331 - RNA, 16 nt, Human
aaugauuucauucaau

SEQ ID NO: 3052332 - RNA, 12 nt, Human
aaugcaaaccau

SEQ ID NO: 3052333 - RNA, 13 nt, Human
aaugcaccuggaa

SEQ ID NO: 3052334 - RNA, 21 nt, Human
aauucagaaggaucuucaucu

SEQ ID NO: 3052335 - RNA, 15 nt, Human
aauucagaaggaucu

SEQ ID NO: 3052336 - RNA, 11 nt, Human
aauucaguugu

SEQ ID NO: 3052337 - RNA, 17 nt, Human
aauucaguuguuagugu

SEQ ID NO: 3052338 - RNA, 22 nt, Human
aauucaguuguuagugugucuu

SEQ ID NO: 3052339 - RNA, 20 nt, Human
aauucaagaaaacaacuuca

SEQ ID NO: 3052340 - RNA, 12 nt, Human
aauucaagaaaa

SEQ ID NO: 3052341 - RNA, 22 nt, Human
aauuauuuauuaaaugcccagc

SEQ ID NO: 3052342 - RNA, 22 nt, Human
aauuaugugccagauuuaugca

SEQ ID NO: 3052343 - RNA, 21 nt, Human
aauuauuuauuaaaugcccag

SEQ ID NO: 3052344 - RNA, 23 nt, Human
uaccugaagcuaucguaaaauua

SEQ ID NO: 3052345 - RNA, 13 nt, Human
uaccugaagucuu

SEQ ID NO: 3052346 - RNA, 14 nt, Human
uaccugaagucuuu

SEQ ID NO: 3052347 - RNA, 13 nt, Human
uaccugaggggcc

SEQ ID NO: 3052348 - RNA, 15 nt, Human
uaccugaggggccuc

SEQ ID NO: 3052349 - RNA, 16 nt, Human
uaccugaagucuuugu

SEQ ID NO: 3052350 - RNA, 23 nt, Human
uaccucuugagccuugaacuuug

SEQ ID NO: 3052351 - RNA, 22 nt, Human
uaccucuugagccuugaacuuu

SEQ ID NO: 3052352 - RNA, 21 nt, Human
uaccucuugagccuugaacuu

SEQ ID NO: 3052353 - RNA, 23 nt, Human
uacccgggaagggggcugggaca

SEQ ID NO: 3052354 - RNA, 17 nt, Human
aauuacaggaaguacug

SEQ ID NO: 3052355 - RNA, 19 nt, Human
aauuacaggaaguacugga

SEQ ID NO: 3052356 - RNA, 20 nt, Human
aauuacaggaaguacuggag

SEQ ID NO: 3052357 - RNA, 13 nt, Human
aauuacauuugua

SEQ ID NO: 3052358 - RNA, 14 nt, Human
aauuacauuuguau

SEQ ID NO: 3052359 - RNA, 16 nt, Human
uaccugaggggccucu

SEQ ID NO: 3052360 - RNA, 16 nt, Human
uaccugccaggaagcc

SEQ ID NO: 3052361 - RNA, 21 nt, Human
aaugugcugaaugguuuucaa

SEQ ID NO: 3052362 - RNA, 13 nt, Human
aauguucaucaau

SEQ ID NO: 3052363 - RNA, 17 nt, Human
aauuaaguacuauguau

SEQ ID NO: 3052364 - RNA, 16 nt, Human
aauuaaguacuaugua

SEQ ID NO: 3052365 - RNA, 15 nt, Human
aauuaacuuuuauaa

SEQ ID NO: 3052366 - RNA, 13 nt, Human
aauuaacuuuuau

SEQ ID NO: 3052367 - RNA, 12 nt, Human
aauuaacuuuua

SEQ ID NO: 3052368 - RNA, 16 nt, Human
aauguucaucaaugaa

SEQ ID NO: 3052369 - RNA, 20 nt, Human
aauguucaucaaugaaugaa

SEQ ID NO: 3052370 - RNA, 13 nt, Human
uacauuuccuaaa

SEQ ID NO: 3052371 - RNA, 11 nt, Human
aauuaacuuuu

SEQ ID NO: 3052372 - RNA, 12 nt, Human
uaccagcagagc

SEQ ID NO: 3052373 - RNA, 18 nt, Human
uaccagccaguaaauggg

SEQ ID NO: 3052374 - RNA, 22 nt, Human
uaccagcagagcaccuuagaca

SEQ ID NO: 3052375 - RNA, 13 nt, Human
uaccagcagagca

SEQ ID NO: 3052376 - RNA, 14 nt, Human
uaccagcagagcac

SEQ ID NO: 3052377 - RNA, 16 nt, Human
uaccaugccauuuaaa

SEQ ID NO: 3052378 - RNA, 19 nt, Human
uaccagggacugaggggag

SEQ ID NO: 3052379 - RNA, 22 nt, Human
aagucuuauauauuguagauaa

SEQ ID NO: 3052380 - RNA, 16 nt, Human
aagucuuucacauuua

SEQ ID NO: 3052381 - RNA, 15 nt, Human
guuuuucauaaagca

SEQ ID NO: 3052382 - RNA, 12 nt, Human
aagugagagagg

SEQ ID NO: 3052383 - RNA, 14 nt, Human
aagugagagcuggg

SEQ ID NO: 3052384 - RNA, 19 nt, Human
aagugaagacaaugacuua

SEQ ID NO: 3052385 - RNA, 17 nt, Human
aagugaagacaaugacu

SEQ ID NO: 3052386 - RNA, 21 nt, Human
aagugaaaaaggaggaagaga

SEQ ID NO: 3052387 - RNA, 20 nt, Human
aaguacacuguuucaaacuu

SEQ ID NO: 3052388 - RNA, 19 nt, Human
aaguacacuguuucaaacu

SEQ ID NO: 3052389 - RNA, 23 nt, Human
aaguacacuguuucaaacuuuac

SEQ ID NO: 3052390 - RNA, 13 nt, Human
aaguauuagaaua

SEQ ID NO: 3052391 - RNA, 18 nt, Human
aaguacacuguuucaaac

SEQ ID NO: 3052392 - RNA, 13 nt, Human
aaguacacuguuu

SEQ ID NO: 3052393 - RNA, 14 nt, Human
aaguaaugauaacu

SEQ ID NO: 3052394 - RNA, 22 nt, Human
guuuugccauguuggccaggcu

SEQ ID NO: 3052395 - RNA, 21 nt, Human
guuuugccauguuggccaggc

SEQ ID NO: 3052396 - RNA, 20 nt, Human
guuuugccauguuggccagg

SEQ ID NO: 3052397 - RNA, 16 nt, Human
guuuugccauguuggc

SEQ ID NO: 3052398 - RNA, 15 nt, Human
guuucugccgcagcc

SEQ ID NO: 3052399 - RNA, 14 nt, Human
guuucugccgcagc

SEQ ID NO: 3052400 - RNA, 20 nt, Human
uaaaagacagugaaagaaaa

SEQ ID NO: 3052401 - RNA, 22 nt, Human
uaaaauaccagccaguaaaugg

SEQ ID NO: 3052402 - RNA, 21 nt, Human
uaaaauaccagccaguaaaug

SEQ ID NO: 3052403 - RNA, 18 nt, Human
aagugauucuccugccuc

SEQ ID NO: 3052404 - RNA, 17 nt, Human
aagugauucuccugccu

SEQ ID NO: 3052405 - RNA, 16 nt, Human
aagugauucuccugcc

SEQ ID NO: 3052406 - RNA, 15 nt, Human
aagugauucuccugc

SEQ ID NO: 3052407 - RNA, 19 nt, Human
aagugauucuccugccuca

SEQ ID NO: 3052408 - RNA, 16 nt, Human
aagugaggaugaaaaa

SEQ ID NO: 3052409 - RNA, 15 nt, Human
aagugagagcugggu

SEQ ID NO: 3052410 - RNA, 12 nt, Human
uaaaagaaugau

SEQ ID NO: 3052411 - RNA, 23 nt, Human
uaaaagaauauuuuaacuuccuu

SEQ ID NO: 3052412 - RNA, 16 nt, Human
uaaaagaauauuuuaa

SEQ ID NO: 3052413 - RNA, 22 nt, Human
uaaaacuugauguguuaucucu

SEQ ID NO: 3052414 - RNA, 20 nt, Human
uaaaacuugauguguuaucu

SEQ ID NO: 3052415 - RNA, 21 nt, Human
uaaaaaucucaaauuucuaaa

SEQ ID NO: 3052416 - RNA, 20 nt, Human
uaaaaaucucaaauuucuaa

SEQ ID NO: 3052417 - RNA, 19 nt, Human
uaaaaaucucaaauuucua

SEQ ID NO: 3052418 - RNA, 19 nt, Human
uaaaaauaaaaaacacugg

SEQ ID NO: 3052419 - RNA, 18 nt, Human
uaaaaauaaaaaacacug

SEQ ID NO: 3052420 - RNA, 15 nt, Human
uaaaaaguggaaaaa

SEQ ID NO: 3052421 - RNA, 15 nt, Human
guuuuucuucucccu

SEQ ID NO: 3052422 - RNA, 15 nt, Human
guuuuucuugcaugg

SEQ ID NO: 3052423 - RNA, 21 nt, Human
uaaaaauaaaaaacacuggga

SEQ ID NO: 3052424 - RNA, 17 nt, Human
uaaaaaucucaaauuuc

SEQ ID NO: 3052425 - RNA, 16 nt, Human
uaaaaaucucaaauuu

SEQ ID NO: 3052426 - RNA, 15 nt, Human
uaaaaaucucaaauu

SEQ ID NO: 3052427 - RNA, 13 nt, Human
aaggauaaugaau

SEQ ID NO: 3052428 - RNA, 21 nt, Human
aaggauacaaaagcaugugag

SEQ ID NO: 3052429 - RNA, 13 nt, Human
aaggauacaaaag

SEQ ID NO: 3052430 - RNA, 19 nt, Human
guugcccaggcaggucuug

SEQ ID NO: 3052431 - RNA, 13 nt, Human
guugcccaggcug

SEQ ID NO: 3052432 - RNA, 12 nt, Human
guugcccaggcu

SEQ ID NO: 3052433 - RNA, 23 nt, Human
guugcccaggcaggucuugaacu

SEQ ID NO: 3052434 - RNA, 15 nt, Human
aaggaaagagggagg

SEQ ID NO: 3052435 - RNA, 15 nt, Human
aaggaagacuucauc

SEQ ID NO: 3052436 - RNA, 13 nt, Human
aaggaagcacaug

SEQ ID NO: 3052437 - RNA, 14 nt, Human
aaggaagacuucau

SEQ ID NO: 3052438 - RNA, 17 nt, Human
aaggaauaccugucccc

SEQ ID NO: 3052439 - RNA, 16 nt, Human
aaggaagcacaugccu

SEQ ID NO: 3052440 - RNA, 14 nt, Human
aaggagauuuacaa

SEQ ID NO: 3052441 - RNA, 11 nt, Human
aaggagagcua

SEQ ID NO: 3052442 - RNA, 18 nt, Human
aaggaauaccuguccccc

SEQ ID NO: 3052443 - RNA, 18 nt, Human
aaggaggaagagaaaaaa

SEQ ID NO: 3052444 - RNA, 20 nt, Human
aaggaggggauagagagaga

SEQ ID NO: 3052445 - RNA, 13 nt, Human
guuuauugucaaa

SEQ ID NO: 3052446 - RNA, 15 nt, Human
guugggccaggagcc

SEQ ID NO: 3052447 - RNA, 17 nt, Human
guugggccaggagccuc

SEQ ID NO: 3052448 - RNA, 13 nt, Human
guugggcuggugu

SEQ ID NO: 3052449 - RNA, 12 nt, Human
guuucaaacuuu

SEQ ID NO: 3052450 - RNA, 15 nt, Human
aaggcuccaggagca

SEQ ID NO: 3052451 - RNA, 16 nt, Human
aaggcuccaggagcag

SEQ ID NO: 3052452 - RNA, 18 nt, Human
aaggcuccaggagcagcc

SEQ ID NO: 3052453 - RNA, 16 nt, Human
guuucaaacuuuacua

SEQ ID NO: 3052454 - RNA, 14 nt, Human
guuucaaacuuuac

SEQ ID NO: 3052455 - RNA, 13 nt, Human
guuucaaacuuua

SEQ ID NO: 3052456 - RNA, 19 nt, Human
aaggcuccaggagcagcca

SEQ ID NO: 3052457 - RNA, 22 nt, Human
aaggcuccaggagcagccacau

SEQ ID NO: 3052458 - RNA, 16 nt, Human
aaggcucgagcaugcc

SEQ ID NO: 3052459 - RNA, 18 nt, Human
aaggcucgagcaugccug

SEQ ID NO: 3052460 - RNA, 19 nt, Human
aaggcucgagcaugccugg

SEQ ID NO: 3052461 - RNA, 20 nt, Human
aaggcucgagcaugccugga

SEQ ID NO: 3052462 - RNA, 22 nt, Human
aaggcucgagcaugccuggaug

SEQ ID NO: 3052463 - RNA, 16 nt, Human
aaguaaggaauuuuau

SEQ ID NO: 3052464 - RNA, 22 nt, Human
guuucuaugacacaugcaaggu

SEQ ID NO: 3052465 - RNA, 12 nt, Human
aaggucauuuuu

SEQ ID NO: 3052466 - RNA, 18 nt, Human
aagguauuuaauagguuu

SEQ ID NO: 3052467 - RNA, 18 nt, Human
guuucugaaagggacgcu

SEQ ID NO: 3052468 - RNA, 19 nt, Human
guuucuauguguagggcgg

SEQ ID NO: 3052469 - RNA, 15 nt, Human
aagggugaaaauuau

SEQ ID NO: 3052470 - RNA, 16 nt, Human
aagggugaaaauuauu

SEQ ID NO: 3052471 - RNA, 13 nt, Human
aagguacuucaaa

SEQ ID NO: 3052472 - RNA, 19 nt, Human
aagggugaugggaaagcau

SEQ ID NO: 3052473 - RNA, 20 nt, Human
aagguagaaauaucugaaaa

SEQ ID NO: 3052474 - RNA, 14 nt, Human
aagguacuucaaau

SEQ ID NO: 3052475 - RNA, 17 nt, Human
aaggggcaguggugguu

SEQ ID NO: 3052476 - RNA, 22 nt, Human
aaggggcccaaauucuuucagu

SEQ ID NO: 3052477 - RNA, 20 nt, Human
guuauuauauuuacaaaugg

SEQ ID NO: 3052478 - RNA, 23 nt, Human
guuauuuuuauuuauuuaaauuu

SEQ ID NO: 3052479 - RNA, 22 nt, Human
guucaaagauauuuugcuuugu

SEQ ID NO: 3052480 - RNA, 21 nt, Human
guucaaagauauuuugcuuug

SEQ ID NO: 3052481 - RNA, 20 nt, Human
guucaaagauauuuugcuuu

SEQ ID NO: 3052482 - RNA, 18 nt, Human
guucaagcgauucuucug

SEQ ID NO: 3052483 - RNA, 18 nt, Human
guuaagagaaaugagcuu

SEQ ID NO: 3052484 - RNA, 11 nt, Human
guuaagagaaa

SEQ ID NO: 3052485 - RNA, 12 nt, Human
guuaagagaaau

SEQ ID NO: 3052486 - RNA, 19 nt, Human
guuaggcauugugggaagg

SEQ ID NO: 3052487 - RNA, 20 nt, Human
guuaggcauugugggaaggg

SEQ ID NO: 3052488 - RNA, 22 nt, Human
aagccugcaauuucauaugcug

SEQ ID NO: 3052489 - RNA, 17 nt, Human
aagccugcaauuucaua

SEQ ID NO: 3052490 - RNA, 22 nt, Human
aagcuagacgagcaggcuucuu

SEQ ID NO: 3052491 - RNA, 20 nt, Human
aagccugaguuugcuuucaa

SEQ ID NO: 3052492 - RNA, 12 nt, Human
aagcuaggccug

SEQ ID NO: 3052493 - RNA, 13 nt, Human
guucagcuccagc

SEQ ID NO: 3052494 - RNA, 17 nt, Human
aagcuccaagcucccag

SEQ ID NO: 3052495 - RNA, 18 nt, Human
aagcuccaagcucccagg

SEQ ID NO: 3052496 - RNA, 13 nt, Human
aagcuccagguag

SEQ ID NO: 3052497 - RNA, 14 nt, Human
aagcuccagguaga

SEQ ID NO: 3052498 - RNA, 18 nt, Human
aagcucagggccuggcuc

SEQ ID NO: 3052499 - RNA, 19 nt, Human
aagcucagggccuggcuca

SEQ ID NO: 3052500 - RNA, 20 nt, Human
aagcucagggccuggcucag

SEQ ID NO: 3052501 - RNA, 12 nt, Human
aagcucagggcc

SEQ ID NO: 3052502 - RNA, 13 nt, Human
aagcucagggccu

SEQ ID NO: 3052503 - RNA, 16 nt, Human
aagcucagggccuggc

SEQ ID NO: 3052504 - RNA, 17 nt, Human
aagcucagggccuggcu

SEQ ID NO: 3052505 - RNA, 20 nt, Human
aagcucacagaccuuugaac

SEQ ID NO: 3052506 - RNA, 14 nt, Human
aagcccaggaaagg

SEQ ID NO: 3052507 - RNA, 17 nt, Human
aagcccaggaaaggcuc

SEQ ID NO: 3052508 - RNA, 22 nt, Human
aagccaaagcuaggccuggcca

SEQ ID NO: 3052509 - RNA, 20 nt, Human
aagccaaagcuaggccuggc

SEQ ID NO: 3052510 - RNA, 19 nt, Human
aagcccaggaaaggcucca

SEQ ID NO: 3052511 - RNA, 22 nt, Human
aagcccaggaaaggcuccagga

SEQ ID NO: 3052512 - RNA, 20 nt, Human
aagccgcuggggccaguugg

SEQ ID NO: 3052513 - RNA, 19 nt, Human
aagcccugagcuuucugcu

SEQ ID NO: 3052514 - RNA, 20 nt, Human
aagcagugcaugcugucccu

SEQ ID NO: 3052515 - RNA, 14 nt, Human
aagcagugcaugcu

SEQ ID NO: 3052516 - RNA, 15 nt, Human
aagcagugcaugcug

SEQ ID NO: 3052517 - RNA, 21 nt, Human
gugugugcgccuacaggagug

SEQ ID NO: 3052518 - RNA, 12 nt, Human
aagcagugcaug

SEQ ID NO: 3052519 - RNA, 16 nt, Human
aagcauuuacuuugug

SEQ ID NO: 3052520 - RNA, 16 nt, Human
aagcauuuagauguau

SEQ ID NO: 3052521 - RNA, 13 nt, Human
aagcauuguaaau

SEQ ID NO: 3052522 - RNA, 16 nt, Human
gugugguagagugugc

SEQ ID NO: 3052523 - RNA, 22 nt, Human
gugugacaaggauugcuacugu

SEQ ID NO: 3052524 - RNA, 20 nt, Human
gugucagguggggcagcuug

SEQ ID NO: 3052525 - RNA, 23 nt, Human
guguauuuuuuuacuaauagaca

SEQ ID NO: 3052526 - RNA, 17 nt, Human
guguauuuuuuuacuaa

SEQ ID NO: 3052527 - RNA, 20 nt, Human
gugucaagagggucugagga

SEQ ID NO: 3052528 - RNA, 16 nt, Human
gugucagcauagaagu

SEQ ID NO: 3052529 - RNA, 13 nt, Human
aagauguagagga

SEQ ID NO: 3052530 - RNA, 14 nt, Human
aagaugaaaauauu

SEQ ID NO: 3052531 - RNA, 13 nt, Human
aagaugaaaauau

SEQ ID NO: 3052532 - RNA, 13 nt, Human
aagaguaggaaga

SEQ ID NO: 3052533 - RNA, 19 nt, Human
aagaugcuucucacugcca

SEQ ID NO: 3052534 - RNA, 17 nt, Human
aagaugcuucucacugc

SEQ ID NO: 3052535 - RNA, 16 nt, Human
aagaugcuucucacug

SEQ ID NO: 3052536 - RNA, 17 nt, Human
guggggucacucuggca

SEQ ID NO: 3052537 - RNA, 20 nt, Human
guggggucacucuggcagcu

SEQ ID NO: 3052538 - RNA, 21 nt, Human
guggggucacucuggcagcuc

SEQ ID NO: 3052539 - RNA, 22 nt, Human
guggggucacucuggcagcuca

SEQ ID NO: 3052540 - RNA, 23 nt, Human
aagagggagggagggcuccagac

SEQ ID NO: 3052541 - RNA, 12 nt, Human
aagaguaggaag

SEQ ID NO: 3052542 - RNA, 23 nt, Human
aagaccuugcuuaugauugcaga

SEQ ID NO: 3052543 - RNA, 21 nt, Human
aagaccuuuggagcaaagcug

SEQ ID NO: 3052544 - RNA, 13 nt, Human
aagacgcugugcu

SEQ ID NO: 3052545 - RNA, 15 nt, Human
aagacgcugugcugc

SEQ ID NO: 3052546 - RNA, 17 nt, Human
aagacgcugugcugccc

SEQ ID NO: 3052547 - RNA, 18 nt, Human
aagacgcugugcugcccu

SEQ ID NO: 3052548 - RNA, 19 nt, Human
aagacgcugugcugcccug

SEQ ID NO: 3052549 - RNA, 15 nt, Human
aagaccuucuccuuc

SEQ ID NO: 3052550 - RNA, 18 nt, Human
aagaccuucuccuucacc

SEQ ID NO: 3052551 - RNA, 19 nt, Human
aagaccuucuccuucaccu

SEQ ID NO: 3052552 - RNA, 22 nt, Human
aagacugaguacguugugcauu

SEQ ID NO: 3052553 - RNA, 23 nt, Human
aagacugaguacguugugcauuu

SEQ ID NO: 3052554 - RNA, 16 nt, Human
aagacugcacaucaaa

SEQ ID NO: 3052555 - RNA, 23 nt, Human
aagaggaaugaaguacucauaca

SEQ ID NO: 3052556 - RNA, 21 nt, Human
guggccucccaacucacccca

SEQ ID NO: 3052557 - RNA, 22 nt, Human
guggccucccaacucaccccag

SEQ ID NO: 3052558 - RNA, 15 nt, Human
guggccucccaacuc

SEQ ID NO: 3052559 - RNA, 13 nt, Human
gugggacacccug

SEQ ID NO: 3052560 - RNA, 15 nt, Human
gugggacacccugug

SEQ ID NO: 3052561 - RNA, 14 nt, Human
gugggagcugccug

SEQ ID NO: 3052562 - RNA, 20 nt, Human
guggcgagccauuuguccca

SEQ ID NO: 3052563 - RNA, 23 nt, Human
guggcgagccauuugucccaagu

SEQ ID NO: 3052564 - RNA, 15 nt, Human
guggggucacucugg

SEQ ID NO: 3052565 - RNA, 18 nt, Human
gugggagcugccuguuca

SEQ ID NO: 3052566 - RNA, 15 nt, Human
gugggagcugccugu

SEQ ID NO: 3052567 - RNA, 19 nt, Human
guauaaaagggacugagaa

SEQ ID NO: 3052568 - RNA, 20 nt, Human
guaguguuggagaagaacug

SEQ ID NO: 3052569 - RNA, 17 nt, Human
guaguguuggagaagaa

SEQ ID NO: 3052570 - RNA, 16 nt, Human
aaauguaagggaaacu

SEQ ID NO: 3052571 - RNA, 22 nt, Human
guaacaggaaaauuuuaaaaau

SEQ ID NO: 3052572 - RNA, 12 nt, Human
guaacaggcaga

SEQ ID NO: 3052573 - RNA, 19 nt, Human
aaaugggggugcauuugag

SEQ ID NO: 3052574 - RNA, 20 nt, Human
guaacaggaaaauuuuaaaa

SEQ ID NO: 3052575 - RNA, 13 nt, Human
guaugguggcugg

SEQ ID NO: 3052576 - RNA, 14 nt, Human
guaugguggcuggg

SEQ ID NO: 3052577 - RNA, 16 nt, Human
guaugguggcuggguu

SEQ ID NO: 3052578 - RNA, 15 nt, Human
guaugguggcugggu

SEQ ID NO: 3052579 - RNA, 22 nt, Human
guaucaggugcugccauccagg

SEQ ID NO: 3052580 - RNA, 19 nt, Human
guaucccaugagccucagc

SEQ ID NO: 3052581 - RNA, 18 nt, Human
guauaaaagggacugaga

SEQ ID NO: 3052582 - RNA, 15 nt, Human
guauaaaauaauuuu

SEQ ID NO: 3052583 - RNA, 21 nt, Human
guauaaaauaauuuuuauauu

SEQ ID NO: 3052584 - RNA, 18 nt, Human
guaucaggugcugccauc

SEQ ID NO: 3052585 - RNA, 16 nt, Human
guaucaggugcugcca

SEQ ID NO: 3052586 - RNA, 16 nt, Human
guauauuuuauaucaa

SEQ ID NO: 3052587 - RNA, 14 nt, Human
aaauuaagaaagga

SEQ ID NO: 3052588 - RNA, 19 nt, Human
aaaugucuaguuguaacac

SEQ ID NO: 3052589 - RNA, 15 nt, Human
aaauguauuacagug

SEQ ID NO: 3052590 - RNA, 18 nt, Human
guauguacuucaugcugu

SEQ ID NO: 3052591 - RNA, 18 nt, Human
aaauucugucucuggauu

SEQ ID NO: 3052592 - RNA, 19 nt, Human
aaauuguaagcaugcacaa

SEQ ID NO: 3052593 - RNA, 20 nt, Human
aaauuguaagcaugcacaaa

SEQ ID NO: 3052594 - RNA, 16 nt, Human
aaauucugucucugga

SEQ ID NO: 3052595 - RNA, 17 nt, Human
gucaacacuaacaugau

SEQ ID NO: 3052596 - RNA, 16 nt, Human
gucaaauugugugaaa

SEQ ID NO: 3052597 - RNA, 12 nt, Human
guauuuuugaca

SEQ ID NO: 3052598 - RNA, 15 nt, Human
guauuuuugacagaa

SEQ ID NO: 3052599 - RNA, 22 nt, Human
guauuuuguuuuugucuuaaaa

SEQ ID NO: 3052600 - RNA, 13 nt, Human
aacagauaaucag

SEQ ID NO: 3052601 - RNA, 16 nt, Human
aacagauaaauaguuu

SEQ ID NO: 3052602 - RNA, 11 nt, Human
aacagaaaugu

SEQ ID NO: 3052603 - RNA, 14 nt, Human
aacagggccucugc

SEQ ID NO: 3052604 - RNA, 15 nt, Human
aacagugauuaccag

SEQ ID NO: 3052605 - RNA, 22 nt, Human
aacagugauuaccagggacuga

SEQ ID NO: 3052606 - RNA, 13 nt, Human
aacagaaauguac

SEQ ID NO: 3052607 - RNA, 12 nt, Human
aacagaaaugua

SEQ ID NO: 3052608 - RNA, 14 nt, Human
aacagaaauguaca

SEQ ID NO: 3052609 - RNA, 12 nt, Human
guccuacucugu

SEQ ID NO: 3052610 - RNA, 15 nt, Human
guccuacccacccuc

SEQ ID NO: 3052611 - RNA, 16 nt, Human
guccuacccacccucc

SEQ ID NO: 3052612 - RNA, 16 nt, Human
gucccccuuccaugga

SEQ ID NO: 3052613 - RNA, 18 nt, Human
gucccccuuccauggacu

SEQ ID NO: 3052614 - RNA, 14 nt, Human
gucccccuuccaug

SEQ ID NO: 3052615 - RNA, 18 nt, Human
gucccccugacaacacuc

SEQ ID NO: 3052616 - RNA, 13 nt, Human
guccaagaagccc

SEQ ID NO: 3052617 - RNA, 15 nt, Human
guccaagaagcccag

SEQ ID NO: 3052618 - RNA, 16 nt, Human
guccaagaagcccagg

SEQ ID NO: 3052619 - RNA, 20 nt, Human
guccaagaagcccaggaaag

SEQ ID NO: 3052620 - RNA, 17 nt, Human
guccaagaagcccagga

SEQ ID NO: 3052621 - RNA, 18 nt, Human
guccaagaagcccaggaa

SEQ ID NO: 3052622 - RNA, 21 nt, Human
gucauuuuuuuuaagaaaaag

SEQ ID NO: 3052623 - RNA, 19 nt, Human
gucauuuuuuuuaagaaaa

SEQ ID NO: 3052624 - RNA, 15 nt, Human
aacacagcaagggug

SEQ ID NO: 3052625 - RNA, 16 nt, Human
gucccaccuuggcugc

SEQ ID NO: 3052626 - RNA, 15 nt, Human
gucccaccuuggcug

SEQ ID NO: 3052627 - RNA, 14 nt, Human
gucccaccuuggcu

SEQ ID NO: 3052628 - RNA, 20 nt, Human
gucccaccccacacacgcca

SEQ ID NO: 3052629 - RNA, 21 nt, Human
gucccaccccacacacgccag

SEQ ID NO: 3052630 - RNA, 13 nt, Human
guccauagagagc

SEQ ID NO: 3052631 - RNA, 14 nt, Human
guccauagagagca

SEQ ID NO: 3052632 - RNA, 12 nt, Human
aacaauaaaaga

SEQ ID NO: 3052633 - RNA, 14 nt, Human
aacaaugcuguauu

SEQ ID NO: 3052634 - RNA, 15 nt, Human
aacaaugcuguauuu

SEQ ID NO: 3052635 - RNA, 18 nt, Human
aacaaggcaaggcuguca

SEQ ID NO: 3052636 - RNA, 21 nt, Human
aacaaggcaaggcugucaauu

SEQ ID NO: 3052637 - RNA, 15 nt, Human
aacacaacuauauug

SEQ ID NO: 3052638 - RNA, 16 nt, Human
aacacaacuauauugu

SEQ ID NO: 3052639 - RNA, 17 nt, Human
aacaaugcuguauuuua

SEQ ID NO: 3052640 - RNA, 22 nt, Human
aacaaugcuguauuuuaaaaga

SEQ ID NO: 3052641 - RNA, 19 nt, Human
aacaagaugguucuagcau

SEQ ID NO: 3052642 - RNA, 15 nt, Human
aacaaggcaaggcug

SEQ ID NO: 3052643 - RNA, 16 nt, Human
aacaaggcaaggcugu

SEQ ID NO: 3052644 - RNA, 20 nt, Human
aacaagaccacguuucuaaa

SEQ ID NO: 3052645 - RNA, 23 nt, Human
aaauuuugauguuuuaaggaugc

SEQ ID NO: 3052646 - RNA, 18 nt, Human
aaauuuugauguuuuaag

SEQ ID NO: 3052647 - RNA, 20 nt, Human
aaauuuuuucucuaggaaau

SEQ ID NO: 3052648 - RNA, 15 nt, Human
gucagugugacugau

SEQ ID NO: 3052649 - RNA, 18 nt, Human
aaauuuguuauaaugaau

SEQ ID NO: 3052650 - RNA, 17 nt, Human
gucagaauagaaauuag

SEQ ID NO: 3052651 - RNA, 13 nt, Human
gucagaauagaaa

SEQ ID NO: 3052652 - RNA, 23 nt, Human
gucagaaguuucugccgcagccc

SEQ ID NO: 3052653 - RNA, 21 nt, Human
gucacacaguauuacuucugc

SEQ ID NO: 3052654 - RNA, 22 nt, Human
gucacacaguauuacuucugcu

SEQ ID NO: 3052655 - RNA, 18 nt, Human
aacuucccagugaauucu

SEQ ID NO: 3052656 - RNA, 18 nt, Human
aacuuccagauccuggaa

SEQ ID NO: 3052657 - RNA, 13 nt, Human
aacuuccaauuua

SEQ ID NO: 3052658 - RNA, 21 nt, Human
aacuucagcgguuuauauaag

SEQ ID NO: 3052659 - RNA, 14 nt, Human
gugauggggcccug

SEQ ID NO: 3052660 - RNA, 16 nt, Human
gugauggggcccugcc

SEQ ID NO: 3052661 - RNA, 17 nt, Human
gugauggggcccugccu

SEQ ID NO: 3052662 - RNA, 18 nt, Human
gugauggggcccugccuc

SEQ ID NO: 3052663 - RNA, 22 nt, Human
gugaugcgcaugucacggaggg

SEQ ID NO: 3052664 - RNA, 17 nt, Human
gugaugggaaagcauug

SEQ ID NO: 3052665 - RNA, 14 nt, Human
gugaugagaggaaa

SEQ ID NO: 3052666 - RNA, 16 nt, Human
gugaugagaggaaauc

SEQ ID NO: 3052667 - RNA, 22 nt, Human
gugcaaugaccuuucaauagga

SEQ ID NO: 3052668 - RNA, 19 nt, Human
gugauggggcccugccucc

SEQ ID NO: 3052669 - RNA, 21 nt, Human
gugcacacaccagagcccacc

SEQ ID NO: 3052670 - RNA, 22 nt, Human
gugcaugcugucccuuacguga

SEQ ID NO: 3052671 - RNA, 19 nt, Human
gugcauuaucuagauacug

SEQ ID NO: 3052672 - RNA, 15 nt, Human
gugcauuaucuagau

SEQ ID NO: 3052673 - RNA, 19 nt, Human
gugcauguguguucaugca

SEQ ID NO: 3052674 - RNA, 23 nt, Human
gugcauuaucuagauacuguauc

SEQ ID NO: 3052675 - RNA, 23 nt, Human
gugccucucccugcugcuccuag

SEQ ID NO: 3052676 - RNA, 12 nt, Human
gugccucucccu

SEQ ID NO: 3052677 - RNA, 14 nt, Human
gugccucucccugc

SEQ ID NO: 3052678 - RNA, 16 nt, Human
gugccucucccugcug

SEQ ID NO: 3052679 - RNA, 22 nt, Human
gugccucucccugcugcuccua

SEQ ID NO: 3052680 - RNA, 15 nt, Human
aacugcugacuguuu

SEQ ID NO: 3052681 - RNA, 19 nt, Human
aacugcacugucaagauga

SEQ ID NO: 3052682 - RNA, 20 nt, Human
aacugcugacuguuuucucu

SEQ ID NO: 3052683 - RNA, 21 nt, Human
aacugcugacuguuuucucuu

SEQ ID NO: 3052684 - RNA, 23 nt, Human
aacugcugacuguuuucucuuga

SEQ ID NO: 3052685 - RNA, 15 nt, Human
aacuggauuaaacuu

SEQ ID NO: 3052686 - RNA, 19 nt, Human
aacuggacugguucaaaug

SEQ ID NO: 3052687 - RNA, 11 nt, Human
aacuggcugca

SEQ ID NO: 3052688 - RNA, 16 nt, Human
aacuggauuaaacuua

SEQ ID NO: 3052689 - RNA, 22 nt, Human
aacugggggagggugaagugaa

SEQ ID NO: 3052690 - RNA, 21 nt, Human
aacugggggagggugaaguga

SEQ ID NO: 3052691 - RNA, 21 nt, Human
aacuggguacuuguggacaca

SEQ ID NO: 3052692 - RNA, 16 nt, Human
aacuggguacuugugg

SEQ ID NO: 3052693 - RNA, 17 nt, Human
aacugggacaggggaga

SEQ ID NO: 3052694 - RNA, 17 nt, Human
gugaggccagagacaca

SEQ ID NO: 3052695 - RNA, 22 nt, Human
gugaggccagagacacaagccu

SEQ ID NO: 3052696 - RNA, 13 nt, Human
gugaggccagaga

SEQ ID NO: 3052697 - RNA, 17 nt, Human
gugaacuugggccacug

SEQ ID NO: 3052698 - RNA, 19 nt, Human
gugaacuugggccacugug

SEQ ID NO: 3052699 - RNA, 21 nt, Human
gugagaugcuagaacucccuu

SEQ ID NO: 3052700 - RNA, 22 nt, Human
gugagucgaggacagggaggug

SEQ ID NO: 3052701 - RNA, 15 nt, Human
gugagucgaggacag

SEQ ID NO: 3052702 - RNA, 21 nt, Human
aacucuucaaucucuugcacu

SEQ ID NO: 3052703 - RNA, 12 nt, Human
aacugaaaucau

SEQ ID NO: 3052704 - RNA, 14 nt, Human
aacccagauaaagg

SEQ ID NO: 3052705 - RNA, 10 nt, Human
aacccagcuc

SEQ ID NO: 3052706 - RNA, 12 nt, Human
aaccucuaaauu

SEQ ID NO: 3052707 - RNA, 18 nt, Human
aaccugagccccaaaagg

SEQ ID NO: 3052708 - RNA, 21 nt, Human
aaccaccacacccagcccacu

SEQ ID NO: 3052709 - RNA, 12 nt, Human
aaccaucauuga

SEQ ID NO: 3052710 - RNA, 17 nt, Human
aaccaucauugaaaucu

SEQ ID NO: 3052711 - RNA, 18 nt, Human
aaccaucauugaaaucuu

SEQ ID NO: 3052712 - RNA, 18 nt, Human
aacccaaguccaagcaua

SEQ ID NO: 3052713 - RNA, 23 nt, Human
aacccaaauguucaucaaugaau

SEQ ID NO: 3052714 - RNA, 20 nt, Human
aaccacauuggagauguuua

SEQ ID NO: 3052715 - RNA, 19 nt, Human
aaccaccacacccagccca

SEQ ID NO: 3052716 - RNA, 15 nt, Human
aaccaagucaaguga

SEQ ID NO: 3052717 - RNA, 22 nt, Human
aacucaucuagguaaauuacag

SEQ ID NO: 3052718 - RNA, 12 nt, Human
aacuccuggccu

SEQ ID NO: 3052719 - RNA, 12 nt, Human
aacucauuucua

SEQ ID NO: 3052720 - RNA, 15 nt, Human
aacucuccuccagag

SEQ ID NO: 3052721 - RNA, 18 nt, Human
aacucuccuccagaguca

SEQ ID NO: 3052722 - RNA, 16 nt, Human
aacucuccucugcugc

SEQ ID NO: 3052723 - RNA, 23 nt, Human
gugaaccaccacacccagcccac

SEQ ID NO: 3052724 - RNA, 22 nt, Human
gugaaccaccacacccagccca

SEQ ID NO: 3052725 - RNA, 18 nt, Human
aaccuugaaaacuuuaug

SEQ ID NO: 3052726 - RNA, 23 nt, Human
aacuaucucauuuccaagcaagu

SEQ ID NO: 3052727 - RNA, 21 nt, Human
aacuagaguuuagcuggaaaa

SEQ ID NO: 3052728 - RNA, 16 nt, Human
gucuuucacauuuaaa

SEQ ID NO: 3052729 - RNA, 18 nt, Human
gucuuuggacccugaggc

SEQ ID NO: 3052730 - RNA, 20 nt, Human
aaccugagccccaaaaggua

SEQ ID NO: 3052731 - RNA, 14 nt, Human
gucuggcccuuccu

SEQ ID NO: 3052732 - RNA, 15 nt, Human
acacgaauauugcug

SEQ ID NO: 3052733 - RNA, 21 nt, Human
acacgaauauugcugauggug

SEQ ID NO: 3052734 - RNA, 20 nt, Human
acaccacuacauucuguuaa

SEQ ID NO: 3052735 - RNA, 17 nt, Human
acaccacuacauucugu

SEQ ID NO: 3052736 - RNA, 12 nt, Human
acacgaauauug

SEQ ID NO: 3052737 - RNA, 14 nt, Human
acacgaauauugcu

SEQ ID NO: 3052738 - RNA, 15 nt, Human
acaccacuacauucu

SEQ ID NO: 3052739 - RNA, 14 nt, Human
acaccacuacauuc

SEQ ID NO: 3052740 - RNA, 18 nt, Human
acacauuuuuuaaaugca

SEQ ID NO: 3052741 - RNA, 16 nt, Human
acacauuuuuuaaaug

SEQ ID NO: 3052742 - RNA, 14 nt, Human
acacauuuuuuaaa

SEQ ID NO: 3052743 - RNA, 21 nt, Human
acacagcucuucuccaggcug

SEQ ID NO: 3052744 - RNA, 20 nt, Human
acacagcucuucuccaggcu

SEQ ID NO: 3052745 - RNA, 19 nt, Human
acacaaaaguuucucuuuu

SEQ ID NO: 3052746 - RNA, 19 nt, Human
acacagcucuucuccaggc

SEQ ID NO: 3052747 - RNA, 20 nt, Human
acaaggaugaucuaggaaga

SEQ ID NO: 3052748 - RNA, 16 nt, Human
acaaggauugcuacug

SEQ ID NO: 3052749 - RNA, 13 nt, Human
acaauuuauuaug

SEQ ID NO: 3052750 - RNA, 20 nt, Human
acacugggagaaaugaaaaa

SEQ ID NO: 3052751 - RNA, 17 nt, Human
acacugugcugagucug

SEQ ID NO: 3052752 - RNA, 22 nt, Human
acacugugcugagucugaaggc

SEQ ID NO: 3052753 - RNA, 13 nt, Human
acagaggcagccc

SEQ ID NO: 3052754 - RNA, 21 nt, Human
acagaggccaugggccuccug

SEQ ID NO: 3052755 - RNA, 14 nt, Human
acagaggggguggc

SEQ ID NO: 3052756 - RNA, 17 nt, Human
acagaggccaugggccu

SEQ ID NO: 3052757 - RNA, 23 nt, Human
acagaggcagccccauucugccu

SEQ ID NO: 3052758 - RNA, 14 nt, Human
acagacaaagcgug

SEQ ID NO: 3052759 - RNA, 13 nt, Human
acagacaaagcgu

SEQ ID NO: 3052760 - RNA, 16 nt, Human
acagaagcuccaggua

SEQ ID NO: 3052761 - RNA, 16 nt, Human
acaaagaaauuaugug

SEQ ID NO: 3052762 - RNA, 14 nt, Human
acaaagaaauuaug

SEQ ID NO: 3052763 - RNA, 12 nt, Human
acaaagaaauua

SEQ ID NO: 3052764 - RNA, 13 nt, Human
acaaaaugaaacg

SEQ ID NO: 3052765 - RNA, 22 nt, Human
acaaaaugaaacgcaaccacca

SEQ ID NO: 3052766 - RNA, 13 nt, Human
acaaaauggaaua

SEQ ID NO: 3052767 - RNA, 14 nt, Human
acaaaauggaauac

SEQ ID NO: 3052768 - RNA, 21 nt, Human
acaaggaugaauuaaguuuuu

SEQ ID NO: 3052769 - RNA, 15 nt, Human
acaagaaaugaaagc

SEQ ID NO: 3052770 - RNA, 16 nt, Human
acaagaaaugaaagca

SEQ ID NO: 3052771 - RNA, 13 nt, Human
acaagaaaugaaa

SEQ ID NO: 3052772 - RNA, 18 nt, Human
aauuuucaucuaggauuu

SEQ ID NO: 3052773 - RNA, 16 nt, Human
aauuuugugcccccau

SEQ ID NO: 3052774 - RNA, 18 nt, Human
aauuuugugaagcaaaau

SEQ ID NO: 3052775 - RNA, 13 nt, Human
aauuuugugaagc

SEQ ID NO: 3052776 - RNA, 17 nt, Human
aauuuugugaagcaaaa

SEQ ID NO: 3052777 - RNA, 14 nt, Human
aauuuugauguuuu

SEQ ID NO: 3052778 - RNA, 17 nt, Human
aauuuauuauggcacau

SEQ ID NO: 3052779 - RNA, 20 nt, Human
aauuuauuuaugggauccug

SEQ ID NO: 3052780 - RNA, 19 nt, Human
aaugucacaggcaggucca

SEQ ID NO: 3052781 - RNA, 16 nt, Human
aaugucacaggcaggu

SEQ ID NO: 3052782 - RNA, 12 nt, Human
aauuguaaggaa

SEQ ID NO: 3052783 - RNA, 16 nt, Human
aauuguaaggaaugau

SEQ ID NO: 3052784 - RNA, 17 nt, Human
aauuuccugggagcuuu

SEQ ID NO: 3052785 - RNA, 18 nt, Human
aauuuccugggagcuuuu

SEQ ID NO: 3052786 - RNA, 21 nt, Human
aauuuccugggagcuuuugua

SEQ ID NO: 3052787 - RNA, 17 nt, Human
acauuuccuaaauauau

SEQ ID NO: 3052788 - RNA, 16 nt, Human
acauuuccuaaauaua

SEQ ID NO: 3052789 - RNA, 23 nt, Human
acaugucuuuucuugcaugaggc

SEQ ID NO: 3052790 - RNA, 19 nt, Human
acaugccucucucaggcca

SEQ ID NO: 3052791 - RNA, 12 nt, Human
accagcagagca

SEQ ID NO: 3052792 - RNA, 13 nt, Human
accagcagagcac

SEQ ID NO: 3052793 - RNA, 14 nt, Human
accagcagaaaugc

SEQ ID NO: 3052794 - RNA, 17 nt, Human
accagccccagugccca

SEQ ID NO: 3052795 - RNA, 16 nt, Human
accagccccagugccc

SEQ ID NO: 3052796 - RNA, 19 nt, Human
accagccccagugcccaca

SEQ ID NO: 3052797 - RNA, 18 nt, Human
accagccccagugcccac

SEQ ID NO: 3052798 - RNA, 20 nt, Human
accagccccagugcccacag

SEQ ID NO: 3052799 - RNA, 19 nt, Human
accaaggcugauuaaacca

SEQ ID NO: 3052800 - RNA, 20 nt, Human
accaaggcugauuaaaccaa

SEQ ID NO: 3052801 - RNA, 23 nt, Human
accaucauugaaaucuuuuugcu

SEQ ID NO: 3052802 - RNA, 15 nt, Human
accaucauugaaauc

SEQ ID NO: 3052803 - RNA, 12 nt, Human
accaucauugaa

SEQ ID NO: 3052804 - RNA, 15 nt, Human
accaucaagccacca

SEQ ID NO: 3052805 - RNA, 14 nt, Human
accaucaagccacc

SEQ ID NO: 3052806 - RNA, 15 nt, Human
acccacccccaccca

SEQ ID NO: 3052807 - RNA, 17 nt, Human
acccacccccacccaag

SEQ ID NO: 3052808 - RNA, 15 nt, Human
acccacccuccuuuc

SEQ ID NO: 3052809 - RNA, 13 nt, Human
acccaugcugccc

SEQ ID NO: 3052810 - RNA, 19 nt, Human
acauaauuaaauuuugagu

SEQ ID NO: 3052811 - RNA, 15 nt, Human
acauaaguaauucaa

SEQ ID NO: 3052812 - RNA, 15 nt, Human
acauaagauaaaugu

SEQ ID NO: 3052813 - RNA, 16 nt, Human
acauaagauaaaugug

SEQ ID NO: 3052814 - RNA, 16 nt, Human
acaugcaaggucauuu

SEQ ID NO: 3052815 - RNA, 20 nt, Human
acaucccuuaccugggaaag

SEQ ID NO: 3052816 - RNA, 15 nt, Human
acaugccucucucag

SEQ ID NO: 3052817 - RNA, 16 nt, Human
acaugccucucucagg

SEQ ID NO: 3052818 - RNA, 17 nt, Human
acaugccucucucaggc

SEQ ID NO: 3052819 - RNA, 18 nt, Human
acaugccucucucaggcc

SEQ ID NO: 3052820 - RNA, 17 nt, Human
acaugcaaggucauuuu

SEQ ID NO: 3052821 - RNA, 13 nt, Human
acagcucuguccu

SEQ ID NO: 3052822 - RNA, 16 nt, Human
acagcucuguccuggg

SEQ ID NO: 3052823 - RNA, 23 nt, Human
acaggcaagcaccuccugccucg

SEQ ID NO: 3052824 - RNA, 20 nt, Human
acaggcaagcaccuccugcc

SEQ ID NO: 3052825 - RNA, 14 nt, Human
acagcucuguccug

SEQ ID NO: 3052826 - RNA, 18 nt, Human
acagcuccuucuguccua

SEQ ID NO: 3052827 - RNA, 16 nt, Human
acagcuccuucugucc

SEQ ID NO: 3052828 - RNA, 17 nt, Human
acagaggggguggccuc

SEQ ID NO: 3052829 - RNA, 18 nt, Human
acagaggggguggccucc

SEQ ID NO: 3052830 - RNA, 19 nt, Human
acagaggggguggccuccc

SEQ ID NO: 3052831 - RNA, 15 nt, Human
acagcuccuucuguc

SEQ ID NO: 3052832 - RNA, 19 nt, Human
acaggcaagcaccuccugc

SEQ ID NO: 3052833 - RNA, 13 nt, Human
acagggccucugc

SEQ ID NO: 3052834 - RNA, 17 nt, Human
acagggccucugcggag

SEQ ID NO: 3052835 - RNA, 12 nt, Human
acagggccucug

SEQ ID NO: 3052836 - RNA, 23 nt, Human
acaggugugagucaccaagccca

SEQ ID NO: 3052837 - RNA, 22 nt, Human
acaggugugagucaccaagccc

SEQ ID NO: 3052838 - RNA, 19 nt, Human
acaggugugaaccaccaca

SEQ ID NO: 3052839 - RNA, 22 nt, Human
acagugagucgaggacagggag

SEQ ID NO: 3052840 - RNA, 23 nt, Human
acagugagucgaggacagggagg

SEQ ID NO: 3052841 - RNA, 20 nt, Human
acagugauuaccagggacug

SEQ ID NO: 3052842 - RNA, 21 nt, Human
acagugauuaccagggacuga

SEQ ID NO: 3052843 - RNA, 19 nt, Human
acaguggggaaugaagaua

SEQ ID NO: 3052844 - RNA, 15 nt, Human
acaguggggaaugaa

SEQ ID NO: 3052845 - RNA, 15 nt, Human
acuuuauuuuguguu

SEQ ID NO: 3052846 - RNA, 12 nt, Human
acuuuaugcuaa

SEQ ID NO: 3052847 - RNA, 17 nt, Human
acuuuaugcuaagugaa

SEQ ID NO: 3052848 - RNA, 22 nt, Human
acuugggaggcugagaugggag

SEQ ID NO: 3052849 - RNA, 14 nt, Human
acuuaaauaaugug

SEQ ID NO: 3052850 - RNA, 19 nt, Human
acuucaaauccuugaagau

SEQ ID NO: 3052851 - RNA, 13 nt, Human
acuuaaaaauggu

SEQ ID NO: 3052852 - RNA, 14 nt, Human
acuuaaaaaugguu

SEQ ID NO: 3052853 - RNA, 20 nt, Human
acuucugccauauucuguug

SEQ ID NO: 3052854 - RNA, 19 nt, Human
acuucugccauauucuguu

SEQ ID NO: 3052855 - RNA, 19 nt, Human
acuucagcgguuuauauaa

SEQ ID NO: 3052856 - RNA, 20 nt, Human
acuucaaauccuugaagauu

SEQ ID NO: 3052857 - RNA, 17 nt, Human
acuucagcgguuuauau

SEQ ID NO: 3052858 - RNA, 18 nt, Human
acuucagcgguuuauaua

SEQ ID NO: 3052859 - RNA, 17 nt, Human
acuucuuauacauuuga

SEQ ID NO: 3052860 - RNA, 23 nt, Human
acugacauuguuggccaaagcca

SEQ ID NO: 3052861 - RNA, 22 nt, Human
acugacauuguuggccaaagcc

SEQ ID NO: 3052862 - RNA, 13 nt, Human
acugaucucucgu

SEQ ID NO: 3052863 - RNA, 22 nt, Human
acugauggcuaauguacugcau

SEQ ID NO: 3052864 - RNA, 22 nt, Human
acugaugggcaacccccagccu

SEQ ID NO: 3052865 - RNA, 12 nt, Human
acugaugggcaa

SEQ ID NO: 3052866 - RNA, 23 nt, Human
acugauuuuuuuuuccuucagug

SEQ ID NO: 3052867 - RNA, 21 nt, Human
acugauuuuuuuuuccuucag

SEQ ID NO: 3052868 - RNA, 22 nt, Human
acugauuuuuuuuuccuucagu

SEQ ID NO: 3052869 - RNA, 19 nt, Human
acucugugucagguggggc

SEQ ID NO: 3052870 - RNA, 21 nt, Human
acucugugucagguggggcag

SEQ ID NO: 3052871 - RNA, 15 nt, Human
acucugucucagucc

SEQ ID NO: 3052872 - RNA, 17 nt, Human
acucugucucaguccau

SEQ ID NO: 3052873 - RNA, 19 nt, Human
acucugucucaaaaaaaca

SEQ ID NO: 3052874 - RNA, 20 nt, Human
acucuuaagaagacugcauu

SEQ ID NO: 3052875 - RNA, 14 nt, Human
acucuuaagaagac

SEQ ID NO: 3052876 - RNA, 15 nt, Human
acucuuaagaagacu

SEQ ID NO: 3052877 - RNA, 15 nt, Human
acugcccggcagggu

SEQ ID NO: 3052878 - RNA, 14 nt, Human
acugccauccuggc

SEQ ID NO: 3052879 - RNA, 20 nt, Human
acugcuuuuggucuguguga

SEQ ID NO: 3052880 - RNA, 16 nt, Human
acugcuuuuggucugu

SEQ ID NO: 3052881 - RNA, 15 nt, Human
acugcuuuuggucug

SEQ ID NO: 3052882 - RNA, 14 nt, Human
acugcuuuuggucu

SEQ ID NO: 3052883 - RNA, 22 nt, Human
acugcccggcaggguccuagaa

SEQ ID NO: 3052884 - RNA, 19 nt, Human
acugccauccuggcccagg

SEQ ID NO: 3052885 - RNA, 18 nt, Human
acuaguauuucuaugaaa

SEQ ID NO: 3052886 - RNA, 16 nt, Human
acuauuguuagucucu

SEQ ID NO: 3052887 - RNA, 17 nt, Human
acuagggaagauaauau

SEQ ID NO: 3052888 - RNA, 18 nt, Human
acgcuggagugcagugag

SEQ ID NO: 3052889 - RNA, 19 nt, Human
acgcuggagugcagugagc

SEQ ID NO: 3052890 - RNA, 19 nt, Human
acggacacucaaaagcugg

SEQ ID NO: 3052891 - RNA, 19 nt, Human
acggacgaaccuugaaaac

SEQ ID NO: 3052892 - RNA, 15 nt, Human
acggaagagccuugc

SEQ ID NO: 3052893 - RNA, 16 nt, Human
acggaagagccuugcg

SEQ ID NO: 3052894 - RNA, 23 nt, Human
acgucugacaggcaaugcuggcu

SEQ ID NO: 3052895 - RNA, 15 nt, Human
acgucugacaggcaa

SEQ ID NO: 3052896 - RNA, 15 nt, Human
acuaauagacaauuu

SEQ ID NO: 3052897 - RNA, 11 nt, Human
accugugucuc

SEQ ID NO: 3052898 - RNA, 19 nt, Human
accgggccacagagaaagu

SEQ ID NO: 3052899 - RNA, 15 nt, Human
accgggccacagaga

SEQ ID NO: 3052900 - RNA, 14 nt, Human
accgugaggccaga

SEQ ID NO: 3052901 - RNA, 14 nt, Human
accggcuggccugg

SEQ ID NO: 3052902 - RNA, 15 nt, Human
accggcuggccuggc

SEQ ID NO: 3052903 - RNA, 17 nt, Human
accggcuggccuggccc

SEQ ID NO: 3052904 - RNA, 18 nt, Human
accggcuggccuggcccc

SEQ ID NO: 3052905 - RNA, 19 nt, Human
accggcuggccuggccccu

SEQ ID NO: 3052906 - RNA, 20 nt, Human
accgggcacucagaagacac

SEQ ID NO: 3052907 - RNA, 17 nt, Human
acccuguuaccauuuug

SEQ ID NO: 3052908 - RNA, 22 nt, Human
acccugugauggggcccugccu

SEQ ID NO: 3052909 - RNA, 16 nt, Human
accccacacacgccag

SEQ ID NO: 3052910 - RNA, 14 nt, Human
acccaugcugcccu

SEQ ID NO: 3052911 - RNA, 15 nt, Human
acccaugcugcccug

SEQ ID NO: 3052912 - RNA, 15 nt, Human
accccaagacuccca

SEQ ID NO: 3052913 - RNA, 16 nt, Human
accccaagacucccau

SEQ ID NO: 3052914 - RNA, 17 nt, Human
accccaagacucccaug

SEQ ID NO: 3052915 - RNA, 18 nt, Human
accccaagacucccauga

SEQ ID NO: 3052916 - RNA, 16 nt, Human
accgugaggccagaga

SEQ ID NO: 3052917 - RNA, 17 nt, Human
accgugaggccagagac

SEQ ID NO: 3052918 - RNA, 12 nt, Human
accucaggccug

SEQ ID NO: 3052919 - RNA, 13 nt, Human
accucaggccugg

SEQ ID NO: 3052920 - RNA, 14 nt, Human
accucaggccuggg

SEQ ID NO: 3052921 - RNA, 22 nt, Human
accucaggccugggggcugggc

SEQ ID NO: 3052922 - RNA, 18 nt, Human
accucaggugagaagcag

SEQ ID NO: 3052923 - RNA, 20 nt, Human
accucuugagccuugaacuu

SEQ ID NO: 3052924 - RNA, 19 nt, Human
accucuugagccuugaacu

SEQ ID NO: 3052925 - RNA, 17 nt, Human
accucuugagccuugaa

SEQ ID NO: 3052926 - RNA, 17 nt, Human
accucugccucagaaaa

SEQ ID NO: 3052927 - RNA, 18 nt, Human
accucugccucagaaaac

SEQ ID NO: 3052928 - RNA, 11 nt, Human
accugccaggg

SEQ ID NO: 3052929 - RNA, 12 nt, Human
accugccaggga

SEQ ID NO: 3052930 - RNA, 13 nt, Human
accugccagggac

SEQ ID NO: 3052931 - RNA, 15 nt, Human
accugccagggacag

SEQ ID NO: 3052932 - RNA, 16 nt, Human
accugccagggacaga

SEQ ID NO: 3052933 - RNA, 18 nt, Human
accugccagggacagagg

SEQ ID NO: 3052934 - RNA, 21 nt, Human
aaauguuuuuuuuuaaagacu

SEQ ID NO: 3052935 - RNA, 18 nt, Human
aaauguuuuuuuuuaaag

SEQ ID NO: 3052936 - RNA, 17 nt, Human
aaauguucaucaaugaa

SEQ ID NO: 3052937 - RNA, 20 nt, Human
aaauguucaucaaugaauga

SEQ ID NO: 3052938 - RNA, 18 nt, Human
aaauugaugggauuuggu

SEQ ID NO: 3052939 - RNA, 14 nt, Human
aaauugauguguuu

SEQ ID NO: 3052940 - RNA, 22 nt, Human
aaauguuuuuuuuuaaagacuu

SEQ ID NO: 3052941 - RNA, 12 nt, Human
aaauuaacuuuu

SEQ ID NO: 3052942 - RNA, 14 nt, Human
aaauuaacuuuuau

SEQ ID NO: 3052943 - RNA, 13 nt, Human
aaauuaacuuuua

SEQ ID NO: 3052944 - RNA, 22 nt, Human
aaauugacacuuaaaaaugguu

SEQ ID NO: 3052945 - RNA, 17 nt, Human
aacacuaacaugauuug

SEQ ID NO: 3052946 - RNA, 21 nt, Human
aacacauacaggaagguagaa

SEQ ID NO: 3052947 - RNA, 22 nt, Human
aacaaaccuguuucugcagcca

SEQ ID NO: 3052948 - RNA, 20 nt, Human
aaaugcuagguuaauuccaa

SEQ ID NO: 3052949 - RNA, 14 nt, Human
aaaucuuaacuuga

SEQ ID NO: 3052950 - RNA, 19 nt, Human
aaaucuccaaaauaaaacu

SEQ ID NO: 3052951 - RNA, 22 nt, Human
aaaucuccaaaauaaaacuuuu

SEQ ID NO: 3052952 - RNA, 15 nt, Human
aaauggacguguuau

SEQ ID NO: 3052953 - RNA, 17 nt, Human
aaauggacguguuauga

SEQ ID NO: 3052954 - RNA, 14 nt, Human
aaauggacguguua

SEQ ID NO: 3052955 - RNA, 17 nt, Human
aaauggaauacucuuau

SEQ ID NO: 3052956 - RNA, 15 nt, Human
aacguauaaaagccu

SEQ ID NO: 3052957 - RNA, 15 nt, Human
aacucaccccagccc

SEQ ID NO: 3052958 - RNA, 18 nt, Human
aacucaccccagccccaa

SEQ ID NO: 3052959 - RNA, 16 nt, Human
aacucaccccagcccc

SEQ ID NO: 3052960 - RNA, 17 nt, Human
aacucaccccagcccca

SEQ ID NO: 3052961 - RNA, 17 nt, Human
aacucaaacucuuaaaa

SEQ ID NO: 3052962 - RNA, 23 nt, Human
aacugagaugugaacacaucagc

SEQ ID NO: 3052963 - RNA, 18 nt, Human
aacucauauuuucaugcu

SEQ ID NO: 3052964 - RNA, 15 nt, Human
aacucauauuuucau

SEQ ID NO: 3052965 - RNA, 16 nt, Human
aacucauauuuucaug

SEQ ID NO: 3052966 - RNA, 16 nt, Human
aacagcuaaugggaca

SEQ ID NO: 3052967 - RNA, 15 nt, Human
aacaucccuccuggg

SEQ ID NO: 3052968 - RNA, 17 nt, Human
aaccaguguuguggauu

SEQ ID NO: 3052969 - RNA, 19 nt, Human
aaccaguguuguggauuua

SEQ ID NO: 3052970 - RNA, 13 nt, Human
aacccuucagugc

SEQ ID NO: 3052971 - RNA, 15 nt, Human
aacauggaaguacua

SEQ ID NO: 3052972 - RNA, 22 nt, Human
aacaugcuacacacugcauguu

SEQ ID NO: 3052973 - RNA, 19 nt, Human
aaccgagggggcugcuccc

SEQ ID NO: 3052974 - RNA, 20 nt, Human
aaccgagggggcugcuccca

SEQ ID NO: 3052975 - RNA, 21 nt, Human
aaccgagggggcugcucccac

SEQ ID NO: 3052976 - RNA, 16 nt, Human
aaaauuauuuuguuca

SEQ ID NO: 3052977 - RNA, 18 nt, Human
aaaauuauuuuguucaua

SEQ ID NO: 3052978 - RNA, 20 nt, Human
aaaauuauuuuguucauaca

SEQ ID NO: 3052979 - RNA, 17 nt, Human
aaacagcuaaugggaca

SEQ ID NO: 3052980 - RNA, 20 nt, Human
aaaauuaagaaaggauaaag

SEQ ID NO: 3052981 - RNA, 13 nt, Human
aaaauuaagaaag

SEQ ID NO: 3052982 - RNA, 12 nt, Human
aaaauuaagaaa

SEQ ID NO: 3052983 - RNA, 22 nt, Human
aaaauuaacaugaauauuuagu

SEQ ID NO: 3052984 - RNA, 19 nt, Human
aaaauccauacauuugugu

SEQ ID NO: 3052985 - RNA, 15 nt, Human
aaaauuagccaagug

SEQ ID NO: 3052986 - RNA, 15 nt, Human
aaaauaaaaaacacu

SEQ ID NO: 3052987 - RNA, 21 nt, Human
aaaauccacuuuaucuugaau

SEQ ID NO: 3052988 - RNA, 20 nt, Human
aaauaaaaauauuguguugu

SEQ ID NO: 3052989 - RNA, 19 nt, Human
aaauaaaccucaaaauguc

SEQ ID NO: 3052990 - RNA, 15 nt, Human
aaauaaacgucuuaa

SEQ ID NO: 3052991 - RNA, 16 nt, Human
aaauaaacgucuuaaa

SEQ ID NO: 3052992 - RNA, 11 nt, Human
aaauaaauuau

SEQ ID NO: 3052993 - RNA, 19 nt, Human
aaaggcagaagcaacccaa

SEQ ID NO: 3052994 - RNA, 22 nt, Human
aaaggcuccaggagcagccaca

SEQ ID NO: 3052995 - RNA, 21 nt, Human
aaaggcuccaggagcagccac

SEQ ID NO: 3052996 - RNA, 14 nt, Human
aaaggcuaccuuug

SEQ ID NO: 3052997 - RNA, 17 nt, Human
aaaggcuaccuuuguau

SEQ ID NO: 3052998 - RNA, 14 nt, Human
aaaggcuccaggag

SEQ ID NO: 3052999 - RNA, 15 nt, Human
aaagccaaagcuagg

SEQ ID NO: 3053000 - RNA, 20 nt, Human
aaagcauuguaaaugugcuu

SEQ ID NO: 3053001 - RNA, 19 nt, Human
aaagcauuguaaaugugcu

SEQ ID NO: 3053002 - RNA, 15 nt, Human
aaagauacaguuacu

SEQ ID NO: 3053003 - RNA, 22 nt, Human
aaaccucaaaaugucuaagaua

SEQ ID NO: 3053004 - RNA, 17 nt, Human
aaaccucaaaaugucua

SEQ ID NO: 3053005 - RNA, 17 nt, Human
aaacucuugaccucagg

SEQ ID NO: 3053006 - RNA, 14 nt, Human
aaacccuucagugc

SEQ ID NO: 3053007 - RNA, 21 nt, Human
aaacccugucucuacuaaaaa

SEQ ID NO: 3053008 - RNA, 17 nt, Human
aaaccccaucucuacaa

SEQ ID NO: 3053009 - RNA, 18 nt, Human
aaacccagcucuggucca

SEQ ID NO: 3053010 - RNA, 20 nt, Human
aaacugauuuuuuuuuccuu

SEQ ID NO: 3053011 - RNA, 13 nt, Human
aaacugauuuuuu

SEQ ID NO: 3053012 - RNA, 19 nt, Human
aaacugauuuuuuuuuccu

SEQ ID NO: 3053013 - RNA, 13 nt, Human
aaagaaacauuug

SEQ ID NO: 3053014 - RNA, 15 nt, Human
aauccaaugaaauga

SEQ ID NO: 3053015 - RNA, 16 nt, Human
aauccauacauuugug

SEQ ID NO: 3053016 - RNA, 14 nt, Human
aauccauacauuug

SEQ ID NO: 3053017 - RNA, 17 nt, Human
aauccauacauuugugu

SEQ ID NO: 3053018 - RNA, 18 nt, Human
aaucuccaaaauaaaacu

SEQ ID NO: 3053019 - RNA, 12 nt, Human
aaugauuaauua

SEQ ID NO: 3053020 - RNA, 13 nt, Human
aaugauuaauuaa

SEQ ID NO: 3053021 - RNA, 15 nt, Human
aaugauagcuacugu

SEQ ID NO: 3053022 - RNA, 15 nt, Human
aaugauaacuggaaa

SEQ ID NO: 3053023 - RNA, 16 nt, Human
aaugauaacuggaaac

SEQ ID NO: 3053024 - RNA, 14 nt, Human
aaugauaacuggaa

SEQ ID NO: 3053025 - RNA, 22 nt, Human
aaucauuucugcaucagcugcu

SEQ ID NO: 3053026 - RNA, 22 nt, Human
aaucaaauaugcaaagcacuga

SEQ ID NO: 3053027 - RNA, 16 nt, Human
aaucaaauaugcaaag

SEQ ID NO: 3053028 - RNA, 15 nt, Human
aaucaaauaugcaaa

SEQ ID NO: 3053029 - RNA, 17 nt, Human
aaugggggugcauuuga

SEQ ID NO: 3053030 - RNA, 15 nt, Human
aaugggggugcauuu

SEQ ID NO: 3053031 - RNA, 15 nt, Human
aaugucacaggcagg

SEQ ID NO: 3053032 - RNA, 23 nt, Human
aaugcucuuuacuucauggacuu

SEQ ID NO: 3053033 - RNA, 14 nt, Human
aaugggagcucaug

SEQ ID NO: 3053034 - RNA, 13 nt, Human
aaugggacacuaa

SEQ ID NO: 3053035 - RNA, 23 nt, Human
aaugcgugcauaccacuuuuguu

SEQ ID NO: 3053036 - RNA, 21 nt, Human
aaugcgugcauaccacuuuug

SEQ ID NO: 3053037 - RNA, 14 nt, Human
aauaauaaauauuu

SEQ ID NO: 3053038 - RNA, 19 nt, Human
aauaaagcuguguggcagu

SEQ ID NO: 3053039 - RNA, 11 nt, Human
aauaaagcugu

SEQ ID NO: 3053040 - RNA, 20 nt, Human
aauaaaccucaaaaugucua

SEQ ID NO: 3053041 - RNA, 15 nt, Human
aauaaacgucuuaaa

SEQ ID NO: 3053042 - RNA, 17 nt, Human
aauaaaccucaaaaugu

SEQ ID NO: 3053043 - RNA, 10 nt, Human
aauaaaccau

SEQ ID NO: 3053044 - RNA, 12 nt, Human
aauaaaauuuuu

SEQ ID NO: 3053045 - RNA, 13 nt, Human
aagugcugcauuu

SEQ ID NO: 3053046 - RNA, 22 nt, Human
aaguugauaugccuuuucccaa

SEQ ID NO: 3053047 - RNA, 17 nt, Human
aaguucugcagauaaac

SEQ ID NO: 3053048 - RNA, 12 nt, Human
aauaauguuuca

SEQ ID NO: 3053049 - RNA, 19 nt, Human
aauaauguuaacauggaca

SEQ ID NO: 3053050 - RNA, 14 nt, Human
aauaauguuucaaa

SEQ ID NO: 3053051 - RNA, 21 nt, Human
aauaccugucccccugacaac

SEQ ID NO: 3053052 - RNA, 19 nt, Human
aauacgugggcauucaaau

SEQ ID NO: 3053053 - RNA, 20 nt, Human
aauacgugggcauucaaaug

SEQ ID NO: 3053054 - RNA, 13 nt, Human
aagauuuucagaa

SEQ ID NO: 3053055 - RNA, 19 nt, Human
aagauuuugaaauuuuuau

SEQ ID NO: 3053056 - RNA, 19 nt, Human
aagccaccaacauacuccc

SEQ ID NO: 3053057 - RNA, 15 nt, Human
aagcagggacuugaa

SEQ ID NO: 3053058 - RNA, 21 nt, Human
aagcagaggaaggagaggaga

SEQ ID NO: 3053059 - RNA, 20 nt, Human
aagauucauauuuacuucuu

SEQ ID NO: 3053060 - RNA, 20 nt, Human
aagauucaaugccccugaau

SEQ ID NO: 3053061 - RNA, 21 nt, Human
aagauucaaugccccugaauu

SEQ ID NO: 3053062 - RNA, 14 nt, Human
aagauacugaaaua

SEQ ID NO: 3053063 - RNA, 16 nt, Human
aagauacugaaauaaa

SEQ ID NO: 3053064 - RNA, 20 nt, Human
aagauacugaaauaaacguc

SEQ ID NO: 3053065 - RNA, 23 nt, Human
aagacagugaaagaaaauaacaa

SEQ ID NO: 3053066 - RNA, 21 nt, Human
aagacauucuuccaaaaagau

SEQ ID NO: 3053067 - RNA, 16 nt, Human
aagacuuuggaaagag

SEQ ID NO: 3053068 - RNA, 15 nt, Human
aagacuuuuaugaua

SEQ ID NO: 3053069 - RNA, 16 nt, Human
aagacuuuggaaagac

SEQ ID NO: 3053070 - RNA, 15 nt, Human
aagagaacuuccaga

SEQ ID NO: 3053071 - RNA, 12 nt, Human
aaggaauuuuau

SEQ ID NO: 3053072 - RNA, 11 nt, Human
aagcugccagc

SEQ ID NO: 3053073 - RNA, 12 nt, Human
aagcugccagcc

SEQ ID NO: 3053074 - RNA, 22 nt, Human
aagcugccagccgagauagcca

SEQ ID NO: 3053075 - RNA, 14 nt, Human
aagcugcugacagu

SEQ ID NO: 3053076 - RNA, 20 nt, Human
aagcgugagccacugcaccg

SEQ ID NO: 3053077 - RNA, 17 nt, Human
aagcgugagccacugca

SEQ ID NO: 3053078 - RNA, 21 nt, Human
aagcgugagccacugcaccgg

SEQ ID NO: 3053079 - RNA, 16 nt, Human
aagcugcugacagugu

SEQ ID NO: 3053080 - RNA, 23 nt, Human
aaggaaugauuaauuaaaacaca

SEQ ID NO: 3053081 - RNA, 21 nt, Human
aagccaccaacauacucccau

SEQ ID NO: 3053082 - RNA, 19 nt, Human
aagccagauuuuccugaaa

SEQ ID NO: 3053083 - RNA, 18 nt, Human
aagccagcaggcucucag

SEQ ID NO: 3053084 - RNA, 15 nt, Human
aagccagcaggcucu

SEQ ID NO: 3053085 - RNA, 16 nt, Human
aagcgauucuucugcu

SEQ ID NO: 3053086 - RNA, 16 nt, Human
aagcgugagccacugc

SEQ ID NO: 3053087 - RNA, 14 nt, Human
aagcgauucuucug

SEQ ID NO: 3053088 - RNA, 15 nt, Human
aagcgauucuucugc

SEQ ID NO: 3053089 - RNA, 17 nt, Human
aagggacugagaaauuu

SEQ ID NO: 3053090 - RNA, 15 nt, Human
aagggacugagaaau

SEQ ID NO: 3053091 - RNA, 18 nt, Human
aagggacgcuacccggga

SEQ ID NO: 3053092 - RNA, 20 nt, Human
aagggacuuggaagcuccgc

SEQ ID NO: 3053093 - RNA, 15 nt, Human
aagggauuuucagcc

SEQ ID NO: 3053094 - RNA, 17 nt, Human
aagggauggcaagaugu

SEQ ID NO: 3053095 - RNA, 14 nt, Human
aagggauggcaaga

SEQ ID NO: 3053096 - RNA, 23 nt, Human
aagggauuuucagcccucagaau

SEQ ID NO: 3053097 - RNA, 21 nt, Human
aagggauuuucagcccucaga

SEQ ID NO: 3053098 - RNA, 12 nt, Human
aaguagaggagg

SEQ ID NO: 3053099 - RNA, 14 nt, Human
agaugguucuagca

SEQ ID NO: 3053100 - RNA, 14 nt, Human
agaugagugagcau

SEQ ID NO: 3053101 - RNA, 19 nt, Human
agauguagaggagaaacug

SEQ ID NO: 3053102 - RNA, 16 nt, Human
agauguagaggagaaa

SEQ ID NO: 3053103 - RNA, 23 nt, Human
agcaaagcugaugacaacuuccc

SEQ ID NO: 3053104 - RNA, 21 nt, Human
agcaaagcugaugacaacuuc

SEQ ID NO: 3053105 - RNA, 20 nt, Human
agcaaaggagauuggaagga

SEQ ID NO: 3053106 - RNA, 21 nt, Human
agauugcaacaggcugggcuu

SEQ ID NO: 3053107 - RNA, 20 nt, Human
agauugcaacaggcugggcu

SEQ ID NO: 3053108 - RNA, 23 nt, Human
agauugcaacaggcugggcuuca

SEQ ID NO: 3053109 - RNA, 19 nt, Human
agauugcaacaggcugggc

SEQ ID NO: 3053110 - RNA, 19 nt, Human
agauucuuuccugaggcug

SEQ ID NO: 3053111 - RNA, 21 nt, Human
agauucuuuccugaggcuggg

SEQ ID NO: 3053112 - RNA, 18 nt, Human
agauucuuuccugaggcu

SEQ ID NO: 3053113 - RNA, 18 nt, Human
agcaaaagaugcuucuca

SEQ ID NO: 3053114 - RNA, 24 nt, Human
agcaaaauuuuuucucuaggaaau

SEQ ID NO: 3053115 - RNA, 23 nt, Human
agcaaaauuuuuucucuaggaaa

SEQ ID NO: 3053116 - RNA, 21 nt, Human
agcacgauuucuguuuagaua

SEQ ID NO: 3053117 - RNA, 19 nt, Human
agcacgauuucuguuuaga

SEQ ID NO: 3053118 - RNA, 17 nt, Human
agcacgauuucuguuua

SEQ ID NO: 3053119 - RNA, 16 nt, Human
agcacagacccugccc

SEQ ID NO: 3053120 - RNA, 14 nt, Human
agcacagacccugc

SEQ ID NO: 3053121 - RNA, 15 nt, Human
agcacagacccugcc

SEQ ID NO: 3053122 - RNA, 12 nt, Human
agcacagacccu

SEQ ID NO: 3053123 - RNA, 16 nt, Human
agccaaagcuaggccu

SEQ ID NO: 3053124 - RNA, 17 nt, Human
agcauccuggcacccgg

SEQ ID NO: 3053125 - RNA, 14 nt, Human
agcauccuggcacc

SEQ ID NO: 3053126 - RNA, 17 nt, Human
agccagaggagagagga

SEQ ID NO: 3053127 - RNA, 18 nt, Human
agccagaggagagaggac

SEQ ID NO: 3053128 - RNA, 14 nt, Human
agccagcaggcucu

SEQ ID NO: 3053129 - RNA, 13 nt, Human
agccagaggagag

SEQ ID NO: 3053130 - RNA, 15 nt, Human
agccagaggagagag

SEQ ID NO: 3053131 - RNA, 16 nt, Human
agccagcaggcucuca

SEQ ID NO: 3053132 - RNA, 15 nt, Human
agcccaccccucaac

SEQ ID NO: 3053133 - RNA, 14 nt, Human
agcccaccuuggcu

SEQ ID NO: 3053134 - RNA, 16 nt, Human
agcccaccuuggcuca

SEQ ID NO: 3053135 - RNA, 14 nt, Human
agcccacgccccca

SEQ ID NO: 3053136 - RNA, 20 nt, Human
agcccacgcccccacuggug

SEQ ID NO: 3053137 - RNA, 23 nt, Human
agcccacgcccccacuggugaca

SEQ ID NO: 3053138 - RNA, 13 nt, Human
agcauccuggcac

SEQ ID NO: 3053139 - RNA, 19 nt, Human
agccccauucugccugccc

SEQ ID NO: 3053140 - RNA, 18 nt, Human
agccccauucugccugcc

SEQ ID NO: 3053141 - RNA, 17 nt, Human
agccccauucugccugc

SEQ ID NO: 3053142 - RNA, 17 nt, Human
agccccauccucuguac

SEQ ID NO: 3053143 - RNA, 23 nt, Human
agccccauccucuguacagagcc

SEQ ID NO: 3053144 - RNA, 15 nt, Human
agccccauccucugu

SEQ ID NO: 3053145 - RNA, 17 nt, Human
agcccgggcucugccuc

SEQ ID NO: 3053146 - RNA, 18 nt, Human
agcccgggcucugccucc

SEQ ID NO: 3053147 - RNA, 20 nt, Human
agcccgggcucugccuccca

SEQ ID NO: 3053148 - RNA, 21 nt, Human
agcccgggcucugccucccau

SEQ ID NO: 3053149 - RNA, 24 nt, Human
agccccaaaacucuccucugcugc

SEQ ID NO: 3053150 - RNA, 13 nt, Human
agccccacagccc

SEQ ID NO: 3053151 - RNA, 22 nt, Human
agacagccaacuauggccugug

SEQ ID NO: 3053152 - RNA, 15 nt, Human
agaccacguuucuaa

SEQ ID NO: 3053153 - RNA, 22 nt, Human
agacagauacuccuccaagguu

SEQ ID NO: 3053154 - RNA, 21 nt, Human
agacagagucucacuguugcc

SEQ ID NO: 3053155 - RNA, 17 nt, Human
agacccaaaaggcagaa

SEQ ID NO: 3053156 - RNA, 19 nt, Human
agacccaaaaggcagaagc

SEQ ID NO: 3053157 - RNA, 22 nt, Human
agacaaugacuuacuguacaug

SEQ ID NO: 3053158 - RNA, 21 nt, Human
agacaaugacuuacuguacau

SEQ ID NO: 3053159 - RNA, 15 nt, Human
agacagagcuacaca

SEQ ID NO: 3053160 - RNA, 20 nt, Human
agacagagucucacuguugc

SEQ ID NO: 3053161 - RNA, 19 nt, Human
agacagagucucacuguug

SEQ ID NO: 3053162 - RNA, 13 nt, Human
agacagagcuaca

SEQ ID NO: 3053163 - RNA, 11 nt, Human
agacagagucu

SEQ ID NO: 3053164 - RNA, 20 nt, Human
agacaaugacuuacuguaca

SEQ ID NO: 3053165 - RNA, 14 nt, Human
agaaguaacuuacu

SEQ ID NO: 3053166 - RNA, 20 nt, Human
agaagucacauuccugaaca

SEQ ID NO: 3053167 - RNA, 21 nt, Human
agaagucacauuccugaacag

SEQ ID NO: 3053168 - RNA, 18 nt, Human
agaagucacauuccugaa

SEQ ID NO: 3053169 - RNA, 21 nt, Human
agaagacacugaugggcaacc

SEQ ID NO: 3053170 - RNA, 13 nt, Human
agaagacacugau

SEQ ID NO: 3053171 - RNA, 21 nt, Human
acuuuccucuuuggucuacac

SEQ ID NO: 3053172 - RNA, 21 nt, Human
agaagagauugugguuucauu

SEQ ID NO: 3053173 - RNA, 21 nt, Human
agaagagcuguucacagccag

SEQ ID NO: 3053174 - RNA, 22 nt, Human
agaagagcuguucacagccaga

SEQ ID NO: 3053175 - RNA, 23 nt, Human
agaagagaaugcacaaacagagg

SEQ ID NO: 3053176 - RNA, 19 nt, Human
agaaugcacaaacagaggc

SEQ ID NO: 3053177 - RNA, 22 nt, Human
agaaugcacaaacagaggccgc

SEQ ID NO: 3053178 - RNA, 17 nt, Human
agaaugauuaugaauua

SEQ ID NO: 3053179 - RNA, 17 nt, Human
agaaugagagacacacu

SEQ ID NO: 3053180 - RNA, 22 nt, Human
agaaugagagacacacugaaga

SEQ ID NO: 3053181 - RNA, 18 nt, Human
agaaugaaagggcccaga

SEQ ID NO: 3053182 - RNA, 16 nt, Human
agaaugaaagggccca

SEQ ID NO: 3053183 - RNA, 21 nt, Human
agaagugaaaaucuacacucc

SEQ ID NO: 3053184 - RNA, 22 nt, Human
agaagucacauuccugaacagg

SEQ ID NO: 3053185 - RNA, 13 nt, Human
agagccagggucu

SEQ ID NO: 3053186 - RNA, 16 nt, Human
agagagaccacuuuuc

SEQ ID NO: 3053187 - RNA, 16 nt, Human
agacuggauaguccgu

SEQ ID NO: 3053188 - RNA, 16 nt, Human
agacgcugugcugccc

SEQ ID NO: 3053189 - RNA, 20 nt, Human
agacugaguacguugugcau

SEQ ID NO: 3053190 - RNA, 18 nt, Human
agacucugucucagucca

SEQ ID NO: 3053191 - RNA, 22 nt, Human
agacugaguacguugugcauuu

SEQ ID NO: 3053192 - RNA, 13 nt, Human
agacucugucuca

SEQ ID NO: 3053193 - RNA, 18 nt, Human
agacucugucucaaaaaa

SEQ ID NO: 3053194 - RNA, 13 nt, Human
agagggccugcaa

SEQ ID NO: 3053195 - RNA, 16 nt, Human
agagggccugcaaggg

SEQ ID NO: 3053196 - RNA, 17 nt, Human
agaggggguggccuccc

SEQ ID NO: 3053197 - RNA, 19 nt, Human
agaggggguggccucccaa

SEQ ID NO: 3053198 - RNA, 22 nt, Human
agaggacuuuucuuuguggcuu

SEQ ID NO: 3053199 - RNA, 21 nt, Human
agaggacuuuucuuuguggcu

SEQ ID NO: 3053200 - RNA, 14 nt, Human
agaggacuuuucuu

SEQ ID NO: 3053201 - RNA, 13 nt, Human
agaggaaugaagu

SEQ ID NO: 3053202 - RNA, 17 nt, Human
agggacugagaaauuua

SEQ ID NO: 3053203 - RNA, 15 nt, Human
agggacccuccacca

SEQ ID NO: 3053204 - RNA, 15 nt, Human
agggacugaggggag

SEQ ID NO: 3053205 - RNA, 18 nt, Human
aggcuuagucacugagac

SEQ ID NO: 3053206 - RNA, 21 nt, Human
aggcuguaucccaugagccuc

SEQ ID NO: 3053207 - RNA, 20 nt, Human
aggcuguaucccaugagccu

SEQ ID NO: 3053208 - RNA, 22 nt, Human
aggcuguaucccaugagccuca

SEQ ID NO: 3053209 - RNA, 17 nt, Human
aggcuuagucacugaga

SEQ ID NO: 3053210 - RNA, 15 nt, Human
aggcuaccuuuguau

SEQ ID NO: 3053211 - RNA, 14 nt, Human
aggcuaccuuugua

SEQ ID NO: 3053212 - RNA, 13 nt, Human
aggcuaccuuugu

SEQ ID NO: 3053213 - RNA, 18 nt, Human
aggcuggguucugauccu

SEQ ID NO: 3053214 - RNA, 22 nt, Human
aggcccucugcccacucccugc

SEQ ID NO: 3053215 - RNA, 23 nt, Human
aggcccucugcccacucccugca

SEQ ID NO: 3053216 - RNA, 21 nt, Human
aggcccucugcccacucccug

SEQ ID NO: 3053217 - RNA, 21 nt, Human
aggccaugggcacugugggua

SEQ ID NO: 3053218 - RNA, 15 nt, Human
aggcccuucucucca

SEQ ID NO: 3053219 - RNA, 19 nt, Human
aggcccuucucuccagccc

SEQ ID NO: 3053220 - RNA, 12 nt, Human
aggcccuucucu

SEQ ID NO: 3053221 - RNA, 19 nt, Human
aggcauuccccaggaggcc

SEQ ID NO: 3053222 - RNA, 20 nt, Human
aggcauuccccaggaggcca

SEQ ID NO: 3053223 - RNA, 23 nt, Human
aggccagcugcuugggcuucauc

SEQ ID NO: 3053224 - RNA, 13 nt, Human
aggccaggcccuc

SEQ ID NO: 3053225 - RNA, 14 nt, Human
aggccaggcccucu

SEQ ID NO: 3053226 - RNA, 15 nt, Human
aggccaggcccucug

SEQ ID NO: 3053227 - RNA, 18 nt, Human
aggcauuccccaggaggc

SEQ ID NO: 3053228 - RNA, 17 nt, Human
aggcauuccccaggagg

SEQ ID NO: 3053229 - RNA, 12 nt, Human
aggcauguucuc

SEQ ID NO: 3053230 - RNA, 19 nt, Human
aggcauguucucugaggac

SEQ ID NO: 3053231 - RNA, 18 nt, Human
aggcauguucucugagga

SEQ ID NO: 3053232 - RNA, 19 nt, Human
aggcaugugaugagaggaa

SEQ ID NO: 3053233 - RNA, 20 nt, Human
aggcaugugaugagaggaaa

SEQ ID NO: 3053234 - RNA, 21 nt, Human
aggcaugugaugagaggaaau

SEQ ID NO: 3053235 - RNA, 17 nt, Human
aggcauguucucugagg

SEQ ID NO: 3053236 - RNA, 17 nt, Human
aggcaugugaugagagg

SEQ ID NO: 3053237 - RNA, 15 nt, Human
aggcaugguggccca

SEQ ID NO: 3053238 - RNA, 22 nt, Human
agggauuuucagcccucagaau

SEQ ID NO: 3053239 - RNA, 17 nt, Human
agggauuuucagcccuc

SEQ ID NO: 3053240 - RNA, 15 nt, Human
agggauuagggagag

SEQ ID NO: 3053241 - RNA, 12 nt, Human
agggccuggccu

SEQ ID NO: 3053242 - RNA, 13 nt, Human
agggccuggccug

SEQ ID NO: 3053243 - RNA, 15 nt, Human
agggccugcaaggga

SEQ ID NO: 3053244 - RNA, 14 nt, Human
agggccugcaaggg

SEQ ID NO: 3053245 - RNA, 16 nt, Human
agggauacccauccca

SEQ ID NO: 3053246 - RNA, 22 nt, Human
aggggcccaaauucuuucagug

SEQ ID NO: 3053247 - RNA, 16 nt, Human
agggucccugguggca

SEQ ID NO: 3053248 - RNA, 17 nt, Human
agggucccugguggcag

SEQ ID NO: 3053249 - RNA, 20 nt, Human
agggucccugguggcagcuc

SEQ ID NO: 3053250 - RNA, 22 nt, Human
agggucccugguggcagcucac

SEQ ID NO: 3053251 - RNA, 12 nt, Human
agggucccuggu

SEQ ID NO: 3053252 - RNA, 14 nt, Human
agggucccuggugg

SEQ ID NO: 3053253 - RNA, 13 nt, Human
aggguauuccaga

SEQ ID NO: 3053254 - RNA, 21 nt, Human
aggguaucuggugacuuuccu

SEQ ID NO: 3053255 - RNA, 15 nt, Human
aggguaucuggugac

SEQ ID NO: 3053256 - RNA, 23 nt, Human
aggucccuaauaaagcugugugg

SEQ ID NO: 3053257 - RNA, 14 nt, Human
agguacucuccugg

SEQ ID NO: 3053258 - RNA, 13 nt, Human
agguacucuccug

SEQ ID NO: 3053259 - RNA, 14 nt, Human
agguaacaggcaga

SEQ ID NO: 3053260 - RNA, 13 nt, Human
agguaacaggcag

SEQ ID NO: 3053261 - RNA, 16 nt, Human
agguaacaggcagaua

SEQ ID NO: 3053262 - RNA, 22 nt, Human
agguacgaaaagaggggaagag

SEQ ID NO: 3053263 - RNA, 23 nt, Human
aggguuuugccauguuggccagg

SEQ ID NO: 3053264 - RNA, 22 nt, Human
aggguuuugccauguuggccag

SEQ ID NO: 3053265 - RNA, 23 nt, Human
agcuaauguaauaacugugaagu

SEQ ID NO: 3053266 - RNA, 16 nt, Human
agcucaccagccccag

SEQ ID NO: 3053267 - RNA, 15 nt, Human
agcucaccucucccu

SEQ ID NO: 3053268 - RNA, 18 nt, Human
agcucaccucucccuugg

SEQ ID NO: 3053269 - RNA, 19 nt, Human
agcucaccucucccuugga

SEQ ID NO: 3053270 - RNA, 12 nt, Human
agcucaccucuc

SEQ ID NO: 3053271 - RNA, 15 nt, Human
agcucaccagcccca

SEQ ID NO: 3053272 - RNA, 20 nt, Human
agcucaccagccccagugcc

SEQ ID NO: 3053273 - RNA, 19 nt, Human
agcucaccagccccagugc

SEQ ID NO: 3053274 - RNA, 18 nt, Human
agcucagagaggguggga

SEQ ID NO: 3053275 - RNA, 14 nt, Human
agcucagagagggu

SEQ ID NO: 3053276 - RNA, 12 nt, Human
agcucagagagg

SEQ ID NO: 3053277 - RNA, 17 nt, Human
agccuggcuucaaauug

SEQ ID NO: 3053278 - RNA, 22 nt, Human
agccuggcuccaaacccucgag

SEQ ID NO: 3053279 - RNA, 18 nt, Human
agccuggcuucaaauugu

SEQ ID NO: 3053280 - RNA, 13 nt, Human
agccuggcuccaa

SEQ ID NO: 3053281 - RNA, 20 nt, Human
agccuggcuccaaacccucg

SEQ ID NO: 3053282 - RNA, 12 nt, Human
agccugggaggu

SEQ ID NO: 3053283 - RNA, 13 nt, Human
agcgagcccuggu

SEQ ID NO: 3053284 - RNA, 19 nt, Human
agcgagcccugguggcagu

SEQ ID NO: 3053285 - RNA, 17 nt, Human
agcgacagugagacucu

SEQ ID NO: 3053286 - RNA, 12 nt, Human
agcugcugacag

SEQ ID NO: 3053287 - RNA, 20 nt, Human
agcugcgguccacccaggag

SEQ ID NO: 3053288 - RNA, 19 nt, Human
agcugcgguccacccagga

SEQ ID NO: 3053289 - RNA, 18 nt, Human
agcugcgguccacccagg

SEQ ID NO: 3053290 - RNA, 17 nt, Human
agcugcgguccacccag

SEQ ID NO: 3053291 - RNA, 16 nt, Human
agcugcgguccaccca

SEQ ID NO: 3053292 - RNA, 13 nt, Human
agcugcgguccac

SEQ ID NO: 3053293 - RNA, 17 nt, Human
agcuggucccacucagu

SEQ ID NO: 3053294 - RNA, 16 nt, Human
agcuggucccacucag

SEQ ID NO: 3053295 - RNA, 14 nt, Human
agcugcugacagug

SEQ ID NO: 3053296 - RNA, 13 nt, Human
agcugcugacagu

SEQ ID NO: 3053297 - RNA, 18 nt, Human
agcuggucccacucaguc

SEQ ID NO: 3053298 - RNA, 19 nt, Human
agcugcugagauccuggac

SEQ ID NO: 3053299 - RNA, 16 nt, Human
agcugguugagguuuc

SEQ ID NO: 3053300 - RNA, 22 nt, Human
agcugguuuuuagcggagacgg

SEQ ID NO: 3053301 - RNA, 20 nt, Human
agcuccccucggagaagagc

SEQ ID NO: 3053302 - RNA, 19 nt, Human
agcuccccucggagaagag

SEQ ID NO: 3053303 - RNA, 17 nt, Human
agcuccccucggagaag

SEQ ID NO: 3053304 - RNA, 15 nt, Human
agcugaaccugggua

SEQ ID NO: 3053305 - RNA, 15 nt, Human
agcuuuuaugugaaa

SEQ ID NO: 3053306 - RNA, 12 nt, Human
aggaacaaggca

SEQ ID NO: 3053307 - RNA, 13 nt, Human
aggaacaaggcaa

SEQ ID NO: 3053308 - RNA, 16 nt, Human
aggaacaaggcaaggc

SEQ ID NO: 3053309 - RNA, 17 nt, Human
aggaacaaggcaaggcu

SEQ ID NO: 3053310 - RNA, 19 nt, Human
aggaacaaggcaaggcugu

SEQ ID NO: 3053311 - RNA, 20 nt, Human
aggaacaaggcaaggcuguc

SEQ ID NO: 3053312 - RNA, 21 nt, Human
aggaacuuaaauaaugugaaa

SEQ ID NO: 3053313 - RNA, 23 nt, Human
aggaaccgagggggcugcuccca

SEQ ID NO: 3053314 - RNA, 15 nt, Human
aggaauaccuguccc

SEQ ID NO: 3053315 - RNA, 18 nt, Human
aggaauaccugucccccu

SEQ ID NO: 3053316 - RNA, 22 nt, Human
aggaauaccugucccccugaca

SEQ ID NO: 3053317 - RNA, 13 nt, Human
aggaaguagagga

SEQ ID NO: 3053318 - RNA, 19 nt, Human
agcuucauuuccugugucu

SEQ ID NO: 3053319 - RNA, 22 nt, Human
agcuuuguuuguugucagcuga

SEQ ID NO: 3053320 - RNA, 23 nt, Human
agcuuuguuuguugucagcugaa

SEQ ID NO: 3053321 - RNA, 18 nt, Human
agcuucauuuccuguguc

SEQ ID NO: 3053322 - RNA, 20 nt, Human
agcuuauuuccucauuuuua

SEQ ID NO: 3053323 - RNA, 15 nt, Human
aggagaggagagggg

SEQ ID NO: 3053324 - RNA, 16 nt, Human
aggacccgucuccagc

SEQ ID NO: 3053325 - RNA, 18 nt, Human
augugaaaucauucauuu

SEQ ID NO: 3053326 - RNA, 17 nt, Human
augugaaaucauucauu

SEQ ID NO: 3053327 - RNA, 15 nt, Human
augugaacacaucag

SEQ ID NO: 3053328 - RNA, 14 nt, Human
augugaaacauguu

SEQ ID NO: 3053329 - RNA, 14 nt, Human
augugaaaucauuc

SEQ ID NO: 3053330 - RNA, 19 nt, Human
augucacaggcagguccag

SEQ ID NO: 3053331 - RNA, 17 nt, Human
augucacaggcaggucc

SEQ ID NO: 3053332 - RNA, 13 nt, Human
augucacaggcag

SEQ ID NO: 3053333 - RNA, 21 nt, Human
augucaaucagccuaguugau

SEQ ID NO: 3053334 - RNA, 16 nt, Human
augucaaucagccuag

SEQ ID NO: 3053335 - RNA, 23 nt, Human
auguaauuaaguacuauguauca

SEQ ID NO: 3053336 - RNA, 20 nt, Human
augggugcuuggaggaagga

SEQ ID NO: 3053337 - RNA, 21 nt, Human
augggugcuuggaggaaggaa

SEQ ID NO: 3053338 - RNA, 23 nt, Human
augggugcuuggaggaaggaaac

SEQ ID NO: 3053339 - RNA, 15 nt, Human
auguguaaaauguga

SEQ ID NO: 3053340 - RNA, 17 nt, Human
auguguaagacaaaaag

SEQ ID NO: 3053341 - RNA, 19 nt, Human
auguguaagacaaaaagcu

SEQ ID NO: 3053342 - RNA, 13 nt, Human
auguguaaguauu

SEQ ID NO: 3053343 - RNA, 16 nt, Human
auguuccuagugaaag

SEQ ID NO: 3053344 - RNA, 15 nt, Human
auguuccuagugaaa

SEQ ID NO: 3053345 - RNA, 16 nt, Human
auguucucucuucucc

SEQ ID NO: 3053346 - RNA, 17 nt, Human
auguuccuagugaaaga

SEQ ID NO: 3053347 - RNA, 17 nt, Human
auguucucucuucucca

SEQ ID NO: 3053348 - RNA, 13 nt, Human
auguucucugagg

SEQ ID NO: 3053349 - RNA, 14 nt, Human
auguucugggacac

SEQ ID NO: 3053350 - RNA, 15 nt, Human
auguucugggacaca

SEQ ID NO: 3053351 - RNA, 17 nt, Human
auguuugccucugccuc

SEQ ID NO: 3053352 - RNA, 15 nt, Human
auguuugccucugcc

SEQ ID NO: 3053353 - RNA, 14 nt, Human
auguuugccucugc

SEQ ID NO: 3053354 - RNA, 22 nt, Human
augcacaaauucugucucugga

SEQ ID NO: 3053355 - RNA, 15 nt, Human
augcacaaauucugu

SEQ ID NO: 3053356 - RNA, 23 nt, Human
augcacaaauucugucucuggau

SEQ ID NO: 3053357 - RNA, 18 nt, Human
augcacaaacagaggccg

SEQ ID NO: 3053358 - RNA, 18 nt, Human
augaugaaaugaggucag

SEQ ID NO: 3053359 - RNA, 23 nt, Human
augaugaaaugaggucagagccu

SEQ ID NO: 3053360 - RNA, 15 nt, Human
augaugauccuaggc

SEQ ID NO: 3053361 - RNA, 18 nt, Human
augaugaucuuuaaaaua

SEQ ID NO: 3053362 - RNA, 21 nt, Human
augaugaucuuuaaaauacac

SEQ ID NO: 3053363 - RNA, 21 nt, Human
augaucuuugcagacaggcaa

SEQ ID NO: 3053364 - RNA, 19 nt, Human
augaucuuugcagacaggc

SEQ ID NO: 3053365 - RNA, 18 nt, Human
augaucuuugcagacagg

SEQ ID NO: 3053366 - RNA, 18 nt, Human
augaucuucuuuauaauu

SEQ ID NO: 3053367 - RNA, 17 nt, Human
augaucuuugcagacag

SEQ ID NO: 3053368 - RNA, 16 nt, Human
augaucuuuaaaauac

SEQ ID NO: 3053369 - RNA, 19 nt, Human
augccuggauggggcugca

SEQ ID NO: 3053370 - RNA, 20 nt, Human
augccuggauggggcugcac

SEQ ID NO: 3053371 - RNA, 22 nt, Human
augcacagaguuguuacauuuu

SEQ ID NO: 3053372 - RNA, 21 nt, Human
augcacagaguuguuacauuu

SEQ ID NO: 3053373 - RNA, 19 nt, Human
augcacagaguuguuacau

SEQ ID NO: 3053374 - RNA, 14 nt, Human
augcacacauuuuu

SEQ ID NO: 3053375 - RNA, 13 nt, Human
augcacacauuuu

SEQ ID NO: 3053376 - RNA, 15 nt, Human
augcacacauuuuuu

SEQ ID NO: 3053377 - RNA, 18 nt, Human
auggauaggcacaggaaa

SEQ ID NO: 3053378 - RNA, 17 nt, Human
auggauaggcacaggaa

SEQ ID NO: 3053379 - RNA, 18 nt, Human
auggcuggagcuagaauu

SEQ ID NO: 3053380 - RNA, 15 nt, Human
augcuuguacauaau

SEQ ID NO: 3053381 - RNA, 16 nt, Human
augcuuguacauaaug

SEQ ID NO: 3053382 - RNA, 17 nt, Human
auggcuuuugugcauua

SEQ ID NO: 3053383 - RNA, 16 nt, Human
auggcuuuugugcauu

SEQ ID NO: 3053384 - RNA, 13 nt, Human
augcugcccugug

SEQ ID NO: 3053385 - RNA, 12 nt, Human
augcugcccugu

SEQ ID NO: 3053386 - RNA, 14 nt, Human
augcugcccuguga

SEQ ID NO: 3053387 - RNA, 15 nt, Human
augcugcccugugag

SEQ ID NO: 3053388 - RNA, 16 nt, Human
augcugcccugugagu

SEQ ID NO: 3053389 - RNA, 15 nt, Human
aucuaguaugaaauu

SEQ ID NO: 3053390 - RNA, 16 nt, Human
aucuaguaugaaauua

SEQ ID NO: 3053391 - RNA, 17 nt, Human
aucuaguaugaaauuau

SEQ ID NO: 3053392 - RNA, 18 nt, Human
aucuaguaugaaauuaua

SEQ ID NO: 3053393 - RNA, 19 nt, Human
aucuaguaugaaauuauau

SEQ ID NO: 3053394 - RNA, 14 nt, Human
aucuaguaugaaau

SEQ ID NO: 3053395 - RNA, 20 nt, Human
aucuccgucaacucauauuu

SEQ ID NO: 3053396 - RNA, 18 nt, Human
aucugggggccucuucug

SEQ ID NO: 3053397 - RNA, 17 nt, Human
augagggagaugccaug

SEQ ID NO: 3053398 - RNA, 16 nt, Human
augagggagaugccau

SEQ ID NO: 3053399 - RNA, 22 nt, Human
augaggcauuuguuugaacuga

SEQ ID NO: 3053400 - RNA, 21 nt, Human
augaggcauuuguuugaacug

SEQ ID NO: 3053401 - RNA, 14 nt, Human
augaggcauuuguu

SEQ ID NO: 3053402 - RNA, 13 nt, Human
augaggcauuugu

SEQ ID NO: 3053403 - RNA, 20 nt, Human
augaaguccaagcauuuaga

SEQ ID NO: 3053404 - RNA, 23 nt, Human
augaaguccaagcauuuagaugu

SEQ ID NO: 3053405 - RNA, 13 nt, Human
augaaguacucau

SEQ ID NO: 3053406 - RNA, 21 nt, Human
augaaguacucauacauguua

SEQ ID NO: 3053407 - RNA, 16 nt, Human
augaaaacacauuuuu

SEQ ID NO: 3053408 - RNA, 15 nt, Human
augaaaacacauuuu

SEQ ID NO: 3053409 - RNA, 14 nt, Human
augaaaacacauuu

SEQ ID NO: 3053410 - RNA, 12 nt, Human
aucaugugaaau

SEQ ID NO: 3053411 - RNA, 14 nt, Human
aucaugucuggcua

SEQ ID NO: 3053412 - RNA, 17 nt, Human
aucaugaauuaguuuua

SEQ ID NO: 3053413 - RNA, 13 nt, Human
aucagcuuauugu

SEQ ID NO: 3053414 - RNA, 22 nt, Human
aucagcuugcccuguuaaaaga

SEQ ID NO: 3053415 - RNA, 24 nt, Human
aucaaaagguuaauaaaguaauua

SEQ ID NO: 3053416 - RNA, 14 nt, Human
aucaaauauauuca

SEQ ID NO: 3053417 - RNA, 20 nt, Human
aucaaagagguuuuaaaaaa

SEQ ID NO: 3053418 - RNA, 23 nt, Human
aucaaagagguuuuaaaaaaauc

SEQ ID NO: 3053419 - RNA, 22 nt, Human
aucaaauauauucagccuggcu

SEQ ID NO: 3053420 - RNA, 14 nt, Human
aucaaauaugcaaa

SEQ ID NO: 3053421 - RNA, 13 nt, Human
aucaccagacagg

SEQ ID NO: 3053422 - RNA, 20 nt, Human
aucaccaacgucugugccau

SEQ ID NO: 3053423 - RNA, 19 nt, Human
auccucaguuuuugugaaa

SEQ ID NO: 3053424 - RNA, 19 nt, Human
aucccaugagccucagcau

SEQ ID NO: 3053425 - RNA, 19 nt, Human
auccagacccggcugcgug

SEQ ID NO: 3053426 - RNA, 17 nt, Human
auccucauacccacccc

SEQ ID NO: 3053427 - RNA, 21 nt, Human
aucgcuccaccuugcagcucu

SEQ ID NO: 3053428 - RNA, 17 nt, Human
aucgcuccaccuugcag

SEQ ID NO: 3053429 - RNA, 23 nt, Human
auauuucagauaaucacaauaca

SEQ ID NO: 3053430 - RNA, 22 nt, Human
auauuauuuuauguugcauaga

SEQ ID NO: 3053431 - RNA, 15 nt, Human
auauuauuuuauguu

SEQ ID NO: 3053432 - RNA, 14 nt, Human
auauuauuuuaugu

SEQ ID NO: 3053433 - RNA, 14 nt, Human
auauuauguuaaaa

SEQ ID NO: 3053434 - RNA, 19 nt, Human
auauucaggaagcucaggg

SEQ ID NO: 3053435 - RNA, 17 nt, Human
auauucaggaagcucag

SEQ ID NO: 3053436 - RNA, 17 nt, Human
auaugcucugcauguua

SEQ ID NO: 3053437 - RNA, 16 nt, Human
auaugcucugcauguu

SEQ ID NO: 3053438 - RNA, 22 nt, Human
auaugcacacauuuuuuaaaug

SEQ ID NO: 3053439 - RNA, 17 nt, Human
auauuauguguuuccau

SEQ ID NO: 3053440 - RNA, 13 nt, Human
auauuauguguuu

SEQ ID NO: 3053441 - RNA, 13 nt, Human
auauuauguuaaa

SEQ ID NO: 3053442 - RNA, 20 nt, Human
auaugcucugcauguuacau

SEQ ID NO: 3053443 - RNA, 18 nt, Human
auauauuuuuuucugaaa

SEQ ID NO: 3053444 - RNA, 17 nt, Human
auagccuaggugacaga

SEQ ID NO: 3053445 - RNA, 15 nt, Human
auagccuaggugaca

SEQ ID NO: 3053446 - RNA, 24 nt, Human
auagguuuggacaaaauggaauac

SEQ ID NO: 3053447 - RNA, 18 nt, Human
auagguuuggacaaaaug

SEQ ID NO: 3053448 - RNA, 17 nt, Human
auagcacagacccugcc

SEQ ID NO: 3053449 - RNA, 18 nt, Human
auagcacagacccugccc

SEQ ID NO: 3053450 - RNA, 15 nt, Human
auagcacagacccug

SEQ ID NO: 3053451 - RNA, 15 nt, Human
auagcagcuuauuca

SEQ ID NO: 3053452 - RNA, 22 nt, Human
auaaaaagccugcaauuucaua

SEQ ID NO: 3053453 - RNA, 20 nt, Human
auaaaaagccugcaauuuca

SEQ ID NO: 3053454 - RNA, 23 nt, Human
aguuugauuaaauucuugcaaag

SEQ ID NO: 3053455 - RNA, 20 nt, Human
aguuugagaucagccugggc

SEQ ID NO: 3053456 - RNA, 16 nt, Human
aguuugauuaaauucu

SEQ ID NO: 3053457 - RNA, 18 nt, Human
aguuugagaucagccugg

SEQ ID NO: 3053458 - RNA, 19 nt, Human
aguuugagaucagccuggg

SEQ ID NO: 3053459 - RNA, 22 nt, Human
aguuugauuaaauucuugcaaa

SEQ ID NO: 3053460 - RNA, 20 nt, Human
aguuugauuaaauucuugca

SEQ ID NO: 3053461 - RNA, 18 nt, Human
aguuugauuaaauucuug

SEQ ID NO: 3053462 - RNA, 17 nt, Human
aguuugauuaaauucuu

SEQ ID NO: 3053463 - RNA, 20 nt, Human
aguuguuacauuuuuaagug

SEQ ID NO: 3053464 - RNA, 19 nt, Human
aguuguuacauuuuuaagu

SEQ ID NO: 3053465 - RNA, 22 nt, Human
aguuguuacauuuuuaagugcu

SEQ ID NO: 3053466 - RNA, 14 nt, Human
auaacaaugaaagu

SEQ ID NO: 3053467 - RNA, 15 nt, Human
auaacaaugcuguau

SEQ ID NO: 3053468 - RNA, 17 nt, Human
auaacaaugcuguauuu

SEQ ID NO: 3053469 - RNA, 21 nt, Human
auaacaaugcuguauuuuaaa

SEQ ID NO: 3053470 - RNA, 19 nt, Human
auaacaaugcuguauuuua

SEQ ID NO: 3053471 - RNA, 20 nt, Human
auaacaaugcuguauuuuaa

SEQ ID NO: 3053472 - RNA, 18 nt, Human
auaacauguaauuaagua

SEQ ID NO: 3053473 - RNA, 13 nt, Human
auaacauguaauu

SEQ ID NO: 3053474 - RNA, 12 nt, Human
auaacauguaau

SEQ ID NO: 3053475 - RNA, 13 nt, Human
auaauggucagag

SEQ ID NO: 3053476 - RNA, 18 nt, Human
auaaggguaucuggugac

SEQ ID NO: 3053477 - RNA, 13 nt, Human
auaauguuucaaa

SEQ ID NO: 3053478 - RNA, 21 nt, Human
auaagccagacaucaacagau

SEQ ID NO: 3053479 - RNA, 22 nt, Human
auaagccagacaucaacagaua

SEQ ID NO: 3053480 - RNA, 14 nt, Human
auaagccagacauc

SEQ ID NO: 3053481 - RNA, 17 nt, Human
auacccagaaaguuauu

SEQ ID NO: 3053482 - RNA, 13 nt, Human
auacagaaaaguu

SEQ ID NO: 3053483 - RNA, 17 nt, Human
auacccacccccaccca

SEQ ID NO: 3053484 - RNA, 19 nt, Human
auaccccaagacucccaug

SEQ ID NO: 3053485 - RNA, 17 nt, Human
auaccccaagacuccca

SEQ ID NO: 3053486 - RNA, 14 nt, Human
auacccacccccac

SEQ ID NO: 3053487 - RNA, 16 nt, Human
auacccacccccaccc

SEQ ID NO: 3053488 - RNA, 13 nt, Human
auacccaccccca

SEQ ID NO: 3053489 - RNA, 22 nt, Human
auacacuuacacuuuaugcaca

SEQ ID NO: 3053490 - RNA, 13 nt, Human
auacacuuacacu

SEQ ID NO: 3053491 - RNA, 17 nt, Human
auacaaugcugugcccu

SEQ ID NO: 3053492 - RNA, 14 nt, Human
auacaaugcugugc

SEQ ID NO: 3053493 - RNA, 18 nt, Human
auaauguuucaaacauau

SEQ ID NO: 3053494 - RNA, 13 nt, Human
auaccuguccccc

SEQ ID NO: 3053495 - RNA, 14 nt, Human
auaccugucccccu

SEQ ID NO: 3053496 - RNA, 15 nt, Human
auaccugucccccug

SEQ ID NO: 3053497 - RNA, 16 nt, Human
auaccugucccccuga

SEQ ID NO: 3053498 - RNA, 15 nt, Human
aguucaucuugaauu

SEQ ID NO: 3053499 - RNA, 19 nt, Human
aguucaucuugaauuguaa

SEQ ID NO: 3053500 - RNA, 13 nt, Human
aguucaucuugaa

SEQ ID NO: 3053501 - RNA, 16 nt, Human
aguugauacuacaguu

SEQ ID NO: 3053502 - RNA, 18 nt, Human
aguugaaaagacuccaaa

SEQ ID NO: 3053503 - RNA, 14 nt, Human
aguugaaaagacuc

SEQ ID NO: 3053504 - RNA, 20 nt, Human
aguugaaaagacuccaaaga

SEQ ID NO: 3053505 - RNA, 19 nt, Human
aguugaaaagacuccaaag

SEQ ID NO: 3053506 - RNA, 20 nt, Human
agugcuaauuuugaaaaacu

SEQ ID NO: 3053507 - RNA, 18 nt, Human
agugcuaauuuugaaaaa

SEQ ID NO: 3053508 - RNA, 15 nt, Human
agugcuaauuuugaa

SEQ ID NO: 3053509 - RNA, 16 nt, Human
agugccuuauggaaca

SEQ ID NO: 3053510 - RNA, 10 nt, Human
agugccuuau

SEQ ID NO: 3053511 - RNA, 13 nt, Human
agugccuuaugga

SEQ ID NO: 3053512 - RNA, 14 nt, Human
agugccuuauggaa

SEQ ID NO: 3053513 - RNA, 15 nt, Human
agugccuuauggaac

SEQ ID NO: 3053514 - RNA, 24 nt, Human
agugauccucccaccucagccucc

SEQ ID NO: 3053515 - RNA, 23 nt, Human
agugauccucccaccucagccuc

SEQ ID NO: 3053516 - RNA, 18 nt, Human
agugauccucccaccuca

SEQ ID NO: 3053517 - RNA, 15 nt, Human
agugauccucccacc

SEQ ID NO: 3053518 - RNA, 14 nt, Human
agugauccucccac

SEQ ID NO: 3053519 - RNA, 17 nt, Human
agugauucuccugccuc

SEQ ID NO: 3053520 - RNA, 15 nt, Human
agugauucuccugcc

SEQ ID NO: 3053521 - RNA, 18 nt, Human
agugccuuacacaauggu

SEQ ID NO: 3053522 - RNA, 14 nt, Human
agugauucuccugc

SEQ ID NO: 3053523 - RNA, 19 nt, Human
agugucaaugcagccccca

SEQ ID NO: 3053524 - RNA, 16 nt, Human
agugggagcugccugu

SEQ ID NO: 3053525 - RNA, 22 nt, Human
aguaaaugcuagguuaauucca

SEQ ID NO: 3053526 - RNA, 11 nt, Human
aguaaaugcua

SEQ ID NO: 3053527 - RNA, 23 nt, Human
aguaaaugcuagguuaauuccaa

SEQ ID NO: 3053528 - RNA, 19 nt, Human
aguaacaaugaagauaaaa

SEQ ID NO: 3053529 - RNA, 15 nt, Human
aggucuguucuuucc

SEQ ID NO: 3053530 - RNA, 13 nt, Human
aggucuguucuuu

SEQ ID NO: 3053531 - RNA, 16 nt, Human
aggucuguucuuucca

SEQ ID NO: 3053532 - RNA, 14 nt, Human
aguacguugugcau

SEQ ID NO: 3053533 - RNA, 15 nt, Human
aguacguugugcauu

SEQ ID NO: 3053534 - RNA, 14 nt, Human
aguacuauguauca

SEQ ID NO: 3053535 - RNA, 12 nt, Human
aguacuauguau

SEQ ID NO: 3053536 - RNA, 22 nt, Human
aguacuucuccacccugcucuc

SEQ ID NO: 3053537 - RNA, 12 nt, Human
aguacuucuuuu

SEQ ID NO: 3053538 - RNA, 17 nt, Human
aguacuucuccacccug

SEQ ID NO: 3053539 - RNA, 19 nt, Human
aguacuacaguccucccau

SEQ ID NO: 3053540 - RNA, 22 nt, Human
aguacuacaguccucccaucuc

SEQ ID NO: 3053541 - RNA, 14 nt, Human
aguacuauaauuua

SEQ ID NO: 3053542 - RNA, 17 nt, Human
aguacguugugcauuug

SEQ ID NO: 3053543 - RNA, 16 nt, Human
aguacguugugcauuu

SEQ ID NO: 3053544 - RNA, 18 nt, Human
aguacguugugcauuugg

SEQ ID NO: 3053545 - RNA, 16 nt, Human
aguauuuuugacagaa

SEQ ID NO: 3053546 - RNA, 17 nt, Human
aguauuuuugacagaau

SEQ ID NO: 3053547 - RNA, 18 nt, Human
aguauuuuugacagaaua

SEQ ID NO: 3053548 - RNA, 13 nt, Human
aguauuuuugaca

SEQ ID NO: 3053549 - RNA, 17 nt, Human
aguauuuuguuucagug

SEQ ID NO: 3053550 - RNA, 17 nt, Human
aguaugaggcauuuguu

SEQ ID NO: 3053551 - RNA, 14 nt, Human
aguauuuuguuuca

SEQ ID NO: 3053552 - RNA, 23 nt, Human
aguaugaggcauuuguuugaacu

SEQ ID NO: 3053553 - RNA, 21 nt, Human
aguaugaggcauuuguuugaa

SEQ ID NO: 3053554 - RNA, 20 nt, Human
aguaugaggcauuuguuuga

SEQ ID NO: 3053555 - RNA, 22 nt, Human
agucacacaguauuacuucugc

SEQ ID NO: 3053556 - RNA, 20 nt, Human
agugaauucuugaaggaaaa

SEQ ID NO: 3053557 - RNA, 17 nt, Human
agucugaaggcuggguu

SEQ ID NO: 3053558 - RNA, 19 nt, Human
aguccuuaccagcagagca

SEQ ID NO: 3053559 - RNA, 19 nt, Human
aguccucuuuucugagagg

SEQ ID NO: 3053560 - RNA, 20 nt, Human
aguccuuaccagcagagcac

SEQ ID NO: 3053561 - RNA, 22 nt, Human
aguccucuuuucugagaggacu

SEQ ID NO: 3053562 - RNA, 13 nt, Human
cacaggaaaccag

SEQ ID NO: 3053563 - RNA, 17 nt, Human
cacaguucaauucucau

SEQ ID NO: 3053564 - RNA, 22 nt, Human
caaaauaauuuuaagaaaucaa

SEQ ID NO: 3053565 - RNA, 18 nt, Human
caaaauaauuuuaagaaa

SEQ ID NO: 3053566 - RNA, 20 nt, Human
caaaauaaaacuuuuuaaaa

SEQ ID NO: 3053567 - RNA, 16 nt, Human
caaaauaaaacuuuuu

SEQ ID NO: 3053568 - RNA, 14 nt, Human
caaaauaaaacuuu

SEQ ID NO: 3053569 - RNA, 21 nt, Human
caaaaucgaugcagugcuucc

SEQ ID NO: 3053570 - RNA, 23 nt, Human
caaaacucuccucugcugcuggc

SEQ ID NO: 3053571 - RNA, 14 nt, Human
caaaaguuucucuu

SEQ ID NO: 3053572 - RNA, 18 nt, Human
caaaacugcacugucaag

SEQ ID NO: 3053573 - RNA, 17 nt, Human
caaaacugcacugucaa

SEQ ID NO: 3053574 - RNA, 14 nt, Human
caaaacugcacugu

SEQ ID NO: 3053575 - RNA, 15 nt, Human
caaaacgguuuuacu

SEQ ID NO: 3053576 - RNA, 21 nt, Human
caaaacgguuuuacugcagcu

SEQ ID NO: 3053577 - RNA, 18 nt, Human
auuuuauuuuauuaugca

SEQ ID NO: 3053578 - RNA, 15 nt, Human
caaaacucuccucug

SEQ ID NO: 3053579 - RNA, 16 nt, Human
caaaacucuccucugc

SEQ ID NO: 3053580 - RNA, 17 nt, Human
caaacugacucuuaaga

SEQ ID NO: 3053581 - RNA, 21 nt, Human
caaacugacucuuaagaagac

SEQ ID NO: 3053582 - RNA, 16 nt, Human
caaacugacucuuaag

SEQ ID NO: 3053583 - RNA, 21 nt, Human
caaacucuugaccucagguga

SEQ ID NO: 3053584 - RNA, 20 nt, Human
caaacucuugaccucaggug

SEQ ID NO: 3053585 - RNA, 19 nt, Human
caaacucuugaccucaggu

SEQ ID NO: 3053586 - RNA, 17 nt, Human
caaacucuugaccucag

SEQ ID NO: 3053587 - RNA, 13 nt, Human
caaacagaggccg

SEQ ID NO: 3053588 - RNA, 11 nt, Human
caaaaugaaac

SEQ ID NO: 3053589 - RNA, 22 nt, Human
caaaaugaaacgcaaccaccac

SEQ ID NO: 3053590 - RNA, 23 nt, Human
caaauauauucagccuggcuuca

SEQ ID NO: 3053591 - RNA, 12 nt, Human
caaauaugcaaa

SEQ ID NO: 3053592 - RNA, 13 nt, Human
caaauaugcaaag

SEQ ID NO: 3053593 - RNA, 23 nt, Human
caaauggaaaugggcagagcaga

SEQ ID NO: 3053594 - RNA, 22 nt, Human
caaauggaaaugggcagagcag

SEQ ID NO: 3053595 - RNA, 14 nt, Human
caaauguucaucaa

SEQ ID NO: 3053596 - RNA, 18 nt, Human
caaauguucaucaaugaa

SEQ ID NO: 3053597 - RNA, 16 nt, Human
caaagagagaaaauaa

SEQ ID NO: 3053598 - RNA, 15 nt, Human
caaagaaauuaugug

SEQ ID NO: 3053599 - RNA, 19 nt, Human
caaagagagaaaauaaaga

SEQ ID NO: 3053600 - RNA, 19 nt, Human
caaagugcugggauuacaa

SEQ ID NO: 3053601 - RNA, 13 nt, Human
caaagugcuggga

SEQ ID NO: 3053602 - RNA, 18 nt, Human
caaauaaaaauauugugu

SEQ ID NO: 3053603 - RNA, 16 nt, Human
caaauaaaaauauugu

SEQ ID NO: 3053604 - RNA, 15 nt, Human
caaauaaaaauauug

SEQ ID NO: 3053605 - RNA, 23 nt, Human
caaagugcugggauuacaagcgu

SEQ ID NO: 3053606 - RNA, 19 nt, Human
caaaguggugagaggcauc

SEQ ID NO: 3053607 - RNA, 17 nt, Human
caacauacucccaucug

SEQ ID NO: 3053608 - RNA, 19 nt, Human
caacauacucccaucugug

SEQ ID NO: 3053609 - RNA, 12 nt, Human
caacaggcuggg

SEQ ID NO: 3053610 - RNA, 20 nt, Human
caacauacucccaucuguga

SEQ ID NO: 3053611 - RNA, 22 nt, Human
caaauuucuaaaucuccaaaau

SEQ ID NO: 3053612 - RNA, 15 nt, Human
caaauuucuaaaucu

SEQ ID NO: 3053613 - RNA, 13 nt, Human
caagaagcccagg

SEQ ID NO: 3053614 - RNA, 15 nt, Human
caagaaaugaaagca

SEQ ID NO: 3053615 - RNA, 17 nt, Human
caagaaaugaaagcagg

SEQ ID NO: 3053616 - RNA, 19 nt, Human
caagaaaugaaagcaggga

SEQ ID NO: 3053617 - RNA, 21 nt, Human
caagaccuucuccuucaccuu

SEQ ID NO: 3053618 - RNA, 23 nt, Human
caagaccuucuccuucaccuuug

SEQ ID NO: 3053619 - RNA, 13 nt, Human
caagacgcugugc

SEQ ID NO: 3053620 - RNA, 19 nt, Human
caauaauaaauauuuuugc

SEQ ID NO: 3053621 - RNA, 16 nt, Human
caauaggaaaaacuga

SEQ ID NO: 3053622 - RNA, 17 nt, Human
caauaggaaaaacugau

SEQ ID NO: 3053623 - RNA, 15 nt, Human
caauaggaaaaacug

SEQ ID NO: 3053624 - RNA, 17 nt, Human
caauagucaaauugugu

SEQ ID NO: 3053625 - RNA, 19 nt, Human
caauagucaaauuguguga

SEQ ID NO: 3053626 - RNA, 21 nt, Human
caagggugaugggaaagcauu

SEQ ID NO: 3053627 - RNA, 23 nt, Human
caagggugaugggaaagcauugu

SEQ ID NO: 3053628 - RNA, 20 nt, Human
caagcugcacccucaggcag

SEQ ID NO: 3053629 - RNA, 22 nt, Human
caagcugcacccucaggcaggu

SEQ ID NO: 3053630 - RNA, 21 nt, Human
caagcuggucccacucagucc

SEQ ID NO: 3053631 - RNA, 17 nt, Human
caagcgauucuucugcu

SEQ ID NO: 3053632 - RNA, 15 nt, Human
caagcgauucuucug

SEQ ID NO: 3053633 - RNA, 21 nt, Human
caagcugcacccucaggcagg

SEQ ID NO: 3053634 - RNA, 18 nt, Human
caagcgauucuucugcuu

SEQ ID NO: 3053635 - RNA, 20 nt, Human
caaggaaaaaauaacaauga

SEQ ID NO: 3053636 - RNA, 18 nt, Human
caaggaaaaaauaacaau

SEQ ID NO: 3053637 - RNA, 23 nt, Human
caagcuggucccacucaguccau

SEQ ID NO: 3053638 - RNA, 22 nt, Human
caagcuggucccacucagucca

SEQ ID NO: 3053639 - RNA, 17 nt, Human
caaggcugcagugagcc

SEQ ID NO: 3053640 - RNA, 22 nt, Human
caaggcugcagugagccgagau

SEQ ID NO: 3053641 - RNA, 20 nt, Human
caaggauccugagccagauu

SEQ ID NO: 3053642 - RNA, 18 nt, Human
caaggauccugagccaga

SEQ ID NO: 3053643 - RNA, 19 nt, Human
caaggauccugagccagau

SEQ ID NO: 3053644 - RNA, 16 nt, Human
caaggagauuuacaac

SEQ ID NO: 3053645 - RNA, 13 nt, Human
cacaaaggagagc

SEQ ID NO: 3053646 - RNA, 18 nt, Human
cacaagaaaugaaagcag

SEQ ID NO: 3053647 - RNA, 20 nt, Human
cacaagaaaugaaagcaggg

SEQ ID NO: 3053648 - RNA, 17 nt, Human
cacacacgcgugcacac

SEQ ID NO: 3053649 - RNA, 22 nt, Human
caaugugaaaagaaaaaugagc

SEQ ID NO: 3053650 - RNA, 19 nt, Human
caaugugaaaagaaaaaug

SEQ ID NO: 3053651 - RNA, 14 nt, Human
caauguucucucuu

SEQ ID NO: 3053652 - RNA, 17 nt, Human
caauuacaggaaguacu

SEQ ID NO: 3053653 - RNA, 18 nt, Human
caauuacaggaaguacug

SEQ ID NO: 3053654 - RNA, 14 nt, Human
cacaaacagaggcc

SEQ ID NO: 3053655 - RNA, 13 nt, Human
cacaaacagaggc

SEQ ID NO: 3053656 - RNA, 22 nt, Human
caauuuuucuuauuucauuucu

SEQ ID NO: 3053657 - RNA, 19 nt, Human
cacagcaggcugccagugc

SEQ ID NO: 3053658 - RNA, 20 nt, Human
cacagcaggcugccagugcc

SEQ ID NO: 3053659 - RNA, 21 nt, Human
cacagcaggcugccagugccu

SEQ ID NO: 3053660 - RNA, 22 nt, Human
cacagcaggcugccagugccug

SEQ ID NO: 3053661 - RNA, 21 nt, Human
cacagcaguugaaaagacucc

SEQ ID NO: 3053662 - RNA, 15 nt, Human
cacagcaggcugcca

SEQ ID NO: 3053663 - RNA, 16 nt, Human
cacagcaggcugccag

SEQ ID NO: 3053664 - RNA, 17 nt, Human
cacagcaggcugccagu

SEQ ID NO: 3053665 - RNA, 13 nt, Human
cacagcaggcugc

SEQ ID NO: 3053666 - RNA, 19 nt, Human
cacagcaguugaaaagacu

SEQ ID NO: 3053667 - RNA, 21 nt, Human
cacagcucuucuccaggcugu

SEQ ID NO: 3053668 - RNA, 14 nt, Human
cacagccccaucug

SEQ ID NO: 3053669 - RNA, 18 nt, Human
cacagccagacuggcaca

SEQ ID NO: 3053670 - RNA, 17 nt, Human
cacagccagacuggcac

SEQ ID NO: 3053671 - RNA, 12 nt, Human
cacagagaaagu

SEQ ID NO: 3053672 - RNA, 13 nt, Human
cacacugaagaag

SEQ ID NO: 3053673 - RNA, 20 nt, Human
cacagagaaaguacuucucc

SEQ ID NO: 3053674 - RNA, 19 nt, Human
cacagagaaaguacuucuc

SEQ ID NO: 3053675 - RNA, 13 nt, Human
cacagaggcugcc

SEQ ID NO: 3053676 - RNA, 22 nt, Human
cacagaguuguuacauuuuuaa

SEQ ID NO: 3053677 - RNA, 21 nt, Human
cacagaguuguuacauuuuua

SEQ ID NO: 3053678 - RNA, 23 nt, Human
cacagaugggugcuuggaggaag

SEQ ID NO: 3053679 - RNA, 12 nt, Human
uuucuaaaguaa

SEQ ID NO: 3053680 - RNA, 18 nt, Human
uuucuaaaggcuaccuuu

SEQ ID NO: 3053681 - RNA, 21 nt, Human
uuucuaaaggcuaccuuugua

SEQ ID NO: 3053682 - RNA, 20 nt, Human
uuucuaaaggcuaccuuugu

SEQ ID NO: 3053683 - RNA, 23 nt, Human
uuucuacucgaguuacagacaaa

SEQ ID NO: 3053684 - RNA, 20 nt, Human
uuucuguucuuucuggcuau

SEQ ID NO: 3053685 - RNA, 13 nt, Human
uuucugagaaaga

SEQ ID NO: 3053686 - RNA, 19 nt, Human
uuucugaaauuuccuggga

SEQ ID NO: 3053687 - RNA, 21 nt, Human
uuucugaaauuuccugggagc

SEQ ID NO: 3053688 - RNA, 15 nt, Human
uuucucugauacaga

SEQ ID NO: 3053689 - RNA, 16 nt, Human
uuucucugauacagaa

SEQ ID NO: 3053690 - RNA, 17 nt, Human
uuucucugauacagaaa

SEQ ID NO: 3053691 - RNA, 18 nt, Human
uuucucugauacagaaaa

SEQ ID NO: 3053692 - RNA, 23 nt, Human
uuacauuuuuaagugcugcauuu

SEQ ID NO: 3053693 - RNA, 17 nt, Human
uuaccacagacauacua

SEQ ID NO: 3053694 - RNA, 14 nt, Human
uuaccacagacaua

SEQ ID NO: 3053695 - RNA, 16 nt, Human
uuuccugaggcugggc

SEQ ID NO: 3053696 - RNA, 18 nt, Human
uuuccucauuuuuauaau

SEQ ID NO: 3053697 - RNA, 22 nt, Human
uuuccucaaaacuucagacaua

SEQ ID NO: 3053698 - RNA, 16 nt, Human
uuugaaucucauaauu

SEQ ID NO: 3053699 - RNA, 19 nt, Human
uuugaaucucauaauuuau

SEQ ID NO: 3053700 - RNA, 20 nt, Human
uuugaaucucauaauuuaua

SEQ ID NO: 3053701 - RNA, 21 nt, Human
uuugaaucucauaauuuauac

SEQ ID NO: 3053702 - RNA, 22 nt, Human
uuugaaucucauaauuuauaca

SEQ ID NO: 3053703 - RNA, 18 nt, Human
uuugaaucaucaagucuu

SEQ ID NO: 3053704 - RNA, 22 nt, Human
uuugaagaugccgcauuuggau

SEQ ID NO: 3053705 - RNA, 14 nt, Human
uuugaacucuucaa

SEQ ID NO: 3053706 - RNA, 15 nt, Human
uuugaacugauaaag

SEQ ID NO: 3053707 - RNA, 19 nt, Human
uuugaacugauaaagauga

SEQ ID NO: 3053708 - RNA, 17 nt, Human
uuugaacugauaaagau

SEQ ID NO: 3053709 - RNA, 12 nt, Human
uuucuucucccu

SEQ ID NO: 3053710 - RNA, 13 nt, Human
uuucuucucccuc

SEQ ID NO: 3053711 - RNA, 23 nt, Human
uuucuuagggaaggauacaaaag

SEQ ID NO: 3053712 - RNA, 18 nt, Human
uuucuuagggaaggauac

SEQ ID NO: 3053713 - RNA, 17 nt, Human
uuucuuauuucauuucu

SEQ ID NO: 3053714 - RNA, 15 nt, Human
uuugcaucugaaaau

SEQ ID NO: 3053715 - RNA, 16 nt, Human
uuugcuuugugauuuu

SEQ ID NO: 3053716 - RNA, 15 nt, Human
uuugcuuugugauuu

SEQ ID NO: 3053717 - RNA, 14 nt, Human
uuuggaauuuugug

SEQ ID NO: 3053718 - RNA, 17 nt, Human
uuuggucuacacugugc

SEQ ID NO: 3053719 - RNA, 21 nt, Human
uuuggaauuuugugcccccau

SEQ ID NO: 3053720 - RNA, 13 nt, Human
uuugguuucuagc

SEQ ID NO: 3053721 - RNA, 19 nt, Human
uuugguuuucacauuggaa

SEQ ID NO: 3053722 - RNA, 13 nt, Human
uuuguauaaaaua

SEQ ID NO: 3053723 - RNA, 14 nt, Human
uuuguauaaaauaa

SEQ ID NO: 3053724 - RNA, 15 nt, Human
uuuuaaaagaaugau

SEQ ID NO: 3053725 - RNA, 21 nt, Human
uuuuaaaagaaugauuaugaa

SEQ ID NO: 3053726 - RNA, 18 nt, Human
uuuuaaagacuuuuauga

SEQ ID NO: 3053727 - RNA, 17 nt, Human
uuuuaaagaaugcucuu

SEQ ID NO: 3053728 - RNA, 21 nt, Human
uuuguucuggcucuuccaggc

SEQ ID NO: 3053729 - RNA, 21 nt, Human
uuuuaaaugcaccuggaauau

SEQ ID NO: 3053730 - RNA, 12 nt, Human
uuuuaaaugcac

SEQ ID NO: 3053731 - RNA, 11 nt, Human
uuuuaaaugca

SEQ ID NO: 3053732 - RNA, 20 nt, Human
uuuuaauaauguuucaaaca

SEQ ID NO: 3053733 - RNA, 18 nt, Human
uuuucuaaaguaaaaaca

SEQ ID NO: 3053734 - RNA, 13 nt, Human
uuuuccugaaaac

SEQ ID NO: 3053735 - RNA, 14 nt, Human
uuuuccugaaaacc

SEQ ID NO: 3053736 - RNA, 20 nt, Human
uuuugaaucucauaauuuau

SEQ ID NO: 3053737 - RNA, 22 nt, Human
uuuucuuuugcuuuauggguuu

SEQ ID NO: 3053738 - RNA, 20 nt, Human
uuuugacaaggggcaguggu

SEQ ID NO: 3053739 - RNA, 14 nt, Human
uuuuggcugcugaa

SEQ ID NO: 3053740 - RNA, 15 nt, Human
uuuuggucuguguga

SEQ ID NO: 3053741 - RNA, 18 nt, Human
uuuuggucuggagggaag

SEQ ID NO: 3053742 - RNA, 18 nt, Human
uuuuguagcacugacaga

SEQ ID NO: 3053743 - RNA, 19 nt, Human
uuuuguagcacugacagau

SEQ ID NO: 3053744 - RNA, 19 nt, Human
uuuuguagagccagggucu

SEQ ID NO: 3053745 - RNA, 13 nt, Human
uuuuuaaagacuu

SEQ ID NO: 3053746 - RNA, 12 nt, Human
uuuuuaaagacu

SEQ ID NO: 3053747 - RNA, 18 nt, Human
uuuuuaaagacuuuuaug

SEQ ID NO: 3053748 - RNA, 16 nt, Human
uuuugucauauaagau

SEQ ID NO: 3053749 - RNA, 18 nt, Human
uuuuuaaaaaagaaacau

SEQ ID NO: 3053750 - RNA, 11 nt, Human
uuuuuccuuca

SEQ ID NO: 3053751 - RNA, 23 nt, Human
uuuuuaagaaaaaggaugcacag

SEQ ID NO: 3053752 - RNA, 19 nt, Human
uuuuuccuucagugccuua

SEQ ID NO: 3053753 - RNA, 23 nt, Human
uuuuucucugauacagaaaaguu

SEQ ID NO: 3053754 - RNA, 19 nt, Human
uuuuucucuaggaaauauu

SEQ ID NO: 3053755 - RNA, 16 nt, Human
uuaaugauaaguaaau

SEQ ID NO: 3053756 - RNA, 22 nt, Human
uuaauuaaaacacaacaucuuu

SEQ ID NO: 3053757 - RNA, 13 nt, Human
uuacauuguaaau

SEQ ID NO: 3053758 - RNA, 12 nt, Human
uuacauuguaaa

SEQ ID NO: 3053759 - RNA, 17 nt, Human
uuacauuuuuaagugcu

SEQ ID NO: 3053760 - RNA, 12 nt, Human
uuacauuuuuaa

SEQ ID NO: 3053761 - RNA, 20 nt, Human
uuacauuuguauaaaauaau

SEQ ID NO: 3053762 - RNA, 20 nt, Human
uuacacuuuaugcacaaaau

SEQ ID NO: 3053763 - RNA, 13 nt, Human
uuacacuuuaugc

SEQ ID NO: 3053764 - RNA, 12 nt, Human
uuaagaguaaaa

SEQ ID NO: 3053765 - RNA, 13 nt, Human
uuaaaugcccagc

SEQ ID NO: 3053766 - RNA, 13 nt, Human
uuaacuuuuauaa

SEQ ID NO: 3053767 - RNA, 12 nt, Human
uuaacuuuuaua

SEQ ID NO: 3053768 - RNA, 19 nt, Human
uguuuccauauuuuauagg

SEQ ID NO: 3053769 - RNA, 16 nt, Human
uguuuuaagaggcagg

SEQ ID NO: 3053770 - RNA, 23 nt, Human
uguuuuaaggaugcuuguacaua

SEQ ID NO: 3053771 - RNA, 22 nt, Human
uguuuuaaggaugcuuguacau

SEQ ID NO: 3053772 - RNA, 19 nt, Human
uguuuuaaggaugcuugua

SEQ ID NO: 3053773 - RNA, 17 nt, Human
uguuuuaagaggcaggg

SEQ ID NO: 3053774 - RNA, 22 nt, Human
uuaaaaaaaaaccugagcccca

SEQ ID NO: 3053775 - RNA, 14 nt, Human
uuaaaacccaagug

SEQ ID NO: 3053776 - RNA, 22 nt, Human
uuaaacuuaaucuaaauggaac

SEQ ID NO: 3053777 - RNA, 18 nt, Human
uuaaaauacacacucaaa

SEQ ID NO: 3053778 - RNA, 15 nt, Human
uuaaaugcccagccc

SEQ ID NO: 3053779 - RNA, 16 nt, Human
uuaaaugcccagcccc

SEQ ID NO: 3053780 - RNA, 14 nt, Human
uuaaaugcccagcc

SEQ ID NO: 3053781 - RNA, 12 nt, Human
uguuuaagagac

SEQ ID NO: 3053782 - RNA, 14 nt, Human
uguuuaaaaucauu

SEQ ID NO: 3053783 - RNA, 19 nt, Human
uguuggcugggggccucag

SEQ ID NO: 3053784 - RNA, 18 nt, Human
uguuuaaaaucauuucug

SEQ ID NO: 3053785 - RNA, 17 nt, Human
uguuuaaaaucauuucu

SEQ ID NO: 3053786 - RNA, 17 nt, Human
uguuggcugggggccuc

SEQ ID NO: 3053787 - RNA, 16 nt, Human
uguuggccaggcuggu

SEQ ID NO: 3053788 - RNA, 15 nt, Human
uguuggccaggcugg

SEQ ID NO: 3053789 - RNA, 19 nt, Human
uguuggagaagaacugaaa

SEQ ID NO: 3053790 - RNA, 14 nt, Human
uguuggagaagaac

SEQ ID NO: 3053791 - RNA, 16 nt, Human
uguuggagaagaacug

SEQ ID NO: 3053792 - RNA, 17 nt, Human
uguuggagaagaacuga

SEQ ID NO: 3053793 - RNA, 23 nt, Human
uguucuuucuggcuaugcauuug

SEQ ID NO: 3053794 - RNA, 17 nt, Human
uguucuggcucuuccag

SEQ ID NO: 3053795 - RNA, 20 nt, Human
uguucuggcucuuccaggcu

SEQ ID NO: 3053796 - RNA, 21 nt, Human
uguucuggcucuuccaggcug

SEQ ID NO: 3053797 - RNA, 20 nt, Human
uguugacaugggacauuugc

SEQ ID NO: 3053798 - RNA, 13 nt, Human
uguucucugcccu

SEQ ID NO: 3053799 - RNA, 14 nt, Human
uguucucugcccuc

SEQ ID NO: 3053800 - RNA, 15 nt, Human
uguucucugcccucc

SEQ ID NO: 3053801 - RNA, 16 nt, Human
uguucucugcccucca

SEQ ID NO: 3053802 - RNA, 13 nt, Human
uguucuggcucuu

SEQ ID NO: 3053803 - RNA, 16 nt, Human
uguucuggcucuucca

SEQ ID NO: 3053804 - RNA, 12 nt, Human
uguucuggcucu

SEQ ID NO: 3053805 - RNA, 19 nt, Human
uguucaucauccuaagcua

SEQ ID NO: 3053806 - RNA, 13 nt, Human
uguucaugaaaga

SEQ ID NO: 3053807 - RNA, 14 nt, Human
uguucaugaaagau

SEQ ID NO: 3053808 - RNA, 15 nt, Human
uguucucucuucucc

SEQ ID NO: 3053809 - RNA, 16 nt, Human
uguucucucuucucca

SEQ ID NO: 3053810 - RNA, 15 nt, Human
uguguuuuucauaaa

SEQ ID NO: 3053811 - RNA, 18 nt, Human
uguguuuuucauaaagca

SEQ ID NO: 3053812 - RNA, 13 nt, Human
uguguuuugcaag

SEQ ID NO: 3053813 - RNA, 19 nt, Human
uguguuuugcaagccagau

SEQ ID NO: 3053814 - RNA, 16 nt, Human
uguguuuauugucaaa

SEQ ID NO: 3053815 - RNA, 13 nt, Human
uguguuuauuguc

SEQ ID NO: 3053816 - RNA, 19 nt, Human
ugugugcacguacacacac

SEQ ID NO: 3053817 - RNA, 20 nt, Human
ugugugaaagguacuucaaa

SEQ ID NO: 3053818 - RNA, 21 nt, Human
ugugugaaagguacuucaaau

SEQ ID NO: 3053819 - RNA, 22 nt, Human
ugugugaaagguacuucaaauc

SEQ ID NO: 3053820 - RNA, 14 nt, Human
uguucauacauauu

SEQ ID NO: 3053821 - RNA, 23 nt, Human
uguucauacauauuuuuguagca

SEQ ID NO: 3053822 - RNA, 17 nt, Human
uguucauaaauaaaguu

SEQ ID NO: 3053823 - RNA, 12 nt, Human
uguucauacaua

SEQ ID NO: 3053824 - RNA, 18 nt, Human
uguucagcuccagcucac

SEQ ID NO: 3053825 - RNA, 21 nt, Human
uguucagcuccagcucaccag

SEQ ID NO: 3053826 - RNA, 20 nt, Human
uguucagcuccagcucacca

SEQ ID NO: 3053827 - RNA, 17 nt, Human
uguuaguaugaggcauu

SEQ ID NO: 3053828 - RNA, 20 nt, Human
uguuaguaugaggcauuugu

SEQ ID NO: 3053829 - RNA, 19 nt, Human
uguuaguaugaggcauuug

SEQ ID NO: 3053830 - RNA, 21 nt, Human
uguuaaaagaugaaaauauuu

SEQ ID NO: 3053831 - RNA, 14 nt, Human
uguuacuaaguuuu

SEQ ID NO: 3053832 - RNA, 21 nt, Human
ugugaauguugugauguauuc

SEQ ID NO: 3053833 - RNA, 18 nt, Human
ugugaagugaaugaaaca

SEQ ID NO: 3053834 - RNA, 15 nt, Human
ugugacauguuuuau

SEQ ID NO: 3053835 - RNA, 13 nt, Human
ugugaggaagccg

SEQ ID NO: 3053836 - RNA, 18 nt, Human
ugugaggaagccgcuggg

SEQ ID NO: 3053837 - RNA, 20 nt, Human
ugugaggaagccgcuggggc

SEQ ID NO: 3053838 - RNA, 12 nt, Human
ugugaggaagcc

SEQ ID NO: 3053839 - RNA, 16 nt, Human
ugugauauaagugugu

SEQ ID NO: 3053840 - RNA, 13 nt, Human
ugugauauaagug

SEQ ID NO: 3053841 - RNA, 17 nt, Human
ugugagucaccaagccc

SEQ ID NO: 3053842 - RNA, 15 nt, Human
ugugagucaccaagc

SEQ ID NO: 3053843 - RNA, 21 nt, Human
ugugagucaccaagcccaguu

SEQ ID NO: 3053844 - RNA, 19 nt, Human
ugugagucaccaagcccag

SEQ ID NO: 3053845 - RNA, 16 nt, Human
ugucuuuggacccuga

SEQ ID NO: 3053846 - RNA, 21 nt, Human
ugucuuuucuugcaugaggcu

SEQ ID NO: 3053847 - RNA, 14 nt, Human
ugucuuuggacccu

SEQ ID NO: 3053848 - RNA, 23 nt, Human
ugucuuuucuugcaugaggcuag

SEQ ID NO: 3053849 - RNA, 23 nt, Human
ugugaaaagaaaaaugagccugg

SEQ ID NO: 3053850 - RNA, 21 nt, Human
ugugaaaagaaaaaugagccu

SEQ ID NO: 3053851 - RNA, 12 nt, Human
uguguagggcgg

SEQ ID NO: 3053852 - RNA, 23 nt, Human
uguggcgcagcauauucaggaag

SEQ ID NO: 3053853 - RNA, 12 nt, Human
uguggcgagcca

SEQ ID NO: 3053854 - RNA, 22 nt, Human
uguggcgagccauuugucccaa

SEQ ID NO: 3053855 - RNA, 18 nt, Human
uguggacacagcucuucu

SEQ ID NO: 3053856 - RNA, 19 nt, Human
uguggacacagcucuucuc

SEQ ID NO: 3053857 - RNA, 16 nt, Human
uguggacacagcucuu

SEQ ID NO: 3053858 - RNA, 16 nt, Human
ugugcucaggagcccu

SEQ ID NO: 3053859 - RNA, 15 nt, Human
ugugcucaggagccc

SEQ ID NO: 3053860 - RNA, 17 nt, Human
ugugcucaggagcccug

SEQ ID NO: 3053861 - RNA, 14 nt, Human
ugugcgccuacagg

SEQ ID NO: 3053862 - RNA, 19 nt, Human
ugugcgccuacaggaguga

SEQ ID NO: 3053863 - RNA, 19 nt, Human
ugugcuaguaauuggaaag

SEQ ID NO: 3053864 - RNA, 21 nt, Human
ugugcauuaucuagauacugu

SEQ ID NO: 3053865 - RNA, 20 nt, Human
ugugcauuaucuagauacug

SEQ ID NO: 3053866 - RNA, 23 nt, Human
ugugcauuaucuagauacuguau

SEQ ID NO: 3053867 - RNA, 14 nt, Human
ugugcauuaucuag

SEQ ID NO: 3053868 - RNA, 19 nt, Human
ugugcauuaucuagauacu

SEQ ID NO: 3053869 - RNA, 16 nt, Human
ugugcauuaucuagau

SEQ ID NO: 3053870 - RNA, 14 nt, Human
ugugcacguacaca

SEQ ID NO: 3053871 - RNA, 18 nt, Human
uguagccccucuccugga

SEQ ID NO: 3053872 - RNA, 22 nt, Human
uguaguguuggagaagaacuga

SEQ ID NO: 3053873 - RNA, 14 nt, Human
uguacgaagaguau

SEQ ID NO: 3053874 - RNA, 22 nt, Human
uguacgaagaguauuuuugaca

SEQ ID NO: 3053875 - RNA, 15 nt, Human
uguacgucugacagg

SEQ ID NO: 3053876 - RNA, 19 nt, Human
uguacugcauaugaaagga

SEQ ID NO: 3053877 - RNA, 17 nt, Human
uguagauaauacaguuc

SEQ ID NO: 3053878 - RNA, 17 nt, Human
uguagcauccuggaaua

SEQ ID NO: 3053879 - RNA, 18 nt, Human
uguagcauccuggaauau

SEQ ID NO: 3053880 - RNA, 14 nt, Human
uguagcauccugga

SEQ ID NO: 3053881 - RNA, 16 nt, Human
uguagcauccuggaau

SEQ ID NO: 3053882 - RNA, 18 nt, Human
uguacagagcccacgccc

SEQ ID NO: 3053883 - RNA, 15 nt, Human
uguaccgcaauguga

SEQ ID NO: 3053884 - RNA, 16 nt, Human
uguaccgcaaugugac

SEQ ID NO: 3053885 - RNA, 16 nt, Human
uguacagagcccacgc

SEQ ID NO: 3053886 - RNA, 17 nt, Human
uguacagagcccacgcc

SEQ ID NO: 3053887 - RNA, 13 nt, Human
uguacagagccca

SEQ ID NO: 3053888 - RNA, 20 nt, Human
uguaauaaacucauuucuag

SEQ ID NO: 3053889 - RNA, 22 nt, Human
uguauaaaagggacugagaaau

SEQ ID NO: 3053890 - RNA, 15 nt, Human
uguaugauucccagc

SEQ ID NO: 3053891 - RNA, 22 nt, Human
uguauucucuccuguaccucuu

SEQ ID NO: 3053892 - RNA, 12 nt, Human
ugucacaggcag

SEQ ID NO: 3053893 - RNA, 17 nt, Human
ugucacacacuuuggcu

SEQ ID NO: 3053894 - RNA, 13 nt, Human
ugucacacacuuu

SEQ ID NO: 3053895 - RNA, 19 nt, Human
uguauuuuacuaauaaaau

SEQ ID NO: 3053896 - RNA, 16 nt, Human
uguccuacccacccuc

SEQ ID NO: 3053897 - RNA, 17 nt, Human
uguccuacucuguguca

SEQ ID NO: 3053898 - RNA, 12 nt, Human
uguccuacucug

SEQ ID NO: 3053899 - RNA, 16 nt, Human
uguccccgacccuugc

SEQ ID NO: 3053900 - RNA, 17 nt, Human
uguccccgacccuugcc

SEQ ID NO: 3053901 - RNA, 20 nt, Human
uguccuacccacccuccuuu

SEQ ID NO: 3053902 - RNA, 18 nt, Human
uguccccaccgcagacag

SEQ ID NO: 3053903 - RNA, 14 nt, Human
ugucccaagugcca

SEQ ID NO: 3053904 - RNA, 15 nt, Human
ugucccaagugccaa

SEQ ID NO: 3053905 - RNA, 12 nt, Human
ugucccaagugc

SEQ ID NO: 3053906 - RNA, 13 nt, Human
ugucccaagugcc

SEQ ID NO: 3053907 - RNA, 19 nt, Human
uguccccaccgcagacagg

SEQ ID NO: 3053908 - RNA, 22 nt, Human
uguccccaccgcagacaggacc

SEQ ID NO: 3053909 - RNA, 13 nt, Human
uguccccaccgca

SEQ ID NO: 3053910 - RNA, 23 nt, Human
ugucccaaaaagaaaggagggga

SEQ ID NO: 3053911 - RNA, 19 nt, Human
ugucauuugagcagggcuc

SEQ ID NO: 3053912 - RNA, 16 nt, Human
ugucauuugagcaggg

SEQ ID NO: 3053913 - RNA, 13 nt, Human
ugucaccugaaga

SEQ ID NO: 3053914 - RNA, 17 nt, Human
ugcucagagcaguguuu

SEQ ID NO: 3053915 - RNA, 16 nt, Human
ugcucacauaucuguc

SEQ ID NO: 3053916 - RNA, 15 nt, Human
ugcucacauaucugu

SEQ ID NO: 3053917 - RNA, 15 nt, Human
ugcuaagcauuccaa

SEQ ID NO: 3053918 - RNA, 19 nt, Human
ugcuaagcauuccaacuau

SEQ ID NO: 3053919 - RNA, 14 nt, Human
ugcuccucucccca

SEQ ID NO: 3053920 - RNA, 16 nt, Human
ugcucaguagucagac

SEQ ID NO: 3053921 - RNA, 17 nt, Human
ugcugaaacaacaaaua

SEQ ID NO: 3053922 - RNA, 17 nt, Human
ugcuccucuccccagca

SEQ ID NO: 3053923 - RNA, 18 nt, Human
ugcuccuuucuuguuuua

SEQ ID NO: 3053924 - RNA, 16 nt, Human
ugcugcaguugccagu

SEQ ID NO: 3053925 - RNA, 18 nt, Human
ugcugcaguugccaguca

SEQ ID NO: 3053926 - RNA, 23 nt, Human
ugcugcaguugccagucaccccg

SEQ ID NO: 3053927 - RNA, 13 nt, Human
ugcugcuggcugg

SEQ ID NO: 3053928 - RNA, 12 nt, Human
ugcugaaggcuc

SEQ ID NO: 3053929 - RNA, 13 nt, Human
ugcugaaggcucg

SEQ ID NO: 3053930 - RNA, 19 nt, Human
ugcugacagacacaggccc

SEQ ID NO: 3053931 - RNA, 23 nt, Human
ugcugacagacacaggcccggcu

SEQ ID NO: 3053932 - RNA, 22 nt, Human
ugcugacagacacaggcccggc

SEQ ID NO: 3053933 - RNA, 15 nt, Human
ugcugauggugcaau

SEQ ID NO: 3053934 - RNA, 17 nt, Human
ugcugauggugcaauga

SEQ ID NO: 3053935 - RNA, 13 nt, Human
ugcugauggugca

SEQ ID NO: 3053936 - RNA, 9 nt, Human
ugccucucu

SEQ ID NO: 3053937 - RNA, 20 nt, Human
ugccucucccugcugcuccu

SEQ ID NO: 3053938 - RNA, 17 nt, Human
ugccucucccugcugcu

SEQ ID NO: 3053939 - RNA, 19 nt, Human
ugccucgaacuggcugcaa

SEQ ID NO: 3053940 - RNA, 18 nt, Human
ugccucgaacuggcugca

SEQ ID NO: 3053941 - RNA, 20 nt, Human
ugccucgaacuggcugcaaa

SEQ ID NO: 3053942 - RNA, 18 nt, Human
ugccccuggcagccccug

SEQ ID NO: 3053943 - RNA, 15 nt, Human
ugccuggcggggugg

SEQ ID NO: 3053944 - RNA, 21 nt, Human
ugccugggaucccucauccuc

SEQ ID NO: 3053945 - RNA, 18 nt, Human
ugccugggcagaaggaag

SEQ ID NO: 3053946 - RNA, 16 nt, Human
ugccugguggcagcug

SEQ ID NO: 3053947 - RNA, 18 nt, Human
ugccuguaaucacagcua

SEQ ID NO: 3053948 - RNA, 15 nt, Human
ugccugguggcagcu

SEQ ID NO: 3053949 - RNA, 14 nt, Human
ugccugguggcagc

SEQ ID NO: 3053950 - RNA, 21 nt, Human
ugcgaucuggguucacugcaa

SEQ ID NO: 3053951 - RNA, 20 nt, Human
ugcgaucuggguucacugca

SEQ ID NO: 3053952 - RNA, 19 nt, Human
ugcgaucuggguucacugc

SEQ ID NO: 3053953 - RNA, 15 nt, Human
ugcgaucuggguuca

SEQ ID NO: 3053954 - RNA, 14 nt, Human
ugcgaucuggguuc

SEQ ID NO: 3053955 - RNA, 15 nt, Human
ugccuucucaacucc

SEQ ID NO: 3053956 - RNA, 16 nt, Human
ugcgccuacaggagug

SEQ ID NO: 3053957 - RNA, 14 nt, Human
ugcgccuacaggag

SEQ ID NO: 3053958 - RNA, 22 nt, Human
ugcgccuacaggagugagcacu

SEQ ID NO: 3053959 - RNA, 13 nt, Human
ugcgccuacagga

SEQ ID NO: 3053960 - RNA, 15 nt, Human
ugcuaaaugugaaug

SEQ ID NO: 3053961 - RNA, 21 nt, Human
ugcauauuuauaaaaauaaaa

SEQ ID NO: 3053962 - RNA, 20 nt, Human
ugcauauuuauaaaaauaaa

SEQ ID NO: 3053963 - RNA, 17 nt, Human
ugccaaauauaaauaaa

SEQ ID NO: 3053964 - RNA, 18 nt, Human
ugccaaauauaaauaaaa

SEQ ID NO: 3053965 - RNA, 19 nt, Human
ugccaaauauaaauaaaaa

SEQ ID NO: 3053966 - RNA, 22 nt, Human
ugccaaauauaaauaaaaauaa

SEQ ID NO: 3053967 - RNA, 14 nt, Human
ugcaucaagaugug

SEQ ID NO: 3053968 - RNA, 22 nt, Human
ugccagguuuuuggucugaccc

SEQ ID NO: 3053969 - RNA, 19 nt, Human
ugccagguuuuuggucuga

SEQ ID NO: 3053970 - RNA, 18 nt, Human
ugccagguuuuuggucug

SEQ ID NO: 3053971 - RNA, 19 nt, Human
ugccacccuggggagaaag

SEQ ID NO: 3053972 - RNA, 20 nt, Human
ugccacuaaauugacacuua

SEQ ID NO: 3053973 - RNA, 22 nt, Human
ugccacuacggaauaguuggcu

SEQ ID NO: 3053974 - RNA, 20 nt, Human
ugccauccagguucagcuug

SEQ ID NO: 3053975 - RNA, 21 nt, Human
ugccauccagguucagcuugu

SEQ ID NO: 3053976 - RNA, 13 nt, Human
ugcccacucccug

SEQ ID NO: 3053977 - RNA, 13 nt, Human
ugcccaccuggcc

SEQ ID NO: 3053978 - RNA, 14 nt, Human
ugcccacucccugc

SEQ ID NO: 3053979 - RNA, 15 nt, Human
ugcccacucccugca

SEQ ID NO: 3053980 - RNA, 16 nt, Human
ugcccacucccugcaa

SEQ ID NO: 3053981 - RNA, 11 nt, Human
ugcccaggcug

SEQ ID NO: 3053982 - RNA, 23 nt, Human
ugccccucaacucuccuccagag

SEQ ID NO: 3053983 - RNA, 17 nt, Human
ugccccuggcagccccu

SEQ ID NO: 3053984 - RNA, 19 nt, Human
ugccccucaacucuccucc

SEQ ID NO: 3053985 - RNA, 23 nt, Human
ugcagcaauaaagcagcguuucu

SEQ ID NO: 3053986 - RNA, 20 nt, Human
ugcagcaauaaagcagcguu

SEQ ID NO: 3053987 - RNA, 12 nt, Human
ugcacuuuguuc

SEQ ID NO: 3053988 - RNA, 14 nt, Human
ugcacuuuguucug

SEQ ID NO: 3053989 - RNA, 22 nt, Human
ugcaccgggccacagagaaagu

SEQ ID NO: 3053990 - RNA, 17 nt, Human
ugcaccgggccacagag

SEQ ID NO: 3053991 - RNA, 19 nt, Human
ugaguccccuguuuguuuc

SEQ ID NO: 3053992 - RNA, 23 nt, Human
ugcaccggcuggccuggccccuc

SEQ ID NO: 3053993 - RNA, 15 nt, Human
ugcaccgggccacag

SEQ ID NO: 3053994 - RNA, 14 nt, Human
ugcaccgggccaca

SEQ ID NO: 3053995 - RNA, 17 nt, Human
ugcacgcacacugucug

SEQ ID NO: 3053996 - RNA, 19 nt, Human
ugcacgcacacugucugcc

SEQ ID NO: 3053997 - RNA, 16 nt, Human
ugcagugcuuccaagg

SEQ ID NO: 3053998 - RNA, 19 nt, Human
ugcagugagccgagauugu

SEQ ID NO: 3053999 - RNA, 13 nt, Human
ugcaggcagccag

SEQ ID NO: 3054000 - RNA, 14 nt, Human
ugcaggcagccagg

SEQ ID NO: 3054001 - RNA, 19 nt, Human
ugcaggcagccaggccaca

SEQ ID NO: 3054002 - RNA, 15 nt, Human
ugcaggcagccaggc

SEQ ID NO: 3054003 - RNA, 22 nt, Human
ugcagugguaugaucacggcuc

SEQ ID NO: 3054004 - RNA, 14 nt, Human
ugcaguucugaaga

SEQ ID NO: 3054005 - RNA, 15 nt, Human
ugcaguucugaagaa

SEQ ID NO: 3054006 - RNA, 16 nt, Human
ugcaguucugaagaag

SEQ ID NO: 3054007 - RNA, 17 nt, Human
ugcaguucugaagaaga

SEQ ID NO: 3054008 - RNA, 18 nt, Human
ugcaguucugaagaagau

SEQ ID NO: 3054009 - RNA, 13 nt, Human
ugcaguugccagu

SEQ ID NO: 3054010 - RNA, 14 nt, Human
ugcaguugccaguc

SEQ ID NO: 3054011 - RNA, 19 nt, Human
ugcaguucugaagaagaug

SEQ ID NO: 3054012 - RNA, 22 nt, Human
ugcaguucugaagaagauggua

SEQ ID NO: 3054013 - RNA, 19 nt, Human
ugggguuuaucagaauucu

SEQ ID NO: 3054014 - RNA, 16 nt, Human
uggguaacuagggaag

SEQ ID NO: 3054015 - RNA, 15 nt, Human
uggguucuacccagg

SEQ ID NO: 3054016 - RNA, 16 nt, Human
uggguucuacccaggu

SEQ ID NO: 3054017 - RNA, 22 nt, Human
uggguucuacccaggugcuagg

SEQ ID NO: 3054018 - RNA, 14 nt, Human
uggguguggcgcag

SEQ ID NO: 3054019 - RNA, 23 nt, Human
ugguauuggcuagagguucaaag

SEQ ID NO: 3054020 - RNA, 21 nt, Human
ugguauguuuucaggcuagau

SEQ ID NO: 3054021 - RNA, 21 nt, Human
uggguuucuaaagcugccagc

SEQ ID NO: 3054022 - RNA, 17 nt, Human
uggguuucuaaagcugc

SEQ ID NO: 3054023 - RNA, 18 nt, Human
uggguuucuaaagcugcc

SEQ ID NO: 3054024 - RNA, 15 nt, Human
ugggggugcauuuga

SEQ ID NO: 3054025 - RNA, 12 nt, Human
ugggggugcauu

SEQ ID NO: 3054026 - RNA, 17 nt, Human
ugggggcugggcagagg

SEQ ID NO: 3054027 - RNA, 18 nt, Human
ugggggcugggcagagga

SEQ ID NO: 3054028 - RNA, 21 nt, Human
ugggggaucacagccucugaa

SEQ ID NO: 3054029 - RNA, 20 nt, Human
ugggggaucacagccucuga

SEQ ID NO: 3054030 - RNA, 15 nt, Human
ugggcuucaguggca

SEQ ID NO: 3054031 - RNA, 17 nt, Human
ugggcuucaguggcagc

SEQ ID NO: 3054032 - RNA, 16 nt, Human
ugggcagaggaaagca

SEQ ID NO: 3054033 - RNA, 22 nt, Human
ugggcuaagugauccucccacc

SEQ ID NO: 3054034 - RNA, 23 nt, Human
ugggcuggguucuacccaggugc

SEQ ID NO: 3054035 - RNA, 17 nt, Human
ugggcuggugucaccug

SEQ ID NO: 3054036 - RNA, 16 nt, Human
ugggcuaguugggcuu

SEQ ID NO: 3054037 - RNA, 14 nt, Human
ugggauccuccagg

SEQ ID NO: 3054038 - RNA, 15 nt, Human
ugggauccuccaggu

SEQ ID NO: 3054039 - RNA, 15 nt, Human
ugggagugagcuggu

SEQ ID NO: 3054040 - RNA, 14 nt, Human
ugggaguacaaaag

SEQ ID NO: 3054041 - RNA, 22 nt, Human
ugggagcugccuguucagcucc

SEQ ID NO: 3054042 - RNA, 21 nt, Human
ugggagcugccuguucagcuc

SEQ ID NO: 3054043 - RNA, 17 nt, Human
ugggagcugccuguuca

SEQ ID NO: 3054044 - RNA, 18 nt, Human
ugggauccuccaggugca

SEQ ID NO: 3054045 - RNA, 13 nt, Human
ugggauccuggag

SEQ ID NO: 3054046 - RNA, 16 nt, Human
ugggauuacaggugug

SEQ ID NO: 3054047 - RNA, 15 nt, Human
ugggcagaggaaagc

SEQ ID NO: 3054048 - RNA, 13 nt, Human
ugggagcaaaaga

SEQ ID NO: 3054049 - RNA, 14 nt, Human
ugggagcugccugu

SEQ ID NO: 3054050 - RNA, 13 nt, Human
ugggagcugccug

SEQ ID NO: 3054051 - RNA, 12 nt, Human
ugggagcugccu

SEQ ID NO: 3054052 - RNA, 12 nt, Human
ugggacacccug

SEQ ID NO: 3054053 - RNA, 14 nt, Human
uggcuuuugugcau

SEQ ID NO: 3054054 - RNA, 22 nt, Human
uggcuuccuaaaauucagugga

SEQ ID NO: 3054055 - RNA, 16 nt, Human
uggcuuccuggcaaua

SEQ ID NO: 3054056 - RNA, 21 nt, Human
uggcugggggccucagugcca

SEQ ID NO: 3054057 - RNA, 16 nt, Human
uggcugcuucaaggau

SEQ ID NO: 3054058 - RNA, 21 nt, Human
uggcugcuucaaggauccuga

SEQ ID NO: 3054059 - RNA, 19 nt, Human
uggcccagggcaucuggga

SEQ ID NO: 3054060 - RNA, 14 nt, Human
uggaaagaguacuc

SEQ ID NO: 3054061 - RNA, 20 nt, Human
uggaaagaguaggaagacuu

SEQ ID NO: 3054062 - RNA, 21 nt, Human
uggaacauaaaauacaauguu

SEQ ID NO: 3054063 - RNA, 20 nt, Human
uggaacauaaaauacaaugu

SEQ ID NO: 3054064 - RNA, 21 nt, Human
uggaaagacuuuuccaacccu

SEQ ID NO: 3054065 - RNA, 23 nt, Human
uggaaacuucagcgguuuauaua

SEQ ID NO: 3054066 - RNA, 17 nt, Human
uggaaacaagucaguca

SEQ ID NO: 3054067 - RNA, 17 nt, Human
uggaaaaauagccugcc

SEQ ID NO: 3054068 - RNA, 20 nt, Human
uggaaaaauagccugccucu

SEQ ID NO: 3054069 - RNA, 16 nt, Human
uggaaugcuguguuaa

SEQ ID NO: 3054070 - RNA, 16 nt, Human
uggacagaagcagcuc

SEQ ID NO: 3054071 - RNA, 15 nt, Human
uggacagaagcagcu

SEQ ID NO: 3054072 - RNA, 18 nt, Human
uggacagaagcagcucuu

SEQ ID NO: 3054073 - RNA, 17 nt, Human
uggacagaagcagcucu

SEQ ID NO: 3054074 - RNA, 13 nt, Human
uggacaugcacag

SEQ ID NO: 3054075 - RNA, 19 nt, Human
uggacaugcacagcuaaca

SEQ ID NO: 3054076 - RNA, 22 nt, Human
uggaauaauccuaaacauauga

SEQ ID NO: 3054077 - RNA, 17 nt, Human
uggaauaaggagaauga

SEQ ID NO: 3054078 - RNA, 16 nt, Human
uggaauauauaaccag

SEQ ID NO: 3054079 - RNA, 15 nt, Human
uggaauauauaacca

SEQ ID NO: 3054080 - RNA, 19 nt, Human
uggaauaacauguaauuaa

SEQ ID NO: 3054081 - RNA, 15 nt, Human
uggaauaacauguaa

SEQ ID NO: 3054082 - RNA, 14 nt, Human
uggaauaacaugua

SEQ ID NO: 3054083 - RNA, 12 nt, Human
uggaggaaggaa

SEQ ID NO: 3054084 - RNA, 18 nt, Human
uggaggaaggaaacccag

SEQ ID NO: 3054085 - RNA, 20 nt, Human
uggaggaaggaaacccagcu

SEQ ID NO: 3054086 - RNA, 11 nt, Human
uggagggaagc

SEQ ID NO: 3054087 - RNA, 24 nt, Human
uggauuuaacagaaauguacagca

SEQ ID NO: 3054088 - RNA, 20 nt, Human
uggauuuaacagaaauguac

SEQ ID NO: 3054089 - RNA, 17 nt, Human
uggauuuaacagaaaug

SEQ ID NO: 3054090 - RNA, 13 nt, Human
uggcagcugcuuu

SEQ ID NO: 3054091 - RNA, 21 nt, Human
uggcacccggccccugcuggu

SEQ ID NO: 3054092 - RNA, 21 nt, Human
uggccagaugcaccagcccuu

SEQ ID NO: 3054093 - RNA, 20 nt, Human
uggccagaugcaccagcccu

SEQ ID NO: 3054094 - RNA, 13 nt, Human
uggcccagggcau

SEQ ID NO: 3054095 - RNA, 14 nt, Human
uggcccagggcauc

SEQ ID NO: 3054096 - RNA, 20 nt, Human
uccuuaccagcagagcaccu

SEQ ID NO: 3054097 - RNA, 21 nt, Human
uccuuaccagcagagcaccuu

SEQ ID NO: 3054098 - RNA, 22 nt, Human
uccuugaaaacacuguucucug

SEQ ID NO: 3054099 - RNA, 23 nt, Human
uccuugaaaacacuguucucugc

SEQ ID NO: 3054100 - RNA, 18 nt, Human
uccuuggugucgggcaug

SEQ ID NO: 3054101 - RNA, 21 nt, Human
uccuuggugucgggcaugaca

SEQ ID NO: 3054102 - RNA, 17 nt, Human
uccuugcaucaauuuuu

SEQ ID NO: 3054103 - RNA, 15 nt, Human
uccuugcaucaauuu

SEQ ID NO: 3054104 - RNA, 18 nt, Human
uccuuugugaggaagccg

SEQ ID NO: 3054105 - RNA, 22 nt, Human
uccuuugugaggaagccgcugg

SEQ ID NO: 3054106 - RNA, 17 nt, Human
uccuuugugaggaagcc

SEQ ID NO: 3054107 - RNA, 18 nt, Human
uccuuuucgcaggauucu

SEQ ID NO: 3054108 - RNA, 22 nt, Human
uccuuuucgcaggauucuuccu

SEQ ID NO: 3054109 - RNA, 23 nt, Human
ucgcaggauucuuccucccuccc

SEQ ID NO: 3054110 - RNA, 21 nt, Human
ucgcaggauucuuccucccuc

SEQ ID NO: 3054111 - RNA, 17 nt, Human
ucgcaggauucuuccuc

SEQ ID NO: 3054112 - RNA, 18 nt, Human
ucggaaaacaugcuacac

SEQ ID NO: 3054113 - RNA, 15 nt, Human
ucggaaaacaugcua

SEQ ID NO: 3054114 - RNA, 23 nt, Human
ucgcccagucuggaaugcagugg

SEQ ID NO: 3054115 - RNA, 19 nt, Human
ucgcccagucuggaaugca

SEQ ID NO: 3054116 - RNA, 14 nt, Human
ucgcccagucugga

SEQ ID NO: 3054117 - RNA, 23 nt, Human
ucgucacugcuuaacuucacaua

SEQ ID NO: 3054118 - RNA, 18 nt, Human
ucggccccaccagugccu

SEQ ID NO: 3054119 - RNA, 19 nt, Human
ucggccccaccagugccuc

SEQ ID NO: 3054120 - RNA, 15 nt, Human
ucggccccaccagug

SEQ ID NO: 3054121 - RNA, 15 nt, Human
ucggccuccauccug

SEQ ID NO: 3054122 - RNA, 16 nt, Human
ucggccuccauccuga

SEQ ID NO: 3054123 - RNA, 15 nt, Human
ucggagcccugucuc

SEQ ID NO: 3054124 - RNA, 14 nt, Human
ucggagcccugucu

SEQ ID NO: 3054125 - RNA, 15 nt, Human
ucuagguaaauuaca

SEQ ID NO: 3054126 - RNA, 12 nt, Human
ucuagggaaaaa

SEQ ID NO: 3054127 - RNA, 13 nt, Human
ucuauauuuuaca

SEQ ID NO: 3054128 - RNA, 20 nt, Human
ucuacucgaguuacagacaa

SEQ ID NO: 3054129 - RNA, 21 nt, Human
ucuacucgaguuacagacaaa

SEQ ID NO: 3054130 - RNA, 18 nt, Human
ucuacucuagggaaaaac

SEQ ID NO: 3054131 - RNA, 18 nt, Human
ucuaggaggucucuaaga

SEQ ID NO: 3054132 - RNA, 14 nt, Human
ucuaauauguaaca

SEQ ID NO: 3054133 - RNA, 19 nt, Human
ucuacuaaaaauacaaaaa

SEQ ID NO: 3054134 - RNA, 15 nt, Human
ucuacuaaaaauaca

SEQ ID NO: 3054135 - RNA, 12 nt, Human
ucuacuaaaaau

SEQ ID NO: 3054136 - RNA, 16 nt, Human
ucucauaauuuauaca

SEQ ID NO: 3054137 - RNA, 22 nt, Human
ucucauaauuuauacaggucau

SEQ ID NO: 3054138 - RNA, 15 nt, Human
ucucacuguugccca

SEQ ID NO: 3054139 - RNA, 14 nt, Human
ucucacuguugccc

SEQ ID NO: 3054140 - RNA, 16 nt, Human
ucucaaauuucuaaau

SEQ ID NO: 3054141 - RNA, 14 nt, Human
ucucaaauuucuaa

SEQ ID NO: 3054142 - RNA, 13 nt, Human
ucucaaauuucua

SEQ ID NO: 3054143 - RNA, 18 nt, Human
ucucaaauuucuaaaucu

SEQ ID NO: 3054144 - RNA, 16 nt, Human
ucucacacaugagcau

SEQ ID NO: 3054145 - RNA, 20 nt, Human
ucucacugccaugccagcuu

SEQ ID NO: 3054146 - RNA, 22 nt, Human
ucucacucugucgcccagucug

SEQ ID NO: 3054147 - RNA, 21 nt, Human
ucucacacaugagcaucaggc

SEQ ID NO: 3054148 - RNA, 23 nt, Human
ucucacucugucgcccagucugg

SEQ ID NO: 3054149 - RNA, 13 nt, Human
ucccucuggggcu

SEQ ID NO: 3054150 - RNA, 17 nt, Human
ucccucuggggcuguuc

SEQ ID NO: 3054151 - RNA, 20 nt, Human
ucccugcacuugcagacucu

SEQ ID NO: 3054152 - RNA, 14 nt, Human
ucccugccaaugga

SEQ ID NO: 3054153 - RNA, 16 nt, Human
ucccugccaauggacu

SEQ ID NO: 3054154 - RNA, 18 nt, Human
ucccucccuuccucuuuc

SEQ ID NO: 3054155 - RNA, 19 nt, Human
ucccaugagggagaugcca

SEQ ID NO: 3054156 - RNA, 23 nt, Human
ucccaugagggagaugccaugag

SEQ ID NO: 3054157 - RNA, 22 nt, Human
ucccaugagccucagcauccug

SEQ ID NO: 3054158 - RNA, 21 nt, Human
uccgcuuucuacccagcgagc

SEQ ID NO: 3054159 - RNA, 22 nt, Human
uccgaaagggacuuggaagcuc

SEQ ID NO: 3054160 - RNA, 17 nt, Human
uccgaccagacaccuug

SEQ ID NO: 3054161 - RNA, 21 nt, Human
uccgaaagggacuuggaagcu

SEQ ID NO: 3054162 - RNA, 17 nt, Human
ucccuucccaccucucu

SEQ ID NO: 3054163 - RNA, 21 nt, Human
ucccuucccacuggaggcaug

SEQ ID NO: 3054164 - RNA, 14 nt, Human
ucccuucccaccuc

SEQ ID NO: 3054165 - RNA, 16 nt, Human
ucccuucccaccucuc

SEQ ID NO: 3054166 - RNA, 21 nt, Human
uccucuaggaggucucuaaga

SEQ ID NO: 3054167 - RNA, 17 nt, Human
uccucuaggaggucucu

SEQ ID NO: 3054168 - RNA, 21 nt, Human
uccuccuuuucacaguucucu

SEQ ID NO: 3054169 - RNA, 17 nt, Human
uccucugcugcuggcug

SEQ ID NO: 3054170 - RNA, 13 nt, Human
uccucuguacaga

SEQ ID NO: 3054171 - RNA, 15 nt, Human
uccucuggccugugu

SEQ ID NO: 3054172 - RNA, 15 nt, Human
uccugaggcugggcu

SEQ ID NO: 3054173 - RNA, 16 nt, Human
uccugaggcugggcuc

SEQ ID NO: 3054174 - RNA, 17 nt, Human
uccugaggcugggcucc

SEQ ID NO: 3054175 - RNA, 19 nt, Human
uccugaggcugggcucccu

SEQ ID NO: 3054176 - RNA, 12 nt, Human
uccugaggcugg

SEQ ID NO: 3054177 - RNA, 21 nt, Human
uccugaggcuccacuuggucu

SEQ ID NO: 3054178 - RNA, 16 nt, Human
uccugaggcuccacuu

SEQ ID NO: 3054179 - RNA, 18 nt, Human
uccugagccagauuucac

SEQ ID NO: 3054180 - RNA, 19 nt, Human
uccugagccagauuucacu

SEQ ID NO: 3054181 - RNA, 15 nt, Human
uccugaggcuccacu

SEQ ID NO: 3054182 - RNA, 14 nt, Human
uccugagccagauu

SEQ ID NO: 3054183 - RNA, 17 nt, Human
uccugagccagauuuca

SEQ ID NO: 3054184 - RNA, 23 nt, Human
uccucuguacagagcccacgccc

SEQ ID NO: 3054185 - RNA, 19 nt, Human
uccucuguacagagcccac

SEQ ID NO: 3054186 - RNA, 16 nt, Human
uccuaagcuauucagu

SEQ ID NO: 3054187 - RNA, 14 nt, Human
uccuaguuccacca

SEQ ID NO: 3054188 - RNA, 17 nt, Human
uccuaguuccaccauca

SEQ ID NO: 3054189 - RNA, 18 nt, Human
uccuaagcuauucaguaa

SEQ ID NO: 3054190 - RNA, 12 nt, Human
uccuaguuccac

SEQ ID NO: 3054191 - RNA, 21 nt, Human
uccuaguuccaccaucaagcc

SEQ ID NO: 3054192 - RNA, 14 nt, Human
uccuccaggugcac

SEQ ID NO: 3054193 - RNA, 18 nt, Human
uccuccaggugcacaagc

SEQ ID NO: 3054194 - RNA, 20 nt, Human
uccuccaggugcacaagcuc

SEQ ID NO: 3054195 - RNA, 22 nt, Human
uccuccaggugcacaagcucca

SEQ ID NO: 3054196 - RNA, 12 nt, Human
uccuccaggugc

SEQ ID NO: 3054197 - RNA, 13 nt, Human
uccuccaggugca

SEQ ID NO: 3054198 - RNA, 12 nt, Human
uccuccucagau

SEQ ID NO: 3054199 - RNA, 17 nt, Human
ucccaacucaccccagc

SEQ ID NO: 3054200 - RNA, 18 nt, Human
ucccaacucaccccagcc

SEQ ID NO: 3054201 - RNA, 19 nt, Human
ucccaacucaccccagccc

SEQ ID NO: 3054202 - RNA, 21 nt, Human
ucccaacucaccccagcccca

SEQ ID NO: 3054203 - RNA, 17 nt, Human
uccauagagagcaagac

SEQ ID NO: 3054204 - RNA, 20 nt, Human
uccauagagagcaagacgcu

SEQ ID NO: 3054205 - RNA, 17 nt, Human
ucccaggcauuccccag

SEQ ID NO: 3054206 - RNA, 18 nt, Human
ucccaggcauuccccagg

SEQ ID NO: 3054207 - RNA, 16 nt, Human
ucccaugagccucagc

SEQ ID NO: 3054208 - RNA, 15 nt, Human
ucccaugagccucag

SEQ ID NO: 3054209 - RNA, 14 nt, Human
ucccacucagucca

SEQ ID NO: 3054210 - RNA, 20 nt, Human
ucccaccucucucacuccuu

SEQ ID NO: 3054211 - RNA, 18 nt, Human
ucccaccuuggcugcagg

SEQ ID NO: 3054212 - RNA, 21 nt, Human
ucccaccuuggcugcagggag

SEQ ID NO: 3054213 - RNA, 19 nt, Human
ucccaccuuggcugcaggg

SEQ ID NO: 3054214 - RNA, 17 nt, Human
ucccaccucucucacuc

SEQ ID NO: 3054215 - RNA, 18 nt, Human
ucccaccucucucacucc

SEQ ID NO: 3054216 - RNA, 14 nt, Human
ucccaccucucuca

SEQ ID NO: 3054217 - RNA, 16 nt, Human
ucccaccucagccucc

SEQ ID NO: 3054218 - RNA, 18 nt, Human
ucccaccucagccucccg

SEQ ID NO: 3054219 - RNA, 20 nt, Human
uccacaagagcccaggccuc

SEQ ID NO: 3054220 - RNA, 19 nt, Human
uccacaagagcccaggccu

SEQ ID NO: 3054221 - RNA, 21 nt, Human
uccacaagagcccaggccucc

SEQ ID NO: 3054222 - RNA, 19 nt, Human
uccaagaccuucuccuuca

SEQ ID NO: 3054223 - RNA, 20 nt, Human
uccaagaccuucuccuucac

SEQ ID NO: 3054224 - RNA, 17 nt, Human
uccaagcaaaugugaau

SEQ ID NO: 3054225 - RNA, 15 nt, Human
uccaagcaaauguga

SEQ ID NO: 3054226 - RNA, 14 nt, Human
uccaagcaggacau

SEQ ID NO: 3054227 - RNA, 20 nt, Human
uccaagcauuuagauguaua

SEQ ID NO: 3054228 - RNA, 15 nt, Human
uccaagaagcccagg

SEQ ID NO: 3054229 - RNA, 16 nt, Human
uccaagaagcccagga

SEQ ID NO: 3054230 - RNA, 14 nt, Human
uccaagaagcccag

SEQ ID NO: 3054231 - RNA, 12 nt, Human
uccaagaagccc

SEQ ID NO: 3054232 - RNA, 15 nt, Human
uccacuuuaucuuga

SEQ ID NO: 3054233 - RNA, 22 nt, Human
uccacugugccaugugccaggu

SEQ ID NO: 3054234 - RNA, 14 nt, Human
uccacccugcucuc

SEQ ID NO: 3054235 - RNA, 13 nt, Human
uccacccugcucu

SEQ ID NO: 3054236 - RNA, 21 nt, Human
uccacccugcucuccgaccag

SEQ ID NO: 3054237 - RNA, 17 nt, Human
uccacuuuaucuugaau

SEQ ID NO: 3054238 - RNA, 14 nt, Human
uccacuuucuagcc

SEQ ID NO: 3054239 - RNA, 17 nt, Human
uccagagccccacagcc

SEQ ID NO: 3054240 - RNA, 18 nt, Human
uccagcugcugagauccu

SEQ ID NO: 3054241 - RNA, 21 nt, Human
uccagcugcugagauccugga

SEQ ID NO: 3054242 - RNA, 14 nt, Human
uccagcugcugaga

SEQ ID NO: 3054243 - RNA, 22 nt, Human
uccagcugcugagauccuggac

SEQ ID NO: 3054244 - RNA, 19 nt, Human
ucagugugucuaaauuuga

SEQ ID NO: 3054245 - RNA, 18 nt, Human
ucagugugacugaucucu

SEQ ID NO: 3054246 - RNA, 17 nt, Human
ucagucugauucccaag

SEQ ID NO: 3054247 - RNA, 15 nt, Human
ucaguccauagcaga

SEQ ID NO: 3054248 - RNA, 18 nt, Human
ucaguccaugaagaugua

SEQ ID NO: 3054249 - RNA, 17 nt, Human
ucagguggggucacucu

SEQ ID NO: 3054250 - RNA, 20 nt, Human
ucagguggggucacucuggc

SEQ ID NO: 3054251 - RNA, 15 nt, Human
ucaggugcugccauc

SEQ ID NO: 3054252 - RNA, 17 nt, Human
ucagguggggcagcuug

SEQ ID NO: 3054253 - RNA, 21 nt, Human
ucagguggggcagcuugaggg

SEQ ID NO: 3054254 - RNA, 16 nt, Human
ucagguggggcagcuu

SEQ ID NO: 3054255 - RNA, 15 nt, Human
ucagguggggcagcu

SEQ ID NO: 3054256 - RNA, 20 nt, Human
ucaggugcugccauccaggu

SEQ ID NO: 3054257 - RNA, 18 nt, Human
ucaggugcugccauccag

SEQ ID NO: 3054258 - RNA, 14 nt, Human
ucagguggggcagc

SEQ ID NO: 3054259 - RNA, 15 nt, Human
ucauacucaccucac

SEQ ID NO: 3054260 - RNA, 24 nt, Human
ucauggacuucugccagcauaaua

SEQ ID NO: 3054261 - RNA, 21 nt, Human
ucauggaauuggagcucgugg

SEQ ID NO: 3054262 - RNA, 19 nt, Human
ucauggaauuggagcucgu

SEQ ID NO: 3054263 - RNA, 13 nt, Human
ucaugaaagauuc

SEQ ID NO: 3054264 - RNA, 17 nt, Human
ucagauaugauucaaau

SEQ ID NO: 3054265 - RNA, 16 nt, Human
ucagauaugauucaaa

SEQ ID NO: 3054266 - RNA, 18 nt, Human
ucagauaugauucaaaug

SEQ ID NO: 3054267 - RNA, 17 nt, Human
ucagcacgauuucuguu

SEQ ID NO: 3054268 - RNA, 16 nt, Human
ucagcacgauuucugu

SEQ ID NO: 3054269 - RNA, 15 nt, Human
ucagcacgauuucug

SEQ ID NO: 3054270 - RNA, 12 nt, Human
ucagccucccaa

SEQ ID NO: 3054271 - RNA, 18 nt, Human
ucagcauccuggcacccg

SEQ ID NO: 3054272 - RNA, 17 nt, Human
ucagcauccuggcaccc

SEQ ID NO: 3054273 - RNA, 16 nt, Human
ucagcauccuggcacc

SEQ ID NO: 3054274 - RNA, 15 nt, Human
ucagcauccuggcac

SEQ ID NO: 3054275 - RNA, 22 nt, Human
ucaggagaguagaacagauaau

SEQ ID NO: 3054276 - RNA, 15 nt, Human
ucagcugcuacuacu

SEQ ID NO: 3054277 - RNA, 16 nt, Human
ucagcugcugaaacaa

SEQ ID NO: 3054278 - RNA, 22 nt, Human
ucagccucccaaagugcuggga

SEQ ID NO: 3054279 - RNA, 20 nt, Human
ucagccucccgaauagcugg

SEQ ID NO: 3054280 - RNA, 12 nt, Human
ucagccucccga

SEQ ID NO: 3054281 - RNA, 16 nt, Human
ucagccugcuccagcu

SEQ ID NO: 3054282 - RNA, 22 nt, Human
ucagcuccagcucaccagcccc

SEQ ID NO: 3054283 - RNA, 21 nt, Human
ucagcuccagcucaccagccc

SEQ ID NO: 3054284 - RNA, 18 nt, Human
ucagcuccagcucaccag

SEQ ID NO: 3054285 - RNA, 15 nt, Human
ucagcuccagcucac

SEQ ID NO: 3054286 - RNA, 21 nt, Human
ucagcuccccucggagaagag

SEQ ID NO: 3054287 - RNA, 22 nt, Human
ucagcuccccucggagaagagc

SEQ ID NO: 3054288 - RNA, 14 nt, Human
ucuggaauuugaaa

SEQ ID NO: 3054289 - RNA, 16 nt, Human
ucuggaaugcaguggu

SEQ ID NO: 3054290 - RNA, 14 nt, Human
ucugcugcuggcug

SEQ ID NO: 3054291 - RNA, 15 nt, Human
ucugcugcuggcugg

SEQ ID NO: 3054292 - RNA, 17 nt, Human
ucugcugcuggcugguu

SEQ ID NO: 3054293 - RNA, 20 nt, Human
ucugccugcccaggccccug

SEQ ID NO: 3054294 - RNA, 18 nt, Human
ucugccugcccaggcccc

SEQ ID NO: 3054295 - RNA, 17 nt, Human
ucugccugcccaggccc

SEQ ID NO: 3054296 - RNA, 16 nt, Human
ucugccugcccaggcc

SEQ ID NO: 3054297 - RNA, 21 nt, Human
ucugcuccucuccccagcaag

SEQ ID NO: 3054298 - RNA, 11 nt, Human
ucugcugcugg

SEQ ID NO: 3054299 - RNA, 13 nt, Human
ucugcugcuggcu

SEQ ID NO: 3054300 - RNA, 22 nt, Human
ucuggagcccacuguacuugcu

SEQ ID NO: 3054301 - RNA, 16 nt, Human
ucuggagcccacugua

SEQ ID NO: 3054302 - RNA, 12 nt, Human
ucuggagcccac

SEQ ID NO: 3054303 - RNA, 16 nt, Human
ucuggugacuuuccuc

SEQ ID NO: 3054304 - RNA, 13 nt, Human
ucugucuaggaau

SEQ ID NO: 3054305 - RNA, 16 nt, Human
ucugucgcccagucug

SEQ ID NO: 3054306 - RNA, 14 nt, Human
ucugucucagucca

SEQ ID NO: 3054307 - RNA, 17 nt, Human
ucugucgcccagucugg

SEQ ID NO: 3054308 - RNA, 12 nt, Human
ucuguccuggga

SEQ ID NO: 3054309 - RNA, 14 nt, Human
ucuguacagagccc

SEQ ID NO: 3054310 - RNA, 15 nt, Human
ucuguacagagccca

SEQ ID NO: 3054311 - RNA, 20 nt, Human
ucuguccuacucugugucag

SEQ ID NO: 3054312 - RNA, 18 nt, Human
ucugagaggacuuuucuu

SEQ ID NO: 3054313 - RNA, 19 nt, Human
ucugacccaugcugcccug

SEQ ID NO: 3054314 - RNA, 20 nt, Human
ucugacccaugcugcccugu

SEQ ID NO: 3054315 - RNA, 22 nt, Human
ucugacccaugcugcccuguga

SEQ ID NO: 3054316 - RNA, 23 nt, Human
ucugacccaugcugcccugugag

SEQ ID NO: 3054317 - RNA, 21 nt, Human
ucugcaagaauugaagcagga

SEQ ID NO: 3054318 - RNA, 21 nt, Human
ucugaggaauccagacccggc

SEQ ID NO: 3054319 - RNA, 18 nt, Human
ucugaggaauccagaccc

SEQ ID NO: 3054320 - RNA, 22 nt, Human
ucugaggaauccagacccggcu

SEQ ID NO: 3054321 - RNA, 13 nt, Human
ucugccucccauc

SEQ ID NO: 3054322 - RNA, 15 nt, Human
ucugccucccaucac

SEQ ID NO: 3054323 - RNA, 12 nt, Human
ucugccucccau

SEQ ID NO: 3054324 - RNA, 13 nt, Human
ucugcccacuccc

SEQ ID NO: 3054325 - RNA, 14 nt, Human
ucugcccacucccu

SEQ ID NO: 3054326 - RNA, 23 nt, Human
ucugccauauucuguuggccagu

SEQ ID NO: 3054327 - RNA, 22 nt, Human
ucugccauauucuguuggccag

SEQ ID NO: 3054328 - RNA, 12 nt, Human
ucugcccacucc

SEQ ID NO: 3054329 - RNA, 18 nt, Human
ucugccauauucuguugg

SEQ ID NO: 3054330 - RNA, 20 nt, Human
ucugccugaagucacacagu

SEQ ID NO: 3054331 - RNA, 19 nt, Human
ucugccugaagucacacag

SEQ ID NO: 3054332 - RNA, 22 nt, Human
ucugccucugacacacagcucu

SEQ ID NO: 3054333 - RNA, 21 nt, Human
ucugccucugacacacagcuc

SEQ ID NO: 3054334 - RNA, 23 nt, Human
ucugccucugacacacagcucug

SEQ ID NO: 3054335 - RNA, 16 nt, Human
ucugccucccaucacc

SEQ ID NO: 3054336 - RNA, 17 nt, Human
ucugccucccaucaccc

SEQ ID NO: 3054337 - RNA, 20 nt, Human
ucugccucccaucacccgcu

SEQ ID NO: 3054338 - RNA, 21 nt, Human
ucugccucccaucacccgcua

SEQ ID NO: 3054339 - RNA, 18 nt, Human
ucugccucugacacacag

SEQ ID NO: 3054340 - RNA, 15 nt, Human
ucugccucugacaca

SEQ ID NO: 3054341 - RNA, 22 nt, Human
ucuuauccaacaucaacaucuu

SEQ ID NO: 3054342 - RNA, 21 nt, Human
ucuucagagacuccugcaggc

SEQ ID NO: 3054343 - RNA, 14 nt, Human
ucuucagaucucua

SEQ ID NO: 3054344 - RNA, 14 nt, Human
ucuuagauguauau

SEQ ID NO: 3054345 - RNA, 15 nt, Human
ucuuagauguauaua

SEQ ID NO: 3054346 - RNA, 20 nt, Human
ucugugucagguggggcagc

SEQ ID NO: 3054347 - RNA, 17 nt, Human
ucugugucagguggggc

SEQ ID NO: 3054348 - RNA, 13 nt, Human
ucuuauaauuuaa

SEQ ID NO: 3054349 - RNA, 14 nt, Human
ucuuauaauuuaaa

SEQ ID NO: 3054350 - RNA, 20 nt, Human
ucuuagguuggcaaaaaggc

SEQ ID NO: 3054351 - RNA, 23 nt, Human
ucuuagguuggcaaaaaggcagg

SEQ ID NO: 3054352 - RNA, 22 nt, Human
ucuuaggguuaugauuaaguaa

SEQ ID NO: 3054353 - RNA, 21 nt, Human
ucuugaaauauaggaacuuaa

SEQ ID NO: 3054354 - RNA, 20 nt, Human
ucuugaaauauaggaacuua

SEQ ID NO: 3054355 - RNA, 15 nt, Human
ucuugcaugaggcua

SEQ ID NO: 3054356 - RNA, 13 nt, Human
ucuugaagacuuu

SEQ ID NO: 3054357 - RNA, 22 nt, Human
ucuugaagacuuuucuuucagc

SEQ ID NO: 3054358 - RNA, 16 nt, Human
ucuucuuggucucagu

SEQ ID NO: 3054359 - RNA, 18 nt, Human
ucuuguagcuuuaucaaa

SEQ ID NO: 3054360 - RNA, 23 nt, Human
ucuugcucugcugacagacacag

SEQ ID NO: 3054361 - RNA, 15 nt, Human
ucuugcucugcugac

SEQ ID NO: 3054362 - RNA, 19 nt, Human
ucuugccaaauauaaauaa

SEQ ID NO: 3054363 - RNA, 20 nt, Human
ucuugcaugguuuggagcug

SEQ ID NO: 3054364 - RNA, 15 nt, Human
ucuugcaugguuugg

SEQ ID NO: 3054365 - RNA, 19 nt, Human
ucuugcaugguuuggagcu

SEQ ID NO: 3054366 - RNA, 14 nt, Human
ucuugcucugcuga

SEQ ID NO: 3054367 - RNA, 15 nt, Human
ugaaacacuuugcau

SEQ ID NO: 3054368 - RNA, 23 nt, Human
ugaaacacucaguuguucaauaa

SEQ ID NO: 3054369 - RNA, 22 nt, Human
ugaaaauuauuuuguucauaca

SEQ ID NO: 3054370 - RNA, 23 nt, Human
ugaaaauuauuuuguucauacau

SEQ ID NO: 3054371 - RNA, 14 nt, Human
ugaaaauucagugg

SEQ ID NO: 3054372 - RNA, 18 nt, Human
ugaaaaccacauuggaga

SEQ ID NO: 3054373 - RNA, 19 nt, Human
ugaaaagaaaaaugagccu

SEQ ID NO: 3054374 - RNA, 15 nt, Human
ugaaaagaaaaauga

SEQ ID NO: 3054375 - RNA, 19 nt, Human
ugaaaauuauuuuguucau

SEQ ID NO: 3054376 - RNA, 20 nt, Human
ugaaaagaaaaaugagccug

SEQ ID NO: 3054377 - RNA, 22 nt, Human
ugaaaagaaaaaugagccuggc

SEQ ID NO: 3054378 - RNA, 22 nt, Human
ugaaaacacuguucucugcccu

SEQ ID NO: 3054379 - RNA, 23 nt, Human
ugaaaacacuguucucugcccuc

SEQ ID NO: 3054380 - RNA, 20 nt, Human
ugaaaacacauuuuucuuag

SEQ ID NO: 3054381 - RNA, 17 nt, Human
ugaaaacacuguucucu

SEQ ID NO: 3054382 - RNA, 20 nt, Human
ugaaaacacuguucucugcc

SEQ ID NO: 3054383 - RNA, 21 nt, Human
ugaaaacacuguucucugccc

SEQ ID NO: 3054384 - RNA, 21 nt, Human
ugaaaacacauuuuucuuagg

SEQ ID NO: 3054385 - RNA, 12 nt, Human
ucuuucccuccc

SEQ ID NO: 3054386 - RNA, 17 nt, Human
ucuuuccaaaguacacu

SEQ ID NO: 3054387 - RNA, 17 nt, Human
ucuuuccacagaagcuc

SEQ ID NO: 3054388 - RNA, 23 nt, Human
ucuuucccucccuuccucuuucc

SEQ ID NO: 3054389 - RNA, 13 nt, Human
ucuuucccucccu

SEQ ID NO: 3054390 - RNA, 23 nt, Human
ucuuuccaaaguacacuguuuca

SEQ ID NO: 3054391 - RNA, 13 nt, Human
ucuuguguguuua

SEQ ID NO: 3054392 - RNA, 14 nt, Human
ucuuuggacccuga

SEQ ID NO: 3054393 - RNA, 15 nt, Human
ucuuuggacccugag

SEQ ID NO: 3054394 - RNA, 13 nt, Human
ucuuuggacccug

SEQ ID NO: 3054395 - RNA, 22 nt, Human
ucuuuggacagaagcagcucuu

SEQ ID NO: 3054396 - RNA, 17 nt, Human
ucuuugcagacaggcaa

SEQ ID NO: 3054397 - RNA, 14 nt, Human
ucuuugcagacagg

SEQ ID NO: 3054398 - RNA, 23 nt, Human
ucuuugagugaagcugggagaac

SEQ ID NO: 3054399 - RNA, 13 nt, Human
ucuuugcagacag

SEQ ID NO: 3054400 - RNA, 13 nt, Human
ugaaucucauaau

SEQ ID NO: 3054401 - RNA, 20 nt, Human
ugaaucucauaauuuauaca

SEQ ID NO: 3054402 - RNA, 23 nt, Human
ugaaugaugauccuaggcauuug

SEQ ID NO: 3054403 - RNA, 15 nt, Human
ugaaugaauggcuaa

SEQ ID NO: 3054404 - RNA, 20 nt, Human
ugaaguuuacauuguaaaua

SEQ ID NO: 3054405 - RNA, 16 nt, Human
ugaaguuuacauugua

SEQ ID NO: 3054406 - RNA, 14 nt, Human
ugaaguuuacauug

SEQ ID NO: 3054407 - RNA, 20 nt, Human
ugaaggcuggguucugaucc

SEQ ID NO: 3054408 - RNA, 21 nt, Human
ugaaggcuggguucugauccu

SEQ ID NO: 3054409 - RNA, 16 nt, Human
ugaaacacuuugcaua

SEQ ID NO: 3054410 - RNA, 13 nt, Human
ugaaacauguuuc

SEQ ID NO: 3054411 - RNA, 23 nt, Human
ugaacuggguacuuguggacaca

SEQ ID NO: 3054412 - RNA, 20 nt, Human
ugaagacucauucuucugua

SEQ ID NO: 3054413 - RNA, 19 nt, Human
ugaagacucauucuucugu

SEQ ID NO: 3054414 - RNA, 19 nt, Human
ugaagagguuuuaaagcuu

SEQ ID NO: 3054415 - RNA, 20 nt, Human
ugaagagguuuuaaagcuuc

SEQ ID NO: 3054416 - RNA, 21 nt, Human
ugaagagguuuuaaagcuucc

SEQ ID NO: 3054417 - RNA, 21 nt, Human
ugaagcuuuuaugugaaacau

SEQ ID NO: 3054418 - RNA, 16 nt, Human
ugaagcuuuuauguga

SEQ ID NO: 3054419 - RNA, 15 nt, Human
ugaaggaaaaugaua

SEQ ID NO: 3054420 - RNA, 18 nt, Human
ugaaggccccgcccaggc

SEQ ID NO: 3054421 - RNA, 16 nt, Human
ugaaggcuggguucug

SEQ ID NO: 3054422 - RNA, 19 nt, Human
ugaaggccccgcccaggcu

SEQ ID NO: 3054423 - RNA, 20 nt, Human
ugaaggccccgcccaggcuu

SEQ ID NO: 3054424 - RNA, 20 nt, Human
ugacaaagguaaaucagacu

SEQ ID NO: 3054425 - RNA, 16 nt, Human
ugaauuuaaauagcuu

SEQ ID NO: 3054426 - RNA, 13 nt, Human
ugacaacacucau

SEQ ID NO: 3054427 - RNA, 23 nt, Human
ugacaacacucauugaccugagg

SEQ ID NO: 3054428 - RNA, 13 nt, Human
ugaauuguaagga

SEQ ID NO: 3054429 - RNA, 21 nt, Human
ugaauuguaaggaaugauuaa

SEQ ID NO: 3054430 - RNA, 14 nt, Human
ugaauuaaguuuuu

SEQ ID NO: 3054431 - RNA, 13 nt, Human
ugaauuacauuug

SEQ ID NO: 3054432 - RNA, 18 nt, Human
ugacagaauauguuucaa

SEQ ID NO: 3054433 - RNA, 15 nt, Human
ugacacacagcucug

SEQ ID NO: 3054434 - RNA, 14 nt, Human
ugacacacagcucu

SEQ ID NO: 3054435 - RNA, 21 nt, Human
ugacagaauauguuucaaacu

SEQ ID NO: 3054436 - RNA, 22 nt, Human
ugacagaauauguuucaaacuu

SEQ ID NO: 3054437 - RNA, 13 nt, Human
ugacagacacagg

SEQ ID NO: 3054438 - RNA, 16 nt, Human
ugacagacacaggccc

SEQ ID NO: 3054439 - RNA, 14 nt, Human
ugacagacacaggc

SEQ ID NO: 3054440 - RNA, 22 nt, Human
ugacaacuucccagugaauucu

SEQ ID NO: 3054441 - RNA, 23 nt, Human
ugacaaggauugcuacuguccua

SEQ ID NO: 3054442 - RNA, 23 nt, Human
ugacagaauauguuucaaacuuu

SEQ ID NO: 3054443 - RNA, 18 nt, Human
ugacagacacaggcccgg

SEQ ID NO: 3054444 - RNA, 17 nt, Human
ugacagacacaggcccg

SEQ ID NO: 3054445 - RNA, 22 nt, Human
ugacagagcaagugagacccug

SEQ ID NO: 3054446 - RNA, 23 nt, Human
ugacaucaacugcaucaagaugu

SEQ ID NO: 3054447 - RNA, 20 nt, Human
ugaccagcaccaucucuccu

SEQ ID NO: 3054448 - RNA, 16 nt, Human
ugaccacugcagaaga

SEQ ID NO: 3054449 - RNA, 17 nt, Human
ugaccacugcagaagac

SEQ ID NO: 3054450 - RNA, 17 nt, Human
ugaggaucagaguaauc

SEQ ID NO: 3054451 - RNA, 13 nt, Human
ugaggaucagagu

SEQ ID NO: 3054452 - RNA, 19 nt, Human
ugaggaucagaguaaucca

SEQ ID NO: 3054453 - RNA, 22 nt, Human
ugaggaugaaaaaauaacacug

SEQ ID NO: 3054454 - RNA, 22 nt, Human
ugagccgagaucacgccacugc

SEQ ID NO: 3054455 - RNA, 23 nt, Human
ugagcagggcucagcggggacag

SEQ ID NO: 3054456 - RNA, 22 nt, Human
ugagcagggcucagcggggaca

SEQ ID NO: 3054457 - RNA, 20 nt, Human
ugagcagggcucagcgggga

SEQ ID NO: 3054458 - RNA, 23 nt, Human
ugagccgagaucacgccacugca

SEQ ID NO: 3054459 - RNA, 14 nt, Human
ugagccgcccaagg

SEQ ID NO: 3054460 - RNA, 15 nt, Human
ugagccgcccaaggc

SEQ ID NO: 3054461 - RNA, 17 nt, Human
ugagccgcccaaggccu

SEQ ID NO: 3054462 - RNA, 18 nt, Human
ugagccgcccaaggccuu

SEQ ID NO: 3054463 - RNA, 19 nt, Human
ugagccgcccaaggccuuc

SEQ ID NO: 3054464 - RNA, 11 nt, Human
ugagcucagga

SEQ ID NO: 3054465 - RNA, 19 nt, Human
ugagcucaggaguuugaga

SEQ ID NO: 3054466 - RNA, 15 nt, Human
ugaggcugggcuccc

SEQ ID NO: 3054467 - RNA, 16 nt, Human
ugaggcugggcucccu

SEQ ID NO: 3054468 - RNA, 18 nt, Human
ugaggcucugcccuuggu

SEQ ID NO: 3054469 - RNA, 16 nt, Human
ugaggcucugcccuug

SEQ ID NO: 3054470 - RNA, 15 nt, Human
ugaggcucugcccuu

SEQ ID NO: 3054471 - RNA, 19 nt, Human
ugaggucagagccugcagu

SEQ ID NO: 3054472 - RNA, 18 nt, Human
ugaggucagagccugcag

SEQ ID NO: 3054473 - RNA, 21 nt, Human
ugaggcugggcucccuuccca

SEQ ID NO: 3054474 - RNA, 21 nt, Human
ugaggugggaggaucucuuga

SEQ ID NO: 3054475 - RNA, 21 nt, Human
ugacucuuucuauuguuucuu

SEQ ID NO: 3054476 - RNA, 16 nt, Human
ugacuuuccucuuugg

SEQ ID NO: 3054477 - RNA, 13 nt, Human
ugaccauucucca

SEQ ID NO: 3054478 - RNA, 14 nt, Human
ugaccauucuccac

SEQ ID NO: 3054479 - RNA, 16 nt, Human
ugacucuuaagaagac

SEQ ID NO: 3054480 - RNA, 14 nt, Human
ugacucuuaagaag

SEQ ID NO: 3054481 - RNA, 15 nt, Human
ugacucuuaagaaga

SEQ ID NO: 3054482 - RNA, 13 nt, Human
ugacucuuaagaa

SEQ ID NO: 3054483 - RNA, 15 nt, Human
ugagaaauaaaguuu

SEQ ID NO: 3054484 - RNA, 20 nt, Human
ugagaaagacuauucaaaca

SEQ ID NO: 3054485 - RNA, 22 nt, Human
ugacuuuucuguccgagcuuug

SEQ ID NO: 3054486 - RNA, 14 nt, Human
ugagaggggaacag

SEQ ID NO: 3054487 - RNA, 18 nt, Human
ugagaggggaacagacug

SEQ ID NO: 3054488 - RNA, 14 nt, Human
ugagaccaaccugg

SEQ ID NO: 3054489 - RNA, 15 nt, Human
ugagcaggauuuuaa

SEQ ID NO: 3054490 - RNA, 20 nt, Human
ugagcaggauuuuaaucuuu

SEQ ID NO: 3054491 - RNA, 16 nt, Human
uagccccucuccugga

SEQ ID NO: 3054492 - RNA, 17 nt, Human
uagcauggcauauuuuu

SEQ ID NO: 3054493 - RNA, 18 nt, Human
uagcauggcauauuuuuc

SEQ ID NO: 3054494 - RNA, 15 nt, Human
uagcauggcauauuu

SEQ ID NO: 3054495 - RNA, 16 nt, Human
uagcaugaagacagag

SEQ ID NO: 3054496 - RNA, 12 nt, Human
uagcucauucuc

SEQ ID NO: 3054497 - RNA, 21 nt, Human
uagcucaggugucccugcacu

SEQ ID NO: 3054498 - RNA, 20 nt, Human
uagcucaggugucccugcac

SEQ ID NO: 3054499 - RNA, 18 nt, Human
uagccugugccucuggga

SEQ ID NO: 3054500 - RNA, 17 nt, Human
uagcugggacuacaggc

SEQ ID NO: 3054501 - RNA, 15 nt, Human
uagcugggacuacag

SEQ ID NO: 3054502 - RNA, 12 nt, Human
uagcugggacua

SEQ ID NO: 3054503 - RNA, 16 nt, Human
uagauacuguaucaug

SEQ ID NO: 3054504 - RNA, 14 nt, Human
uagauaggccaugg

SEQ ID NO: 3054505 - RNA, 19 nt, Human
uagcauacguacacauuuu

SEQ ID NO: 3054506 - RNA, 18 nt, Human
uagcauacguacacauuu

SEQ ID NO: 3054507 - RNA, 17 nt, Human
uagcauacguacacauu

SEQ ID NO: 3054508 - RNA, 16 nt, Human
uagcauacguacacau

SEQ ID NO: 3054509 - RNA, 11 nt, Human
uagcagggaaa

SEQ ID NO: 3054510 - RNA, 18 nt, Human
uagcauccuggaauaucu

SEQ ID NO: 3054511 - RNA, 13 nt, Human
uagcauccuggaa

SEQ ID NO: 3054512 - RNA, 15 nt, Human
uagcauccuggaaua

SEQ ID NO: 3054513 - RNA, 16 nt, Human
uagcauccuggaauau

SEQ ID NO: 3054514 - RNA, 17 nt, Human
uagaguugauacuacag

SEQ ID NO: 3054515 - RNA, 14 nt, Human
uagaguugauacua

SEQ ID NO: 3054516 - RNA, 12 nt, Human
uagagugggagc

SEQ ID NO: 3054517 - RNA, 15 nt, Human
uagagguucaaagau

SEQ ID NO: 3054518 - RNA, 14 nt, Human
uagagguucaaaga

SEQ ID NO: 3054519 - RNA, 20 nt, Human
uagaagucuuagauguauau

SEQ ID NO: 3054520 - RNA, 23 nt, Human
uagaauaccacaggaaccacaag

SEQ ID NO: 3054521 - RNA, 23 nt, Human
uagaauuaguggcacuugcuuuu

SEQ ID NO: 3054522 - RNA, 18 nt, Human
uagaauuaacacaugauc

SEQ ID NO: 3054523 - RNA, 15 nt, Human
uagaauuaacacaug

SEQ ID NO: 3054524 - RNA, 16 nt, Human
uagaauuaacacauga

SEQ ID NO: 3054525 - RNA, 22 nt, Human
uagguuaauuccaauuauauga

SEQ ID NO: 3054526 - RNA, 13 nt, Human
uagguguggggga

SEQ ID NO: 3054527 - RNA, 17 nt, Human
uaggugugggggaagca

SEQ ID NO: 3054528 - RNA, 23 nt, Human
uaggugugacugaauuucuuuug

SEQ ID NO: 3054529 - RNA, 21 nt, Human
uaggugugacugaauuucuuu

SEQ ID NO: 3054530 - RNA, 19 nt, Human
uaggugugacugaauuucu

SEQ ID NO: 3054531 - RNA, 18 nt, Human
uaguaugaggcauuuguu

SEQ ID NO: 3054532 - RNA, 17 nt, Human
uaguaugaggcauuugu

SEQ ID NO: 3054533 - RNA, 15 nt, Human
uaggucucaauaccu

SEQ ID NO: 3054534 - RNA, 16 nt, Human
uaggugacagagugag

SEQ ID NO: 3054535 - RNA, 11 nt, Human
uaggugacaga

SEQ ID NO: 3054536 - RNA, 18 nt, Human
uaggugcuacaaaaacac

SEQ ID NO: 3054537 - RNA, 23 nt, Human
uaggugcuacaaaaacacagcaa

SEQ ID NO: 3054538 - RNA, 22 nt, Human
uaggugcuacaaaaacacagca

SEQ ID NO: 3054539 - RNA, 20 nt, Human
uaggugcuacaaaaacacag

SEQ ID NO: 3054540 - RNA, 22 nt, Human
uagcuggucuuauuuguaaagc

SEQ ID NO: 3054541 - RNA, 16 nt, Human
uaguuugauuaaauuc

SEQ ID NO: 3054542 - RNA, 15 nt, Human
uaguuugauuaaauu

SEQ ID NO: 3054543 - RNA, 14 nt, Human
uauaaacuuuaccu

SEQ ID NO: 3054544 - RNA, 13 nt, Human
uauaaacuuuacc

SEQ ID NO: 3054545 - RNA, 11 nt, Human
uauaaacuuua

SEQ ID NO: 3054546 - RNA, 18 nt, Human
uauaaaccgaacugaugu

SEQ ID NO: 3054547 - RNA, 16 nt, Human
uauaaacuuuaccuuu

SEQ ID NO: 3054548 - RNA, 15 nt, Human
uauaaacuuuaccuu

SEQ ID NO: 3054549 - RNA, 17 nt, Human
uauaaacuuuaccuuuu

SEQ ID NO: 3054550 - RNA, 15 nt, Human
uaguaugaggcauuu

SEQ ID NO: 3054551 - RNA, 16 nt, Human
uaguaugguggcuggg

SEQ ID NO: 3054552 - RNA, 17 nt, Human
uaguauuguccaggucu

SEQ ID NO: 3054553 - RNA, 20 nt, Human
uaguggcuuaaaacaacacu

SEQ ID NO: 3054554 - RNA, 20 nt, Human
uaguuguuugauucagacag

SEQ ID NO: 3054555 - RNA, 21 nt, Human
uaguuguuugauucagacagc

SEQ ID NO: 3054556 - RNA, 22 nt, Human
uaguuguuugauucagacagcu

SEQ ID NO: 3054557 - RNA, 14 nt, Human
uauaucuuguagcu

SEQ ID NO: 3054558 - RNA, 13 nt, Human
uauauaacaaugc

SEQ ID NO: 3054559 - RNA, 17 nt, Human
uauauaacaaugcugua

SEQ ID NO: 3054560 - RNA, 19 nt, Human
uauauaacaaugcuguauu

SEQ ID NO: 3054561 - RNA, 20 nt, Human
uauauuugaaauauugacuu

SEQ ID NO: 3054562 - RNA, 14 nt, Human
uauaugcuucuguu

SEQ ID NO: 3054563 - RNA, 16 nt, Human
uauaugcuucuguuuu

SEQ ID NO: 3054564 - RNA, 21 nt, Human
uauauuuuuuguuaaaugauu

SEQ ID NO: 3054565 - RNA, 19 nt, Human
uauauuuuuuguuaaauga

SEQ ID NO: 3054566 - RNA, 16 nt, Human
uauauuuuuuucugaa

SEQ ID NO: 3054567 - RNA, 19 nt, Human
uauauuuuuuucugaaauu

SEQ ID NO: 3054568 - RNA, 20 nt, Human
uauauuuuuuucugaaauuu

SEQ ID NO: 3054569 - RNA, 19 nt, Human
uaucaggugcugccaucca

SEQ ID NO: 3054570 - RNA, 14 nt, Human
uaucaaaagaaaga

SEQ ID NO: 3054571 - RNA, 20 nt, Human
uaucaggugcugccauccag

SEQ ID NO: 3054572 - RNA, 17 nt, Human
uaucaggugcugccauc

SEQ ID NO: 3054573 - RNA, 17 nt, Human
uaucaugacaaagacug

SEQ ID NO: 3054574 - RNA, 20 nt, Human
uacaggaugaugacuaugga

SEQ ID NO: 3054575 - RNA, 18 nt, Human
uacaguuccuagguauaa

SEQ ID NO: 3054576 - RNA, 23 nt, Human
uacaguucggugagcuacaaaug

SEQ ID NO: 3054577 - RNA, 14 nt, Human
uacaggaaguacug

SEQ ID NO: 3054578 - RNA, 15 nt, Human
uacaggaaguacugg

SEQ ID NO: 3054579 - RNA, 22 nt, Human
uacaggaaguacuggagaaaau

SEQ ID NO: 3054580 - RNA, 15 nt, Human
uacaggagugagcac

SEQ ID NO: 3054581 - RNA, 17 nt, Human
uacaguugaaaaacagc

SEQ ID NO: 3054582 - RNA, 19 nt, Human
uacaguugaaaaacagcug

SEQ ID NO: 3054583 - RNA, 20 nt, Human
uacaguugaaaaacagcuga

SEQ ID NO: 3054584 - RNA, 18 nt, Human
uacaguuuguuaguauga

SEQ ID NO: 3054585 - RNA, 18 nt, Human
uacaggaagguagaaaua

SEQ ID NO: 3054586 - RNA, 13 nt, Human
uacaggaaguacu

SEQ ID NO: 3054587 - RNA, 20 nt, Human
uacagcuugaccgugaggcc

SEQ ID NO: 3054588 - RNA, 16 nt, Human
uacacuuacacuuuau

SEQ ID NO: 3054589 - RNA, 22 nt, Human
uacacuguuucaaacuuuacua

SEQ ID NO: 3054590 - RNA, 22 nt, Human
uacacugugcugagucugaagg

SEQ ID NO: 3054591 - RNA, 23 nt, Human
uacacugugcugagucugaaggc

SEQ ID NO: 3054592 - RNA, 20 nt, Human
uacacuguuucaaacuuuac

SEQ ID NO: 3054593 - RNA, 21 nt, Human
uacaguuuguuaguaugaggc

SEQ ID NO: 3054594 - RNA, 19 nt, Human
uacaguuuguuaguaugag

SEQ ID NO: 3054595 - RNA, 16 nt, Human
uacauaaacaaguccu

SEQ ID NO: 3054596 - RNA, 23 nt, Human
uacaugaaaacacauuuuucuua

SEQ ID NO: 3054597 - RNA, 19 nt, Human
uacaugaaaacacauuuuu

SEQ ID NO: 3054598 - RNA, 18 nt, Human
uacaugaaaacacauuuu

SEQ ID NO: 3054599 - RNA, 17 nt, Human
uacaugaaaacacauuu

SEQ ID NO: 3054600 - RNA, 17 nt, Human
uacauaagauaaaugug

SEQ ID NO: 3054601 - RNA, 16 nt, Human
uacauaagauaaaugu

SEQ ID NO: 3054602 - RNA, 16 nt, Human
uacaugaaaacacauu

SEQ ID NO: 3054603 - RNA, 22 nt, Human
uacauggaauaacauguaauua

SEQ ID NO: 3054604 - RNA, 19 nt, Human
uacauggaauaacauguaa

SEQ ID NO: 3054605 - RNA, 18 nt, Human
uacauggaauaacaugua

SEQ ID NO: 3054606 - RNA, 14 nt, Human
uacauggaauaaca

SEQ ID NO: 3054607 - RNA, 22 nt, Human
uacauuuuuaagugcugcauuu

SEQ ID NO: 3054608 - RNA, 19 nt, Human
uacauuuuuaagugcugca

SEQ ID NO: 3054609 - RNA, 14 nt, Human
uacauuuuuaagug

SEQ ID NO: 3054610 - RNA, 21 nt, Human
uacauggcuggagcuagaauu

SEQ ID NO: 3054611 - RNA, 16 nt, Human
uacacacucaaaucaa

SEQ ID NO: 3054612 - RNA, 15 nt, Human
uacacacugcauguu

SEQ ID NO: 3054613 - RNA, 17 nt, Human
uacacacucaaaucaag

SEQ ID NO: 3054614 - RNA, 21 nt, Human
uacacugugcugagucugaag

SEQ ID NO: 3054615 - RNA, 14 nt, Human
uacacuccagugag

SEQ ID NO: 3054616 - RNA, 23 nt, Human
uacacaaugguuuucuugugugu

SEQ ID NO: 3054617 - RNA, 11 nt, Human
uacacacacac

SEQ ID NO: 3054618 - RNA, 18 nt, Human
uacaaaguagaagucuua

SEQ ID NO: 3054619 - RNA, 14 nt, Human
uacaaaguagaagu

SEQ ID NO: 3054620 - RNA, 13 nt, Human
uaauuuugugaag

SEQ ID NO: 3054621 - RNA, 18 nt, Human
uaauuuugugaagcaaaa

SEQ ID NO: 3054622 - RNA, 12 nt, Human
uaauuuuuauau

SEQ ID NO: 3054623 - RNA, 16 nt, Human
uaauuuuuauauuuga

SEQ ID NO: 3054624 - RNA, 15 nt, Human
uacuccccuccuuga

SEQ ID NO: 3054625 - RNA, 22 nt, Human
uacucgaguuacagacaaagcg

SEQ ID NO: 3054626 - RNA, 18 nt, Human
uacucgaguuacagacaa

SEQ ID NO: 3054627 - RNA, 22 nt, Human
uacuacaguccucccaucucac

SEQ ID NO: 3054628 - RNA, 20 nt, Human
uacuacaguccucccaucuc

SEQ ID NO: 3054629 - RNA, 14 nt, Human
uacuacaguuuguu

SEQ ID NO: 3054630 - RNA, 13 nt, Human
uacuacaguuugu

SEQ ID NO: 3054631 - RNA, 14 nt, Human
uacugccuauuuua

SEQ ID NO: 3054632 - RNA, 21 nt, Human
uacugccuauuuuaauaaaca

SEQ ID NO: 3054633 - RNA, 22 nt, Human
uacugccauccuggcccagggc

SEQ ID NO: 3054634 - RNA, 18 nt, Human
uacugccauccuggccca

SEQ ID NO: 3054635 - RNA, 19 nt, Human
uacugccauccuggcccag

SEQ ID NO: 3054636 - RNA, 15 nt, Human
uacugccauccuggc

SEQ ID NO: 3054637 - RNA, 17 nt, Human
uacugcauaugaaagga

SEQ ID NO: 3054638 - RNA, 13 nt, Human
uacuuaacuauuc

SEQ ID NO: 3054639 - RNA, 19 nt, Human
uacuugcucuugaugccug

SEQ ID NO: 3054640 - RNA, 18 nt, Human
uacuugcucuugaugccu

SEQ ID NO: 3054641 - RNA, 14 nt, Human
uacuugcucuugau

SEQ ID NO: 3054642 - RNA, 13 nt, Human
uacuugcucuuga

SEQ ID NO: 3054643 - RNA, 13 nt, Human
uacuuguggacac

SEQ ID NO: 3054644 - RNA, 16 nt, Human
uacuguccuacccacc

SEQ ID NO: 3054645 - RNA, 23 nt, Human
uacugucagcuccccucggagaa

SEQ ID NO: 3054646 - RNA, 21 nt, Human
uacugucuucaguaagccgug

SEQ ID NO: 3054647 - RNA, 14 nt, Human
uacccagaaaguua

SEQ ID NO: 3054648 - RNA, 15 nt, Human
uacccacugcucugg

SEQ ID NO: 3054649 - RNA, 22 nt, Human
uaccaaaaaucucaauauuuca

SEQ ID NO: 3054650 - RNA, 23 nt, Human
uacauuuuuaagugcugcauuua

SEQ ID NO: 3054651 - RNA, 22 nt, Human
uaccuaacgaaguauccuucag

SEQ ID NO: 3054652 - RNA, 15 nt, Human
uaccuacauacaauu

SEQ ID NO: 3054653 - RNA, 16 nt, Human
uaccuaucaucuuaag

SEQ ID NO: 3054654 - RNA, 22 nt, Human
uaccuuuuuuagaguugauacu

SEQ ID NO: 3054655 - RNA, 19 nt, Human
uaccuuuuuuagaguugau

SEQ ID NO: 3054656 - RNA, 13 nt, Human
uaccuuuuuuaga

SEQ ID NO: 3054657 - RNA, 23 nt, Human
uaccuuuguucccaaauuucaua

SEQ ID NO: 3054658 - RNA, 18 nt, Human
uaccucggugccuuccuc

SEQ ID NO: 3054659 - RNA, 18 nt, Human
uacgaaaagaggggaaga

SEQ ID NO: 3054660 - RNA, 21 nt, Human
uacgaaaagaggggaagagac

SEQ ID NO: 3054661 - RNA, 16 nt, Human
uaccuuuuuuauacau

SEQ ID NO: 3054662 - RNA, 13 nt, Human
uaccuuuuuuaua

SEQ ID NO: 3054663 - RNA, 17 nt, Human
uaccuuuuuuauacaua

SEQ ID NO: 3054664 - RNA, 22 nt, Human
uaccuuuuuuauacauaaacaa

SEQ ID NO: 3054665 - RNA, 21 nt, Human
uacuaauagacaauuuauuau

SEQ ID NO: 3054666 - RNA, 20 nt, Human
uacuaauagacaauuuauua

SEQ ID NO: 3054667 - RNA, 14 nt, Human
uacuaaggaaucuu

SEQ ID NO: 3054668 - RNA, 13 nt, Human
uacuaacuuuccu

SEQ ID NO: 3054669 - RNA, 18 nt, Human
uaacugugaaguuuacau

SEQ ID NO: 3054670 - RNA, 17 nt, Human
uaacugugaaguuuaca

SEQ ID NO: 3054671 - RNA, 13 nt, Human
uaacugugaaguu

SEQ ID NO: 3054672 - RNA, 15 nt, Human
uaacuggaaacuuca

SEQ ID NO: 3054673 - RNA, 23 nt, Human
uaagaaaaaggaugcacagaguu

SEQ ID NO: 3054674 - RNA, 19 nt, Human
uaagaaaaaggaugcacag

SEQ ID NO: 3054675 - RNA, 18 nt, Human
uaagaaaaaggaugcaca

SEQ ID NO: 3054676 - RNA, 16 nt, Human
uaagaaaaaggaugca

SEQ ID NO: 3054677 - RNA, 19 nt, Human
uaagaaaucaaagagagaa

SEQ ID NO: 3054678 - RNA, 21 nt, Human
uaagaaaauaucacuugucaa

SEQ ID NO: 3054679 - RNA, 19 nt, Human
uaagaaccuuuugagugcc

SEQ ID NO: 3054680 - RNA, 13 nt, Human
uaagagagaauga

SEQ ID NO: 3054681 - RNA, 14 nt, Human
uaagagagaaugag

SEQ ID NO: 3054682 - RNA, 13 nt, Human
uaaccagaucauu

SEQ ID NO: 3054683 - RNA, 16 nt, Human
uaaccacuucagcuga

SEQ ID NO: 3054684 - RNA, 23 nt, Human
uaaccaguguuguggauuuaaca

SEQ ID NO: 3054685 - RNA, 17 nt, Human
uaaccaggggccaugaa

SEQ ID NO: 3054686 - RNA, 11 nt, Human
uaacagaaaug

SEQ ID NO: 3054687 - RNA, 22 nt, Human
uaaauuugaauguuaagcagau

SEQ ID NO: 3054688 - RNA, 14 nt, Human
uaaauuugaauguu

SEQ ID NO: 3054689 - RNA, 22 nt, Human
uaaauuuaguauuuuguuucag

SEQ ID NO: 3054690 - RNA, 13 nt, Human
uaaauucuuucau

SEQ ID NO: 3054691 - RNA, 20 nt, Human
uaaauugacacuuaaaaaug

SEQ ID NO: 3054692 - RNA, 18 nt, Human
uaacaccaugauuaacca

SEQ ID NO: 3054693 - RNA, 16 nt, Human
uaaauucuugcaaagu

SEQ ID NO: 3054694 - RNA, 18 nt, Human
uaaauucuugcaaaguau

SEQ ID NO: 3054695 - RNA, 17 nt, Human
uaaauucuugcaaagua

SEQ ID NO: 3054696 - RNA, 22 nt, Human
uaaauucuugcaaaguaucccu

SEQ ID NO: 3054697 - RNA, 11 nt, Human
uaaauuauuuu

SEQ ID NO: 3054698 - RNA, 16 nt, Human
uaaaugugccuucauu

SEQ ID NO: 3054699 - RNA, 17 nt, Human
uaaaguugguaaaccuu

SEQ ID NO: 3054700 - RNA, 16 nt, Human
uaaaguugguaaaccu

SEQ ID NO: 3054701 - RNA, 13 nt, Human
uaaaugcccagcc

SEQ ID NO: 3054702 - RNA, 14 nt, Human
uaaaugcccagccc

SEQ ID NO: 3054703 - RNA, 15 nt, Human
uaaaugcccagcccc

SEQ ID NO: 3054704 - RNA, 16 nt, Human
uaaaugcccagccccu

SEQ ID NO: 3054705 - RNA, 17 nt, Human
uaaaugcccagccccuu

SEQ ID NO: 3054706 - RNA, 16 nt, Human
uaaauggaaccacucu

SEQ ID NO: 3054707 - RNA, 17 nt, Human
uaaaugggggugcauuu

SEQ ID NO: 3054708 - RNA, 14 nt, Human
uaaaugggggugca

SEQ ID NO: 3054709 - RNA, 20 nt, Human
uaaauggcuuccuggcaaua

SEQ ID NO: 3054710 - RNA, 19 nt, Human
uaaaugggggugcauuuga

SEQ ID NO: 3054711 - RNA, 18 nt, Human
uaaaugggggugcauuug

SEQ ID NO: 3054712 - RNA, 20 nt, Human
uaaaugucuaguuguaacac

SEQ ID NO: 3054713 - RNA, 22 nt, Human
uaaaugucucuuuaaugucaca

SEQ ID NO: 3054714 - RNA, 21 nt, Human
uaauaacugugaaguuuacau

SEQ ID NO: 3054715 - RNA, 12 nt, Human
uaauaaagcugu

SEQ ID NO: 3054716 - RNA, 11 nt, Human
uaauaaagcug

SEQ ID NO: 3054717 - RNA, 22 nt, Human
uaagugcugcauuuaaaagaua

SEQ ID NO: 3054718 - RNA, 18 nt, Human
uaagugcugcauuuaaaa

SEQ ID NO: 3054719 - RNA, 16 nt, Human
uaagugcugcauuuaa

SEQ ID NO: 3054720 - RNA, 15 nt, Human
uaagugcugcauuua

SEQ ID NO: 3054721 - RNA, 20 nt, Human
uaagugguacuaacuuuccu

SEQ ID NO: 3054722 - RNA, 22 nt, Human
uaagugauugcugguuuuaguu

SEQ ID NO: 3054723 - RNA, 12 nt, Human
uaagugagagag

SEQ ID NO: 3054724 - RNA, 23 nt, Human
uaagugaggaugaaaaaauaaca

SEQ ID NO: 3054725 - RNA, 14 nt, Human
uaagugcugcauuu

SEQ ID NO: 3054726 - RNA, 13 nt, Human
uaagugaaauaag

SEQ ID NO: 3054727 - RNA, 17 nt, Human
uaaggguaucuggugac

SEQ ID NO: 3054728 - RNA, 15 nt, Human
uaaggugugcucuga

SEQ ID NO: 3054729 - RNA, 20 nt, Human
uaagguggguacgggagggu

SEQ ID NO: 3054730 - RNA, 15 nt, Human
uaagaggcagggucu

SEQ ID NO: 3054731 - RNA, 12 nt, Human
uaagaggcaggg

SEQ ID NO: 3054732 - RNA, 18 nt, Human
uaagcuacugccauccug

SEQ ID NO: 3054733 - RNA, 15 nt, Human
uaagcuacugccauc

SEQ ID NO: 3054734 - RNA, 16 nt, Human
uaagcuacugccaucc

SEQ ID NO: 3054735 - RNA, 14 nt, Human
uaagcuacugccau

SEQ ID NO: 3054736 - RNA, 16 nt, Human
uaaggauguucuagca

SEQ ID NO: 3054737 - RNA, 18 nt, Human
uaauaugcacacauuuuu

SEQ ID NO: 3054738 - RNA, 17 nt, Human
uaauaugcacacauuuu

SEQ ID NO: 3054739 - RNA, 16 nt, Human
uaauaugcacacauuu

SEQ ID NO: 3054740 - RNA, 15 nt, Human
uaauaugcacacauu

SEQ ID NO: 3054741 - RNA, 19 nt, Human
uaauaugcacacauuuuuu

SEQ ID NO: 3054742 - RNA, 13 nt, Human
uaaucuaaaugga

SEQ ID NO: 3054743 - RNA, 12 nt, Human
uaaucuaaaugg

SEQ ID NO: 3054744 - RNA, 20 nt, Human
uaauauuaaggaagacaaug

SEQ ID NO: 3054745 - RNA, 17 nt, Human
uaauuaaguacuaugua

SEQ ID NO: 3054746 - RNA, 14 nt, Human
uaauuaaguacuau

SEQ ID NO: 3054747 - RNA, 22 nt, Human
uaauguuucaaacauauauaac

SEQ ID NO: 3054748 - RNA, 15 nt, Human
uaaugcgugcauacc

SEQ ID NO: 3054749 - RNA, 17 nt, Human
uaaugauaacuggaaac

SEQ ID NO: 3054750 - RNA, 22 nt, Human
uaaugauaacuggaaacuucag

SEQ ID NO: 3054751 - RNA, 22 nt, Human
uaaugcgugcauaccacuuuug

SEQ ID NO: 3054752 - RNA, 19 nt, Human
uaaugcgugcauaccacuu

SEQ ID NO: 3054753 - RNA, 23 nt, Human
uaaugcgugcauaccacuuuugu

SEQ ID NO: 3054754 - RNA, 16 nt, Human
uaaugauaacuggaaa

SEQ ID NO: 3054755 - RNA, 15 nt, Human
uaauggggcggugag

SEQ ID NO: 3054756 - RNA, 14 nt, Human
uaaaagauacaguu

SEQ ID NO: 3054757 - RNA, 20 nt, Human
uaaaagauacaguuacucag

SEQ ID NO: 3054758 - RNA, 17 nt, Human
uaaaagauacaguuacu

SEQ ID NO: 3054759 - RNA, 21 nt, Human
uaaaagauacaguuacucaga

SEQ ID NO: 3054760 - RNA, 12 nt, Human
uaaaaggugacc

SEQ ID NO: 3054761 - RNA, 13 nt, Human
uaaaaucauuucu

SEQ ID NO: 3054762 - RNA, 10 nt, Human
uaaaaucauu

SEQ ID NO: 3054763 - RNA, 15 nt, Human
uaaaauccauacauu

SEQ ID NO: 3054764 - RNA, 17 nt, Human
uaaaauccauacauuug

SEQ ID NO: 3054765 - RNA, 22 nt, Human
uaaaaucauuucugcaucagcu

SEQ ID NO: 3054766 - RNA, 18 nt, Human
uaaaaucauuucugcauc

SEQ ID NO: 3054767 - RNA, 21 nt, Human
uaaaagguaugcaaucaaauc

SEQ ID NO: 3054768 - RNA, 12 nt, Human
uaaaaggagcca

SEQ ID NO: 3054769 - RNA, 21 nt, Human
uaaaaagacauucuuccaaaa

SEQ ID NO: 3054770 - RNA, 19 nt, Human
uaaaaaugguuuaaauggu

SEQ ID NO: 3054771 - RNA, 15 nt, Human
uaaaaaugguuuaaa

SEQ ID NO: 3054772 - RNA, 18 nt, Human
uaaaaaugguuuaaaugg

SEQ ID NO: 3054773 - RNA, 17 nt, Human
uaaaaacaaagaaauua

SEQ ID NO: 3054774 - RNA, 21 nt, Human
uaaaaacaaagaaauuaugug

SEQ ID NO: 3054775 - RNA, 18 nt, Human
uaaaaacaacuuuauacc

SEQ ID NO: 3054776 - RNA, 19 nt, Human
uaaaaacaacuuuauaccc

SEQ ID NO: 3054777 - RNA, 13 nt, Human
uaaaaacaacuuu

SEQ ID NO: 3054778 - RNA, 22 nt, Human
uaaaacaagcacuaaacaaaga

SEQ ID NO: 3054779 - RNA, 15 nt, Human
uaaaacaacacucac

SEQ ID NO: 3054780 - RNA, 22 nt, Human
uaaaacacaacaucuuuuucua

SEQ ID NO: 3054781 - RNA, 23 nt, Human
uaaaacacaacaucuuuuucuac

SEQ ID NO: 3054782 - RNA, 17 nt, Human
uaaaacacaacaucuuu

SEQ ID NO: 3054783 - RNA, 17 nt, Human
uaaacacucuugaaaaa

SEQ ID NO: 3054784 - RNA, 15 nt, Human
uaaacacucuugaaa

SEQ ID NO: 3054785 - RNA, 18 nt, Human
uaaacacucuugaaaaau

SEQ ID NO: 3054786 - RNA, 19 nt, Human
uaaacaagaccacguuucu

SEQ ID NO: 3054787 - RNA, 20 nt, Human
uaaacaagaccacguuucua

SEQ ID NO: 3054788 - RNA, 22 nt, Human
uaaacaagaccacguuucuaaa

SEQ ID NO: 3054789 - RNA, 21 nt, Human
uaaacaagaccacguuucuaa

SEQ ID NO: 3054790 - RNA, 22 nt, Human
uaaacuugguuuuuaaaaaacu

SEQ ID NO: 3054791 - RNA, 14 nt, Human
uaaaguguuugaaa

SEQ ID NO: 3054792 - RNA, 17 nt, Human
uaaaggcuaccuuugua

SEQ ID NO: 3054793 - RNA, 15 nt, Human
uaaaggcuaccuuug

SEQ ID NO: 3054794 - RNA, 20 nt, Human
uaaagccugaguuugcuuuc

SEQ ID NO: 3054795 - RNA, 18 nt, Human
uaaagcaggcagaacuca

SEQ ID NO: 3054796 - RNA, 19 nt, Human
uaaagcagcguuucuauga

SEQ ID NO: 3054797 - RNA, 17 nt, Human
uaaagcagcguuucuau

SEQ ID NO: 3054798 - RNA, 16 nt, Human
uaaagcagcguuucua

SEQ ID NO: 3054799 - RNA, 12 nt, Human
uaaagaaaacug

SEQ ID NO: 3054800 - RNA, 18 nt, Human
guuucuuuguaaugaaaa

SEQ ID NO: 3054801 - RNA, 19 nt, Human
guuucuuuguaaugaaaac

SEQ ID NO: 3054802 - RNA, 23 nt, Human
guuugauuaaauucuugcaaagu

SEQ ID NO: 3054803 - RNA, 17 nt, Human
guuugagaucagccugg

SEQ ID NO: 3054804 - RNA, 18 nt, Human
guuuguuucugaaaggga

SEQ ID NO: 3054805 - RNA, 16 nt, Human
guuugauucagacagc

SEQ ID NO: 3054806 - RNA, 20 nt, Human
guuugauucagacagcugcc

SEQ ID NO: 3054807 - RNA, 21 nt, Human
guuugauucagacagcugccu

SEQ ID NO: 3054808 - RNA, 18 nt, Human
guuuggggaugagaaagg

SEQ ID NO: 3054809 - RNA, 20 nt, Human
guuuguaaauuaacuuuuau

SEQ ID NO: 3054810 - RNA, 20 nt, Human
guuuucaaaauuguuacaaa

SEQ ID NO: 3054811 - RNA, 17 nt, Human
guuuucaaaauaaaaau

SEQ ID NO: 3054812 - RNA, 12 nt, Human
guuuucacucuu

SEQ ID NO: 3054813 - RNA, 11 nt, Human
guuuucacucu

SEQ ID NO: 3054814 - RNA, 16 nt, Human
guuuuaaaaugagaaa

SEQ ID NO: 3054815 - RNA, 15 nt, Human
guuuuaaaaugagaa

SEQ ID NO: 3054816 - RNA, 20 nt, Human
guuuguuucugaaagggacg

SEQ ID NO: 3054817 - RNA, 20 nt, Human
guuuuccagguuuaagcugu

SEQ ID NO: 3054818 - RNA, 19 nt, Human
guuuuccaugaguccccug

SEQ ID NO: 3054819 - RNA, 20 nt, Human
guuuuccaugaguccccugu

SEQ ID NO: 3054820 - RNA, 19 nt, Human
guuuaggaacuacugagga

SEQ ID NO: 3054821 - RNA, 20 nt, Human
guuuagcuggaaaaguaugu

SEQ ID NO: 3054822 - RNA, 21 nt, Human
guuuagcuggaaaaguauguu

SEQ ID NO: 3054823 - RNA, 20 nt, Human
guuuauauaagcuuguauuc

SEQ ID NO: 3054824 - RNA, 17 nt, Human
guuuagaaagcuugccc

SEQ ID NO: 3054825 - RNA, 14 nt, Human
guuuagauaauaca

SEQ ID NO: 3054826 - RNA, 15 nt, Human
guuguuacauuuuua

SEQ ID NO: 3054827 - RNA, 14 nt, Human
guuguuacauuuuu

SEQ ID NO: 3054828 - RNA, 14 nt, Human
guugugaauguugu

SEQ ID NO: 3054829 - RNA, 19 nt, Human
guugucugcaacucugaag

SEQ ID NO: 3054830 - RNA, 22 nt, Human
guuguggauuuaacagaaaugu

SEQ ID NO: 3054831 - RNA, 14 nt, Human
guugugguuaaucu

SEQ ID NO: 3054832 - RNA, 12 nt, Human
guugucagcuga

SEQ ID NO: 3054833 - RNA, 19 nt, Human
guuggcugggggccucagu

SEQ ID NO: 3054834 - RNA, 12 nt, Human
guuggcuggggg

SEQ ID NO: 3054835 - RNA, 14 nt, Human
guuggccccugccc

SEQ ID NO: 3054836 - RNA, 13 nt, Human
guuggccccugcc

SEQ ID NO: 3054837 - RNA, 20 nt, Human
guuggccccugcccggcugc

SEQ ID NO: 3054838 - RNA, 17 nt, Human
guggucccaccccacac

SEQ ID NO: 3054839 - RNA, 18 nt, Human
gugguccuaaucuucuga

SEQ ID NO: 3054840 - RNA, 14 nt, Human
guggucccacccca

SEQ ID NO: 3054841 - RNA, 15 nt, Human
guggucccaccccac

SEQ ID NO: 3054842 - RNA, 16 nt, Human
guggucccaccccaca

SEQ ID NO: 3054843 - RNA, 19 nt, Human
gugguaugaucacggcuca

SEQ ID NO: 3054844 - RNA, 17 nt, Human
gugguagagugugccug

SEQ ID NO: 3054845 - RNA, 21 nt, Human
guggugagaggcauccaguau

SEQ ID NO: 3054846 - RNA, 17 nt, Human
guggugaccucugccug

SEQ ID NO: 3054847 - RNA, 14 nt, Human
guggugaccucugc

SEQ ID NO: 3054848 - RNA, 19 nt, Human
guggugcgaucuggguuca

SEQ ID NO: 3054849 - RNA, 17 nt, Human
guguaagacaaaaagcu

SEQ ID NO: 3054850 - RNA, 21 nt, Human
guguaaguauucuuauuuaau

SEQ ID NO: 3054851 - RNA, 21 nt, Human
guguaaguagauaggccaugg

SEQ ID NO: 3054852 - RNA, 15 nt, Human
guguacuuaacuauu

SEQ ID NO: 3054853 - RNA, 22 nt, Human
guguacauggaauaacauguaa

SEQ ID NO: 3054854 - RNA, 17 nt, Human
guguacauggaauaaca

SEQ ID NO: 3054855 - RNA, 18 nt, Human
gugucccugcacuugcag

SEQ ID NO: 3054856 - RNA, 16 nt, Human
gugucccugcacuugc

SEQ ID NO: 3054857 - RNA, 13 nt, Human
gugucccugcacu

SEQ ID NO: 3054858 - RNA, 23 nt, Human
guggcugcuucaaggauccugag

SEQ ID NO: 3054859 - RNA, 19 nt, Human
guggcuggguuggagggug

SEQ ID NO: 3054860 - RNA, 15 nt, Human
guggcugcuucaagg

SEQ ID NO: 3054861 - RNA, 16 nt, Human
guggcugcuucaagga

SEQ ID NO: 3054862 - RNA, 19 nt, Human
guggcugcuucaaggaucc

SEQ ID NO: 3054863 - RNA, 22 nt, Human
guggcugcuucaaggauccuga

SEQ ID NO: 3054864 - RNA, 22 nt, Human
guggcuuaaaacaacacucaca

SEQ ID NO: 3054865 - RNA, 15 nt, Human
gugcuaauuuugaaa

SEQ ID NO: 3054866 - RNA, 13 nt, Human
gugcuaauuuuga

SEQ ID NO: 3054867 - RNA, 20 nt, Human
gugcuacaaaaacacagcaa

SEQ ID NO: 3054868 - RNA, 15 nt, Human
gugcuacaaaaacac

SEQ ID NO: 3054869 - RNA, 14 nt, Human
guggcucacgccug

SEQ ID NO: 3054870 - RNA, 12 nt, Human
guggcugcuuca

SEQ ID NO: 3054871 - RNA, 14 nt, Human
guggcugcuucaag

SEQ ID NO: 3054872 - RNA, 17 nt, Human
gugggcccaaugcacuu

SEQ ID NO: 3054873 - RNA, 15 nt, Human
gugggcauucaaaug

SEQ ID NO: 3054874 - RNA, 15 nt, Human
gugggcuaguugggc

SEQ ID NO: 3054875 - RNA, 15 nt, Human
guggggaccucaggc

SEQ ID NO: 3054876 - RNA, 18 nt, Human
guggggaccucaggccug

SEQ ID NO: 3054877 - RNA, 13 nt, Human
guggggcagcuug

SEQ ID NO: 3054878 - RNA, 17 nt, Human
guggggcagcuugaggg

SEQ ID NO: 3054879 - RNA, 23 nt, Human
guggguuucuaaagcugccagcc

SEQ ID NO: 3054880 - RNA, 18 nt, Human
guguuuuucauaaagcag

SEQ ID NO: 3054881 - RNA, 14 nt, Human
guguguuuuucaua

SEQ ID NO: 3054882 - RNA, 16 nt, Human
guguguuuuaaaauga

SEQ ID NO: 3054883 - RNA, 13 nt, Human
guguguuuuaaaa

SEQ ID NO: 3054884 - RNA, 19 nt, Human
guguguuuuaaaaugagaa

SEQ ID NO: 3054885 - RNA, 12 nt, Human
guguuacuaagu

SEQ ID NO: 3054886 - RNA, 14 nt, Human
guguuacuaaguuu

SEQ ID NO: 3054887 - RNA, 18 nt, Human
guguuaugacuccagaau

SEQ ID NO: 3054888 - RNA, 16 nt, Human
guuaaaagaugaaaau

SEQ ID NO: 3054889 - RNA, 14 nt, Human
guuaaaagaugaaa

SEQ ID NO: 3054890 - RNA, 22 nt, Human
guuaaaauaccagccaguaaau

SEQ ID NO: 3054891 - RNA, 20 nt, Human
guuaaaagaugaaaauauuu

SEQ ID NO: 3054892 - RNA, 13 nt, Human
guuacagacaaag

SEQ ID NO: 3054893 - RNA, 16 nt, Human
guuacacuaaaaggug

SEQ ID NO: 3054894 - RNA, 15 nt, Human
guuacacuaaaaggu

SEQ ID NO: 3054895 - RNA, 17 nt, Human
gugugcucaggagcccu

SEQ ID NO: 3054896 - RNA, 16 nt, Human
gugugcucaggagccc

SEQ ID NO: 3054897 - RNA, 16 nt, Human
gugugcguccugucgg

SEQ ID NO: 3054898 - RNA, 14 nt, Human
gugugcguccuguc

SEQ ID NO: 3054899 - RNA, 19 nt, Human
gugugcucaggagcccugg

SEQ ID NO: 3054900 - RNA, 18 nt, Human
gugugcucaggagcccug

SEQ ID NO: 3054901 - RNA, 12 nt, Human
gugugcucugau

SEQ ID NO: 3054902 - RNA, 22 nt, Human
gugugcucugaucauccacugu

SEQ ID NO: 3054903 - RNA, 15 nt, Human
gugugcucugaucau

SEQ ID NO: 3054904 - RNA, 12 nt, Human
guguguuuuaaa

SEQ ID NO: 3054905 - RNA, 13 nt, Human
guguggagaagcg

SEQ ID NO: 3054906 - RNA, 21 nt, Human
guguggagaagcggcuggcag

SEQ ID NO: 3054907 - RNA, 15 nt, Human
gugucgggcaugaca

SEQ ID NO: 3054908 - RNA, 14 nt, Human
guguccggucccug

SEQ ID NO: 3054909 - RNA, 23 nt, Human
gugucccugcacuugcagacucu

SEQ ID NO: 3054910 - RNA, 14 nt, Human
gugucucuuggucc

SEQ ID NO: 3054911 - RNA, 17 nt, Human
gugucucccuucauccu

SEQ ID NO: 3054912 - RNA, 22 nt, Human
gugucucuugguccugcugcag

SEQ ID NO: 3054913 - RNA, 18 nt, Human
gugucucuugguccugcu

SEQ ID NO: 3054914 - RNA, 19 nt, Human
gugucucuugguccugcug

SEQ ID NO: 3054915 - RNA, 20 nt, Human
gugucucuugguccugcugc

SEQ ID NO: 3054916 - RNA, 21 nt, Human
gugucucuugguccugcugca

SEQ ID NO: 3054917 - RNA, 20 nt, Human
gugugagucaccaagcccag

SEQ ID NO: 3054918 - RNA, 18 nt, Human
guucaauaauaaauauuu

SEQ ID NO: 3054919 - RNA, 20 nt, Human
guucaagcgauucuucugcu

SEQ ID NO: 3054920 - RNA, 23 nt, Human
guucaauucucauuugucacaca

SEQ ID NO: 3054921 - RNA, 16 nt, Human
guucaauucucauuug

SEQ ID NO: 3054922 - RNA, 19 nt, Human
guuauuaaaaaucucaaau

SEQ ID NO: 3054923 - RNA, 19 nt, Human
guucaagcgauucuucugc

SEQ ID NO: 3054924 - RNA, 21 nt, Human
guuaugacuccagaauuuccc

SEQ ID NO: 3054925 - RNA, 23 nt, Human
guuaccucugccucagaaaacaa

SEQ ID NO: 3054926 - RNA, 23 nt, Human
guuaccauuuugggguacccacu

SEQ ID NO: 3054927 - RNA, 16 nt, Human
guuacccaaauuaaga

SEQ ID NO: 3054928 - RNA, 21 nt, Human
guuacauuuuuaagugcugca

SEQ ID NO: 3054929 - RNA, 19 nt, Human
guuacauaagauaaaugug

SEQ ID NO: 3054930 - RNA, 18 nt, Human
guuacauaagauaaaugu

SEQ ID NO: 3054931 - RNA, 15 nt, Human
guuacagacaaagcg

SEQ ID NO: 3054932 - RNA, 17 nt, Human
guuacagacaaagcgug

SEQ ID NO: 3054933 - RNA, 22 nt, Human
guuacuaaguuuuuauggcuuu

SEQ ID NO: 3054934 - RNA, 15 nt, Human
guuacucagaauucu

SEQ ID NO: 3054935 - RNA, 16 nt, Human
guuaguuucuccaagc

SEQ ID NO: 3054936 - RNA, 19 nt, Human
guuaguuucuccaagcagg

SEQ ID NO: 3054937 - RNA, 22 nt, Human
guuaguuucuccaagcaggaca

SEQ ID NO: 3054938 - RNA, 17 nt, Human
guuccaccaucaagcca

SEQ ID NO: 3054939 - RNA, 20 nt, Human
guuccaccaucaagccacca

SEQ ID NO: 3054940 - RNA, 14 nt, Human
guuccuaauccucu

SEQ ID NO: 3054941 - RNA, 22 nt, Human
guuccucauuagcauuuugcua

SEQ ID NO: 3054942 - RNA, 19 nt, Human
guucacugcaaccuccgcc

SEQ ID NO: 3054943 - RNA, 17 nt, Human
guucaucauccuaagcu

SEQ ID NO: 3054944 - RNA, 16 nt, Human
guucaucaaugaauga

SEQ ID NO: 3054945 - RNA, 12 nt, Human
guucaucuugaa

SEQ ID NO: 3054946 - RNA, 13 nt, Human
guucaucuugaau

SEQ ID NO: 3054947 - RNA, 18 nt, Human
guucaucuugaauuguaa

SEQ ID NO: 3054948 - RNA, 12 nt, Human
guucaugaaaga

SEQ ID NO: 3054949 - RNA, 16 nt, Human
guugcaacuuuguaua

SEQ ID NO: 3054950 - RNA, 14 nt, Human
guugcaacuuugua

SEQ ID NO: 3054951 - RNA, 15 nt, Human
guugcaggaccucag

SEQ ID NO: 3054952 - RNA, 16 nt, Human
guugaagacagagcua

SEQ ID NO: 3054953 - RNA, 18 nt, Human
guugaagagguuuuaaag

SEQ ID NO: 3054954 - RNA, 21 nt, Human
guugauggugguauguuuuca

SEQ ID NO: 3054955 - RNA, 20 nt, Human
guugauggugguauguuuuc

SEQ ID NO: 3054956 - RNA, 23 nt, Human
guuggccaaagccaaagcuaggc

SEQ ID NO: 3054957 - RNA, 14 nt, Human
guuggcaaaaaggc

SEQ ID NO: 3054958 - RNA, 18 nt, Human
guuggcaaaaaggcagga

SEQ ID NO: 3054959 - RNA, 13 nt, Human
guuggccaggcug

SEQ ID NO: 3054960 - RNA, 14 nt, Human
guuggccaggcugg

SEQ ID NO: 3054961 - RNA, 15 nt, Human
guuggccaggcuggu

SEQ ID NO: 3054962 - RNA, 14 nt, Human
guuggccaguguga

SEQ ID NO: 3054963 - RNA, 19 nt, Human
guuggccaggcuggucuca

SEQ ID NO: 3054964 - RNA, 17 nt, Human
guuggccaggcuggucu

SEQ ID NO: 3054965 - RNA, 14 nt, Human
guugcccaggcagg

SEQ ID NO: 3054966 - RNA, 12 nt, Human
guugcccaggca

SEQ ID NO: 3054967 - RNA, 16 nt, Human
guugccagucaccccg

SEQ ID NO: 3054968 - RNA, 17 nt, Human
guugccagucaccccgg

SEQ ID NO: 3054969 - RNA, 18 nt, Human
guugccagucaccccggc

SEQ ID NO: 3054970 - RNA, 23 nt, Human
guugccagucaccccggccaccu

SEQ ID NO: 3054971 - RNA, 13 nt, Human
guugccagucacc

SEQ ID NO: 3054972 - RNA, 14 nt, Human
guugccagucaccc

SEQ ID NO: 3054973 - RNA, 19 nt, Human
guucugauccuaguuccac

SEQ ID NO: 3054974 - RNA, 12 nt, Human
guucugaagaag

SEQ ID NO: 3054975 - RNA, 13 nt, Human
guucugaagaaga

SEQ ID NO: 3054976 - RNA, 14 nt, Human
guucugaagaagau

SEQ ID NO: 3054977 - RNA, 15 nt, Human
guucugaagaagaug

SEQ ID NO: 3054978 - RNA, 17 nt, Human
guugaaaaacagcugag

SEQ ID NO: 3054979 - RNA, 23 nt, Human
guugaaaagacuccaaagaaaug

SEQ ID NO: 3054980 - RNA, 22 nt, Human
guugaaaagacuccaaagaaau

SEQ ID NO: 3054981 - RNA, 17 nt, Human
guugaaaagacuccaaa

SEQ ID NO: 3054982 - RNA, 20 nt, Human
guucuuuccaaaguacacug

SEQ ID NO: 3054983 - RNA, 18 nt, Human
guucuuuccaaaguacac

SEQ ID NO: 3054984 - RNA, 14 nt, Human
guucuuuccaaagu

SEQ ID NO: 3054985 - RNA, 13 nt, Human
guucuuuccaaag

SEQ ID NO: 3054986 - RNA, 18 nt, Human
guucuuucacccuuuucu

SEQ ID NO: 3054987 - RNA, 16 nt, Human
guucugggacacaguu

SEQ ID NO: 3054988 - RNA, 15 nt, Human
guucugggacacagu

SEQ ID NO: 3054989 - RNA, 14 nt, Human
guucugggacacag

SEQ ID NO: 3054990 - RNA, 12 nt, Human
guucugggacac

SEQ ID NO: 3054991 - RNA, 11 nt, Human
guucugggaca

SEQ ID NO: 3054992 - RNA, 23 nt, Human
guucuggcagaguugaagacaga

SEQ ID NO: 3054993 - RNA, 16 nt, Human
guucuggcucuuccag

SEQ ID NO: 3054994 - RNA, 20 nt, Human
guucuggcucuuccaggcug

SEQ ID NO: 3054995 - RNA, 12 nt, Human
guucuggcucuu

SEQ ID NO: 3054996 - RNA, 13 nt, Human
guaugaaauuaua

SEQ ID NO: 3054997 - RNA, 23 nt, Human
guaugaaauuauauaaguauucu

SEQ ID NO: 3054998 - RNA, 15 nt, Human
guaugaggcauuugu

SEQ ID NO: 3054999 - RNA, 13 nt, Human
guaugaggcauuu

SEQ ID NO: 3055000 - RNA, 12 nt, Human
guaucugagcag

SEQ ID NO: 3055001 - RNA, 12 nt, Human
guaucuggugac

SEQ ID NO: 3055002 - RNA, 19 nt, Human
guaucuggugacuuuccuc

SEQ ID NO: 3055003 - RNA, 21 nt, Human
guaugaucacggcucacugca

SEQ ID NO: 3055004 - RNA, 17 nt, Human
guauguuagugcaaauu

SEQ ID NO: 3055005 - RNA, 20 nt, Human
guaugaggcauuuguuugaa

SEQ ID NO: 3055006 - RNA, 17 nt, Human
guaugaggcauuuguuu

SEQ ID NO: 3055007 - RNA, 20 nt, Human
guaugaucacggcucacugc

SEQ ID NO: 3055008 - RNA, 22 nt, Human
guauaugucaagccauaauugu

SEQ ID NO: 3055009 - RNA, 14 nt, Human
guagcacugacaga

SEQ ID NO: 3055010 - RNA, 15 nt, Human
guagcacugacagau

SEQ ID NO: 3055011 - RNA, 16 nt, Human
guagcauccuggaaua

SEQ ID NO: 3055012 - RNA, 15 nt, Human
guagagugugccuga

SEQ ID NO: 3055013 - RNA, 18 nt, Human
gcuauaggugcuacaaaa

SEQ ID NO: 3055014 - RNA, 22 nt, Human
guagggcgggaggauguucugg

SEQ ID NO: 3055015 - RNA, 21 nt, Human
guagggcgggaggauguucug

SEQ ID NO: 3055016 - RNA, 23 nt, Human
guagggcgggaggauguucuggg

SEQ ID NO: 3055017 - RNA, 16 nt, Human
guagggcgggaggaug

SEQ ID NO: 3055018 - RNA, 21 nt, Human
guagcauuuguguugaagagg

SEQ ID NO: 3055019 - RNA, 14 nt, Human
guagucaggugccu

SEQ ID NO: 3055020 - RNA, 16 nt, Human
guaggguuauaauaau

SEQ ID NO: 3055021 - RNA, 17 nt, Human
guauaauucacauugua

SEQ ID NO: 3055022 - RNA, 14 nt, Human
guaguguuggagaa

SEQ ID NO: 3055023 - RNA, 15 nt, Human
guaguguuggagaag

SEQ ID NO: 3055024 - RNA, 17 nt, Human
gucccuaauaaagcugu

SEQ ID NO: 3055025 - RNA, 16 nt, Human
gucccuaauaaagcug

SEQ ID NO: 3055026 - RNA, 15 nt, Human
gucccuaauaaagcu

SEQ ID NO: 3055027 - RNA, 23 nt, Human
gucccaccuuggcugcagggagu

SEQ ID NO: 3055028 - RNA, 20 nt, Human
gucccaccuuggcugcaggg

SEQ ID NO: 3055029 - RNA, 16 nt, Human
gucccugcacuugcag

SEQ ID NO: 3055030 - RNA, 21 nt, Human
gucccugcacuugcagacucu

SEQ ID NO: 3055031 - RNA, 19 nt, Human
gucccugcacuugcagacu

SEQ ID NO: 3055032 - RNA, 20 nt, Human
gucccuaauaaagcugugug

SEQ ID NO: 3055033 - RNA, 18 nt, Human
gucccuaauaaagcugug

SEQ ID NO: 3055034 - RNA, 23 nt, Human
gucagcuccccucggagaagagc

SEQ ID NO: 3055035 - RNA, 22 nt, Human
gucagcuccccucggagaagag

SEQ ID NO: 3055036 - RNA, 21 nt, Human
gucagcuccccucggagaaga

SEQ ID NO: 3055037 - RNA, 21 nt, Human
gucauucagauaugauucaaa

SEQ ID NO: 3055038 - RNA, 21 nt, Human
gucccaccuuggcugcaggga

SEQ ID NO: 3055039 - RNA, 12 nt, Human
guccacccagga

SEQ ID NO: 3055040 - RNA, 23 nt, Human
guccacccaggagccccgaggcc

SEQ ID NO: 3055041 - RNA, 16 nt, Human
gucagagccugcaguu

SEQ ID NO: 3055042 - RNA, 15 nt, Human
gucagagccugcagu

SEQ ID NO: 3055043 - RNA, 14 nt, Human
gucagagccugcag

SEQ ID NO: 3055044 - RNA, 19 nt, Human
gucagcuccccucggagaa

SEQ ID NO: 3055045 - RNA, 12 nt, Human
gucacucuggca

SEQ ID NO: 3055046 - RNA, 13 nt, Human
gucacucuggcag

SEQ ID NO: 3055047 - RNA, 14 nt, Human
gucacucuggcagc

SEQ ID NO: 3055048 - RNA, 16 nt, Human
gucacucuggcagcuc

SEQ ID NO: 3055049 - RNA, 17 nt, Human
gucacucuggcagcuca

SEQ ID NO: 3055050 - RNA, 19 nt, Human
gucacucuggcagcucaga

SEQ ID NO: 3055051 - RNA, 17 nt, Human
gucaccccggccaccug

SEQ ID NO: 3055052 - RNA, 18 nt, Human
gucaccccggccaccugc

SEQ ID NO: 3055053 - RNA, 22 nt, Human
gucaccccggccaccugcggug

SEQ ID NO: 3055054 - RNA, 14 nt, Human
guauuuuacuaaua

SEQ ID NO: 3055055 - RNA, 18 nt, Human
guauuuuaaaagaaugau

SEQ ID NO: 3055056 - RNA, 13 nt, Human
guauuuuaaucac

SEQ ID NO: 3055057 - RNA, 20 nt, Human
guauuuuaaaagaaugauua

SEQ ID NO: 3055058 - RNA, 15 nt, Human
gucaccccggccacc

SEQ ID NO: 3055059 - RNA, 15 nt, Human
gucaaugcagccccc

SEQ ID NO: 3055060 - RNA, 15 nt, Human
gucaagugaaaaagg

SEQ ID NO: 3055061 - RNA, 22 nt, Human
gucaauaaaauccauacauuug

SEQ ID NO: 3055062 - RNA, 23 nt, Human
gucaauaaaauccauacauuugu

SEQ ID NO: 3055063 - RNA, 19 nt, Human
guauuuuguuuuugucuua

SEQ ID NO: 3055064 - RNA, 18 nt, Human
gugaauucuugaaggaaa

SEQ ID NO: 3055065 - RNA, 21 nt, Human
gugaaugaugauccuaggcau

SEQ ID NO: 3055066 - RNA, 22 nt, Human
gugaauucuugaaggaaaauga

SEQ ID NO: 3055067 - RNA, 20 nt, Human
gugacaaggauugcuacugu

SEQ ID NO: 3055068 - RNA, 16 nt, Human
gugacaagcucacaga

SEQ ID NO: 3055069 - RNA, 13 nt, Human
gugaacacaucag

SEQ ID NO: 3055070 - RNA, 21 nt, Human
gugaacaaauuuacagagaca

SEQ ID NO: 3055071 - RNA, 14 nt, Human
gugaccucugccug

SEQ ID NO: 3055072 - RNA, 13 nt, Human
gugaccucugccu

SEQ ID NO: 3055073 - RNA, 15 nt, Human
gugacagaggcagcc

SEQ ID NO: 3055074 - RNA, 12 nt, Human
gugaccucugcc

SEQ ID NO: 3055075 - RNA, 14 nt, Human
gugacagaggcagc

SEQ ID NO: 3055076 - RNA, 13 nt, Human
gugacagaggcag

SEQ ID NO: 3055077 - RNA, 12 nt, Human
gugacagaggca

SEQ ID NO: 3055078 - RNA, 20 nt, Human
gugagccacugcaccgggcc

SEQ ID NO: 3055079 - RNA, 15 nt, Human
gugagccacugcacc

SEQ ID NO: 3055080 - RNA, 14 nt, Human
gugagccacugcac

SEQ ID NO: 3055081 - RNA, 18 nt, Human
gugaggagcuugaaaccc

SEQ ID NO: 3055082 - RNA, 17 nt, Human
gugaggaugaaaaaaua

SEQ ID NO: 3055083 - RNA, 19 nt, Human
gugagccgagaucacgcca

SEQ ID NO: 3055084 - RNA, 19 nt, Human
gugauauaaguguguguuu

SEQ ID NO: 3055085 - RNA, 22 nt, Human
gugauccacccaccucagccuc

SEQ ID NO: 3055086 - RNA, 17 nt, Human
gugaguugauagcacag

SEQ ID NO: 3055087 - RNA, 15 nt, Human
gugauacaaugcugu

SEQ ID NO: 3055088 - RNA, 17 nt, Human
gugauacaaugcugugc

SEQ ID NO: 3055089 - RNA, 21 nt, Human
gugcgaucuggguucacugca

SEQ ID NO: 3055090 - RNA, 16 nt, Human
gugccaugugccaggu

SEQ ID NO: 3055091 - RNA, 14 nt, Human
gugccaugugccag

SEQ ID NO: 3055092 - RNA, 14 nt, Human
gugcgccuacagga

SEQ ID NO: 3055093 - RNA, 14 nt, Human
gugcggccuuuggc

SEQ ID NO: 3055094 - RNA, 13 nt, Human
gugcguccugucg

SEQ ID NO: 3055095 - RNA, 13 nt, Human
gugcgggguacac

SEQ ID NO: 3055096 - RNA, 22 nt, Human
gugcacuaauguguaagacaaa

SEQ ID NO: 3055097 - RNA, 18 nt, Human
gugauuuuuguaauuuuu

SEQ ID NO: 3055098 - RNA, 13 nt, Human
gugauuuuuguaa

SEQ ID NO: 3055099 - RNA, 24 nt, Human
gugauccacccaccucagccuccc

SEQ ID NO: 3055100 - RNA, 23 nt, Human
gugauccacccaccucagccucc

SEQ ID NO: 3055101 - RNA, 23 nt, Human
gugcaguggugcgaucuggguuc

SEQ ID NO: 3055102 - RNA, 20 nt, Human
gugcaguggugcgaucuggg

SEQ ID NO: 3055103 - RNA, 22 nt, Human
gugcauaccacuuuuguucuug

SEQ ID NO: 3055104 - RNA, 21 nt, Human
gugcauaccacuuuuguucuu

SEQ ID NO: 3055105 - RNA, 17 nt, Human
gucucuggaauuugaaa

SEQ ID NO: 3055106 - RNA, 21 nt, Human
gucucuggauuauauuaugaa

SEQ ID NO: 3055107 - RNA, 13 nt, Human
gucugacuguuuc

SEQ ID NO: 3055108 - RNA, 22 nt, Human
gucucacucugucgcccagucu

SEQ ID NO: 3055109 - RNA, 19 nt, Human
gucucacucugucgcccag

SEQ ID NO: 3055110 - RNA, 18 nt, Human
gucucacucugucgccca

SEQ ID NO: 3055111 - RNA, 16 nt, Human
gucucacucugucgcc

SEQ ID NO: 3055112 - RNA, 15 nt, Human
gucucacucugucgc

SEQ ID NO: 3055113 - RNA, 18 nt, Human
gucgucaaagcugaaaug

SEQ ID NO: 3055114 - RNA, 21 nt, Human
gucuaagauaguaacaaugaa

SEQ ID NO: 3055115 - RNA, 13 nt, Human
gucuaaauuugaa

SEQ ID NO: 3055116 - RNA, 19 nt, Human
gucucacuauguugcccag

SEQ ID NO: 3055117 - RNA, 11 nt, Human
gucucacucug

SEQ ID NO: 3055118 - RNA, 18 nt, Human
gucucacuauguugccca

SEQ ID NO: 3055119 - RNA, 15 nt, Human
gucccugccaaugga

SEQ ID NO: 3055120 - RNA, 11 nt, Human
gucccugccaa

SEQ ID NO: 3055121 - RNA, 14 nt, Human
gucccugccaaugg

SEQ ID NO: 3055122 - RNA, 21 nt, Human
guccuuaccagcagagcaccu

SEQ ID NO: 3055123 - RNA, 18 nt, Human
guccuuaccagcagagca

SEQ ID NO: 3055124 - RNA, 19 nt, Human
guccuuaccagcagagcac

SEQ ID NO: 3055125 - RNA, 16 nt, Human
gucgggcaugacacga

SEQ ID NO: 3055126 - RNA, 23 nt, Human
gucggguuuuauuguuuaaaauc

SEQ ID NO: 3055127 - RNA, 16 nt, Human
gucggagcccugucuc

SEQ ID NO: 3055128 - RNA, 15 nt, Human
gucggccccaccagu

SEQ ID NO: 3055129 - RNA, 17 nt, Human
gucggccccaccagugc

SEQ ID NO: 3055130 - RNA, 19 nt, Human
gucggccccaccagugccu

SEQ ID NO: 3055131 - RNA, 22 nt, Human
gucggccccaccagugccucuc

SEQ ID NO: 3055132 - RNA, 21 nt, Human
gucggaaaacaugcuacacac

SEQ ID NO: 3055133 - RNA, 12 nt, Human
gucggagcccug

SEQ ID NO: 3055134 - RNA, 16 nt, Human
gucuuuuuucacuaca

SEQ ID NO: 3055135 - RNA, 21 nt, Human
gucuugcaauggcagccuugg

SEQ ID NO: 3055136 - RNA, 20 nt, Human
gucuugcaauggcagccuug

SEQ ID NO: 3055137 - RNA, 23 nt, Human
gucuugcaauggcagccuuggca

SEQ ID NO: 3055138 - RNA, 19 nt, Human
gucuugcaauggcagccuu

SEQ ID NO: 3055139 - RNA, 18 nt, Human
gucuugcaauggcagccu

SEQ ID NO: 3055140 - RNA, 17 nt, Human
gucuugcaauggcagcc

SEQ ID NO: 3055141 - RNA, 16 nt, Human
gucuugcaauggcagc

SEQ ID NO: 3055142 - RNA, 20 nt, Human
gucuugaacuccuggccuca

SEQ ID NO: 3055143 - RNA, 18 nt, Human
gucuugaacuccuggccu

SEQ ID NO: 3055144 - RNA, 21 nt, Human
gucuugaacuccuggccucaa

SEQ ID NO: 3055145 - RNA, 17 nt, Human
gucuugaacuccuggcc

SEQ ID NO: 3055146 - RNA, 16 nt, Human
gucuugaacuccuggc

SEQ ID NO: 3055147 - RNA, 21 nt, Human
gucuuaaaaaguggaaaaaua

SEQ ID NO: 3055148 - RNA, 17 nt, Human
gucuguucuuuccaaag

SEQ ID NO: 3055149 - RNA, 14 nt, Human
gucuguucuuucca

SEQ ID NO: 3055150 - RNA, 18 nt, Human
gucugugccauuuuguau

SEQ ID NO: 3055151 - RNA, 22 nt, Human
gucugugagaugcuagaacucc

SEQ ID NO: 3055152 - RNA, 23 nt, Human
gucugugagaugcuagaacuccc

SEQ ID NO: 3055153 - RNA, 15 nt, Human
gucugugagaugcua

SEQ ID NO: 3055154 - RNA, 16 nt, Human
gucugugagaugcuag

SEQ ID NO: 3055155 - RNA, 17 nt, Human
gucugugagaugcuaga

SEQ ID NO: 3055156 - RNA, 21 nt, Human
gucugugagaugcuagaacuc

SEQ ID NO: 3055157 - RNA, 13 nt, Human
gccugguggcagc

SEQ ID NO: 3055158 - RNA, 21 nt, Human
gccugguggcagcugcggucc

SEQ ID NO: 3055159 - RNA, 19 nt, Human
gccugguggcagcugcggu

SEQ ID NO: 3055160 - RNA, 18 nt, Human
gccugguggcagcugcgg

SEQ ID NO: 3055161 - RNA, 15 nt, Human
gccugcaauuucaua

SEQ ID NO: 3055162 - RNA, 21 nt, Human
gccugggggcugggcagagga

SEQ ID NO: 3055163 - RNA, 22 nt, Human
gccugggggcugggcagaggaa

SEQ ID NO: 3055164 - RNA, 13 nt, Human
gccuguuuaagag

SEQ ID NO: 3055165 - RNA, 12 nt, Human
gccuguuuaaga

SEQ ID NO: 3055166 - RNA, 21 nt, Human
gccuguugggccaggagccuc

SEQ ID NO: 3055167 - RNA, 16 nt, Human
gccuuacacaaugguu

SEQ ID NO: 3055168 - RNA, 20 nt, Human
gccuuacacaaugguuuucu

SEQ ID NO: 3055169 - RNA, 18 nt, Human
gccuuacccucauguucu

SEQ ID NO: 3055170 - RNA, 21 nt, Human
gccuuacacaaugguuuucuu

SEQ ID NO: 3055171 - RNA, 18 nt, Human
gccuuagaagucacacag

SEQ ID NO: 3055172 - RNA, 17 nt, Human
gccuuagaagucacaca

SEQ ID NO: 3055173 - RNA, 19 nt, Human
gccuuagaagucacacagu

SEQ ID NO: 3055174 - RNA, 10 nt, Human
gccuuaugga

SEQ ID NO: 3055175 - RNA, 14 nt, Human
gccuuauggaacac

SEQ ID NO: 3055176 - RNA, 13 nt, Human
gccuuuggcuuca

SEQ ID NO: 3055177 - RNA, 23 nt, Human
gcgacaaugcaaaccaucauuga

SEQ ID NO: 3055178 - RNA, 16 nt, Human
gccuuauggaacacuc

SEQ ID NO: 3055179 - RNA, 18 nt, Human
gccuuauggaacacucug

SEQ ID NO: 3055180 - RNA, 19 nt, Human
gccuuauggaacacucuga

SEQ ID NO: 3055181 - RNA, 20 nt, Human
gccuuauggaacacucugag

SEQ ID NO: 3055182 - RNA, 12 nt, Human
gccuuccagggg

SEQ ID NO: 3055183 - RNA, 15 nt, Human
gccuuccaggggugg

SEQ ID NO: 3055184 - RNA, 16 nt, Human
gccuuccagggguggg

SEQ ID NO: 3055185 - RNA, 13 nt, Human
gcuaagagggagg

SEQ ID NO: 3055186 - RNA, 14 nt, Human
gcuacacaggggaa

SEQ ID NO: 3055187 - RNA, 20 nt, Human
gcuacacacugcauguuugu

SEQ ID NO: 3055188 - RNA, 13 nt, Human
gcuacacacugca

SEQ ID NO: 3055189 - RNA, 20 nt, Human
gcuaagagggagggagggcu

SEQ ID NO: 3055190 - RNA, 15 nt, Human
gcuaggaacacuccu

SEQ ID NO: 3055191 - RNA, 13 nt, Human
gcuauaggugcua

SEQ ID NO: 3055192 - RNA, 16 nt, Human
gcuaccuuuguauucu

SEQ ID NO: 3055193 - RNA, 18 nt, Human
gcuagaacucccuuucaa

SEQ ID NO: 3055194 - RNA, 19 nt, Human
gcuagaacucccuuucaac

SEQ ID NO: 3055195 - RNA, 13 nt, Human
gcggacagccacg

SEQ ID NO: 3055196 - RNA, 11 nt, Human
gcggacagcca

SEQ ID NO: 3055197 - RNA, 15 nt, Human
gcgccuacaggagug

SEQ ID NO: 3055198 - RNA, 12 nt, Human
gcgacagugaga

SEQ ID NO: 3055199 - RNA, 19 nt, Human
gcgucucauacucaccuca

SEQ ID NO: 3055200 - RNA, 15 nt, Human
gcggacagccacggc

SEQ ID NO: 3055201 - RNA, 17 nt, Human
gccucccgaguagcugg

SEQ ID NO: 3055202 - RNA, 19 nt, Human
gccucccgaguagcuggga

SEQ ID NO: 3055203 - RNA, 18 nt, Human
gccucccgaguagcuggg

SEQ ID NO: 3055204 - RNA, 16 nt, Human
gccucccaacucaccc

SEQ ID NO: 3055205 - RNA, 17 nt, Human
gccucccaacucacccc

SEQ ID NO: 3055206 - RNA, 18 nt, Human
gccucccaacucacccca

SEQ ID NO: 3055207 - RNA, 19 nt, Human
gccucccaacucaccccag

SEQ ID NO: 3055208 - RNA, 14 nt, Human
gccucccaucaccc

SEQ ID NO: 3055209 - RNA, 16 nt, Human
gccucccaucacccgc

SEQ ID NO: 3055210 - RNA, 13 nt, Human
gccucccaacuca

SEQ ID NO: 3055211 - RNA, 19 nt, Human
gccucccaaagugcuggga

SEQ ID NO: 3055212 - RNA, 18 nt, Human
gccucccaaagugcuggg

SEQ ID NO: 3055213 - RNA, 16 nt, Human
gccucagcauccuggc

SEQ ID NO: 3055214 - RNA, 15 nt, Human
gccucagcauccugg

SEQ ID NO: 3055215 - RNA, 18 nt, Human
gccucacaguccuuacca

SEQ ID NO: 3055216 - RNA, 13 nt, Human
gccucucucaggc

SEQ ID NO: 3055217 - RNA, 14 nt, Human
gccucucucaggcc

SEQ ID NO: 3055218 - RNA, 16 nt, Human
gccucucucaggccaa

SEQ ID NO: 3055219 - RNA, 16 nt, Human
gccucugacacacagc

SEQ ID NO: 3055220 - RNA, 18 nt, Human
gccucugacacacagcuc

SEQ ID NO: 3055221 - RNA, 17 nt, Human
gccucugacacacagcu

SEQ ID NO: 3055222 - RNA, 14 nt, Human
gccucugcacuccc

SEQ ID NO: 3055223 - RNA, 21 nt, Human
gccucugacacacagcucugu

SEQ ID NO: 3055224 - RNA, 20 nt, Human
gccucugacacacagcucug

SEQ ID NO: 3055225 - RNA, 19 nt, Human
gccucugacacacagcucu

SEQ ID NO: 3055226 - RNA, 13 nt, Human
gccucugccucug

SEQ ID NO: 3055227 - RNA, 12 nt, Human
gccucugccucu

SEQ ID NO: 3055228 - RNA, 13 nt, Human
gccugcaagggag

SEQ ID NO: 3055229 - RNA, 15 nt, Human
gccugcaagggagug

SEQ ID NO: 3055230 - RNA, 22 nt, Human
gccgugugugugcguccugucg

SEQ ID NO: 3055231 - RNA, 13 nt, Human
gccucacaguccu

SEQ ID NO: 3055232 - RNA, 17 nt, Human
gccucacaguccuuacc

SEQ ID NO: 3055233 - RNA, 17 nt, Human
gccucaaccuccugggc

SEQ ID NO: 3055234 - RNA, 19 nt, Human
gccucaaccuccugggcua

SEQ ID NO: 3055235 - RNA, 18 nt, Human
gccucaaccuccugggcu

SEQ ID NO: 3055236 - RNA, 15 nt, Human
gccgucuaccugagg

SEQ ID NO: 3055237 - RNA, 16 nt, Human
gccgucuaccugaggg

SEQ ID NO: 3055238 - RNA, 17 nt, Human
gccgucuaccugagggg

SEQ ID NO: 3055239 - RNA, 20 nt, Human
gccguguaaccauggaccca

SEQ ID NO: 3055240 - RNA, 23 nt, Human
gccguggugauuuagcaggaagc

SEQ ID NO: 3055241 - RNA, 21 nt, Human
gccgggcgcgguggcucacgc

SEQ ID NO: 3055242 - RNA, 20 nt, Human
gccgggcgugguggugagug

SEQ ID NO: 3055243 - RNA, 18 nt, Human
gccgggaccccgagccug

SEQ ID NO: 3055244 - RNA, 23 nt, Human
gccgggaccccgagccuggcucc

SEQ ID NO: 3055245 - RNA, 19 nt, Human
gccgggaccccgagccugg

SEQ ID NO: 3055246 - RNA, 11 nt, Human
gccgcagcccu

SEQ ID NO: 3055247 - RNA, 12 nt, Human
gccgcagcccug

SEQ ID NO: 3055248 - RNA, 22 nt, Human
gccgagaucacgccacugcacu

SEQ ID NO: 3055249 - RNA, 21 nt, Human
gccgagaucacgccacugcac

SEQ ID NO: 3055250 - RNA, 20 nt, Human
gccgagaucacgccacugca

SEQ ID NO: 3055251 - RNA, 14 nt, Human
gcccuucucuccag

SEQ ID NO: 3055252 - RNA, 16 nt, Human
gcccuucucuccagcc

SEQ ID NO: 3055253 - RNA, 17 nt, Human
gcccuucucuccagccc

SEQ ID NO: 3055254 - RNA, 18 nt, Human
gcccuucucuccagcccc

SEQ ID NO: 3055255 - RNA, 16 nt, Human
gcccuugucggcccca

SEQ ID NO: 3055256 - RNA, 21 nt, Human
gcccuugucggccccaccagu

SEQ ID NO: 3055257 - RNA, 14 nt, Human
gccauccuggccca

SEQ ID NO: 3055258 - RNA, 20 nt, Human
gccauccuggcccagggcau

SEQ ID NO: 3055259 - RNA, 18 nt, Human
gccauccuggcccagggc

SEQ ID NO: 3055260 - RNA, 19 nt, Human
gccauccuggcccagggca

SEQ ID NO: 3055261 - RNA, 14 nt, Human
gccaugcuccuggc

SEQ ID NO: 3055262 - RNA, 20 nt, Human
gccaugaggaacaaggcaag

SEQ ID NO: 3055263 - RNA, 17 nt, Human
gccaggcugggucgccc

SEQ ID NO: 3055264 - RNA, 23 nt, Human
gccaggcugggucgcccuggacu

SEQ ID NO: 3055265 - RNA, 13 nt, Human
gccaggcuggucu

SEQ ID NO: 3055266 - RNA, 12 nt, Human
gccaguaaaugg

SEQ ID NO: 3055267 - RNA, 23 nt, Human
gccaguaaaugggggugcauuug

SEQ ID NO: 3055268 - RNA, 21 nt, Human
gccagucaccccggccaccug

SEQ ID NO: 3055269 - RNA, 14 nt, Human
gcccacuucugcca

SEQ ID NO: 3055270 - RNA, 16 nt, Human
gcccaccuuggcucaa

SEQ ID NO: 3055271 - RNA, 15 nt, Human
gcccaccuuggcuca

SEQ ID NO: 3055272 - RNA, 13 nt, Human
gcccaccuuggcu

SEQ ID NO: 3055273 - RNA, 17 nt, Human
gcccaccuggccucugc

SEQ ID NO: 3055274 - RNA, 20 nt, Human
gcccaccuggccucugcacu

SEQ ID NO: 3055275 - RNA, 21 nt, Human
gcccaccuggccucugcacuc

SEQ ID NO: 3055276 - RNA, 24 nt, Human
gcccaccuggccucugcacucccc

SEQ ID NO: 3055277 - RNA, 15 nt, Human
gcccaccuggccucu

SEQ ID NO: 3055278 - RNA, 16 nt, Human
gcccaccuggccucug

SEQ ID NO: 3055279 - RNA, 16 nt, Human
gccaugggccuccugu

SEQ ID NO: 3055280 - RNA, 15 nt, Human
gccaugggccuccug

SEQ ID NO: 3055281 - RNA, 19 nt, Human
gccaugggcacugugggua

SEQ ID NO: 3055282 - RNA, 16 nt, Human
gcccaaggccuucccc

SEQ ID NO: 3055283 - RNA, 13 nt, Human
gcccaaggccuuc

SEQ ID NO: 3055284 - RNA, 24 nt, Human
gccaaggccaaaggaagcacaugc

SEQ ID NO: 3055285 - RNA, 19 nt, Human
gccaaggccaaaggaagca

SEQ ID NO: 3055286 - RNA, 20 nt, Human
gccaaggccaaaggaagcac

SEQ ID NO: 3055287 - RNA, 21 nt, Human
gccagagacacaagccuucgg

SEQ ID NO: 3055288 - RNA, 22 nt, Human
gccagagacacaagccuucggc

SEQ ID NO: 3055289 - RNA, 19 nt, Human
gccacugcaccgggccaca

SEQ ID NO: 3055290 - RNA, 21 nt, Human
gccacugcaccgggccacaga

SEQ ID NO: 3055291 - RNA, 20 nt, Human
gccacugcaccgggccacag

SEQ ID NO: 3055292 - RNA, 14 nt, Human
gccagaugcaccag

SEQ ID NO: 3055293 - RNA, 24 nt, Human
gccagauucuuuccugaggcuggg

SEQ ID NO: 3055294 - RNA, 13 nt, Human
gccagauuucacu

SEQ ID NO: 3055295 - RNA, 20 nt, Human
gccagauucuuuccugaggc

SEQ ID NO: 3055296 - RNA, 15 nt, Human
gccagaugcaccagc

SEQ ID NO: 3055297 - RNA, 22 nt, Human
gccagccgagauagccaaggcc

SEQ ID NO: 3055298 - RNA, 21 nt, Human
gccagccgagauagccaaggc

SEQ ID NO: 3055299 - RNA, 19 nt, Human
gccagauucuuuccugagg

SEQ ID NO: 3055300 - RNA, 20 nt, Human
gccagcugcuugggcuucau

SEQ ID NO: 3055301 - RNA, 12 nt, Human
gccaggaagcca

SEQ ID NO: 3055302 - RNA, 13 nt, Human
gccaggaagccag

SEQ ID NO: 3055303 - RNA, 14 nt, Human
gccaggaagccagc

SEQ ID NO: 3055304 - RNA, 17 nt, Human
gccagcugcuugggcuu

SEQ ID NO: 3055305 - RNA, 18 nt, Human
gccagcugcuugggcuuc

SEQ ID NO: 3055306 - RNA, 16 nt, Human
gccagcugcuugggcu

SEQ ID NO: 3055307 - RNA, 19 nt, Human
gccaggagccuccugcccu

SEQ ID NO: 3055308 - RNA, 20 nt, Human
gccaggagccuccugcccuu

SEQ ID NO: 3055309 - RNA, 14 nt, Human
gccaggagccuccu

SEQ ID NO: 3055310 - RNA, 16 nt, Human
gccaggagccuccugc

SEQ ID NO: 3055311 - RNA, 20 nt, Human
gccaggaagccagcaggcuc

SEQ ID NO: 3055312 - RNA, 11 nt, Human
gccaggaagcc

SEQ ID NO: 3055313 - RNA, 20 nt, Human
gccccuucugacccaugcug

SEQ ID NO: 3055314 - RNA, 16 nt, Human
gccccucagggucccu

SEQ ID NO: 3055315 - RNA, 18 nt, Human
gccccucccacagcgcug

SEQ ID NO: 3055316 - RNA, 14 nt, Human
gccccucagggucc

SEQ ID NO: 3055317 - RNA, 18 nt, Human
gccccgaggccuucucug

SEQ ID NO: 3055318 - RNA, 23 nt, Human
gccccucaacucuccuccagagu

SEQ ID NO: 3055319 - RNA, 15 nt, Human
gccccgaggccuucu

SEQ ID NO: 3055320 - RNA, 17 nt, Human
gcccccuguggaugcug

SEQ ID NO: 3055321 - RNA, 13 nt, Human
gcccccuguggau

SEQ ID NO: 3055322 - RNA, 19 nt, Human
gcccuccaagaccuucucc

SEQ ID NO: 3055323 - RNA, 21 nt, Human
gcccuccaagaccuucuccuu

SEQ ID NO: 3055324 - RNA, 22 nt, Human
gcccuccaagaccuucuccuuc

SEQ ID NO: 3055325 - RNA, 23 nt, Human
gcccuccaagaccuucuccuuca

SEQ ID NO: 3055326 - RNA, 20 nt, Human
gcccuccagagccccacagc

SEQ ID NO: 3055327 - RNA, 22 nt, Human
gcccuccagagccccacagccc

SEQ ID NO: 3055328 - RNA, 14 nt, Human
gcccuccagagccc

SEQ ID NO: 3055329 - RNA, 16 nt, Human
gcccuccagagcccca

SEQ ID NO: 3055330 - RNA, 18 nt, Human
gcccuccagagccccaca

SEQ ID NO: 3055331 - RNA, 12 nt, Human
gcccuccagagc

SEQ ID NO: 3055332 - RNA, 15 nt, Human
gcccugcagagggca

SEQ ID NO: 3055333 - RNA, 14 nt, Human
gcccugcagagggc

SEQ ID NO: 3055334 - RNA, 13 nt, Human
gcccugcagaggg

SEQ ID NO: 3055335 - RNA, 13 nt, Human
gcccucugcccac

SEQ ID NO: 3055336 - RNA, 16 nt, Human
gcccucugcccacucc

SEQ ID NO: 3055337 - RNA, 18 nt, Human
gcccucugcccacucccu

SEQ ID NO: 3055338 - RNA, 19 nt, Human
gcccucugcccacucccug

SEQ ID NO: 3055339 - RNA, 12 nt, Human
gccccagugccc

SEQ ID NO: 3055340 - RNA, 18 nt, Human
gccccaucccaaacccuu

SEQ ID NO: 3055341 - RNA, 14 nt, Human
gccccagugcccac

SEQ ID NO: 3055342 - RNA, 13 nt, Human
gccccagugccca

SEQ ID NO: 3055343 - RNA, 21 nt, Human
gccccagugcccacaggauca

SEQ ID NO: 3055344 - RNA, 13 nt, Human
gccccauccucug

SEQ ID NO: 3055345 - RNA, 14 nt, Human
gccccauccucugu

SEQ ID NO: 3055346 - RNA, 22 nt, Human
gccccauccucuguacagagcc

SEQ ID NO: 3055347 - RNA, 14 nt, Human
gccccauucugccu

SEQ ID NO: 3055348 - RNA, 12 nt, Human
gcccaggcuggc

SEQ ID NO: 3055349 - RNA, 14 nt, Human
gcccagggcaucug

SEQ ID NO: 3055350 - RNA, 15 nt, Human
gcccagggcaucugg

SEQ ID NO: 3055351 - RNA, 18 nt, Human
gcccagggcaucugggag

SEQ ID NO: 3055352 - RNA, 22 nt, Human
gcccaggccccugccacccugg

SEQ ID NO: 3055353 - RNA, 13 nt, Human
gcccaggccuccu

SEQ ID NO: 3055354 - RNA, 23 nt, Human
gcccaggccccugccacccuggg

SEQ ID NO: 3055355 - RNA, 21 nt, Human
gcccagagaggguggugaccu

SEQ ID NO: 3055356 - RNA, 15 nt, Human
gcccagagagggugg

SEQ ID NO: 3055357 - RNA, 22 nt, Human
gcccaguuggguggaugccugg

SEQ ID NO: 3055358 - RNA, 20 nt, Human
gcccaggguggccacaccuc

SEQ ID NO: 3055359 - RNA, 15 nt, Human
gcccaggguggccac

SEQ ID NO: 3055360 - RNA, 16 nt, Human
gcaucugaaaauugau

SEQ ID NO: 3055361 - RNA, 12 nt, Human
gcaucagcugcu

SEQ ID NO: 3055362 - RNA, 18 nt, Human
gcaugcgggcuuccuccu

SEQ ID NO: 3055363 - RNA, 22 nt, Human
gcauguucucugaggacacuaa

SEQ ID NO: 3055364 - RNA, 13 nt, Human
gcauuauauuuau

SEQ ID NO: 3055365 - RNA, 21 nt, Human
gcauguucucugaggacacua

SEQ ID NO: 3055366 - RNA, 15 nt, Human
gcauguucucugagg

SEQ ID NO: 3055367 - RNA, 14 nt, Human
gcauguucucugag

SEQ ID NO: 3055368 - RNA, 17 nt, Human
gcauuaucuagauacug

SEQ ID NO: 3055369 - RNA, 19 nt, Human
gcauucaaauguauuacag

SEQ ID NO: 3055370 - RNA, 16 nt, Human
gcauuuguuugaacug

SEQ ID NO: 3055371 - RNA, 16 nt, Human
gcauuuguguugaaga

SEQ ID NO: 3055372 - RNA, 14 nt, Human
gcauuugcugaaua

SEQ ID NO: 3055373 - RNA, 13 nt, Human
gcauuugcugaau

SEQ ID NO: 3055374 - RNA, 21 nt, Human
gcauuugaggucuguucuuuc

SEQ ID NO: 3055375 - RNA, 14 nt, Human
gccaaacucaccug

SEQ ID NO: 3055376 - RNA, 16 nt, Human
gccaaacucaccugcc

SEQ ID NO: 3055377 - RNA, 18 nt, Human
gcauuuguuugaacugau

SEQ ID NO: 3055378 - RNA, 22 nt, Human
gccaaagcuaggccuggccaga

SEQ ID NO: 3055379 - RNA, 16 nt, Human
gccaaagcuaggccug

SEQ ID NO: 3055380 - RNA, 16 nt, Human
gccaaagccuccucca

SEQ ID NO: 3055381 - RNA, 19 nt, Human
gccaaagccuccuccagcc

SEQ ID NO: 3055382 - RNA, 20 nt, Human
gccaaagccaaagcuaggcc

SEQ ID NO: 3055383 - RNA, 13 nt, Human
gccaaagccaaag

SEQ ID NO: 3055384 - RNA, 14 nt, Human
gcauauuuuucaca

SEQ ID NO: 3055385 - RNA, 15 nt, Human
gcauauuuuucacau

SEQ ID NO: 3055386 - RNA, 16 nt, Human
gcauauuuuucacaua

SEQ ID NO: 3055387 - RNA, 19 nt, Human
gcauauuuuucacauaucu

SEQ ID NO: 3055388 - RNA, 20 nt, Human
gcauauuuuucacauaucua

SEQ ID NO: 3055389 - RNA, 19 nt, Human
gcauauuuauaaaaauaaa

SEQ ID NO: 3055390 - RNA, 17 nt, Human
gcauagguuuaauaauu

SEQ ID NO: 3055391 - RNA, 13 nt, Human
gcauagaaguaaa

SEQ ID NO: 3055392 - RNA, 14 nt, Human
gcaguucugaagaa

SEQ ID NO: 3055393 - RNA, 17 nt, Human
gcaguucugaagaagau

SEQ ID NO: 3055394 - RNA, 17 nt, Human
gcaguuauuaacacuaa

SEQ ID NO: 3055395 - RNA, 15 nt, Human
gcaguucugaagaag

SEQ ID NO: 3055396 - RNA, 15 nt, Human
gcagugggagcugcc

SEQ ID NO: 3055397 - RNA, 14 nt, Human
gcagugggagcugc

SEQ ID NO: 3055398 - RNA, 12 nt, Human
gcagugggagcu

SEQ ID NO: 3055399 - RNA, 13 nt, Human
gcagugggagcug

SEQ ID NO: 3055400 - RNA, 23 nt, Human
gcaguggugguuuucuguucuuu

SEQ ID NO: 3055401 - RNA, 22 nt, Human
gcaguggugguuuucuguucuu

SEQ ID NO: 3055402 - RNA, 20 nt, Human
gcaggucuugaacuccuggc

SEQ ID NO: 3055403 - RNA, 19 nt, Human
gcaggucuugaacuccugg

SEQ ID NO: 3055404 - RNA, 22 nt, Human
gcagguccaggguuugaguuca

SEQ ID NO: 3055405 - RNA, 15 nt, Human
gcagugcaugcuguc

SEQ ID NO: 3055406 - RNA, 16 nt, Human
gcagugcaugcugucc

SEQ ID NO: 3055407 - RNA, 14 nt, Human
gcagggcucagcgg

SEQ ID NO: 3055408 - RNA, 22 nt, Human
gcaggggaggguagagcggaga

SEQ ID NO: 3055409 - RNA, 18 nt, Human
gcagggucucacucuguc

SEQ ID NO: 3055410 - RNA, 17 nt, Human
gcagggucucacucugu

SEQ ID NO: 3055411 - RNA, 15 nt, Human
gcaggcagccaggcc

SEQ ID NO: 3055412 - RNA, 16 nt, Human
gcaggcagccaggcca

SEQ ID NO: 3055413 - RNA, 21 nt, Human
gcagggcucagcggggacagc

SEQ ID NO: 3055414 - RNA, 19 nt, Human
gcagggcucagcggggaca

SEQ ID NO: 3055415 - RNA, 16 nt, Human
gcacugcuuccaguga

SEQ ID NO: 3055416 - RNA, 18 nt, Human
gcacugcuuccagugagg

SEQ ID NO: 3055417 - RNA, 20 nt, Human
gcacugcuuccagugaggcu

SEQ ID NO: 3055418 - RNA, 12 nt, Human
gcagacaggacc

SEQ ID NO: 3055419 - RNA, 13 nt, Human
gcagacaggacca

SEQ ID NO: 3055420 - RNA, 15 nt, Human
gcagacaggaccagg

SEQ ID NO: 3055421 - RNA, 19 nt, Human
gcagacaggcaagcaccuc

SEQ ID NO: 3055422 - RNA, 23 nt, Human
gcagacaggcaagcaccuccugc

SEQ ID NO: 3055423 - RNA, 12 nt, Human
gcacgauuucug

SEQ ID NO: 3055424 - RNA, 18 nt, Human
gcaccuuagacagucccu

SEQ ID NO: 3055425 - RNA, 21 nt, Human
gcaccuggaauauauaaccag

SEQ ID NO: 3055426 - RNA, 18 nt, Human
gcaccuggaauauauaac

SEQ ID NO: 3055427 - RNA, 15 nt, Human
gcacccucaggcagg

SEQ ID NO: 3055428 - RNA, 14 nt, Human
gcaccuuagacagu

SEQ ID NO: 3055429 - RNA, 17 nt, Human
gcaccuuagacaguccc

SEQ ID NO: 3055430 - RNA, 22 nt, Human
gcaccuggaauauauaaccagu

SEQ ID NO: 3055431 - RNA, 19 nt, Human
gcacccggccccugcuggu

SEQ ID NO: 3055432 - RNA, 18 nt, Human
gcacccggccccugcugg

SEQ ID NO: 3055433 - RNA, 22 nt, Human
gcacccaccaucaugucuggcu

SEQ ID NO: 3055434 - RNA, 16 nt, Human
gcaccagcagccugga

SEQ ID NO: 3055435 - RNA, 21 nt, Human
gcaccacugcacuccagccug

SEQ ID NO: 3055436 - RNA, 22 nt, Human
gcaccacugcacuccagccugg

SEQ ID NO: 3055437 - RNA, 15 nt, Human
gcaccagcagccugg

SEQ ID NO: 3055438 - RNA, 14 nt, Human
gcaccagcagccug

SEQ ID NO: 3055439 - RNA, 13 nt, Human
gcaauggcagccu

SEQ ID NO: 3055440 - RNA, 12 nt, Human
gcaauggcagcc

SEQ ID NO: 3055441 - RNA, 20 nt, Human
gcaccacugcacuccagccu

SEQ ID NO: 3055442 - RNA, 14 nt, Human
gcaauggcagccuu

SEQ ID NO: 3055443 - RNA, 14 nt, Human
gcagcccugcagag

SEQ ID NO: 3055444 - RNA, 15 nt, Human
gcagcccugcagagg

SEQ ID NO: 3055445 - RNA, 16 nt, Human
gcagcccugcagaggg

SEQ ID NO: 3055446 - RNA, 17 nt, Human
gcagcccugcagagggc

SEQ ID NO: 3055447 - RNA, 15 nt, Human
gcagcucaccucucc

SEQ ID NO: 3055448 - RNA, 15 nt, Human
gcagccuuggcaaac

SEQ ID NO: 3055449 - RNA, 14 nt, Human
gcagcucaccucuc

SEQ ID NO: 3055450 - RNA, 23 nt, Human
gcaggaggaucacuugaguccag

SEQ ID NO: 3055451 - RNA, 20 nt, Human
gcaggaggaucacuugaguc

SEQ ID NO: 3055452 - RNA, 13 nt, Human
gcaggcagccagg

SEQ ID NO: 3055453 - RNA, 14 nt, Human
gcaggcagccaggc

SEQ ID NO: 3055454 - RNA, 12 nt, Human
gcaggcagccag

SEQ ID NO: 3055455 - RNA, 20 nt, Human
gcagaguugaagacagagcu

SEQ ID NO: 3055456 - RNA, 18 nt, Human
gcagauaaacaguaguga

SEQ ID NO: 3055457 - RNA, 21 nt, Human
gcagaguugaagacagagcua

SEQ ID NO: 3055458 - RNA, 17 nt, Human
gcagacaguuaagagaa

SEQ ID NO: 3055459 - RNA, 20 nt, Human
gcagaccauuggggcuccca

SEQ ID NO: 3055460 - RNA, 21 nt, Human
gcagaccauuggggcucccag

SEQ ID NO: 3055461 - RNA, 22 nt, Human
gcagaccauuggggcucccagc

SEQ ID NO: 3055462 - RNA, 23 nt, Human
gcagaccauuggggcucccagcc

SEQ ID NO: 3055463 - RNA, 12 nt, Human
gcagcaauaaag

SEQ ID NO: 3055464 - RNA, 22 nt, Human
gcagauacaggaaaagcugcug

SEQ ID NO: 3055465 - RNA, 24 nt, Human
gcagccccauucugccugcccagg

SEQ ID NO: 3055466 - RNA, 21 nt, Human
gcagccccauucugccugccc

SEQ ID NO: 3055467 - RNA, 19 nt, Human
gcagccccauucugccugc

SEQ ID NO: 3055468 - RNA, 18 nt, Human
gcagccccauucugccug

SEQ ID NO: 3055469 - RNA, 23 nt, Human
gcagcaauaaagcagcguuucua

SEQ ID NO: 3055470 - RNA, 16 nt, Human
gcagcaauaaagcagc

SEQ ID NO: 3055471 - RNA, 17 nt, Human
gcagccccauucugccu

SEQ ID NO: 3055472 - RNA, 20 nt, Human
gcagccccuguucuggcaga

SEQ ID NO: 3055473 - RNA, 21 nt, Human
gcagccccuguucuggcagag

SEQ ID NO: 3055474 - RNA, 20 nt, Human
gcagccccgugggguuccuc

SEQ ID NO: 3055475 - RNA, 13 nt, Human
gcagcccugcaga

SEQ ID NO: 3055476 - RNA, 18 nt, Human
gauucccaagcucugcuc

SEQ ID NO: 3055477 - RNA, 19 nt, Human
gauucauauuuacuucuua

SEQ ID NO: 3055478 - RNA, 18 nt, Human
gauucauauuuacuucuu

SEQ ID NO: 3055479 - RNA, 17 nt, Human
gauucauauuuacuucu

SEQ ID NO: 3055480 - RNA, 23 nt, Human
gauggggcugcaccggcuggccu

SEQ ID NO: 3055481 - RNA, 19 nt, Human
gauggggcugcaccggcug

SEQ ID NO: 3055482 - RNA, 13 nt, Human
gauucagcucugc

SEQ ID NO: 3055483 - RNA, 15 nt, Human
gauucagcucugcaa

SEQ ID NO: 3055484 - RNA, 19 nt, Human
gauucagacagcugccugg

SEQ ID NO: 3055485 - RNA, 20 nt, Human
gauucccaagcucugcuccu

SEQ ID NO: 3055486 - RNA, 19 nt, Human
gauucccaagcucugcucc

SEQ ID NO: 3055487 - RNA, 12 nt, Human
gauucuuuccug

SEQ ID NO: 3055488 - RNA, 16 nt, Human
gauucuuuccugaggc

SEQ ID NO: 3055489 - RNA, 17 nt, Human
gauucuuuccugaggcu

SEQ ID NO: 3055490 - RNA, 18 nt, Human
gauucuuuccugaggcug

SEQ ID NO: 3055491 - RNA, 20 nt, Human
gauugcaacaggcugggcuu

SEQ ID NO: 3055492 - RNA, 16 nt, Human
gauugcaccacugcac

SEQ ID NO: 3055493 - RNA, 23 nt, Human
gauugcaccacugcacuccagcc

SEQ ID NO: 3055494 - RNA, 21 nt, Human
gauugcaacaggcugggcuuc

SEQ ID NO: 3055495 - RNA, 22 nt, Human
gauuuggucaacacuaacauga

SEQ ID NO: 3055496 - RNA, 19 nt, Human
gauuucuguuuagauaaua

SEQ ID NO: 3055497 - RNA, 11 nt, Human
gauuucuguuu

SEQ ID NO: 3055498 - RNA, 15 nt, Human
gauuuccguuaaaau

SEQ ID NO: 3055499 - RNA, 19 nt, Human
gauuuucagcccucagaau

SEQ ID NO: 3055500 - RNA, 15 nt, Human
gauuuucagcccuca

SEQ ID NO: 3055501 - RNA, 11 nt, Human
gauuuucagcc

SEQ ID NO: 3055502 - RNA, 15 nt, Human
gauuuuccugaaaac

SEQ ID NO: 3055503 - RNA, 17 nt, Human
gcaagaauugaagcagg

SEQ ID NO: 3055504 - RNA, 14 nt, Human
gcaagacgcugugc

SEQ ID NO: 3055505 - RNA, 20 nt, Human
gcaagacgcugugcugcccu

SEQ ID NO: 3055506 - RNA, 21 nt, Human
gcaagacgcugugcugcccug

SEQ ID NO: 3055507 - RNA, 22 nt, Human
gcaagacgcugugcugcccugc

SEQ ID NO: 3055508 - RNA, 23 nt, Human
gcaagacgcugugcugcccugcc

SEQ ID NO: 3055509 - RNA, 17 nt, Human
gcaaaauugauguguuu

SEQ ID NO: 3055510 - RNA, 13 nt, Human
gcaaacagggccu

SEQ ID NO: 3055511 - RNA, 16 nt, Human
gcaaacagggccucug

SEQ ID NO: 3055512 - RNA, 17 nt, Human
gcaaacagggccucugc

SEQ ID NO: 3055513 - RNA, 18 nt, Human
gcaaacagggccucugcg

SEQ ID NO: 3055514 - RNA, 23 nt, Human
gcaaagcacugacuucuaaguaa

SEQ ID NO: 3055515 - RNA, 16 nt, Human
gcaaaguaucccuacu

SEQ ID NO: 3055516 - RNA, 11 nt, Human
gcaaggcuguc

SEQ ID NO: 3055517 - RNA, 14 nt, Human
gcaagggugauggg

SEQ ID NO: 3055518 - RNA, 18 nt, Human
gcaaggagauuuacaacu

SEQ ID NO: 3055519 - RNA, 10 nt, Human
gcaagccaga

SEQ ID NO: 3055520 - RNA, 15 nt, Human
gcaaugaccuuucaa

SEQ ID NO: 3055521 - RNA, 17 nt, Human
gcaaugaccuuucaaua

SEQ ID NO: 3055522 - RNA, 20 nt, Human
gcaaugaccuuucaauagga

SEQ ID NO: 3055523 - RNA, 22 nt, Human
gcaaugaccuuucaauaggaaa

SEQ ID NO: 3055524 - RNA, 15 nt, Human
gcaaucaaaucugcu

SEQ ID NO: 3055525 - RNA, 17 nt, Human
gcaaucaaaucugcuuu

SEQ ID NO: 3055526 - RNA, 23 nt, Human
gcaaugcuggcuguuggcugggg

SEQ ID NO: 3055527 - RNA, 22 nt, Human
gcaaugcuggcuguuggcuggg

SEQ ID NO: 3055528 - RNA, 14 nt, Human
gcaaugcuggcugu

SEQ ID NO: 3055529 - RNA, 13 nt, Human
gcaaugcuggcug

SEQ ID NO: 3055530 - RNA, 23 nt, Human
gcaaugaccuuucaauaggaaaa

SEQ ID NO: 3055531 - RNA, 17 nt, Human
gaugacaacuucccagu

SEQ ID NO: 3055532 - RNA, 22 nt, Human
gaugcacagaguuguuacauuu

SEQ ID NO: 3055533 - RNA, 21 nt, Human
gaugcacagaguuguuacauu

SEQ ID NO: 3055534 - RNA, 13 nt, Human
gaugcaccagccc

SEQ ID NO: 3055535 - RNA, 14 nt, Human
gaugcagccucaca

SEQ ID NO: 3055536 - RNA, 12 nt, Human
gaugcagccuca

SEQ ID NO: 3055537 - RNA, 17 nt, Human
gaugccugguggcagcu

SEQ ID NO: 3055538 - RNA, 22 nt, Human
gauggauuuccagccaaagccu

SEQ ID NO: 3055539 - RNA, 19 nt, Human
gaugccugguggcagcugc

SEQ ID NO: 3055540 - RNA, 18 nt, Human
gaugccugguggcagcug

SEQ ID NO: 3055541 - RNA, 20 nt, Human
gaugccugguggcagcugcg

SEQ ID NO: 3055542 - RNA, 14 nt, Human
gauggggcccugcc

SEQ ID NO: 3055543 - RNA, 22 nt, Human
gauggggcccugccuccuuugu

SEQ ID NO: 3055544 - RNA, 13 nt, Human
gauggggcccugc

SEQ ID NO: 3055545 - RNA, 21 nt, Human
gauggcuaguaucaaaagaaa

SEQ ID NO: 3055546 - RNA, 14 nt, Human
gaugaaaauauuug

SEQ ID NO: 3055547 - RNA, 17 nt, Human
gaucuuugcagacaggc

SEQ ID NO: 3055548 - RNA, 18 nt, Human
gaucuuugcagacaggca

SEQ ID NO: 3055549 - RNA, 21 nt, Human
gaucuuuggacagaagcagcu

SEQ ID NO: 3055550 - RNA, 13 nt, Human
gaucuuuggacag

SEQ ID NO: 3055551 - RNA, 21 nt, Human
gauccugagccagauuucacu

SEQ ID NO: 3055552 - RNA, 22 nt, Human
gauccugagccagauuucacuc

SEQ ID NO: 3055553 - RNA, 15 nt, Human
gaucccucauccuca

SEQ ID NO: 3055554 - RNA, 16 nt, Human
gaucccucauccucau

SEQ ID NO: 3055555 - RNA, 23 nt, Human
gauagauaggucagugcaaauac

SEQ ID NO: 3055556 - RNA, 11 nt, Human
gauacagaaaa

SEQ ID NO: 3055557 - RNA, 22 nt, Human
gauaauacaccacuacauucug

SEQ ID NO: 3055558 - RNA, 21 nt, Human
gauaauacaccacuacauucu

SEQ ID NO: 3055559 - RNA, 18 nt, Human
gauaauacaccacuacau

SEQ ID NO: 3055560 - RNA, 14 nt, Human
gauaauacaccacu

SEQ ID NO: 3055561 - RNA, 18 nt, Human
gauacaggaaaagcugcu

SEQ ID NO: 3055562 - RNA, 17 nt, Human
gauaggucagugcaaau

SEQ ID NO: 3055563 - RNA, 20 nt, Human
gauagcacagacccugcccu

SEQ ID NO: 3055564 - RNA, 21 nt, Human
gauagcacagacccugcccug

SEQ ID NO: 3055565 - RNA, 22 nt, Human
gauagcacagacccugcccugu

SEQ ID NO: 3055566 - RNA, 14 nt, Human
gauaaguucauaca

SEQ ID NO: 3055567 - RNA, 16 nt, Human
gauaaguucauacauu

SEQ ID NO: 3055568 - RNA, 12 nt, Human
gauaaguucaua

SEQ ID NO: 3055569 - RNA, 22 nt, Human
gauaaauaguuuaugauuccac

SEQ ID NO: 3055570 - RNA, 19 nt, Human
gauaaaguugguaaaccuu

SEQ ID NO: 3055571 - RNA, 13 nt, Human
gaggaaggaaacc

SEQ ID NO: 3055572 - RNA, 19 nt, Human
gaggaaggaaacccagcuc

SEQ ID NO: 3055573 - RNA, 20 nt, Human
gaggaaggaaacccagcucu

SEQ ID NO: 3055574 - RNA, 21 nt, Human
gaggaaggaaacccagcucug

SEQ ID NO: 3055575 - RNA, 14 nt, Human
gauagucuuucagu

SEQ ID NO: 3055576 - RNA, 15 nt, Human
gauaguaacaaugaa

SEQ ID NO: 3055577 - RNA, 22 nt, Human
gauagucuuucaguuaaggaga

SEQ ID NO: 3055578 - RNA, 18 nt, Human
gaucacgccacugcacua

SEQ ID NO: 3055579 - RNA, 16 nt, Human
gaucacgccacugcac

SEQ ID NO: 3055580 - RNA, 21 nt, Human
gaucaaguuauuuuuaauuug

SEQ ID NO: 3055581 - RNA, 12 nt, Human
gaucacggcuca

SEQ ID NO: 3055582 - RNA, 12 nt, Human
gaucagccuggg

SEQ ID NO: 3055583 - RNA, 15 nt, Human
gaucagccugggcaa

SEQ ID NO: 3055584 - RNA, 22 nt, Human
gaucagucugauucccaagcuc

SEQ ID NO: 3055585 - RNA, 14 nt, Human
gaucauugugaaau

SEQ ID NO: 3055586 - RNA, 20 nt, Human
gaucauugugaaauuauuca

SEQ ID NO: 3055587 - RNA, 21 nt, Human
gaucauccacugugccaugug

SEQ ID NO: 3055588 - RNA, 16 nt, Human
gaucauccacugugcc

SEQ ID NO: 3055589 - RNA, 19 nt, Human
gaucauccacugugccaug

SEQ ID NO: 3055590 - RNA, 17 nt, Human
gaucauccacugugcca

SEQ ID NO: 3055591 - RNA, 23 nt, Human
gaccugauuucugagcauuuaau

SEQ ID NO: 3055592 - RNA, 11 nt, Human
gaccucaggcc

SEQ ID NO: 3055593 - RNA, 12 nt, Human
gaccucaggccu

SEQ ID NO: 3055594 - RNA, 14 nt, Human
gaccugaggcccuu

SEQ ID NO: 3055595 - RNA, 15 nt, Human
gaccugaggcccuuc

SEQ ID NO: 3055596 - RNA, 18 nt, Human
gaccugaggcccuucucu

SEQ ID NO: 3055597 - RNA, 21 nt, Human
gaccugaggcccuucucucca

SEQ ID NO: 3055598 - RNA, 14 nt, Human
gaccgugaggccag

SEQ ID NO: 3055599 - RNA, 19 nt, Human
gaccgugaggccagagaca

SEQ ID NO: 3055600 - RNA, 11 nt, Human
gacccacugcu

SEQ ID NO: 3055601 - RNA, 22 nt, Human
gacccacaagaaaugaaagcag

SEQ ID NO: 3055602 - RNA, 16 nt, Human
gacccaugcugcccug

SEQ ID NO: 3055603 - RNA, 14 nt, Human
gacccaugcugccc

SEQ ID NO: 3055604 - RNA, 15 nt, Human
gacccaugcugcccu

SEQ ID NO: 3055605 - RNA, 13 nt, Human
gacccaugcugcc

SEQ ID NO: 3055606 - RNA, 23 nt, Human
gacccugucucaaaaaaagaaaa

SEQ ID NO: 3055607 - RNA, 16 nt, Human
gacccugcccuguggg

SEQ ID NO: 3055608 - RNA, 13 nt, Human
gacccugcccugu

SEQ ID NO: 3055609 - RNA, 15 nt, Human
gacccugcccugugg

SEQ ID NO: 3055610 - RNA, 19 nt, Human
gacccugaggcccagaggg

SEQ ID NO: 3055611 - RNA, 20 nt, Human
gacccugaggcccagagggc

SEQ ID NO: 3055612 - RNA, 12 nt, Human
gacccugcccug

SEQ ID NO: 3055613 - RNA, 21 nt, Human
gacccugaggcccagagggcc

SEQ ID NO: 3055614 - RNA, 18 nt, Human
gacccugaggcccagagg

SEQ ID NO: 3055615 - RNA, 13 nt, Human
gaccccuccaugu

SEQ ID NO: 3055616 - RNA, 20 nt, Human
gaccccgagccuggcuccaa

SEQ ID NO: 3055617 - RNA, 21 nt, Human
gaccuuucaauaggaaaaacu

SEQ ID NO: 3055618 - RNA, 23 nt, Human
gaccuugaacuggguacuugugg

SEQ ID NO: 3055619 - RNA, 15 nt, Human
gacguguuaugacuc

SEQ ID NO: 3055620 - RNA, 17 nt, Human
gacguguuaugacucca

SEQ ID NO: 3055621 - RNA, 20 nt, Human
gacguguuaugacuccagaa

SEQ ID NO: 3055622 - RNA, 21 nt, Human
gacggagucccaccuuggcug

SEQ ID NO: 3055623 - RNA, 18 nt, Human
gacggagucccaccuugg

SEQ ID NO: 3055624 - RNA, 14 nt, Human
gacggagucccacc

SEQ ID NO: 3055625 - RNA, 15 nt, Human
gacuccugcaggcag

SEQ ID NO: 3055626 - RNA, 16 nt, Human
gacuccugcaggcagc

SEQ ID NO: 3055627 - RNA, 14 nt, Human
gacuccugcaggca

SEQ ID NO: 3055628 - RNA, 18 nt, Human
gacucccaugagggagau

SEQ ID NO: 3055629 - RNA, 18 nt, Human
gacuccaaagaaauguaa

SEQ ID NO: 3055630 - RNA, 17 nt, Human
gacuacucccccaggug

SEQ ID NO: 3055631 - RNA, 12 nt, Human
gacuacaggcac

SEQ ID NO: 3055632 - RNA, 22 nt, Human
gacguguuaugacuccagaauu

SEQ ID NO: 3055633 - RNA, 19 nt, Human
gacagccaacuauggccug

SEQ ID NO: 3055634 - RNA, 22 nt, Human
gacagccaacuauggccugugg

SEQ ID NO: 3055635 - RNA, 12 nt, Human
gacagcugccug

SEQ ID NO: 3055636 - RNA, 13 nt, Human
gacagcugccugg

SEQ ID NO: 3055637 - RNA, 16 nt, Human
gacagacacaggcccg

SEQ ID NO: 3055638 - RNA, 15 nt, Human
gacagacacaggccc

SEQ ID NO: 3055639 - RNA, 21 nt, Human
gacacuaaccacgcuggaccu

SEQ ID NO: 3055640 - RNA, 20 nt, Human
gacacuaaccacgcuggacc

SEQ ID NO: 3055641 - RNA, 14 nt, Human
gacagacacaggcc

SEQ ID NO: 3055642 - RNA, 12 nt, Human
gacagacacagg

SEQ ID NO: 3055643 - RNA, 14 nt, Human
gacagcugccuggg

SEQ ID NO: 3055644 - RNA, 15 nt, Human
gacagcugccuggga

SEQ ID NO: 3055645 - RNA, 19 nt, Human
gacaggcauguucucugag

SEQ ID NO: 3055646 - RNA, 18 nt, Human
gacaggcauguucucuga

SEQ ID NO: 3055647 - RNA, 17 nt, Human
gacaggcaaugcuggcu

SEQ ID NO: 3055648 - RNA, 24 nt, Human
gacaggcaaugcuggcuguuggcu

SEQ ID NO: 3055649 - RNA, 16 nt, Human
gacaggcaaugcuggc

SEQ ID NO: 3055650 - RNA, 14 nt, Human
gacaggcaaugcug

SEQ ID NO: 3055651 - RNA, 21 nt, Human
gacaggcaagcaccuccugcc

SEQ ID NO: 3055652 - RNA, 17 nt, Human
gacaugucuuuucuugc

SEQ ID NO: 3055653 - RNA, 21 nt, Human
gacaugucuuuucuugcauga

SEQ ID NO: 3055654 - RNA, 17 nt, Human
gacaugggacauuugcu

SEQ ID NO: 3055655 - RNA, 22 nt, Human
gacaugggacauuugcucaugg

SEQ ID NO: 3055656 - RNA, 23 nt, Human
gacauacuaaccagcagaaaugc

SEQ ID NO: 3055657 - RNA, 16 nt, Human
gacauacuaaccagca

SEQ ID NO: 3055658 - RNA, 15 nt, Human
gacauacuaaccagc

SEQ ID NO: 3055659 - RNA, 22 nt, Human
gacacccugugauggggcccug

SEQ ID NO: 3055660 - RNA, 23 nt, Human
gacacccugugauggggcccugc

SEQ ID NO: 3055661 - RNA, 18 nt, Human
gacacaggcccggcucca

SEQ ID NO: 3055662 - RNA, 12 nt, Human
gacacccuguga

SEQ ID NO: 3055663 - RNA, 13 nt, Human
gacacccugugau

SEQ ID NO: 3055664 - RNA, 18 nt, Human
gacacuaaccacgcugga

SEQ ID NO: 3055665 - RNA, 17 nt, Human
gacacuaaccacgcugg

SEQ ID NO: 3055666 - RNA, 16 nt, Human
gacacuaaccacgcug

SEQ ID NO: 3055667 - RNA, 15 nt, Human
gacacuaaccacgcu

SEQ ID NO: 3055668 - RNA, 17 nt, Human
gacacgaauauugcuga

SEQ ID NO: 3055669 - RNA, 18 nt, Human
gacacgaauauugcugau

SEQ ID NO: 3055670 - RNA, 19 nt, Human
gacacgaauauugcugaug

SEQ ID NO: 3055671 - RNA, 17 nt, Human
gacaccuugacagggca

SEQ ID NO: 3055672 - RNA, 15 nt, Human
gacaccuugacaggg

SEQ ID NO: 3055673 - RNA, 20 nt, Human
gacaccuugacagggcacac

SEQ ID NO: 3055674 - RNA, 18 nt, Human
gacaccuugacagggcac

SEQ ID NO: 3055675 - RNA, 15 nt, Human
gacacgaauauugcu

SEQ ID NO: 3055676 - RNA, 21 nt, Human
gacaaugacuuacuguacaug

SEQ ID NO: 3055677 - RNA, 12 nt, Human
gacaaugcaaac

SEQ ID NO: 3055678 - RNA, 20 nt, Human
gacaaugacuuacuguacau

SEQ ID NO: 3055679 - RNA, 17 nt, Human
gacaaugacuuacugua

SEQ ID NO: 3055680 - RNA, 16 nt, Human
gacaaugcaaaccauc

SEQ ID NO: 3055681 - RNA, 18 nt, Human
gacaaugcaaaccaucau

SEQ ID NO: 3055682 - RNA, 12 nt, Human
gacaauuuauua

SEQ ID NO: 3055683 - RNA, 19 nt, Human
gacaauuuauuauggcaca

SEQ ID NO: 3055684 - RNA, 13 nt, Human
gacaauuuauuau

SEQ ID NO: 3055685 - RNA, 22 nt, Human
gacacaagccuucggcgccuua

SEQ ID NO: 3055686 - RNA, 17 nt, Human
gacacaggcccggcucc

SEQ ID NO: 3055687 - RNA, 15 nt, Human
gacacaggcccggcu

SEQ ID NO: 3055688 - RNA, 12 nt, Human
gacacaggcccg

SEQ ID NO: 3055689 - RNA, 16 nt, Human
gacaaugacccagugg

SEQ ID NO: 3055690 - RNA, 22 nt, Human
gacaaggauugcuacuguccua

SEQ ID NO: 3055691 - RNA, 21 nt, Human
gacaaggauugcuacuguccu

SEQ ID NO: 3055692 - RNA, 16 nt, Human
gaagucuuuguacaga

SEQ ID NO: 3055693 - RNA, 14 nt, Human
gaagucuuuguaca

SEQ ID NO: 3055694 - RNA, 17 nt, Human
gagauacagaauuuuau

SEQ ID NO: 3055695 - RNA, 19 nt, Human
gagagugaacaaauuuaca

SEQ ID NO: 3055696 - RNA, 15 nt, Human
gagagugaacaaauu

SEQ ID NO: 3055697 - RNA, 20 nt, Human
gagagggugggagugggccc

SEQ ID NO: 3055698 - RNA, 21 nt, Human
gagagggugggagugggccca

SEQ ID NO: 3055699 - RNA, 18 nt, Human
gagaggggaacagacugg

SEQ ID NO: 3055700 - RNA, 13 nt, Human
gagaggggaacag

SEQ ID NO: 3055701 - RNA, 13 nt, Human
gagagccuuccag

SEQ ID NO: 3055702 - RNA, 17 nt, Human
gagagaagagaaugcac

SEQ ID NO: 3055703 - RNA, 14 nt, Human
gagacagcccgggc

SEQ ID NO: 3055704 - RNA, 17 nt, Human
gagacagcccgggcucu

SEQ ID NO: 3055705 - RNA, 18 nt, Human
gagacagcccgggcucug

SEQ ID NO: 3055706 - RNA, 19 nt, Human
gagacagcccgggcucugc

SEQ ID NO: 3055707 - RNA, 20 nt, Human
gagacagcccgggcucugcc

SEQ ID NO: 3055708 - RNA, 21 nt, Human
gagacagcccgggcucugccu

SEQ ID NO: 3055709 - RNA, 22 nt, Human
gagacagcccgggcucugccuc

SEQ ID NO: 3055710 - RNA, 23 nt, Human
gagacagcccgggcucugccucc

SEQ ID NO: 3055711 - RNA, 24 nt, Human
gagacagcccgggcucugccuccc

SEQ ID NO: 3055712 - RNA, 13 nt, Human
gagacagcucugc

SEQ ID NO: 3055713 - RNA, 15 nt, Human
gagacagcucugcau

SEQ ID NO: 3055714 - RNA, 18 nt, Human
gagacagcucugcauacu

SEQ ID NO: 3055715 - RNA, 22 nt, Human
gagacuccugcaggcagccagg

SEQ ID NO: 3055716 - RNA, 16 nt, Human
gagacucgcgacaaug

SEQ ID NO: 3055717 - RNA, 13 nt, Human
gagacucugucuc

SEQ ID NO: 3055718 - RNA, 14 nt, Human
gagacucugucuca

SEQ ID NO: 3055719 - RNA, 21 nt, Human
gagaaugagagacacacugaa

SEQ ID NO: 3055720 - RNA, 20 nt, Human
gagaaugcacaaacagaggc

SEQ ID NO: 3055721 - RNA, 21 nt, Human
gagaaugcacaaacagaggcc

SEQ ID NO: 3055722 - RNA, 22 nt, Human
gagaaugcacaaacagaggccg

SEQ ID NO: 3055723 - RNA, 16 nt, Human
gagaagaacugaaauc

SEQ ID NO: 3055724 - RNA, 13 nt, Human
gagaagaacugaa

SEQ ID NO: 3055725 - RNA, 14 nt, Human
gagaagaacugaaa

SEQ ID NO: 3055726 - RNA, 13 nt, Human
gagaagagcuguu

SEQ ID NO: 3055727 - RNA, 22 nt, Human
gagaagagcuguucacagccag

SEQ ID NO: 3055728 - RNA, 15 nt, Human
gagaagagcuguuca

SEQ ID NO: 3055729 - RNA, 16 nt, Human
gagacagccaacuaug

SEQ ID NO: 3055730 - RNA, 12 nt, Human
gagacagcccgg

SEQ ID NO: 3055731 - RNA, 19 nt, Human
gagacagaguuuucacucu

SEQ ID NO: 3055732 - RNA, 15 nt, Human
gagacacaagccuuc

SEQ ID NO: 3055733 - RNA, 17 nt, Human
gagacacaagccuucgg

SEQ ID NO: 3055734 - RNA, 18 nt, Human
gagacacacugaagaagc

SEQ ID NO: 3055735 - RNA, 14 nt, Human
gagaaauuuauaaa

SEQ ID NO: 3055736 - RNA, 22 nt, Human
gagaaaguacuucuccacccug

SEQ ID NO: 3055737 - RNA, 23 nt, Human
gagaaaguacuucuccacccugc

SEQ ID NO: 3055738 - RNA, 18 nt, Human
gagaaagacuauucaaac

SEQ ID NO: 3055739 - RNA, 17 nt, Human
gagaaagacuauucaaa

SEQ ID NO: 3055740 - RNA, 15 nt, Human
gagaaagacuauuca

SEQ ID NO: 3055741 - RNA, 13 nt, Human
gagaaagacuauu

SEQ ID NO: 3055742 - RNA, 13 nt, Human
gacuuggaagcuc

SEQ ID NO: 3055743 - RNA, 21 nt, Human
gagaaaauggacguguuauga

SEQ ID NO: 3055744 - RNA, 17 nt, Human
gacuccugcaggcagcc

SEQ ID NO: 3055745 - RNA, 18 nt, Human
gacucgcgacaaugcaaa

SEQ ID NO: 3055746 - RNA, 19 nt, Human
gacucgcgacaaugcaaac

SEQ ID NO: 3055747 - RNA, 16 nt, Human
gacuuggaagcuccgc

SEQ ID NO: 3055748 - RNA, 15 nt, Human
gacuuggaagcuccg

SEQ ID NO: 3055749 - RNA, 14 nt, Human
gacuuggaagcucc

SEQ ID NO: 3055750 - RNA, 22 nt, Human
gagcuugaaacccguggcgcuu

SEQ ID NO: 3055751 - RNA, 20 nt, Human
gagcuuugaaaauucagugg

SEQ ID NO: 3055752 - RNA, 22 nt, Human
gagcuuucugcuaucaaagagg

SEQ ID NO: 3055753 - RNA, 16 nt, Human
gaggaaagcaaaggag

SEQ ID NO: 3055754 - RNA, 17 nt, Human
gaggaaagcaaaggaga

SEQ ID NO: 3055755 - RNA, 14 nt, Human
gagcuuuuguagaa

SEQ ID NO: 3055756 - RNA, 14 nt, Human
gaggaagccgcugg

SEQ ID NO: 3055757 - RNA, 17 nt, Human
gaggaagccgcuggggc

SEQ ID NO: 3055758 - RNA, 18 nt, Human
gaggaagccgcuggggcc

SEQ ID NO: 3055759 - RNA, 13 nt, Human
gaggaagccgcug

SEQ ID NO: 3055760 - RNA, 17 nt, Human
gaggaagagaaaaaaua

SEQ ID NO: 3055761 - RNA, 16 nt, Human
gaggaacaaggcaagg

SEQ ID NO: 3055762 - RNA, 14 nt, Human
gaggaacaaggcaa

SEQ ID NO: 3055763 - RNA, 16 nt, Human
gagcucgugggacagu

SEQ ID NO: 3055764 - RNA, 15 nt, Human
gagcugaguggggga

SEQ ID NO: 3055765 - RNA, 21 nt, Human
gagcugaucgcuucuccccca

SEQ ID NO: 3055766 - RNA, 16 nt, Human
gagcugaucgcuucuc

SEQ ID NO: 3055767 - RNA, 15 nt, Human
gagcuagcagcaggg

SEQ ID NO: 3055768 - RNA, 17 nt, Human
gagcuagcagcagggag

SEQ ID NO: 3055769 - RNA, 15 nt, Human
gagccugcaguuauu

SEQ ID NO: 3055770 - RNA, 21 nt, Human
gagcccacuguacuugcucuu

SEQ ID NO: 3055771 - RNA, 18 nt, Human
gagcccacuguacuugcu

SEQ ID NO: 3055772 - RNA, 18 nt, Human
gagcccacgcccccacug

SEQ ID NO: 3055773 - RNA, 20 nt, Human
gagccgagaucacgccacug

SEQ ID NO: 3055774 - RNA, 19 nt, Human
gagccgagaucacgccacu

SEQ ID NO: 3055775 - RNA, 22 nt, Human
gagccgagaucacgccacugca

SEQ ID NO: 3055776 - RNA, 21 nt, Human
gagccgagaucacgccacugc

SEQ ID NO: 3055777 - RNA, 16 nt, Human
gagccgcccaaggccu

SEQ ID NO: 3055778 - RNA, 13 nt, Human
gagccgcccaagg

SEQ ID NO: 3055779 - RNA, 13 nt, Human
gagccucagcauc

SEQ ID NO: 3055780 - RNA, 15 nt, Human
gagccucagcauccu

SEQ ID NO: 3055781 - RNA, 14 nt, Human
gagccucagcaucc

SEQ ID NO: 3055782 - RNA, 17 nt, Human
gagccucagcauccugg

SEQ ID NO: 3055783 - RNA, 12 nt, Human
gagccugcaguu

SEQ ID NO: 3055784 - RNA, 13 nt, Human
gagccuccugccc

SEQ ID NO: 3055785 - RNA, 18 nt, Human
gagccagauuucacucuc

SEQ ID NO: 3055786 - RNA, 19 nt, Human
gagccagauuucacucucc

SEQ ID NO: 3055787 - RNA, 15 nt, Human
gagccagauuucacu

SEQ ID NO: 3055788 - RNA, 13 nt, Human
gagccacugcacc

SEQ ID NO: 3055789 - RNA, 19 nt, Human
gagccacugcaccgggcca

SEQ ID NO: 3055790 - RNA, 18 nt, Human
gagccacugcaccgggcc

SEQ ID NO: 3055791 - RNA, 17 nt, Human
gagcccaccuuggcuca

SEQ ID NO: 3055792 - RNA, 15 nt, Human
gagcccaccuuggcu

SEQ ID NO: 3055793 - RNA, 13 nt, Human
gagcccaccuugg

SEQ ID NO: 3055794 - RNA, 13 nt, Human
gagccagauuuca

SEQ ID NO: 3055795 - RNA, 22 nt, Human
gagcagccacauuccugaugcu

SEQ ID NO: 3055796 - RNA, 21 nt, Human
gagcagccacauuccugaugc

SEQ ID NO: 3055797 - RNA, 19 nt, Human
gagcagagaccaucccuga

SEQ ID NO: 3055798 - RNA, 21 nt, Human
gagcagagaccaucccugaag

SEQ ID NO: 3055799 - RNA, 23 nt, Human
gagcagagaccaucccugaaggc

SEQ ID NO: 3055800 - RNA, 17 nt, Human
gagcagagaccaucccu

SEQ ID NO: 3055801 - RNA, 18 nt, Human
gagcagagaccaucccug

SEQ ID NO: 3055802 - RNA, 16 nt, Human
gagcagagaccauccc

SEQ ID NO: 3055803 - RNA, 19 nt, Human
gagauagccaaggccaaag

SEQ ID NO: 3055804 - RNA, 20 nt, Human
gagauagccaaggccaaagg

SEQ ID NO: 3055805 - RNA, 21 nt, Human
gagauagccaaggccaaagga

SEQ ID NO: 3055806 - RNA, 14 nt, Human
cuuuccaggaaggc

SEQ ID NO: 3055807 - RNA, 16 nt, Human
cuuuccaaaguacacu

SEQ ID NO: 3055808 - RNA, 16 nt, Human
cuuuccaaaugcccag

SEQ ID NO: 3055809 - RNA, 22 nt, Human
cuuuccaaaguacacuguuuca

SEQ ID NO: 3055810 - RNA, 19 nt, Human
cuuuauuuuguguuuagga

SEQ ID NO: 3055811 - RNA, 21 nt, Human
cuuuauuuucuauaauuuaaa

SEQ ID NO: 3055812 - RNA, 21 nt, Human
cuuguggacacagcucuucuc

SEQ ID NO: 3055813 - RNA, 17 nt, Human
cuuuccugaggcugggc

SEQ ID NO: 3055814 - RNA, 16 nt, Human
cuuuccugaggcuggg

SEQ ID NO: 3055815 - RNA, 20 nt, Human
cuuuccugaggcugggcucc

SEQ ID NO: 3055816 - RNA, 21 nt, Human
cuuuccugaggcugggcuccc

SEQ ID NO: 3055817 - RNA, 19 nt, Human
cuuuggaaagaguaggaag

SEQ ID NO: 3055818 - RNA, 23 nt, Human
cuuuggaaagaguaggaagacuu

SEQ ID NO: 3055819 - RNA, 15 nt, Human
cuuugcagacaggca

SEQ ID NO: 3055820 - RNA, 14 nt, Human
cuuugcagacaggc

SEQ ID NO: 3055821 - RNA, 19 nt, Human
cuuuuuuaucaugugaaau

SEQ ID NO: 3055822 - RNA, 18 nt, Human
cuuuuuuauacauaaaca

SEQ ID NO: 3055823 - RNA, 11 nt, Human
gaaaaagaaaa

SEQ ID NO: 3055824 - RNA, 16 nt, Human
gaaaaagaaaaaauau

SEQ ID NO: 3055825 - RNA, 17 nt, Human
cuuuuuuauacauaaac

SEQ ID NO: 3055826 - RNA, 16 nt, Human
cuuuuuuauacauaaa

SEQ ID NO: 3055827 - RNA, 15 nt, Human
cuuuuuuauacauaa

SEQ ID NO: 3055828 - RNA, 17 nt, Human
cuuuucuuucagccaag

SEQ ID NO: 3055829 - RNA, 16 nt, Human
cuuuucuuucagccaa

SEQ ID NO: 3055830 - RNA, 13 nt, Human
cuuuucuuuucuu

SEQ ID NO: 3055831 - RNA, 22 nt, Human
cuuuuuaauauugauaugcuua

SEQ ID NO: 3055832 - RNA, 16 nt, Human
cuuuggaacaagaugg

SEQ ID NO: 3055833 - RNA, 21 nt, Human
cuuuucgcaggauucuuccuc

SEQ ID NO: 3055834 - RNA, 20 nt, Human
cuuuucgcaggauucuuccu

SEQ ID NO: 3055835 - RNA, 13 nt, Human
cuuuuccaacccu

SEQ ID NO: 3055836 - RNA, 23 nt, Human
cuuuuccaacccucaucaccaac

SEQ ID NO: 3055837 - RNA, 22 nt, Human
cuuuucauuuaggugaggaagc

SEQ ID NO: 3055838 - RNA, 16 nt, Human
cuugaacuggguacuu

SEQ ID NO: 3055839 - RNA, 19 nt, Human
cuugaacuccuggccucaa

SEQ ID NO: 3055840 - RNA, 20 nt, Human
cuugaacuggguacuugugg

SEQ ID NO: 3055841 - RNA, 18 nt, Human
cuugaacuggguacuugu

SEQ ID NO: 3055842 - RNA, 15 nt, Human
cuugaacuuugaccu

SEQ ID NO: 3055843 - RNA, 18 nt, Human
cuugaacuccuggccuca

SEQ ID NO: 3055844 - RNA, 17 nt, Human
cuugaacuccuggccuc

SEQ ID NO: 3055845 - RNA, 15 nt, Human
cuugaacuccuggcc

SEQ ID NO: 3055846 - RNA, 14 nt, Human
cuugaacuccuggc

SEQ ID NO: 3055847 - RNA, 20 nt, Human
cuugaacccgggaggcagag

SEQ ID NO: 3055848 - RNA, 19 nt, Human
cuugaacccgggaggcaga

SEQ ID NO: 3055849 - RNA, 14 nt, Human
cuugaacccgggag

SEQ ID NO: 3055850 - RNA, 22 nt, Human
cuucuuuauaauucuacuuuga

SEQ ID NO: 3055851 - RNA, 13 nt, Human
cuucuuuccacag

SEQ ID NO: 3055852 - RNA, 19 nt, Human
cuucuuuccacagaagcuc

SEQ ID NO: 3055853 - RNA, 19 nt, Human
cuugaaauauaggaacuua

SEQ ID NO: 3055854 - RNA, 22 nt, Human
cuugagccuugaacuuugaccu

SEQ ID NO: 3055855 - RNA, 20 nt, Human
cuugagccuugaacuuugac

SEQ ID NO: 3055856 - RNA, 14 nt, Human
cuugagagggugga

SEQ ID NO: 3055857 - RNA, 21 nt, Human
cuugaccauucuccaccugcc

SEQ ID NO: 3055858 - RNA, 17 nt, Human
cuugaccauucuccacc

SEQ ID NO: 3055859 - RNA, 20 nt, Human
cuugaccauucuccaccugc

SEQ ID NO: 3055860 - RNA, 19 nt, Human
cuugagccuugaacuuuga

SEQ ID NO: 3055861 - RNA, 21 nt, Human
cuugcaugaggcuaguguggu

SEQ ID NO: 3055862 - RNA, 17 nt, Human
cuugcaugaggcuagug

SEQ ID NO: 3055863 - RNA, 18 nt, Human
cuugcaugguuuggagcu

SEQ ID NO: 3055864 - RNA, 19 nt, Human
cuugcaugguuuggagcug

SEQ ID NO: 3055865 - RNA, 21 nt, Human
cuugcaugguuuagaaagcuu

SEQ ID NO: 3055866 - RNA, 18 nt, Human
cuugcagacucuacagag

SEQ ID NO: 3055867 - RNA, 22 nt, Human
cuugcagcucuccccuucucug

SEQ ID NO: 3055868 - RNA, 14 nt, Human
cuugcaauggcagc

SEQ ID NO: 3055869 - RNA, 22 nt, Human
cuugcaaaguaucccuacugua

SEQ ID NO: 3055870 - RNA, 16 nt, Human
cuugagugcucaguag

SEQ ID NO: 3055871 - RNA, 17 nt, Human
cuugccaaauauaaaua

SEQ ID NO: 3055872 - RNA, 20 nt, Human
cuugcaugguuuggagcuga

SEQ ID NO: 3055873 - RNA, 22 nt, Human
cuugcaugguuuggagcugauc

SEQ ID NO: 3055874 - RNA, 15 nt, Human
cuugcuuuuaaaauc

SEQ ID NO: 3055875 - RNA, 13 nt, Human
cuugcuugcuuuu

SEQ ID NO: 3055876 - RNA, 13 nt, Human
cuuggauuguccc

SEQ ID NO: 3055877 - RNA, 23 nt, Human
cuuggcucaaguccucuuuucug

SEQ ID NO: 3055878 - RNA, 13 nt, Human
cuuggcugcaggg

SEQ ID NO: 3055879 - RNA, 12 nt, Human
cuuggcugcagg

SEQ ID NO: 3055880 - RNA, 20 nt, Human
cuugguuuguaaauuaacuu

SEQ ID NO: 3055881 - RNA, 21 nt, Human
cuuguaaauagcucagguguc

SEQ ID NO: 3055882 - RNA, 18 nt, Human
cuuggggaccagagcugc

SEQ ID NO: 3055883 - RNA, 19 nt, Human
cuuggggaccagagcugcc

SEQ ID NO: 3055884 - RNA, 17 nt, Human
cuuggggaccagagcug

SEQ ID NO: 3055885 - RNA, 16 nt, Human
cuuggggaccagagcu

SEQ ID NO: 3055886 - RNA, 13 nt, Human
cuuguauuaugug

SEQ ID NO: 3055887 - RNA, 18 nt, Human
cuuguauuauguguguuu

SEQ ID NO: 3055888 - RNA, 18 nt, Human
cuuguggacacagcucuu

SEQ ID NO: 3055889 - RNA, 17 nt, Human
cuuguggacacagcucu

SEQ ID NO: 3055890 - RNA, 16 nt, Human
cuuguggacacagcuc

SEQ ID NO: 3055891 - RNA, 23 nt, Human
gaaauuaguacuccccuccuuga

SEQ ID NO: 3055892 - RNA, 17 nt, Human
gaaauuauauaaguauu

SEQ ID NO: 3055893 - RNA, 23 nt, Human
gaaauuauauaaguauucuaaau

SEQ ID NO: 3055894 - RNA, 15 nt, Human
gaacacuccuucaca

SEQ ID NO: 3055895 - RNA, 16 nt, Human
gaacacuccuucacag

SEQ ID NO: 3055896 - RNA, 21 nt, Human
gaaauuuccugggagcuuuug

SEQ ID NO: 3055897 - RNA, 19 nt, Human
gaacagacuggaagcacag

SEQ ID NO: 3055898 - RNA, 20 nt, Human
gaacagacuggaagcacagc

SEQ ID NO: 3055899 - RNA, 17 nt, Human
gaacacuccuucacaga

SEQ ID NO: 3055900 - RNA, 18 nt, Human
gaacagauaaucagugug

SEQ ID NO: 3055901 - RNA, 22 nt, Human
gaacagacuggaagcacagcuu

SEQ ID NO: 3055902 - RNA, 17 nt, Human
gaacaggauauucucac

SEQ ID NO: 3055903 - RNA, 24 nt, Human
gaacaguuaccucugccucagaaa

SEQ ID NO: 3055904 - RNA, 20 nt, Human
gaacaguuguguuugaagca

SEQ ID NO: 3055905 - RNA, 14 nt, Human
gaacaucccuccug

SEQ ID NO: 3055906 - RNA, 22 nt, Human
gaacaguuguguuugaagcaca

SEQ ID NO: 3055907 - RNA, 17 nt, Human
gaaaugggcagagcaga

SEQ ID NO: 3055908 - RNA, 19 nt, Human
gaaaugggcagagcagaga

SEQ ID NO: 3055909 - RNA, 17 nt, Human
gaaauguacagcaagga

SEQ ID NO: 3055910 - RNA, 22 nt, Human
gaaauguaagggaaacugccag

SEQ ID NO: 3055911 - RNA, 16 nt, Human
gaaaugggcagagcag

SEQ ID NO: 3055912 - RNA, 15 nt, Human
gaaaugggcagagca

SEQ ID NO: 3055913 - RNA, 11 nt, Human
gaaaugagcug

SEQ ID NO: 3055914 - RNA, 18 nt, Human
gaaaugaggucagagccu

SEQ ID NO: 3055915 - RNA, 17 nt, Human
gaaauauaggaacuuaa

SEQ ID NO: 3055916 - RNA, 18 nt, Human
gaaauaaacgucuuaaau

SEQ ID NO: 3055917 - RNA, 21 nt, Human
gaaauaaacgucuuaaauauu

SEQ ID NO: 3055918 - RNA, 14 nt, Human
gaaauaaacgucuu

SEQ ID NO: 3055919 - RNA, 16 nt, Human
gaaauaaacgucuuaa

SEQ ID NO: 3055920 - RNA, 17 nt, Human
gaaauaaacgucuuaaa

SEQ ID NO: 3055921 - RNA, 19 nt, Human
gaaauaucugaaaauguau

SEQ ID NO: 3055922 - RNA, 18 nt, Human
gaaauaucugaaaaugua

SEQ ID NO: 3055923 - RNA, 13 nt, Human
gaaauauuuauuu

SEQ ID NO: 3055924 - RNA, 15 nt, Human
gaaauauuuauuuua

SEQ ID NO: 3055925 - RNA, 16 nt, Human
gaaauauuuauuuuaa

SEQ ID NO: 3055926 - RNA, 23 nt, Human
gaaaguuauugauaaguucauac

SEQ ID NO: 3055927 - RNA, 11 nt, Human
gaaaggaaaga

SEQ ID NO: 3055928 - RNA, 16 nt, Human
gaaaggaaagaggcuc

SEQ ID NO: 3055929 - RNA, 21 nt, Human
gaaagcuugcccuggugccuc

SEQ ID NO: 3055930 - RNA, 22 nt, Human
gaaaguacuucuccacccugcu

SEQ ID NO: 3055931 - RNA, 19 nt, Human
gaaacuaggugcauauuua

SEQ ID NO: 3055932 - RNA, 20 nt, Human
gaaacuaggugcauauuuau

SEQ ID NO: 3055933 - RNA, 16 nt, Human
gaaacugacacaugcu

SEQ ID NO: 3055934 - RNA, 15 nt, Human
gaaacugccagcaac

SEQ ID NO: 3055935 - RNA, 13 nt, Human
gaaacugccagca

SEQ ID NO: 3055936 - RNA, 16 nt, Human
gaaaaaugagccuggc

SEQ ID NO: 3055937 - RNA, 19 nt, Human
gaaagacuauucaaacagu

SEQ ID NO: 3055938 - RNA, 23 nt, Human
gaaagacuauucaaacagucuca

SEQ ID NO: 3055939 - RNA, 22 nt, Human
gaaagacuauucaaacagucuc

SEQ ID NO: 3055940 - RNA, 16 nt, Human
gaaagaucaaaagguu

SEQ ID NO: 3055941 - RNA, 16 nt, Human
gaaagaguaggaagac

SEQ ID NO: 3055942 - RNA, 13 nt, Human
gaaagcagaacag

SEQ ID NO: 3055943 - RNA, 22 nt, Human
gaagauugagauguguucacaa

SEQ ID NO: 3055944 - RNA, 17 nt, Human
gaagauugagauguguu

SEQ ID NO: 3055945 - RNA, 18 nt, Human
gaagcauuuacuuugugu

SEQ ID NO: 3055946 - RNA, 20 nt, Human
gaagaguauuuuugacagaa

SEQ ID NO: 3055947 - RNA, 23 nt, Human
gaagagcuguucacagccagacu

SEQ ID NO: 3055948 - RNA, 13 nt, Human
gaagagcuguuca

SEQ ID NO: 3055949 - RNA, 20 nt, Human
gaagagcuguucacagccag

SEQ ID NO: 3055950 - RNA, 15 nt, Human
gaagagcuguucaca

SEQ ID NO: 3055951 - RNA, 15 nt, Human
gaagacuucaucccu

SEQ ID NO: 3055952 - RNA, 16 nt, Human
gaagacuucaucccuc

SEQ ID NO: 3055953 - RNA, 12 nt, Human
gaagagccuugc

SEQ ID NO: 3055954 - RNA, 17 nt, Human
gaagacuucaucccucu

SEQ ID NO: 3055955 - RNA, 19 nt, Human
gaagacuucaucccucugg

SEQ ID NO: 3055956 - RNA, 22 nt, Human
gaacuuguaaaggaauuuaaaa

SEQ ID NO: 3055957 - RNA, 17 nt, Human
gaacuugggccacugug

SEQ ID NO: 3055958 - RNA, 18 nt, Human
gaacuuggcgcugccccu

SEQ ID NO: 3055959 - RNA, 17 nt, Human
gaacuuuccaggaaggc

SEQ ID NO: 3055960 - RNA, 22 nt, Human
gaacuuugaccucugcagcaau

SEQ ID NO: 3055961 - RNA, 16 nt, Human
gaacuuugaccucugc

SEQ ID NO: 3055962 - RNA, 14 nt, Human
gaagaagcucucuc

SEQ ID NO: 3055963 - RNA, 18 nt, Human
gaaccacaucuugcucug

SEQ ID NO: 3055964 - RNA, 14 nt, Human
gaaccacaagacug

SEQ ID NO: 3055965 - RNA, 15 nt, Human
gaaccacaagacugc

SEQ ID NO: 3055966 - RNA, 15 nt, Human
gaacucccuuucaac

SEQ ID NO: 3055967 - RNA, 16 nt, Human
gaacucccuuucaaca

SEQ ID NO: 3055968 - RNA, 17 nt, Human
gaacuuggcgcugcccc

SEQ ID NO: 3055969 - RNA, 14 nt, Human
gaacuuaaauaaug

SEQ ID NO: 3055970 - RNA, 17 nt, Human
gaacuuaaauaauguga

SEQ ID NO: 3055971 - RNA, 19 nt, Human
gaaggaagacuucaucccu

SEQ ID NO: 3055972 - RNA, 15 nt, Human
gaaggaacguccccu

SEQ ID NO: 3055973 - RNA, 21 nt, Human
gaaggaaacccagcucugguc

SEQ ID NO: 3055974 - RNA, 22 nt, Human
gaaggaaacccagcucuggucc

SEQ ID NO: 3055975 - RNA, 21 nt, Human
gaaggacauugcggacagcca

SEQ ID NO: 3055976 - RNA, 20 nt, Human
gaaggacauugcggacagcc

SEQ ID NO: 3055977 - RNA, 19 nt, Human
gaaggacauugcggacagc

SEQ ID NO: 3055978 - RNA, 18 nt, Human
gaagccgcuggggccagu

SEQ ID NO: 3055979 - RNA, 20 nt, Human
gaagccgcuggggccaguug

SEQ ID NO: 3055980 - RNA, 14 nt, Human
gaagccgcuggggc

SEQ ID NO: 3055981 - RNA, 19 nt, Human
gaaggaaacccagcucugg

SEQ ID NO: 3055982 - RNA, 20 nt, Human
gaaggaaacccagcucuggu

SEQ ID NO: 3055983 - RNA, 21 nt, Human
gaaggugaggagcuugaaacc

SEQ ID NO: 3055984 - RNA, 20 nt, Human
gaaguaauaugcacacauuu

SEQ ID NO: 3055985 - RNA, 19 nt, Human
gaaguaauaugcacacauu

SEQ ID NO: 3055986 - RNA, 13 nt, Human
gaagucacacagu

SEQ ID NO: 3055987 - RNA, 18 nt, Human
gaagucuuagauguauau

SEQ ID NO: 3055988 - RNA, 23 nt, Human
gaaguccaagcauuuagauguau

SEQ ID NO: 3055989 - RNA, 21 nt, Human
gaagucacauuccugaacagg

SEQ ID NO: 3055990 - RNA, 16 nt, Human
gaagucacauuccuga

SEQ ID NO: 3055991 - RNA, 20 nt, Human
gaagucacauuccugaacag

SEQ ID NO: 3055992 - RNA, 14 nt, Human
gaaggaugcugucu

SEQ ID NO: 3055993 - RNA, 13 nt, Human
gaagggggcuggg

SEQ ID NO: 3055994 - RNA, 22 nt, Human
cuguaccucuugagccuugaac

SEQ ID NO: 3055995 - RNA, 15 nt, Human
cuguaucccaugagc

SEQ ID NO: 3055996 - RNA, 14 nt, Human
cuguaucccaugag

SEQ ID NO: 3055997 - RNA, 18 nt, Human
cuguaucccaugagccuc

SEQ ID NO: 3055998 - RNA, 15 nt, Human
cuguaugauucccag

SEQ ID NO: 3055999 - RNA, 22 nt, Human
cugucccagugccgagaaggaa

SEQ ID NO: 3056000 - RNA, 23 nt, Human
cugucauuugagcagggcucagc

SEQ ID NO: 3056001 - RNA, 13 nt, Human
cuguauuuuaaaa

SEQ ID NO: 3056002 - RNA, 16 nt, Human
cuguauuuuaaaagaa

SEQ ID NO: 3056003 - RNA, 13 nt, Human
cugucccccugac

SEQ ID NO: 3056004 - RNA, 14 nt, Human
cugucccccugaca

SEQ ID NO: 3056005 - RNA, 20 nt, Human
cuguccuacucugugucagg

SEQ ID NO: 3056006 - RNA, 18 nt, Human
cuguccuacucuguguca

SEQ ID NO: 3056007 - RNA, 17 nt, Human
cuguccuacucuguguc

SEQ ID NO: 3056008 - RNA, 16 nt, Human
cuguccuacucugugu

SEQ ID NO: 3056009 - RNA, 22 nt, Human
cugucccuuacgugaguccugg

SEQ ID NO: 3056010 - RNA, 21 nt, Human
cuguccuacucugugucaggu

SEQ ID NO: 3056011 - RNA, 22 nt, Human
cugucucaaaaaaagaaaaaga

SEQ ID NO: 3056012 - RNA, 20 nt, Human
cugucuccucucucuguaau

SEQ ID NO: 3056013 - RNA, 17 nt, Human
cugucuccucucucugu

SEQ ID NO: 3056014 - RNA, 18 nt, Human
cugucucuacuaaaaaua

SEQ ID NO: 3056015 - RNA, 18 nt, Human
cuguaaggcaaucauggu

SEQ ID NO: 3056016 - RNA, 20 nt, Human
cugguucaggguuggccccu

SEQ ID NO: 3056017 - RNA, 13 nt, Human
cugguggcagcuc

SEQ ID NO: 3056018 - RNA, 14 nt, Human
cugguggcagcuca

SEQ ID NO: 3056019 - RNA, 12 nt, Human
cugguggcagcu

SEQ ID NO: 3056020 - RNA, 23 nt, Human
cuguacaugaaaacacauuuuuc

SEQ ID NO: 3056021 - RNA, 22 nt, Human
cuguacaugaaaacacauuuuu

SEQ ID NO: 3056022 - RNA, 21 nt, Human
cuguaccucuugagccuugaa

SEQ ID NO: 3056023 - RNA, 21 nt, Human
cuguaauuugugauacaaugc

SEQ ID NO: 3056024 - RNA, 23 nt, Human
cuguacagagcccacgcccccac

SEQ ID NO: 3056025 - RNA, 17 nt, Human
cuguaauuugugauaca

SEQ ID NO: 3056026 - RNA, 18 nt, Human
cuguaauuugugauacaa

SEQ ID NO: 3056027 - RNA, 18 nt, Human
cugggucgcccuggacug

SEQ ID NO: 3056028 - RNA, 17 nt, Human
cugggucgcccuggacu

SEQ ID NO: 3056029 - RNA, 22 nt, Human
cugggucgcccuggacugugug

SEQ ID NO: 3056030 - RNA, 15 nt, Human
cuggguuggagggug

SEQ ID NO: 3056031 - RNA, 16 nt, Human
cugggucgcccuggac

SEQ ID NO: 3056032 - RNA, 18 nt, Human
cuggguacuuguggacac

SEQ ID NO: 3056033 - RNA, 14 nt, Human
cuggguacuugugg

SEQ ID NO: 3056034 - RNA, 16 nt, Human
cuggguacuuguggac

SEQ ID NO: 3056035 - RNA, 19 nt, Human
cugggcucccuucccaccu

SEQ ID NO: 3056036 - RNA, 20 nt, Human
cugggcucccuucccaccuc

SEQ ID NO: 3056037 - RNA, 21 nt, Human
cugggcucccuucccaccucu

SEQ ID NO: 3056038 - RNA, 22 nt, Human
cugggcucccuucccaccucuc

SEQ ID NO: 3056039 - RNA, 21 nt, Human
cugguccauagagagcaagac

SEQ ID NO: 3056040 - RNA, 23 nt, Human
cuggucucaaacucuugaccuca

SEQ ID NO: 3056041 - RNA, 13 nt, Human
cuggucccacuca

SEQ ID NO: 3056042 - RNA, 20 nt, Human
cuggaagugcuaauuuugaa

SEQ ID NO: 3056043 - RNA, 18 nt, Human
cuggaauauauaaccagu

SEQ ID NO: 3056044 - RNA, 14 nt, Human
cuggcaagaaugug

SEQ ID NO: 3056045 - RNA, 22 nt, Human
cuggcacccggccccugcuggu

SEQ ID NO: 3056046 - RNA, 18 nt, Human
cuggcacccggccccugc

SEQ ID NO: 3056047 - RNA, 17 nt, Human
cuggcacccggccccug

SEQ ID NO: 3056048 - RNA, 16 nt, Human
cuggcacccggccccu

SEQ ID NO: 3056049 - RNA, 22 nt, Human
cuggccagaugcaccagcccuu

SEQ ID NO: 3056050 - RNA, 24 nt, Human
cuggcaugggaaugaaugucagug

SEQ ID NO: 3056051 - RNA, 16 nt, Human
cuggcaugggaaugaa

SEQ ID NO: 3056052 - RNA, 18 nt, Human
cuggcaugggaaugaaug

SEQ ID NO: 3056053 - RNA, 19 nt, Human
cuggcaugggaaugaaugu

SEQ ID NO: 3056054 - RNA, 22 nt, Human
cuggcaugggaaugaaugucag

SEQ ID NO: 3056055 - RNA, 16 nt, Human
cuggcacuauaaugua

SEQ ID NO: 3056056 - RNA, 15 nt, Human
cuggcacuauaaugu

SEQ ID NO: 3056057 - RNA, 16 nt, Human
cuggccuggccccuca

SEQ ID NO: 3056058 - RNA, 17 nt, Human
cuggccuggccccucag

SEQ ID NO: 3056059 - RNA, 14 nt, Human
cuggccugugucua

SEQ ID NO: 3056060 - RNA, 15 nt, Human
cuggccuucggccuc

SEQ ID NO: 3056061 - RNA, 16 nt, Human
cuggccuucggccucc

SEQ ID NO: 3056062 - RNA, 17 nt, Human
cuggccuucggccucca

SEQ ID NO: 3056063 - RNA, 18 nt, Human
cuggccuucggccuccau

SEQ ID NO: 3056064 - RNA, 21 nt, Human
cuggccuucggccuccauccu

SEQ ID NO: 3056065 - RNA, 15 nt, Human
cuggccugagcuggg

SEQ ID NO: 3056066 - RNA, 18 nt, Human
cuggccugagcugggaug

SEQ ID NO: 3056067 - RNA, 14 nt, Human
cuggccuggccccu

SEQ ID NO: 3056068 - RNA, 13 nt, Human
cuggccuggcccc

SEQ ID NO: 3056069 - RNA, 13 nt, Human
cuggccucugcac

SEQ ID NO: 3056070 - RNA, 14 nt, Human
cuggccucugcacu

SEQ ID NO: 3056071 - RNA, 16 nt, Human
cuggccugagcuggga

SEQ ID NO: 3056072 - RNA, 22 nt, Human
cuggccucaagugauucuccug

SEQ ID NO: 3056073 - RNA, 12 nt, Human
cuggccucugca

SEQ ID NO: 3056074 - RNA, 23 nt, Human
cuggccucaagugauucuccugc

SEQ ID NO: 3056075 - RNA, 21 nt, Human
cugggaggcucuggagcccac

SEQ ID NO: 3056076 - RNA, 20 nt, Human
cugggaggcucuggagccca

SEQ ID NO: 3056077 - RNA, 18 nt, Human
cugggaggcucuggagcc

SEQ ID NO: 3056078 - RNA, 17 nt, Human
cugggaggcucuggagc

SEQ ID NO: 3056079 - RNA, 19 nt, Human
cugggaggucaaggcugca

SEQ ID NO: 3056080 - RNA, 21 nt, Human
cugggaggucaaggcugcagu

SEQ ID NO: 3056081 - RNA, 20 nt, Human
cugggaucccucauccucau

SEQ ID NO: 3056082 - RNA, 18 nt, Human
cugggaugauuggagggg

SEQ ID NO: 3056083 - RNA, 20 nt, Human
cugggauuacaggugugaac

SEQ ID NO: 3056084 - RNA, 17 nt, Human
cugggauuacaggugug

SEQ ID NO: 3056085 - RNA, 17 nt, Human
cuggcuguuggcugggg

SEQ ID NO: 3056086 - RNA, 16 nt, Human
cuggcuguuggcuggg

SEQ ID NO: 3056087 - RNA, 22 nt, Human
cuggcuggguggcaccagcagc

SEQ ID NO: 3056088 - RNA, 20 nt, Human
cuggcugguuagagguuccc

SEQ ID NO: 3056089 - RNA, 19 nt, Human
cugggagagccuuccaggg

SEQ ID NO: 3056090 - RNA, 20 nt, Human
cugggagagccuuccagggg

SEQ ID NO: 3056091 - RNA, 21 nt, Human
cugggagagccuuccaggggu

SEQ ID NO: 3056092 - RNA, 17 nt, Human
cugggagagccuuccag

SEQ ID NO: 3056093 - RNA, 18 nt, Human
cugggagagccuuccagg

SEQ ID NO: 3056094 - RNA, 20 nt, Human
cugggaaagggauuuucagc

SEQ ID NO: 3056095 - RNA, 12 nt, Human
cugcucugguua

SEQ ID NO: 3056096 - RNA, 23 nt, Human
cugcugccugcuuuuuauggccu

SEQ ID NO: 3056097 - RNA, 14 nt, Human
cugcugccugcuuu

SEQ ID NO: 3056098 - RNA, 14 nt, Human
cugcugcaguugcc

SEQ ID NO: 3056099 - RNA, 10 nt, Human
cugcugcagu

SEQ ID NO: 3056100 - RNA, 13 nt, Human
cugcugcaguugc

SEQ ID NO: 3056101 - RNA, 15 nt, Human
cugcucuccgaccag

SEQ ID NO: 3056102 - RNA, 20 nt, Human
cugcuccucuccccagcaag

SEQ ID NO: 3056103 - RNA, 19 nt, Human
cugcuccucuccccagcaa

SEQ ID NO: 3056104 - RNA, 23 nt, Human
cugcuccucuccccagcaaguga

SEQ ID NO: 3056105 - RNA, 20 nt, Human
cugcggugcuaucuccccca

SEQ ID NO: 3056106 - RNA, 21 nt, Human
cugcggugcuaucucccccag

SEQ ID NO: 3056107 - RNA, 22 nt, Human
cugcggugcuaucucccccagc

SEQ ID NO: 3056108 - RNA, 23 nt, Human
cugcggugcuaucucccccagcc

SEQ ID NO: 3056109 - RNA, 16 nt, Human
cugcucccaccuggcu

SEQ ID NO: 3056110 - RNA, 21 nt, Human
cugcgggggcagugcucaccc

SEQ ID NO: 3056111 - RNA, 17 nt, Human
cugcucccaccuggcuc

SEQ ID NO: 3056112 - RNA, 20 nt, Human
cugcucccaccuggcucugu

SEQ ID NO: 3056113 - RNA, 18 nt, Human
cugcucccaccuggcucu

SEQ ID NO: 3056114 - RNA, 19 nt, Human
cugcucccaccuggcucug

SEQ ID NO: 3056115 - RNA, 22 nt, Human
cugccugcuuuuuauggccugu

SEQ ID NO: 3056116 - RNA, 18 nt, Human
cugcgggggcagugcuca

SEQ ID NO: 3056117 - RNA, 18 nt, Human
cugcggugcuaucucccc

SEQ ID NO: 3056118 - RNA, 19 nt, Human
cugcggugcuaucuccccc

SEQ ID NO: 3056119 - RNA, 23 nt, Human
cugcgguccacccaggagccccg

SEQ ID NO: 3056120 - RNA, 20 nt, Human
cugcccugcccaccuggccu

SEQ ID NO: 3056121 - RNA, 17 nt, Human
cugcccugcccaccugg

SEQ ID NO: 3056122 - RNA, 21 nt, Human
cugcccugcccaccuggccuc

SEQ ID NO: 3056123 - RNA, 16 nt, Human
cugccugaagucacac

SEQ ID NO: 3056124 - RNA, 18 nt, Human
cugccugaagucacacag

SEQ ID NO: 3056125 - RNA, 19 nt, Human
cugccugaagucacacagu

SEQ ID NO: 3056126 - RNA, 13 nt, Human
cugcuugaggcaa

SEQ ID NO: 3056127 - RNA, 20 nt, Human
cugcuugaggcaacucaucu

SEQ ID NO: 3056128 - RNA, 21 nt, Human
cugcuugaggcaacucaucuu

SEQ ID NO: 3056129 - RNA, 17 nt, Human
cugcuggguguggcgca

SEQ ID NO: 3056130 - RNA, 14 nt, Human
cugcuggguguggc

SEQ ID NO: 3056131 - RNA, 15 nt, Human
cugcuggguguggcg

SEQ ID NO: 3056132 - RNA, 12 nt, Human
cugcugcuggcu

SEQ ID NO: 3056133 - RNA, 13 nt, Human
cugcugcuggcug

SEQ ID NO: 3056134 - RNA, 17 nt, Human
cugcuuuuggucugugu

SEQ ID NO: 3056135 - RNA, 15 nt, Human
cugcuuuuggucugu

SEQ ID NO: 3056136 - RNA, 20 nt, Human
cugcuugcuugcuuuuuaau

SEQ ID NO: 3056137 - RNA, 22 nt, Human
cugcuugaggcaacucaucuua

SEQ ID NO: 3056138 - RNA, 13 nt, Human
cugcuugggcuuc

SEQ ID NO: 3056139 - RNA, 15 nt, Human
cugcuugggcuucau

SEQ ID NO: 3056140 - RNA, 17 nt, Human
cugcuugggcuucaucc

SEQ ID NO: 3056141 - RNA, 18 nt, Human
cugcuugggcuucauccu

SEQ ID NO: 3056142 - RNA, 19 nt, Human
cugcuugggcuucauccuc

SEQ ID NO: 3056143 - RNA, 19 nt, Human
cugcuugugaaaggaaaga

SEQ ID NO: 3056144 - RNA, 22 nt, Human
cugcaggucccuaauaaagcug

SEQ ID NO: 3056145 - RNA, 21 nt, Human
cugcaggucccuaauaaagcu

SEQ ID NO: 3056146 - RNA, 20 nt, Human
cugcaggucccuaauaaagc

SEQ ID NO: 3056147 - RNA, 19 nt, Human
cugcaggucccuaauaaag

SEQ ID NO: 3056148 - RNA, 23 nt, Human
cugcaggucccuaauaaagcugu

SEQ ID NO: 3056149 - RNA, 13 nt, Human
cugcaguugccag

SEQ ID NO: 3056150 - RNA, 16 nt, Human
cugcaguugccaguca

SEQ ID NO: 3056151 - RNA, 18 nt, Human
cugcaggucccuaauaaa

SEQ ID NO: 3056152 - RNA, 17 nt, Human
cugcaggucccuaauaa

SEQ ID NO: 3056153 - RNA, 16 nt, Human
cugcaggucccuaaua

SEQ ID NO: 3056154 - RNA, 15 nt, Human
cugcaggucccuaau

SEQ ID NO: 3056155 - RNA, 14 nt, Human
cugcaggucccuaa

SEQ ID NO: 3056156 - RNA, 13 nt, Human
cugcaggucccua

SEQ ID NO: 3056157 - RNA, 12 nt, Human
cugcaggucccu

SEQ ID NO: 3056158 - RNA, 11 nt, Human
cugcagguccc

SEQ ID NO: 3056159 - RNA, 17 nt, Human
cugcagcaauaaagcag

SEQ ID NO: 3056160 - RNA, 10 nt, Human
cugcagaggg

SEQ ID NO: 3056161 - RNA, 16 nt, Human
cugcagcaauaaagca

SEQ ID NO: 3056162 - RNA, 15 nt, Human
cugcagcaauaaagc

SEQ ID NO: 3056163 - RNA, 13 nt, Human
cugcagagggcac

SEQ ID NO: 3056164 - RNA, 21 nt, Human
cugcacuccccugcugggugu

SEQ ID NO: 3056165 - RNA, 18 nt, Human
cugcacuccccugcuggg

SEQ ID NO: 3056166 - RNA, 12 nt, Human
cugcacugucaa

SEQ ID NO: 3056167 - RNA, 19 nt, Human
cugcacuccccugcugggu

SEQ ID NO: 3056168 - RNA, 20 nt, Human
cugcacuccccugcugggug

SEQ ID NO: 3056169 - RNA, 13 nt, Human
cugcacuccccug

SEQ ID NO: 3056170 - RNA, 20 nt, Human
cugcacuccagccuggguga

SEQ ID NO: 3056171 - RNA, 18 nt, Human
cugcaccgggccacagag

SEQ ID NO: 3056172 - RNA, 22 nt, Human
cugaggcccuucucuccagccc

SEQ ID NO: 3056173 - RNA, 23 nt, Human
cugaggcccuucucuccagcccc

SEQ ID NO: 3056174 - RNA, 14 nt, Human
cugcaccggcuggc

SEQ ID NO: 3056175 - RNA, 15 nt, Human
cugcaccggcuggcc

SEQ ID NO: 3056176 - RNA, 15 nt, Human
cugcaccgggccaca

SEQ ID NO: 3056177 - RNA, 14 nt, Human
cugcaccgggccac

SEQ ID NO: 3056178 - RNA, 12 nt, Human
cugccacccugg

SEQ ID NO: 3056179 - RNA, 21 nt, Human
cugccacccuggggagaaagu

SEQ ID NO: 3056180 - RNA, 20 nt, Human
cugcaucaagaugugacaug

SEQ ID NO: 3056181 - RNA, 15 nt, Human
cugcauaugaaagga

SEQ ID NO: 3056182 - RNA, 22 nt, Human
cugccaggaagccagcaggcuc

SEQ ID NO: 3056183 - RNA, 15 nt, Human
cugccauccucccaa

SEQ ID NO: 3056184 - RNA, 21 nt, Human
cugccauccagguucagcuug

SEQ ID NO: 3056185 - RNA, 23 nt, Human
cugccauccuggcccagggcauc

SEQ ID NO: 3056186 - RNA, 21 nt, Human
cugccauccuggcccagggca

SEQ ID NO: 3056187 - RNA, 22 nt, Human
cugccauccuggcccagggcau

SEQ ID NO: 3056188 - RNA, 13 nt, Human
cugccauccuggc

SEQ ID NO: 3056189 - RNA, 16 nt, Human
cugccauccuggccca

SEQ ID NO: 3056190 - RNA, 17 nt, Human
cugccauccuggcccag

SEQ ID NO: 3056191 - RNA, 18 nt, Human
cugccauccuggcccagg

SEQ ID NO: 3056192 - RNA, 19 nt, Human
cugccauccuggcccaggg

SEQ ID NO: 3056193 - RNA, 20 nt, Human
cugccauccuggcccagggc

SEQ ID NO: 3056194 - RNA, 13 nt, Human
cugccaggaagcc

SEQ ID NO: 3056195 - RNA, 14 nt, Human
cugccaggaagcca

SEQ ID NO: 3056196 - RNA, 20 nt, Human
cugccaggaagccagcaggc

SEQ ID NO: 3056197 - RNA, 21 nt, Human
cugccaggaagccagcaggcu

SEQ ID NO: 3056198 - RNA, 15 nt, Human
cugccagcaacgcag

SEQ ID NO: 3056199 - RNA, 13 nt, Human
cugcccggcaggg

SEQ ID NO: 3056200 - RNA, 18 nt, Human
cugccccuggcagccccu

SEQ ID NO: 3056201 - RNA, 17 nt, Human
cugccccuggcagcccc

SEQ ID NO: 3056202 - RNA, 19 nt, Human
cugccccuggcagccccug

SEQ ID NO: 3056203 - RNA, 15 nt, Human
cugccauuucugaga

SEQ ID NO: 3056204 - RNA, 15 nt, Human
cugcccaggccccug

SEQ ID NO: 3056205 - RNA, 14 nt, Human
cugcccaggccccu

SEQ ID NO: 3056206 - RNA, 12 nt, Human
cugcccaccugg

SEQ ID NO: 3056207 - RNA, 13 nt, Human
cugcccaggcccc

SEQ ID NO: 3056208 - RNA, 20 nt, Human
cugcccaggccccugccacc

SEQ ID NO: 3056209 - RNA, 19 nt, Human
cugcccaggccccugccac

SEQ ID NO: 3056210 - RNA, 18 nt, Human
cugcccaggccccugcca

SEQ ID NO: 3056211 - RNA, 16 nt, Human
cugcccaggccccugc

SEQ ID NO: 3056212 - RNA, 18 nt, Human
cucacuauguugcccagg

SEQ ID NO: 3056213 - RNA, 18 nt, Human
cuccauccugaggcucca

SEQ ID NO: 3056214 - RNA, 14 nt, Human
cuccauccugaggc

SEQ ID NO: 3056215 - RNA, 16 nt, Human
cuccauccugaggcuc

SEQ ID NO: 3056216 - RNA, 13 nt, Human
cuccaugugggcu

SEQ ID NO: 3056217 - RNA, 17 nt, Human
cucccaaagugcuggga

SEQ ID NO: 3056218 - RNA, 21 nt, Human
cucccaucucacacaugagca

SEQ ID NO: 3056219 - RNA, 11 nt, Human
cucccaucugu

SEQ ID NO: 3056220 - RNA, 14 nt, Human
cucccaucugugaa

SEQ ID NO: 3056221 - RNA, 15 nt, Human
cucccaucugugaaa

SEQ ID NO: 3056222 - RNA, 18 nt, Human
cucccaucugugaaagga

SEQ ID NO: 3056223 - RNA, 23 nt, Human
cucccaucugugaaaggaaagag

SEQ ID NO: 3056224 - RNA, 16 nt, Human
cucccaacucacccca

SEQ ID NO: 3056225 - RNA, 17 nt, Human
cucccaacucaccccag

SEQ ID NO: 3056226 - RNA, 18 nt, Human
cucccaaagugcugggau

SEQ ID NO: 3056227 - RNA, 22 nt, Human
cucccaacucaccccagcccca

SEQ ID NO: 3056228 - RNA, 12 nt, Human
cuccccugcugg

SEQ ID NO: 3056229 - RNA, 20 nt, Human
cuccccagccccaucccaaa

SEQ ID NO: 3056230 - RNA, 20 nt, Human
cuccccagcaagugagagcu

SEQ ID NO: 3056231 - RNA, 12 nt, Human
cuccccagcaag

SEQ ID NO: 3056232 - RNA, 18 nt, Human
cucccaugagggagaugc

SEQ ID NO: 3056233 - RNA, 20 nt, Human
cucccaugagggagaugcca

SEQ ID NO: 3056234 - RNA, 22 nt, Human
cucccaugagggagaugccaug

SEQ ID NO: 3056235 - RNA, 17 nt, Human
cucccgaguagcuggga

SEQ ID NO: 3056236 - RNA, 16 nt, Human
cucccgaguagcuggg

SEQ ID NO: 3056237 - RNA, 18 nt, Human
cucccgaauagcugggac

SEQ ID NO: 3056238 - RNA, 15 nt, Human
cucccgaguagcugg

SEQ ID NO: 3056239 - RNA, 13 nt, Human
cuccccugcuggg

SEQ ID NO: 3056240 - RNA, 16 nt, Human
cucccgaauagcuggg

SEQ ID NO: 3056241 - RNA, 17 nt, Human
cucccgaauagcuggga

SEQ ID NO: 3056242 - RNA, 22 nt, Human
cuccucuccccagcaagugaga

SEQ ID NO: 3056243 - RNA, 22 nt, Human
cuccuccagccgccaugcuccu

SEQ ID NO: 3056244 - RNA, 17 nt, Human
cucccuuucuucccuac

SEQ ID NO: 3056245 - RNA, 18 nt, Human
cucccucagucuggcccu

SEQ ID NO: 3056246 - RNA, 15 nt, Human
cuccgaccagacacc

SEQ ID NO: 3056247 - RNA, 15 nt, Human
cuccugccucagccu

SEQ ID NO: 3056248 - RNA, 22 nt, Human
cuccugccucgaacuggcugca

SEQ ID NO: 3056249 - RNA, 19 nt, Human
cuccugugugugcgccuac

SEQ ID NO: 3056250 - RNA, 16 nt, Human
cuccugugugugcgcc

SEQ ID NO: 3056251 - RNA, 11 nt, Human
cuccugcaggc

SEQ ID NO: 3056252 - RNA, 16 nt, Human
cuccugcaggcagcca

SEQ ID NO: 3056253 - RNA, 17 nt, Human
cuccugcaggcagccag

SEQ ID NO: 3056254 - RNA, 14 nt, Human
cuccugccucagcc

SEQ ID NO: 3056255 - RNA, 13 nt, Human
cuccugccucagc

SEQ ID NO: 3056256 - RNA, 11 nt, Human
cuccugcccuu

SEQ ID NO: 3056257 - RNA, 18 nt, Human
cuccugcaggcagccagg

SEQ ID NO: 3056258 - RNA, 20 nt, Human
cuccugcaggcagccaggcc

SEQ ID NO: 3056259 - RNA, 13 nt, Human
cucuacccuggca

SEQ ID NO: 3056260 - RNA, 20 nt, Human
cucuaccauccccuguagag

SEQ ID NO: 3056261 - RNA, 23 nt, Human
cucuagggaaaaaccagcgugug

SEQ ID NO: 3056262 - RNA, 17 nt, Human
cucuaggaaauauuuau

SEQ ID NO: 3056263 - RNA, 15 nt, Human
cucuaggaaauauuu

SEQ ID NO: 3056264 - RNA, 16 nt, Human
cuccuucacagauggg

SEQ ID NO: 3056265 - RNA, 17 nt, Human
cuccuucacagaugggu

SEQ ID NO: 3056266 - RNA, 14 nt, Human
cuccugugugugcg

SEQ ID NO: 3056267 - RNA, 20 nt, Human
cuccugugugugcgccuaca

SEQ ID NO: 3056268 - RNA, 19 nt, Human
cuccuucacagaugggugc

SEQ ID NO: 3056269 - RNA, 13 nt, Human
cucuacaaaaagc

SEQ ID NO: 3056270 - RNA, 16 nt, Human
cucuacagaggccaug

SEQ ID NO: 3056271 - RNA, 14 nt, Human
cucuacagaggcca

SEQ ID NO: 3056272 - RNA, 19 nt, Human
cucuacagaggccaugggc

SEQ ID NO: 3056273 - RNA, 13 nt, Human
cucuacagaggcc

SEQ ID NO: 3056274 - RNA, 21 nt, Human
cucuccugauagucuuucagu

SEQ ID NO: 3056275 - RNA, 13 nt, Human
cucuccucugcug

SEQ ID NO: 3056276 - RNA, 14 nt, Human
cucuccucugcugc

SEQ ID NO: 3056277 - RNA, 15 nt, Human
cucuccucugcugcu

SEQ ID NO: 3056278 - RNA, 18 nt, Human
cucuccucugcugcuggc

SEQ ID NO: 3056279 - RNA, 13 nt, Human
cucuccccagcaa

SEQ ID NO: 3056280 - RNA, 19 nt, Human
cucuccagccccuggaugc

SEQ ID NO: 3056281 - RNA, 12 nt, Human
cucuccucugcu

SEQ ID NO: 3056282 - RNA, 24 nt, Human
cucuccccagcaagugagagcugg

SEQ ID NO: 3056283 - RNA, 22 nt, Human
cucuccccagcaagugagagcu

SEQ ID NO: 3056284 - RNA, 14 nt, Human
cucuccccagcaag

SEQ ID NO: 3056285 - RNA, 12 nt, Human
cucucucacucc

SEQ ID NO: 3056286 - RNA, 13 nt, Human
cucucucaggcca

SEQ ID NO: 3056287 - RNA, 14 nt, Human
cucuccagccccug

SEQ ID NO: 3056288 - RNA, 15 nt, Human
cucuccagccccugg

SEQ ID NO: 3056289 - RNA, 16 nt, Human
cucuccagccccugga

SEQ ID NO: 3056290 - RNA, 17 nt, Human
cucuccagccccuggau

SEQ ID NO: 3056291 - RNA, 18 nt, Human
cucuccagccccuggaug

SEQ ID NO: 3056292 - RNA, 17 nt, Human
cucucaggccagcugcu

SEQ ID NO: 3056293 - RNA, 18 nt, Human
cucucaggccagcugcuu

SEQ ID NO: 3056294 - RNA, 19 nt, Human
cucucaggccagcugcuug

SEQ ID NO: 3056295 - RNA, 21 nt, Human
cucucaggccagcugcuuggg

SEQ ID NO: 3056296 - RNA, 22 nt, Human
cucucaggccaaacucaccugc

SEQ ID NO: 3056297 - RNA, 23 nt, Human
cucucaggccaaacucaccugcc

SEQ ID NO: 3056298 - RNA, 13 nt, Human
cucucaggccagc

SEQ ID NO: 3056299 - RNA, 15 nt, Human
cucucaggccagcug

SEQ ID NO: 3056300 - RNA, 20 nt, Human
cucucaggccaaacucaccu

SEQ ID NO: 3056301 - RNA, 21 nt, Human
cucucaggccaaacucaccug

SEQ ID NO: 3056302 - RNA, 12 nt, Human
cucucaggccaa

SEQ ID NO: 3056303 - RNA, 21 nt, Human
cucuaguuugauuaaauucuu

SEQ ID NO: 3056304 - RNA, 20 nt, Human
cucuaguuugauuaaauucu

SEQ ID NO: 3056305 - RNA, 19 nt, Human
cucuaguuugauuaaauuc

SEQ ID NO: 3056306 - RNA, 15 nt, Human
cucuaguuugauuaa

SEQ ID NO: 3056307 - RNA, 11 nt, Human
cugacagauuu

SEQ ID NO: 3056308 - RNA, 15 nt, Human
cugacagauuuccau

SEQ ID NO: 3056309 - RNA, 21 nt, Human
cugacaggcaaugcuggcugu

SEQ ID NO: 3056310 - RNA, 21 nt, Human
cugacauuguuggccaaagcc

SEQ ID NO: 3056311 - RNA, 13 nt, Human
cugacccaugcug

SEQ ID NO: 3056312 - RNA, 14 nt, Human
cugacccacugcuu

SEQ ID NO: 3056313 - RNA, 13 nt, Human
cugacccacugcu

SEQ ID NO: 3056314 - RNA, 14 nt, Human
cugacccaugcugc

SEQ ID NO: 3056315 - RNA, 15 nt, Human
cugacccaugcugcc

SEQ ID NO: 3056316 - RNA, 16 nt, Human
cugacccaugcugccc

SEQ ID NO: 3056317 - RNA, 12 nt, Human
cugacccacugc

SEQ ID NO: 3056318 - RNA, 22 nt, Human
cugacauuguuggccaaagcca

SEQ ID NO: 3056319 - RNA, 15 nt, Human
cugacuaugacauaa

SEQ ID NO: 3056320 - RNA, 16 nt, Human
cugacuguuuucucuu

SEQ ID NO: 3056321 - RNA, 17 nt, Human
cugacucuuaagaagac

SEQ ID NO: 3056322 - RNA, 18 nt, Human
cugacuguuuucucuuga

SEQ ID NO: 3056323 - RNA, 15 nt, Human
cugacuucuaaguaa

SEQ ID NO: 3056324 - RNA, 13 nt, Human
cugacuucuaagu

SEQ ID NO: 3056325 - RNA, 16 nt, Human
cugacuucuaaguaaa

SEQ ID NO: 3056326 - RNA, 14 nt, Human
cugagaaauuuaua

SEQ ID NO: 3056327 - RNA, 11 nt, Human
cugagaaauuu

SEQ ID NO: 3056328 - RNA, 23 nt, Human
cugagaaagacuauucaaacagu

SEQ ID NO: 3056329 - RNA, 22 nt, Human
cugagaaagacuauucaaacag

SEQ ID NO: 3056330 - RNA, 14 nt, Human
cugagacagcccgg

SEQ ID NO: 3056331 - RNA, 15 nt, Human
cugagacagcccggg

SEQ ID NO: 3056332 - RNA, 17 nt, Human
cugaggaucagaguaau

SEQ ID NO: 3056333 - RNA, 19 nt, Human
cugaggaucagaguaaucc

SEQ ID NO: 3056334 - RNA, 12 nt, Human
cugaggcccaga

SEQ ID NO: 3056335 - RNA, 13 nt, Human
cugaggcccagag

SEQ ID NO: 3056336 - RNA, 14 nt, Human
cugaggcccagagg

SEQ ID NO: 3056337 - RNA, 15 nt, Human
cugaggcccagaggg

SEQ ID NO: 3056338 - RNA, 16 nt, Human
cugaggcccagagggc

SEQ ID NO: 3056339 - RNA, 17 nt, Human
cugaggcccagagggcc

SEQ ID NO: 3056340 - RNA, 18 nt, Human
cugaggcccagagggccu

SEQ ID NO: 3056341 - RNA, 19 nt, Human
cugaggcccagagggccug

SEQ ID NO: 3056342 - RNA, 21 nt, Human
cugaggcccagagggccugca

SEQ ID NO: 3056343 - RNA, 23 nt, Human
cugaggcccagagggccugcaag

SEQ ID NO: 3056344 - RNA, 14 nt, Human
cugaggcccuucuc

SEQ ID NO: 3056345 - RNA, 15 nt, Human
cugaggcccuucucu

SEQ ID NO: 3056346 - RNA, 18 nt, Human
cugaggcccuucucucca

SEQ ID NO: 3056347 - RNA, 19 nt, Human
cugaggcccuucucuccag

SEQ ID NO: 3056348 - RNA, 20 nt, Human
cugaggcccuucucuccagc

SEQ ID NO: 3056349 - RNA, 16 nt, Human
cugagacagcccgggc

SEQ ID NO: 3056350 - RNA, 17 nt, Human
cugagacagcccgggcu

SEQ ID NO: 3056351 - RNA, 18 nt, Human
cugagacagcccgggcuc

SEQ ID NO: 3056352 - RNA, 17 nt, Human
cugagccagauuucacu

SEQ ID NO: 3056353 - RNA, 18 nt, Human
cugagccagauuucacuc

SEQ ID NO: 3056354 - RNA, 19 nt, Human
cugagccagauuucacucu

SEQ ID NO: 3056355 - RNA, 20 nt, Human
cugagccagauuucacucuc

SEQ ID NO: 3056356 - RNA, 21 nt, Human
cugagccagauuucacucucc

SEQ ID NO: 3056357 - RNA, 15 nt, Human
cugagccagauuuca

SEQ ID NO: 3056358 - RNA, 16 nt, Human
cugagcgacagugaga

SEQ ID NO: 3056359 - RNA, 20 nt, Human
cugagcgacagugagacucu

SEQ ID NO: 3056360 - RNA, 19 nt, Human
cucuggagcccacuguacu

SEQ ID NO: 3056361 - RNA, 14 nt, Human
cucuggacaggcau

SEQ ID NO: 3056362 - RNA, 22 nt, Human
cucuggacaggcauguucucug

SEQ ID NO: 3056363 - RNA, 16 nt, Human
cucuggacaggcaugu

SEQ ID NO: 3056364 - RNA, 12 nt, Human
cucuggcagcuc

SEQ ID NO: 3056365 - RNA, 14 nt, Human
cucuggcagcucag

SEQ ID NO: 3056366 - RNA, 15 nt, Human
cucuggcagcucaga

SEQ ID NO: 3056367 - RNA, 16 nt, Human
cucuggcagcucagag

SEQ ID NO: 3056368 - RNA, 12 nt, Human
cucuggccuucg

SEQ ID NO: 3056369 - RNA, 19 nt, Human
cucuggccuucggccucca

SEQ ID NO: 3056370 - RNA, 15 nt, Human
cucuggacaggcaug

SEQ ID NO: 3056371 - RNA, 21 nt, Human
cucugccugaagucacacagu

SEQ ID NO: 3056372 - RNA, 10 nt, Human
cucugccuga

SEQ ID NO: 3056373 - RNA, 22 nt, Human
cucugccugaagucacacagug

SEQ ID NO: 3056374 - RNA, 13 nt, Human
cucucuccucccu

SEQ ID NO: 3056375 - RNA, 15 nt, Human
cucugugucaggugg

SEQ ID NO: 3056376 - RNA, 16 nt, Human
cucuguggcgagccau

SEQ ID NO: 3056377 - RNA, 13 nt, Human
cucuuagaaaaac

SEQ ID NO: 3056378 - RNA, 15 nt, Human
cucuuagaaaaacca

SEQ ID NO: 3056379 - RNA, 14 nt, Human
cucuuccaggcugg

SEQ ID NO: 3056380 - RNA, 15 nt, Human
cucuuccaggcuggg

SEQ ID NO: 3056381 - RNA, 13 nt, Human
cucuuccaggcug

SEQ ID NO: 3056382 - RNA, 19 nt, Human
cucuuggguucaagcgauu

SEQ ID NO: 3056383 - RNA, 21 nt, Human
cucuuggguucaagcgauucu

SEQ ID NO: 3056384 - RNA, 22 nt, Human
cucuugaaauauaggaacuuaa

SEQ ID NO: 3056385 - RNA, 22 nt, Human
cucuucuuuaaagggauggcaa

SEQ ID NO: 3056386 - RNA, 17 nt, Human
cucuuucccucccuucc

SEQ ID NO: 3056387 - RNA, 13 nt, Human
cucuuucccuccc

SEQ ID NO: 3056388 - RNA, 23 nt, Human
cucuuuaaugucacaggcagguc

SEQ ID NO: 3056389 - RNA, 22 nt, Human
cucuuuaaugucacaggcaggu

SEQ ID NO: 3056390 - RNA, 21 nt, Human
cucuuuaaugucacaggcagg

SEQ ID NO: 3056391 - RNA, 20 nt, Human
cucuuuaaugucacaggcag

SEQ ID NO: 3056392 - RNA, 13 nt, Human
cucuugguccugc

SEQ ID NO: 3056393 - RNA, 15 nt, Human
cucuugguccugcug

SEQ ID NO: 3056394 - RNA, 16 nt, Human
cucuugguccugcugc

SEQ ID NO: 3056395 - RNA, 18 nt, Human
cucuuuaaugucacaggc

SEQ ID NO: 3056396 - RNA, 19 nt, Human
cugaagaauugaaaaacca

SEQ ID NO: 3056397 - RNA, 14 nt, Human
cugaagaagauggu

SEQ ID NO: 3056398 - RNA, 23 nt, Human
cugaagaagcaccaaucaugaau

SEQ ID NO: 3056399 - RNA, 13 nt, Human
cugaaauuuccug

SEQ ID NO: 3056400 - RNA, 23 nt, Human
cugaaauuuccugggagcuuuug

SEQ ID NO: 3056401 - RNA, 16 nt, Human
cugaaauuuccuggga

SEQ ID NO: 3056402 - RNA, 15 nt, Human
cugaaagcccugagc

SEQ ID NO: 3056403 - RNA, 16 nt, Human
cugaaagcccugagcu

SEQ ID NO: 3056404 - RNA, 17 nt, Human
cugaaagcccugagcuu

SEQ ID NO: 3056405 - RNA, 18 nt, Human
cugaaagcccugagcuuu

SEQ ID NO: 3056406 - RNA, 19 nt, Human
cugaaagcccugagcuuuc

SEQ ID NO: 3056407 - RNA, 23 nt, Human
cugaaagcccugagcuuucugcu

SEQ ID NO: 3056408 - RNA, 21 nt, Human
cugaaauaaacgucuuaaaua

SEQ ID NO: 3056409 - RNA, 16 nt, Human
cgcccuggacugugug

SEQ ID NO: 3056410 - RNA, 22 nt, Human
cgcccaggcuuagucacugaga

SEQ ID NO: 3056411 - RNA, 21 nt, Human
cgccccucccacagcgcuggc

SEQ ID NO: 3056412 - RNA, 19 nt, Human
cgccccucccacagcgcug

SEQ ID NO: 3056413 - RNA, 23 nt, Human
cgccaggggaaaaucagccugcu

SEQ ID NO: 3056414 - RNA, 14 nt, Human
cgccaucccagccc

SEQ ID NO: 3056415 - RNA, 16 nt, Human
cgccaucccagcccca

SEQ ID NO: 3056416 - RNA, 17 nt, Human
ccucugcccacucccug

SEQ ID NO: 3056417 - RNA, 19 nt, Human
ccucugcccacucccugca

SEQ ID NO: 3056418 - RNA, 20 nt, Human
ccucugcccacucccugcaa

SEQ ID NO: 3056419 - RNA, 22 nt, Human
cgccagauucuuuccugaggcu

SEQ ID NO: 3056420 - RNA, 22 nt, Human
cgcugucagccauuccuguucc

SEQ ID NO: 3056421 - RNA, 18 nt, Human
cgcucucuggccuucggc

SEQ ID NO: 3056422 - RNA, 16 nt, Human
cgcugugcugcccugc

SEQ ID NO: 3056423 - RNA, 17 nt, Human
cgcugugcugcccugcc

SEQ ID NO: 3056424 - RNA, 15 nt, Human
cgcugugcugcccug

SEQ ID NO: 3056425 - RNA, 20 nt, Human
cggaaaacaugcuacacacu

SEQ ID NO: 3056426 - RNA, 15 nt, Human
cggaaaacaugcuac

SEQ ID NO: 3056427 - RNA, 16 nt, Human
cgcuacccgggaaggg

SEQ ID NO: 3056428 - RNA, 14 nt, Human
cgcucucuggccuu

SEQ ID NO: 3056429 - RNA, 15 nt, Human
cgcucucuggccuuc

SEQ ID NO: 3056430 - RNA, 22 nt, Human
cgcuaagagggagggagggcuc

SEQ ID NO: 3056431 - RNA, 21 nt, Human
cgcuaagagggagggagggcu

SEQ ID NO: 3056432 - RNA, 12 nt, Human
cggccuccaucc

SEQ ID NO: 3056433 - RNA, 24 nt, Human
cggccaggccagagggagugacag

SEQ ID NO: 3056434 - RNA, 19 nt, Human
cggccccugcugguucagg

SEQ ID NO: 3056435 - RNA, 18 nt, Human
cggccccugcugguucag

SEQ ID NO: 3056436 - RNA, 13 nt, Human
cggccccugcugg

SEQ ID NO: 3056437 - RNA, 13 nt, Human
cggaagagccuug

SEQ ID NO: 3056438 - RNA, 11 nt, Human
cggccaccugc

SEQ ID NO: 3056439 - RNA, 15 nt, Human
cggccaccugcggug

SEQ ID NO: 3056440 - RNA, 16 nt, Human
cggccaccugcggugc

SEQ ID NO: 3056441 - RNA, 17 nt, Human
cggccaccugcggugcu

SEQ ID NO: 3056442 - RNA, 17 nt, Human
cggugagcuacaaaugc

SEQ ID NO: 3056443 - RNA, 21 nt, Human
cggugagaggggaacagacug

SEQ ID NO: 3056444 - RNA, 20 nt, Human
cggugagaggggaacagacu

SEQ ID NO: 3056445 - RNA, 22 nt, Human
cggucggguuuuauuguuuaaa

SEQ ID NO: 3056446 - RNA, 20 nt, Human
cgguccacccaggagccccg

SEQ ID NO: 3056447 - RNA, 16 nt, Human
cgguccacccaggagc

SEQ ID NO: 3056448 - RNA, 15 nt, Human
cgguccacccaggag

SEQ ID NO: 3056449 - RNA, 14 nt, Human
cgguccacccagga

SEQ ID NO: 3056450 - RNA, 21 nt, Human
cggguuuuauuguuuaaaauc

SEQ ID NO: 3056451 - RNA, 23 nt, Human
cggcuggccuggccccucagggu

SEQ ID NO: 3056452 - RNA, 22 nt, Human
cggcuggccuggccccucaggg

SEQ ID NO: 3056453 - RNA, 19 nt, Human
cggcuggccuggccccuca

SEQ ID NO: 3056454 - RNA, 22 nt, Human
cgggcacucagaagacacugau

SEQ ID NO: 3056455 - RNA, 14 nt, Human
cgggcacucagaag

SEQ ID NO: 3056456 - RNA, 22 nt, Human
cggggacagcuccuucuguccu

SEQ ID NO: 3056457 - RNA, 18 nt, Human
cgggaggucgaggcagga

SEQ ID NO: 3056458 - RNA, 20 nt, Human
cgggaggucgaggcaggagg

SEQ ID NO: 3056459 - RNA, 15 nt, Human
cgggggcagagaggg

SEQ ID NO: 3056460 - RNA, 14 nt, Human
cgggggcagugcuc

SEQ ID NO: 3056461 - RNA, 22 nt, Human
cgggggcagugcucacccacac

SEQ ID NO: 3056462 - RNA, 23 nt, Human
cggggacagcuccuucuguccua

SEQ ID NO: 3056463 - RNA, 17 nt, Human
cguggcugcuucaagga

SEQ ID NO: 3056464 - RNA, 22 nt, Human
cggugcuaucucccccagcccc

SEQ ID NO: 3056465 - RNA, 20 nt, Human
cggugcuaucucccccagcc

SEQ ID NO: 3056466 - RNA, 21 nt, Human
cggugcuaucucccccagccc

SEQ ID NO: 3056467 - RNA, 18 nt, Human
cggugcuaucucccccag

SEQ ID NO: 3056468 - RNA, 16 nt, Human
cgucucauacucaccu

SEQ ID NO: 3056469 - RNA, 16 nt, Human
cgucuaccugaggggc

SEQ ID NO: 3056470 - RNA, 14 nt, Human
cgucuccagcugcu

SEQ ID NO: 3056471 - RNA, 16 nt, Human
cgugcacacaccagag

SEQ ID NO: 3056472 - RNA, 22 nt, Human
cgucugacaggcaaugcuggcu

SEQ ID NO: 3056473 - RNA, 21 nt, Human
cgucugacaggcaaugcuggc

SEQ ID NO: 3056474 - RNA, 20 nt, Human
cgucugacaggcaaugcugg

SEQ ID NO: 3056475 - RNA, 23 nt, Human
cgugcauaccacuuuuguucuug

SEQ ID NO: 3056476 - RNA, 21 nt, Human
cgugcaguggugcgaucuggg

SEQ ID NO: 3056477 - RNA, 19 nt, Human
cgugcacacaccagagccc

SEQ ID NO: 3056478 - RNA, 18 nt, Human
cgugcacacaccagagcc

SEQ ID NO: 3056479 - RNA, 14 nt, Human
cgugcacacaccag

SEQ ID NO: 3056480 - RNA, 18 nt, Human
cgugcacgcacacugucu

SEQ ID NO: 3056481 - RNA, 23 nt, Human
cuaaauuugaauguuaagcagau

SEQ ID NO: 3056482 - RNA, 15 nt, Human
cuaacaugauuuggg

SEQ ID NO: 3056483 - RNA, 15 nt, Human
cuaacauggaaguac

SEQ ID NO: 3056484 - RNA, 17 nt, Human
cuaacauggaaguacua

SEQ ID NO: 3056485 - RNA, 16 nt, Human
cuaaauguugaaagau

SEQ ID NO: 3056486 - RNA, 23 nt, Human
cuaaauugacacuuaaaaauggu

SEQ ID NO: 3056487 - RNA, 20 nt, Human
cuaaauauauuuuaagacga

SEQ ID NO: 3056488 - RNA, 18 nt, Human
cuaaauauauuuuaagac

SEQ ID NO: 3056489 - RNA, 17 nt, Human
cuaaauauauuuuaaga

SEQ ID NO: 3056490 - RNA, 18 nt, Human
cuaaauggaaccacucua

SEQ ID NO: 3056491 - RNA, 17 nt, Human
cuaaauggaaccacucu

SEQ ID NO: 3056492 - RNA, 16 nt, Human
cuaaauggaaccacuc

SEQ ID NO: 3056493 - RNA, 15 nt, Human
cuaaauggaaccacu

SEQ ID NO: 3056494 - RNA, 22 nt, Human
cuauuuuaauaaacacucuuga

SEQ ID NO: 3056495 - RNA, 18 nt, Human
cuauuuuaauaaacacuc

SEQ ID NO: 3056496 - RNA, 14 nt, Human
cuaugcauuugaaa

SEQ ID NO: 3056497 - RNA, 19 nt, Human
cucaacucuccuccagagu

SEQ ID NO: 3056498 - RNA, 20 nt, Human
cucaacucuccuccagaguc

SEQ ID NO: 3056499 - RNA, 21 nt, Human
cucaacucuccuccagaguca

SEQ ID NO: 3056500 - RNA, 17 nt, Human
cucacuauguugcccag

SEQ ID NO: 3056501 - RNA, 16 nt, Human
cucacuauguugccca

SEQ ID NO: 3056502 - RNA, 17 nt, Human
cucaccccuugccauaa

SEQ ID NO: 3056503 - RNA, 12 nt, Human
cucaccccagcc

SEQ ID NO: 3056504 - RNA, 13 nt, Human
cucaccccagccc

SEQ ID NO: 3056505 - RNA, 19 nt, Human
cucaccagccccagugccc

SEQ ID NO: 3056506 - RNA, 21 nt, Human
cucaccagccccagugcccac

SEQ ID NO: 3056507 - RNA, 20 nt, Human
cucaccagccccagugccca

SEQ ID NO: 3056508 - RNA, 20 nt, Human
cucaagugauucuccugccu

SEQ ID NO: 3056509 - RNA, 19 nt, Human
cucaagugauucuccugcc

SEQ ID NO: 3056510 - RNA, 18 nt, Human
cucaagugauucuccugc

SEQ ID NO: 3056511 - RNA, 23 nt, Human
cucacaguccuuaccagcagagc

SEQ ID NO: 3056512 - RNA, 21 nt, Human
cuaugacauaaaaacaacuuu

SEQ ID NO: 3056513 - RNA, 12 nt, Human
cuaugcauuuga

SEQ ID NO: 3056514 - RNA, 11 nt, Human
cuaugcauuug

SEQ ID NO: 3056515 - RNA, 20 nt, Human
cuaucaaguauuauaccuuu

SEQ ID NO: 3056516 - RNA, 22 nt, Human
cuauauuuuuuguuaaaugauu

SEQ ID NO: 3056517 - RNA, 18 nt, Human
cuaugacauaaaaacaac

SEQ ID NO: 3056518 - RNA, 14 nt, Human
cuaugacacaugca

SEQ ID NO: 3056519 - RNA, 13 nt, Human
cuaugaaauauua

SEQ ID NO: 3056520 - RNA, 23 nt, Human
cuauauuguuuucaguguacaug

SEQ ID NO: 3056521 - RNA, 20 nt, Human
cuauauuuuuuguuaaauga

SEQ ID NO: 3056522 - RNA, 22 nt, Human
cuauauuguuuucaguguacau

SEQ ID NO: 3056523 - RNA, 19 nt, Human
cuauauuguuugcuaagca

SEQ ID NO: 3056524 - RNA, 18 nt, Human
cuauauuguuugcuaagc

SEQ ID NO: 3056525 - RNA, 16 nt, Human
cuaguaugaaauuaua

SEQ ID NO: 3056526 - RNA, 23 nt, Human
cuaguaucaaaagaaagaaaauc

SEQ ID NO: 3056527 - RNA, 15 nt, Human
cuaguaucaaaagaa

SEQ ID NO: 3056528 - RNA, 17 nt, Human
cuaguaucaaaagaaag

SEQ ID NO: 3056529 - RNA, 22 nt, Human
cuaguauuucuaugaaauauua

SEQ ID NO: 3056530 - RNA, 19 nt, Human
cuaguauuucuaugaaaua

SEQ ID NO: 3056531 - RNA, 20 nt, Human
cuaguauuucuaugaaauau

SEQ ID NO: 3056532 - RNA, 21 nt, Human
cuaggcauuugcugaauacag

SEQ ID NO: 3056533 - RNA, 21 nt, Human
cuagugugguguuuccuggca

SEQ ID NO: 3056534 - RNA, 22 nt, Human
cuagugugguguuuccuggcac

SEQ ID NO: 3056535 - RNA, 23 nt, Human
cuagugugguguuuccuggcacu

SEQ ID NO: 3056536 - RNA, 19 nt, Human
cuagugugguguuuccugg

SEQ ID NO: 3056537 - RNA, 21 nt, Human
cuaggaagacuuuggaaagag

SEQ ID NO: 3056538 - RNA, 13 nt, Human
cuaggaacacucc

SEQ ID NO: 3056539 - RNA, 15 nt, Human
cuaggaacacuccuu

SEQ ID NO: 3056540 - RNA, 22 nt, Human
cuaggaaauauuuauuuuaaua

SEQ ID NO: 3056541 - RNA, 17 nt, Human
cuaggaggucucuaaga

SEQ ID NO: 3056542 - RNA, 22 nt, Human
cuaggaccccuccaugugggcu

SEQ ID NO: 3056543 - RNA, 20 nt, Human
cuaggacccgucuccagcug

SEQ ID NO: 3056544 - RNA, 21 nt, Human
cuaggacccgucuccagcugc

SEQ ID NO: 3056545 - RNA, 22 nt, Human
cuaggacccgucuccagcugcu

SEQ ID NO: 3056546 - RNA, 23 nt, Human
cuaggacccgucuccagcugcug

SEQ ID NO: 3056547 - RNA, 22 nt, Human
cuaggacugaauuaugaaacuu

SEQ ID NO: 3056548 - RNA, 21 nt, Human
cuacuguaaggcaaucauggu

SEQ ID NO: 3056549 - RNA, 16 nt, Human
cuacuguaauuuguga

SEQ ID NO: 3056550 - RNA, 17 nt, Human
cuacuguaauuugugau

SEQ ID NO: 3056551 - RNA, 14 nt, Human
cuacugaggugcua

SEQ ID NO: 3056552 - RNA, 14 nt, Human
cuacccgggaaggg

SEQ ID NO: 3056553 - RNA, 15 nt, Human
cuacccgggaagggg

SEQ ID NO: 3056554 - RNA, 20 nt, Human
cuacccgggaagggggcugg

SEQ ID NO: 3056555 - RNA, 21 nt, Human
cuacccgggaagggggcuggg

SEQ ID NO: 3056556 - RNA, 21 nt, Human
cuacucugugucagguggggc

SEQ ID NO: 3056557 - RNA, 16 nt, Human
cuacucugugucaggu

SEQ ID NO: 3056558 - RNA, 13 nt, Human
cuacucuguguca

SEQ ID NO: 3056559 - RNA, 22 nt, Human
cuacuuauuguagcauccugga

SEQ ID NO: 3056560 - RNA, 15 nt, Human
cuacuugggaggcug

SEQ ID NO: 3056561 - RNA, 18 nt, Human
cuacuugggaggcugaga

SEQ ID NO: 3056562 - RNA, 19 nt, Human
cuacuugggaggcugagau

SEQ ID NO: 3056563 - RNA, 17 nt, Human
cuagcacuuugggaggc

SEQ ID NO: 3056564 - RNA, 17 nt, Human
cuagagugaacuugggc

SEQ ID NO: 3056565 - RNA, 21 nt, Human
cuagagugaacuugggccacu

SEQ ID NO: 3056566 - RNA, 20 nt, Human
cuagacgagcaggcuucuuc

SEQ ID NO: 3056567 - RNA, 21 nt, Human
cuagacgagcaggcuucuucc

SEQ ID NO: 3056568 - RNA, 13 nt, Human
cuaauaaagcugu

SEQ ID NO: 3056569 - RNA, 18 nt, Human
cuaauauguaacaagcca

SEQ ID NO: 3056570 - RNA, 12 nt, Human
cuaauaaagcug

SEQ ID NO: 3056571 - RNA, 21 nt, Human
cuaauaaaauuuaaaagucuu

SEQ ID NO: 3056572 - RNA, 16 nt, Human
cuaaggugugcucuga

SEQ ID NO: 3056573 - RNA, 20 nt, Human
cuaauaaaauuuaaaagucu

SEQ ID NO: 3056574 - RNA, 19 nt, Human
cuaauguaauaacugugaa

SEQ ID NO: 3056575 - RNA, 14 nt, Human
cuaauguacugcau

SEQ ID NO: 3056576 - RNA, 16 nt, Human
cuaauguacugcauau

SEQ ID NO: 3056577 - RNA, 19 nt, Human
cuacccagcgagcccuggu

SEQ ID NO: 3056578 - RNA, 20 nt, Human
cuacccagcgagcccuggug

SEQ ID NO: 3056579 - RNA, 22 nt, Human
cuacccacccuccuuucaccac

SEQ ID NO: 3056580 - RNA, 13 nt, Human
cuacccacccucc

SEQ ID NO: 3056581 - RNA, 17 nt, Human
cuacccacccuccuuuc

SEQ ID NO: 3056582 - RNA, 15 nt, Human
cuacagaggccaugg

SEQ ID NO: 3056583 - RNA, 18 nt, Human
cuacacugugcugagucu

SEQ ID NO: 3056584 - RNA, 17 nt, Human
cuacacuccagugagac

SEQ ID NO: 3056585 - RNA, 16 nt, Human
cuacacuccagugaga

SEQ ID NO: 3056586 - RNA, 15 nt, Human
cuacacacugcaugu

SEQ ID NO: 3056587 - RNA, 13 nt, Human
cuacacacugcau

SEQ ID NO: 3056588 - RNA, 17 nt, Human
cuaaccagcagaaaugc

SEQ ID NO: 3056589 - RNA, 14 nt, Human
cuaagcaaaaugug

SEQ ID NO: 3056590 - RNA, 17 nt, Human
cuaaccacgcuggaccu

SEQ ID NO: 3056591 - RNA, 16 nt, Human
cuaaccagcagaaaug

SEQ ID NO: 3056592 - RNA, 15 nt, Human
cuaagcaaaauguga

SEQ ID NO: 3056593 - RNA, 18 nt, Human
cuaagcaaaaugugauau

SEQ ID NO: 3056594 - RNA, 21 nt, Human
cuaagcuauucaguaauaacu

SEQ ID NO: 3056595 - RNA, 19 nt, Human
cuaagcuauucaguaauaa

SEQ ID NO: 3056596 - RNA, 15 nt, Human
cuaaggugugcucug

SEQ ID NO: 3056597 - RNA, 16 nt, Human
ccaucaugucuggcua

SEQ ID NO: 3056598 - RNA, 14 nt, Human
ccaucaugucuggc

SEQ ID NO: 3056599 - RNA, 21 nt, Human
ccauccucuguacagagccca

SEQ ID NO: 3056600 - RNA, 15 nt, Human
ccauccugaggcucc

SEQ ID NO: 3056601 - RNA, 17 nt, Human
ccauccuggcccagggc

SEQ ID NO: 3056602 - RNA, 18 nt, Human
ccauccuggcccagggca

SEQ ID NO: 3056603 - RNA, 19 nt, Human
ccauccuggcccagggcau

SEQ ID NO: 3056604 - RNA, 20 nt, Human
ccauccuggcccagggcauc

SEQ ID NO: 3056605 - RNA, 22 nt, Human
ccauccuggcccagggcaucug

SEQ ID NO: 3056606 - RNA, 12 nt, Human
ccaucacccgcu

SEQ ID NO: 3056607 - RNA, 18 nt, Human
ccauauucuguuggccag

SEQ ID NO: 3056608 - RNA, 15 nt, Human
ccauauucuguuggc

SEQ ID NO: 3056609 - RNA, 19 nt, Human
ccauauuaccacagacaua

SEQ ID NO: 3056610 - RNA, 23 nt, Human
ccauagagagcaagacgcugugc

SEQ ID NO: 3056611 - RNA, 23 nt, Human
ccagggacagaggggguggccuc

SEQ ID NO: 3056612 - RNA, 14 nt, Human
ccagugccucuccc

SEQ ID NO: 3056613 - RNA, 16 nt, Human
ccagugccucucccug

SEQ ID NO: 3056614 - RNA, 11 nt, Human
ccagugccucu

SEQ ID NO: 3056615 - RNA, 19 nt, Human
ccagugccucucccugcug

SEQ ID NO: 3056616 - RNA, 21 nt, Human
ccagugccucucccugcugcu

SEQ ID NO: 3056617 - RNA, 13 nt, Human
ccagugccugggu

SEQ ID NO: 3056618 - RNA, 14 nt, Human
ccagugccugggug

SEQ ID NO: 3056619 - RNA, 16 nt, Human
ccagcugcuugggcuu

SEQ ID NO: 3056620 - RNA, 18 nt, Human
ccagcugcuugggcuuca

SEQ ID NO: 3056621 - RNA, 13 nt, Human
ccagcugcuuggg

SEQ ID NO: 3056622 - RNA, 15 nt, Human
ccagcugcuugggcu

SEQ ID NO: 3056623 - RNA, 21 nt, Human
ccagcugugcucuggacaggc

SEQ ID NO: 3056624 - RNA, 20 nt, Human
ccagcugugcucuggacagg

SEQ ID NO: 3056625 - RNA, 18 nt, Human
ccagcugugcucuggaca

SEQ ID NO: 3056626 - RNA, 15 nt, Human
ccagccuggaugcca

SEQ ID NO: 3056627 - RNA, 13 nt, Human
ccagccuggaugc

SEQ ID NO: 3056628 - RNA, 17 nt, Human
ccagccuggaugccauc

SEQ ID NO: 3056629 - RNA, 12 nt, Human
ccaggagcagcc

SEQ ID NO: 3056630 - RNA, 13 nt, Human
ccaggagcagcca

SEQ ID NO: 3056631 - RNA, 14 nt, Human
ccaggaagccagca

SEQ ID NO: 3056632 - RNA, 15 nt, Human
ccaggaagccagcag

SEQ ID NO: 3056633 - RNA, 17 nt, Human
ccaggaagccagcaggc

SEQ ID NO: 3056634 - RNA, 19 nt, Human
ccaggaagccagcaggcuc

SEQ ID NO: 3056635 - RNA, 23 nt, Human
ccagcugugcucuggacaggcau

SEQ ID NO: 3056636 - RNA, 22 nt, Human
ccagcugugcucuggacaggca

SEQ ID NO: 3056637 - RNA, 16 nt, Human
ccaggcccucugccca

SEQ ID NO: 3056638 - RNA, 17 nt, Human
ccaggcccucugcccac

SEQ ID NO: 3056639 - RNA, 18 nt, Human
ccaggcccucugcccacu

SEQ ID NO: 3056640 - RNA, 19 nt, Human
ccaggcccucugcccacuc

SEQ ID NO: 3056641 - RNA, 13 nt, Human
ccaggccuccuac

SEQ ID NO: 3056642 - RNA, 18 nt, Human
ccaggccuccuacagcuu

SEQ ID NO: 3056643 - RNA, 19 nt, Human
ccaggccuccuacagcuug

SEQ ID NO: 3056644 - RNA, 12 nt, Human
ccaggccagagg

SEQ ID NO: 3056645 - RNA, 14 nt, Human
ccaggagcagccac

SEQ ID NO: 3056646 - RNA, 21 nt, Human
ccaggccagagggagugacag

SEQ ID NO: 3056647 - RNA, 14 nt, Human
ccaggccagaggga

SEQ ID NO: 3056648 - RNA, 23 nt, Human
ccaggccccugccacccugggga

SEQ ID NO: 3056649 - RNA, 21 nt, Human
ccaggccccugccacccuggg

SEQ ID NO: 3056650 - RNA, 19 nt, Human
ccaggccccugccacccug

SEQ ID NO: 3056651 - RNA, 14 nt, Human
cccaggaggccagc

SEQ ID NO: 3056652 - RNA, 14 nt, Human
cccaggagccccga

SEQ ID NO: 3056653 - RNA, 13 nt, Human
cccaggagccccg

SEQ ID NO: 3056654 - RNA, 14 nt, Human
cccagcgagcccug

SEQ ID NO: 3056655 - RNA, 13 nt, Human
cccagcucugguc

SEQ ID NO: 3056656 - RNA, 14 nt, Human
cccagcucuggucc

SEQ ID NO: 3056657 - RNA, 12 nt, Human
cccagcucuggu

SEQ ID NO: 3056658 - RNA, 15 nt, Human
cccagcucuggucca

SEQ ID NO: 3056659 - RNA, 16 nt, Human
cccagcucugguccau

SEQ ID NO: 3056660 - RNA, 18 nt, Human
cccagcucugguccauag

SEQ ID NO: 3056661 - RNA, 23 nt, Human
cccagauugcaacaggcugggcu

SEQ ID NO: 3056662 - RNA, 17 nt, Human
cccagccccaaugaaca

SEQ ID NO: 3056663 - RNA, 11 nt, Human
cccagccccau

SEQ ID NO: 3056664 - RNA, 12 nt, Human
cccagccccauc

SEQ ID NO: 3056665 - RNA, 13 nt, Human
cccagccccaaug

SEQ ID NO: 3056666 - RNA, 18 nt, Human
cccagccccauccucugu

SEQ ID NO: 3056667 - RNA, 19 nt, Human
cccagccccauccucugua

SEQ ID NO: 3056668 - RNA, 18 nt, Human
cccagccccuucugaccc

SEQ ID NO: 3056669 - RNA, 13 nt, Human
cccagccccaucc

SEQ ID NO: 3056670 - RNA, 14 nt, Human
cccagccccauccc

SEQ ID NO: 3056671 - RNA, 14 nt, Human
cccagccccauccu

SEQ ID NO: 3056672 - RNA, 15 nt, Human
cccagccccauccuc

SEQ ID NO: 3056673 - RNA, 18 nt, Human
cccaggaggccagccuug

SEQ ID NO: 3056674 - RNA, 13 nt, Human
cccacgcccccac

SEQ ID NO: 3056675 - RNA, 14 nt, Human
cccacgcccccacu

SEQ ID NO: 3056676 - RNA, 19 nt, Human
cccaccuuggcugcaggga

SEQ ID NO: 3056677 - RNA, 17 nt, Human
cccaccuuggcugcagg

SEQ ID NO: 3056678 - RNA, 16 nt, Human
cccaccuuggcugcag

SEQ ID NO: 3056679 - RNA, 12 nt, Human
cccaccuggccu

SEQ ID NO: 3056680 - RNA, 15 nt, Human
cccaccuggccucug

SEQ ID NO: 3056681 - RNA, 15 nt, Human
ccauguuggccaggc

SEQ ID NO: 3056682 - RNA, 18 nt, Human
ccauguuggccaggcugg

SEQ ID NO: 3056683 - RNA, 21 nt, Human
ccauguuggccaggcuggucu

SEQ ID NO: 3056684 - RNA, 19 nt, Human
ccauguuggccaggcuggu

SEQ ID NO: 3056685 - RNA, 13 nt, Human
ccaugugccaggu

SEQ ID NO: 3056686 - RNA, 23 nt, Human
ccauggcacucuauguucuaaga

SEQ ID NO: 3056687 - RNA, 14 nt, Human
ccauguuggccagg

SEQ ID NO: 3056688 - RNA, 13 nt, Human
ccauguuggccag

SEQ ID NO: 3056689 - RNA, 13 nt, Human
ccaugcuccuggc

SEQ ID NO: 3056690 - RNA, 16 nt, Human
ccaugcugcccuguga

SEQ ID NO: 3056691 - RNA, 17 nt, Human
ccaugcugcccugugag

SEQ ID NO: 3056692 - RNA, 15 nt, Human
ccaugcuccuggccc

SEQ ID NO: 3056693 - RNA, 18 nt, Human
ccaugcuccuggcccacu

SEQ ID NO: 3056694 - RNA, 15 nt, Human
ccaugcugcccugug

SEQ ID NO: 3056695 - RNA, 16 nt, Human
cccaugagccucagca

SEQ ID NO: 3056696 - RNA, 15 nt, Human
cccaugagccucagc

SEQ ID NO: 3056697 - RNA, 20 nt, Human
cccaugagccucagcauccu

SEQ ID NO: 3056698 - RNA, 12 nt, Human
cccaugcugccc

SEQ ID NO: 3056699 - RNA, 13 nt, Human
cccaugcugcccu

SEQ ID NO: 3056700 - RNA, 14 nt, Human
cccaugcugcccug

SEQ ID NO: 3056701 - RNA, 12 nt, Human
cccaucugugaa

SEQ ID NO: 3056702 - RNA, 18 nt, Human
cccaucucacacaugagc

SEQ ID NO: 3056703 - RNA, 13 nt, Human
cccaucucacaca

SEQ ID NO: 3056704 - RNA, 20 nt, Human
cccaucugugaaaggaaaga

SEQ ID NO: 3056705 - RNA, 21 nt, Human
ccccaaauggaaaugggcaga

SEQ ID NO: 3056706 - RNA, 13 nt, Human
cccagguuucuau

SEQ ID NO: 3056707 - RNA, 15 nt, Human
cccaguccugcccgc

SEQ ID NO: 3056708 - RNA, 15 nt, Human
cccaggaggccagcc

SEQ ID NO: 3056709 - RNA, 16 nt, Human
cccaggaggccagccu

SEQ ID NO: 3056710 - RNA, 15 nt, Human
cccaggcauucccca

SEQ ID NO: 3056711 - RNA, 23 nt, Human
cccaggcaggucuugaacuccug

SEQ ID NO: 3056712 - RNA, 17 nt, Human
cccaggcauuccccagg

SEQ ID NO: 3056713 - RNA, 13 nt, Human
cccaggguggcca

SEQ ID NO: 3056714 - RNA, 14 nt, Human
cccaggguggccac

SEQ ID NO: 3056715 - RNA, 15 nt, Human
cccaggguggccaca

SEQ ID NO: 3056716 - RNA, 19 nt, Human
cccaggguggccacaccuc

SEQ ID NO: 3056717 - RNA, 19 nt, Human
cccagucuggaaugcagug

SEQ ID NO: 3056718 - RNA, 18 nt, Human
cccagucuggaaugcagu

SEQ ID NO: 3056719 - RNA, 10 nt, Human
cccagucugg

SEQ ID NO: 3056720 - RNA, 21 nt, Human
cccagugcccacaggaucagu

SEQ ID NO: 3056721 - RNA, 15 nt, Human
cccagugccgagaag

SEQ ID NO: 3056722 - RNA, 20 nt, Human
cccagugguuccuaauccuc

SEQ ID NO: 3056723 - RNA, 14 nt, Human
cccaguuagcucuc

SEQ ID NO: 3056724 - RNA, 17 nt, Human
cccaguguuuuaggagc

SEQ ID NO: 3056725 - RNA, 16 nt, Human
cccaguguuuuaggag

SEQ ID NO: 3056726 - RNA, 22 nt, Human
ccccagcuggggccaggcuggg

SEQ ID NO: 3056727 - RNA, 21 nt, Human
ccccagcuggggccaggcugg

SEQ ID NO: 3056728 - RNA, 13 nt, Human
ccccagccugcua

SEQ ID NO: 3056729 - RNA, 12 nt, Human
ccccacagcccc

SEQ ID NO: 3056730 - RNA, 16 nt, Human
ccccagccccauccca

SEQ ID NO: 3056731 - RNA, 15 nt, Human
ccccagccccauccu

SEQ ID NO: 3056732 - RNA, 13 nt, Human
ccccaccagugcc

SEQ ID NO: 3056733 - RNA, 14 nt, Human
ccccaccagugccu

SEQ ID NO: 3056734 - RNA, 22 nt, Human
ccccaggugguuauggagaggg

SEQ ID NO: 3056735 - RNA, 14 nt, Human
ccccaggugccagu

SEQ ID NO: 3056736 - RNA, 12 nt, Human
ccccuggcagcc

SEQ ID NO: 3056737 - RNA, 14 nt, Human
ccccuggcagcccc

SEQ ID NO: 3056738 - RNA, 15 nt, Human
ccccuggcagccccu

SEQ ID NO: 3056739 - RNA, 12 nt, Human
ccccaggaggcc

SEQ ID NO: 3056740 - RNA, 22 nt, Human
ccccuguccccgcacugggcuu

SEQ ID NO: 3056741 - RNA, 20 nt, Human
ccccuguucuggcagaguug

SEQ ID NO: 3056742 - RNA, 15 nt, Human
cccgaggccuucucu

SEQ ID NO: 3056743 - RNA, 20 nt, Human
cccgaggccuucucugaagg

SEQ ID NO: 3056744 - RNA, 18 nt, Human
cccuaauaaagcugugug

SEQ ID NO: 3056745 - RNA, 15 nt, Human
cccuaauaaagcugu

SEQ ID NO: 3056746 - RNA, 14 nt, Human
cccuaauaaagcug

SEQ ID NO: 3056747 - RNA, 13 nt, Human
cccuaauaaagcu

SEQ ID NO: 3056748 - RNA, 12 nt, Human
cccuaauaaagc

SEQ ID NO: 3056749 - RNA, 16 nt, Human
cccucagggucccugg

SEQ ID NO: 3056750 - RNA, 17 nt, Human
cccucagggucccuggu

SEQ ID NO: 3056751 - RNA, 18 nt, Human
cccucagggucccuggug

SEQ ID NO: 3056752 - RNA, 19 nt, Human
cccucagggucccuggugg

SEQ ID NO: 3056753 - RNA, 15 nt, Human
cccucagggucccug

SEQ ID NO: 3056754 - RNA, 16 nt, Human
cccggcaggguccuag

SEQ ID NO: 3056755 - RNA, 17 nt, Human
cccuaaaguguauuuuu

SEQ ID NO: 3056756 - RNA, 22 nt, Human
cccuaaaguguauuuuuuuacu

SEQ ID NO: 3056757 - RNA, 13 nt, Human
cccucccucuuuc

SEQ ID NO: 3056758 - RNA, 17 nt, Human
cccuccaugugggcuag

SEQ ID NO: 3056759 - RNA, 18 nt, Human
cccuccagagccccacag

SEQ ID NO: 3056760 - RNA, 19 nt, Human
cccuccagagccccacagc

SEQ ID NO: 3056761 - RNA, 21 nt, Human
cccuccagagccccacagccc

SEQ ID NO: 3056762 - RNA, 21 nt, Human
cccuccaagaccuucuccuuc

SEQ ID NO: 3056763 - RNA, 22 nt, Human
cccucauccucauacccacccc

SEQ ID NO: 3056764 - RNA, 17 nt, Human
cccucauccucauaccc

SEQ ID NO: 3056765 - RNA, 20 nt, Human
cccucauccucauacccacc

SEQ ID NO: 3056766 - RNA, 22 nt, Human
cccucaucaccaacgucugugc

SEQ ID NO: 3056767 - RNA, 20 nt, Human
cccucagucuggcccuuccu

SEQ ID NO: 3056768 - RNA, 21 nt, Human
cccucagggucccugguggca

SEQ ID NO: 3056769 - RNA, 18 nt, Human
cccugccucucugcaggu

SEQ ID NO: 3056770 - RNA, 11 nt, Human
cccugccucuc

SEQ ID NO: 3056771 - RNA, 16 nt, Human
cccugccuccuuugug

SEQ ID NO: 3056772 - RNA, 23 nt, Human
cccugccuccuuugugaggaagc

SEQ ID NO: 3056773 - RNA, 14 nt, Human
cccugccuccuuug

SEQ ID NO: 3056774 - RNA, 18 nt, Human
cccugccacccuggggag

SEQ ID NO: 3056775 - RNA, 17 nt, Human
cccugccacccugggga

SEQ ID NO: 3056776 - RNA, 15 nt, Human
cccugccacccuggg

SEQ ID NO: 3056777 - RNA, 14 nt, Human
cccugccacccugg

SEQ ID NO: 3056778 - RNA, 12 nt, Human
cccugccacccu

SEQ ID NO: 3056779 - RNA, 22 nt, Human
cccugcaaccugauugugucuc

SEQ ID NO: 3056780 - RNA, 16 nt, Human
cccugcaaccugauug

SEQ ID NO: 3056781 - RNA, 18 nt, Human
cccugcagagggcacaga

SEQ ID NO: 3056782 - RNA, 12 nt, Human
cccugcagaggg

SEQ ID NO: 3056783 - RNA, 22 nt, Human
cccugcacuugcagacucuaca

SEQ ID NO: 3056784 - RNA, 16 nt, Human
cccugggaggcucugg

SEQ ID NO: 3056785 - RNA, 15 nt, Human
cccugggaggcucug

SEQ ID NO: 3056786 - RNA, 18 nt, Human
cccugggaggcucuggag

SEQ ID NO: 3056787 - RNA, 17 nt, Human
cccugggaggcucugga

SEQ ID NO: 3056788 - RNA, 21 nt, Human
cccugguggcagugggagcug

SEQ ID NO: 3056789 - RNA, 22 nt, Human
cccugguggcagugggagcugc

SEQ ID NO: 3056790 - RNA, 21 nt, Human
cccuggacugugugcucagga

SEQ ID NO: 3056791 - RNA, 20 nt, Human
cccugcugguucaggguugg

SEQ ID NO: 3056792 - RNA, 19 nt, Human
cccugcugguucaggguug

SEQ ID NO: 3056793 - RNA, 22 nt, Human
cccugcuggguguggcgcagca

SEQ ID NO: 3056794 - RNA, 22 nt, Human
cccugccucucugcaggucccu

SEQ ID NO: 3056795 - RNA, 21 nt, Human
cccugccucucugcagguccc

SEQ ID NO: 3056796 - RNA, 16 nt, Human
cccugccucucugcag

SEQ ID NO: 3056797 - RNA, 13 nt, Human
cccugcugguuca

SEQ ID NO: 3056798 - RNA, 14 nt, Human
cccugguggcagcu

SEQ ID NO: 3056799 - RNA, 22 nt, Human
ccuagguauaauucacauugua

SEQ ID NO: 3056800 - RNA, 13 nt, Human
ccuaggugacaga

SEQ ID NO: 3056801 - RNA, 21 nt, Human
ccuagaaauuccccacccuga

SEQ ID NO: 3056802 - RNA, 19 nt, Human
ccuacuguaauuugugaua

SEQ ID NO: 3056803 - RNA, 18 nt, Human
ccuacccacccuccuuuc

SEQ ID NO: 3056804 - RNA, 13 nt, Human
ccuacccacccuc

SEQ ID NO: 3056805 - RNA, 21 nt, Human
ccuacaguugaaaaacagcug

SEQ ID NO: 3056806 - RNA, 19 nt, Human
ccuacagcuugaccgugag

SEQ ID NO: 3056807 - RNA, 22 nt, Human
ccuacaguugaaaaacagcuga

SEQ ID NO: 3056808 - RNA, 13 nt, Human
ccuaaacauauga

SEQ ID NO: 3056809 - RNA, 15 nt, Human
ccuaaaauucagugg

SEQ ID NO: 3056810 - RNA, 16 nt, Human
ccuaaaauucagugga

SEQ ID NO: 3056811 - RNA, 12 nt, Human
ccguuauuaaaa

SEQ ID NO: 3056812 - RNA, 13 nt, Human
cccuucccaccuc

SEQ ID NO: 3056813 - RNA, 12 nt, Human
cccuucccaccu

SEQ ID NO: 3056814 - RNA, 22 nt, Human
cccuugguuaggcauuguggga

SEQ ID NO: 3056815 - RNA, 23 nt, Human
cccuugguuaggcauugugggaa

SEQ ID NO: 3056816 - RNA, 19 nt, Human
cccuugucggccccaccag

SEQ ID NO: 3056817 - RNA, 22 nt, Human
cccuugucggccccaccagugc

SEQ ID NO: 3056818 - RNA, 22 nt, Human
cccuuguggucccaccccacac

SEQ ID NO: 3056819 - RNA, 20 nt, Human
cccuuguggucccaccccac

SEQ ID NO: 3056820 - RNA, 17 nt, Human
cccuuggauuguccccg

SEQ ID NO: 3056821 - RNA, 17 nt, Human
cccuucuuuccacagaa

SEQ ID NO: 3056822 - RNA, 17 nt, Human
ccgggaagggggcuggg

SEQ ID NO: 3056823 - RNA, 24 nt, Human
ccucacaguccuuaccagcagagc

SEQ ID NO: 3056824 - RNA, 23 nt, Human
ccucacaguccuuaccagcagag

SEQ ID NO: 3056825 - RNA, 16 nt, Human
ccuauuagagaagaga

SEQ ID NO: 3056826 - RNA, 17 nt, Human
ccuauuagagaagagau

SEQ ID NO: 3056827 - RNA, 15 nt, Human
ccuaggugacagagu

SEQ ID NO: 3056828 - RNA, 16 nt, Human
ccucagaucuucugug

SEQ ID NO: 3056829 - RNA, 20 nt, Human
ccucagaugcacaugagcug

SEQ ID NO: 3056830 - RNA, 16 nt, Human
ccucagggucccuggu

SEQ ID NO: 3056831 - RNA, 17 nt, Human
ccucagggucccuggug

SEQ ID NO: 3056832 - RNA, 20 nt, Human
ccucagggucccugguggca

SEQ ID NO: 3056833 - RNA, 23 nt, Human
ccucaggccugggggcugggcag

SEQ ID NO: 3056834 - RNA, 15 nt, Human
ccucuccccagcaag

SEQ ID NO: 3056835 - RNA, 20 nt, Human
ccucuccccagcaagugaga

SEQ ID NO: 3056836 - RNA, 13 nt, Human
ccucucccuugga

SEQ ID NO: 3056837 - RNA, 22 nt, Human
ccucucccuuggauuguccccg

SEQ ID NO: 3056838 - RNA, 23 nt, Human
ccucucccugcugcuccuaggac

SEQ ID NO: 3056839 - RNA, 15 nt, Human
ccucucccugcugcu

SEQ ID NO: 3056840 - RNA, 17 nt, Human
ccucucccugcugcucc

SEQ ID NO: 3056841 - RNA, 19 nt, Human
ccucucccugcugcuccua

SEQ ID NO: 3056842 - RNA, 14 nt, Human
ccucucccugcugc

SEQ ID NO: 3056843 - RNA, 21 nt, Human
ccuccuccagccgccaugcuc

SEQ ID NO: 3056844 - RNA, 18 nt, Human
ccucgguguggagaagcg

SEQ ID NO: 3056845 - RNA, 13 nt, Human
ccucugcccacuc

SEQ ID NO: 3056846 - RNA, 16 nt, Human
ccucugcccacucccu

SEQ ID NO: 3056847 - RNA, 18 nt, Human
ccucugcagcaauaaagc

SEQ ID NO: 3056848 - RNA, 14 nt, Human
ccucugcagcaaua

SEQ ID NO: 3056849 - RNA, 23 nt, Human
ccucugcacuccccugcugggug

SEQ ID NO: 3056850 - RNA, 18 nt, Human
ccucugcacuccccugcu

SEQ ID NO: 3056851 - RNA, 16 nt, Human
ccucugcacuccccug

SEQ ID NO: 3056852 - RNA, 17 nt, Human
ccucugcacuccccugc

SEQ ID NO: 3056853 - RNA, 15 nt, Human
ccucugcacuccccu

SEQ ID NO: 3056854 - RNA, 21 nt, Human
ccucugacacacagcucuguc

SEQ ID NO: 3056855 - RNA, 20 nt, Human
ccucugacacacagcucugu

SEQ ID NO: 3056856 - RNA, 19 nt, Human
ccucugacacacagcucug

SEQ ID NO: 3056857 - RNA, 14 nt, Human
ccucugacacacag

SEQ ID NO: 3056858 - RNA, 13 nt, Human
ccucugacacaca

SEQ ID NO: 3056859 - RNA, 17 nt, Human
ccucaggugagaagcag

SEQ ID NO: 3056860 - RNA, 18 nt, Human
ccucaggugagaagcaga

SEQ ID NO: 3056861 - RNA, 20 nt, Human
ccucaggugagaagcagagg

SEQ ID NO: 3056862 - RNA, 17 nt, Human
ccuccaggugcacaagc

SEQ ID NO: 3056863 - RNA, 11 nt, Human
ccuccaggugc

SEQ ID NO: 3056864 - RNA, 12 nt, Human
ccuccaggugca

SEQ ID NO: 3056865 - RNA, 14 nt, Human
ccucccaacucacc

SEQ ID NO: 3056866 - RNA, 17 nt, Human
ccucccaaagugcuggg

SEQ ID NO: 3056867 - RNA, 15 nt, Human
ccuccaugugggcua

SEQ ID NO: 3056868 - RNA, 12 nt, Human
ccuccauguggg

SEQ ID NO: 3056869 - RNA, 12 nt, Human
ccuccauccuga

SEQ ID NO: 3056870 - RNA, 13 nt, Human
ccuccauccugag

SEQ ID NO: 3056871 - RNA, 20 nt, Human
ccucccgaauagcugggacu

SEQ ID NO: 3056872 - RNA, 19 nt, Human
ccucccgaauagcugggac

SEQ ID NO: 3056873 - RNA, 21 nt, Human
ccucccgaauagcugggacua

SEQ ID NO: 3056874 - RNA, 18 nt, Human
ccucccgaguagcuggga

SEQ ID NO: 3056875 - RNA, 17 nt, Human
ccucccgaguagcuggg

SEQ ID NO: 3056876 - RNA, 12 nt, Human
ccuccuccagcc

SEQ ID NO: 3056877 - RNA, 11 nt, Human
ccuccucagau

SEQ ID NO: 3056878 - RNA, 13 nt, Human
ccucccucuuucc

SEQ ID NO: 3056879 - RNA, 18 nt, Human
ccucccgaauagcuggga

SEQ ID NO: 3056880 - RNA, 15 nt, Human
ccucccaacucaccc

SEQ ID NO: 3056881 - RNA, 22 nt, Human
cauggacuucugccagcauaau

SEQ ID NO: 3056882 - RNA, 18 nt, Human
cauggacaugaucuucuu

SEQ ID NO: 3056883 - RNA, 16 nt, Human
cauggaauaacaugua

SEQ ID NO: 3056884 - RNA, 20 nt, Human
cauggaaguacuauaauuua

SEQ ID NO: 3056885 - RNA, 22 nt, Human
cauggaaguacuauaauuuacc

SEQ ID NO: 3056886 - RNA, 17 nt, Human
caugcugucccuuacgu

SEQ ID NO: 3056887 - RNA, 20 nt, Human
caugcuguucaugaaagauu

SEQ ID NO: 3056888 - RNA, 22 nt, Human
caugcugucccuuacgugaguc

SEQ ID NO: 3056889 - RNA, 23 nt, Human
caugcugucuacacuaagagaga

SEQ ID NO: 3056890 - RNA, 17 nt, Human
caugcgggcuuccuccu

SEQ ID NO: 3056891 - RNA, 18 nt, Human
caugccuggauggggcug

SEQ ID NO: 3056892 - RNA, 21 nt, Human
caugccuggauggggcugcac

SEQ ID NO: 3056893 - RNA, 23 nt, Human
caugccuggauggggcugcaccg

SEQ ID NO: 3056894 - RNA, 17 nt, Human
cauggagguuugaagau

SEQ ID NO: 3056895 - RNA, 11 nt, Human
cauggacuuug

SEQ ID NO: 3056896 - RNA, 13 nt, Human
cauggacuuuguu

SEQ ID NO: 3056897 - RNA, 16 nt, Human
cauggaguauauguca

SEQ ID NO: 3056898 - RNA, 18 nt, Human
caugggaaugaaugucag

SEQ ID NO: 3056899 - RNA, 17 nt, Human
caugggccuccugugug

SEQ ID NO: 3056900 - RNA, 16 nt, Human
caugggccuccugugu

SEQ ID NO: 3056901 - RNA, 22 nt, Human
caugggaaugaaugucagugug

SEQ ID NO: 3056902 - RNA, 17 nt, Human
caugggacagggaggac

SEQ ID NO: 3056903 - RNA, 15 nt, Human
caugggccuccugug

SEQ ID NO: 3056904 - RNA, 16 nt, Human
caugccucucucaggc

SEQ ID NO: 3056905 - RNA, 17 nt, Human
caugccucucucaggcc

SEQ ID NO: 3056906 - RNA, 18 nt, Human
caugccucucucaggcca

SEQ ID NO: 3056907 - RNA, 19 nt, Human
caugccucucucaggccaa

SEQ ID NO: 3056908 - RNA, 13 nt, Human
caugccuggaugg

SEQ ID NO: 3056909 - RNA, 14 nt, Human
caugccucucucag

SEQ ID NO: 3056910 - RNA, 15 nt, Human
caugccucucucagg

SEQ ID NO: 3056911 - RNA, 13 nt, Human
caugccccugaac

SEQ ID NO: 3056912 - RNA, 19 nt, Human
caugccagcuuaucucagg

SEQ ID NO: 3056913 - RNA, 20 nt, Human
caugccagcuuaucucaggg

SEQ ID NO: 3056914 - RNA, 15 nt, Human
cauguuuuguuuacg

SEQ ID NO: 3056915 - RNA, 21 nt, Human
cauuaaagccugaguuugcuu

SEQ ID NO: 3056916 - RNA, 16 nt, Human
cauggucggaaaacau

SEQ ID NO: 3056917 - RNA, 17 nt, Human
caugugaaaucauucau

SEQ ID NO: 3056918 - RNA, 16 nt, Human
caugugaaaucauuca

SEQ ID NO: 3056919 - RNA, 15 nt, Human
caugugaaaucauuc

SEQ ID NO: 3056920 - RNA, 14 nt, Human
caugucuuuucuug

SEQ ID NO: 3056921 - RNA, 19 nt, Human
caugucuuuucuugcauga

SEQ ID NO: 3056922 - RNA, 21 nt, Human
caugucuuuucuugcaugagg

SEQ ID NO: 3056923 - RNA, 23 nt, Human
caugucuuuucuugcaugaggcu

SEQ ID NO: 3056924 - RNA, 21 nt, Human
cauguaauuaaguacuaugua

SEQ ID NO: 3056925 - RNA, 18 nt, Human
cauguaauuaaguacuau

SEQ ID NO: 3056926 - RNA, 21 nt, Human
cauguuucuuuguaaugaaaa

SEQ ID NO: 3056927 - RNA, 20 nt, Human
cauguuucuuuguaaugaaa

SEQ ID NO: 3056928 - RNA, 22 nt, Human
cauguuucuuuguaaugaaaac

SEQ ID NO: 3056929 - RNA, 15 nt, Human
cauguuugugauuga

SEQ ID NO: 3056930 - RNA, 15 nt, Human
caugugcacaugcac

SEQ ID NO: 3056931 - RNA, 21 nt, Human
caugugccagguuuuuggucu

SEQ ID NO: 3056932 - RNA, 14 nt, Human
ccaagacucccaug

SEQ ID NO: 3056933 - RNA, 15 nt, Human
ccaagacucccauga

SEQ ID NO: 3056934 - RNA, 19 nt, Human
ccaagacucccaugaggga

SEQ ID NO: 3056935 - RNA, 12 nt, Human
ccaagacuccca

SEQ ID NO: 3056936 - RNA, 13 nt, Human
ccaacccucauca

SEQ ID NO: 3056937 - RNA, 15 nt, Human
ccaacccucaucacc

SEQ ID NO: 3056938 - RNA, 15 nt, Human
ccaagaccuucuccu

SEQ ID NO: 3056939 - RNA, 22 nt, Human
ccaaauucuuucaguggcuacc

SEQ ID NO: 3056940 - RNA, 15 nt, Human
ccaaauucuuucagu

SEQ ID NO: 3056941 - RNA, 14 nt, Human
ccaacacgagcagg

SEQ ID NO: 3056942 - RNA, 16 nt, Human
ccaacaucaacaucuu

SEQ ID NO: 3056943 - RNA, 14 nt, Human
ccaacauacuccca

SEQ ID NO: 3056944 - RNA, 13 nt, Human
ccaacaucaacau

SEQ ID NO: 3056945 - RNA, 21 nt, Human
ccaacacgagcaggcuacugu

SEQ ID NO: 3056946 - RNA, 14 nt, Human
ccaaagaugcagcc

SEQ ID NO: 3056947 - RNA, 13 nt, Human
ccaaagaugcagc

SEQ ID NO: 3056948 - RNA, 23 nt, Human
ccaagcagagguugggaggccau

SEQ ID NO: 3056949 - RNA, 14 nt, Human
ccaagcaggacaug

SEQ ID NO: 3056950 - RNA, 12 nt, Human
ccaagcucccag

SEQ ID NO: 3056951 - RNA, 13 nt, Human
ccaagcucccagg

SEQ ID NO: 3056952 - RNA, 13 nt, Human
ccaaggccuuccc

SEQ ID NO: 3056953 - RNA, 19 nt, Human
ccaaggccuuccccuggca

SEQ ID NO: 3056954 - RNA, 18 nt, Human
ccaaggcuagaaccaccu

SEQ ID NO: 3056955 - RNA, 14 nt, Human
ccaaggcuggggga

SEQ ID NO: 3056956 - RNA, 18 nt, Human
ccaaggugggaggauugc

SEQ ID NO: 3056957 - RNA, 19 nt, Human
ccaaggcugauuaaaccaa

SEQ ID NO: 3056958 - RNA, 23 nt, Human
ccaagugccaaagaagcagacca

SEQ ID NO: 3056959 - RNA, 20 nt, Human
ccaauauucauagcagcuua

SEQ ID NO: 3056960 - RNA, 16 nt, Human
ccacaagacccuugug

SEQ ID NO: 3056961 - RNA, 13 nt, Human
ccacaagagccca

SEQ ID NO: 3056962 - RNA, 16 nt, Human
ccacaagaaaugaaag

SEQ ID NO: 3056963 - RNA, 22 nt, Human
ccacaagaaaugaaagcaggga

SEQ ID NO: 3056964 - RNA, 18 nt, Human
ccacaaaggagagcuagc

SEQ ID NO: 3056965 - RNA, 20 nt, Human
ccacaaguuaaauaaaucau

SEQ ID NO: 3056966 - RNA, 15 nt, Human
ccacaaguuaaauaa

SEQ ID NO: 3056967 - RNA, 16 nt, Human
ccacaagagcccaggc

SEQ ID NO: 3056968 - RNA, 17 nt, Human
ccacaagagcccaggcc

SEQ ID NO: 3056969 - RNA, 18 nt, Human
ccacaagagcccaggccu

SEQ ID NO: 3056970 - RNA, 19 nt, Human
ccacaagagcccaggccuc

SEQ ID NO: 3056971 - RNA, 20 nt, Human
ccacaagagcccaggccucc

SEQ ID NO: 3056972 - RNA, 21 nt, Human
ccacaagagcccaggccuccu

SEQ ID NO: 3056973 - RNA, 16 nt, Human
ccaaacccuucagugc

SEQ ID NO: 3056974 - RNA, 21 nt, Human
ccaaaauaaaacuuuuuaaaa

SEQ ID NO: 3056975 - RNA, 18 nt, Human
ccaaaauaaaacuuuuua

SEQ ID NO: 3056976 - RNA, 20 nt, Human
cauuuuuaguagagacaggg

SEQ ID NO: 3056977 - RNA, 17 nt, Human
ccaaagaaauguaaggg

SEQ ID NO: 3056978 - RNA, 21 nt, Human
cauuuuauuuuauuaugcaug

SEQ ID NO: 3056979 - RNA, 19 nt, Human
cauuuuauuuuauuaugca

SEQ ID NO: 3056980 - RNA, 16 nt, Human
cauuugcucauggaau

SEQ ID NO: 3056981 - RNA, 15 nt, Human
cauuugcucauggaa

SEQ ID NO: 3056982 - RNA, 14 nt, Human
cauuugcucaugga

SEQ ID NO: 3056983 - RNA, 20 nt, Human
cauuuuuaagugcugcauuu

SEQ ID NO: 3056984 - RNA, 15 nt, Human
cauuuuuaagugcug

SEQ ID NO: 3056985 - RNA, 18 nt, Human
cauuuuuaguagagacag

SEQ ID NO: 3056986 - RNA, 19 nt, Human
cauuuuuaguagagacagg

SEQ ID NO: 3056987 - RNA, 23 nt, Human
cauuuugggguacccacugcucu

SEQ ID NO: 3056988 - RNA, 18 nt, Human
cauuuugcuaaaugugaa

SEQ ID NO: 3056989 - RNA, 21 nt, Human
cauuuugcuaaaugugaauga

SEQ ID NO: 3056990 - RNA, 24 nt, Human
cauuuugcuaaaugugaaugauga

SEQ ID NO: 3056991 - RNA, 22 nt, Human
cauuuugggguacccacugcuc

SEQ ID NO: 3056992 - RNA, 21 nt, Human
cauuuugggguacccacugcu

SEQ ID NO: 3056993 - RNA, 20 nt, Human
cauuuugggguacccacugc

SEQ ID NO: 3056994 - RNA, 23 nt, Human
cauuucuuccacaagagcccagg

SEQ ID NO: 3056995 - RNA, 14 nt, Human
cauuugagcagggc

SEQ ID NO: 3056996 - RNA, 19 nt, Human
cauuugaggucuguucuuu

SEQ ID NO: 3056997 - RNA, 18 nt, Human
cauuugaggucuguucuu

SEQ ID NO: 3056998 - RNA, 17 nt, Human
cauuugaggucuguucu

SEQ ID NO: 3056999 - RNA, 21 nt, Human
cauuuacuuuguguucaccuu

SEQ ID NO: 3057000 - RNA, 17 nt, Human
cauuuacuuuguguuca

SEQ ID NO: 3057001 - RNA, 19 nt, Human
cauuuaaagcuuauuaaaa

SEQ ID NO: 3057002 - RNA, 12 nt, Human
cauuuccaagca

SEQ ID NO: 3057003 - RNA, 21 nt, Human
cauuuaaaagauacaguuacu

SEQ ID NO: 3057004 - RNA, 21 nt, Human
cauuucuuccacaagagccca

SEQ ID NO: 3057005 - RNA, 23 nt, Human
cauuucugcaucagcugcugaaa

SEQ ID NO: 3057006 - RNA, 19 nt, Human
cauugaaaucuuuuugcuu

SEQ ID NO: 3057007 - RNA, 13 nt, Human
cauugaccugagg

SEQ ID NO: 3057008 - RNA, 22 nt, Human
cauugaccugaggcccuucucu

SEQ ID NO: 3057009 - RNA, 14 nt, Human
cauacccaccccca

SEQ ID NO: 3057010 - RNA, 17 nt, Human
cauacccacccccaccc

SEQ ID NO: 3057011 - RNA, 18 nt, Human
cauacccacccccaccca

SEQ ID NO: 3057012 - RNA, 21 nt, Human
cauacccacccccacccaagg

SEQ ID NO: 3057013 - RNA, 21 nt, Human
cauacuaaccagcagaaaugc

SEQ ID NO: 3057014 - RNA, 14 nt, Human
cauacuaaccagca

SEQ ID NO: 3057015 - RNA, 18 nt, Human
cauacguacacauuuuau

SEQ ID NO: 3057016 - RNA, 17 nt, Human
cauacguacacauuuua

SEQ ID NO: 3057017 - RNA, 16 nt, Human
cauacguacacauuuu

SEQ ID NO: 3057018 - RNA, 15 nt, Human
cauacguacacauuu

SEQ ID NO: 3057019 - RNA, 13 nt, Human
cauacguacacau

SEQ ID NO: 3057020 - RNA, 15 nt, Human
cauaaaaacaacuuu

SEQ ID NO: 3057021 - RNA, 20 nt, Human
caguuuucugagaaagacua

SEQ ID NO: 3057022 - RNA, 19 nt, Human
caguuuucugagaaagacu

SEQ ID NO: 3057023 - RNA, 17 nt, Human
caguuguuagugugucu

SEQ ID NO: 3057024 - RNA, 15 nt, Human
caguuuucugagaaa

SEQ ID NO: 3057025 - RNA, 14 nt, Human
caguuuucugagaa

SEQ ID NO: 3057026 - RNA, 23 nt, Human
caguugccagucaccccggccac

SEQ ID NO: 3057027 - RNA, 16 nt, Human
caguuggguggaugcc

SEQ ID NO: 3057028 - RNA, 19 nt, Human
caguuggucccccuuccau

SEQ ID NO: 3057029 - RNA, 20 nt, Human
caguuggucccccuuccaug

SEQ ID NO: 3057030 - RNA, 21 nt, Human
caguuggucccccuuccaugg

SEQ ID NO: 3057031 - RNA, 22 nt, Human
caguuggucccccuuccaugga

SEQ ID NO: 3057032 - RNA, 19 nt, Human
caguuggguggaugccugg

SEQ ID NO: 3057033 - RNA, 18 nt, Human
caguuggguggaugccug

SEQ ID NO: 3057034 - RNA, 18 nt, Human
caguuggucccccuucca

SEQ ID NO: 3057035 - RNA, 23 nt, Human
caguugaaaagacuccaaagaaa

SEQ ID NO: 3057036 - RNA, 22 nt, Human
caguugaaaagacuccaaagaa

SEQ ID NO: 3057037 - RNA, 21 nt, Human
caguugaaaagacuccaaaga

SEQ ID NO: 3057038 - RNA, 18 nt, Human
caguugaaaagacuccaa

SEQ ID NO: 3057039 - RNA, 14 nt, Human
caguugaaaagacu

SEQ ID NO: 3057040 - RNA, 17 nt, Human
cauaaguaauucaagaa

SEQ ID NO: 3057041 - RNA, 16 nt, Human
cauaaguaauucaaga

SEQ ID NO: 3057042 - RNA, 20 nt, Human
cauaagcuacugccauccug

SEQ ID NO: 3057043 - RNA, 22 nt, Human
cauaaguaauucaagaaaacaa

SEQ ID NO: 3057044 - RNA, 18 nt, Human
cauaaguaauucaagaaa

SEQ ID NO: 3057045 - RNA, 14 nt, Human
cauaagauaaaugu

SEQ ID NO: 3057046 - RNA, 14 nt, Human
cauaagcuacugcc

SEQ ID NO: 3057047 - RNA, 16 nt, Human
cauaagcuacugccau

SEQ ID NO: 3057048 - RNA, 17 nt, Human
cauaagcuacugccauc

SEQ ID NO: 3057049 - RNA, 11 nt, Human
cauacauauuu

SEQ ID NO: 3057050 - RNA, 15 nt, Human
cauaauacuugcuuu

SEQ ID NO: 3057051 - RNA, 12 nt, Human
cauacauauuuu

SEQ ID NO: 3057052 - RNA, 19 nt, Human
cauacauauuuuuguagca

SEQ ID NO: 3057053 - RNA, 15 nt, Human
cauacauuguacgaa

SEQ ID NO: 3057054 - RNA, 17 nt, Human
cauaccaacacgagcag

SEQ ID NO: 3057055 - RNA, 18 nt, Human
cauaccacuuuuguucuu

SEQ ID NO: 3057056 - RNA, 15 nt, Human
cauaccacuuuuguu

SEQ ID NO: 3057057 - RNA, 14 nt, Human
cauaccacuuuugu

SEQ ID NO: 3057058 - RNA, 13 nt, Human
cauaccacuuuug

SEQ ID NO: 3057059 - RNA, 11 nt, Human
cauacccaccc

SEQ ID NO: 3057060 - RNA, 12 nt, Human
cauacccacccc

SEQ ID NO: 3057061 - RNA, 19 nt, Human
cauaccacuuuuguucuug

SEQ ID NO: 3057062 - RNA, 17 nt, Human
cauaaaaacaacuuuau

SEQ ID NO: 3057063 - RNA, 20 nt, Human
cauaaaaacaacuuuauacc

SEQ ID NO: 3057064 - RNA, 21 nt, Human
cauaaaaacaacuuuauaccc

SEQ ID NO: 3057065 - RNA, 23 nt, Human
cauaaaaacaacuuuauacccag

SEQ ID NO: 3057066 - RNA, 23 nt, Human
cauaaaaagccugcaauuucaua

SEQ ID NO: 3057067 - RNA, 21 nt, Human
cauaaaaauuagccaagugug

SEQ ID NO: 3057068 - RNA, 16 nt, Human
cauaaagcaggcagaa

SEQ ID NO: 3057069 - RNA, 14 nt, Human
cauaaagcaggcag

SEQ ID NO: 3057070 - RNA, 21 nt, Human
cauaaacaagaccacguuucu

SEQ ID NO: 3057071 - RNA, 20 nt, Human
cauaaacaagaccacguuuc

SEQ ID NO: 3057072 - RNA, 22 nt, Human
cauaaacaagaccacguuucua

SEQ ID NO: 3057073 - RNA, 16 nt, Human
cauaaccuagccuuag

SEQ ID NO: 3057074 - RNA, 19 nt, Human
cauaaauuuaguauuuugu

SEQ ID NO: 3057075 - RNA, 20 nt, Human
cauaaauuuaguauuuuguu

SEQ ID NO: 3057076 - RNA, 22 nt, Human
caguguuguggauuuaacagaa

SEQ ID NO: 3057077 - RNA, 20 nt, Human
caguguuguggauuuaacag

SEQ ID NO: 3057078 - RNA, 19 nt, Human
caguguuguggauuuaaca

SEQ ID NO: 3057079 - RNA, 16 nt, Human
caguguuuuaggagca

SEQ ID NO: 3057080 - RNA, 20 nt, Human
caguguuuuaggagcaugag

SEQ ID NO: 3057081 - RNA, 21 nt, Human
caguuaccucugccucagaaa

SEQ ID NO: 3057082 - RNA, 13 nt, Human
caguuaagagaaa

SEQ ID NO: 3057083 - RNA, 14 nt, Human
caguuaagagaaau

SEQ ID NO: 3057084 - RNA, 22 nt, Human
caguucggugagcuacaaaugc

SEQ ID NO: 3057085 - RNA, 14 nt, Human
caguucucuccuuc

SEQ ID NO: 3057086 - RNA, 15 nt, Human
caguucucuccuucu

SEQ ID NO: 3057087 - RNA, 13 nt, Human
caguucucuccuu

SEQ ID NO: 3057088 - RNA, 22 nt, Human
caguucugaagaagaugguacc

SEQ ID NO: 3057089 - RNA, 15 nt, Human
caguucugaagaaga

SEQ ID NO: 3057090 - RNA, 16 nt, Human
caguucugaagaagau

SEQ ID NO: 3057091 - RNA, 22 nt, Human
caguucucuccuucuucccccc

SEQ ID NO: 3057092 - RNA, 12 nt, Human
caguucugaaga

SEQ ID NO: 3057093 - RNA, 13 nt, Human
caguucugaagaa

SEQ ID NO: 3057094 - RNA, 14 nt, Human
caguucugaagaag

SEQ ID NO: 3057095 - RNA, 12 nt, Human
caguugaaaaac

SEQ ID NO: 3057096 - RNA, 18 nt, Human
caguugaaaaacagcuga

SEQ ID NO: 3057097 - RNA, 19 nt, Human
caguugaaaaacagcugag

SEQ ID NO: 3057098 - RNA, 22 nt, Human
cagugguuccuaauccucuagg

SEQ ID NO: 3057099 - RNA, 16 nt, Human
caguggcagcugcuuu

SEQ ID NO: 3057100 - RNA, 15 nt, Human
caguggcagcugcuu

SEQ ID NO: 3057101 - RNA, 14 nt, Human
caguggcagcugcu

SEQ ID NO: 3057102 - RNA, 13 nt, Human
caguggcagcugc

SEQ ID NO: 3057103 - RNA, 12 nt, Human
caguggcagcug

SEQ ID NO: 3057104 - RNA, 14 nt, Human
cagugugucuaaau

SEQ ID NO: 3057105 - RNA, 23 nt, Human
cagugugucuaaauuugaauguu

SEQ ID NO: 3057106 - RNA, 12 nt, Human
cagugugacuga

SEQ ID NO: 3057107 - RNA, 14 nt, Human
cagugugacaagga

SEQ ID NO: 3057108 - RNA, 23 nt, Human
caguguacauggaauaacaugua

SEQ ID NO: 3057109 - RNA, 20 nt, Human
caguguacauggaauaacau

SEQ ID NO: 3057110 - RNA, 16 nt, Human
caguguacauggaaua

SEQ ID NO: 3057111 - RNA, 14 nt, Human
cagugucaaugcag

SEQ ID NO: 3057112 - RNA, 20 nt, Human
cauagaauaaaauuuuuaau

SEQ ID NO: 3057113 - RNA, 14 nt, Human
cauagaauaaaauu

SEQ ID NO: 3057114 - RNA, 23 nt, Human
cauagagagcaagacgcugugcu

SEQ ID NO: 3057115 - RNA, 19 nt, Human
cauagagagcaagacgcug

SEQ ID NO: 3057116 - RNA, 21 nt, Human
cauagagagcaagacgcugug

SEQ ID NO: 3057117 - RNA, 16 nt, Human
cauacucccaucugug

SEQ ID NO: 3057118 - RNA, 15 nt, Human
cauacucccaucugu

SEQ ID NO: 3057119 - RNA, 18 nt, Human
cauacucccaucugugaa

SEQ ID NO: 3057120 - RNA, 20 nt, Human
cauacucccaucugugaaag

SEQ ID NO: 3057121 - RNA, 11 nt, Human
cauacucugcu

SEQ ID NO: 3057122 - RNA, 17 nt, Human
cauaugauguacaugua

SEQ ID NO: 3057123 - RNA, 15 nt, Human
cauaugauguacaug

SEQ ID NO: 3057124 - RNA, 21 nt, Human
cauaugauguacauguacuga

SEQ ID NO: 3057125 - RNA, 22 nt, Human
cauauauauguuuuaagaggca

SEQ ID NO: 3057126 - RNA, 20 nt, Human
cauauauaacaaugcuguau

SEQ ID NO: 3057127 - RNA, 22 nt, Human
cauaguggcuuaaaacaacacu

SEQ ID NO: 3057128 - RNA, 19 nt, Human
cauaguaugguggcugggu

SEQ ID NO: 3057129 - RNA, 18 nt, Human
cauaguaugguggcuggg

SEQ ID NO: 3057130 - RNA, 20 nt, Human
cauaguaugguggcuggguu

SEQ ID NO: 3057131 - RNA, 17 nt, Human
cauaguaugguggcugg

SEQ ID NO: 3057132 - RNA, 17 nt, Human
cauauuuauaaaaauaa

SEQ ID NO: 3057133 - RNA, 18 nt, Human
cauauuuuucacauaucu

SEQ ID NO: 3057134 - RNA, 12 nt, Human
cauauuuauaaa

SEQ ID NO: 3057135 - RNA, 20 nt, Human
cauauuuacuucuuauacau

SEQ ID NO: 3057136 - RNA, 17 nt, Human
cauauuuacuucuuaua

SEQ ID NO: 3057137 - RNA, 16 nt, Human
cauauuuacuucuuau

SEQ ID NO: 3057138 - RNA, 14 nt, Human
cauauuuacuucuu

SEQ ID NO: 3057139 - RNA, 21 nt, Human
cauauuuuucacauaucuagu

SEQ ID NO: 3057140 - RNA, 14 nt, Human
cauauuuuucacau

SEQ ID NO: 3057141 - RNA, 12 nt, Human
cauauuuucaug

SEQ ID NO: 3057142 - RNA, 22 nt, Human
caucaagucuuucacauuuaaa

SEQ ID NO: 3057143 - RNA, 14 nt, Human
caucaagaugugac

SEQ ID NO: 3057144 - RNA, 18 nt, Human
caucaaugaaugaaugaa

SEQ ID NO: 3057145 - RNA, 17 nt, Human
caucuagguaaauuaca

SEQ ID NO: 3057146 - RNA, 18 nt, Human
caucuagguaaauuacag

SEQ ID NO: 3057147 - RNA, 14 nt, Human
caucuagugagcag

SEQ ID NO: 3057148 - RNA, 12 nt, Human
caucuaggauuu

SEQ ID NO: 3057149 - RNA, 15 nt, Human
caucuacccuccgau

SEQ ID NO: 3057150 - RNA, 15 nt, Human
cauccucuguacaga

SEQ ID NO: 3057151 - RNA, 18 nt, Human
cauccucuguacagagcc

SEQ ID NO: 3057152 - RNA, 19 nt, Human
cauccucuguacagagccc

SEQ ID NO: 3057153 - RNA, 16 nt, Human
caucucacacaugagc

SEQ ID NO: 3057154 - RNA, 17 nt, Human
caucucacacaugagca

SEQ ID NO: 3057155 - RNA, 22 nt, Human
caucuagugagcagucaggaaa

SEQ ID NO: 3057156 - RNA, 20 nt, Human
caucucacacaugagcauca

SEQ ID NO: 3057157 - RNA, 15 nt, Human
cauccucauacccac

SEQ ID NO: 3057158 - RNA, 16 nt, Human
cauccucauacccacc

SEQ ID NO: 3057159 - RNA, 17 nt, Human
cauccucauacccaccc

SEQ ID NO: 3057160 - RNA, 18 nt, Human
cauccucauacccacccc

SEQ ID NO: 3057161 - RNA, 21 nt, Human
cauccucauacccacccccac

SEQ ID NO: 3057162 - RNA, 22 nt, Human
cauccucauacccacccccacc

SEQ ID NO: 3057163 - RNA, 13 nt, Human
cauccucccaagg

SEQ ID NO: 3057164 - RNA, 15 nt, Human
cauccuccucagauc

SEQ ID NO: 3057165 - RNA, 16 nt, Human
cauccuccucagaucu

SEQ ID NO: 3057166 - RNA, 18 nt, Human
cauccuccucagaucuuc

SEQ ID NO: 3057167 - RNA, 19 nt, Human
cauccuccucagaucuucu

SEQ ID NO: 3057168 - RNA, 11 nt, Human
cauccuccuca

SEQ ID NO: 3057169 - RNA, 12 nt, Human
cauccuccucag

SEQ ID NO: 3057170 - RNA, 22 nt, Human
caucuuccaaggguacuaagga

SEQ ID NO: 3057171 - RNA, 13 nt, Human
caucuugcucugc

SEQ ID NO: 3057172 - RNA, 14 nt, Human
caucuugcucugcu

SEQ ID NO: 3057173 - RNA, 19 nt, Human
caucuugcucugcugacag

SEQ ID NO: 3057174 - RNA, 20 nt, Human
caucuugcucugcugacaga

SEQ ID NO: 3057175 - RNA, 17 nt, Human
caucccugaaggccccg

SEQ ID NO: 3057176 - RNA, 18 nt, Human
caucccugaaggccccgc

SEQ ID NO: 3057177 - RNA, 19 nt, Human
caucccugaaggccccgcc

SEQ ID NO: 3057178 - RNA, 21 nt, Human
caucccugaaggccccgccca

SEQ ID NO: 3057179 - RNA, 11 nt, Human
caucccugaag

SEQ ID NO: 3057180 - RNA, 13 nt, Human
caucccugaaggc

SEQ ID NO: 3057181 - RNA, 19 nt, Human
caucccucuggggcuguuc

SEQ ID NO: 3057182 - RNA, 15 nt, Human
cauccagguucagcu

SEQ ID NO: 3057183 - RNA, 14 nt, Human
caucauugaaaucu

SEQ ID NO: 3057184 - RNA, 15 nt, Human
caucauugaaaucuu

SEQ ID NO: 3057185 - RNA, 20 nt, Human
caucauugaaaucuuuuugc

SEQ ID NO: 3057186 - RNA, 21 nt, Human
caucauugaaaucuuuuugcu

SEQ ID NO: 3057187 - RNA, 13 nt, Human
caucauugaaauc

SEQ ID NO: 3057188 - RNA, 15 nt, Human
caucaccaacgucug

SEQ ID NO: 3057189 - RNA, 17 nt, Human
aaaacacauuuuucuua

SEQ ID NO: 3057190 - RNA, 19 nt, Human
aaaacacuguucucugccc

SEQ ID NO: 3057191 - RNA, 11 nt, Human
aaaagaaaaag

SEQ ID NO: 3057192 - RNA, 20 nt, Human
aaaagacaaggaaaaaauaa

SEQ ID NO: 3057193 - RNA, 13 nt, Human
aaaagaauauuuu

SEQ ID NO: 3057194 - RNA, 13 nt, Human
aaaagacuccaaa

SEQ ID NO: 3057195 - RNA, 11 nt, Human
aaaagaaugau

SEQ ID NO: 3057196 - RNA, 12 nt, Human
aaaagaauauuu

SEQ ID NO: 3057197 - RNA, 17 nt, Human
aaaagaaagaaaaucag

SEQ ID NO: 3057198 - RNA, 14 nt, Human
aaaauaaaacuuuu

SEQ ID NO: 3057199 - RNA, 13 nt, Human
aaaaguugaauuu

SEQ ID NO: 3057200 - RNA, 18 nt, Human
aaaaguugaauuuuacau

SEQ ID NO: 3057201 - RNA, 13 nt, Human
aaaaucagccugc

SEQ ID NO: 3057202 - RNA, 17 nt, Human
aaaaucagccugcucca

SEQ ID NO: 3057203 - RNA, 21 nt, Human
aaaaucagccugcuccagcug

SEQ ID NO: 3057204 - RNA, 10 nt, Human
aaaaucauuu

SEQ ID NO: 3057205 - RNA, 12 nt, Human
aaaaucauuucu

SEQ ID NO: 3057206 - RNA, 11 nt, Human
aaaaucauuuc

SEQ ID NO: 3057207 - RNA, 18 nt, Human
aaagccugcaauuucaua

SEQ ID NO: 3057208 - RNA, 13 nt, Human
aaagccugcaauu

SEQ ID NO: 3057209 - RNA, 16 nt, Human
aaagccuccuccagcc

SEQ ID NO: 3057210 - RNA, 17 nt, Human
aaagcauuguaaaugug

SEQ ID NO: 3057211 - RNA, 15 nt, Human
aaagcauuguaaaug

SEQ ID NO: 3057212 - RNA, 20 nt, Human
aaagauauuuugcuuuguga

SEQ ID NO: 3057213 - RNA, 18 nt, Human
aaaaucucaaauuucuaa

SEQ ID NO: 3057214 - RNA, 16 nt, Human
aaaaucucaaauuucu

SEQ ID NO: 3057215 - RNA, 15 nt, Human
aaaaucucaaauuuc

SEQ ID NO: 3057216 - RNA, 21 nt, Human
aaaaucauuucugcaucagcu

SEQ ID NO: 3057217 - RNA, 15 nt, Human
aaaccgccaaggcug

SEQ ID NO: 3057218 - RNA, 16 nt, Human
aaaccgccaaggcugg

SEQ ID NO: 3057219 - RNA, 12 nt, Human
aaacccagcucu

SEQ ID NO: 3057220 - RNA, 16 nt, Human
aaacccagcucugguc

SEQ ID NO: 3057221 - RNA, 19 nt, Human
aaacccuugccaugugcua

SEQ ID NO: 3057222 - RNA, 22 nt, Human
aaaccgaacugauguaaguaaa

SEQ ID NO: 3057223 - RNA, 12 nt, Human
aaacucuuaaaa

SEQ ID NO: 3057224 - RNA, 23 nt, Human
aaacucuuaaaacccaagugccu

SEQ ID NO: 3057225 - RNA, 22 nt, Human
aaacugauuuuuuuuuccuuca

SEQ ID NO: 3057226 - RNA, 23 nt, Human
aaacugauuuuuuuuuccuucag

SEQ ID NO: 3057227 - RNA, 15 nt, Human
aaacugcacugucaa

SEQ ID NO: 3057228 - RNA, 23 nt, Human
aaaucucaaauuuggauugcuaa

SEQ ID NO: 3057229 - RNA, 19 nt, Human
aaaucucaaauuucuaaau

SEQ ID NO: 3057230 - RNA, 18 nt, Human
aaaucucaauauuucaga

SEQ ID NO: 3057231 - RNA, 13 nt, Human
aaaucuuuuugcu

SEQ ID NO: 3057232 - RNA, 14 nt, Human
aaaucuuuuugcuu

SEQ ID NO: 3057233 - RNA, 19 nt, Human
aaaugcuguaacuuucuga

SEQ ID NO: 3057234 - RNA, 21 nt, Human
aaauauuuauuuuaauaaugu

SEQ ID NO: 3057235 - RNA, 14 nt, Human
aaaggaugcacaga

SEQ ID NO: 3057236 - RNA, 20 nt, Human
aaaggaugcccaaagaugca

SEQ ID NO: 3057237 - RNA, 23 nt, Human
aaauguugacaugggacauuugc

SEQ ID NO: 3057238 - RNA, 13 nt, Human
aaauguucaucaa

SEQ ID NO: 3057239 - RNA, 22 nt, Human
aaauguugacaugggacauuug

SEQ ID NO: 3057240 - RNA, 18 nt, Human
aaccuuuguuugcaucug

SEQ ID NO: 3057241 - RNA, 16 nt, Human
aaccuuuugagugccu

SEQ ID NO: 3057242 - RNA, 23 nt, Human
aaccuuuugagugccuuacacaa

SEQ ID NO: 3057243 - RNA, 23 nt, Human
aacauggccuuugcuugaaagaa

SEQ ID NO: 3057244 - RNA, 22 nt, Human
aacauggccuuugcuugaaaga

SEQ ID NO: 3057245 - RNA, 11 nt, Human
aacaggcagau

SEQ ID NO: 3057246 - RNA, 15 nt, Human
aaauucuugcaaagu

SEQ ID NO: 3057247 - RNA, 23 nt, Human
aaauucuucuccacuuucuagcc

SEQ ID NO: 3057248 - RNA, 16 nt, Human
aaucucauaauuuaua

SEQ ID NO: 3057249 - RNA, 16 nt, Human
aaucucaauauuucag

SEQ ID NO: 3057250 - RNA, 14 nt, Human
aaugaagcaaugcu

SEQ ID NO: 3057251 - RNA, 20 nt, Human
aaugaaagacuguacaaagu

SEQ ID NO: 3057252 - RNA, 18 nt, Human
aaugaaagacuguacaaa

SEQ ID NO: 3057253 - RNA, 21 nt, Human
aaugaaagacuguacaaagua

SEQ ID NO: 3057254 - RNA, 20 nt, Human
aaugaagauacugaaauaaa

SEQ ID NO: 3057255 - RNA, 20 nt, Human
aaugaauacuuuauaaagga

SEQ ID NO: 3057256 - RNA, 20 nt, Human
aaugaugccaugaggaacaa

SEQ ID NO: 3057257 - RNA, 13 nt, Human
aauauuaagaaag

SEQ ID NO: 3057258 - RNA, 23 nt, Human
aauauguggaguucaucuugaau

SEQ ID NO: 3057259 - RNA, 23 nt, Human
aaucaccgaaaacguggcugcuu

SEQ ID NO: 3057260 - RNA, 21 nt, Human
aaucaccgaaaacguggcugc

SEQ ID NO: 3057261 - RNA, 16 nt, Human
aauaaacacucuugaa

SEQ ID NO: 3057262 - RNA, 11 nt, Human
aauaaacacuc

SEQ ID NO: 3057263 - RNA, 19 nt, Human
aauaaacacucuugaaaaa

SEQ ID NO: 3057264 - RNA, 22 nt, Human
aagugcugcauuuaaaagauac

SEQ ID NO: 3057265 - RNA, 14 nt, Human
aagugcugcauuua

SEQ ID NO: 3057266 - RNA, 12 nt, Human
aagugcugggau

SEQ ID NO: 3057267 - RNA, 16 nt, Human
aauaaugugaaacugg

SEQ ID NO: 3057268 - RNA, 14 nt, Human
aauaaagcagcguu

SEQ ID NO: 3057269 - RNA, 22 nt, Human
aauaaugugaaacuggauuaaa

SEQ ID NO: 3057270 - RNA, 17 nt, Human
aauaaugugaaacugga

SEQ ID NO: 3057271 - RNA, 19 nt, Human
aagaguauuuuugacagaa

SEQ ID NO: 3057272 - RNA, 16 nt, Human
aagaguaguaauagag

SEQ ID NO: 3057273 - RNA, 20 nt, Human
aagaguaggaagacuuugga

SEQ ID NO: 3057274 - RNA, 21 nt, Human
aagacaaggaaaaaauaacaa

SEQ ID NO: 3057275 - RNA, 20 nt, Human
aagaagacugcauuauauuu

SEQ ID NO: 3057276 - RNA, 15 nt, Human
aagaagacugcauua

SEQ ID NO: 3057277 - RNA, 20 nt, Human
aagacaaugugaaaagaaaa

SEQ ID NO: 3057278 - RNA, 19 nt, Human
aagacaaugugaaaagaaa

SEQ ID NO: 3057279 - RNA, 22 nt, Human
aagacaaugacuuacuguacau

SEQ ID NO: 3057280 - RNA, 15 nt, Human
aagaacugaaaucau

SEQ ID NO: 3057281 - RNA, 11 nt, Human
aagaacugaaa

SEQ ID NO: 3057282 - RNA, 12 nt, Human
aagaacugaaau

SEQ ID NO: 3057283 - RNA, 13 nt, Human
aagaacugaaauc

SEQ ID NO: 3057284 - RNA, 20 nt, Human
aacgcaggcccccaggugcc

SEQ ID NO: 3057285 - RNA, 14 nt, Human
aagagagaaaauaa

SEQ ID NO: 3057286 - RNA, 17 nt, Human
aagacuuuuccaacccu

SEQ ID NO: 3057287 - RNA, 13 nt, Human
aagagaaaaaaua

SEQ ID NO: 3057288 - RNA, 19 nt, Human
aagacuuuucuuucagcca

SEQ ID NO: 3057289 - RNA, 21 nt, Human
aagacuuuuccaacccucauc

SEQ ID NO: 3057290 - RNA, 12 nt, Human
aagacuuuucuu

SEQ ID NO: 3057291 - RNA, 17 nt, Human
aagaccacguuucuaaa

SEQ ID NO: 3057292 - RNA, 15 nt, Human
aagaccacguuucua

SEQ ID NO: 3057293 - RNA, 23 nt, Human
aagacagauacuccuccaagguu

SEQ ID NO: 3057294 - RNA, 22 nt, Human
aagacagagccccacccucaga

SEQ ID NO: 3057295 - RNA, 15 nt, Human
aagcgugagccacug

SEQ ID NO: 3057296 - RNA, 13 nt, Human
aagcuacuuauug

SEQ ID NO: 3057297 - RNA, 14 nt, Human
aagcggcuggcagc

SEQ ID NO: 3057298 - RNA, 17 nt, Human
aagauacaguuacucag

SEQ ID NO: 3057299 - RNA, 19 nt, Human
aagauaauauuaaggaaga

SEQ ID NO: 3057300 - RNA, 21 nt, Human
aagauaauauuaaggaagaca

SEQ ID NO: 3057301 - RNA, 14 nt, Human
aagauaaaugugcu

SEQ ID NO: 3057302 - RNA, 13 nt, Human
aagcugcacccuc

SEQ ID NO: 3057303 - RNA, 19 nt, Human
aagcugcacccucaggcag

SEQ ID NO: 3057304 - RNA, 13 nt, Human
aaggcaaggcugu

SEQ ID NO: 3057305 - RNA, 15 nt, Human
aaggcaaggcuguca

SEQ ID NO: 3057306 - RNA, 15 nt, Human
aauuauauaaguauu

SEQ ID NO: 3057307 - RNA, 16 nt, Human
aauuauauaaguauuc

SEQ ID NO: 3057308 - RNA, 17 nt, Human
aauuauauaaguauucu

SEQ ID NO: 3057309 - RNA, 19 nt, Human
aauuaugaguuauuuuuau

SEQ ID NO: 3057310 - RNA, 18 nt, Human
aauuaugaaacuuuugga

SEQ ID NO: 3057311 - RNA, 13 nt, Human
aauuaugaaacuu

SEQ ID NO: 3057312 - RNA, 15 nt, Human
aauuaugaaacuuuu

SEQ ID NO: 3057313 - RNA, 12 nt, Human
aauuaugaaacu

SEQ ID NO: 3057314 - RNA, 19 nt, Human
aauucucagaaucucaaau

SEQ ID NO: 3057315 - RNA, 14 nt, Human
aauucuacuuugag

SEQ ID NO: 3057316 - RNA, 17 nt, Human
aauucucuaguuugauu

SEQ ID NO: 3057317 - RNA, 15 nt, Human
aauucucuaguuuga

SEQ ID NO: 3057318 - RNA, 15 nt, Human
aauucucuuauccaa

SEQ ID NO: 3057319 - RNA, 21 nt, Human
aauucucauuugucacacacu

SEQ ID NO: 3057320 - RNA, 14 nt, Human
aauucuguuuuucu

SEQ ID NO: 3057321 - RNA, 18 nt, Human
aauucuguuuuucuaggc

SEQ ID NO: 3057322 - RNA, 15 nt, Human
aauuggagcucgugg

SEQ ID NO: 3057323 - RNA, 22 nt, Human
aauuguaaggaaugauuaauua

SEQ ID NO: 3057324 - RNA, 11 nt, Human
aauuguaauag

SEQ ID NO: 3057325 - RNA, 22 nt, Human
aauuucauaccuaucaucuuaa

SEQ ID NO: 3057326 - RNA, 18 nt, Human
aauuucauaugcuguaua

SEQ ID NO: 3057327 - RNA, 16 nt, Human
aauuucauaugcugua

SEQ ID NO: 3057328 - RNA, 15 nt, Human
aauuucccaaagcag

SEQ ID NO: 3057329 - RNA, 17 nt, Human
aauuucccaaagcagug

SEQ ID NO: 3057330 - RNA, 12 nt, Human
aauuuccuggga

SEQ ID NO: 3057331 - RNA, 15 nt, Human
aauuuccugggagcu

SEQ ID NO: 3057332 - RNA, 16 nt, Human
acacagcucuucucca

SEQ ID NO: 3057333 - RNA, 14 nt, Human
acacagcucuucuc

SEQ ID NO: 3057334 - RNA, 13 nt, Human
acaccagagccca

SEQ ID NO: 3057335 - RNA, 15 nt, Human
acaccaauauucaua

SEQ ID NO: 3057336 - RNA, 23 nt, Human
acaccagagcccaccuuggcuca

SEQ ID NO: 3057337 - RNA, 18 nt, Human
acaccagagcccaccuug

SEQ ID NO: 3057338 - RNA, 18 nt, Human
acacagcucuucuccagg

SEQ ID NO: 3057339 - RNA, 16 nt, Human
acaaggcaaggcuguc

SEQ ID NO: 3057340 - RNA, 17 nt, Human
acaaggcaaggcuguca

SEQ ID NO: 3057341 - RNA, 19 nt, Human
acaaggcaaggcugucaau

SEQ ID NO: 3057342 - RNA, 15 nt, Human
acaaggcaaggcugu

SEQ ID NO: 3057343 - RNA, 15 nt, Human
acaaguuaaauaaau

SEQ ID NO: 3057344 - RNA, 12 nt, Human
accaagcccagu

SEQ ID NO: 3057345 - RNA, 16 nt, Human
accacgcuggaccuug

SEQ ID NO: 3057346 - RNA, 14 nt, Human
accacgcuggaccu

SEQ ID NO: 3057347 - RNA, 18 nt, Human
accacgcuggaccuugaa

SEQ ID NO: 3057348 - RNA, 14 nt, Human
accacguuucuaaa

SEQ ID NO: 3057349 - RNA, 13 nt, Human
accacguuucuaa

SEQ ID NO: 3057350 - RNA, 14 nt, Human
accaacgucugugc

SEQ ID NO: 3057351 - RNA, 17 nt, Human
accaacgucugugccau

SEQ ID NO: 3057352 - RNA, 15 nt, Human
acauuugcucaugga

SEQ ID NO: 3057353 - RNA, 14 nt, Human
acauuuguauaaaa

SEQ ID NO: 3057354 - RNA, 16 nt, Human
acauuuguauaaaaua

SEQ ID NO: 3057355 - RNA, 19 nt, Human
acauuuguauaaaauaauu

SEQ ID NO: 3057356 - RNA, 14 nt, Human
accagagcugccac

SEQ ID NO: 3057357 - RNA, 16 nt, Human
accagagcugccaccu

SEQ ID NO: 3057358 - RNA, 13 nt, Human
accagagcugcca

SEQ ID NO: 3057359 - RNA, 12 nt, Human
accagagcugcc

SEQ ID NO: 3057360 - RNA, 23 nt, Human
acauguuucuuuguaaugaaaac

SEQ ID NO: 3057361 - RNA, 20 nt, Human
acauaaguauuuaauucaug

SEQ ID NO: 3057362 - RNA, 21 nt, Human
acauaaguaauucaagaaaac

SEQ ID NO: 3057363 - RNA, 20 nt, Human
acauaaguaauucaagaaaa

SEQ ID NO: 3057364 - RNA, 20 nt, Human
acauaaauuuaguauuuugu

SEQ ID NO: 3057365 - RNA, 16 nt, Human
acauacaauuccaaac

SEQ ID NO: 3057366 - RNA, 20 nt, Human
acauacaggaagguagaaau

SEQ ID NO: 3057367 - RNA, 20 nt, Human
acaugccucucucaggccaa

SEQ ID NO: 3057368 - RNA, 13 nt, Human
acaugcacgugug

SEQ ID NO: 3057369 - RNA, 23 nt, Human
acaugcacagcuaacauggaagu

SEQ ID NO: 3057370 - RNA, 14 nt, Human
acaggcaaugcugg

SEQ ID NO: 3057371 - RNA, 24 nt, Human
acaggaugguucccuugaugaaga

SEQ ID NO: 3057372 - RNA, 22 nt, Human
acaggaugguucccuugaugaa

SEQ ID NO: 3057373 - RNA, 17 nt, Human
acaggcaaugcuggcug

SEQ ID NO: 3057374 - RNA, 14 nt, Human
acaggcacccacca

SEQ ID NO: 3057375 - RNA, 16 nt, Human
acaggcaaugcuggcu

SEQ ID NO: 3057376 - RNA, 15 nt, Human
acaggcaaugcuggc

SEQ ID NO: 3057377 - RNA, 18 nt, Human
acagcucuucuccaggcu

SEQ ID NO: 3057378 - RNA, 20 nt, Human
acagcucuucuccaggcugu

SEQ ID NO: 3057379 - RNA, 19 nt, Human
acagcucuucuccaggcug

SEQ ID NO: 3057380 - RNA, 23 nt, Human
acaggcacccaccaucaugucug

SEQ ID NO: 3057381 - RNA, 23 nt, Human
acagugaucaaguuauuuuuaau

SEQ ID NO: 3057382 - RNA, 19 nt, Human
acagugauuaccagggacu

SEQ ID NO: 3057383 - RNA, 14 nt, Human
acuugaaaauuaac

SEQ ID NO: 3057384 - RNA, 12 nt, Human
acuugaaaauua

SEQ ID NO: 3057385 - RNA, 23 nt, Human
acuuggggggcugaggugggagg

SEQ ID NO: 3057386 - RNA, 21 nt, Human
acuucagacauagaauuaaca

SEQ ID NO: 3057387 - RNA, 18 nt, Human
acuguuucaaacuuuacu

SEQ ID NO: 3057388 - RNA, 15 nt, Human
acuguuucaaacuuu

SEQ ID NO: 3057389 - RNA, 13 nt, Human
acuguuucaaacu

SEQ ID NO: 3057390 - RNA, 19 nt, Human
acuguuucaaacuuuacua

SEQ ID NO: 3057391 - RNA, 17 nt, Human
acuucaaauccuugaag

SEQ ID NO: 3057392 - RNA, 12 nt, Human
acuucagacaua

SEQ ID NO: 3057393 - RNA, 18 nt, Human
acuucaaauccuugaaga

SEQ ID NO: 3057394 - RNA, 22 nt, Human
acuuaaaaaugguuuaaauggu

SEQ ID NO: 3057395 - RNA, 21 nt, Human
acuuaaaaaugguuuaaaugg

SEQ ID NO: 3057396 - RNA, 23 nt, Human
acugucuuuuuucuaaaguaaaa

SEQ ID NO: 3057397 - RNA, 22 nt, Human
acugucuuuuuucuaaaguaaa

SEQ ID NO: 3057398 - RNA, 16 nt, Human
acugugccaugugcca

SEQ ID NO: 3057399 - RNA, 18 nt, Human
acugugccaugugccagg

SEQ ID NO: 3057400 - RNA, 17 nt, Human
acugugccaugugccag

SEQ ID NO: 3057401 - RNA, 16 nt, Human
acugucuuuuuucuaa

SEQ ID NO: 3057402 - RNA, 17 nt, Human
acuguaaaauaauaacu

SEQ ID NO: 3057403 - RNA, 15 nt, Human
acugccuauuuuaau

SEQ ID NO: 3057404 - RNA, 14 nt, Human
acugccaugccagc

SEQ ID NO: 3057405 - RNA, 19 nt, Human
acugauaugggucuugaua

SEQ ID NO: 3057406 - RNA, 14 nt, Human
acugauuacugccu

SEQ ID NO: 3057407 - RNA, 23 nt, Human
acugaugggcaacccccagccug

SEQ ID NO: 3057408 - RNA, 17 nt, Human
acugauuuuuuuuuccu

SEQ ID NO: 3057409 - RNA, 18 nt, Human
acugauuuuuuuuuccuu

SEQ ID NO: 3057410 - RNA, 19 nt, Human
acugauuuuuuuuuccuuc

SEQ ID NO: 3057411 - RNA, 20 nt, Human
acugauuuuuuuuuccuuca

SEQ ID NO: 3057412 - RNA, 16 nt, Human
acugauuuuuuuuucc

SEQ ID NO: 3057413 - RNA, 16 nt, Human
acugacagauuuccau

SEQ ID NO: 3057414 - RNA, 18 nt, Human
acugacauuguuggccaa

SEQ ID NO: 3057415 - RNA, 17 nt, Human
acugacauuguuggcca

SEQ ID NO: 3057416 - RNA, 23 nt, Human
acugaauuucuuuugccguuauu

SEQ ID NO: 3057417 - RNA, 13 nt, Human
acugacacaugcu

SEQ ID NO: 3057418 - RNA, 22 nt, Human
acugaauggacuuugcacacuu

SEQ ID NO: 3057419 - RNA, 17 nt, Human
acugaauggacuuugca

SEQ ID NO: 3057420 - RNA, 12 nt, Human
acugaauuucuu

SEQ ID NO: 3057421 - RNA, 20 nt, Human
acugaauuaugaaacuuuug

SEQ ID NO: 3057422 - RNA, 13 nt, Human
acugaauuaugaa

SEQ ID NO: 3057423 - RNA, 14 nt, Human
acugaauuaugaaa

SEQ ID NO: 3057424 - RNA, 15 nt, Human
acugaauuaugaaac

SEQ ID NO: 3057425 - RNA, 22 nt, Human
acucccaucugugaaaggaaag

SEQ ID NO: 3057426 - RNA, 17 nt, Human
acucccaugagggagau

SEQ ID NO: 3057427 - RNA, 22 nt, Human
acucccaugagggagaugccau

SEQ ID NO: 3057428 - RNA, 23 nt, Human
acucccaugagggagaugccaug

SEQ ID NO: 3057429 - RNA, 16 nt, Human
acuccggcccuccaga

SEQ ID NO: 3057430 - RNA, 14 nt, Human
acucccuuucaaca

SEQ ID NO: 3057431 - RNA, 19 nt, Human
acuccggcccuccagagcc

SEQ ID NO: 3057432 - RNA, 15 nt, Human
acucuacagaggcca

SEQ ID NO: 3057433 - RNA, 14 nt, Human
acucguuaauuugu

SEQ ID NO: 3057434 - RNA, 19 nt, Human
acucguuaauuuguagugu

SEQ ID NO: 3057435 - RNA, 18 nt, Human
accgugaggccagagaca

SEQ ID NO: 3057436 - RNA, 11 nt, Human
accucagccuc

SEQ ID NO: 3057437 - RNA, 12 nt, Human
accucagccucc

SEQ ID NO: 3057438 - RNA, 23 nt, Human
accgugaggccagagacacaagc

SEQ ID NO: 3057439 - RNA, 17 nt, Human
acccugugauggggccc

SEQ ID NO: 3057440 - RNA, 19 nt, Human
acccugugauggggcccug

SEQ ID NO: 3057441 - RNA, 20 nt, Human
acccugugauggggcccugc

SEQ ID NO: 3057442 - RNA, 21 nt, Human
acccugugauggggcccugcc

SEQ ID NO: 3057443 - RNA, 16 nt, Human
accgggcacucagaag

SEQ ID NO: 3057444 - RNA, 20 nt, Human
accgggccacagagaaagua

SEQ ID NO: 3057445 - RNA, 14 nt, Human
accgggcacucaga

SEQ ID NO: 3057446 - RNA, 12 nt, Human
accgggcacuca

SEQ ID NO: 3057447 - RNA, 21 nt, Human
accucaggugauccacccacc

SEQ ID NO: 3057448 - RNA, 20 nt, Human
accucaggugauccacccac

SEQ ID NO: 3057449 - RNA, 11 nt, Human
accucaggccu

SEQ ID NO: 3057450 - RNA, 23 nt, Human
acccucaucaccaacgucugugc

SEQ ID NO: 3057451 - RNA, 23 nt, Human
acccuggcacuauaauguaagcu

SEQ ID NO: 3057452 - RNA, 15 nt, Human
acccucaggcaggug

SEQ ID NO: 3057453 - RNA, 16 nt, Human
acccucaggcaggugg

SEQ ID NO: 3057454 - RNA, 13 nt, Human
acccucaucacca

SEQ ID NO: 3057455 - RNA, 13 nt, Human
acccucaggcagg

SEQ ID NO: 3057456 - RNA, 14 nt, Human
acccucaggcaggu

SEQ ID NO: 3057457 - RNA, 20 nt, Human
acccucagaugcacaugagc

SEQ ID NO: 3057458 - RNA, 16 nt, Human
acccugugauggggcc

SEQ ID NO: 3057459 - RNA, 21 nt, Human
acccugucucuacuaaaaaua

SEQ ID NO: 3057460 - RNA, 16 nt, Human
acccuggggagaaagu

SEQ ID NO: 3057461 - RNA, 14 nt, Human
acccuauugcugcu

SEQ ID NO: 3057462 - RNA, 19 nt, Human
acccuauugcugcuugagg

SEQ ID NO: 3057463 - RNA, 13 nt, Human
acccuauugcugc

SEQ ID NO: 3057464 - RNA, 17 nt, Human
acccgucuccagcugcu

SEQ ID NO: 3057465 - RNA, 12 nt, Human
accucugccuga

SEQ ID NO: 3057466 - RNA, 20 nt, Human
accucugccucagaaaacaa

SEQ ID NO: 3057467 - RNA, 20 nt, Human
accucugccugaagucacac

SEQ ID NO: 3057468 - RNA, 19 nt, Human
accugccaggaagccagca

SEQ ID NO: 3057469 - RNA, 23 nt, Human
accugccaggaagccagcaggcu

SEQ ID NO: 3057470 - RNA, 21 nt, Human
accugccaggaagccagcagg

SEQ ID NO: 3057471 - RNA, 22 nt, Human
accugccaggaagccagcaggc

SEQ ID NO: 3057472 - RNA, 12 nt, Human
accugccccuca

SEQ ID NO: 3057473 - RNA, 15 nt, Human
accugccccucaacu

SEQ ID NO: 3057474 - RNA, 18 nt, Human
acuaauggggcggugaga

SEQ ID NO: 3057475 - RNA, 20 nt, Human
acuaauguguaagacaaaaa

SEQ ID NO: 3057476 - RNA, 22 nt, Human
acgcugugcugcccugcccacc

SEQ ID NO: 3057477 - RNA, 19 nt, Human
acgcugugcugcccugccc

SEQ ID NO: 3057478 - RNA, 12 nt, Human
acgucugugcca

SEQ ID NO: 3057479 - RNA, 13 nt, Human
acgucugugccau

SEQ ID NO: 3057480 - RNA, 13 nt, Human
acgucuuaaauau

SEQ ID NO: 3057481 - RNA, 14 nt, Human
acgucuuaaauauu

SEQ ID NO: 3057482 - RNA, 15 nt, Human
acggaauaguuggcu

SEQ ID NO: 3057483 - RNA, 19 nt, Human
acggaauaguuggcuagga

SEQ ID NO: 3057484 - RNA, 17 nt, Human
acggacacucaaaagcu

SEQ ID NO: 3057485 - RNA, 19 nt, Human
acgauuucuguuuagauaa

SEQ ID NO: 3057486 - RNA, 23 nt, Human
acgauuucuguuuagauaauaca

SEQ ID NO: 3057487 - RNA, 20 nt, Human
acgauuucuguuuagauaau

SEQ ID NO: 3057488 - RNA, 14 nt, Human
acgcacacugucug

SEQ ID NO: 3057489 - RNA, 13 nt, Human
agugaaugaaaca

SEQ ID NO: 3057490 - RNA, 14 nt, Human
agugacagaggcag

SEQ ID NO: 3057491 - RNA, 19 nt, Human
agugacagaggcagcccca

SEQ ID NO: 3057492 - RNA, 16 nt, Human
agugacagaggcagcc

SEQ ID NO: 3057493 - RNA, 19 nt, Human
agugccuuauggaacacuc

SEQ ID NO: 3057494 - RNA, 20 nt, Human
agugccuuauggaacacucu

SEQ ID NO: 3057495 - RNA, 21 nt, Human
agugccuuauggaacacucug

SEQ ID NO: 3057496 - RNA, 22 nt, Human
agugccuuauggaacacucuga

SEQ ID NO: 3057497 - RNA, 18 nt, Human
agugccuuauggaacacu

SEQ ID NO: 3057498 - RNA, 20 nt, Human
agugauucuccugccucagc

SEQ ID NO: 3057499 - RNA, 18 nt, Human
agugauucuccugccuca

SEQ ID NO: 3057500 - RNA, 19 nt, Human
agugauucuccugccucag

SEQ ID NO: 3057501 - RNA, 22 nt, Human
agugauccucccaccucagccu

SEQ ID NO: 3057502 - RNA, 20 nt, Human
agugauccucccaccucagc

SEQ ID NO: 3057503 - RNA, 19 nt, Human
agugauccucccaccucag

SEQ ID NO: 3057504 - RNA, 13 nt, Human
agugauuaccagg

SEQ ID NO: 3057505 - RNA, 19 nt, Human
agugaugucacuagggcag

SEQ ID NO: 3057506 - RNA, 16 nt, Human
aguccuuaccagcaga

SEQ ID NO: 3057507 - RNA, 18 nt, Human
aguccuuaccagcagagc

SEQ ID NO: 3057508 - RNA, 14 nt, Human
aguccucuuuucug

SEQ ID NO: 3057509 - RNA, 13 nt, Human
agucauuuaauaa

SEQ ID NO: 3057510 - RNA, 16 nt, Human
agucgaggacagggag

SEQ ID NO: 3057511 - RNA, 18 nt, Human
agucuggaaugcaguggu

SEQ ID NO: 3057512 - RNA, 20 nt, Human
agucugauucccaagcucug

SEQ ID NO: 3057513 - RNA, 22 nt, Human
agucugauucccaagcucugcu

SEQ ID NO: 3057514 - RNA, 21 nt, Human
agucugauucccaagcucugc

SEQ ID NO: 3057515 - RNA, 18 nt, Human
agucuggcccuuccuuuu

SEQ ID NO: 3057516 - RNA, 22 nt, Human
aguauauugauccagaaagaaa

SEQ ID NO: 3057517 - RNA, 21 nt, Human
aguacuucuccacccugcucu

SEQ ID NO: 3057518 - RNA, 19 nt, Human
aguacuucuccacccugcu

SEQ ID NO: 3057519 - RNA, 20 nt, Human
aguacuucuccacccugcuc

SEQ ID NO: 3057520 - RNA, 15 nt, Human
aguacuggagaaaau

SEQ ID NO: 3057521 - RNA, 13 nt, Human
aguacucauacau

SEQ ID NO: 3057522 - RNA, 18 nt, Human
aguaaaugggggugcauu

SEQ ID NO: 3057523 - RNA, 20 nt, Human
aguaaaugggggugcauuug

SEQ ID NO: 3057524 - RNA, 19 nt, Human
aguaaaugggggugcauuu

SEQ ID NO: 3057525 - RNA, 21 nt, Human
aguaaaugggggugcauuuga

SEQ ID NO: 3057526 - RNA, 17 nt, Human
aguaacuuacuuaggug

SEQ ID NO: 3057527 - RNA, 15 nt, Human
auaaguaaaugcuag

SEQ ID NO: 3057528 - RNA, 14 nt, Human
auaagcuacugcca

SEQ ID NO: 3057529 - RNA, 16 nt, Human
auaagcuacugccauc

SEQ ID NO: 3057530 - RNA, 17 nt, Human
auaaguaauucaagaaa

SEQ ID NO: 3057531 - RNA, 15 nt, Human
auacaccacuacauu

SEQ ID NO: 3057532 - RNA, 20 nt, Human
auacacacucaaaucaagaa

SEQ ID NO: 3057533 - RNA, 23 nt, Human
auacaaugcugugcccuaaagug

SEQ ID NO: 3057534 - RNA, 12 nt, Human
auaauguuaaca

SEQ ID NO: 3057535 - RNA, 21 nt, Human
auaaagaugagugagcaugcc

SEQ ID NO: 3057536 - RNA, 19 nt, Human
auacuugaaaauuaacaug

SEQ ID NO: 3057537 - RNA, 17 nt, Human
auacaccacuacauucu

SEQ ID NO: 3057538 - RNA, 20 nt, Human
aguuguucaauaauaaauau

SEQ ID NO: 3057539 - RNA, 17 nt, Human
aguuguuagugugucuu

SEQ ID NO: 3057540 - RNA, 22 nt, Human
aguuguuagugugucuuagugu

SEQ ID NO: 3057541 - RNA, 14 nt, Human
aguucauacccugu

SEQ ID NO: 3057542 - RNA, 18 nt, Human
aguuccaccaucaagcca

SEQ ID NO: 3057543 - RNA, 21 nt, Human
aguuccaccaucaagccacca

SEQ ID NO: 3057544 - RNA, 18 nt, Human
aguugaaaaacagcugag

SEQ ID NO: 3057545 - RNA, 16 nt, Human
aguugaagacagagcu

SEQ ID NO: 3057546 - RNA, 17 nt, Human
aguugaagacagagcua

SEQ ID NO: 3057547 - RNA, 17 nt, Human
aguugaaaaacagcuga

SEQ ID NO: 3057548 - RNA, 17 nt, Human
agugcucacccacacca

SEQ ID NO: 3057549 - RNA, 18 nt, Human
agugcucacccacaccau

SEQ ID NO: 3057550 - RNA, 14 nt, Human
auaaaaacaacuuu

SEQ ID NO: 3057551 - RNA, 20 nt, Human
auaaaaagacauucuuccaa

SEQ ID NO: 3057552 - RNA, 23 nt, Human
auaaaaauauuguguugugaaug

SEQ ID NO: 3057553 - RNA, 22 nt, Human
auaaaaauauuguguugugaau

SEQ ID NO: 3057554 - RNA, 16 nt, Human
auaaaagacagugaaa

SEQ ID NO: 3057555 - RNA, 15 nt, Human
auaaaagacagugaa

SEQ ID NO: 3057556 - RNA, 14 nt, Human
aguuugauuaaauu

SEQ ID NO: 3057557 - RNA, 11 nt, Human
aguuugcaguu

SEQ ID NO: 3057558 - RNA, 20 nt, Human
aucaaagggugaaaauuauu

SEQ ID NO: 3057559 - RNA, 18 nt, Human
aucaaagagagaaaauaa

SEQ ID NO: 3057560 - RNA, 19 nt, Human
aucaaagagguuuuaaaaa

SEQ ID NO: 3057561 - RNA, 20 nt, Human
aucaaaagguuaauaaagua

SEQ ID NO: 3057562 - RNA, 18 nt, Human
auauuuuuuucuuuucuu

SEQ ID NO: 3057563 - RNA, 16 nt, Human
auauuuuuuucugaaa

SEQ ID NO: 3057564 - RNA, 18 nt, Human
auauuuuuuucugaaauu

SEQ ID NO: 3057565 - RNA, 14 nt, Human
auauuuuuuucuga

SEQ ID NO: 3057566 - RNA, 14 nt, Human
aucaaaagaaagaa

SEQ ID NO: 3057567 - RNA, 19 nt, Human
auauuuuuuucugaaauuu

SEQ ID NO: 3057568 - RNA, 14 nt, Human
auagcacagacccu

SEQ ID NO: 3057569 - RNA, 23 nt, Human
auccacuuuaucuugaauaaugu

SEQ ID NO: 3057570 - RNA, 21 nt, Human
auccacugugccaugugccag

SEQ ID NO: 3057571 - RNA, 15 nt, Human
aucauccuaagcuau

SEQ ID NO: 3057572 - RNA, 20 nt, Human
aucaugacaaagacugagua

SEQ ID NO: 3057573 - RNA, 21 nt, Human
aucaugaauuaguuuuauaug

SEQ ID NO: 3057574 - RNA, 22 nt, Human
aucuaggaagacuuuggaaaga

SEQ ID NO: 3057575 - RNA, 12 nt, Human
auccuugaagau

SEQ ID NO: 3057576 - RNA, 15 nt, Human
augaccuuucaauag

SEQ ID NO: 3057577 - RNA, 13 nt, Human
augaccuuucaau

SEQ ID NO: 3057578 - RNA, 11 nt, Human
augagccuggc

SEQ ID NO: 3057579 - RNA, 19 nt, Human
augagccucagcauccugg

SEQ ID NO: 3057580 - RNA, 21 nt, Human
augagccucagcauccuggca

SEQ ID NO: 3057581 - RNA, 12 nt, Human
augaaagacugu

SEQ ID NO: 3057582 - RNA, 16 nt, Human
augaaacuuuuggaag

SEQ ID NO: 3057583 - RNA, 23 nt, Human
augaagcauuuacuuuguguuca

SEQ ID NO: 3057584 - RNA, 23 nt, Human
augaaguuuuuuuuauacaggau

SEQ ID NO: 3057585 - RNA, 21 nt, Human
augaaguaauaugcacacauu

SEQ ID NO: 3057586 - RNA, 14 nt, Human
augaaguaauaugc

SEQ ID NO: 3057587 - RNA, 23 nt, Human
augaaguaauaugcacacauuuu

SEQ ID NO: 3057588 - RNA, 19 nt, Human
aucuaggauuuuaagggaa

SEQ ID NO: 3057589 - RNA, 11 nt, Human
aucuaggauuu

SEQ ID NO: 3057590 - RNA, 23 nt, Human
aucuaggaagacuuuggaaagag

SEQ ID NO: 3057591 - RNA, 16 nt, Human
augcuuugaucccuuc

SEQ ID NO: 3057592 - RNA, 14 nt, Human
augcuucuucagag

SEQ ID NO: 3057593 - RNA, 17 nt, Human
augcuucuucagagacu

SEQ ID NO: 3057594 - RNA, 20 nt, Human
augcuucuucagagacuccu

SEQ ID NO: 3057595 - RNA, 21 nt, Human
augcuucuguuuuauaauuuu

SEQ ID NO: 3057596 - RNA, 19 nt, Human
augcucugcauguuacaua

SEQ ID NO: 3057597 - RNA, 18 nt, Human
augcucugcauguuacau

SEQ ID NO: 3057598 - RNA, 15 nt, Human
augcucugcauguua

SEQ ID NO: 3057599 - RNA, 21 nt, Human
augggaaugaaugucagugug

SEQ ID NO: 3057600 - RNA, 20 nt, Human
augggaaagcauuguaaaug

SEQ ID NO: 3057601 - RNA, 14 nt, Human
augggaaagcauug

SEQ ID NO: 3057602 - RNA, 15 nt, Human
augggacagggagga

SEQ ID NO: 3057603 - RNA, 20 nt, Human
augggacauuugcucaugga

SEQ ID NO: 3057604 - RNA, 23 nt, Human
auggcuuccuggcaauagucaaa

SEQ ID NO: 3057605 - RNA, 18 nt, Human
auggcuuuugugcauuau

SEQ ID NO: 3057606 - RNA, 24 nt, Human
augcauauuauuuuauguugcaua

SEQ ID NO: 3057607 - RNA, 20 nt, Human
augcauauuauuuuauguug

SEQ ID NO: 3057608 - RNA, 18 nt, Human
augccugguggcagcugc

SEQ ID NO: 3057609 - RNA, 19 nt, Human
augccugguggcagcugcg

SEQ ID NO: 3057610 - RNA, 13 nt, Human
augccugguggca

SEQ ID NO: 3057611 - RNA, 12 nt, Human
augccugguggc

SEQ ID NO: 3057612 - RNA, 11 nt, Human
augccuggugg

SEQ ID NO: 3057613 - RNA, 21 nt, Human
augccugguggcagcugcggu

SEQ ID NO: 3057614 - RNA, 23 nt, Human
agcaaaauugauguguuuauuua

SEQ ID NO: 3057615 - RNA, 19 nt, Human
agcaaauucuguuuuucua

SEQ ID NO: 3057616 - RNA, 19 nt, Human
agcaaaauugauguguuua

SEQ ID NO: 3057617 - RNA, 13 nt, Human
agcaaaauugaug

SEQ ID NO: 3057618 - RNA, 16 nt, Human
agauugcaccacugca

SEQ ID NO: 3057619 - RNA, 17 nt, Human
agauugcaacaggcugg

SEQ ID NO: 3057620 - RNA, 17 nt, Human
agauugagauguguuca

SEQ ID NO: 3057621 - RNA, 16 nt, Human
agauugcaacaggcug

SEQ ID NO: 3057622 - RNA, 15 nt, Human
agauucuuuccugag

SEQ ID NO: 3057623 - RNA, 16 nt, Human
agauucuuuccugagg

SEQ ID NO: 3057624 - RNA, 18 nt, Human
agaucucuaacuucacca

SEQ ID NO: 3057625 - RNA, 18 nt, Human
agaugacaucugucuagg

SEQ ID NO: 3057626 - RNA, 20 nt, Human
agaugggugcuuggaggaag

SEQ ID NO: 3057627 - RNA, 22 nt, Human
agaugggugcuuggaggaagga

SEQ ID NO: 3057628 - RNA, 14 nt, Human
agauucuuuccuga

SEQ ID NO: 3057629 - RNA, 20 nt, Human
agagggucugaggaauccag

SEQ ID NO: 3057630 - RNA, 23 nt, Human
agaggggguggccucccaacuca

SEQ ID NO: 3057631 - RNA, 20 nt, Human
agauagauaggucagugcaa

SEQ ID NO: 3057632 - RNA, 20 nt, Human
agauagccaaggccaaagga

SEQ ID NO: 3057633 - RNA, 13 nt, Human
agaguugaagaca

SEQ ID NO: 3057634 - RNA, 14 nt, Human
agaguugaagacag

SEQ ID NO: 3057635 - RNA, 15 nt, Human
agaguugaagacaga

SEQ ID NO: 3057636 - RNA, 15 nt, Human
agauaugauucaaau

SEQ ID NO: 3057637 - RNA, 14 nt, Human
agauaugauucaaa

SEQ ID NO: 3057638 - RNA, 17 nt, Human
agccaacuauggccugu

SEQ ID NO: 3057639 - RNA, 14 nt, Human
agccagauuucacu

SEQ ID NO: 3057640 - RNA, 17 nt, Human
agccagauuucacucuc

SEQ ID NO: 3057641 - RNA, 20 nt, Human
agccagauuucacucuccuu

SEQ ID NO: 3057642 - RNA, 22 nt, Human
agccagauuucacucuccuugg

SEQ ID NO: 3057643 - RNA, 19 nt, Human
agccauuugucccaagugc

SEQ ID NO: 3057644 - RNA, 22 nt, Human
agccagcaggcucucaggccag

SEQ ID NO: 3057645 - RNA, 21 nt, Human
agccagcaggcucucaggcca

SEQ ID NO: 3057646 - RNA, 23 nt, Human
agccagcaggcucucaggccagc

SEQ ID NO: 3057647 - RNA, 17 nt, Human
agcccacgcccccacug

SEQ ID NO: 3057648 - RNA, 18 nt, Human
agcccacgcccccacugg

SEQ ID NO: 3057649 - RNA, 15 nt, Human
agcccacgcccccac

SEQ ID NO: 3057650 - RNA, 19 nt, Human
agcccacgcccccacuggu

SEQ ID NO: 3057651 - RNA, 23 nt, Human
agcccaccccucaacaccucugc

SEQ ID NO: 3057652 - RNA, 13 nt, Human
agcccaccuuggc

SEQ ID NO: 3057653 - RNA, 16 nt, Human
agcaucuaugugagac

SEQ ID NO: 3057654 - RNA, 17 nt, Human
agcagugcaugcugucc

SEQ ID NO: 3057655 - RNA, 16 nt, Human
agcagccuggacccug

SEQ ID NO: 3057656 - RNA, 19 nt, Human
agcacugacuucuaaguaa

SEQ ID NO: 3057657 - RNA, 17 nt, Human
agcacugacuucuaagu

SEQ ID NO: 3057658 - RNA, 13 nt, Human
agcagugcaugcu

SEQ ID NO: 3057659 - RNA, 16 nt, Human
agcagugcaugcuguc

SEQ ID NO: 3057660 - RNA, 19 nt, Human
agcagcguuucuaugacac

SEQ ID NO: 3057661 - RNA, 18 nt, Human
agcagcguuucuaugaca

SEQ ID NO: 3057662 - RNA, 20 nt, Human
agcagccuggacccugugga

SEQ ID NO: 3057663 - RNA, 20 nt, Human
agcacuaaggugugcucuga

SEQ ID NO: 3057664 - RNA, 21 nt, Human
agcacagacccugcccugugg

SEQ ID NO: 3057665 - RNA, 23 nt, Human
agaaugcacaaacagaggccgcc

SEQ ID NO: 3057666 - RNA, 18 nt, Human
agaaugcucuuuacuuca

SEQ ID NO: 3057667 - RNA, 17 nt, Human
agaaucucaaauaacua

SEQ ID NO: 3057668 - RNA, 21 nt, Human
agaaccaaaaagaggcuaugu

SEQ ID NO: 3057669 - RNA, 18 nt, Human
agaagacugcauuauauu

SEQ ID NO: 3057670 - RNA, 21 nt, Human
agaagacugcauuauauuuau

SEQ ID NO: 3057671 - RNA, 15 nt, Human
agaagagaaugcaca

SEQ ID NO: 3057672 - RNA, 13 nt, Human
agaagagcuguuc

SEQ ID NO: 3057673 - RNA, 13 nt, Human
agaagauagcagg

SEQ ID NO: 3057674 - RNA, 20 nt, Human
agaagagcuguucacagcca

SEQ ID NO: 3057675 - RNA, 19 nt, Human
agaagucuuagauguauau

SEQ ID NO: 3057676 - RNA, 17 nt, Human
agaagucuuagauguau

SEQ ID NO: 3057677 - RNA, 14 nt, Human
agaagucacacagu

SEQ ID NO: 3057678 - RNA, 19 nt, Human
agaacagauaaucagugug

SEQ ID NO: 3057679 - RNA, 17 nt, Human
agaacaucccuccuggg

SEQ ID NO: 3057680 - RNA, 13 nt, Human
agaacaucccucc

SEQ ID NO: 3057681 - RNA, 17 nt, Human
agaaccaaaaagaggcu

SEQ ID NO: 3057682 - RNA, 18 nt, Human
agaaccaaaaagaggcua

SEQ ID NO: 3057683 - RNA, 22 nt, Human
agaacagugauuaccagggacu

SEQ ID NO: 3057684 - RNA, 18 nt, Human
agacgaaacauuuguucu

SEQ ID NO: 3057685 - RNA, 19 nt, Human
agaccauuggggcucccag

SEQ ID NO: 3057686 - RNA, 20 nt, Human
agaccauuggggcucccagc

SEQ ID NO: 3057687 - RNA, 22 nt, Human
agaccauuggggcucccagcca

SEQ ID NO: 3057688 - RNA, 23 nt, Human
agaccauuggggcucccagccag

SEQ ID NO: 3057689 - RNA, 14 nt, Human
agaccacguuucua

SEQ ID NO: 3057690 - RNA, 23 nt, Human
agaccaucccugaaggccccgcc

SEQ ID NO: 3057691 - RNA, 18 nt, Human
agaccauuggggcuccca

SEQ ID NO: 3057692 - RNA, 21 nt, Human
agacagcccgggcucugccuc

SEQ ID NO: 3057693 - RNA, 14 nt, Human
agacaauuuauuau

SEQ ID NO: 3057694 - RNA, 22 nt, Human
agacagcccgggcucugccucc

SEQ ID NO: 3057695 - RNA, 23 nt, Human
agacagcccgggcucugccuccc

SEQ ID NO: 3057696 - RNA, 18 nt, Human
agacgcugugcugcccug

SEQ ID NO: 3057697 - RNA, 19 nt, Human
agacgcugugcugcccugc

SEQ ID NO: 3057698 - RNA, 17 nt, Human
agacgcugugcugcccu

SEQ ID NO: 3057699 - RNA, 19 nt, Human
agacaaggaaaaaauaaca

SEQ ID NO: 3057700 - RNA, 23 nt, Human
agacaaugacuuacuguacauga

SEQ ID NO: 3057701 - RNA, 20 nt, Human
agacaaugugaaaagaaaaa

SEQ ID NO: 3057702 - RNA, 18 nt, Human
agagcccacgcccccacu

SEQ ID NO: 3057703 - RNA, 11 nt, Human
agagagcaaga

SEQ ID NO: 3057704 - RNA, 19 nt, Human
agagagcaagacgcugugc

SEQ ID NO: 3057705 - RNA, 17 nt, Human
agagcccacgcccccac

SEQ ID NO: 3057706 - RNA, 18 nt, Human
agagaaaguacuucucca

SEQ ID NO: 3057707 - RNA, 16 nt, Human
agacucuuuggacacu

SEQ ID NO: 3057708 - RNA, 18 nt, Human
aggaaaaaauaacaauga

SEQ ID NO: 3057709 - RNA, 23 nt, Human
agcuuuuuucucugauacagaaa

SEQ ID NO: 3057710 - RNA, 19 nt, Human
agcuuuuuucucugauaca

SEQ ID NO: 3057711 - RNA, 20 nt, Human
agcuuuuuucucugauacag

SEQ ID NO: 3057712 - RNA, 22 nt, Human
agcuuuuuucucugauacagaa

SEQ ID NO: 3057713 - RNA, 21 nt, Human
agcuuuguuuguugucagcug

SEQ ID NO: 3057714 - RNA, 15 nt, Human
aggaacacuccuuca

SEQ ID NO: 3057715 - RNA, 23 nt, Human
aggaacuuaaauaaugugaaacu

SEQ ID NO: 3057716 - RNA, 12 nt, Human
aggaacacuccu

SEQ ID NO: 3057717 - RNA, 23 nt, Human
aggaacaaggcaaggcugucaau

SEQ ID NO: 3057718 - RNA, 14 nt, Human
aggaagguagaaau

SEQ ID NO: 3057719 - RNA, 11 nt, Human
aggaaguacug

SEQ ID NO: 3057720 - RNA, 15 nt, Human
aggaaguacuggaga

SEQ ID NO: 3057721 - RNA, 17 nt, Human
agcuguaugauucccag

SEQ ID NO: 3057722 - RNA, 18 nt, Human
agcuguaugauucccagc

SEQ ID NO: 3057723 - RNA, 22 nt, Human
agcugccuguucagcuccagcu

SEQ ID NO: 3057724 - RNA, 20 nt, Human
agcugcugaaacaacaaaua

SEQ ID NO: 3057725 - RNA, 16 nt, Human
agcugcugaaacaaca

SEQ ID NO: 3057726 - RNA, 15 nt, Human
agcugcugaaacaac

SEQ ID NO: 3057727 - RNA, 14 nt, Human
agcugcugaaacaa

SEQ ID NO: 3057728 - RNA, 15 nt, Human
agcuggucccacuca

SEQ ID NO: 3057729 - RNA, 14 nt, Human
agcuguaugauucc

SEQ ID NO: 3057730 - RNA, 15 nt, Human
agcugacuuuucugu

SEQ ID NO: 3057731 - RNA, 21 nt, Human
agcugacuuuucuguccgagc

SEQ ID NO: 3057732 - RNA, 23 nt, Human
agcucaccagccccagugcccac

SEQ ID NO: 3057733 - RNA, 22 nt, Human
agcucaccagccccagugccca

SEQ ID NO: 3057734 - RNA, 17 nt, Human
agccugcugccugcuuu

SEQ ID NO: 3057735 - RNA, 14 nt, Human
agccuggacccugu

SEQ ID NO: 3057736 - RNA, 10 nt, Human
agccuggaug

SEQ ID NO: 3057737 - RNA, 11 nt, Human
agccuggaugc

SEQ ID NO: 3057738 - RNA, 13 nt, Human
agccuggaugcca

SEQ ID NO: 3057739 - RNA, 15 nt, Human
agccuggaugccauc

SEQ ID NO: 3057740 - RNA, 16 nt, Human
agccuggaugccaucc

SEQ ID NO: 3057741 - RNA, 18 nt, Human
agccugggcaaugugaua

SEQ ID NO: 3057742 - RNA, 20 nt, Human
agccugggaggucaaggcug

SEQ ID NO: 3057743 - RNA, 13 nt, Human
agcgacagugaga

SEQ ID NO: 3057744 - RNA, 15 nt, Human
agcgacagugagacu

SEQ ID NO: 3057745 - RNA, 15 nt, Human
agcgauucuucugcu

SEQ ID NO: 3057746 - RNA, 19 nt, Human
agcgauucuucugcuucag

SEQ ID NO: 3057747 - RNA, 17 nt, Human
agcgauucuucugcuuc

SEQ ID NO: 3057748 - RNA, 19 nt, Human
agcuaacauggaaguacua

SEQ ID NO: 3057749 - RNA, 20 nt, Human
agcuaacauggaaguacuau

SEQ ID NO: 3057750 - RNA, 12 nt, Human
agcuacaaaugc

SEQ ID NO: 3057751 - RNA, 15 nt, Human
agcuaaugggacacu

SEQ ID NO: 3057752 - RNA, 14 nt, Human
agcuaaugggacac

SEQ ID NO: 3057753 - RNA, 13 nt, Human
agcuaaugggaca

SEQ ID NO: 3057754 - RNA, 13 nt, Human
agcuacaaaugca

SEQ ID NO: 3057755 - RNA, 21 nt, Human
agcucaccagccccagugccc

SEQ ID NO: 3057756 - RNA, 14 nt, Human
agcucaccagcccc

SEQ ID NO: 3057757 - RNA, 13 nt, Human
agcucaccagccc

SEQ ID NO: 3057758 - RNA, 18 nt, Human
aggaguuucguuuucaaa

SEQ ID NO: 3057759 - RNA, 14 nt, Human
aggagugagcacua

SEQ ID NO: 3057760 - RNA, 12 nt, Human
aggagugagcac

SEQ ID NO: 3057761 - RNA, 15 nt, Human
aggaggucucuaaga

SEQ ID NO: 3057762 - RNA, 14 nt, Human
aggaggucucuaag

SEQ ID NO: 3057763 - RNA, 19 nt, Human
aggaaguacuggagaaaau

SEQ ID NO: 3057764 - RNA, 22 nt, Human
aggcagaacucaucuagguaaa

SEQ ID NO: 3057765 - RNA, 13 nt, Human
aggcagauacagg

SEQ ID NO: 3057766 - RNA, 20 nt, Human
aggcagagguugcagugagc

SEQ ID NO: 3057767 - RNA, 15 nt, Human
aggcagccaggccac

SEQ ID NO: 3057768 - RNA, 16 nt, Human
aggcagccaggccaca

SEQ ID NO: 3057769 - RNA, 14 nt, Human
aggcagccaggcca

SEQ ID NO: 3057770 - RNA, 23 nt, Human
aggccaugggcacuguggguaga

SEQ ID NO: 3057771 - RNA, 17 nt, Human
aggcccucugcccacuc

SEQ ID NO: 3057772 - RNA, 15 nt, Human
aggcccucugcccac

SEQ ID NO: 3057773 - RNA, 16 nt, Human
aggccaugggccuccu

SEQ ID NO: 3057774 - RNA, 14 nt, Human
aggccaugggccuc

SEQ ID NO: 3057775 - RNA, 13 nt, Human
aggccagcugcuu

SEQ ID NO: 3057776 - RNA, 14 nt, Human
aggccagcugcuug

SEQ ID NO: 3057777 - RNA, 16 nt, Human
aggccagcugcuuggg

SEQ ID NO: 3057778 - RNA, 16 nt, Human
aggccaggcccucugc

SEQ ID NO: 3057779 - RNA, 17 nt, Human
aggccaggcccucugcc

SEQ ID NO: 3057780 - RNA, 18 nt, Human
aggccaggcccucugccc

SEQ ID NO: 3057781 - RNA, 19 nt, Human
aggccaggcccucugccca

SEQ ID NO: 3057782 - RNA, 23 nt, Human
aggccaggcccucugcccacucc

SEQ ID NO: 3057783 - RNA, 23 nt, Human
aggcaugugaugagaggaaauca

SEQ ID NO: 3057784 - RNA, 24 nt, Human
aggcaugugaugagaggaaaucac

SEQ ID NO: 3057785 - RNA, 22 nt, Human
aggcauguucucugaggacacu

SEQ ID NO: 3057786 - RNA, 20 nt, Human
aggcauguucucugaggaca

SEQ ID NO: 3057787 - RNA, 21 nt, Human
aggcauuccccaggaggccag

SEQ ID NO: 3057788 - RNA, 22 nt, Human
aggcauuccccaggaggccagc

SEQ ID NO: 3057789 - RNA, 23 nt, Human
aggcauuccccaggaggccagcc

SEQ ID NO: 3057790 - RNA, 12 nt, Human
aggccagcugcu

SEQ ID NO: 3057791 - RNA, 14 nt, Human
agggacugagaaau

SEQ ID NO: 3057792 - RNA, 13 nt, Human
agggacugagaaa

SEQ ID NO: 3057793 - RNA, 15 nt, Human
agggacugagaaauu

SEQ ID NO: 3057794 - RNA, 20 nt, Human
agggauuagggagagaagau

SEQ ID NO: 3057795 - RNA, 18 nt, Human
agggccuggccugagcug

SEQ ID NO: 3057796 - RNA, 13 nt, Human
agggccuggcuca

SEQ ID NO: 3057797 - RNA, 14 nt, Human
agggccuggcucag

SEQ ID NO: 3057798 - RNA, 18 nt, Human
agggccuggcucaggugg

SEQ ID NO: 3057799 - RNA, 22 nt, Human
aggcucuggagcccacuguacu

SEQ ID NO: 3057800 - RNA, 17 nt, Human
aggcuagauguauguac

SEQ ID NO: 3057801 - RNA, 24 nt, Human
aggcuguaucccaugagccucagc

SEQ ID NO: 3057802 - RNA, 11 nt, Human
aggcugccagu

SEQ ID NO: 3057803 - RNA, 12 nt, Human
aggcugucaauu

SEQ ID NO: 3057804 - RNA, 17 nt, Human
aggcugcagugagccga

SEQ ID NO: 3057805 - RNA, 19 nt, Human
aggcugcagugagccgaga

SEQ ID NO: 3057806 - RNA, 23 nt, Human
aggcuguaucccaugagccucag

SEQ ID NO: 3057807 - RNA, 17 nt, Human
agggacaggauaagagg

SEQ ID NO: 3057808 - RNA, 19 nt, Human
aggcccucugcccacuccc

SEQ ID NO: 3057809 - RNA, 20 nt, Human
aggcccucugcccacucccu

SEQ ID NO: 3057810 - RNA, 12 nt, Human
ggcagaaggaag

SEQ ID NO: 3057811 - RNA, 14 nt, Human
ggcagccaggccac

SEQ ID NO: 3057812 - RNA, 10 nt, Human
ggcagagcag

SEQ ID NO: 3057813 - RNA, 15 nt, Human
ggcagccaggccaca

SEQ ID NO: 3057814 - RNA, 17 nt, Human
ggcagccaggccacaag

SEQ ID NO: 3057815 - RNA, 22 nt, Human
ggaugguucccuugaugaagaa

SEQ ID NO: 3057816 - RNA, 23 nt, Human
ggaugguucccuugaugaagaag

SEQ ID NO: 3057817 - RNA, 22 nt, Human
ggauguugaaaaaguucugcag

SEQ ID NO: 3057818 - RNA, 22 nt, Human
ggaugagaaagguugaagcacc

SEQ ID NO: 3057819 - RNA, 12 nt, Human
ggaugagaaagg

SEQ ID NO: 3057820 - RNA, 21 nt, Human
ggaugaauuccaaauucugcu

SEQ ID NO: 3057821 - RNA, 23 nt, Human
ggauuaaacuuaaucuaaaugga

SEQ ID NO: 3057822 - RNA, 21 nt, Human
ggauuuugauccaagcugguc

SEQ ID NO: 3057823 - RNA, 12 nt, Human
ggauuuucagcc

SEQ ID NO: 3057824 - RNA, 14 nt, Human
ggcaaacagggccu

SEQ ID NO: 3057825 - RNA, 17 nt, Human
ggcaaacagggccucug

SEQ ID NO: 3057826 - RNA, 18 nt, Human
ggcaaacagggccucugc

SEQ ID NO: 3057827 - RNA, 13 nt, Human
ggccucccaacuc

SEQ ID NO: 3057828 - RNA, 14 nt, Human
ggccucccaacuca

SEQ ID NO: 3057829 - RNA, 16 nt, Human
ggccuccauccugagg

SEQ ID NO: 3057830 - RNA, 12 nt, Human
ggcccagggcau

SEQ ID NO: 3057831 - RNA, 15 nt, Human
ggcccagggcaucug

SEQ ID NO: 3057832 - RNA, 16 nt, Human
ggccccaccagugccu

SEQ ID NO: 3057833 - RNA, 15 nt, Human
ggccccaccagugcc

SEQ ID NO: 3057834 - RNA, 16 nt, Human
ggcccagggcaucugg

SEQ ID NO: 3057835 - RNA, 23 nt, Human
ggcccuccagagccccacagccc

SEQ ID NO: 3057836 - RNA, 17 nt, Human
ggcccuccagagcccca

SEQ ID NO: 3057837 - RNA, 21 nt, Human
ggcccuccagagccccacagc

SEQ ID NO: 3057838 - RNA, 14 nt, Human
ggcccuccagagcc

SEQ ID NO: 3057839 - RNA, 15 nt, Human
ggcccuccagagccc

SEQ ID NO: 3057840 - RNA, 12 nt, Human
ggcauuguggga

SEQ ID NO: 3057841 - RNA, 21 nt, Human
ggccaaacucaccugccccuc

SEQ ID NO: 3057842 - RNA, 12 nt, Human
ggccaaaggaag

SEQ ID NO: 3057843 - RNA, 15 nt, Human
ggccaaagccaaagc

SEQ ID NO: 3057844 - RNA, 21 nt, Human
ggccaaaggaagcacaugccu

SEQ ID NO: 3057845 - RNA, 20 nt, Human
ggccagaugcaccagcccuu

SEQ ID NO: 3057846 - RNA, 19 nt, Human
ggccagaugcaccagcccu

SEQ ID NO: 3057847 - RNA, 17 nt, Human
ggccagaugcaccagcc

SEQ ID NO: 3057848 - RNA, 23 nt, Human
ggccagagggagugacagaggca

SEQ ID NO: 3057849 - RNA, 22 nt, Human
ggccagagggagugacagaggc

SEQ ID NO: 3057850 - RNA, 13 nt, Human
ggccaagguggga

SEQ ID NO: 3057851 - RNA, 15 nt, Human
ggagagcuagcagca

SEQ ID NO: 3057852 - RNA, 22 nt, Human
ggagagccuuccagggguggga

SEQ ID NO: 3057853 - RNA, 17 nt, Human
ggagagccuuccagggg

SEQ ID NO: 3057854 - RNA, 18 nt, Human
ggagagccuuccaggggu

SEQ ID NO: 3057855 - RNA, 13 nt, Human
ggagagccuucca

SEQ ID NO: 3057856 - RNA, 16 nt, Human
ggagagccuuccaggg

SEQ ID NO: 3057857 - RNA, 17 nt, Human
ggacuuggaagcuccgc

SEQ ID NO: 3057858 - RNA, 15 nt, Human
ggacuuggaagcucc

SEQ ID NO: 3057859 - RNA, 19 nt, Human
ggagaaaauggacguguua

SEQ ID NO: 3057860 - RNA, 9 nt, Human
ggacuuugu

SEQ ID NO: 3057861 - RNA, 18 nt, Human
ggagaaaugaaaaaauau

SEQ ID NO: 3057862 - RNA, 22 nt, Human
ggagaaccaaaaagaggcuaug

SEQ ID NO: 3057863 - RNA, 22 nt, Human
ggacugugugcucaggagcccu

SEQ ID NO: 3057864 - RNA, 23 nt, Human
ggacugugugcucaggagcccug

SEQ ID NO: 3057865 - RNA, 17 nt, Human
ggacugugugcucagga

SEQ ID NO: 3057866 - RNA, 20 nt, Human
ggacuacaggugugagucac

SEQ ID NO: 3057867 - RNA, 22 nt, Human
ggacucaaugcacugacauugu

SEQ ID NO: 3057868 - RNA, 18 nt, Human
ggacucaaugcacugaca

SEQ ID NO: 3057869 - RNA, 21 nt, Human
ggaccccgagccuggcuccaa

SEQ ID NO: 3057870 - RNA, 18 nt, Human
ggaccccgagccuggcuc

SEQ ID NO: 3057871 - RNA, 15 nt, Human
ggacccugaggccca

SEQ ID NO: 3057872 - RNA, 18 nt, Human
ggacccugaggcccagag

SEQ ID NO: 3057873 - RNA, 14 nt, Human
ggacccugaggccc

SEQ ID NO: 3057874 - RNA, 19 nt, Human
gcuuguacauaaugcgugc

SEQ ID NO: 3057875 - RNA, 15 nt, Human
ggagcccacuguacu

SEQ ID NO: 3057876 - RNA, 13 nt, Human
ggagcagccacau

SEQ ID NO: 3057877 - RNA, 21 nt, Human
ggagcagccacauuccugaug

SEQ ID NO: 3057878 - RNA, 18 nt, Human
ggaggucgaggcaggagg

SEQ ID NO: 3057879 - RNA, 15 nt, Human
ggaggcucuggagcc

SEQ ID NO: 3057880 - RNA, 21 nt, Human
ggaggcucuggagcccacugu

SEQ ID NO: 3057881 - RNA, 15 nt, Human
ggaggcugagauggg

SEQ ID NO: 3057882 - RNA, 19 nt, Human
ggaggcugagaugggagaa

SEQ ID NO: 3057883 - RNA, 15 nt, Human
ggaggucgaggcagg

SEQ ID NO: 3057884 - RNA, 16 nt, Human
ggaggucgaggcagga

SEQ ID NO: 3057885 - RNA, 14 nt, Human
ggaggucgaggcag

SEQ ID NO: 3057886 - RNA, 20 nt, Human
ggaggcucuggagcccacug

SEQ ID NO: 3057887 - RNA, 17 nt, Human
ggaggcucuggagccca

SEQ ID NO: 3057888 - RNA, 12 nt, Human
ggaggccagccu

SEQ ID NO: 3057889 - RNA, 18 nt, Human
ggaggccaaggugggagg

SEQ ID NO: 3057890 - RNA, 13 nt, Human
ggaggccagccuu

SEQ ID NO: 3057891 - RNA, 21 nt, Human
ggaggcaugugaugagaggaa

SEQ ID NO: 3057892 - RNA, 12 nt, Human
ggaggaagagaa

SEQ ID NO: 3057893 - RNA, 20 nt, Human
ggaggaaccgagggggcugc

SEQ ID NO: 3057894 - RNA, 18 nt, Human
ggagcccacuguacuugc

SEQ ID NO: 3057895 - RNA, 22 nt, Human
ggagcugccuguucagcuccag

SEQ ID NO: 3057896 - RNA, 13 nt, Human
aaaaaaacacaaa

SEQ ID NO: 3057897 - RNA, 23 nt, Human
gggaaaaucagccugcuccagcu

SEQ ID NO: 3057898 - RNA, 13 nt, Human
gggaaaaucagcc

SEQ ID NO: 3057899 - RNA, 16 nt, Human
ggcuucaguggcagcu

SEQ ID NO: 3057900 - RNA, 16 nt, Human
ggcuggugucaccuga

SEQ ID NO: 3057901 - RNA, 19 nt, Human
ggcuguaucccaugagccu

SEQ ID NO: 3057902 - RNA, 15 nt, Human
ggcugucaauuacag

SEQ ID NO: 3057903 - RNA, 23 nt, Human
ggcuguaucccaugagccucagc

SEQ ID NO: 3057904 - RNA, 22 nt, Human
ggcuguaucccaugagccucag

SEQ ID NO: 3057905 - RNA, 20 nt, Human
ggcuguaucccaugagccuc

SEQ ID NO: 3057906 - RNA, 15 nt, Human
ggcuucaguggcagc

SEQ ID NO: 3057907 - RNA, 15 nt, Human
ggcugccagugccug

SEQ ID NO: 3057908 - RNA, 17 nt, Human
ggcugccagugccuggg

SEQ ID NO: 3057909 - RNA, 18 nt, Human
ggcugccagugccugggu

SEQ ID NO: 3057910 - RNA, 17 nt, Human
ggcuggccuggccccuc

SEQ ID NO: 3057911 - RNA, 22 nt, Human
ggcuggccuggccccucagggu

SEQ ID NO: 3057912 - RNA, 20 nt, Human
ggcuggcgugcaguggugcg

SEQ ID NO: 3057913 - RNA, 16 nt, Human
ggcuggcgugcagugg

SEQ ID NO: 3057914 - RNA, 14 nt, Human
ggcuggcgugcagu

SEQ ID NO: 3057915 - RNA, 20 nt, Human
ggcucccuucccaccucucu

SEQ ID NO: 3057916 - RNA, 22 nt, Human
ggcucccuucccaccucucuca

SEQ ID NO: 3057917 - RNA, 17 nt, Human
ggcucccuucccaccuc

SEQ ID NO: 3057918 - RNA, 18 nt, Human
ggcucccuucccaccucu

SEQ ID NO: 3057919 - RNA, 16 nt, Human
ggcucccuucccaccu

SEQ ID NO: 3057920 - RNA, 20 nt, Human
ggcucuuccaggcugggaga

SEQ ID NO: 3057921 - RNA, 23 nt, Human
ggcucuuccaggcugggagagcc

SEQ ID NO: 3057922 - RNA, 24 nt, Human
ggcucuuccaggcugggagagccu

SEQ ID NO: 3057923 - RNA, 18 nt, Human
ggcucgagcaugccugga

SEQ ID NO: 3057924 - RNA, 17 nt, Human
ggcugcagggaguccga

SEQ ID NO: 3057925 - RNA, 20 nt, Human
ggcugcaugcgggcuuccuc

SEQ ID NO: 3057926 - RNA, 21 nt, Human
ggcugccaaugggagcucaug

SEQ ID NO: 3057927 - RNA, 14 nt, Human
ggcugccagugccu

SEQ ID NO: 3057928 - RNA, 19 nt, Human
aaaacugcucauaugaugu

SEQ ID NO: 3057929 - RNA, 18 nt, Human
aaaacugauuuuuuuuuc

SEQ ID NO: 3057930 - RNA, 22 nt, Human
aaaacugauuuuuuuuuccuuc

SEQ ID NO: 3057931 - RNA, 21 nt, Human
aaaacguggcugcuucaagga

SEQ ID NO: 3057932 - RNA, 14 nt, Human
aaaacguggcugcu

SEQ ID NO: 3057933 - RNA, 16 nt, Human
aaaacguggcugcuuc

SEQ ID NO: 3057934 - RNA, 17 nt, Human
aaaacguggcugcuuca

SEQ ID NO: 3057935 - RNA, 18 nt, Human
aaaacguggcugcuucaa

SEQ ID NO: 3057936 - RNA, 15 nt, Human
aaaaccaauguucuc

SEQ ID NO: 3057937 - RNA, 20 nt, Human
aaaaaucucaaauuucuaaa

SEQ ID NO: 3057938 - RNA, 19 nt, Human
aaaaaucucaaauuucuaa

SEQ ID NO: 3057939 - RNA, 17 nt, Human
aaaaaucucaaauuucu

SEQ ID NO: 3057940 - RNA, 22 nt, Human
gggaacagacuggaagcacagc

SEQ ID NO: 3057941 - RNA, 14 nt, Human
gggaacagacugga

SEQ ID NO: 3057942 - RNA, 22 nt, Human
aaaagcuccauuuuuagugaaa

SEQ ID NO: 3057943 - RNA, 14 nt, Human
aaaagcugggcagg

SEQ ID NO: 3057944 - RNA, 18 nt, Human
aaaagccuguuuaagaga

SEQ ID NO: 3057945 - RNA, 16 nt, Human
aaaagccuguuuaaga

SEQ ID NO: 3057946 - RNA, 19 nt, Human
aaaagccugcaauuucaua

SEQ ID NO: 3057947 - RNA, 22 nt, Human
aaaacuugauguguuaucucuu

SEQ ID NO: 3057948 - RNA, 21 nt, Human
aaaacuuuaugcuaagugaaa

SEQ ID NO: 3057949 - RNA, 11 nt, Human
gggagggcucc

SEQ ID NO: 3057950 - RNA, 13 nt, Human
gggagggcuccag

SEQ ID NO: 3057951 - RNA, 20 nt, Human
gggaggcagagguugcagug

SEQ ID NO: 3057952 - RNA, 11 nt, Human
gggaggcagag

SEQ ID NO: 3057953 - RNA, 14 nt, Human
aaaauauauuuaau

SEQ ID NO: 3057954 - RNA, 18 nt, Human
aaaauauauaucaaauau

SEQ ID NO: 3057955 - RNA, 12 nt, Human
aaaauagccugc

SEQ ID NO: 3057956 - RNA, 18 nt, Human
aaaauaguggugugauuu

SEQ ID NO: 3057957 - RNA, 12 nt, Human
aaaauaaauuau

SEQ ID NO: 3057958 - RNA, 20 nt, Human
aaaauaauuuuuauauuuga

SEQ ID NO: 3057959 - RNA, 14 nt, Human
aaaauaccagccag

SEQ ID NO: 3057960 - RNA, 21 nt, Human
aaaauaauuuuuauauuugaa

SEQ ID NO: 3057961 - RNA, 23 nt, Human
aaaauaauuuuuauauuugaaau

SEQ ID NO: 3057962 - RNA, 15 nt, Human
aaaauaccagccagu

SEQ ID NO: 3057963 - RNA, 14 nt, Human
aaaauaccaaggaa

SEQ ID NO: 3057964 - RNA, 16 nt, Human
aaaagggacugagaaa

SEQ ID NO: 3057965 - RNA, 15 nt, Human
gggauuuccaugaug

SEQ ID NO: 3057966 - RNA, 23 nt, Human
gggcagagcagagaccaucccug

SEQ ID NO: 3057967 - RNA, 21 nt, Human
gggauuuucagcccucagaau

SEQ ID NO: 3057968 - RNA, 13 nt, Human
aaaggaauuuaaa

SEQ ID NO: 3057969 - RNA, 11 nt, Human
aaaggaaagag

SEQ ID NO: 3057970 - RNA, 13 nt, Human
aaagcuuauuaaa

SEQ ID NO: 3057971 - RNA, 16 nt, Human
aaagcagugcaugcug

SEQ ID NO: 3057972 - RNA, 21 nt, Human
aaagcagugcaugcugucccu

SEQ ID NO: 3057973 - RNA, 22 nt, Human
aaagcagugcaugcugucccuu

SEQ ID NO: 3057974 - RNA, 18 nt, Human
aaagcuaggccuggccag

SEQ ID NO: 3057975 - RNA, 17 nt, Human
aaagcuaggccuggcca

SEQ ID NO: 3057976 - RNA, 16 nt, Human
aaagcuacuuauugua

SEQ ID NO: 3057977 - RNA, 17 nt, Human
aaagcuacuuauuguag

SEQ ID NO: 3057978 - RNA, 17 nt, Human
aaagcagugcaugcugu

SEQ ID NO: 3057979 - RNA, 21 nt, Human
aaagauuuucagaaaauauua

SEQ ID NO: 3057980 - RNA, 19 nt, Human
ggucuguucuuuccaaagu

SEQ ID NO: 3057981 - RNA, 17 nt, Human
ggucuguucuuuccaaa

SEQ ID NO: 3057982 - RNA, 22 nt, Human
ggucuugaacuccuggccucaa

SEQ ID NO: 3057983 - RNA, 21 nt, Human
ggucuugaacuccuggccuca

SEQ ID NO: 3057984 - RNA, 12 nt, Human
ggucuguucuuu

SEQ ID NO: 3057985 - RNA, 14 nt, Human
ggucugugagaugc

SEQ ID NO: 3057986 - RNA, 15 nt, Human
ggugccaguuauggc

SEQ ID NO: 3057987 - RNA, 16 nt, Human
ggugcacaagcuccaa

SEQ ID NO: 3057988 - RNA, 22 nt, Human
ggugcacaagcuccaagcuccc

SEQ ID NO: 3057989 - RNA, 20 nt, Human
ggugauuuagcaggaagcug

SEQ ID NO: 3057990 - RNA, 21 nt, Human
ggucauauuaauauauuucca

SEQ ID NO: 3057991 - RNA, 18 nt, Human
ggucauauuaauauauuu

SEQ ID NO: 3057992 - RNA, 23 nt, Human
gguauuggcuagagguucaaaga

SEQ ID NO: 3057993 - RNA, 19 nt, Human
gguccacccaggagccccg

SEQ ID NO: 3057994 - RNA, 14 nt, Human
aaacuuuaccuuuu

SEQ ID NO: 3057995 - RNA, 16 nt, Human
aaagaaugauuaugaa

SEQ ID NO: 3057996 - RNA, 12 nt, Human
ggucccacccca

SEQ ID NO: 3057997 - RNA, 22 nt, Human
gguccacccaggagccccgagg

SEQ ID NO: 3057998 - RNA, 20 nt, Human
gguccacccaggagccccga

SEQ ID NO: 3057999 - RNA, 15 nt, Human
aaagauuuucagaaa

SEQ ID NO: 3058000 - RNA, 14 nt, Human
aaagauuuucagaa

SEQ ID NO: 3058001 - RNA, 20 nt, Human
aaagaggcagcuugaaacug

SEQ ID NO: 3058002 - RNA, 13 nt, Human
aaagaggcuaugu

SEQ ID NO: 3058003 - RNA, 18 nt, Human
aaagaggcuaugugagca

SEQ ID NO: 3058004 - RNA, 15 nt, Human
aaagaugagugagca

SEQ ID NO: 3058005 - RNA, 18 nt, Human
aaagagaacuuccagauc

SEQ ID NO: 3058006 - RNA, 19 nt, Human
aaagacuuuuccaacccuc

SEQ ID NO: 3058007 - RNA, 15 nt, Human
aaagacuguacaaag

SEQ ID NO: 3058008 - RNA, 23 nt, Human
aaagacuauucaaacagucucag

SEQ ID NO: 3058009 - RNA, 13 nt, Human
aaagacuccaaag

SEQ ID NO: 3058010 - RNA, 22 nt, Human
aaagacuauucaaacagucuca

SEQ ID NO: 3058011 - RNA, 14 nt, Human
ggggccaggcuggg

SEQ ID NO: 3058012 - RNA, 13 nt, Human
ggggccaggcugg

SEQ ID NO: 3058013 - RNA, 16 nt, Human
ggggccaggcuggguc

SEQ ID NO: 3058014 - RNA, 17 nt, Human
ggggccaguuggucccc

SEQ ID NO: 3058015 - RNA, 16 nt, Human
ggggcccugccuccuu

SEQ ID NO: 3058016 - RNA, 15 nt, Human
ggggcccugccuccu

SEQ ID NO: 3058017 - RNA, 19 nt, Human
ggggcccugccuccuuugu

SEQ ID NO: 3058018 - RNA, 23 nt, Human
ggggcccugccuccuuugugagg

SEQ ID NO: 3058019 - RNA, 13 nt, Human
ggggaccucaggc

SEQ ID NO: 3058020 - RNA, 15 nt, Human
ggggaccucaggccu

SEQ ID NO: 3058021 - RNA, 16 nt, Human
ggggaccucaggccug

SEQ ID NO: 3058022 - RNA, 17 nt, Human
ggggaccucaggccugg

SEQ ID NO: 3058023 - RNA, 24 nt, Human
ggggaaaaucagccugcuccagcu

SEQ ID NO: 3058024 - RNA, 16 nt, Human
aaacaugcuacacacu

SEQ ID NO: 3058025 - RNA, 21 nt, Human
aaacauauauaacaaugcugu

SEQ ID NO: 3058026 - RNA, 22 nt, Human
aaacaugcuacacacugcaugu

SEQ ID NO: 3058027 - RNA, 13 nt, Human
aaacauauauaac

SEQ ID NO: 3058028 - RNA, 16 nt, Human
aaacauauauaacaau

SEQ ID NO: 3058029 - RNA, 19 nt, Human
aaacauauauaacaaugcu

SEQ ID NO: 3058030 - RNA, 19 nt, Human
aaacaagucagucauucag

SEQ ID NO: 3058031 - RNA, 14 nt, Human
aaacacaacuauau

SEQ ID NO: 3058032 - RNA, 19 nt, Human
aaacacaaacgggcucagc

SEQ ID NO: 3058033 - RNA, 13 nt, Human
aaacaaagaaauu

SEQ ID NO: 3058034 - RNA, 19 nt, Human
aaacaacuucaauauccaa

SEQ ID NO: 3058035 - RNA, 17 nt, Human
aaacaaggaugaauuaa

SEQ ID NO: 3058036 - RNA, 16 nt, Human
aaaauuuuuaaucuuu

SEQ ID NO: 3058037 - RNA, 15 nt, Human
aaaauuuuuaaucuu

SEQ ID NO: 3058038 - RNA, 19 nt, Human
aaaauuuuuaaucuuuaau

SEQ ID NO: 3058039 - RNA, 19 nt, Human
aaaauuuuuucucuaggaa

SEQ ID NO: 3058040 - RNA, 15 nt, Human
aaaauauuauguguu

SEQ ID NO: 3058041 - RNA, 14 nt, Human
aaaauauuaugugu

SEQ ID NO: 3058042 - RNA, 21 nt, Human
aaaauauuauguguuuccaua

SEQ ID NO: 3058043 - RNA, 20 nt, Human
aaaauggaagacagcucuua

SEQ ID NO: 3058044 - RNA, 21 nt, Human
aaaauggacguguuaugacuc

SEQ ID NO: 3058045 - RNA, 12 nt, Human
aaaauggaauac

SEQ ID NO: 3058046 - RNA, 21 nt, Human
aaaauguaggguuauaauaau

SEQ ID NO: 3058047 - RNA, 21 nt, Human
aaaccacauuggagauguuua

SEQ ID NO: 3058048 - RNA, 15 nt, Human
aaaccacagcaguug

SEQ ID NO: 3058049 - RNA, 16 nt, Human
aaaccacagcaguuga

SEQ ID NO: 3058050 - RNA, 16 nt, Human
aaacguggcugcuuca

SEQ ID NO: 3058051 - RNA, 15 nt, Human
aaacgucuuaaauau

SEQ ID NO: 3058052 - RNA, 17 nt, Human
aaacguggcugcuucaa

SEQ ID NO: 3058053 - RNA, 16 nt, Human
aaacuggauuaaacuu

SEQ ID NO: 3058054 - RNA, 16 nt, Human
aaacucauuucuagca

SEQ ID NO: 3058055 - RNA, 23 nt, Human
aaacauguuucuuuguaaugaaa

SEQ ID NO: 3058056 - RNA, 22 nt, Human
aaacauguuucuuuguaaugaa

SEQ ID NO: 3058057 - RNA, 19 nt, Human
aaacauguuucuuuguaau

SEQ ID NO: 3058058 - RNA, 23 nt, Human
gggucucacuauguugcccaggc

SEQ ID NO: 3058059 - RNA, 22 nt, Human
gggucucacuauguugcccagg

SEQ ID NO: 3058060 - RNA, 20 nt, Human
ggguaucaggugcugccauc

SEQ ID NO: 3058061 - RNA, 22 nt, Human
gggucacucuggcagcucagag

SEQ ID NO: 3058062 - RNA, 14 nt, Human
gcccugccuccuuu

SEQ ID NO: 3058063 - RNA, 16 nt, Human
gcccugccuccuuugu

SEQ ID NO: 3058064 - RNA, 22 nt, Human
gcccugccuccuuugugaggaa

SEQ ID NO: 3058065 - RNA, 21 nt, Human
gcccugugggcccccaaaugg

SEQ ID NO: 3058066 - RNA, 17 nt, Human
gcccuguuaaaagauga

SEQ ID NO: 3058067 - RNA, 14 nt, Human
gcccuguuaaaaga

SEQ ID NO: 3058068 - RNA, 13 nt, Human
gcccuguuaaaag

SEQ ID NO: 3058069 - RNA, 15 nt, Human
gccgccaugcuccug

SEQ ID NO: 3058070 - RNA, 16 nt, Human
gcccuuaccugccagg

SEQ ID NO: 3058071 - RNA, 20 nt, Human
gcccuuaccugccaggaagc

SEQ ID NO: 3058072 - RNA, 16 nt, Human
gccgccaugcuccugg

SEQ ID NO: 3058073 - RNA, 13 nt, Human
gccgcccaaggcc

SEQ ID NO: 3058074 - RNA, 16 nt, Human
gccccuggaugcagcc

SEQ ID NO: 3058075 - RNA, 18 nt, Human
gccccuggaugcagccuc

SEQ ID NO: 3058076 - RNA, 22 nt, Human
gccccuggaugcagccucacag

SEQ ID NO: 3058077 - RNA, 22 nt, Human
gcccuaaaguguauuuuuuuac

SEQ ID NO: 3058078 - RNA, 16 nt, Human
gcccccaggugccagu

SEQ ID NO: 3058079 - RNA, 18 nt, Human
gccccaaaacucuccucu

SEQ ID NO: 3058080 - RNA, 14 nt, Human
gccccugcccggcu

SEQ ID NO: 3058081 - RNA, 13 nt, Human
gccccugcccggc

SEQ ID NO: 3058082 - RNA, 14 nt, Human
gcccacucccugca

SEQ ID NO: 3058083 - RNA, 15 nt, Human
gcccacucccugcaa

SEQ ID NO: 3058084 - RNA, 19 nt, Human
gcccacucccugcaaccug

SEQ ID NO: 3058085 - RNA, 13 nt, Human
gcccacucccugc

SEQ ID NO: 3058086 - RNA, 16 nt, Human
gccugccucuucucua

SEQ ID NO: 3058087 - RNA, 15 nt, Human
gccuggccccucagg

SEQ ID NO: 3058088 - RNA, 16 nt, Human
gccuggccccucaggg

SEQ ID NO: 3058089 - RNA, 17 nt, Human
gccuggccccucagggu

SEQ ID NO: 3058090 - RNA, 18 nt, Human
gccugggaucccucaucc

SEQ ID NO: 3058091 - RNA, 22 nt, Human
gccugggaggucaaggcugcag

SEQ ID NO: 3058092 - RNA, 14 nt, Human
gccugggaucccuc

SEQ ID NO: 3058093 - RNA, 21 nt, Human
gccugggaggucaaggcugca

SEQ ID NO: 3058094 - RNA, 20 nt, Human
gccuggccccucaggguccc

SEQ ID NO: 3058095 - RNA, 22 nt, Human
gccuggccccucagggucccug

SEQ ID NO: 3058096 - RNA, 10 nt, Human
gccuggccug

SEQ ID NO: 3058097 - RNA, 12 nt, Human
gccucuucucua

SEQ ID NO: 3058098 - RNA, 23 nt, Human
gccucuucucuacucuagggaaa

SEQ ID NO: 3058099 - RNA, 19 nt, Human
gccugcccaggccccugcc

SEQ ID NO: 3058100 - RNA, 18 nt, Human
gccugcccaggccccugc

SEQ ID NO: 3058101 - RNA, 17 nt, Human
gccugcccaggccccug

SEQ ID NO: 3058102 - RNA, 12 nt, Human
gccucugggacu

SEQ ID NO: 3058103 - RNA, 18 nt, Human
gccuccugcccuuaccug

SEQ ID NO: 3058104 - RNA, 13 nt, Human
gccuccuccagcc

SEQ ID NO: 3058105 - RNA, 16 nt, Human
gccauaugaaaaggcu

SEQ ID NO: 3058106 - RNA, 20 nt, Human
gccauauucuguuggccagu

SEQ ID NO: 3058107 - RNA, 19 nt, Human
gccauauucuguuggccag

SEQ ID NO: 3058108 - RNA, 18 nt, Human
gccauguuggccaggcug

SEQ ID NO: 3058109 - RNA, 17 nt, Human
gccauguuggccaggcu

SEQ ID NO: 3058110 - RNA, 16 nt, Human
gccauguuggccaggc

SEQ ID NO: 3058111 - RNA, 15 nt, Human
gccauguuggccagg

SEQ ID NO: 3058112 - RNA, 14 nt, Human
gccauguuggccag

SEQ ID NO: 3058113 - RNA, 24 nt, Human
gccauguuggccaggcuggucuca

SEQ ID NO: 3058114 - RNA, 22 nt, Human
gccauguuggccaggcuggucu

SEQ ID NO: 3058115 - RNA, 20 nt, Human
gccauguuggccaggcuggu

SEQ ID NO: 3058116 - RNA, 19 nt, Human
gccauguuggccaggcugg

SEQ ID NO: 3058117 - RNA, 13 nt, Human
gcccacgccccca

SEQ ID NO: 3058118 - RNA, 14 nt, Human
gcccacgcccccac

SEQ ID NO: 3058119 - RNA, 18 nt, Human
gcccaccuuggcucaagu

SEQ ID NO: 3058120 - RNA, 17 nt, Human
gcccaccuuggcucaag

SEQ ID NO: 3058121 - RNA, 17 nt, Human
gcccacgcuggagugca

SEQ ID NO: 3058122 - RNA, 16 nt, Human
gcccacgcuggagugc

SEQ ID NO: 3058123 - RNA, 15 nt, Human
gcccacgcuggagug

SEQ ID NO: 3058124 - RNA, 15 nt, Human
gccaggcccucugcc

SEQ ID NO: 3058125 - RNA, 13 nt, Human
gccaggccagagg

SEQ ID NO: 3058126 - RNA, 16 nt, Human
gccaggcccucugccc

SEQ ID NO: 3058127 - RNA, 17 nt, Human
gccaggcccucugccca

SEQ ID NO: 3058128 - RNA, 19 nt, Human
gccaggcccucugcccacu

SEQ ID NO: 3058129 - RNA, 20 nt, Human
gccaggcccucugcccacuc

SEQ ID NO: 3058130 - RNA, 21 nt, Human
gccaggcccucugcccacucc

SEQ ID NO: 3058131 - RNA, 21 nt, Human
gccaggcccuugucggcccca

SEQ ID NO: 3058132 - RNA, 12 nt, Human
gccaggccagag

SEQ ID NO: 3058133 - RNA, 23 nt, Human
gccaggccacaagacccuugugg

SEQ ID NO: 3058134 - RNA, 19 nt, Human
gccagauuuuccugaaaac

SEQ ID NO: 3058135 - RNA, 22 nt, Human
gccagacaucaacagauaaaua

SEQ ID NO: 3058136 - RNA, 17 nt, Human
gccagcaggcucucagg

SEQ ID NO: 3058137 - RNA, 18 nt, Human
gccagcaggcucucaggc

SEQ ID NO: 3058138 - RNA, 19 nt, Human
gccagcaggcucucaggcc

SEQ ID NO: 3058139 - RNA, 20 nt, Human
gccagcaggcucucaggcca

SEQ ID NO: 3058140 - RNA, 21 nt, Human
gccagcaggcucucaggccag

SEQ ID NO: 3058141 - RNA, 13 nt, Human
gccagcaggcucu

SEQ ID NO: 3058142 - RNA, 16 nt, Human
gccagcaggcucucag

SEQ ID NO: 3058143 - RNA, 16 nt, Human
gccacauuccugaugc

SEQ ID NO: 3058144 - RNA, 20 nt, Human
gccacauuccugaugcuucu

SEQ ID NO: 3058145 - RNA, 22 nt, Human
gccaccaacauacucccaucug

SEQ ID NO: 3058146 - RNA, 20 nt, Human
gccaccaacauacucccauc

SEQ ID NO: 3058147 - RNA, 21 nt, Human
gccaccaacauacucccaucu

SEQ ID NO: 3058148 - RNA, 19 nt, Human
gccaccaacauacucccau

SEQ ID NO: 3058149 - RNA, 21 nt, Human
gccacuguuuugaaucucaua

SEQ ID NO: 3058150 - RNA, 19 nt, Human
gccacugugaagagaacca

SEQ ID NO: 3058151 - RNA, 18 nt, Human
gccacugugaagagaacc

SEQ ID NO: 3058152 - RNA, 23 nt, Human
gccacugcaccgggccacagaga

SEQ ID NO: 3058153 - RNA, 19 nt, Human
gccacccuggggagaaagu

SEQ ID NO: 3058154 - RNA, 13 nt, Human
gccacccugggga

SEQ ID NO: 3058155 - RNA, 21 nt, Human
gccacugcacuauagccuagg

SEQ ID NO: 3058156 - RNA, 22 nt, Human
gccacugcaccgggccacagag

SEQ ID NO: 3058157 - RNA, 13 nt, Human
gcugccaccugcc

SEQ ID NO: 3058158 - RNA, 19 nt, Human
gcugccagccgagauagcc

SEQ ID NO: 3058159 - RNA, 21 nt, Human
gcugccagccgagauagccaa

SEQ ID NO: 3058160 - RNA, 23 nt, Human
gcugccauccagguucagcuugu

SEQ ID NO: 3058161 - RNA, 21 nt, Human
gcugccauccagguucagcuu

SEQ ID NO: 3058162 - RNA, 14 nt, Human
gcugcaccggcugg

SEQ ID NO: 3058163 - RNA, 16 nt, Human
gcugcaccggcuggcc

SEQ ID NO: 3058164 - RNA, 17 nt, Human
gcugcaccggcuggccu

SEQ ID NO: 3058165 - RNA, 18 nt, Human
gcugcaccggcuggccug

SEQ ID NO: 3058166 - RNA, 19 nt, Human
gcugcaccggcuggccugg

SEQ ID NO: 3058167 - RNA, 22 nt, Human
gcugcaccggcuggccuggccc

SEQ ID NO: 3058168 - RNA, 13 nt, Human
gcugccugggauc

SEQ ID NO: 3058169 - RNA, 19 nt, Human
gcugccugggaucccucau

SEQ ID NO: 3058170 - RNA, 22 nt, Human
gcugcuccuaggacccgucucc

SEQ ID NO: 3058171 - RNA, 16 nt, Human
gcugccugggaucccu

SEQ ID NO: 3058172 - RNA, 18 nt, Human
gcugccugggaucccuca

SEQ ID NO: 3058173 - RNA, 13 nt, Human
gcugcugccccug

SEQ ID NO: 3058174 - RNA, 14 nt, Human
gcugcugccccugc

SEQ ID NO: 3058175 - RNA, 15 nt, Human
gcugcugccccugca

SEQ ID NO: 3058176 - RNA, 23 nt, Human
gcugcugccccugcacagcaggc

SEQ ID NO: 3058177 - RNA, 22 nt, Human
gcuggaccuugaacuggguacu

SEQ ID NO: 3058178 - RNA, 12 nt, Human
gcuggagugcag

SEQ ID NO: 3058179 - RNA, 17 nt, Human
gcuggagcucugcccau

SEQ ID NO: 3058180 - RNA, 14 nt, Human
gcuggagcucugcc

SEQ ID NO: 3058181 - RNA, 19 nt, Human
gcugggucgcccuggacug

SEQ ID NO: 3058182 - RNA, 15 nt, Human
gcuggguguggcgca

SEQ ID NO: 3058183 - RNA, 18 nt, Human
gcugggucgcccuggacu

SEQ ID NO: 3058184 - RNA, 17 nt, Human
gcugggucgcccuggac

SEQ ID NO: 3058185 - RNA, 16 nt, Human
gcugggucgcccugga

SEQ ID NO: 3058186 - RNA, 12 nt, Human
gcugggucgccc

SEQ ID NO: 3058187 - RNA, 19 nt, Human
gcugggcagaggaaagcaa

SEQ ID NO: 3058188 - RNA, 16 nt, Human
gcugggcagaggaaag

SEQ ID NO: 3058189 - RNA, 17 nt, Human
gcugggcagaggaaagc

SEQ ID NO: 3058190 - RNA, 12 nt, Human
gcugggcucccu

SEQ ID NO: 3058191 - RNA, 16 nt, Human
gcugggcucccuuccc

SEQ ID NO: 3058192 - RNA, 17 nt, Human
gcugggcucccuuccca

SEQ ID NO: 3058193 - RNA, 20 nt, Human
gcugggcucccuucccaccu

SEQ ID NO: 3058194 - RNA, 18 nt, Human
gcuggccuggccccucag

SEQ ID NO: 3058195 - RNA, 19 nt, Human
gcuggccuggccccucagg

SEQ ID NO: 3058196 - RNA, 16 nt, Human
gcugggauuacaggug

SEQ ID NO: 3058197 - RNA, 16 nt, Human
gcuggccuggccccuc

SEQ ID NO: 3058198 - RNA, 17 nt, Human
gcuggccuggccccuca

SEQ ID NO: 3058199 - RNA, 15 nt, Human
gcuggagugcaguga

SEQ ID NO: 3058200 - RNA, 14 nt, Human
gcuggagugcagug

SEQ ID NO: 3058201 - RNA, 14 nt, Human
gcugggcagaggaa

SEQ ID NO: 3058202 - RNA, 15 nt, Human
gcugggcagaggaaa

SEQ ID NO: 3058203 - RNA, 13 nt, Human
gcugggcagagga

SEQ ID NO: 3058204 - RNA, 18 nt, Human
gcugggauuacaggugug

SEQ ID NO: 3058205 - RNA, 19 nt, Human
gcugggauuacagguguga

SEQ ID NO: 3058206 - RNA, 20 nt, Human
gcuucacggaagagccuugc

SEQ ID NO: 3058207 - RNA, 22 nt, Human
gcuucaaggauccugagccaga

SEQ ID NO: 3058208 - RNA, 19 nt, Human
gcuucacggaagagccuug

SEQ ID NO: 3058209 - RNA, 19 nt, Human
gcugugcugcccugcccac

SEQ ID NO: 3058210 - RNA, 22 nt, Human
gcugugcugcccugcccaccug

SEQ ID NO: 3058211 - RNA, 22 nt, Human
gcuguuggcugggggccucagu

SEQ ID NO: 3058212 - RNA, 21 nt, Human
gcuguuggcugggggccucag

SEQ ID NO: 3058213 - RNA, 12 nt, Human
gcugugcugccc

SEQ ID NO: 3058214 - RNA, 21 nt, Human
gcugugcucuggacaggcaug

SEQ ID NO: 3058215 - RNA, 13 nt, Human
gcugugcugcccu

SEQ ID NO: 3058216 - RNA, 18 nt, Human
gcugugcucuggacaggc

SEQ ID NO: 3058217 - RNA, 15 nt, Human
gcuggguucuaccca

SEQ ID NO: 3058218 - RNA, 15 nt, Human
gcuggguucugaucc

SEQ ID NO: 3058219 - RNA, 21 nt, Human
gcuggguuggaggguguccca

SEQ ID NO: 3058220 - RNA, 14 nt, Human
gcuggguuggaggg

SEQ ID NO: 3058221 - RNA, 19 nt, Human
gcuguaucccaugagccuc

SEQ ID NO: 3058222 - RNA, 23 nt, Human
gcuguaucccaugagccucagca

SEQ ID NO: 3058223 - RNA, 20 nt, Human
gcuguaucccaugagccuca

SEQ ID NO: 3058224 - RNA, 22 nt, Human
gcuuccuucugugaaaguacau

SEQ ID NO: 3058225 - RNA, 16 nt, Human
gcuuguacauaaugcg

SEQ ID NO: 3058226 - RNA, 14 nt, Human
gcuuguacauaaug

SEQ ID NO: 3058227 - RNA, 18 nt, Human
gcucaggagcccugggag

SEQ ID NO: 3058228 - RNA, 15 nt, Human
gcucaggagcccugg

SEQ ID NO: 3058229 - RNA, 12 nt, Human
gcucagggccug

SEQ ID NO: 3058230 - RNA, 13 nt, Human
gcucagggccugg

SEQ ID NO: 3058231 - RNA, 16 nt, Human
gcucagggccuggcuc

SEQ ID NO: 3058232 - RNA, 14 nt, Human
gcucaggagcccug

SEQ ID NO: 3058233 - RNA, 18 nt, Human
gcucagagagggugggag

SEQ ID NO: 3058234 - RNA, 20 nt, Human
gcucagagagggugggagug

SEQ ID NO: 3058235 - RNA, 15 nt, Human
gcucagagagggugg

SEQ ID NO: 3058236 - RNA, 21 nt, Human
gcucagguggggucacucugg

SEQ ID NO: 3058237 - RNA, 22 nt, Human
gcucagguggggucacucuggc

SEQ ID NO: 3058238 - RNA, 19 nt, Human
gccuguucagcuccagcuc

SEQ ID NO: 3058239 - RNA, 20 nt, Human
gccuguucagcuccagcuca

SEQ ID NO: 3058240 - RNA, 19 nt, Human
gcuaggaacacuccuucac

SEQ ID NO: 3058241 - RNA, 21 nt, Human
gcuaggaacacuccuucacag

SEQ ID NO: 3058242 - RNA, 18 nt, Human
gcuaggaacacuccuuca

SEQ ID NO: 3058243 - RNA, 16 nt, Human
gcuaggaacacuccuu

SEQ ID NO: 3058244 - RNA, 15 nt, Human
gcuaggccuggccag

SEQ ID NO: 3058245 - RNA, 14 nt, Human
gcuaggccuggcca

SEQ ID NO: 3058246 - RNA, 22 nt, Human
gcuaggaccccuccaugugggc

SEQ ID NO: 3058247 - RNA, 16 nt, Human
gcuaguaucaaaagaa

SEQ ID NO: 3058248 - RNA, 21 nt, Human
gcuaguaauuggaaaggcagc

SEQ ID NO: 3058249 - RNA, 13 nt, Human
gcucucaggccag

SEQ ID NO: 3058250 - RNA, 14 nt, Human
gcucucaggccagc

SEQ ID NO: 3058251 - RNA, 15 nt, Human
gcucucaggccagcu

SEQ ID NO: 3058252 - RNA, 16 nt, Human
gcucucaggccagcug

SEQ ID NO: 3058253 - RNA, 20 nt, Human
gcucccaggcauuccccagg

SEQ ID NO: 3058254 - RNA, 21 nt, Human
gcucccaggcauuccccagga

SEQ ID NO: 3058255 - RNA, 14 nt, Human
gcuccccagcccca

SEQ ID NO: 3058256 - RNA, 22 nt, Human
gcucccaggcauuccccaggag

SEQ ID NO: 3058257 - RNA, 17 nt, Human
gcucccaggcauucccc

SEQ ID NO: 3058258 - RNA, 15 nt, Human
gcuccccucggagaa

SEQ ID NO: 3058259 - RNA, 23 nt, Human
gcucuggagcccacuguacuugc

SEQ ID NO: 3058260 - RNA, 16 nt, Human
gcucuguccugggagu

SEQ ID NO: 3058261 - RNA, 14 nt, Human
gcucuguccuggga

SEQ ID NO: 3058262 - RNA, 15 nt, Human
gcucuguccugggag

SEQ ID NO: 3058263 - RNA, 15 nt, Human
gcucuuccaggcugg

SEQ ID NO: 3058264 - RNA, 16 nt, Human
gcucuuccaggcuggg

SEQ ID NO: 3058265 - RNA, 12 nt, Human
gcucuuccaggc

SEQ ID NO: 3058266 - RNA, 22 nt, Human
gcugaauacagaggcaacugca

SEQ ID NO: 3058267 - RNA, 17 nt, Human
gcugaaugguuuucaaa

SEQ ID NO: 3058268 - RNA, 12 nt, Human
gcugaaggcucg

SEQ ID NO: 3058269 - RNA, 20 nt, Human
gcugaaggcucgagcaugcc

SEQ ID NO: 3058270 - RNA, 16 nt, Human
gcugacagacacaggc

SEQ ID NO: 3058271 - RNA, 15 nt, Human
gcugacagacacagg

SEQ ID NO: 3058272 - RNA, 14 nt, Human
gcugacagacacag

SEQ ID NO: 3058273 - RNA, 20 nt, Human
gagccuuccaggggugggac

SEQ ID NO: 3058274 - RNA, 13 nt, Human
gagccuugaacuu

SEQ ID NO: 3058275 - RNA, 23 nt, Human
gagccuuccaggggugggacacc

SEQ ID NO: 3058276 - RNA, 14 nt, Human
gaggcagggucuca

SEQ ID NO: 3058277 - RNA, 15 nt, Human
gaggacgcucucugg

SEQ ID NO: 3058278 - RNA, 22 nt, Human
gaggcagggucucacucugucg

SEQ ID NO: 3058279 - RNA, 15 nt, Human
gaggcagggucucac

SEQ ID NO: 3058280 - RNA, 17 nt, Human
gaggccaaggugggagg

SEQ ID NO: 3058281 - RNA, 22 nt, Human
gaggccaaggugggaggauugc

SEQ ID NO: 3058282 - RNA, 18 nt, Human
gaggcuacuguaaggcaa

SEQ ID NO: 3058283 - RNA, 19 nt, Human
gaggcuccacuuggucugu

SEQ ID NO: 3058284 - RNA, 18 nt, Human
gaggcuccacuuggucug

SEQ ID NO: 3058285 - RNA, 23 nt, Human
gaggcuccacuuggucugugaga

SEQ ID NO: 3058286 - RNA, 13 nt, Human
gaggccagagaca

SEQ ID NO: 3058287 - RNA, 14 nt, Human
gaggccagagacac

SEQ ID NO: 3058288 - RNA, 22 nt, Human
gaggcuagugugguguuuccug

SEQ ID NO: 3058289 - RNA, 22 nt, Human
gaguuguuacauuuuuaagugc

SEQ ID NO: 3058290 - RNA, 18 nt, Human
gaguugauucagcucugc

SEQ ID NO: 3058291 - RNA, 15 nt, Human
gaggucgaggcagga

SEQ ID NO: 3058292 - RNA, 23 nt, Human
gaggugaccccagguuucuaugu

SEQ ID NO: 3058293 - RNA, 17 nt, Human
gagucaccaagcccagu

SEQ ID NO: 3058294 - RNA, 16 nt, Human
gagucaccaagcccag

SEQ ID NO: 3058295 - RNA, 15 nt, Human
gagucaccaagccca

SEQ ID NO: 3058296 - RNA, 22 nt, Human
gagucagaaguuucugccgcag

SEQ ID NO: 3058297 - RNA, 18 nt, Human
gagugacagaggcagccc

SEQ ID NO: 3058298 - RNA, 12 nt, Human
gagucccaccuu

SEQ ID NO: 3058299 - RNA, 15 nt, Human
gaguugauucagcuc

SEQ ID NO: 3058300 - RNA, 16 nt, Human
gaguugauucagcucu

SEQ ID NO: 3058301 - RNA, 17 nt, Human
gaguugauucagcucug

SEQ ID NO: 3058302 - RNA, 22 nt, Human
gaguugauagcacagacccugc

SEQ ID NO: 3058303 - RNA, 20 nt, Human
gagugacagaggcagcccca

SEQ ID NO: 3058304 - RNA, 17 nt, Human
gcacuccccugcugggu

SEQ ID NO: 3058305 - RNA, 16 nt, Human
gcacucagaagacacu

SEQ ID NO: 3058306 - RNA, 13 nt, Human
gcacucagaagac

SEQ ID NO: 3058307 - RNA, 22 nt, Human
gcacuccccugcuggguguggc

SEQ ID NO: 3058308 - RNA, 16 nt, Human
gcacuccccugcuggg

SEQ ID NO: 3058309 - RNA, 16 nt, Human
gcacuugcagacucua

SEQ ID NO: 3058310 - RNA, 23 nt, Human
gcaccgggccacagagaaaguac

SEQ ID NO: 3058311 - RNA, 23 nt, Human
gcacaucagcacgauuucuguuu

SEQ ID NO: 3058312 - RNA, 22 nt, Human
gcacaucagcacgauuucuguu

SEQ ID NO: 3058313 - RNA, 14 nt, Human
gcaccgggccacag

SEQ ID NO: 3058314 - RNA, 18 nt, Human
gcaagucagaauagaaau

SEQ ID NO: 3058315 - RNA, 20 nt, Human
gcaaguauuagaauaccaca

SEQ ID NO: 3058316 - RNA, 19 nt, Human
gcaagugagagcugggugu

SEQ ID NO: 3058317 - RNA, 22 nt, Human
gcaauagucaaauugugugaaa

SEQ ID NO: 3058318 - RNA, 22 nt, Human
gcacaagcugcacccucaggca

SEQ ID NO: 3058319 - RNA, 14 nt, Human
gcacaccgggcacu

SEQ ID NO: 3058320 - RNA, 14 nt, Human
gcacacauuuuuua

SEQ ID NO: 3058321 - RNA, 23 nt, Human
gcacaguuuucugagaaagacua

SEQ ID NO: 3058322 - RNA, 22 nt, Human
gcacaguuuucugagaaagacu

SEQ ID NO: 3058323 - RNA, 20 nt, Human
gcacaguuuucugagaaaga

SEQ ID NO: 3058324 - RNA, 12 nt, Human
gauuauuggaaa

SEQ ID NO: 3058325 - RNA, 14 nt, Human
gauuauauuaugaa

SEQ ID NO: 3058326 - RNA, 14 nt, Human
gauucuccugccuc

SEQ ID NO: 3058327 - RNA, 18 nt, Human
gauucuccugccucagcc

SEQ ID NO: 3058328 - RNA, 17 nt, Human
gauucuccugccucagc

SEQ ID NO: 3058329 - RNA, 15 nt, Human
gauucuccugccuca

SEQ ID NO: 3058330 - RNA, 18 nt, Human
gauucuuccucccucccu

SEQ ID NO: 3058331 - RNA, 17 nt, Human
gauucuuccucccuccc

SEQ ID NO: 3058332 - RNA, 15 nt, Human
gauuuaccacuugug

SEQ ID NO: 3058333 - RNA, 16 nt, Human
gauuuaccacuugugu

SEQ ID NO: 3058334 - RNA, 16 nt, Human
gaugagugagcaugcc

SEQ ID NO: 3058335 - RNA, 21 nt, Human
gaugaucuaggaagacuuugg

SEQ ID NO: 3058336 - RNA, 16 nt, Human
gaugaucuuuaaaaua

SEQ ID NO: 3058337 - RNA, 15 nt, Human
gaugaucuaggaaga

SEQ ID NO: 3058338 - RNA, 14 nt, Human
gaugguucuagcau

SEQ ID NO: 3058339 - RNA, 22 nt, Human
gaugguucccuugaugaagaag

SEQ ID NO: 3058340 - RNA, 17 nt, Human
gauguagaggagaaacu

SEQ ID NO: 3058341 - RNA, 18 nt, Human
gauguagaggagaaacug

SEQ ID NO: 3058342 - RNA, 14 nt, Human
gaugauccuaggca

SEQ ID NO: 3058343 - RNA, 14 nt, Human
gaagcacaugccuc

SEQ ID NO: 3058344 - RNA, 15 nt, Human
gaagcagaggaagga

SEQ ID NO: 3058345 - RNA, 23 nt, Human
gaagcagaccauuggggcuccca

SEQ ID NO: 3058346 - RNA, 20 nt, Human
gaagcaaugcuucaucccuu

SEQ ID NO: 3058347 - RNA, 23 nt, Human
gaagcaacccaaauguucaucaa

SEQ ID NO: 3058348 - RNA, 17 nt, Human
gaagcacaugccucucu

SEQ ID NO: 3058349 - RNA, 20 nt, Human
gaagcacaugccucucucag

SEQ ID NO: 3058350 - RNA, 15 nt, Human
gaagcacaugccucu

SEQ ID NO: 3058351 - RNA, 23 nt, Human
gaagauuuugaaauuuuuauuaa

SEQ ID NO: 3058352 - RNA, 14 nt, Human
gaagcaaaauuuuu

SEQ ID NO: 3058353 - RNA, 23 nt, Human
gaagacaaugugaaaagaaaaau

SEQ ID NO: 3058354 - RNA, 22 nt, Human
gaagacaaugacuuacuguaca

SEQ ID NO: 3058355 - RNA, 16 nt, Human
gaagacaaugacuuac

SEQ ID NO: 3058356 - RNA, 12 nt, Human
gaacuggcugca

SEQ ID NO: 3058357 - RNA, 11 nt, Human
gaacuggcugc

SEQ ID NO: 3058358 - RNA, 20 nt, Human
gaaccgagggggcugcuccc

SEQ ID NO: 3058359 - RNA, 21 nt, Human
gaaccgagggggcugcuccca

SEQ ID NO: 3058360 - RNA, 15 nt, Human
gaacuccuggccuca

SEQ ID NO: 3058361 - RNA, 22 nt, Human
gaaccgagggggcugcucccac

SEQ ID NO: 3058362 - RNA, 14 nt, Human
gaacugaaaucaua

SEQ ID NO: 3058363 - RNA, 13 nt, Human
gaacugaaaucau

SEQ ID NO: 3058364 - RNA, 19 nt, Human
gaacccgggaggcagaggu

SEQ ID NO: 3058365 - RNA, 20 nt, Human
gaagcuaucguaaaauuaag

SEQ ID NO: 3058366 - RNA, 19 nt, Human
gaagcuccgcuuucuaccc

SEQ ID NO: 3058367 - RNA, 17 nt, Human
gaaggccccgcccaggc

SEQ ID NO: 3058368 - RNA, 22 nt, Human
gaagcuccgcuuucuacccagc

SEQ ID NO: 3058369 - RNA, 20 nt, Human
gaaggcuggguucugauccu

SEQ ID NO: 3058370 - RNA, 22 nt, Human
gaaggcuggguucugauccuag

SEQ ID NO: 3058371 - RNA, 15 nt, Human
gaaggcuggguucug

SEQ ID NO: 3058372 - RNA, 19 nt, Human
gaaggcuggguucugaucc

SEQ ID NO: 3058373 - RNA, 19 nt, Human
gaaggcucgagcaugccug

SEQ ID NO: 3058374 - RNA, 18 nt, Human
gaaggccccgcccaggcu

SEQ ID NO: 3058375 - RNA, 19 nt, Human
gaaggccccgcccaggcuu

SEQ ID NO: 3058376 - RNA, 21 nt, Human
gaaggcucgagcaugccugga

SEQ ID NO: 3058377 - RNA, 22 nt, Human
gaaggggagauaaggguaucug

SEQ ID NO: 3058378 - RNA, 14 nt, Human
gaauauguuucaaa

SEQ ID NO: 3058379 - RNA, 15 nt, Human
gaauauguuucaaac

SEQ ID NO: 3058380 - RNA, 20 nt, Human
gaauauguuucaaacuuugg

SEQ ID NO: 3058381 - RNA, 14 nt, Human
gaauauugcugaug

SEQ ID NO: 3058382 - RNA, 15 nt, Human
gaauauugcugaugg

SEQ ID NO: 3058383 - RNA, 19 nt, Human
gaauauugcugauggugca

SEQ ID NO: 3058384 - RNA, 20 nt, Human
gaauauugcugauggugcaa

SEQ ID NO: 3058385 - RNA, 22 nt, Human
gaauauugcuuuggucauauga

SEQ ID NO: 3058386 - RNA, 16 nt, Human
gacgcucucuggccuu

SEQ ID NO: 3058387 - RNA, 17 nt, Human
gacgcucucuggccuuc

SEQ ID NO: 3058388 - RNA, 16 nt, Human
gacgcuacccgggaag

SEQ ID NO: 3058389 - RNA, 18 nt, Human
gacgcuacccgggaaggg

SEQ ID NO: 3058390 - RNA, 19 nt, Human
gacgcuacccgggaagggg

SEQ ID NO: 3058391 - RNA, 15 nt, Human
gacgcucucuggccu

SEQ ID NO: 3058392 - RNA, 17 nt, Human
gacgccaucccagcccc

SEQ ID NO: 3058393 - RNA, 18 nt, Human
gacgccaucccagcccca

SEQ ID NO: 3058394 - RNA, 15 nt, Human
gacgccaucccagcc

SEQ ID NO: 3058395 - RNA, 14 nt, Human
gaccucugcagcaa

SEQ ID NO: 3058396 - RNA, 13 nt, Human
gaccucugccuga

SEQ ID NO: 3058397 - RNA, 20 nt, Human
gaccaucccugaaggccccg

SEQ ID NO: 3058398 - RNA, 11 nt, Human
gaccugaggcc

SEQ ID NO: 3058399 - RNA, 13 nt, Human
gaccugaggcccu

SEQ ID NO: 3058400 - RNA, 16 nt, Human
gacgccaucccagccc

SEQ ID NO: 3058401 - RNA, 22 nt, Human
gacugugugcucaggagcccug

SEQ ID NO: 3058402 - RNA, 14 nt, Human
gacugaauuucuuu

SEQ ID NO: 3058403 - RNA, 16 nt, Human
gacugaauggacuuug

SEQ ID NO: 3058404 - RNA, 14 nt, Human
gacugaauuaugaa

SEQ ID NO: 3058405 - RNA, 20 nt, Human
gacugaauuaugaaacuuuu

SEQ ID NO: 3058406 - RNA, 19 nt, Human
gacucugucucaaaaaaac

SEQ ID NO: 3058407 - RNA, 14 nt, Human
gacucuuaagaaga

SEQ ID NO: 3058408 - RNA, 18 nt, Human
gacucuuaagaagacugc

SEQ ID NO: 3058409 - RNA, 21 nt, Human
gacucuuaagaagacugcauu

SEQ ID NO: 3058410 - RNA, 14 nt, Human
gacacacugaagaa

SEQ ID NO: 3058411 - RNA, 15 nt, Human
gacacacugaagaag

SEQ ID NO: 3058412 - RNA, 16 nt, Human
gacacacugaagaagc

SEQ ID NO: 3058413 - RNA, 16 nt, Human
gacacagcucuucucc

SEQ ID NO: 3058414 - RNA, 14 nt, Human
gacacagcucuucu

SEQ ID NO: 3058415 - RNA, 13 nt, Human
gacacagcucuuc

SEQ ID NO: 3058416 - RNA, 23 nt, Human
gacacagcucuucuccaggcugu

SEQ ID NO: 3058417 - RNA, 22 nt, Human
gacacagcucuucuccaggcug

SEQ ID NO: 3058418 - RNA, 17 nt, Human
gacagcccgggcucugc

SEQ ID NO: 3058419 - RNA, 15 nt, Human
gacagaagcagcucu

SEQ ID NO: 3058420 - RNA, 21 nt, Human
gacagaaagcagaacagugau

SEQ ID NO: 3058421 - RNA, 12 nt, Human
gaccaucccuga

SEQ ID NO: 3058422 - RNA, 13 nt, Human
gaccaucccugaa

SEQ ID NO: 3058423 - RNA, 18 nt, Human
gaccaucccugaaggccc

SEQ ID NO: 3058424 - RNA, 19 nt, Human
gaccaucccugaaggcccc

SEQ ID NO: 3058425 - RNA, 20 nt, Human
gaccagggauuuccaugaug

SEQ ID NO: 3058426 - RNA, 18 nt, Human
gaccagggauuuccauga

SEQ ID NO: 3058427 - RNA, 16 nt, Human
gacauuugcucaugga

SEQ ID NO: 3058428 - RNA, 19 nt, Human
gacauuguuggccaaagcc

SEQ ID NO: 3058429 - RNA, 14 nt, Human
gacagugaaagaaa

SEQ ID NO: 3058430 - RNA, 18 nt, Human
gacagcccgggcucugcc

SEQ ID NO: 3058431 - RNA, 19 nt, Human
gacagcccgggcucugccu

SEQ ID NO: 3058432 - RNA, 21 nt, Human
gacagugagacucugucucag

SEQ ID NO: 3058433 - RNA, 15 nt, Human
gacauugcggacagc

SEQ ID NO: 3058434 - RNA, 14 nt, Human
gacauugcggacag

SEQ ID NO: 3058435 - RNA, 23 nt, Human
cuucugacccaugcugcccugug

SEQ ID NO: 3058436 - RNA, 20 nt, Human
cuucuucagagacuccugca

SEQ ID NO: 3058437 - RNA, 21 nt, Human
cuucuucagagacuccugcag

SEQ ID NO: 3058438 - RNA, 15 nt, Human
cuucuguuuuauaau

SEQ ID NO: 3058439 - RNA, 20 nt, Human
cuucuguuuuauaauuuugu

SEQ ID NO: 3058440 - RNA, 18 nt, Human
cuucuucagagacuccug

SEQ ID NO: 3058441 - RNA, 22 nt, Human
cuucuucagagacuccugcagg

SEQ ID NO: 3058442 - RNA, 20 nt, Human
cuugaaugaugccaugagga

SEQ ID NO: 3058443 - RNA, 23 nt, Human
cuugaaugaugccaugaggaaca

SEQ ID NO: 3058444 - RNA, 20 nt, Human
cuugccgucuaccugagggg

SEQ ID NO: 3058445 - RNA, 12 nt, Human
cuugacagggca

SEQ ID NO: 3058446 - RNA, 23 nt, Human
cuugccgucuaccugaggggccu

SEQ ID NO: 3058447 - RNA, 12 nt, Human
cuugcucugcug

SEQ ID NO: 3058448 - RNA, 15 nt, Human
cuuguggacacagcu

SEQ ID NO: 3058449 - RNA, 14 nt, Human
cuuguggacacagc

SEQ ID NO: 3058450 - RNA, 13 nt, Human
cuuguggacacag

SEQ ID NO: 3058451 - RNA, 20 nt, Human
cuuuaaagggauggcaagau

SEQ ID NO: 3058452 - RNA, 18 nt, Human
cuuucaauaggaaaaacu

SEQ ID NO: 3058453 - RNA, 20 nt, Human
cuuucaauaggaaaaacuga

SEQ ID NO: 3058454 - RNA, 21 nt, Human
cuuucaauaggaaaaacugau

SEQ ID NO: 3058455 - RNA, 22 nt, Human
cuuucaauaggaaaaacugauu

SEQ ID NO: 3058456 - RNA, 15 nt, Human
cuuuucaaaacauuu

SEQ ID NO: 3058457 - RNA, 15 nt, Human
cuuuuauaaacuuua

SEQ ID NO: 3058458 - RNA, 18 nt, Human
cuuuuauaaacuuuaccu

SEQ ID NO: 3058459 - RNA, 16 nt, Human
cuuuuauaaacuuuac

SEQ ID NO: 3058460 - RNA, 14 nt, Human
cuuuuauaaacuuu

SEQ ID NO: 3058461 - RNA, 16 nt, Human
cuuuggucuacacugu

SEQ ID NO: 3058462 - RNA, 20 nt, Human
cuuuggucuacacugugcug

SEQ ID NO: 3058463 - RNA, 21 nt, Human
cuuugagugucuuaauuaaaa

SEQ ID NO: 3058464 - RNA, 18 nt, Human
cuuugacgccaucccagc

SEQ ID NO: 3058465 - RNA, 19 nt, Human
cuuugacgccaucccagcc

SEQ ID NO: 3058466 - RNA, 21 nt, Human
cuuugacgccaucccagcccc

SEQ ID NO: 3058467 - RNA, 22 nt, Human
cuuugacgccaucccagcccca

SEQ ID NO: 3058468 - RNA, 13 nt, Human
cuuacacaauggu

SEQ ID NO: 3058469 - RNA, 17 nt, Human
cuguugggccaggagcc

SEQ ID NO: 3058470 - RNA, 20 nt, Human
cuguugggccaggagccucc

SEQ ID NO: 3058471 - RNA, 16 nt, Human
cuguugggccaggagc

SEQ ID NO: 3058472 - RNA, 19 nt, Human
cuuacccucauguucuuaa

SEQ ID NO: 3058473 - RNA, 18 nt, Human
cuuacccucauguucuua

SEQ ID NO: 3058474 - RNA, 17 nt, Human
cuuacccucauguucuu

SEQ ID NO: 3058475 - RNA, 13 nt, Human
cuuaccucggugc

SEQ ID NO: 3058476 - RNA, 19 nt, Human
cuuaccucggugccuuccu

SEQ ID NO: 3058477 - RNA, 21 nt, Human
cuuaccucggugccuuccucu

SEQ ID NO: 3058478 - RNA, 19 nt, Human
cuuagauguauauauuucc

SEQ ID NO: 3058479 - RNA, 20 nt, Human
cugugcugagucugaaggcu

SEQ ID NO: 3058480 - RNA, 22 nt, Human
cugugcugagucugaaggcugg

SEQ ID NO: 3058481 - RNA, 11 nt, Human
cugugcugccc

SEQ ID NO: 3058482 - RNA, 19 nt, Human
cugugcugagucugaaggc

SEQ ID NO: 3058483 - RNA, 14 nt, Human
cugugucucccuuc

SEQ ID NO: 3058484 - RNA, 19 nt, Human
cugugucucccuucauccu

SEQ ID NO: 3058485 - RNA, 14 nt, Human
cugugucuugcaau

SEQ ID NO: 3058486 - RNA, 21 nt, Human
cugugucagguggggcagcuu

SEQ ID NO: 3058487 - RNA, 20 nt, Human
cugugucagcauagaaguaa

SEQ ID NO: 3058488 - RNA, 19 nt, Human
cugugucagguggggcagc

SEQ ID NO: 3058489 - RNA, 19 nt, Human
cugugucuugcaauggcag

SEQ ID NO: 3058490 - RNA, 16 nt, Human
cugugucuugcaaugg

SEQ ID NO: 3058491 - RNA, 13 nt, Human
cuguucagcucca

SEQ ID NO: 3058492 - RNA, 21 nt, Human
cuuauggaacacucugagacu

SEQ ID NO: 3058493 - RNA, 14 nt, Human
cuuaugggcugggu

SEQ ID NO: 3058494 - RNA, 21 nt, Human
cuuaugggcuggguucuaccc

SEQ ID NO: 3058495 - RNA, 13 nt, Human
cuuauugcccacg

SEQ ID NO: 3058496 - RNA, 12 nt, Human
cuuauugcccac

SEQ ID NO: 3058497 - RNA, 22 nt, Human
cuuaugggcuggguucuaccca

SEQ ID NO: 3058498 - RNA, 23 nt, Human
cuuaugggcuggguucuacccag

SEQ ID NO: 3058499 - RNA, 18 nt, Human
cuuagcagggaaacagcu

SEQ ID NO: 3058500 - RNA, 18 nt, Human
cuuccagugaggcucugc

SEQ ID NO: 3058501 - RNA, 17 nt, Human
cuuccagugaggcucug

SEQ ID NO: 3058502 - RNA, 19 nt, Human
cuuccagugaggcucugcc

SEQ ID NO: 3058503 - RNA, 20 nt, Human
cuuccagugaggcucugccc

SEQ ID NO: 3058504 - RNA, 16 nt, Human
cuuccauggacuuugu

SEQ ID NO: 3058505 - RNA, 17 nt, Human
cuuccauggacuuuguu

SEQ ID NO: 3058506 - RNA, 18 nt, Human
cuucaucugacuaugaca

SEQ ID NO: 3058507 - RNA, 23 nt, Human
cuucaugcugucuacacuaagag

SEQ ID NO: 3058508 - RNA, 12 nt, Human
cuucaucugacu

SEQ ID NO: 3058509 - RNA, 16 nt, Human
cuucauccuccucaga

SEQ ID NO: 3058510 - RNA, 23 nt, Human
cuucagagacuccugcaggcagc

SEQ ID NO: 3058511 - RNA, 17 nt, Human
cuucaguggcagcugcu

SEQ ID NO: 3058512 - RNA, 18 nt, Human
cuucaguggcagcugcuu

SEQ ID NO: 3058513 - RNA, 13 nt, Human
cuucaucccucug

SEQ ID NO: 3058514 - RNA, 15 nt, Human
cuucauccuccucag

SEQ ID NO: 3058515 - RNA, 16 nt, Human
cuucagagacuccugc

SEQ ID NO: 3058516 - RNA, 21 nt, Human
cuucagagacuccugcaggca

SEQ ID NO: 3058517 - RNA, 22 nt, Human
cuucagagacuccugcaggcag

SEQ ID NO: 3058518 - RNA, 11 nt, Human
cuucagacaua

SEQ ID NO: 3058519 - RNA, 17 nt, Human
cuucaccuuugucccca

SEQ ID NO: 3058520 - RNA, 20 nt, Human
cuucaccuuuguccccaccg

SEQ ID NO: 3058521 - RNA, 18 nt, Human
cuuauugcccacgcugga

SEQ ID NO: 3058522 - RNA, 14 nt, Human
cuucaccuuugucc

SEQ ID NO: 3058523 - RNA, 14 nt, Human
cuggguguggcgca

SEQ ID NO: 3058524 - RNA, 21 nt, Human
cuggguggcaccagcagccug

SEQ ID NO: 3058525 - RNA, 15 nt, Human
cuggguguggcgcag

SEQ ID NO: 3058526 - RNA, 12 nt, Human
cuggugccucac

SEQ ID NO: 3058527 - RNA, 21 nt, Human
cuggugccucaccccuugcca

SEQ ID NO: 3058528 - RNA, 20 nt, Human
cugggcagguuggugggggc

SEQ ID NO: 3058529 - RNA, 20 nt, Human
cugggcagaggaaagcaaag

SEQ ID NO: 3058530 - RNA, 13 nt, Human
cugggcagaggaa

SEQ ID NO: 3058531 - RNA, 16 nt, Human
cugggcagaggaaagc

SEQ ID NO: 3058532 - RNA, 12 nt, Human
cugggcagagga

SEQ ID NO: 3058533 - RNA, 13 nt, Human
cuggggagaaagu

SEQ ID NO: 3058534 - RNA, 18 nt, Human
cuggguggcaccagcagc

SEQ ID NO: 3058535 - RNA, 20 nt, Human
cuggguggcaccagcagccu

SEQ ID NO: 3058536 - RNA, 16 nt, Human
cuggguggaugggcca

SEQ ID NO: 3058537 - RNA, 12 nt, Human
cuggcccuuccu

SEQ ID NO: 3058538 - RNA, 14 nt, Human
cuggcuaugcauuu

SEQ ID NO: 3058539 - RNA, 13 nt, Human
cuggcuaugcauu

SEQ ID NO: 3058540 - RNA, 16 nt, Human
cuggcuaugcauuuga

SEQ ID NO: 3058541 - RNA, 15 nt, Human
cuggcuaugcauuug

SEQ ID NO: 3058542 - RNA, 22 nt, Human
cuggcuaugcauuugaaaauuu

SEQ ID NO: 3058543 - RNA, 14 nt, Human
cuggcucacccagu

SEQ ID NO: 3058544 - RNA, 13 nt, Human
cuggcucacccag

SEQ ID NO: 3058545 - RNA, 16 nt, Human
cugggagaaaugaaaa

SEQ ID NO: 3058546 - RNA, 17 nt, Human
cugggagaaaugaaaaa

SEQ ID NO: 3058547 - RNA, 22 nt, Human
cugggagaaccaaaaagaggcu

SEQ ID NO: 3058548 - RNA, 15 nt, Human
cugggacuacaggca

SEQ ID NO: 3058549 - RNA, 13 nt, Human
cugggacuacagg

SEQ ID NO: 3058550 - RNA, 18 nt, Human
cugggacaugggaaaggg

SEQ ID NO: 3058551 - RNA, 22 nt, Human
cugggacaugggaaaggggaag

SEQ ID NO: 3058552 - RNA, 14 nt, Human
cugggacaugggaa

SEQ ID NO: 3058553 - RNA, 14 nt, Human
cugcucacauaucu

SEQ ID NO: 3058554 - RNA, 19 nt, Human
cugcucacauaucugucau

SEQ ID NO: 3058555 - RNA, 16 nt, Human
cugcucacauaucugu

SEQ ID NO: 3058556 - RNA, 12 nt, Human
cugcugaaggcu

SEQ ID NO: 3058557 - RNA, 13 nt, Human
cugcugaaggcuc

SEQ ID NO: 3058558 - RNA, 14 nt, Human
cugcugaaggcucg

SEQ ID NO: 3058559 - RNA, 15 nt, Human
cugcugaaggcucga

SEQ ID NO: 3058560 - RNA, 12 nt, Human
cugcugacagug

SEQ ID NO: 3058561 - RNA, 11 nt, Human
cugcugacagu

SEQ ID NO: 3058562 - RNA, 15 nt, Human
cugcugacaguguug

SEQ ID NO: 3058563 - RNA, 13 nt, Human
cugcugacagugu

SEQ ID NO: 3058564 - RNA, 20 nt, Human
cugcuuaacuucacauauug

SEQ ID NO: 3058565 - RNA, 22 nt, Human
cuggaugcagccucacaguccu

SEQ ID NO: 3058566 - RNA, 22 nt, Human
cuggaugcccccuguggaugcu

SEQ ID NO: 3058567 - RNA, 12 nt, Human
cuggaugccauc

SEQ ID NO: 3058568 - RNA, 17 nt, Human
cuggaugcccccugugg

SEQ ID NO: 3058569 - RNA, 18 nt, Human
cuggaugcccccugugga

SEQ ID NO: 3058570 - RNA, 19 nt, Human
cuggaugcccccuguggau

SEQ ID NO: 3058571 - RNA, 22 nt, Human
cuggacugugugcucaggagcc

SEQ ID NO: 3058572 - RNA, 19 nt, Human
cuggacugugugcucagga

SEQ ID NO: 3058573 - RNA, 23 nt, Human
cuggacugugugcucaggagccc

SEQ ID NO: 3058574 - RNA, 16 nt, Human
cuggaguucugguucc

SEQ ID NO: 3058575 - RNA, 17 nt, Human
cuggaguucugguuccu

SEQ ID NO: 3058576 - RNA, 15 nt, Human
cuggaguucugguuc

SEQ ID NO: 3058577 - RNA, 16 nt, Human
cugcccuuaccugcca

SEQ ID NO: 3058578 - RNA, 17 nt, Human
cugcccuuaccugccag

SEQ ID NO: 3058579 - RNA, 12 nt, Human
cugcccuuaccu

SEQ ID NO: 3058580 - RNA, 19 nt, Human
cugcccugugggcccccaa

SEQ ID NO: 3058581 - RNA, 17 nt, Human
cugcauuuaaaagauac

SEQ ID NO: 3058582 - RNA, 20 nt, Human
cugccagggacagagggggu

SEQ ID NO: 3058583 - RNA, 22 nt, Human
cugccagggacagagggggugg

SEQ ID NO: 3058584 - RNA, 23 nt, Human
cugccagggacagaggggguggc

SEQ ID NO: 3058585 - RNA, 17 nt, Human
cugccagugccugggug

SEQ ID NO: 3058586 - RNA, 13 nt, Human
cugccagugccug

SEQ ID NO: 3058587 - RNA, 16 nt, Human
cugccagugccugggu

SEQ ID NO: 3058588 - RNA, 12 nt, Human
cugccagugccu

SEQ ID NO: 3058589 - RNA, 19 nt, Human
cugccauccagguucagcu

SEQ ID NO: 3058590 - RNA, 18 nt, Human
cugccauccagguucagc

SEQ ID NO: 3058591 - RNA, 16 nt, Human
cugccauccagguuca

SEQ ID NO: 3058592 - RNA, 16 nt, Human
cugccauauucuguug

SEQ ID NO: 3058593 - RNA, 12 nt, Human
cugccauccagg

SEQ ID NO: 3058594 - RNA, 13 nt, Human
cugcauuggcuuu

SEQ ID NO: 3058595 - RNA, 14 nt, Human
cugcauuuaaaaga

SEQ ID NO: 3058596 - RNA, 12 nt, Human
cugcagcuuugu

SEQ ID NO: 3058597 - RNA, 13 nt, Human
cugcaggcagcca

SEQ ID NO: 3058598 - RNA, 14 nt, Human
cugcaggcagccag

SEQ ID NO: 3058599 - RNA, 15 nt, Human
cugcaggcagccagg

SEQ ID NO: 3058600 - RNA, 16 nt, Human
cugcaggcagccaggc

SEQ ID NO: 3058601 - RNA, 17 nt, Human
cugcaggcagccaggcc

SEQ ID NO: 3058602 - RNA, 18 nt, Human
cugcaggcagccaggcca

SEQ ID NO: 3058603 - RNA, 19 nt, Human
cugcaggcagccaggccac

SEQ ID NO: 3058604 - RNA, 20 nt, Human
cugcaggcagccaggccaca

SEQ ID NO: 3058605 - RNA, 15 nt, Human
cugcacuccagccug

SEQ ID NO: 3058606 - RNA, 16 nt, Human
cugcacuccagccuga

SEQ ID NO: 3058607 - RNA, 17 nt, Human
cugcacuccagccugag

SEQ ID NO: 3058608 - RNA, 20 nt, Human
cugcacuccagccugagcga

SEQ ID NO: 3058609 - RNA, 13 nt, Human
cugcacuccagcc

SEQ ID NO: 3058610 - RNA, 23 nt, Human
cugcacuauagccuaggugacag

SEQ ID NO: 3058611 - RNA, 22 nt, Human
cugcacuauagccuaggugaca

SEQ ID NO: 3058612 - RNA, 20 nt, Human
cugcacuauagccuagguga

SEQ ID NO: 3058613 - RNA, 18 nt, Human
cugcacuauagccuaggu

SEQ ID NO: 3058614 - RNA, 17 nt, Human
cugcacuauagccuagg

SEQ ID NO: 3058615 - RNA, 16 nt, Human
cugcacuauagccuag

SEQ ID NO: 3058616 - RNA, 17 nt, Human
cugcacuccagccuggg

SEQ ID NO: 3058617 - RNA, 16 nt, Human
cugcacuccagccugg

SEQ ID NO: 3058618 - RNA, 18 nt, Human
cugcacuccagccugggu

SEQ ID NO: 3058619 - RNA, 24 nt, Human
cugcagccucaaccuccugggcua

SEQ ID NO: 3058620 - RNA, 19 nt, Human
cugcacuccagccugggug

SEQ ID NO: 3058621 - RNA, 23 nt, Human
cugcagccucaaccuccugggcu

SEQ ID NO: 3058622 - RNA, 20 nt, Human
cugcaaccuccgccucuugg

SEQ ID NO: 3058623 - RNA, 19 nt, Human
cugcaaccugauugugucu

SEQ ID NO: 3058624 - RNA, 21 nt, Human
cugcaaccugauugugucucu

SEQ ID NO: 3058625 - RNA, 14 nt, Human
cugcaaccugauug

SEQ ID NO: 3058626 - RNA, 22 nt, Human
cugcaaccuccgccucuugggu

SEQ ID NO: 3058627 - RNA, 18 nt, Human
cugcaagaauugaagcag

SEQ ID NO: 3058628 - RNA, 22 nt, Human
cugcaaccugauugugucucuu

SEQ ID NO: 3058629 - RNA, 23 nt, Human
cugcaccgggccacagagaaagu

SEQ ID NO: 3058630 - RNA, 20 nt, Human
cugcaccgggccacagagaa

SEQ ID NO: 3058631 - RNA, 20 nt, Human
cugcaagaauugaagcagga

SEQ ID NO: 3058632 - RNA, 12 nt, Human
cugcaagggagu

SEQ ID NO: 3058633 - RNA, 16 nt, Human
cugaugcuucuucaga

SEQ ID NO: 3058634 - RNA, 17 nt, Human
cugaugcuucuucagag

SEQ ID NO: 3058635 - RNA, 14 nt, Human
cucuuaugggcugg

SEQ ID NO: 3058636 - RNA, 15 nt, Human
cucuuauaucuauau

SEQ ID NO: 3058637 - RNA, 18 nt, Human
cucuuauaucuauauuuu

SEQ ID NO: 3058638 - RNA, 15 nt, Human
cucuuaugggcuggg

SEQ ID NO: 3058639 - RNA, 21 nt, Human
cugaugggcaacccccagccu

SEQ ID NO: 3058640 - RNA, 18 nt, Human
cugaugggcaacccccag

SEQ ID NO: 3058641 - RNA, 18 nt, Human
cugaugcuucuucagaga

SEQ ID NO: 3058642 - RNA, 19 nt, Human
cugaugcuucuucagagac

SEQ ID NO: 3058643 - RNA, 20 nt, Human
cugaugcuucuucagagacu

SEQ ID NO: 3058644 - RNA, 22 nt, Human
cugcaaaggguaucaggugcug

SEQ ID NO: 3058645 - RNA, 21 nt, Human
cugcaaaggguaucaggugcu

SEQ ID NO: 3058646 - RNA, 23 nt, Human
cugaugggcaacccccagccugc

SEQ ID NO: 3058647 - RNA, 22 nt, Human
cugaugggcaacccccagccug

SEQ ID NO: 3058648 - RNA, 24 nt, Human
cugaugggcaacccccagccugcu

SEQ ID NO: 3058649 - RNA, 23 nt, Human
caguuguucaauaauaaauauuu

SEQ ID NO: 3058650 - RNA, 18 nt, Human
caguuguuagugugucuu

SEQ ID NO: 3058651 - RNA, 22 nt, Human
caguuguuagugugucuuagug

SEQ ID NO: 3058652 - RNA, 23 nt, Human
caguuuguuaguaugaggcauuu

SEQ ID NO: 3058653 - RNA, 21 nt, Human
caguuuguuaguaugaggcau

SEQ ID NO: 3058654 - RNA, 18 nt, Human
cauaauuauuauuuggcc

SEQ ID NO: 3058655 - RNA, 16 nt, Human
cauacaguuugcacuu

SEQ ID NO: 3058656 - RNA, 23 nt, Human
cauacaggaagguagaaauaucu

SEQ ID NO: 3058657 - RNA, 23 nt, Human
cauaaugcgugcauaccacuuuu

SEQ ID NO: 3058658 - RNA, 22 nt, Human
cauauuaccacagacauacuaa

SEQ ID NO: 3058659 - RNA, 23 nt, Human
cauagcagagaaugaaagggccc

SEQ ID NO: 3058660 - RNA, 19 nt, Human
cauagcagcuuauucacaa

SEQ ID NO: 3058661 - RNA, 18 nt, Human
cauccugaggcuccacuu

SEQ ID NO: 3058662 - RNA, 19 nt, Human
cauccugaggcuccacuug

SEQ ID NO: 3058663 - RNA, 11 nt, Human
caucccagccc

SEQ ID NO: 3058664 - RNA, 20 nt, Human
caucccaaacccuucagugc

SEQ ID NO: 3058665 - RNA, 21 nt, Human
cauccucuguacagagcccac

SEQ ID NO: 3058666 - RNA, 22 nt, Human
cauccucuguacagagcccacg

SEQ ID NO: 3058667 - RNA, 19 nt, Human
caucccaaacccuucagug

SEQ ID NO: 3058668 - RNA, 19 nt, Human
caucagcacgauuucuguu

SEQ ID NO: 3058669 - RNA, 21 nt, Human
caucagcacgauuucuguuua

SEQ ID NO: 3058670 - RNA, 22 nt, Human
caguuauuauauuuacaaaugg

SEQ ID NO: 3058671 - RNA, 17 nt, Human
caguuauuauauuuaca

SEQ ID NO: 3058672 - RNA, 21 nt, Human
caguuauuauauuuacaaaug

SEQ ID NO: 3058673 - RNA, 13 nt, Human
caguuauggcuau

SEQ ID NO: 3058674 - RNA, 20 nt, Human
caguuauggcuauaggugcu

SEQ ID NO: 3058675 - RNA, 19 nt, Human
caguuauggcuauaggugc

SEQ ID NO: 3058676 - RNA, 19 nt, Human
caguggugcgaucuggguu

SEQ ID NO: 3058677 - RNA, 14 nt, Human
caguuacucagaau

SEQ ID NO: 3058678 - RNA, 21 nt, Human
cagugguaugaucacggcuca

SEQ ID NO: 3058679 - RNA, 20 nt, Human
caguuacucagaauucucua

SEQ ID NO: 3058680 - RNA, 23 nt, Human
cagucugauucccaagcucugcu

SEQ ID NO: 3058681 - RNA, 22 nt, Human
cagugauuaccagggacugagg

SEQ ID NO: 3058682 - RNA, 22 nt, Human
cagugcccacaggaucagucug

SEQ ID NO: 3058683 - RNA, 18 nt, Human
cagugcccacaggaucag

SEQ ID NO: 3058684 - RNA, 21 nt, Human
cagugcccacaggaucagucu

SEQ ID NO: 3058685 - RNA, 20 nt, Human
cagugguaugaucacggcuc

SEQ ID NO: 3058686 - RNA, 18 nt, Human
cagugggagcugccuguu

SEQ ID NO: 3058687 - RNA, 17 nt, Human
cagugggagcugccugu

SEQ ID NO: 3058688 - RNA, 15 nt, Human
cagugggagcugccu

SEQ ID NO: 3058689 - RNA, 16 nt, Human
cagugggagcugccug

SEQ ID NO: 3058690 - RNA, 22 nt, Human
cagucugauucccaagcucugc

SEQ ID NO: 3058691 - RNA, 21 nt, Human
cagucugauucccaagcucug

SEQ ID NO: 3058692 - RNA, 21 nt, Human
caugaauauuuaguguucaua

SEQ ID NO: 3058693 - RNA, 16 nt, Human
caugaauuugugaagg

SEQ ID NO: 3058694 - RNA, 13 nt, Human
caugacaaagacu

SEQ ID NO: 3058695 - RNA, 12 nt, Human
caugcaagguca

SEQ ID NO: 3058696 - RNA, 21 nt, Human
cauggccucuucagaucucua

SEQ ID NO: 3058697 - RNA, 18 nt, Human
caugggaaaggggaaguu

SEQ ID NO: 3058698 - RNA, 14 nt, Human
caugcuccuggccc

SEQ ID NO: 3058699 - RNA, 16 nt, Human
caugcuccuggcccac

SEQ ID NO: 3058700 - RNA, 17 nt, Human
caugcuccuggcccacu

SEQ ID NO: 3058701 - RNA, 17 nt, Human
cauguuacauaagauaa

SEQ ID NO: 3058702 - RNA, 16 nt, Human
cauguuacauaagaua

SEQ ID NO: 3058703 - RNA, 15 nt, Human
cauguccaagaagcc

SEQ ID NO: 3058704 - RNA, 16 nt, Human
cauguucuuaauucuu

SEQ ID NO: 3058705 - RNA, 13 nt, Human
cauguucuuaauu

SEQ ID NO: 3058706 - RNA, 21 nt, Human
cauguuacauaagauaaaugu

SEQ ID NO: 3058707 - RNA, 17 nt, Human
cauguuggccaggcugg

SEQ ID NO: 3058708 - RNA, 18 nt, Human
cauguuggccaggcuggu

SEQ ID NO: 3058709 - RNA, 18 nt, Human
cauguucuuaauucuuag

SEQ ID NO: 3058710 - RNA, 19 nt, Human
cauuauauuuauuacugua

SEQ ID NO: 3058711 - RNA, 20 nt, Human
cauucuccuuguguuacuaa

SEQ ID NO: 3058712 - RNA, 17 nt, Human
cauucuccaccugccag

SEQ ID NO: 3058713 - RNA, 18 nt, Human
cauucuccaccugccagg

SEQ ID NO: 3058714 - RNA, 19 nt, Human
cauucuccaccugccaggg

SEQ ID NO: 3058715 - RNA, 21 nt, Human
cauucuccaccugccagggac

SEQ ID NO: 3058716 - RNA, 19 nt, Human
ccaauucgaacuuuuucca

SEQ ID NO: 3058717 - RNA, 22 nt, Human
ccaauuauaugagacguuuuug

SEQ ID NO: 3058718 - RNA, 23 nt, Human
ccaauggacuaacuugucuuugg

SEQ ID NO: 3058719 - RNA, 15 nt, Human
ccaacuauggccugu

SEQ ID NO: 3058720 - RNA, 14 nt, Human
ccaacuauggccug

SEQ ID NO: 3058721 - RNA, 16 nt, Human
ccaacuauggccugug

SEQ ID NO: 3058722 - RNA, 13 nt, Human
ccaacucacccca

SEQ ID NO: 3058723 - RNA, 23 nt, Human
ccaaaucagcugcuacuacuccu

SEQ ID NO: 3058724 - RNA, 15 nt, Human
ccaaaucagcugcua

SEQ ID NO: 3058725 - RNA, 21 nt, Human
ccaacucaccccagccccaaa

SEQ ID NO: 3058726 - RNA, 21 nt, Human
ccaacuccagaaagugacaag

SEQ ID NO: 3058727 - RNA, 15 nt, Human
ccaagcucugcuccu

SEQ ID NO: 3058728 - RNA, 14 nt, Human
ccaagcucugcucc

SEQ ID NO: 3058729 - RNA, 16 nt, Human
ccaagcucugcuccuc

SEQ ID NO: 3058730 - RNA, 22 nt, Human
ccaaaguacacuguuucaaacu

SEQ ID NO: 3058731 - RNA, 16 nt, Human
cauuggagauguuuag

SEQ ID NO: 3058732 - RNA, 15 nt, Human
cauuggggcucccag

SEQ ID NO: 3058733 - RNA, 16 nt, Human
cauuggggcucccagc

SEQ ID NO: 3058734 - RNA, 16 nt, Human
cauuuaggugaggaag

SEQ ID NO: 3058735 - RNA, 22 nt, Human
cauuggggcucccagccaggcc

SEQ ID NO: 3058736 - RNA, 17 nt, Human
cauuggggcucccagcc

SEQ ID NO: 3058737 - RNA, 18 nt, Human
cauuggggcucccagcca

SEQ ID NO: 3058738 - RNA, 19 nt, Human
cauuggggcucccagccag

SEQ ID NO: 3058739 - RNA, 21 nt, Human
cauuggggcucccagccaggc

SEQ ID NO: 3058740 - RNA, 18 nt, Human
cauuuaggugaggaagca

SEQ ID NO: 3058741 - RNA, 22 nt, Human
cauuuuuuuuaagaaaaaggau

SEQ ID NO: 3058742 - RNA, 23 nt, Human
cauuuuuuuuaagaaaaaggaug

SEQ ID NO: 3058743 - RNA, 20 nt, Human
cauuuguguugaagagguuu

SEQ ID NO: 3058744 - RNA, 14 nt, Human
cauuuguauaaaau

SEQ ID NO: 3058745 - RNA, 16 nt, Human
cauuuguauaaaauaa

SEQ ID NO: 3058746 - RNA, 14 nt, Human
ccaaaaggcagaag

SEQ ID NO: 3058747 - RNA, 13 nt, Human
cagauuuaugcau

SEQ ID NO: 3058748 - RNA, 20 nt, Human
cagauuucacucuccuuggu

SEQ ID NO: 3058749 - RNA, 20 nt, Human
cagauugcaacaggcugggc

SEQ ID NO: 3058750 - RNA, 19 nt, Human
cagauugcaacaggcuggg

SEQ ID NO: 3058751 - RNA, 19 nt, Human
cagcaccaucucuccuccu

SEQ ID NO: 3058752 - RNA, 17 nt, Human
cagcaccaucucuccuc

SEQ ID NO: 3058753 - RNA, 19 nt, Human
cagauuucacucuccuugg

SEQ ID NO: 3058754 - RNA, 18 nt, Human
cagauugcaacaggcugg

SEQ ID NO: 3058755 - RNA, 20 nt, Human
cagcacgauuucuguuuaga

SEQ ID NO: 3058756 - RNA, 15 nt, Human
cagcacgauuucugu

SEQ ID NO: 3058757 - RNA, 14 nt, Human
cagcacgauuucug

SEQ ID NO: 3058758 - RNA, 14 nt, Human
cagccagacuggca

SEQ ID NO: 3058759 - RNA, 22 nt, Human
cagccaggccacaagacccuug

SEQ ID NO: 3058760 - RNA, 12 nt, Human
cagccaggcccu

SEQ ID NO: 3058761 - RNA, 18 nt, Human
cagccagacuggcacagu

SEQ ID NO: 3058762 - RNA, 15 nt, Human
cagccagacuggcac

SEQ ID NO: 3058763 - RNA, 12 nt, Human
cagagagggugg

SEQ ID NO: 3058764 - RNA, 17 nt, Human
cagagaggguggugacc

SEQ ID NO: 3058765 - RNA, 22 nt, Human
cagagaggguggugaccucugc

SEQ ID NO: 3058766 - RNA, 20 nt, Human
cagagaggguggugaccucu

SEQ ID NO: 3058767 - RNA, 23 nt, Human
cagagacuccugcaggcagccag

SEQ ID NO: 3058768 - RNA, 17 nt, Human
cagaggaaagcaaagga

SEQ ID NO: 3058769 - RNA, 19 nt, Human
cagaggaaagcaaaggaga

SEQ ID NO: 3058770 - RNA, 13 nt, Human
cagaggggguggc

SEQ ID NO: 3058771 - RNA, 13 nt, Human
cagagcugccacc

SEQ ID NO: 3058772 - RNA, 20 nt, Human
cagagagguuaaggugggua

SEQ ID NO: 3058773 - RNA, 23 nt, Human
cagagaggguggugaccucugcc

SEQ ID NO: 3058774 - RNA, 23 nt, Human
cagagagggugggagugggccca

SEQ ID NO: 3058775 - RNA, 14 nt, Human
cagaggggguggcc

SEQ ID NO: 3058776 - RNA, 16 nt, Human
cagaggggguggccuc

SEQ ID NO: 3058777 - RNA, 19 nt, Human
cagauacuuggggggcuga

SEQ ID NO: 3058778 - RNA, 19 nt, Human
cagauagauauaugcucug

SEQ ID NO: 3058779 - RNA, 14 nt, Human
cagauaugauucaa

SEQ ID NO: 3058780 - RNA, 13 nt, Human
cagacagcugccu

SEQ ID NO: 3058781 - RNA, 14 nt, Human
cagacagcugccug

SEQ ID NO: 3058782 - RNA, 13 nt, Human
cagacaggaccag

SEQ ID NO: 3058783 - RNA, 15 nt, Human
cagacaggaccaggg

SEQ ID NO: 3058784 - RNA, 16 nt, Human
cagacaggaccaggga

SEQ ID NO: 3058785 - RNA, 15 nt, Human
cagacagcugccugg

SEQ ID NO: 3058786 - RNA, 16 nt, Human
cagacagcugccuggg

SEQ ID NO: 3058787 - RNA, 17 nt, Human
cagacagcugccuggga

SEQ ID NO: 3058788 - RNA, 18 nt, Human
cagacagcugccugggau

SEQ ID NO: 3058789 - RNA, 21 nt, Human
cagacaggcaagcaccuccug

SEQ ID NO: 3058790 - RNA, 20 nt, Human
cagacaggcaagcaccuccu

SEQ ID NO: 3058791 - RNA, 18 nt, Human
cagacaggcaagcaccuc

SEQ ID NO: 3058792 - RNA, 13 nt, Human
cagacaggcaagc

SEQ ID NO: 3058793 - RNA, 17 nt, Human
cagacaggaccagggau

SEQ ID NO: 3058794 - RNA, 24 nt, Human
cagacaggaccagggauuuccaug

SEQ ID NO: 3058795 - RNA, 11 nt, Human
cagacaggcaa

SEQ ID NO: 3058796 - RNA, 23 nt, Human
cagacaggcaagcaccuccugcc

SEQ ID NO: 3058797 - RNA, 22 nt, Human
cagacaggcaagcaccuccugc

SEQ ID NO: 3058798 - RNA, 17 nt, Human
cagacucuacagaggcc

SEQ ID NO: 3058799 - RNA, 21 nt, Human
cagacucuacagaggccaugg

SEQ ID NO: 3058800 - RNA, 20 nt, Human
cagacucuacagaggccaug

SEQ ID NO: 3058801 - RNA, 19 nt, Human
cagacucuacagaggccau

SEQ ID NO: 3058802 - RNA, 18 nt, Human
cagacucuacagaggcca

SEQ ID NO: 3058803 - RNA, 23 nt, Human
cagacucuacagaggccaugggc

SEQ ID NO: 3058804 - RNA, 18 nt, Human
cagacuggaagcacagcu

SEQ ID NO: 3058805 - RNA, 17 nt, Human
cagacuggaagcacagc

SEQ ID NO: 3058806 - RNA, 16 nt, Human
cagacuggaagcacag

SEQ ID NO: 3058807 - RNA, 14 nt, Human
cagacuggaagcac

SEQ ID NO: 3058808 - RNA, 13 nt, Human
cagacuggaagca

SEQ ID NO: 3058809 - RNA, 21 nt, Human
cagacuggaagcacagcuuca

SEQ ID NO: 3058810 - RNA, 20 nt, Human
cagacuggaagcacagcuuc

SEQ ID NO: 3058811 - RNA, 18 nt, Human
cagacuggcacaguuuuc

SEQ ID NO: 3058812 - RNA, 17 nt, Human
cagacuggcacaguuuu

SEQ ID NO: 3058813 - RNA, 19 nt, Human
cagacuggauaguccgucu

SEQ ID NO: 3058814 - RNA, 23 nt, Human
cagacuggcacaguuuucugaga

SEQ ID NO: 3058815 - RNA, 22 nt, Human
cagacuggcacaguuuucugag

SEQ ID NO: 3058816 - RNA, 12 nt, Human
caggccuccuac

SEQ ID NO: 3058817 - RNA, 14 nt, Human
caggccuccuacag

SEQ ID NO: 3058818 - RNA, 21 nt, Human
caggcugggagagccuuccag

SEQ ID NO: 3058819 - RNA, 20 nt, Human
caggcugggagagccuucca

SEQ ID NO: 3058820 - RNA, 11 nt, Human
caggcuacugu

SEQ ID NO: 3058821 - RNA, 14 nt, Human
caggggaaaagagg

SEQ ID NO: 3058822 - RNA, 16 nt, Human
caggggaaaagaggag

SEQ ID NO: 3058823 - RNA, 22 nt, Human
caggcugggagagccuuccagg

SEQ ID NO: 3058824 - RNA, 23 nt, Human
caggcugggagagccuuccaggg

SEQ ID NO: 3058825 - RNA, 21 nt, Human
caggaccagggauuuccauga

SEQ ID NO: 3058826 - RNA, 16 nt, Human
caggaccucaggugag

SEQ ID NO: 3058827 - RNA, 23 nt, Human
caggaccucaggugagaagcaga

SEQ ID NO: 3058828 - RNA, 16 nt, Human
caggcaaugcuggcug

SEQ ID NO: 3058829 - RNA, 15 nt, Human
caggcaaugcuggcu

SEQ ID NO: 3058830 - RNA, 14 nt, Human
caggcaaugcuggc

SEQ ID NO: 3058831 - RNA, 18 nt, Human
caggaggccagccuugac

SEQ ID NO: 3058832 - RNA, 19 nt, Human
caggaggccagccuugacc

SEQ ID NO: 3058833 - RNA, 22 nt, Human
caggaggccagccuugaccauu

SEQ ID NO: 3058834 - RNA, 19 nt, Human
caggaggaucacuugaguc

SEQ ID NO: 3058835 - RNA, 11 nt, Human
caggccaggcc

SEQ ID NO: 3058836 - RNA, 12 nt, Human
caggccaggccc

SEQ ID NO: 3058837 - RNA, 16 nt, Human
caggaaaggcuccagg

SEQ ID NO: 3058838 - RNA, 17 nt, Human
caggaaaggcuccagga

SEQ ID NO: 3058839 - RNA, 16 nt, Human
caggaaagagaacuuc

SEQ ID NO: 3058840 - RNA, 19 nt, Human
caggaaaggcuccaggagc

SEQ ID NO: 3058841 - RNA, 20 nt, Human
caggaaaggcuccaggagca

SEQ ID NO: 3058842 - RNA, 17 nt, Human
cagcuuauucacaagac

SEQ ID NO: 3058843 - RNA, 20 nt, Human
cagcuuauugucuagugaaa

SEQ ID NO: 3058844 - RNA, 20 nt, Human
cagcuguaugauucccagcc

SEQ ID NO: 3058845 - RNA, 14 nt, Human
cagcuuauugucua

SEQ ID NO: 3058846 - RNA, 21 nt, Human
cagcugacuuuucuguccgag

SEQ ID NO: 3058847 - RNA, 19 nt, Human
cagcuguaugauucccagc

SEQ ID NO: 3058848 - RNA, 15 nt, Human
cagcuaacauggaag

SEQ ID NO: 3058849 - RNA, 19 nt, Human
cagcguuucuaugacacau

SEQ ID NO: 3058850 - RNA, 20 nt, Human
cagcgcuggccgggaccccg

SEQ ID NO: 3058851 - RNA, 16 nt, Human
cagccugcuccagcug

SEQ ID NO: 3058852 - RNA, 17 nt, Human
cagccugcuccagcugu

SEQ ID NO: 3058853 - RNA, 19 nt, Human
cagccugcuccagcuguuc

SEQ ID NO: 3058854 - RNA, 15 nt, Human
cagccugcuccagcu

SEQ ID NO: 3058855 - RNA, 13 nt, Human
caacuauggccug

SEQ ID NO: 3058856 - RNA, 19 nt, Human
caacuauauuguuugcuaa

SEQ ID NO: 3058857 - RNA, 19 nt, Human
caacuaucucauuuccaag

SEQ ID NO: 3058858 - RNA, 16 nt, Human
caaccccuucgcuccu

SEQ ID NO: 3058859 - RNA, 14 nt, Human
caaccccuucgcuc

SEQ ID NO: 3058860 - RNA, 17 nt, Human
caaccccuucgcuccug

SEQ ID NO: 3058861 - RNA, 14 nt, Human
caacccccagccug

SEQ ID NO: 3058862 - RNA, 14 nt, Human
caacuauggccugu

SEQ ID NO: 3058863 - RNA, 15 nt, Human
caacuauuuuuccaa

SEQ ID NO: 3058864 - RNA, 12 nt, Human
caacuccagaaa

SEQ ID NO: 3058865 - RNA, 14 nt, Human
caagaagcccagga

SEQ ID NO: 3058866 - RNA, 15 nt, Human
caagaagcccaggaa

SEQ ID NO: 3058867 - RNA, 18 nt, Human
caagaagcccaggaaagg

SEQ ID NO: 3058868 - RNA, 17 nt, Human
caagaaggaugauucaa

SEQ ID NO: 3058869 - RNA, 19 nt, Human
caagcaaaugugaaucauu

SEQ ID NO: 3058870 - RNA, 17 nt, Human
caagcaaaugugaauca

SEQ ID NO: 3058871 - RNA, 15 nt, Human
caagcaaaugugaau

SEQ ID NO: 3058872 - RNA, 14 nt, Human
caagcaaguauuag

SEQ ID NO: 3058873 - RNA, 14 nt, Human
caagaccacguuuc

SEQ ID NO: 3058874 - RNA, 13 nt, Human
caagcaccuccug

SEQ ID NO: 3058875 - RNA, 20 nt, Human
caaggauugcuacuguccua

SEQ ID NO: 3058876 - RNA, 19 nt, Human
caaggauugcuacuguccu

SEQ ID NO: 3058877 - RNA, 14 nt, Human
caaggcaaggcugu

SEQ ID NO: 3058878 - RNA, 22 nt, Human
caaguauuauaccuuuuuuaga

SEQ ID NO: 3058879 - RNA, 17 nt, Human
caaguauuauaccuuuu

SEQ ID NO: 3058880 - RNA, 13 nt, Human
caaguauuauacc

SEQ ID NO: 3058881 - RNA, 17 nt, Human
caagcuccaagcuccca

SEQ ID NO: 3058882 - RNA, 18 nt, Human
caagcuccaagcucccag

SEQ ID NO: 3058883 - RNA, 19 nt, Human
caagcuccaagcucccagg

SEQ ID NO: 3058884 - RNA, 21 nt, Human
caagcuccaagcucccaggca

SEQ ID NO: 3058885 - RNA, 12 nt, Human
caagcucccagg

SEQ ID NO: 3058886 - RNA, 14 nt, Human
caagcucccaggca

SEQ ID NO: 3058887 - RNA, 15 nt, Human
caagcucccaggcau

SEQ ID NO: 3058888 - RNA, 17 nt, Human
caagcucccaggcauuc

SEQ ID NO: 3058889 - RNA, 16 nt, Human
caagcucugcuccucu

SEQ ID NO: 3058890 - RNA, 15 nt, Human
caagcucugcuccuc

SEQ ID NO: 3058891 - RNA, 20 nt, Human
caaguuauuuuuaauuuggu

SEQ ID NO: 3058892 - RNA, 21 nt, Human
caauauuucagauaaucacaa

SEQ ID NO: 3058893 - RNA, 14 nt, Human
caaucaaaucugcu

SEQ ID NO: 3058894 - RNA, 17 nt, Human
caaucagccuaguugau

SEQ ID NO: 3058895 - RNA, 15 nt, Human
caauggcagccuugg

SEQ ID NO: 3058896 - RNA, 14 nt, Human
caauggcagccuug

SEQ ID NO: 3058897 - RNA, 13 nt, Human
caauggcagccuu

SEQ ID NO: 3058898 - RNA, 13 nt, Human
caauuuauuaugg

SEQ ID NO: 3058899 - RNA, 20 nt, Human
caauuuauuauggcacauca

SEQ ID NO: 3058900 - RNA, 17 nt, Human
cacccuggggagaaagu

SEQ ID NO: 3058901 - RNA, 18 nt, Human
caccugccccucaacucu

SEQ ID NO: 3058902 - RNA, 21 nt, Human
caccugccccucaacucuccu

SEQ ID NO: 3058903 - RNA, 11 nt, Human
caccugccagg

SEQ ID NO: 3058904 - RNA, 12 nt, Human
caccugccaggg

SEQ ID NO: 3058905 - RNA, 12 nt, Human
cacccuccuuuc

SEQ ID NO: 3058906 - RNA, 12 nt, Human
cacccugcucuc

SEQ ID NO: 3058907 - RNA, 17 nt, Human
caccugcggugcuaucu

SEQ ID NO: 3058908 - RNA, 19 nt, Human
caccugcggugcuaucucc

SEQ ID NO: 3058909 - RNA, 16 nt, Human
caccugcggugcuauc

SEQ ID NO: 3058910 - RNA, 15 nt, Human
cacgcuggagugcag

SEQ ID NO: 3058911 - RNA, 20 nt, Human
cacgcuggagugcagugagc

SEQ ID NO: 3058912 - RNA, 18 nt, Human
cacgcuggagugcaguga

SEQ ID NO: 3058913 - RNA, 17 nt, Human
cacgcuggagugcagug

SEQ ID NO: 3058914 - RNA, 16 nt, Human
cacgcuggagugcagu

SEQ ID NO: 3058915 - RNA, 21 nt, Human
cacgcuggagugcagugagcc

SEQ ID NO: 3058916 - RNA, 14 nt, Human
cacuacauucuguu

SEQ ID NO: 3058917 - RNA, 13 nt, Human
cacuacauucugu

SEQ ID NO: 3058918 - RNA, 21 nt, Human
cacuacauuauaaaugucucu

SEQ ID NO: 3058919 - RNA, 16 nt, Human
cacggaagagccuugc

SEQ ID NO: 3058920 - RNA, 22 nt, Human
cacggaagagccuugcggaagg

SEQ ID NO: 3058921 - RNA, 15 nt, Human
cacuacauucuguua

SEQ ID NO: 3058922 - RNA, 11 nt, Human
cacugaagaag

SEQ ID NO: 3058923 - RNA, 23 nt, Human
cacugaagaagcaccaaucauga

SEQ ID NO: 3058924 - RNA, 16 nt, Human
cacuccagugagacag

SEQ ID NO: 3058925 - RNA, 21 nt, Human
cacuccagugagacagcucug

SEQ ID NO: 3058926 - RNA, 22 nt, Human
cacaucuugcucugcugacaga

SEQ ID NO: 3058927 - RNA, 21 nt, Human
cacaucuugcucugcugacag

SEQ ID NO: 3058928 - RNA, 20 nt, Human
cacaucuugcucugcugaca

SEQ ID NO: 3058929 - RNA, 15 nt, Human
cacaucuugcucugc

SEQ ID NO: 3058930 - RNA, 14 nt, Human
cacaucuugcucug

SEQ ID NO: 3058931 - RNA, 13 nt, Human
cacaucuugcucu

SEQ ID NO: 3058932 - RNA, 23 nt, Human
cacaucagcuugcccuguuaaaa

SEQ ID NO: 3058933 - RNA, 13 nt, Human
cacaucagcuugc

SEQ ID NO: 3058934 - RNA, 19 nt, Human
caccagcccuuagcaggga

SEQ ID NO: 3058935 - RNA, 16 nt, Human
caccagccccagugcc

SEQ ID NO: 3058936 - RNA, 22 nt, Human
caccagccccagugcccacagg

SEQ ID NO: 3058937 - RNA, 21 nt, Human
caccagccccagugcccacag

SEQ ID NO: 3058938 - RNA, 18 nt, Human
caccagccccagugccca

SEQ ID NO: 3058939 - RNA, 17 nt, Human
caccagccccagugccc

SEQ ID NO: 3058940 - RNA, 18 nt, Human
cacauuuauucugcucac

SEQ ID NO: 3058941 - RNA, 17 nt, Human
cacauuuauucugcuca

SEQ ID NO: 3058942 - RNA, 19 nt, Human
cacaucuugcucugcugac

SEQ ID NO: 3058943 - RNA, 23 nt, Human
cacaucuugcucugcugacagac

SEQ ID NO: 3058944 - RNA, 12 nt, Human
cacccagcccac

SEQ ID NO: 3058945 - RNA, 19 nt, Human
cacccaguccugcccgcca

SEQ ID NO: 3058946 - RNA, 21 nt, Human
auuaugugccagauuuaugca

SEQ ID NO: 3058947 - RNA, 13 nt, Human
auuaugugccaga

SEQ ID NO: 3058948 - RNA, 14 nt, Human
auucauauuuacuu

SEQ ID NO: 3058949 - RNA, 15 nt, Human
auucucuuauccaac

SEQ ID NO: 3058950 - RNA, 14 nt, Human
auucucuuauccaa

SEQ ID NO: 3058951 - RNA, 12 nt, Human
auucucuuaucc

SEQ ID NO: 3058952 - RNA, 23 nt, Human
auucucuaguuugauuaaauucu

SEQ ID NO: 3058953 - RNA, 19 nt, Human
auucucuaguuugauuaaa

SEQ ID NO: 3058954 - RNA, 20 nt, Human
auucucuaguuugauuaaau

SEQ ID NO: 3058955 - RNA, 22 nt, Human
auugaggacacugauauggguc

SEQ ID NO: 3058956 - RNA, 20 nt, Human
auuaaauuuugaguucuaca

SEQ ID NO: 3058957 - RNA, 22 nt, Human
auuacaagcgugagccacugca

SEQ ID NO: 3058958 - RNA, 16 nt, Human
auugauaaguucauac

SEQ ID NO: 3058959 - RNA, 17 nt, Human
auugauaaguucauaca

SEQ ID NO: 3058960 - RNA, 18 nt, Human
auugauaaguucauacau

SEQ ID NO: 3058961 - RNA, 19 nt, Human
auugauaaguucauacauu

SEQ ID NO: 3058962 - RNA, 12 nt, Human
auugauaaguuc

SEQ ID NO: 3058963 - RNA, 15 nt, Human
auugauaaguucaua

SEQ ID NO: 3058964 - RNA, 16 nt, Human
auuucagcagcugcag

SEQ ID NO: 3058965 - RNA, 12 nt, Human
auuucacucucc

SEQ ID NO: 3058966 - RNA, 16 nt, Human
auuuauccucuguuga

SEQ ID NO: 3058967 - RNA, 12 nt, Human
auuuauccucug

SEQ ID NO: 3058968 - RNA, 22 nt, Human
auuuaauagguuuggacaaaau

SEQ ID NO: 3058969 - RNA, 21 nt, Human
auuucuguuuagauaauacac

SEQ ID NO: 3058970 - RNA, 19 nt, Human
auuucuguuuagauaauac

SEQ ID NO: 3058971 - RNA, 20 nt, Human
auuucuguuuagauaauaca

SEQ ID NO: 3058972 - RNA, 19 nt, Human
auuuguucuauagcuuuuc

SEQ ID NO: 3058973 - RNA, 14 nt, Human
auuuguuauaauga

SEQ ID NO: 3058974 - RNA, 18 nt, Human
auuuguguugaagagguu

SEQ ID NO: 3058975 - RNA, 22 nt, Human
auuuguguugaagagguuuuaa

SEQ ID NO: 3058976 - RNA, 14 nt, Human
auuuguguugaaga

SEQ ID NO: 3058977 - RNA, 15 nt, Human
auuuguguugaagag

SEQ ID NO: 3058978 - RNA, 15 nt, Human
auuuugaaaaacugc

SEQ ID NO: 3058979 - RNA, 13 nt, Human
auuuugaaaaacu

SEQ ID NO: 3058980 - RNA, 17 nt, Human
auuuucuauaauuuaaa

SEQ ID NO: 3058981 - RNA, 18 nt, Human
auuuucuauaauuuaaau

SEQ ID NO: 3058982 - RNA, 19 nt, Human
auuuucuauaauuuaaaua

SEQ ID NO: 3058983 - RNA, 15 nt, Human
auuuuuuucugaauu

SEQ ID NO: 3058984 - RNA, 16 nt, Human
auuuuuuucugaaauu

SEQ ID NO: 3058985 - RNA, 17 nt, Human
auuuuuuucugaaauuu

SEQ ID NO: 3058986 - RNA, 16 nt, Human
auuuuuauuaaauuau

SEQ ID NO: 3058987 - RNA, 19 nt, Human
auuuuuauauuugaaauau

SEQ ID NO: 3058988 - RNA, 22 nt, Human
auuuuguuuuugucuuaaaaag

SEQ ID NO: 3058989 - RNA, 21 nt, Human
auuuuguuuuugucuuaaaaa

SEQ ID NO: 3058990 - RNA, 16 nt, Human
auuuuuauauuugaaa

SEQ ID NO: 3058991 - RNA, 13 nt, Human
caaaagcauguga

SEQ ID NO: 3058992 - RNA, 19 nt, Human
caaaagcaucuaugugaga

SEQ ID NO: 3058993 - RNA, 21 nt, Human
caaaagguauuuuaaucacca

SEQ ID NO: 3058994 - RNA, 20 nt, Human
caaaagguuaauaaaguaau

SEQ ID NO: 3058995 - RNA, 17 nt, Human
caaacauauauaacaau

SEQ ID NO: 3058996 - RNA, 17 nt, Human
caaaccaucauugaaau

SEQ ID NO: 3058997 - RNA, 14 nt, Human
caaaccaucauuga

SEQ ID NO: 3058998 - RNA, 16 nt, Human
caaaccaucauugaaa

SEQ ID NO: 3058999 - RNA, 21 nt, Human
ccacuuuuguucuugguuugu

SEQ ID NO: 3059000 - RNA, 15 nt, Human
ccacuuuuguucuug

SEQ ID NO: 3059001 - RNA, 14 nt, Human
ccacuuuuguucuu

SEQ ID NO: 3059002 - RNA, 16 nt, Human
ccagacccggcugcgu

SEQ ID NO: 3059003 - RNA, 17 nt, Human
ccagacccggcugcgug

SEQ ID NO: 3059004 - RNA, 20 nt, Human
ccacuuucuagccagaggag

SEQ ID NO: 3059005 - RNA, 18 nt, Human
ccacuuucuagccagagg

SEQ ID NO: 3059006 - RNA, 19 nt, Human
ccacuuucuagccagagga

SEQ ID NO: 3059007 - RNA, 13 nt, Human
ccacuuucuagcc

SEQ ID NO: 3059008 - RNA, 20 nt, Human
ccacuuggucugugagaugc

SEQ ID NO: 3059009 - RNA, 22 nt, Human
ccacuuggucugugagaugcua

SEQ ID NO: 3059010 - RNA, 15 nt, Human
ccacuuggucuguga

SEQ ID NO: 3059011 - RNA, 16 nt, Human
ccacuuggucugugag

SEQ ID NO: 3059012 - RNA, 17 nt, Human
ccacuuggucugugaga

SEQ ID NO: 3059013 - RNA, 19 nt, Human
ccacuuggucugugagaug

SEQ ID NO: 3059014 - RNA, 19 nt, Human
ccacugcaccgggccacag

SEQ ID NO: 3059015 - RNA, 17 nt, Human
ccacugcaccgggccac

SEQ ID NO: 3059016 - RNA, 14 nt, Human
ccacugcaccgggc

SEQ ID NO: 3059017 - RNA, 13 nt, Human
ccacugcaccggg

SEQ ID NO: 3059018 - RNA, 20 nt, Human
ccacugcacuauagccuagg

SEQ ID NO: 3059019 - RNA, 19 nt, Human
ccacugcacuauagccuag

SEQ ID NO: 3059020 - RNA, 12 nt, Human
ccacuuggucug

SEQ ID NO: 3059021 - RNA, 16 nt, Human
ccagagacacaagccu

SEQ ID NO: 3059022 - RNA, 18 nt, Human
ccagagacacaagccuuc

SEQ ID NO: 3059023 - RNA, 14 nt, Human
ccagaugcaccagc

SEQ ID NO: 3059024 - RNA, 13 nt, Human
ccagaugcaccag

SEQ ID NO: 3059025 - RNA, 20 nt, Human
ccagagggccugcaagggag

SEQ ID NO: 3059026 - RNA, 22 nt, Human
ccagcagaaaugccuuacccuc

SEQ ID NO: 3059027 - RNA, 17 nt, Human
ccagcagaaaugccuua

SEQ ID NO: 3059028 - RNA, 16 nt, Human
ccagcagaaaugccuu

SEQ ID NO: 3059029 - RNA, 11 nt, Human
ccagcagccug

SEQ ID NO: 3059030 - RNA, 12 nt, Human
ccagcagccugg

SEQ ID NO: 3059031 - RNA, 12 nt, Human
ccagcagaaaug

SEQ ID NO: 3059032 - RNA, 13 nt, Human
ccagccccuggau

SEQ ID NO: 3059033 - RNA, 14 nt, Human
ccagccccuggaug

SEQ ID NO: 3059034 - RNA, 15 nt, Human
ccagccccuggaugc

SEQ ID NO: 3059035 - RNA, 13 nt, Human
ccagcagccugga

SEQ ID NO: 3059036 - RNA, 23 nt, Human
ccagccccauccucuguacagag

SEQ ID NO: 3059037 - RNA, 18 nt, Human
ccagccccauccucugua

SEQ ID NO: 3059038 - RNA, 15 nt, Human
ccagccccuucugac

SEQ ID NO: 3059039 - RNA, 16 nt, Human
ccagccccuucugacc

SEQ ID NO: 3059040 - RNA, 17 nt, Human
ccagccccuucugaccc

SEQ ID NO: 3059041 - RNA, 18 nt, Human
ccagccccuucugaccca

SEQ ID NO: 3059042 - RNA, 21 nt, Human
ccagcgagcccugguggcagu

SEQ ID NO: 3059043 - RNA, 20 nt, Human
ccaggaaaggcuccaggagc

SEQ ID NO: 3059044 - RNA, 18 nt, Human
ccaggaaaggcuccagga

SEQ ID NO: 3059045 - RNA, 19 nt, Human
ccaggaaaggcuccaggag

SEQ ID NO: 3059046 - RNA, 17 nt, Human
ccaggaaaggcuccagg

SEQ ID NO: 3059047 - RNA, 19 nt, Human
ccaggggugggacacccug

SEQ ID NO: 3059048 - RNA, 15 nt, Human
ccaggggccaugaau

SEQ ID NO: 3059049 - RNA, 20 nt, Human
ccaggggugggacacccugu

SEQ ID NO: 3059050 - RNA, 21 nt, Human
ccaggggugggacacccugug

SEQ ID NO: 3059051 - RNA, 22 nt, Human
ccaggggugggacacccuguga

SEQ ID NO: 3059052 - RNA, 13 nt, Human
ccaguaucuugaa

SEQ ID NO: 3059053 - RNA, 19 nt, Human
ccaguaucuugaagacuuu

SEQ ID NO: 3059054 - RNA, 22 nt, Human
ccaguaucuugaagacuuuucu

SEQ ID NO: 3059055 - RNA, 16 nt, Human
ccagucaccccggcca

SEQ ID NO: 3059056 - RNA, 17 nt, Human
ccagucaccccggccac

SEQ ID NO: 3059057 - RNA, 18 nt, Human
ccagucaccccggccacc

SEQ ID NO: 3059058 - RNA, 16 nt, Human
ccaguccugcccgcca

SEQ ID NO: 3059059 - RNA, 13 nt, Human
ccagucaccccgg

SEQ ID NO: 3059060 - RNA, 22 nt, Human
ccauuggggcucccagccaggc

SEQ ID NO: 3059061 - RNA, 20 nt, Human
ccauuggggcucccagccag

SEQ ID NO: 3059062 - RNA, 21 nt, Human
ccauuggggcucccagccagg

SEQ ID NO: 3059063 - RNA, 19 nt, Human
ccauuggggcucccagcca

SEQ ID NO: 3059064 - RNA, 22 nt, Human
ccauuguggucacaggaaguag

SEQ ID NO: 3059065 - RNA, 13 nt, Human
ccauuuaaagcuu

SEQ ID NO: 3059066 - RNA, 17 nt, Human
cccaagcucugcuccuc

SEQ ID NO: 3059067 - RNA, 15 nt, Human
cccaagcucugcucc

SEQ ID NO: 3059068 - RNA, 15 nt, Human
cccacccaagggccu

SEQ ID NO: 3059069 - RNA, 18 nt, Human
cccaccaucaugucuggc

SEQ ID NO: 3059070 - RNA, 19 nt, Human
cccacuguacuugcucuug

SEQ ID NO: 3059071 - RNA, 18 nt, Human
cccacuguacuugcucuu

SEQ ID NO: 3059072 - RNA, 23 nt, Human
cccacuguacuugcucuugaugc

SEQ ID NO: 3059073 - RNA, 15 nt, Human
cccaccgcagacagg

SEQ ID NO: 3059074 - RNA, 18 nt, Human
cccaccgcagacaggacc

SEQ ID NO: 3059075 - RNA, 18 nt, Human
ccaugggcacugugggua

SEQ ID NO: 3059076 - RNA, 16 nt, Human
ccaugaggaacaaggc

SEQ ID NO: 3059077 - RNA, 17 nt, Human
ccaugaggaacaaggca

SEQ ID NO: 3059078 - RNA, 18 nt, Human
ccaugaggaacaaggcaa

SEQ ID NO: 3059079 - RNA, 17 nt, Human
ccaugggccuccugugu

SEQ ID NO: 3059080 - RNA, 20 nt, Human
cccagcuggggccaggcugg

SEQ ID NO: 3059081 - RNA, 23 nt, Human
cccagccccaaaacucuccucug

SEQ ID NO: 3059082 - RNA, 21 nt, Human
cccagccccaaaacucuccuc

SEQ ID NO: 3059083 - RNA, 19 nt, Human
cccagcccacuucugccau

SEQ ID NO: 3059084 - RNA, 17 nt, Human
cccagcccacuucugcc

SEQ ID NO: 3059085 - RNA, 23 nt, Human
cccagcuggggccaggcuggguc

SEQ ID NO: 3059086 - RNA, 22 nt, Human
cccagcuggggccaggcugggu

SEQ ID NO: 3059087 - RNA, 18 nt, Human
cccaggcuggcgugcagu

SEQ ID NO: 3059088 - RNA, 20 nt, Human
cccaggcuggcgugcagugg

SEQ ID NO: 3059089 - RNA, 19 nt, Human
cccaggcuggcgugcagug

SEQ ID NO: 3059090 - RNA, 14 nt, Human
cccauccucuguac

SEQ ID NO: 3059091 - RNA, 16 nt, Human
cccagggcaucuggga

SEQ ID NO: 3059092 - RNA, 17 nt, Human
cccagggcaucugggag

SEQ ID NO: 3059093 - RNA, 15 nt, Human
cccauccucuguaca

SEQ ID NO: 3059094 - RNA, 19 nt, Human
cccauccucuguacagagc

SEQ ID NO: 3059095 - RNA, 15 nt, Human
ccccauuguggucac

SEQ ID NO: 3059096 - RNA, 14 nt, Human
cccccuuccaugga

SEQ ID NO: 3059097 - RNA, 20 nt, Human
cccccuguggaugcugcugc

SEQ ID NO: 3059098 - RNA, 12 nt, Human
ccccgcccaggc

SEQ ID NO: 3059099 - RNA, 13 nt, Human
ccccggccaccug

SEQ ID NO: 3059100 - RNA, 14 nt, Human
ccccggccaccugc

SEQ ID NO: 3059101 - RNA, 18 nt, Human
ccccggccaccugcggug

SEQ ID NO: 3059102 - RNA, 14 nt, Human
ccccgcccaggcuu

SEQ ID NO: 3059103 - RNA, 18 nt, Human
ccccaaaacucuccucug

SEQ ID NO: 3059104 - RNA, 20 nt, Human
ccccaaaacucuccucugcu

SEQ ID NO: 3059105 - RNA, 14 nt, Human
ccccagccccaucc

SEQ ID NO: 3059106 - RNA, 14 nt, Human
ccccagccccaaaa

SEQ ID NO: 3059107 - RNA, 21 nt, Human
ccccauucugccugcccaggc

SEQ ID NO: 3059108 - RNA, 10 nt, Human
ccccagcccc

SEQ ID NO: 3059109 - RNA, 12 nt, Human
ccccagccccaa

SEQ ID NO: 3059110 - RNA, 23 nt, Human
cccauucugccugcccaggcccc

SEQ ID NO: 3059111 - RNA, 12 nt, Human
cccugaaggccc

SEQ ID NO: 3059112 - RNA, 16 nt, Human
cccugaaagcccugag

SEQ ID NO: 3059113 - RNA, 13 nt, Human
cccugaaggcccc

SEQ ID NO: 3059114 - RNA, 14 nt, Human
cccugaaggccccg

SEQ ID NO: 3059115 - RNA, 16 nt, Human
cccugaaggccccgcc

SEQ ID NO: 3059116 - RNA, 19 nt, Human
cccugaaggccccgcccag

SEQ ID NO: 3059117 - RNA, 16 nt, Human
cccugacaacacucau

SEQ ID NO: 3059118 - RNA, 22 nt, Human
cccugacaacacucauugaccu

SEQ ID NO: 3059119 - RNA, 20 nt, Human
cccugaauuuaaauagcuuu

SEQ ID NO: 3059120 - RNA, 20 nt, Human
cccugaaggccccgcccagg

SEQ ID NO: 3059121 - RNA, 22 nt, Human
cccugaaggccccgcccaggcu

SEQ ID NO: 3059122 - RNA, 14 nt, Human
cccugacaacacuc

SEQ ID NO: 3059123 - RNA, 18 nt, Human
cccugaaagcccugagcu

SEQ ID NO: 3059124 - RNA, 13 nt, Human
cccucggagaaga

SEQ ID NO: 3059125 - RNA, 23 nt, Human
cccucgaggcggaucuuuggaca

SEQ ID NO: 3059126 - RNA, 22 nt, Human
cccucgaggcggaucuuuggac

SEQ ID NO: 3059127 - RNA, 16 nt, Human
cccugagcuuucugcu

SEQ ID NO: 3059128 - RNA, 20 nt, Human
cccugcccaccuggccucug

SEQ ID NO: 3059129 - RNA, 14 nt, Human
cccugagcaggauu

SEQ ID NO: 3059130 - RNA, 17 nt, Human
cccugcccggcugcgga

SEQ ID NO: 3059131 - RNA, 14 nt, Human
cccugcccggcugc

SEQ ID NO: 3059132 - RNA, 22 nt, Human
cccugcccaccuggccucugca

SEQ ID NO: 3059133 - RNA, 17 nt, Human
cccuggaugcagccuca

SEQ ID NO: 3059134 - RNA, 21 nt, Human
cccuggaugcagccucacagu

SEQ ID NO: 3059135 - RNA, 13 nt, Human
cccuggaugcagc

SEQ ID NO: 3059136 - RNA, 16 nt, Human
cccuggcacuggcaaa

SEQ ID NO: 3059137 - RNA, 13 nt, Human
cccuggcacuggc

SEQ ID NO: 3059138 - RNA, 23 nt, Human
ccgaaggugaggagcuugaaacc

SEQ ID NO: 3059139 - RNA, 16 nt, Human
ccgaauagcugggacu

SEQ ID NO: 3059140 - RNA, 17 nt, Human
ccgaccagacaccuuga

SEQ ID NO: 3059141 - RNA, 13 nt, Human
ccgaccagacacc

SEQ ID NO: 3059142 - RNA, 15 nt, Human
ccgcagacaggacca

SEQ ID NO: 3059143 - RNA, 16 nt, Human
ccgaaaacguggcugc

SEQ ID NO: 3059144 - RNA, 17 nt, Human
ccgaaaacguggcugcu

SEQ ID NO: 3059145 - RNA, 19 nt, Human
ccgaaagggacuuggaagc

SEQ ID NO: 3059146 - RNA, 15 nt, Human
cccuuccucuuucca

SEQ ID NO: 3059147 - RNA, 16 nt, Human
ccgcagacaggaccag

SEQ ID NO: 3059148 - RNA, 17 nt, Human
ccgcagacaggaccagg

SEQ ID NO: 3059149 - RNA, 12 nt, Human
ccgcccaaggcc

SEQ ID NO: 3059150 - RNA, 13 nt, Human
ccgcccaaggccu

SEQ ID NO: 3059151 - RNA, 14 nt, Human
ccgcccaaggccuu

SEQ ID NO: 3059152 - RNA, 17 nt, Human
ccgcccaaggccuuccc

SEQ ID NO: 3059153 - RNA, 12 nt, Human
ccgcccaggcuu

SEQ ID NO: 3059154 - RNA, 21 nt, Human
cccugugauggggcccugccu

SEQ ID NO: 3059155 - RNA, 22 nt, Human
cccugugauggggcccugccuc

SEQ ID NO: 3059156 - RNA, 23 nt, Human
cccugugauggggcccugccucc

SEQ ID NO: 3059157 - RNA, 17 nt, Human
ccgucuaccugaggggc

SEQ ID NO: 3059158 - RNA, 12 nt, Human
ccgugaggccag

SEQ ID NO: 3059159 - RNA, 13 nt, Human
ccgugaggccaga

SEQ ID NO: 3059160 - RNA, 14 nt, Human
ccgugaggccagag

SEQ ID NO: 3059161 - RNA, 16 nt, Human
ccgugaggccagagac

SEQ ID NO: 3059162 - RNA, 20 nt, Human
ccuaacgaaguauccuucag

SEQ ID NO: 3059163 - RNA, 15 nt, Human
ccuaacgaaguaucc

SEQ ID NO: 3059164 - RNA, 14 nt, Human
ccgucuaccugagg

SEQ ID NO: 3059165 - RNA, 15 nt, Human
ccgucuaccugaggg

SEQ ID NO: 3059166 - RNA, 14 nt, Human
ccggcuccaggcuc

SEQ ID NO: 3059167 - RNA, 13 nt, Human
ccggcuccaggcu

SEQ ID NO: 3059168 - RNA, 12 nt, Human
ccggcuccaggc

SEQ ID NO: 3059169 - RNA, 14 nt, Human
ccuaaucuucugaa

SEQ ID NO: 3059170 - RNA, 20 nt, Human
ccuagccugugccucuggga

SEQ ID NO: 3059171 - RNA, 17 nt, Human
ccuagcacuuugggagg

SEQ ID NO: 3059172 - RNA, 19 nt, Human
ccuagcauacguacacauu

SEQ ID NO: 3059173 - RNA, 16 nt, Human
ccggccaccugcggug

SEQ ID NO: 3059174 - RNA, 15 nt, Human
ccggccccugcuggu

SEQ ID NO: 3059175 - RNA, 17 nt, Human
ccggcccuccagagccc

SEQ ID NO: 3059176 - RNA, 13 nt, Human
ccggcccuccaga

SEQ ID NO: 3059177 - RNA, 16 nt, Human
ccggcccuccagagcc

SEQ ID NO: 3059178 - RNA, 18 nt, Human
ccggcaggguccuagaaa

SEQ ID NO: 3059179 - RNA, 17 nt, Human
ccucucugcaggucccu

SEQ ID NO: 3059180 - RNA, 16 nt, Human
ccucucugcagguccc

SEQ ID NO: 3059181 - RNA, 19 nt, Human
ccucucugcaggucccuaa

SEQ ID NO: 3059182 - RNA, 18 nt, Human
ccucucugcaggucccua

SEQ ID NO: 3059183 - RNA, 20 nt, Human
ccucugccugaagucacaca

SEQ ID NO: 3059184 - RNA, 11 nt, Human
ccucugccuga

SEQ ID NO: 3059185 - RNA, 23 nt, Human
ccucugccucugacacacagcuc

SEQ ID NO: 3059186 - RNA, 21 nt, Human
ccucugccucugacacacagc

SEQ ID NO: 3059187 - RNA, 20 nt, Human
ccucugccucugacacacag

SEQ ID NO: 3059188 - RNA, 19 nt, Human
ccuccuuugugaggaagcc

SEQ ID NO: 3059189 - RNA, 18 nt, Human
ccuccuuugugaggaagc

SEQ ID NO: 3059190 - RNA, 15 nt, Human
ccucgaacuggcugc

SEQ ID NO: 3059191 - RNA, 16 nt, Human
ccucgaacuggcugca

SEQ ID NO: 3059192 - RNA, 17 nt, Human
ccucccaacucacccca

SEQ ID NO: 3059193 - RNA, 20 nt, Human
ccucccaacucaccccagcc

SEQ ID NO: 3059194 - RNA, 21 nt, Human
ccucccaacucaccccagccc

SEQ ID NO: 3059195 - RNA, 17 nt, Human
ccucccaccucagccuc

SEQ ID NO: 3059196 - RNA, 11 nt, Human
ccucaggcagg

SEQ ID NO: 3059197 - RNA, 17 nt, Human
ccugccucucugcaggu

SEQ ID NO: 3059198 - RNA, 23 nt, Human
ccugccuccuuugugaggaagcc

SEQ ID NO: 3059199 - RNA, 21 nt, Human
ccugccuccuuugugaggaag

SEQ ID NO: 3059200 - RNA, 22 nt, Human
ccugccuccuuugugaggaagc

SEQ ID NO: 3059201 - RNA, 13 nt, Human
ccugccuccuuug

SEQ ID NO: 3059202 - RNA, 15 nt, Human
ccugccuccuuugug

SEQ ID NO: 3059203 - RNA, 19 nt, Human
ccugccuccuuugugagga

SEQ ID NO: 3059204 - RNA, 20 nt, Human
ccugccuccuuugugaggaa

SEQ ID NO: 3059205 - RNA, 21 nt, Human
ccugccucucugcaggucccu

SEQ ID NO: 3059206 - RNA, 20 nt, Human
ccugccucucugcagguccc

SEQ ID NO: 3059207 - RNA, 15 nt, Human
ccugccucuucucua

SEQ ID NO: 3059208 - RNA, 12 nt, Human
ccugcugcaguu

SEQ ID NO: 3059209 - RNA, 16 nt, Human
ccugcugcaguugcca

SEQ ID NO: 3059210 - RNA, 11 nt, Human
ccugcugcagu

SEQ ID NO: 3059211 - RNA, 22 nt, Human
ccugcugcaguugccagucacc

SEQ ID NO: 3059212 - RNA, 21 nt, Human
ccugcugcaguugccagucac

SEQ ID NO: 3059213 - RNA, 15 nt, Human
ccugcaggcagccag

SEQ ID NO: 3059214 - RNA, 12 nt, Human
ccugcagagggc

SEQ ID NO: 3059215 - RNA, 16 nt, Human
ccugcaggcagccagg

SEQ ID NO: 3059216 - RNA, 17 nt, Human
ccugcaggcagccaggc

SEQ ID NO: 3059217 - RNA, 23 nt, Human
ccugcaggcagccaggccacaag

SEQ ID NO: 3059218 - RNA, 18 nt, Human
ccugcaggcagccaggcc

SEQ ID NO: 3059219 - RNA, 19 nt, Human
ccugcaggcagccaggcca

SEQ ID NO: 3059220 - RNA, 20 nt, Human
ccugcaggcagccaggccac

SEQ ID NO: 3059221 - RNA, 21 nt, Human
ccugcaggcagccaggccaca

SEQ ID NO: 3059222 - RNA, 16 nt, Human
ccugaggcugggcucc

SEQ ID NO: 3059223 - RNA, 17 nt, Human
ccugaggcugggcuccc

SEQ ID NO: 3059224 - RNA, 19 nt, Human
ccugaggcugggcucccuu

SEQ ID NO: 3059225 - RNA, 21 nt, Human
ccugaggcugggcucccuucc

SEQ ID NO: 3059226 - RNA, 16 nt, Human
ccugaggggccucuua

SEQ ID NO: 3059227 - RNA, 12 nt, Human
ccugaggggccu

SEQ ID NO: 3059228 - RNA, 16 nt, Human
ccucuuugagugaagc

SEQ ID NO: 3059229 - RNA, 19 nt, Human
ccucuuuggucuacacugu

SEQ ID NO: 3059230 - RNA, 23 nt, Human
cuaaaguaaaaacaaagaaauua

SEQ ID NO: 3059231 - RNA, 20 nt, Human
cuaacgaaguauccuucagc

SEQ ID NO: 3059232 - RNA, 14 nt, Human
cuaacuugucuuug

SEQ ID NO: 3059233 - RNA, 22 nt, Human
cuaacuugucuuuggacccuga

SEQ ID NO: 3059234 - RNA, 11 nt, Human
cuaaagcugcc

SEQ ID NO: 3059235 - RNA, 19 nt, Human
cgugaguccuggcauggga

SEQ ID NO: 3059236 - RNA, 18 nt, Human
cgugaguccuggcauggg

SEQ ID NO: 3059237 - RNA, 19 nt, Human
cguguuaugacuccagaau

SEQ ID NO: 3059238 - RNA, 15 nt, Human
cguguuaugacucca

SEQ ID NO: 3059239 - RNA, 12 nt, Human
cgugacaacacu

SEQ ID NO: 3059240 - RNA, 15 nt, Human
cgugacaacacuugu

SEQ ID NO: 3059241 - RNA, 14 nt, Human
cgugacaacacuug

SEQ ID NO: 3059242 - RNA, 20 nt, Human
cgugagccacugcaccgggc

SEQ ID NO: 3059243 - RNA, 15 nt, Human
cgugagccacugcac

SEQ ID NO: 3059244 - RNA, 14 nt, Human
cgugagccacugca

SEQ ID NO: 3059245 - RNA, 14 nt, Human
cgugaggccagaga

SEQ ID NO: 3059246 - RNA, 22 nt, Human
cgugagccacugcaccgggcca

SEQ ID NO: 3059247 - RNA, 19 nt, Human
cuacaaaaagcauaaaaau

SEQ ID NO: 3059248 - RNA, 20 nt, Human
cuacaaaaacacagcaaggg

SEQ ID NO: 3059249 - RNA, 14 nt, Human
cuaaguuuuuaugg

SEQ ID NO: 3059250 - RNA, 12 nt, Human
cgggcucugccu

SEQ ID NO: 3059251 - RNA, 19 nt, Human
cgggcucagcaaaagaugc

SEQ ID NO: 3059252 - RNA, 17 nt, Human
cgggccacagagaaagu

SEQ ID NO: 3059253 - RNA, 20 nt, Human
cgguggcucacgccuguaau

SEQ ID NO: 3059254 - RNA, 16 nt, Human
cguacacauuuuauuu

SEQ ID NO: 3059255 - RNA, 22 nt, Human
cguacacauuuuauuuuauuau

SEQ ID NO: 3059256 - RNA, 17 nt, Human
cggagacggagucccac

SEQ ID NO: 3059257 - RNA, 20 nt, Human
cggagacggagucccaccuu

SEQ ID NO: 3059258 - RNA, 15 nt, Human
cggagacggaguccc

SEQ ID NO: 3059259 - RNA, 22 nt, Human
cggagucccaccuuggcugcag

SEQ ID NO: 3059260 - RNA, 21 nt, Human
cggagucccaccuuggcugca

SEQ ID NO: 3059261 - RNA, 23 nt, Human
cggagucccaccuuggcugcagg

SEQ ID NO: 3059262 - RNA, 23 nt, Human
cgccaaggcugggggaagaagcu

SEQ ID NO: 3059263 - RNA, 23 nt, Human
cgagggggcugcucccaccuggc

SEQ ID NO: 3059264 - RNA, 15 nt, Human
cgagggggcugcucc

SEQ ID NO: 3059265 - RNA, 17 nt, Human
cgagggggcugcuccca

SEQ ID NO: 3059266 - RNA, 18 nt, Human
cgagggggcugcucccac

SEQ ID NO: 3059267 - RNA, 12 nt, Human
ccuuuucccaac

SEQ ID NO: 3059268 - RNA, 18 nt, Human
cgcuggagugcagugagc

SEQ ID NO: 3059269 - RNA, 17 nt, Human
cgcuggagugcagugag

SEQ ID NO: 3059270 - RNA, 19 nt, Human
cgcugccccuggcagcccc

SEQ ID NO: 3059271 - RNA, 20 nt, Human
cgcugccccuggcagccccu

SEQ ID NO: 3059272 - RNA, 14 nt, Human
ccuugcauaauggu

SEQ ID NO: 3059273 - RNA, 15 nt, Human
ccuuucaauaggaaa

SEQ ID NO: 3059274 - RNA, 17 nt, Human
ccuuucaauaggaaaaa

SEQ ID NO: 3059275 - RNA, 20 nt, Human
ccuucucuccagccccugga

SEQ ID NO: 3059276 - RNA, 16 nt, Human
ccuucucugaaggaca

SEQ ID NO: 3059277 - RNA, 14 nt, Human
ccuucucugaagga

SEQ ID NO: 3059278 - RNA, 21 nt, Human
ccuucucuccagccccuggau

SEQ ID NO: 3059279 - RNA, 23 nt, Human
ccuucucuccagccccuggaugc

SEQ ID NO: 3059280 - RNA, 13 nt, Human
ccuuccccuggca

SEQ ID NO: 3059281 - RNA, 21 nt, Human
ccuucuguccuacucuguguc

SEQ ID NO: 3059282 - RNA, 20 nt, Human
ccuucuguccuacucugugu

SEQ ID NO: 3059283 - RNA, 17 nt, Human
ccuucucuucacaguca

SEQ ID NO: 3059284 - RNA, 22 nt, Human
ccuucuguccuacucuguguca

SEQ ID NO: 3059285 - RNA, 13 nt, Human
ccuguucagcucc

SEQ ID NO: 3059286 - RNA, 12 nt, Human
ccuuauggaaca

SEQ ID NO: 3059287 - RNA, 22 nt, Human
ccuuauggaacacucugagacu

SEQ ID NO: 3059288 - RNA, 19 nt, Human
ccuuauggaacacucugag

SEQ ID NO: 3059289 - RNA, 20 nt, Human
ccuuauggaacacucugaga

SEQ ID NO: 3059290 - RNA, 14 nt, Human
ccuuauggaacacu

SEQ ID NO: 3059291 - RNA, 16 nt, Human
ccuuauggaacacucu

SEQ ID NO: 3059292 - RNA, 17 nt, Human
ccuuauggaacacucug

SEQ ID NO: 3059293 - RNA, 18 nt, Human
ccuuauggaacacucuga

SEQ ID NO: 3059294 - RNA, 14 nt, Human
ccuucccaccucuc

SEQ ID NO: 3059295 - RNA, 19 nt, Human
ccuucccaccucucucacu

SEQ ID NO: 3059296 - RNA, 12 nt, Human
ccuucccaccuc

SEQ ID NO: 3059297 - RNA, 20 nt, Human
ccuuagcagggaaacagcua

SEQ ID NO: 3059298 - RNA, 19 nt, Human
ccuuagcagggaaacagcu

SEQ ID NO: 3059299 - RNA, 16 nt, Human
ccuuagcaaauucugu

SEQ ID NO: 3059300 - RNA, 17 nt, Human
ccuguugggccaggagc

SEQ ID NO: 3059301 - RNA, 18 nt, Human
ccuguugggccaggagcc

SEQ ID NO: 3059302 - RNA, 19 nt, Human
ccuguugggccaggagccu

SEQ ID NO: 3059303 - RNA, 20 nt, Human
ccuguugggccaggagccuc

SEQ ID NO: 3059304 - RNA, 16 nt, Human
ccuguugggccaggag

SEQ ID NO: 3059305 - RNA, 19 nt, Human
ccuguucagcuccagcuca

SEQ ID NO: 3059306 - RNA, 16 nt, Human
ccuguucagcuccagc

SEQ ID NO: 3059307 - RNA, 15 nt, Human
ccuguucagcuccag

SEQ ID NO: 3059308 - RNA, 14 nt, Human
ccuguucagcucca

SEQ ID NO: 3059309 - RNA, 21 nt, Human
ccuguucagcuccagcucacc

SEQ ID NO: 3059310 - RNA, 20 nt, Human
ccuguucagcuccagcucac

SEQ ID NO: 3059311 - RNA, 23 nt, Human
ccuguucagcuccagcucaccag

SEQ ID NO: 3059312 - RNA, 12 nt, Human
ccuguucuggca

SEQ ID NO: 3059313 - RNA, 17 nt, Human
ccuguucuggcagaguu

SEQ ID NO: 3059314 - RNA, 18 nt, Human
ccuguucccaugagauga

SEQ ID NO: 3059315 - RNA, 22 nt, Human
cucagucuggcccuuccuuuuc

SEQ ID NO: 3059316 - RNA, 20 nt, Human
cucagucuggcccuuccuuu

SEQ ID NO: 3059317 - RNA, 16 nt, Human
cucaguccaugaagau

SEQ ID NO: 3059318 - RNA, 17 nt, Human
cucaguccauagcagag

SEQ ID NO: 3059319 - RNA, 15 nt, Human
cucaguccauagcag

SEQ ID NO: 3059320 - RNA, 23 nt, Human
cucaggugucccugcacuugcag

SEQ ID NO: 3059321 - RNA, 18 nt, Human
cucaguagucagacugga

SEQ ID NO: 3059322 - RNA, 22 nt, Human
cucaggccugggggcugggcag

SEQ ID NO: 3059323 - RNA, 11 nt, Human
cucaggccugg

SEQ ID NO: 3059324 - RNA, 18 nt, Human
cucaggccagcugcuugg

SEQ ID NO: 3059325 - RNA, 16 nt, Human
cucaggccagcugcuu

SEQ ID NO: 3059326 - RNA, 17 nt, Human
cucaggccagcugcuug

SEQ ID NO: 3059327 - RNA, 19 nt, Human
cucaggccaaacucaccug

SEQ ID NO: 3059328 - RNA, 20 nt, Human
cucaggccaaacucaccugc

SEQ ID NO: 3059329 - RNA, 21 nt, Human
cucaggccaaacucaccugcc

SEQ ID NO: 3059330 - RNA, 15 nt, Human
cucaggccagcugcu

SEQ ID NO: 3059331 - RNA, 22 nt, Human
cucagccucccgaauagcuggg

SEQ ID NO: 3059332 - RNA, 21 nt, Human
cucagccucccgaauagcugg

SEQ ID NO: 3059333 - RNA, 19 nt, Human
cucagccucccgaauagcu

SEQ ID NO: 3059334 - RNA, 23 nt, Human
cucagaagacacugaugggcaac

SEQ ID NO: 3059335 - RNA, 17 nt, Human
cucaccuuucccaucuu

SEQ ID NO: 3059336 - RNA, 22 nt, Human
cucagaagacacugaugggcaa

SEQ ID NO: 3059337 - RNA, 20 nt, Human
cucagaagacacugaugggc

SEQ ID NO: 3059338 - RNA, 17 nt, Human
cucagaagacacugaug

SEQ ID NO: 3059339 - RNA, 15 nt, Human
cucagaagacacuga

SEQ ID NO: 3059340 - RNA, 13 nt, Human
cucagaagacacu

SEQ ID NO: 3059341 - RNA, 23 nt, Human
cucaauuauuuugcauuuuuucu

SEQ ID NO: 3059342 - RNA, 21 nt, Human
cucaagugauucuccugccuc

SEQ ID NO: 3059343 - RNA, 13 nt, Human
cuaucucccccag

SEQ ID NO: 3059344 - RNA, 18 nt, Human
cuaucucauuuccaagca

SEQ ID NO: 3059345 - RNA, 14 nt, Human
cuaugugagaccau

SEQ ID NO: 3059346 - RNA, 23 nt, Human
cuaugucauuugcuggagcucug

SEQ ID NO: 3059347 - RNA, 22 nt, Human
cuauguugcccaggcaggucuu

SEQ ID NO: 3059348 - RNA, 21 nt, Human
cuauguugcccaggcaggucu

SEQ ID NO: 3059349 - RNA, 19 nt, Human
cuauguugcccaggcaggu

SEQ ID NO: 3059350 - RNA, 18 nt, Human
cuauguugcccaggcagg

SEQ ID NO: 3059351 - RNA, 18 nt, Human
cuauguucuaagaaguga

SEQ ID NO: 3059352 - RNA, 17 nt, Human
cucugcacuccccugcu

SEQ ID NO: 3059353 - RNA, 21 nt, Human
cucugcuccucuccccagcaa

SEQ ID NO: 3059354 - RNA, 20 nt, Human
cucugcuccucuccccagca

SEQ ID NO: 3059355 - RNA, 23 nt, Human
cucugcugacagacacaggcccg

SEQ ID NO: 3059356 - RNA, 13 nt, Human
cucugcugcuggc

SEQ ID NO: 3059357 - RNA, 20 nt, Human
cucugcugacagacacaggc

SEQ ID NO: 3059358 - RNA, 22 nt, Human
cucugcugacagacacaggccc

SEQ ID NO: 3059359 - RNA, 21 nt, Human
cucugcugacagacacaggcc

SEQ ID NO: 3059360 - RNA, 16 nt, Human
cucuguacagagccca

SEQ ID NO: 3059361 - RNA, 14 nt, Human
cucugcugcuggcu

SEQ ID NO: 3059362 - RNA, 15 nt, Human
cucugcugcuggcug

SEQ ID NO: 3059363 - RNA, 16 nt, Human
cucugcugcuggcugg

SEQ ID NO: 3059364 - RNA, 14 nt, Human
cucuguacagagcc

SEQ ID NO: 3059365 - RNA, 15 nt, Human
cucuguacagagccc

SEQ ID NO: 3059366 - RNA, 13 nt, Human
cucuguacagagc

SEQ ID NO: 3059367 - RNA, 20 nt, Human
cucugcacaagcugcacccu

SEQ ID NO: 3059368 - RNA, 21 nt, Human
cucugcacaagcugcacccuc

SEQ ID NO: 3059369 - RNA, 19 nt, Human
cucugcacaagcugcaccc

SEQ ID NO: 3059370 - RNA, 15 nt, Human
cucugcacuccccug

SEQ ID NO: 3059371 - RNA, 16 nt, Human
cucugcacuccccugc

SEQ ID NO: 3059372 - RNA, 14 nt, Human
cucugcacuccccu

SEQ ID NO: 3059373 - RNA, 21 nt, Human
cucucuguaauaaacucauuu

SEQ ID NO: 3059374 - RNA, 16 nt, Human
cucucuguaauaaacu

SEQ ID NO: 3059375 - RNA, 16 nt, Human
cucucccugcugcucc

SEQ ID NO: 3059376 - RNA, 19 nt, Human
cucucccugcugcuccuag

SEQ ID NO: 3059377 - RNA, 22 nt, Human
cucucuggccuucggccuccau

SEQ ID NO: 3059378 - RNA, 16 nt, Human
cucuccuccagaguca

SEQ ID NO: 3059379 - RNA, 13 nt, Human
cucucuggccuuc

SEQ ID NO: 3059380 - RNA, 14 nt, Human
cucucuggccuucg

SEQ ID NO: 3059381 - RNA, 16 nt, Human
cucucuggccuucggc

SEQ ID NO: 3059382 - RNA, 13 nt, Human
cucuccuccagag

SEQ ID NO: 3059383 - RNA, 15 nt, Human
cucuccuccagaguc

SEQ ID NO: 3059384 - RNA, 12 nt, Human
cucuccuccaga

SEQ ID NO: 3059385 - RNA, 13 nt, Human
cucucccugcugc

SEQ ID NO: 3059386 - RNA, 14 nt, Human
cucucccugcugcu

SEQ ID NO: 3059387 - RNA, 19 nt, Human
cucuauguucuaagaagug

SEQ ID NO: 3059388 - RNA, 16 nt, Human
cucuccccaugauguu

SEQ ID NO: 3059389 - RNA, 15 nt, Human
cucuccccaugaugu

SEQ ID NO: 3059390 - RNA, 16 nt, Human
cucgguguggagaagc

SEQ ID NO: 3059391 - RNA, 17 nt, Human
cucgguguggagaagcg

SEQ ID NO: 3059392 - RNA, 17 nt, Human
cuccuuugugaggaagc

SEQ ID NO: 3059393 - RNA, 18 nt, Human
cuccuuugugaggaagcc

SEQ ID NO: 3059394 - RNA, 20 nt, Human
cucccucuuucccucccuuc

SEQ ID NO: 3059395 - RNA, 22 nt, Human
cuccaggugcacaagcuccaag

SEQ ID NO: 3059396 - RNA, 20 nt, Human
cuccaggcuguaucccauga

SEQ ID NO: 3059397 - RNA, 23 nt, Human
cuccaggcuccuuuagcgcccag

SEQ ID NO: 3059398 - RNA, 15 nt, Human
cuccaggcuccuuua

SEQ ID NO: 3059399 - RNA, 23 nt, Human
cuccaggugcacaagcuccaagc

SEQ ID NO: 3059400 - RNA, 13 nt, Human
cuccucugcugcu

SEQ ID NO: 3059401 - RNA, 14 nt, Human
cuccucugcugcug

SEQ ID NO: 3059402 - RNA, 19 nt, Human
cuccuggcccacugcaucg

SEQ ID NO: 3059403 - RNA, 18 nt, Human
cuccugggcuaagugauc

SEQ ID NO: 3059404 - RNA, 19 nt, Human
cuccuggccucaagugauu

SEQ ID NO: 3059405 - RNA, 14 nt, Human
cuccuuguguuacu

SEQ ID NO: 3059406 - RNA, 15 nt, Human
cuccuuucaccacau

SEQ ID NO: 3059407 - RNA, 16 nt, Human
cuccuguaccucuuga

SEQ ID NO: 3059408 - RNA, 23 nt, Human
cuccgcuuucuacccagcgagcc

SEQ ID NO: 3059409 - RNA, 19 nt, Human
cuccggcccuccagagccc

SEQ ID NO: 3059410 - RNA, 16 nt, Human
auuuaaauagcuuuuu

SEQ ID NO: 3059411 - RNA, 22 nt, Human
auuuacaacugggggaggguga

SEQ ID NO: 3059412 - RNA, 22 nt, Human
auuuaccacuuguguuuugcaa

SEQ ID NO: 3059413 - RNA, 15 nt, Human
auuuaccacuugugu

SEQ ID NO: 3059414 - RNA, 17 nt, Human
auuguagcauccuggaa

SEQ ID NO: 3059415 - RNA, 16 nt, Human
auuguaguccuguaau

SEQ ID NO: 3059416 - RNA, 17 nt, Human
auuguuuucaguguaca

SEQ ID NO: 3059417 - RNA, 20 nt, Human
auuguagcauccuggaauau

SEQ ID NO: 3059418 - RNA, 19 nt, Human
auuguuuucaguguacaug

SEQ ID NO: 3059419 - RNA, 18 nt, Human
auuguuuucaguguacau

SEQ ID NO: 3059420 - RNA, 17 nt, Human
auuuaaaaaaaaaccug

SEQ ID NO: 3059421 - RNA, 17 nt, Human
auuuaguguucauaaau

SEQ ID NO: 3059422 - RNA, 23 nt, Human
auuuauaaaaauaaaaaacacug

SEQ ID NO: 3059423 - RNA, 16 nt, Human
auuuaguguucauaaa

SEQ ID NO: 3059424 - RNA, 20 nt, Human
auuuacuucuuauacauuug

SEQ ID NO: 3059425 - RNA, 19 nt, Human
auuuacuucuuauacauuu

SEQ ID NO: 3059426 - RNA, 15 nt, Human
auuuauaaacuuuuu

SEQ ID NO: 3059427 - RNA, 21 nt, Human
auuuccuaaauauauuuuaag

SEQ ID NO: 3059428 - RNA, 14 nt, Human
auuuccuaaauaua

SEQ ID NO: 3059429 - RNA, 17 nt, Human
auuuccguuaaaauacc

SEQ ID NO: 3059430 - RNA, 14 nt, Human
auuucccaaagcag

SEQ ID NO: 3059431 - RNA, 16 nt, Human
auuucccaaagcagug

SEQ ID NO: 3059432 - RNA, 21 nt, Human
auuuauuuuaauaauguuuca

SEQ ID NO: 3059433 - RNA, 19 nt, Human
auuuauuacuguaagaaaa

SEQ ID NO: 3059434 - RNA, 20 nt, Human
auuuauuacuguaagaaaau

SEQ ID NO: 3059435 - RNA, 18 nt, Human
auuugaauguuaagcaga

SEQ ID NO: 3059436 - RNA, 13 nt, Human
auuugaauguuaa

SEQ ID NO: 3059437 - RNA, 20 nt, Human
auuucuugagguaaaagcau

SEQ ID NO: 3059438 - RNA, 19 nt, Human
auuugaauguuaagcagau

SEQ ID NO: 3059439 - RNA, 18 nt, Human
auuugaggucuguucuuu

SEQ ID NO: 3059440 - RNA, 17 nt, Human
auuugaggucuguucuu

SEQ ID NO: 3059441 - RNA, 15 nt, Human
auuugaggucuguuc

SEQ ID NO: 3059442 - RNA, 15 nt, Human
auuugagcagggcuc

SEQ ID NO: 3059443 - RNA, 21 nt, Human
auuuggagacacaacuauuuu

SEQ ID NO: 3059444 - RNA, 21 nt, Human
auuugaggucuguucuuucca

SEQ ID NO: 3059445 - RNA, 19 nt, Human
auuugauaugugaacaguu

SEQ ID NO: 3059446 - RNA, 18 nt, Human
auuugauaugugaacagu

SEQ ID NO: 3059447 - RNA, 21 nt, Human
auuuggugguuucagaaaugu

SEQ ID NO: 3059448 - RNA, 12 nt, Human
auuugguuuuca

SEQ ID NO: 3059449 - RNA, 14 nt, Human
auuugguuuucaca

SEQ ID NO: 3059450 - RNA, 18 nt, Human
auugaugggauuugguca

SEQ ID NO: 3059451 - RNA, 12 nt, Human
auugauguguuu

SEQ ID NO: 3059452 - RNA, 19 nt, Human
auugauguguuuauuuaua

SEQ ID NO: 3059453 - RNA, 18 nt, Human
auugcaacaggcugggcu

SEQ ID NO: 3059454 - RNA, 17 nt, Human
auugcaacaggcugggc

SEQ ID NO: 3059455 - RNA, 12 nt, Human
auugcaccacug

SEQ ID NO: 3059456 - RNA, 19 nt, Human
auugcaacaggcugggcuu

SEQ ID NO: 3059457 - RNA, 16 nt, Human
auugcaacaggcuggg

SEQ ID NO: 3059458 - RNA, 24 nt, Human
auuccuagaaacugacacaugcug

SEQ ID NO: 3059459 - RNA, 17 nt, Human
auugaaggaugcugucu

SEQ ID NO: 3059460 - RNA, 17 nt, Human
auuguacgaagaguauu

SEQ ID NO: 3059461 - RNA, 14 nt, Human
auuggggcucccag

SEQ ID NO: 3059462 - RNA, 23 nt, Human
auuggcuagagguucaaagauau

SEQ ID NO: 3059463 - RNA, 22 nt, Human
auuggcuagagguucaaagaua

SEQ ID NO: 3059464 - RNA, 20 nt, Human
auuggcuagagguucaaaga

SEQ ID NO: 3059465 - RNA, 19 nt, Human
auuggcuagagguucaaag

SEQ ID NO: 3059466 - RNA, 16 nt, Human
auuggagcucguggaa

SEQ ID NO: 3059467 - RNA, 17 nt, Human
auuggagcucgugggac

SEQ ID NO: 3059468 - RNA, 14 nt, Human
auuggaaacaaguc

SEQ ID NO: 3059469 - RNA, 13 nt, Human
auuggaaacaagu

SEQ ID NO: 3059470 - RNA, 15 nt, Human
auucagccuggcuuc

SEQ ID NO: 3059471 - RNA, 14 nt, Human
auucagccuggcuu

SEQ ID NO: 3059472 - RNA, 20 nt, Human
auucagauaugauucaaaug

SEQ ID NO: 3059473 - RNA, 22 nt, Human
auucaggagaguagaacagaua

SEQ ID NO: 3059474 - RNA, 21 nt, Human
auucaggagaguagaacagau

SEQ ID NO: 3059475 - RNA, 17 nt, Human
auuccaagugauugaaa

SEQ ID NO: 3059476 - RNA, 17 nt, Human
auucccaagcucugcuc

SEQ ID NO: 3059477 - RNA, 19 nt, Human
auucccaagcucugcuccu

SEQ ID NO: 3059478 - RNA, 18 nt, Human
auucccaagcucugcucc

SEQ ID NO: 3059479 - RNA, 19 nt, Human
auuccccaggaggccagcc

SEQ ID NO: 3059480 - RNA, 20 nt, Human
auuccccaggaggccagccu

SEQ ID NO: 3059481 - RNA, 22 nt, Human
auuccccaggaggccagccuug

SEQ ID NO: 3059482 - RNA, 20 nt, Human
auuauauggcuugaguuuaa

SEQ ID NO: 3059483 - RNA, 22 nt, Human
auucaaacagucucaggaaauc

SEQ ID NO: 3059484 - RNA, 20 nt, Human
uuuuuguagcacugacagau

SEQ ID NO: 3059485 - RNA, 21 nt, Human
uuuuuguagcacugacagauu

SEQ ID NO: 3059486 - RNA, 17 nt, Human
uuuuuguagcacugaca

SEQ ID NO: 3059487 - RNA, 19 nt, Human
uuuuuguagcacugacaga

SEQ ID NO: 3059488 - RNA, 13 nt, Human
auuaaggaagaca

SEQ ID NO: 3059489 - RNA, 19 nt, Human
auuaaguacuauguaucaa

SEQ ID NO: 3059490 - RNA, 16 nt, Human
auuaaguacuauguau

SEQ ID NO: 3059491 - RNA, 18 nt, Human
auuaaguacuauguauca

SEQ ID NO: 3059492 - RNA, 15 nt, Human
uuuuugaagcuguau

SEQ ID NO: 3059493 - RNA, 12 nt, Human
uuuuugacagaa

SEQ ID NO: 3059494 - RNA, 13 nt, Human
uuuuugacagaau

SEQ ID NO: 3059495 - RNA, 16 nt, Human
uuuuguuuuugucuua

SEQ ID NO: 3059496 - RNA, 15 nt, Human
uuuuguuuucauuau

SEQ ID NO: 3059497 - RNA, 23 nt, Human
uuuuuauacauaaacaagaccac

SEQ ID NO: 3059498 - RNA, 23 nt, Human
uuuugugcauuaucuagauacug

SEQ ID NO: 3059499 - RNA, 14 nt, Human
uuuugugaagcaaa

SEQ ID NO: 3059500 - RNA, 13 nt, Human
auuacuucugcua

SEQ ID NO: 3059501 - RNA, 12 nt, Human
auuacuucugcu

SEQ ID NO: 3059502 - RNA, 14 nt, Human
auuacuucugcuac

SEQ ID NO: 3059503 - RNA, 15 nt, Human
auuacuguaagaaaa

SEQ ID NO: 3059504 - RNA, 16 nt, Human
auuacuguaagaaaau

SEQ ID NO: 3059505 - RNA, 12 nt, Human
auguuaagcaga

SEQ ID NO: 3059506 - RNA, 19 nt, Human
auguuacauaagauaaaug

SEQ ID NO: 3059507 - RNA, 20 nt, Human
auguuacauaagauaaaugu

SEQ ID NO: 3059508 - RNA, 15 nt, Human
auguugcccaggcag

SEQ ID NO: 3059509 - RNA, 14 nt, Human
auguugcccaggca

SEQ ID NO: 3059510 - RNA, 18 nt, Human
auguugaaagaucaaaag

SEQ ID NO: 3059511 - RNA, 13 nt, Human
auguugcccaggc

SEQ ID NO: 3059512 - RNA, 20 nt, Human
auguucuuucacccuuuucu

SEQ ID NO: 3059513 - RNA, 12 nt, Human
auguugaaagau

SEQ ID NO: 3059514 - RNA, 21 nt, Human
uuuuagacccuauugcugcuu

SEQ ID NO: 3059515 - RNA, 17 nt, Human
uuuuagaguugauacua

SEQ ID NO: 3059516 - RNA, 12 nt, Human
auguguuuccau

SEQ ID NO: 3059517 - RNA, 18 nt, Human
uuuuaaaaaacugcugac

SEQ ID NO: 3059518 - RNA, 21 nt, Human
augugcuaguaauuggaaagg

SEQ ID NO: 3059519 - RNA, 20 nt, Human
augugcuaguaauuggaaag

SEQ ID NO: 3059520 - RNA, 15 nt, Human
auguuuuuuuuuaaa

SEQ ID NO: 3059521 - RNA, 23 nt, Human
auuaaaaaucucaaauuucuaaa

SEQ ID NO: 3059522 - RNA, 22 nt, Human
auuaaaaaucucaaauuucuaa

SEQ ID NO: 3059523 - RNA, 19 nt, Human
auuaaaacacaacaucuuu

SEQ ID NO: 3059524 - RNA, 13 nt, Human
uuuucuguucuuu

SEQ ID NO: 3059525 - RNA, 16 nt, Human
auguuggccaggcugg

SEQ ID NO: 3059526 - RNA, 17 nt, Human
auguuggccaggcuggu

SEQ ID NO: 3059527 - RNA, 23 nt, Human
uuuucuacucgaguuacagacaa

SEQ ID NO: 3059528 - RNA, 16 nt, Human
uuuucucuaggaaaua

SEQ ID NO: 3059529 - RNA, 17 nt, Human
uuuucucugauacagaa

SEQ ID NO: 3059530 - RNA, 20 nt, Human
uuuucaggcuagauguaugu

SEQ ID NO: 3059531 - RNA, 21 nt, Human
uuuuauggcuuuugugcauua

SEQ ID NO: 3059532 - RNA, 12 nt, Human
uuuuauuaaauu

SEQ ID NO: 3059533 - RNA, 19 nt, Human
uuuuauggcuuuugugcau

SEQ ID NO: 3059534 - RNA, 18 nt, Human
uuuuauggcuuuugugca

SEQ ID NO: 3059535 - RNA, 22 nt, Human
uuuuauggcacuaguauuucua

SEQ ID NO: 3059536 - RNA, 15 nt, Human
uuuuaguagagacag

SEQ ID NO: 3059537 - RNA, 23 nt, Human
augucgucaaagcugaaauggac

SEQ ID NO: 3059538 - RNA, 13 nt, Human
augugagaccauu

SEQ ID NO: 3059539 - RNA, 14 nt, Human
augugagacugguu

SEQ ID NO: 3059540 - RNA, 12 nt, Human
auguaucaauga

SEQ ID NO: 3059541 - RNA, 19 nt, Human
auguauauuuuauaucaau

SEQ ID NO: 3059542 - RNA, 16 nt, Human
auguccaagaagccca

SEQ ID NO: 3059543 - RNA, 17 nt, Human
auguccaagaagcccag

SEQ ID NO: 3059544 - RNA, 14 nt, Human
uuuguacagacaac

SEQ ID NO: 3059545 - RNA, 16 nt, Human
uuuguaauuuuuuuau

SEQ ID NO: 3059546 - RNA, 23 nt, Human
uuugucuuaaaaaguggaaaaau

SEQ ID NO: 3059547 - RNA, 16 nt, Human
uuugugauacaaugcu

SEQ ID NO: 3059548 - RNA, 13 nt, Human
uuugucuuaaaaa

SEQ ID NO: 3059549 - RNA, 14 nt, Human
uuugucuuaaaaag

SEQ ID NO: 3059550 - RNA, 19 nt, Human
uuugugcauuaucuagaua

SEQ ID NO: 3059551 - RNA, 22 nt, Human
uuugugauacaaugcugugccc

SEQ ID NO: 3059552 - RNA, 15 nt, Human
uuugugauacaaugc

SEQ ID NO: 3059553 - RNA, 22 nt, Human
uuugugcauuaucuagauacug

SEQ ID NO: 3059554 - RNA, 14 nt, Human
uuuguuucugaaag

SEQ ID NO: 3059555 - RNA, 16 nt, Human
uuuguuucugaaaggg

SEQ ID NO: 3059556 - RNA, 21 nt, Human
uuugggguacccacugcucug

SEQ ID NO: 3059557 - RNA, 22 nt, Human
uuugggguacccacugcucugg

SEQ ID NO: 3059558 - RNA, 12 nt, Human
uuuggcugcuga

SEQ ID NO: 3059559 - RNA, 13 nt, Human
uuuggcugcugaa

SEQ ID NO: 3059560 - RNA, 19 nt, Human
uuugcuggggccgaaagaa

SEQ ID NO: 3059561 - RNA, 22 nt, Human
uuugcuggggccgaaagaacag

SEQ ID NO: 3059562 - RNA, 20 nt, Human
uuugcuggagcucugcccau

SEQ ID NO: 3059563 - RNA, 22 nt, Human
uuuggauuggaugaauuccaaa

SEQ ID NO: 3059564 - RNA, 18 nt, Human
uuugauucagacagcugc

SEQ ID NO: 3059565 - RNA, 18 nt, Human
uuugaccucugcagcaau

SEQ ID NO: 3059566 - RNA, 13 nt, Human
uuugagacagagu

SEQ ID NO: 3059567 - RNA, 13 nt, Human
uuugagaguucua

SEQ ID NO: 3059568 - RNA, 14 nt, Human
uuugauccaagcug

SEQ ID NO: 3059569 - RNA, 15 nt, Human
uuugauccaagcugg

SEQ ID NO: 3059570 - RNA, 23 nt, Human
uuugauuaaauucuugcaaagua

SEQ ID NO: 3059571 - RNA, 15 nt, Human
uuugauucagacagc

SEQ ID NO: 3059572 - RNA, 18 nt, Human
uuugacaaagguaaauca

SEQ ID NO: 3059573 - RNA, 14 nt, Human
uuugacaaggggca

SEQ ID NO: 3059574 - RNA, 18 nt, Human
uuugacagaauauguuuc

SEQ ID NO: 3059575 - RNA, 19 nt, Human
uuugacagaauauguuuca

SEQ ID NO: 3059576 - RNA, 20 nt, Human
uuugacagaauauguuucaa

SEQ ID NO: 3059577 - RNA, 21 nt, Human
uuugacagaauauguuucaaa

SEQ ID NO: 3059578 - RNA, 21 nt, Human
uuugaccucugcagcaauaaa

SEQ ID NO: 3059579 - RNA, 19 nt, Human
uuugaccucugcagcaaua

SEQ ID NO: 3059580 - RNA, 23 nt, Human
uuucccucccuuccucuuuccau

SEQ ID NO: 3059581 - RNA, 16 nt, Human
uucaaacuuuggaaca

SEQ ID NO: 3059582 - RNA, 15 nt, Human
uucaaacauauauaa

SEQ ID NO: 3059583 - RNA, 14 nt, Human
uucaaacauauaua

SEQ ID NO: 3059584 - RNA, 17 nt, Human
uucaaaauaaaaaugag

SEQ ID NO: 3059585 - RNA, 22 nt, Human
uucaagaaaacaacuucaauau

SEQ ID NO: 3059586 - RNA, 15 nt, Human
uucaaggauccugag

SEQ ID NO: 3059587 - RNA, 16 nt, Human
uucaaggauccugagc

SEQ ID NO: 3059588 - RNA, 18 nt, Human
uucaaggauccugagcca

SEQ ID NO: 3059589 - RNA, 19 nt, Human
uucaaggauccugagccag

SEQ ID NO: 3059590 - RNA, 21 nt, Human
uucaaggauccugagccagau

SEQ ID NO: 3059591 - RNA, 17 nt, Human
auaggcacaggaaacca

SEQ ID NO: 3059592 - RNA, 19 nt, Human
auaggaacuuaaauaaugu

SEQ ID NO: 3059593 - RNA, 21 nt, Human
auaggaauugacccacaagaa

SEQ ID NO: 3059594 - RNA, 19 nt, Human
uucacauuguauucagagu

SEQ ID NO: 3059595 - RNA, 13 nt, Human
uucacauuggaaa

SEQ ID NO: 3059596 - RNA, 20 nt, Human
uucacauaucuaguaugaaa

SEQ ID NO: 3059597 - RNA, 21 nt, Human
uucacauaucuaguaugaaau

SEQ ID NO: 3059598 - RNA, 17 nt, Human
uucacauauugauuucc

SEQ ID NO: 3059599 - RNA, 22 nt, Human
uucaccacaugugcacaugcac

SEQ ID NO: 3059600 - RNA, 14 nt, Human
uucacauuggaaac

SEQ ID NO: 3059601 - RNA, 14 nt, Human
auagcuacuaauuu

SEQ ID NO: 3059602 - RNA, 17 nt, Human
auagcuacuaauuuuaa

SEQ ID NO: 3059603 - RNA, 18 nt, Human
auagccugccucuucucu

SEQ ID NO: 3059604 - RNA, 17 nt, Human
auaagauaaaugugcug

SEQ ID NO: 3059605 - RNA, 13 nt, Human
auaagauaaaugu

SEQ ID NO: 3059606 - RNA, 18 nt, Human
auagcuacuaauuuuaaa

SEQ ID NO: 3059607 - RNA, 19 nt, Human
auagcucaggugucccugc

SEQ ID NO: 3059608 - RNA, 12 nt, Human
auagcugggacu

SEQ ID NO: 3059609 - RNA, 21 nt, Human
auagcucaggugucccugcac

SEQ ID NO: 3059610 - RNA, 20 nt, Human
auagcucaggugucccugca

SEQ ID NO: 3059611 - RNA, 22 nt, Human
auagcucaggugucccugcacu

SEQ ID NO: 3059612 - RNA, 16 nt, Human
uuauuuaguuccuuga

SEQ ID NO: 3059613 - RNA, 22 nt, Human
uuauuuaaugaaagacuguaca

SEQ ID NO: 3059614 - RNA, 18 nt, Human
uuauuuaaugaaagacug

SEQ ID NO: 3059615 - RNA, 14 nt, Human
uuauuuaaauuuua

SEQ ID NO: 3059616 - RNA, 22 nt, Human
auagcuggucuuauuuguaaag

SEQ ID NO: 3059617 - RNA, 17 nt, Human
auagcugggacuacagg

SEQ ID NO: 3059618 - RNA, 23 nt, Human
auagcuggucuuauuuguaaagc

SEQ ID NO: 3059619 - RNA, 17 nt, Human
uuauuguuuaaaaucau

SEQ ID NO: 3059620 - RNA, 19 nt, Human
auauaaguauucuaaauuu

SEQ ID NO: 3059621 - RNA, 14 nt, Human
auauauaacaaugc

SEQ ID NO: 3059622 - RNA, 17 nt, Human
auauauaacaaugcugu

SEQ ID NO: 3059623 - RNA, 18 nt, Human
auauauaacaaugcugua

SEQ ID NO: 3059624 - RNA, 17 nt, Human
auauaaguauucuaaau

SEQ ID NO: 3059625 - RNA, 19 nt, Human
auauaagcuuguauuccuu

SEQ ID NO: 3059626 - RNA, 12 nt, Human
auauaacaaugc

SEQ ID NO: 3059627 - RNA, 15 nt, Human
auauaacaaugcugu

SEQ ID NO: 3059628 - RNA, 17 nt, Human
auagucaaauuguguga

SEQ ID NO: 3059629 - RNA, 18 nt, Human
auagucaaauugugugaa

SEQ ID NO: 3059630 - RNA, 21 nt, Human
uucagaaaauauuauguguuu

SEQ ID NO: 3059631 - RNA, 20 nt, Human
uucagaaaauauuauguguu

SEQ ID NO: 3059632 - RNA, 14 nt, Human
uucagaaaauauua

SEQ ID NO: 3059633 - RNA, 13 nt, Human
uucagaaaauauu

SEQ ID NO: 3059634 - RNA, 17 nt, Human
uucagaucucuaacuuc

SEQ ID NO: 3059635 - RNA, 14 nt, Human
uucagccaagaauu

SEQ ID NO: 3059636 - RNA, 19 nt, Human
uucagccaagaauucuuaa

SEQ ID NO: 3059637 - RNA, 15 nt, Human
uucagcccucagaau

SEQ ID NO: 3059638 - RNA, 18 nt, Human
auauauucagccuggcuu

SEQ ID NO: 3059639 - RNA, 17 nt, Human
auaucuauauuuuacau

SEQ ID NO: 3059640 - RNA, 16 nt, Human
auaucuauauuuuaca

SEQ ID NO: 3059641 - RNA, 20 nt, Human
auaucuauauuuuacauaaa

SEQ ID NO: 3059642 - RNA, 22 nt, Human
auaucuauauuuuacauaaauu

SEQ ID NO: 3059643 - RNA, 21 nt, Human
uucaucauccuaagcuauuca

SEQ ID NO: 3059644 - RNA, 18 nt, Human
uucaucauccuaagcuau

SEQ ID NO: 3059645 - RNA, 14 nt, Human
uucaguaauaacuc

SEQ ID NO: 3059646 - RNA, 21 nt, Human
uucauauuuacuucuuauaca

SEQ ID NO: 3059647 - RNA, 16 nt, Human
uucauauuuacuucuu

SEQ ID NO: 3059648 - RNA, 22 nt, Human
auaucugaaaauguauguguaa

SEQ ID NO: 3059649 - RNA, 20 nt, Human
auaugauuuaaaucagccgu

SEQ ID NO: 3059650 - RNA, 13 nt, Human
auaugauucaaau

SEQ ID NO: 3059651 - RNA, 22 nt, Human
auaugauucaaaugucuauaaa

SEQ ID NO: 3059652 - RNA, 12 nt, Human
auaugauucaaa

SEQ ID NO: 3059653 - RNA, 14 nt, Human
auaugucaagccau

SEQ ID NO: 3059654 - RNA, 13 nt, Human
auaugugaacagu

SEQ ID NO: 3059655 - RNA, 23 nt, Human
auaugcaaagcacugacuucuaa

SEQ ID NO: 3059656 - RNA, 15 nt, Human
auaugcaaagcacug

SEQ ID NO: 3059657 - RNA, 16 nt, Human
auaugcaaagcacuga

SEQ ID NO: 3059658 - RNA, 23 nt, Human
auauuugaaauauugacuuuuua

SEQ ID NO: 3059659 - RNA, 14 nt, Human
auauuugaaauauu

SEQ ID NO: 3059660 - RNA, 19 nt, Human
auauuugaaauauugacuu

SEQ ID NO: 3059661 - RNA, 22 nt, Human
auauuuguaucacaaaucuuaa

SEQ ID NO: 3059662 - RNA, 12 nt, Human
auauuuuaacuu

SEQ ID NO: 3059663 - RNA, 18 nt, Human
auauuguguugugaaugu

SEQ ID NO: 3059664 - RNA, 17 nt, Human
auauuguguugugaaug

SEQ ID NO: 3059665 - RNA, 17 nt, Human
auauugcugauggugca

SEQ ID NO: 3059666 - RNA, 21 nt, Human
auauugcugauggugcaauga

SEQ ID NO: 3059667 - RNA, 20 nt, Human
auauuguuuucaguguacau

SEQ ID NO: 3059668 - RNA, 17 nt, Human
auauuguuuucagugua

SEQ ID NO: 3059669 - RNA, 13 nt, Human
auauuugaaauau

SEQ ID NO: 3059670 - RNA, 22 nt, Human
auauugauccagaaagaaaacu

SEQ ID NO: 3059671 - RNA, 15 nt, Human
auauugauccagaaa

SEQ ID NO: 3059672 - RNA, 22 nt, Human
auauugauuuccguuaaaauac

SEQ ID NO: 3059673 - RNA, 21 nt, Human
auauugauuuccguuaaaaua

SEQ ID NO: 3059674 - RNA, 19 nt, Human
auauugauuuccguuaaaa

SEQ ID NO: 3059675 - RNA, 16 nt, Human
auauucuguuggccag

SEQ ID NO: 3059676 - RNA, 21 nt, Human
auauucucacagcuccaagaa

SEQ ID NO: 3059677 - RNA, 22 nt, Human
auauucucacagcuccaagaau

SEQ ID NO: 3059678 - RNA, 23 nt, Human
auauucucacagcuccaagaauu

SEQ ID NO: 3059679 - RNA, 17 nt, Human
auauguuucaaacuuug

SEQ ID NO: 3059680 - RNA, 18 nt, Human
auauguuuuaagaggcag

SEQ ID NO: 3059681 - RNA, 20 nt, Human
auauguuuuaagaggcaggg

SEQ ID NO: 3059682 - RNA, 22 nt, Human
auauuaaggaagacaaugugaa

SEQ ID NO: 3059683 - RNA, 24 nt, Human
auauuaagaaagacuaucuaaaug

SEQ ID NO: 3059684 - RNA, 22 nt, Human
auauuaagaaagacuaucuaaa

SEQ ID NO: 3059685 - RNA, 22 nt, Human
aucacggcucacugcagccuca

SEQ ID NO: 3059686 - RNA, 19 nt, Human
aucaauuuuucuuauuuca

SEQ ID NO: 3059687 - RNA, 18 nt, Human
aucaaguauuauaccuuu

SEQ ID NO: 3059688 - RNA, 14 nt, Human
aucaaguauuauac

SEQ ID NO: 3059689 - RNA, 13 nt, Human
aucaaguauuaua

SEQ ID NO: 3059690 - RNA, 13 nt, Human
uuccuaauccucu

SEQ ID NO: 3059691 - RNA, 15 nt, Human
uuccuaauccucuag

SEQ ID NO: 3059692 - RNA, 11 nt, Human
uuccucuuucc

SEQ ID NO: 3059693 - RNA, 15 nt, Human
uuccugggagcuuuu

SEQ ID NO: 3059694 - RNA, 16 nt, Human
uuccugggagcuuuug

SEQ ID NO: 3059695 - RNA, 17 nt, Human
uuccuguucccaugaga

SEQ ID NO: 3059696 - RNA, 11 nt, Human
uuccuucagug

SEQ ID NO: 3059697 - RNA, 14 nt, Human
uuccuucagugccu

SEQ ID NO: 3059698 - RNA, 18 nt, Human
auauuuucaugcuguuca

SEQ ID NO: 3059699 - RNA, 21 nt, Human
auauuuucaugcuguucauga

SEQ ID NO: 3059700 - RNA, 16 nt, Human
auccagguucagcuug

SEQ ID NO: 3059701 - RNA, 15 nt, Human
auccagguucagcuu

SEQ ID NO: 3059702 - RNA, 20 nt, Human
aucauuucugcaucagcugc

SEQ ID NO: 3059703 - RNA, 17 nt, Human
aucccauaugccugggc

SEQ ID NO: 3059704 - RNA, 16 nt, Human
aucccauaugccuggg

SEQ ID NO: 3059705 - RNA, 15 nt, Human
uucugaaagggacgc

SEQ ID NO: 3059706 - RNA, 19 nt, Human
aucauugaaaucuuuuugc

SEQ ID NO: 3059707 - RNA, 23 nt, Human
uucugaacuuggcgcugccccug

SEQ ID NO: 3059708 - RNA, 21 nt, Human
uucugaaauuuccugggagcu

SEQ ID NO: 3059709 - RNA, 12 nt, Human
uucugaagaaga

SEQ ID NO: 3059710 - RNA, 13 nt, Human
uucugaagaagau

SEQ ID NO: 3059711 - RNA, 16 nt, Human
uucugcaucagcugcu

SEQ ID NO: 3059712 - RNA, 23 nt, Human
uucugcaucagcugcugaaacaa

SEQ ID NO: 3059713 - RNA, 23 nt, Human
uucugccgcagcccugcagaggg

SEQ ID NO: 3059714 - RNA, 16 nt, Human
uucugccgcagcccug

SEQ ID NO: 3059715 - RNA, 22 nt, Human
uucugggacacaguucaauucu

SEQ ID NO: 3059716 - RNA, 11 nt, Human
uucugggacac

SEQ ID NO: 3059717 - RNA, 10 nt, Human
uucugggaca

SEQ ID NO: 3059718 - RNA, 19 nt, Human
aucagugugucuaaauuug

SEQ ID NO: 3059719 - RNA, 20 nt, Human
aucagugugucuaaauuuga

SEQ ID NO: 3059720 - RNA, 18 nt, Human
aucagcacgauuucuguu

SEQ ID NO: 3059721 - RNA, 17 nt, Human
aucagcacgauuucugu

SEQ ID NO: 3059722 - RNA, 16 nt, Human
aucagcacgauuucug

SEQ ID NO: 3059723 - RNA, 15 nt, Human
aucagcacgauuucu

SEQ ID NO: 3059724 - RNA, 14 nt, Human
aucauucauuuucu

SEQ ID NO: 3059725 - RNA, 22 nt, Human
aucauuaaagccugaguuugcu

SEQ ID NO: 3059726 - RNA, 14 nt, Human
aucauugaaaucuu

SEQ ID NO: 3059727 - RNA, 15 nt, Human
aucauugaaaucuuu

SEQ ID NO: 3059728 - RNA, 13 nt, Human
aucauugaaaucu

SEQ ID NO: 3059729 - RNA, 23 nt, Human
uucuaggacugaauuaugaaacu

SEQ ID NO: 3059730 - RNA, 13 nt, Human
uucuaggccuggg

SEQ ID NO: 3059731 - RNA, 14 nt, Human
uucucaacuccaaa

SEQ ID NO: 3059732 - RNA, 18 nt, Human
uucucaacuccaaacuga

SEQ ID NO: 3059733 - RNA, 22 nt, Human
uucucagaaucucaaauaacua

SEQ ID NO: 3059734 - RNA, 19 nt, Human
uucucagaaucucaaauaa

SEQ ID NO: 3059735 - RNA, 13 nt, Human
uucucagaaucuc

SEQ ID NO: 3059736 - RNA, 23 nt, Human
uucucagaaucucaaauaacuaa

SEQ ID NO: 3059737 - RNA, 14 nt, Human
uuuaagagacagcc

SEQ ID NO: 3059738 - RNA, 12 nt, Human
uuuaagagaaau

SEQ ID NO: 3059739 - RNA, 21 nt, Human
uuuaagcuguuacugucuuca

SEQ ID NO: 3059740 - RNA, 19 nt, Human
uuuaaggaugcuuguacau

SEQ ID NO: 3059741 - RNA, 21 nt, Human
uuuaaggaugcuuguacauaa

SEQ ID NO: 3059742 - RNA, 20 nt, Human
uuuaaggaugcuuguacaua

SEQ ID NO: 3059743 - RNA, 22 nt, Human
uuuaaggaugcuuguacauaau

SEQ ID NO: 3059744 - RNA, 16 nt, Human
uuuaaugaaagacugu

SEQ ID NO: 3059745 - RNA, 18 nt, Human
uuuaaauauaugcuaagu

SEQ ID NO: 3059746 - RNA, 21 nt, Human
uuuaaauauaugcuaagucuu

SEQ ID NO: 3059747 - RNA, 20 nt, Human
uuuaagacgaaacauuuguu

SEQ ID NO: 3059748 - RNA, 11 nt, Human
uuuaaaugcac

SEQ ID NO: 3059749 - RNA, 18 nt, Human
uuuaaaaaaauuccaagu

SEQ ID NO: 3059750 - RNA, 23 nt, Human
augcacuuuguucuggcucuucc

SEQ ID NO: 3059751 - RNA, 21 nt, Human
augcacuuuguucuggcucuu

SEQ ID NO: 3059752 - RNA, 14 nt, Human
augcaaagcacuga

SEQ ID NO: 3059753 - RNA, 13 nt, Human
augcaaagcacug

SEQ ID NO: 3059754 - RNA, 12 nt, Human
augcaaagcacu

SEQ ID NO: 3059755 - RNA, 16 nt, Human
uuguucauacauauuu

SEQ ID NO: 3059756 - RNA, 18 nt, Human
uuguucauacauauuuuu

SEQ ID NO: 3059757 - RNA, 19 nt, Human
uuguucuugguuuguaaau

SEQ ID NO: 3059758 - RNA, 17 nt, Human
uuguucuugguuuguaa

SEQ ID NO: 3059759 - RNA, 13 nt, Human
augauuucauuca

SEQ ID NO: 3059760 - RNA, 13 nt, Human
uuguucauacaua

SEQ ID NO: 3059761 - RNA, 22 nt, Human
uuguucaauaauaaauauuuuu

SEQ ID NO: 3059762 - RNA, 20 nt, Human
uuguucaauaauaaauauuu

SEQ ID NO: 3059763 - RNA, 17 nt, Human
uugugaggaagccgcug

SEQ ID NO: 3059764 - RNA, 18 nt, Human
uugugaggaagccgcugg

SEQ ID NO: 3059765 - RNA, 20 nt, Human
uugugauacaaugcugugcc

SEQ ID NO: 3059766 - RNA, 19 nt, Human
uugugauacaaugcugugc

SEQ ID NO: 3059767 - RNA, 13 nt, Human
uugugaggaagcc

SEQ ID NO: 3059768 - RNA, 18 nt, Human
uuguccccaccgcagaca

SEQ ID NO: 3059769 - RNA, 20 nt, Human
uuguccccaccgcagacagg

SEQ ID NO: 3059770 - RNA, 15 nt, Human
uugucccaagugcca

SEQ ID NO: 3059771 - RNA, 15 nt, Human
uuguccccgacccuu

SEQ ID NO: 3059772 - RNA, 13 nt, Human
augaguccccugu

SEQ ID NO: 3059773 - RNA, 20 nt, Human
uugucaauaaaauccauaca

SEQ ID NO: 3059774 - RNA, 17 nt, Human
uugucacacacuuuggc

SEQ ID NO: 3059775 - RNA, 21 nt, Human
uugucauauaagauucauauu

SEQ ID NO: 3059776 - RNA, 16 nt, Human
uuguagcuuuaucaaa

SEQ ID NO: 3059777 - RNA, 17 nt, Human
uuguagcuuuaucaaag

SEQ ID NO: 3059778 - RNA, 15 nt, Human
augagguacugagag

SEQ ID NO: 3059779 - RNA, 17 nt, Human
augagguacugagagug

SEQ ID NO: 3059780 - RNA, 18 nt, Human
augagguacugagaguga

SEQ ID NO: 3059781 - RNA, 16 nt, Human
uuguagcauccuggaa

SEQ ID NO: 3059782 - RNA, 18 nt, Human
uuguagcauccuggaaua

SEQ ID NO: 3059783 - RNA, 18 nt, Human
augaggucagagccugca

SEQ ID NO: 3059784 - RNA, 16 nt, Human
augaggucagagccug

SEQ ID NO: 3059785 - RNA, 15 nt, Human
augaggucagagccu

SEQ ID NO: 3059786 - RNA, 20 nt, Human
augaggucagagccugcagu

SEQ ID NO: 3059787 - RNA, 19 nt, Human
augaggucagagccugcag

SEQ ID NO: 3059788 - RNA, 17 nt, Human
auggaaugcuguguuaa

SEQ ID NO: 3059789 - RNA, 21 nt, Human
auggaaugcuguguuaaauaa

SEQ ID NO: 3059790 - RNA, 17 nt, Human
uuucaaacauauauaac

SEQ ID NO: 3059791 - RNA, 22 nt, Human
uuucacauaucuaguaugaaau

SEQ ID NO: 3059792 - RNA, 12 nt, Human
uuucaaacuuua

SEQ ID NO: 3059793 - RNA, 19 nt, Human
uuucaaacauauauaacaa

SEQ ID NO: 3059794 - RNA, 14 nt, Human
uuucacauuggaaa

SEQ ID NO: 3059795 - RNA, 19 nt, Human
uuucacauuggaaacaagu

SEQ ID NO: 3059796 - RNA, 13 nt, Human
uuucacauuggaa

SEQ ID NO: 3059797 - RNA, 12 nt, Human
uuucagaaaugu

SEQ ID NO: 3059798 - RNA, 11 nt, Human
uuucagaaaug

SEQ ID NO: 3059799 - RNA, 21 nt, Human
uuucaugcuguucaugaaaga

SEQ ID NO: 3059800 - RNA, 19 nt, Human
uuucaugcuguucaugaaa

SEQ ID NO: 3059801 - RNA, 16 nt, Human
uuucccuauuagagaa

SEQ ID NO: 3059802 - RNA, 16 nt, Human
augcuucucacugcca

SEQ ID NO: 3059803 - RNA, 20 nt, Human
augcuucucacugccaugcc

SEQ ID NO: 3059804 - RNA, 17 nt, Human
auggaagacagcucuua

SEQ ID NO: 3059805 - RNA, 18 nt, Human
auggaagacagcucuuau

SEQ ID NO: 3059806 - RNA, 20 nt, Human
augcuggcuguuggcugggg

SEQ ID NO: 3059807 - RNA, 19 nt, Human
augcuggcuguuggcuggg

SEQ ID NO: 3059808 - RNA, 19 nt, Human
augcuguauuuuaaaagaa

SEQ ID NO: 3059809 - RNA, 22 nt, Human
augcuguauuuuaaaagaauga

SEQ ID NO: 3059810 - RNA, 23 nt, Human
augcuguucaugaaagauucaau

SEQ ID NO: 3059811 - RNA, 23 nt, Human
augcuguauuuuaaaagaaugau

SEQ ID NO: 3059812 - RNA, 18 nt, Human
augcuggcuguuggcugg

SEQ ID NO: 3059813 - RNA, 14 nt, Human
augcuccuggccca

SEQ ID NO: 3059814 - RNA, 14 nt, Human
uuuaucagaauucu

SEQ ID NO: 3059815 - RNA, 18 nt, Human
augcuacaggauuugaaa

SEQ ID NO: 3059816 - RNA, 22 nt, Human
augcgugcauaccacuuuuguu

SEQ ID NO: 3059817 - RNA, 20 nt, Human
augcgugcauaccacuuuug

SEQ ID NO: 3059818 - RNA, 15 nt, Human
augccucucucaggc

SEQ ID NO: 3059819 - RNA, 14 nt, Human
augccuuuucccaa

SEQ ID NO: 3059820 - RNA, 20 nt, Human
augccuuuucccaacuccag

SEQ ID NO: 3059821 - RNA, 22 nt, Human
augccuuuucccaacuccagaa

SEQ ID NO: 3059822 - RNA, 13 nt, Human
augccucucucag

SEQ ID NO: 3059823 - RNA, 14 nt, Human
augccucucucagg

SEQ ID NO: 3059824 - RNA, 23 nt, Human
uuuaaugaaagacuguacaaagu

SEQ ID NO: 3059825 - RNA, 21 nt, Human
uuuaaugaaagacuguacaaa

SEQ ID NO: 3059826 - RNA, 21 nt, Human
augccaugaggaacaaggcaa

SEQ ID NO: 3059827 - RNA, 16 nt, Human
augcccagccccuucu

SEQ ID NO: 3059828 - RNA, 15 nt, Human
augcccagccccuuc

SEQ ID NO: 3059829 - RNA, 17 nt, Human
augcccagccccuucug

SEQ ID NO: 3059830 - RNA, 15 nt, Human
augccccugaauuua

SEQ ID NO: 3059831 - RNA, 20 nt, Human
augccccugaauuuaaauag

SEQ ID NO: 3059832 - RNA, 18 nt, Human
uuuaccugaagucuuugu

SEQ ID NO: 3059833 - RNA, 16 nt, Human
uuuacugcagcuuugu

SEQ ID NO: 3059834 - RNA, 11 nt, Human
uuuacuuaaac

SEQ ID NO: 3059835 - RNA, 13 nt, Human
uuuacuucuuaua

SEQ ID NO: 3059836 - RNA, 14 nt, Human
uuuacuucuuauac

SEQ ID NO: 3059837 - RNA, 21 nt, Human
uuuauaugcuucuguuuuaua

SEQ ID NO: 3059838 - RNA, 19 nt, Human
uuuauaugcuucuguuuua

SEQ ID NO: 3059839 - RNA, 17 nt, Human
uugcaacuuuguauaaa

SEQ ID NO: 3059840 - RNA, 16 nt, Human
uugcaacuuuguauaa

SEQ ID NO: 3059841 - RNA, 18 nt, Human
uugcaacuuuguauaaaa

SEQ ID NO: 3059842 - RNA, 20 nt, Human
uugauuaaauucuugcaaag

SEQ ID NO: 3059843 - RNA, 16 nt, Human
uugauuaaauucuugc

SEQ ID NO: 3059844 - RNA, 15 nt, Human
uugauuaaauucuug

SEQ ID NO: 3059845 - RNA, 14 nt, Human
aucugacuaugaca

SEQ ID NO: 3059846 - RNA, 17 nt, Human
aucugacuaugacauaa

SEQ ID NO: 3059847 - RNA, 20 nt, Human
uugauguguuuauuuauaga

SEQ ID NO: 3059848 - RNA, 23 nt, Human
uugauguucuuucacccuuuucu

SEQ ID NO: 3059849 - RNA, 16 nt, Human
aucucuuguuuaaauu

SEQ ID NO: 3059850 - RNA, 17 nt, Human
aucucaaauuucuaaau

SEQ ID NO: 3059851 - RNA, 16 nt, Human
aucucaaauuucuaaa

SEQ ID NO: 3059852 - RNA, 23 nt, Human
aucucacacaugagcaucaggcc

SEQ ID NO: 3059853 - RNA, 18 nt, Human
aucucuugagccugggag

SEQ ID NO: 3059854 - RNA, 14 nt, Human
uugcaugaggcuag

SEQ ID NO: 3059855 - RNA, 12 nt, Human
uugcaugaggcu

SEQ ID NO: 3059856 - RNA, 19 nt, Human
uugcaugguuuggagcuga

SEQ ID NO: 3059857 - RNA, 14 nt, Human
uugcaauggcagcc

SEQ ID NO: 3059858 - RNA, 21 nt, Human
uugcaccacugcacuccagcc

SEQ ID NO: 3059859 - RNA, 11 nt, Human
uugcccaggca

SEQ ID NO: 3059860 - RNA, 23 nt, Human
uugcccaggcuggcgugcagugg

SEQ ID NO: 3059861 - RNA, 14 nt, Human
uugcccaggcuggc

SEQ ID NO: 3059862 - RNA, 12 nt, Human
uugcccaggcug

SEQ ID NO: 3059863 - RNA, 11 nt, Human
uugcccaggcu

SEQ ID NO: 3059864 - RNA, 18 nt, Human
uugcccaggcaggucuug

SEQ ID NO: 3059865 - RNA, 16 nt, Human
uugcccaggcaggucu

SEQ ID NO: 3059866 - RNA, 14 nt, Human
uugcccaggcaggu

SEQ ID NO: 3059867 - RNA, 13 nt, Human
uugcccaggcagg

SEQ ID NO: 3059868 - RNA, 21 nt, Human
aucucaaauaacuaaaaggua

SEQ ID NO: 3059869 - RNA, 14 nt, Human
aucucaaauaacua

SEQ ID NO: 3059870 - RNA, 23 nt, Human
aucucaaauaacuaaaagguaug

SEQ ID NO: 3059871 - RNA, 14 nt, Human
aucucaaauuucua

SEQ ID NO: 3059872 - RNA, 15 nt, Human
aucucaaaacugcac

SEQ ID NO: 3059873 - RNA, 20 nt, Human
aucucaaaacugcacuguca

SEQ ID NO: 3059874 - RNA, 19 nt, Human
aucucaaaacugcacuguc

SEQ ID NO: 3059875 - RNA, 17 nt, Human
aucuaggaagacuuugg

SEQ ID NO: 3059876 - RNA, 18 nt, Human
aucuaggaagacuuugga

SEQ ID NO: 3059877 - RNA, 19 nt, Human
aucuaggaagacuuuggaa

SEQ ID NO: 3059878 - RNA, 19 nt, Human
aucuagauacuguaucaug

SEQ ID NO: 3059879 - RNA, 18 nt, Human
aucuagauacuguaucau

SEQ ID NO: 3059880 - RNA, 23 nt, Human
aucuaauauguaacaagccaccc

SEQ ID NO: 3059881 - RNA, 20 nt, Human
aucuaauauguaacaagcca

SEQ ID NO: 3059882 - RNA, 17 nt, Human
uugauacuacaguuugu

SEQ ID NO: 3059883 - RNA, 15 nt, Human
uugauacuacaguuu

SEQ ID NO: 3059884 - RNA, 21 nt, Human
uugagugcugucuccauguuu

SEQ ID NO: 3059885 - RNA, 11 nt, Human
uugagugccuu

SEQ ID NO: 3059886 - RNA, 16 nt, Human
uugagcagggcucagc

SEQ ID NO: 3059887 - RNA, 12 nt, Human
uugagcagggcu

SEQ ID NO: 3059888 - RNA, 11 nt, Human
uugagacagag

SEQ ID NO: 3059889 - RNA, 12 nt, Human
uugacuuuuuau

SEQ ID NO: 3059890 - RNA, 13 nt, Human
uugacaucaacug

SEQ ID NO: 3059891 - RNA, 16 nt, Human
uugacaucaacugcau

SEQ ID NO: 3059892 - RNA, 13 nt, Human
uugacaugggaca

SEQ ID NO: 3059893 - RNA, 12 nt, Human
uugacagggcac

SEQ ID NO: 3059894 - RNA, 10 nt, Human
uugacagggc

SEQ ID NO: 3059895 - RNA, 19 nt, Human
uugacaggauuauuggaaa

SEQ ID NO: 3059896 - RNA, 22 nt, Human
augaaccacaucuugcucugcu

SEQ ID NO: 3059897 - RNA, 23 nt, Human
augaaccacaucuugcucugcug

SEQ ID NO: 3059898 - RNA, 14 nt, Human
augaagcaaugcuu

SEQ ID NO: 3059899 - RNA, 18 nt, Human
augaacuuguaaaggaau

SEQ ID NO: 3059900 - RNA, 15 nt, Human
augaagcaaugcuuc

SEQ ID NO: 3059901 - RNA, 17 nt, Human
augaaugaaacauuuug

SEQ ID NO: 3059902 - RNA, 20 nt, Human
uugguuuucacauuggaaac

SEQ ID NO: 3059903 - RNA, 14 nt, Human
uugguuuguaaauu

SEQ ID NO: 3059904 - RNA, 18 nt, Human
uuggugucgggcaugaca

SEQ ID NO: 3059905 - RNA, 19 nt, Human
uuggugucgggcaugacac

SEQ ID NO: 3059906 - RNA, 17 nt, Human
uuggugucgggcaugac

SEQ ID NO: 3059907 - RNA, 16 nt, Human
augaaugucaguguga

SEQ ID NO: 3059908 - RNA, 18 nt, Human
augaaugucagugugacu

SEQ ID NO: 3059909 - RNA, 19 nt, Human
uuggugguuucagaaaugu

SEQ ID NO: 3059910 - RNA, 18 nt, Human
uuggugguuucagaaaug

SEQ ID NO: 3059911 - RNA, 17 nt, Human
aucugucauuugagcag

SEQ ID NO: 3059912 - RNA, 12 nt, Human
aucugucauuug

SEQ ID NO: 3059913 - RNA, 14 nt, Human
aucuuauaauuuaa

SEQ ID NO: 3059914 - RNA, 16 nt, Human
aucuugcucugcugac

SEQ ID NO: 3059915 - RNA, 15 nt, Human
aucuugcucugcuga

SEQ ID NO: 3059916 - RNA, 15 nt, Human
aucuuauaauuuaaa

SEQ ID NO: 3059917 - RNA, 16 nt, Human
aucuuauaauuuaaaa

SEQ ID NO: 3059918 - RNA, 14 nt, Human
aucuugcucugcug

SEQ ID NO: 3059919 - RNA, 17 nt, Human
uugcucuugaugccugg

SEQ ID NO: 3059920 - RNA, 14 nt, Human
uugcucuugaugcc

SEQ ID NO: 3059921 - RNA, 18 nt, Human
uugcucuugaugccuggc

SEQ ID NO: 3059922 - RNA, 15 nt, Human
aucuuuaaaauacac

SEQ ID NO: 3059923 - RNA, 12 nt, Human
aucuuuaaaaua

SEQ ID NO: 3059924 - RNA, 15 nt, Human
uugcuuugugauuuu

SEQ ID NO: 3059925 - RNA, 18 nt, Human
uuggagacacaacuauuu

SEQ ID NO: 3059926 - RNA, 15 nt, Human
uuggagaagaacuga

SEQ ID NO: 3059927 - RNA, 17 nt, Human
uuggagaagaacugaaa

SEQ ID NO: 3059928 - RNA, 22 nt, Human
uuggagaagaacugaaaucaua

SEQ ID NO: 3059929 - RNA, 17 nt, Human
uuggaaaauaaauuauu

SEQ ID NO: 3059930 - RNA, 20 nt, Human
uugcuuugugauuuuuguaa

SEQ ID NO: 3059931 - RNA, 14 nt, Human
agugugucuaaauu

SEQ ID NO: 3059932 - RNA, 20 nt, Human
agugugucuuagugugugca

SEQ ID NO: 3059933 - RNA, 12 nt, Human
uguuauaaucuu

SEQ ID NO: 3059934 - RNA, 15 nt, Human
uguuauaaucuuuca

SEQ ID NO: 3059935 - RNA, 20 nt, Human
uguuccacaaguuaaauaaa

SEQ ID NO: 3059936 - RNA, 19 nt, Human
uguuccacaaguuaaauaa

SEQ ID NO: 3059937 - RNA, 16 nt, Human
uguucugggacacagu

SEQ ID NO: 3059938 - RNA, 18 nt, Human
uguuccuagugaaagagg

SEQ ID NO: 3059939 - RNA, 14 nt, Human
uguuccuagugaaa

SEQ ID NO: 3059940 - RNA, 18 nt, Human
uguucugugauauaagug

SEQ ID NO: 3059941 - RNA, 15 nt, Human
uguucugugauauaa

SEQ ID NO: 3059942 - RNA, 18 nt, Human
uguugcccaggcaggucu

SEQ ID NO: 3059943 - RNA, 17 nt, Human
uguugcccaggcagguc

SEQ ID NO: 3059944 - RNA, 16 nt, Human
uguugcccaggcaggu

SEQ ID NO: 3059945 - RNA, 15 nt, Human
uguugcccaggcagg

SEQ ID NO: 3059946 - RNA, 12 nt, Human
uguugcccaggc

SEQ ID NO: 3059947 - RNA, 13 nt, Human
uguugcccaggca

SEQ ID NO: 3059948 - RNA, 17 nt, Human
aguguacuuaacuauuc

SEQ ID NO: 3059949 - RNA, 16 nt, Human
agugugguguuuccug

SEQ ID NO: 3059950 - RNA, 19 nt, Human
agugugguguuuccuggca

SEQ ID NO: 3059951 - RNA, 17 nt, Human
agugugguguuuccugg

SEQ ID NO: 3059952 - RNA, 23 nt, Human
aguggugguuuucuguucuuucu

SEQ ID NO: 3059953 - RNA, 21 nt, Human
aguggugguuuucuguucuuu

SEQ ID NO: 3059954 - RNA, 20 nt, Human
aguggugguuuucuguucuu

SEQ ID NO: 3059955 - RNA, 19 nt, Human
aguggugguuuucuguucu

SEQ ID NO: 3059956 - RNA, 18 nt, Human
aguggugguuuucuguuc

SEQ ID NO: 3059957 - RNA, 17 nt, Human
aguggugguuuucuguu

SEQ ID NO: 3059958 - RNA, 21 nt, Human
agugguggugaacagaacaaa

SEQ ID NO: 3059959 - RNA, 17 nt, Human
aguggugcgaucugggu

SEQ ID NO: 3059960 - RNA, 16 nt, Human
aguggugcgaucuggg

SEQ ID NO: 3059961 - RNA, 16 nt, Human
uguuaaguauguguaa

SEQ ID NO: 3059962 - RNA, 15 nt, Human
uguuaaguaugugua

SEQ ID NO: 3059963 - RNA, 19 nt, Human
uguguuaaguauguguaaa

SEQ ID NO: 3059964 - RNA, 13 nt, Human
uguguugaagagg

SEQ ID NO: 3059965 - RNA, 19 nt, Human
uguguguuuauugucaaag

SEQ ID NO: 3059966 - RNA, 23 nt, Human
uguguguuuauugucaaaguggu

SEQ ID NO: 3059967 - RNA, 11 nt, Human
uguguguuuau

SEQ ID NO: 3059968 - RNA, 17 nt, Human
ugugucucuugguccug

SEQ ID NO: 3059969 - RNA, 20 nt, Human
ugugucucuugguccugcug

SEQ ID NO: 3059970 - RNA, 13 nt, Human
uguguaaguagau

SEQ ID NO: 3059971 - RNA, 21 nt, Human
ugugucucuugguccugcugc

SEQ ID NO: 3059972 - RNA, 20 nt, Human
ugugucuugcaauggcagcc

SEQ ID NO: 3059973 - RNA, 21 nt, Human
ugugucuugcaauggcagccu

SEQ ID NO: 3059974 - RNA, 16 nt, Human
ugugucucuugguccu

SEQ ID NO: 3059975 - RNA, 23 nt, Human
uguggguuucuaaagcugccagc

SEQ ID NO: 3059976 - RNA, 20 nt, Human
uguggucacaggaaguagag

SEQ ID NO: 3059977 - RNA, 21 nt, Human
uguggguuucuaaagcugcca

SEQ ID NO: 3059978 - RNA, 14 nt, Human
ugugguguuuccug

SEQ ID NO: 3059979 - RNA, 16 nt, Human
ugugguguuuccuggc

SEQ ID NO: 3059980 - RNA, 18 nt, Human
uguguaagacaaaaagcu

SEQ ID NO: 3059981 - RNA, 13 nt, Human
uguggucccaccc

SEQ ID NO: 3059982 - RNA, 15 nt, Human
uguggucccacccca

SEQ ID NO: 3059983 - RNA, 22 nt, Human
agugaguugauagcacagaccc

SEQ ID NO: 3059984 - RNA, 23 nt, Human
agugaguugauagcacagacccu

SEQ ID NO: 3059985 - RNA, 13 nt, Human
agugcugcauuua

SEQ ID NO: 3059986 - RNA, 12 nt, Human
agugcugcauuu

SEQ ID NO: 3059987 - RNA, 21 nt, Human
agugcugggauuacaggugug

SEQ ID NO: 3059988 - RNA, 17 nt, Human
agugcugcauuuaaaag

SEQ ID NO: 3059989 - RNA, 16 nt, Human
agugcugcauuuaaaa

SEQ ID NO: 3059990 - RNA, 19 nt, Human
agugcugcauuuaaaagau

SEQ ID NO: 3059991 - RNA, 20 nt, Human
agugcugggauuacaggugu

SEQ ID NO: 3059992 - RNA, 15 nt, Human
agugaaagaaaauaa

SEQ ID NO: 3059993 - RNA, 16 nt, Human
agugaacaaauuuaca

SEQ ID NO: 3059994 - RNA, 14 nt, Human
ugugauguauucua

SEQ ID NO: 3059995 - RNA, 19 nt, Human
ugugauggggcccugccuc

SEQ ID NO: 3059996 - RNA, 20 nt, Human
ugugauggggcccugccucc

SEQ ID NO: 3059997 - RNA, 18 nt, Human
ugugauggggcccugccu

SEQ ID NO: 3059998 - RNA, 18 nt, Human
ugugccagauuuaugcau

SEQ ID NO: 3059999 - RNA, 23 nt, Human
ugugcauuuggugguuucagaaa

SEQ ID NO: 3060000 - RNA, 20 nt, Human
ugugccagauuuaugcauau

SEQ ID NO: 3060001 - RNA, 20 nt, Human
ugugccagguuuuuggucug

SEQ ID NO: 3060002 - RNA, 16 nt, Human
ugugccaugugccagg

SEQ ID NO: 3060003 - RNA, 12 nt, Human
ugugccaugugc

SEQ ID NO: 3060004 - RNA, 21 nt, Human
uguggaguucaucuugaauug

SEQ ID NO: 3060005 - RNA, 17 nt, Human
uguggaguucaucuuga

SEQ ID NO: 3060006 - RNA, 21 nt, Human
ugugcccccauguaagcaccc

SEQ ID NO: 3060007 - RNA, 21 nt, Human
ugugcugcccugcccaccugg

SEQ ID NO: 3060008 - RNA, 15 nt, Human
agugaggcucugccc

SEQ ID NO: 3060009 - RNA, 14 nt, Human
agugaggcucugcc

SEQ ID NO: 3060010 - RNA, 16 nt, Human
agugaggcucugcccu

SEQ ID NO: 3060011 - RNA, 17 nt, Human
agugaggcucugcccuu

SEQ ID NO: 3060012 - RNA, 19 nt, Human
agugaggcucugcccuugg

SEQ ID NO: 3060013 - RNA, 20 nt, Human
agugaggcucugcccuuggu

SEQ ID NO: 3060014 - RNA, 21 nt, Human
agugaggcucugcccuugguu

SEQ ID NO: 3060015 - RNA, 21 nt, Human
agugaguugauagcacagacc

SEQ ID NO: 3060016 - RNA, 15 nt, Human
agugagucgaggaca

SEQ ID NO: 3060017 - RNA, 18 nt, Human
agucacuaccuucaugca

SEQ ID NO: 3060018 - RNA, 12 nt, Human
ugugaaauuauu

SEQ ID NO: 3060019 - RNA, 18 nt, Human
ugugaaaggaaagaggcu

SEQ ID NO: 3060020 - RNA, 21 nt, Human
ugugaaaggaaagagggaggu

SEQ ID NO: 3060021 - RNA, 15 nt, Human
ugugaaaggaaagag

SEQ ID NO: 3060022 - RNA, 20 nt, Human
ugugaacaguuguguuugaa

SEQ ID NO: 3060023 - RNA, 19 nt, Human
ugugaaccaccacacccag

SEQ ID NO: 3060024 - RNA, 21 nt, Human
ugugaaccaccacacccagcc

SEQ ID NO: 3060025 - RNA, 20 nt, Human
ugugaaccaccacacccagc

SEQ ID NO: 3060026 - RNA, 17 nt, Human
ugugaaccaccacaccc

SEQ ID NO: 3060027 - RNA, 18 nt, Human
agucuuucacauuuaaau

SEQ ID NO: 3060028 - RNA, 14 nt, Human
agucuuuguacaga

SEQ ID NO: 3060029 - RNA, 20 nt, Human
agugaaacucguuaauuugu

SEQ ID NO: 3060030 - RNA, 23 nt, Human
agucuuagauguauauauuuccu

SEQ ID NO: 3060031 - RNA, 15 nt, Human
ugugacugaauuucu

SEQ ID NO: 3060032 - RNA, 16 nt, Human
ugugacugaauuucuu

SEQ ID NO: 3060033 - RNA, 15 nt, Human
ugugagaugcuagaa

SEQ ID NO: 3060034 - RNA, 19 nt, Human
ugugagaugcuagaacucc

SEQ ID NO: 3060035 - RNA, 22 nt, Human
agucucaggaaaucaaauaugc

SEQ ID NO: 3060036 - RNA, 16 nt, Human
agucucaggaaaucaa

SEQ ID NO: 3060037 - RNA, 22 nt, Human
auaaaagggacugagaaauuua

SEQ ID NO: 3060038 - RNA, 15 nt, Human
auaaaauaauuuuua

SEQ ID NO: 3060039 - RNA, 16 nt, Human
auaaaauaauuuuuau

SEQ ID NO: 3060040 - RNA, 21 nt, Human
auaaaauaauuuuuauauuug

SEQ ID NO: 3060041 - RNA, 18 nt, Human
auaaaauccauacauuug

SEQ ID NO: 3060042 - RNA, 19 nt, Human
auaaaauccauacauuugu

SEQ ID NO: 3060043 - RNA, 18 nt, Human
uuaaguaaggaauuuuau

SEQ ID NO: 3060044 - RNA, 16 nt, Human
uuaagaggcagggucu

SEQ ID NO: 3060045 - RNA, 15 nt, Human
uuaagaggcaggguc

SEQ ID NO: 3060046 - RNA, 13 nt, Human
uuaagaggcaggg

SEQ ID NO: 3060047 - RNA, 20 nt, Human
uuaagaagacugcauuauau

SEQ ID NO: 3060048 - RNA, 22 nt, Human
uuaagaagacugcauuauauuu

SEQ ID NO: 3060049 - RNA, 17 nt, Human
uuaaguacuauguauca

SEQ ID NO: 3060050 - RNA, 18 nt, Human
uuaaguaaugauaacugg

SEQ ID NO: 3060051 - RNA, 22 nt, Human
uuaagugcugcauuuaaaagau

SEQ ID NO: 3060052 - RNA, 20 nt, Human
auaaaauuuuuaaucuuuaa

SEQ ID NO: 3060053 - RNA, 22 nt, Human
auaaacaagaccacguuucuaa

SEQ ID NO: 3060054 - RNA, 15 nt, Human
auaaacaagaccacg

SEQ ID NO: 3060055 - RNA, 23 nt, Human
auaaacaagaccacguuucuaaa

SEQ ID NO: 3060056 - RNA, 19 nt, Human
uuaauuuuuuugagacaga

SEQ ID NO: 3060057 - RNA, 17 nt, Human
uuaauuccaauuauaug

SEQ ID NO: 3060058 - RNA, 15 nt, Human
uuaauucuuagcuca

SEQ ID NO: 3060059 - RNA, 13 nt, Human
uuaauaaacacuc

SEQ ID NO: 3060060 - RNA, 17 nt, Human
uuaauaaacacucuuga

SEQ ID NO: 3060061 - RNA, 20 nt, Human
uuaaugaaagacuguacaaa

SEQ ID NO: 3060062 - RNA, 23 nt, Human
uuaaugaaagacuguacaaagua

SEQ ID NO: 3060063 - RNA, 11 nt, Human
uuagacagagu

SEQ ID NO: 3060064 - RNA, 14 nt, Human
uuagaaauauaauu

SEQ ID NO: 3060065 - RNA, 12 nt, Human
uuagaaauauaa

SEQ ID NO: 3060066 - RNA, 11 nt, Human
uuagaaauaua

SEQ ID NO: 3060067 - RNA, 15 nt, Human
uuacuguaagaaaau

SEQ ID NO: 3060068 - RNA, 23 nt, Human
uuacucagaauucucuaguuuga

SEQ ID NO: 3060069 - RNA, 18 nt, Human
uuacucagaauucucuag

SEQ ID NO: 3060070 - RNA, 19 nt, Human
uuacuauggcccuggccua

SEQ ID NO: 3060071 - RNA, 20 nt, Human
uuacauaagauaaaugugcu

SEQ ID NO: 3060072 - RNA, 14 nt, Human
uuaccuuacagaag

SEQ ID NO: 3060073 - RNA, 12 nt, Human
uuaccugggaaa

SEQ ID NO: 3060074 - RNA, 14 nt, Human
uuacaggaaguacu

SEQ ID NO: 3060075 - RNA, 16 nt, Human
auaacuaaaagguaug

SEQ ID NO: 3060076 - RNA, 19 nt, Human
uguugccuugcauaauggu

SEQ ID NO: 3060077 - RNA, 19 nt, Human
uguugcccaggcaggucuu

SEQ ID NO: 3060078 - RNA, 17 nt, Human
uguuuauugucaaagug

SEQ ID NO: 3060079 - RNA, 19 nt, Human
uguuuauugucaaaguggu

SEQ ID NO: 3060080 - RNA, 24 nt, Human
uguuuauuuauagaguguacuuaa

SEQ ID NO: 3060081 - RNA, 14 nt, Human
uguuuauuuauaga

SEQ ID NO: 3060082 - RNA, 19 nt, Human
uguuucuuuguaaugaaaa

SEQ ID NO: 3060083 - RNA, 18 nt, Human
uguuucuuuguaaugaaa

SEQ ID NO: 3060084 - RNA, 17 nt, Human
uguuugauucagacagc

SEQ ID NO: 3060085 - RNA, 22 nt, Human
uguuugauucagacagcugccu

SEQ ID NO: 3060086 - RNA, 19 nt, Human
uguuuugaaucucauaauu

SEQ ID NO: 3060087 - RNA, 20 nt, Human
uguuuuccaugaguccccug

SEQ ID NO: 3060088 - RNA, 19 nt, Human
uguuuucauuaucucaaaa

SEQ ID NO: 3060089 - RNA, 21 nt, Human
uguuuuauuuuaauucaguug

SEQ ID NO: 3060090 - RNA, 17 nt, Human
uguuuucaguguacaug

SEQ ID NO: 3060091 - RNA, 21 nt, Human
uguuuuauuuaaccucuaaau

SEQ ID NO: 3060092 - RNA, 14 nt, Human
aguucugguuccua

SEQ ID NO: 3060093 - RNA, 21 nt, Human
aguucugcagauaaacaguag

SEQ ID NO: 3060094 - RNA, 16 nt, Human
aguucugcagauaaac

SEQ ID NO: 3060095 - RNA, 16 nt, Human
aguucugaagaagaug

SEQ ID NO: 3060096 - RNA, 14 nt, Human
uguuuugcaagcca

SEQ ID NO: 3060097 - RNA, 20 nt, Human
uuaaagcuuccauuguuguc

SEQ ID NO: 3060098 - RNA, 20 nt, Human
uuaaauucuugcaaaguauc

SEQ ID NO: 3060099 - RNA, 16 nt, Human
aguuuagcuggaaaag

SEQ ID NO: 3060100 - RNA, 21 nt, Human
aguuguuugauucagacagcu

SEQ ID NO: 3060101 - RNA, 23 nt, Human
aguuguuugauucagacagcugc

SEQ ID NO: 3060102 - RNA, 18 nt, Human
aguuggucccccuuccau

SEQ ID NO: 3060103 - RNA, 21 nt, Human
aguuggguggaugccuggugg

SEQ ID NO: 3060104 - RNA, 17 nt, Human
aguuggguggaugccug

SEQ ID NO: 3060105 - RNA, 16 nt, Human
aguuggcuaggacccc

SEQ ID NO: 3060106 - RNA, 18 nt, Human
ugggucgcccuggacugu

SEQ ID NO: 3060107 - RNA, 16 nt, Human
ugggucgcccuggacu

SEQ ID NO: 3060108 - RNA, 15 nt, Human
agggugggagugggc

SEQ ID NO: 3060109 - RNA, 16 nt, Human
aggguggugaccucug

SEQ ID NO: 3060110 - RNA, 20 nt, Human
ugguagagugugccugaagu

SEQ ID NO: 3060111 - RNA, 17 nt, Human
uggguggcaccagcagc

SEQ ID NO: 3060112 - RNA, 20 nt, Human
uggguggcaccagcagccug

SEQ ID NO: 3060113 - RNA, 21 nt, Human
uggguggcaccagcagccugg

SEQ ID NO: 3060114 - RNA, 17 nt, Human
agggggccuggaugccc

SEQ ID NO: 3060115 - RNA, 15 nt, Human
agggggccuggaugc

SEQ ID NO: 3060116 - RNA, 14 nt, Human
agggggcugcuccc

SEQ ID NO: 3060117 - RNA, 15 nt, Human
agggggcugcuccca

SEQ ID NO: 3060118 - RNA, 16 nt, Human
agggggcugcucccac

SEQ ID NO: 3060119 - RNA, 19 nt, Human
agggggcugcucccaccug

SEQ ID NO: 3060120 - RNA, 22 nt, Human
agggggcugcucccaccuggcu

SEQ ID NO: 3060121 - RNA, 20 nt, Human
aggggaauguuugccucugc

SEQ ID NO: 3060122 - RNA, 19 nt, Human
aggggaauguuugccucug

SEQ ID NO: 3060123 - RNA, 21 nt, Human
aggggaauguuugccucugcc

SEQ ID NO: 3060124 - RNA, 18 nt, Human
aggggagcaugggaagug

SEQ ID NO: 3060125 - RNA, 16 nt, Human
agggucucacucuguc

SEQ ID NO: 3060126 - RNA, 15 nt, Human
agggucucacucugu

SEQ ID NO: 3060127 - RNA, 14 nt, Human
agggucucacucug

SEQ ID NO: 3060128 - RNA, 15 nt, Human
aggguaaggcugugg

SEQ ID NO: 3060129 - RNA, 20 nt, Human
aggggguggccucccaacuc

SEQ ID NO: 3060130 - RNA, 12 nt, Human
uggggcucccag

SEQ ID NO: 3060131 - RNA, 13 nt, Human
uggggcucccagc

SEQ ID NO: 3060132 - RNA, 15 nt, Human
uggggcucccagcca

SEQ ID NO: 3060133 - RNA, 18 nt, Human
uggggcucccagccaggc

SEQ ID NO: 3060134 - RNA, 22 nt, Human
uggggcugcaccggcuggccug

SEQ ID NO: 3060135 - RNA, 23 nt, Human
uggggcugcaccggcuggccugg

SEQ ID NO: 3060136 - RNA, 19 nt, Human
uggggcucccagccaggcc

SEQ ID NO: 3060137 - RNA, 20 nt, Human
uggggcucccagccaggccc

SEQ ID NO: 3060138 - RNA, 21 nt, Human
uggggcucccagccaggcccu

SEQ ID NO: 3060139 - RNA, 23 nt, Human
uggggcucccagccaggcccuug

SEQ ID NO: 3060140 - RNA, 21 nt, Human
uggggccaguuggucccccuu

SEQ ID NO: 3060141 - RNA, 12 nt, Human
uggggcccugcc

SEQ ID NO: 3060142 - RNA, 16 nt, Human
uggggaccucaggccu

SEQ ID NO: 3060143 - RNA, 17 nt, Human
uggggaccucaggccug

SEQ ID NO: 3060144 - RNA, 12 nt, Human
agggcuccagac

SEQ ID NO: 3060145 - RNA, 14 nt, Human
uggggaccucaggc

SEQ ID NO: 3060146 - RNA, 15 nt, Human
uggggaccucaggcc

SEQ ID NO: 3060147 - RNA, 22 nt, Human
uggggucacucuggcagcucag

SEQ ID NO: 3060148 - RNA, 16 nt, Human
uggggucacucuggca

SEQ ID NO: 3060149 - RNA, 20 nt, Human
uggggucacucuggcagcuc

SEQ ID NO: 3060150 - RNA, 13 nt, Human
uggggucacucug

SEQ ID NO: 3060151 - RNA, 14 nt, Human
uggggucacucugg

SEQ ID NO: 3060152 - RNA, 15 nt, Human
ugggguaugggagag

SEQ ID NO: 3060153 - RNA, 19 nt, Human
ugggguacccacugcucug

SEQ ID NO: 3060154 - RNA, 18 nt, Human
ugggguacccacugcucu

SEQ ID NO: 3060155 - RNA, 17 nt, Human
ugggguacccacugcuc

SEQ ID NO: 3060156 - RNA, 13 nt, Human
aggggaauguuug

SEQ ID NO: 3060157 - RNA, 18 nt, Human
aggggaaaaucagccugc

SEQ ID NO: 3060158 - RNA, 22 nt, Human
aggggaaaaucagccugcucca

SEQ ID NO: 3060159 - RNA, 14 nt, Human
aggggaacagacug

SEQ ID NO: 3060160 - RNA, 13 nt, Human
aggggaaaagagg

SEQ ID NO: 3060161 - RNA, 19 nt, Human
ugggccccugccucucugc

SEQ ID NO: 3060162 - RNA, 15 nt, Human
ugggccccugccucu

SEQ ID NO: 3060163 - RNA, 15 nt, Human
agggagggagggcuc

SEQ ID NO: 3060164 - RNA, 13 nt, Human
agggagggcucca

SEQ ID NO: 3060165 - RNA, 21 nt, Human
ugggcccccaaauggaaaugg

SEQ ID NO: 3060166 - RNA, 16 nt, Human
ugggcccccaaaugga

SEQ ID NO: 3060167 - RNA, 11 nt, Human
ugggcagagca

SEQ ID NO: 3060168 - RNA, 12 nt, Human
ugggcagagcag

SEQ ID NO: 3060169 - RNA, 18 nt, Human
ugggccaggagccuccug

SEQ ID NO: 3060170 - RNA, 12 nt, Human
ugggcagaagga

SEQ ID NO: 3060171 - RNA, 23 nt, Human
ugggcagaaggaagacuucaucc

SEQ ID NO: 3060172 - RNA, 20 nt, Human
ugggaggaucucuugagccu

SEQ ID NO: 3060173 - RNA, 21 nt, Human
ugggaggaucucuugagccug

SEQ ID NO: 3060174 - RNA, 19 nt, Human
ugggaggccaaggugggag

SEQ ID NO: 3060175 - RNA, 20 nt, Human
ugggaggccaaggugggagg

SEQ ID NO: 3060176 - RNA, 14 nt, Human
agggagggcuccag

SEQ ID NO: 3060177 - RNA, 15 nt, Human
agggagggcuccaga

SEQ ID NO: 3060178 - RNA, 16 nt, Human
agggagggcuccagac

SEQ ID NO: 3060179 - RNA, 23 nt, Human
agggcucagcggggacagcuccu

SEQ ID NO: 3060180 - RNA, 22 nt, Human
agggcucagcggggacagcucc

SEQ ID NO: 3060181 - RNA, 20 nt, Human
agggcucagcggggacagcu

SEQ ID NO: 3060182 - RNA, 19 nt, Human
agggcucagcggggacagc

SEQ ID NO: 3060183 - RNA, 22 nt, Human
ugggagaaccaaaaagaggcua

SEQ ID NO: 3060184 - RNA, 18 nt, Human
ugggacucaaugcacuga

SEQ ID NO: 3060185 - RNA, 20 nt, Human
ugggacucaaugcacugaca

SEQ ID NO: 3060186 - RNA, 19 nt, Human
ugggagagaagagaaugca

SEQ ID NO: 3060187 - RNA, 21 nt, Human
ugggagagaagagaaugcaca

SEQ ID NO: 3060188 - RNA, 18 nt, Human
ugggaggaucucuugagc

SEQ ID NO: 3060189 - RNA, 16 nt, Human
ugggagagccuuccag

SEQ ID NO: 3060190 - RNA, 16 nt, Human
ugggacuacaggcacc

SEQ ID NO: 3060191 - RNA, 15 nt, Human
ugggacuacaggcac

SEQ ID NO: 3060192 - RNA, 14 nt, Human
ugggacuacaggca

SEQ ID NO: 3060193 - RNA, 23 nt, Human
agggaggacgcucucuggccuuc

SEQ ID NO: 3060194 - RNA, 21 nt, Human
agggaggacgcucucuggccu

SEQ ID NO: 3060195 - RNA, 22 nt, Human
agggaggacgcucucuggccuu

SEQ ID NO: 3060196 - RNA, 13 nt, Human
agggaaauuucag

SEQ ID NO: 3060197 - RNA, 20 nt, Human
aggcccggcuccaggcuccu

SEQ ID NO: 3060198 - RNA, 18 nt, Human
aggcccggcuccaggcuc

SEQ ID NO: 3060199 - RNA, 21 nt, Human
aggcccggcuccaggcuccuu

SEQ ID NO: 3060200 - RNA, 22 nt, Human
agggaaggauacaaaagcaugu

SEQ ID NO: 3060201 - RNA, 20 nt, Human
aggugcauauuuauaaaaau

SEQ ID NO: 3060202 - RNA, 20 nt, Human
aggugauccacccaccucag

SEQ ID NO: 3060203 - RNA, 14 nt, Human
aggugauccaccca

SEQ ID NO: 3060204 - RNA, 16 nt, Human
aggugggauccuccag

SEQ ID NO: 3060205 - RNA, 17 nt, Human
aggugggauccuccagg

SEQ ID NO: 3060206 - RNA, 23 nt, Human
agguggggcagcuugaggguugg

SEQ ID NO: 3060207 - RNA, 16 nt, Human
agguggggcagcuuga

SEQ ID NO: 3060208 - RNA, 18 nt, Human
aggugccucaagagaagg

SEQ ID NO: 3060209 - RNA, 15 nt, Human
aggugggauccucca

SEQ ID NO: 3060210 - RNA, 20 nt, Human
aggugugcucugaucaucca

SEQ ID NO: 3060211 - RNA, 15 nt, Human
aggugugcucugauc

SEQ ID NO: 3060212 - RNA, 17 nt, Human
aggugugaaccaccaca

SEQ ID NO: 3060213 - RNA, 19 nt, Human
agguggggucacucuggca

SEQ ID NO: 3060214 - RNA, 20 nt, Human
aggugucccugcacuugcag

SEQ ID NO: 3060215 - RNA, 14 nt, Human
agguuuaagcuguu

SEQ ID NO: 3060216 - RNA, 12 nt, Human
aggugugcucug

SEQ ID NO: 3060217 - RNA, 16 nt, Human
uguaaauaguauuuga

SEQ ID NO: 3060218 - RNA, 16 nt, Human
uguaaauagcucaggu

SEQ ID NO: 3060219 - RNA, 15 nt, Human
uguaaauagcucagg

SEQ ID NO: 3060220 - RNA, 16 nt, Human
uguaaaggaauuuaaa

SEQ ID NO: 3060221 - RNA, 17 nt, Human
ugguuuucaaaauaaaa

SEQ ID NO: 3060222 - RNA, 15 nt, Human
ugguuuucaaaauaa

SEQ ID NO: 3060223 - RNA, 14 nt, Human
ugguuuucaaaaua

SEQ ID NO: 3060224 - RNA, 15 nt, Human
ugguuuguaaauuaa

SEQ ID NO: 3060225 - RNA, 15 nt, Human
uggucagauuugaac

SEQ ID NO: 3060226 - RNA, 16 nt, Human
uggucagauuugaacu

SEQ ID NO: 3060227 - RNA, 13 nt, Human
aggucagagccug

SEQ ID NO: 3060228 - RNA, 18 nt, Human
aggucagagccugcaguu

SEQ ID NO: 3060229 - RNA, 17 nt, Human
aggucagagccugcagu

SEQ ID NO: 3060230 - RNA, 15 nt, Human
aggucagagccugca

SEQ ID NO: 3060231 - RNA, 14 nt, Human
aggucagagccugc

SEQ ID NO: 3060232 - RNA, 16 nt, Human
aggucuugaacuccug

SEQ ID NO: 3060233 - RNA, 16 nt, Human
aggugagaagcagagg

SEQ ID NO: 3060234 - RNA, 21 nt, Human
aggugagaagcagaggaagga

SEQ ID NO: 3060235 - RNA, 23 nt, Human
aggugagaagcagaggaaggaga

SEQ ID NO: 3060236 - RNA, 15 nt, Human
aggugacagagugag

SEQ ID NO: 3060237 - RNA, 13 nt, Human
aggugacagagug

SEQ ID NO: 3060238 - RNA, 17 nt, Human
aggucuugaacuccugg

SEQ ID NO: 3060239 - RNA, 13 nt, Human
aggugaccccagg

SEQ ID NO: 3060240 - RNA, 22 nt, Human
aggugacagagugagacucugu

SEQ ID NO: 3060241 - RNA, 17 nt, Human
uggugcgaucuggguuc

SEQ ID NO: 3060242 - RNA, 16 nt, Human
uggugcgaucuggguu

SEQ ID NO: 3060243 - RNA, 19 nt, Human
uggugucgggcaugacacg

SEQ ID NO: 3060244 - RNA, 15 nt, Human
ugguggcagcugcgg

SEQ ID NO: 3060245 - RNA, 13 nt, Human
ugguggcagcugc

SEQ ID NO: 3060246 - RNA, 14 nt, Human
ugguggcagcugcg

SEQ ID NO: 3060247 - RNA, 18 nt, Human
ugguuaggcauuguggga

SEQ ID NO: 3060248 - RNA, 20 nt, Human
ugguuaggcauugugggaag

SEQ ID NO: 3060249 - RNA, 20 nt, Human
uguauucuagcuaauguaau

SEQ ID NO: 3060250 - RNA, 22 nt, Human
uguauuacaaauccaaugaaau

SEQ ID NO: 3060251 - RNA, 13 nt, Human
uguauuacaaauc

SEQ ID NO: 3060252 - RNA, 22 nt, Human
uguauucuagcuaauguaauaa

SEQ ID NO: 3060253 - RNA, 16 nt, Human
uguauuuuuuuacuaa

SEQ ID NO: 3060254 - RNA, 20 nt, Human
uguauucucuccuguaccuc

SEQ ID NO: 3060255 - RNA, 19 nt, Human
uguauucucuccuguaccu

SEQ ID NO: 3060256 - RNA, 17 nt, Human
uguaucaaugaguaaca

SEQ ID NO: 3060257 - RNA, 18 nt, Human
uguaucacaaaucuuaac

SEQ ID NO: 3060258 - RNA, 15 nt, Human
uguaucacaaaucuu

SEQ ID NO: 3060259 - RNA, 14 nt, Human
uguaguguuggaga

SEQ ID NO: 3060260 - RNA, 15 nt, Human
uguaguguuggagaa

SEQ ID NO: 3060261 - RNA, 16 nt, Human
aguaguaauagagcaa

SEQ ID NO: 3060262 - RNA, 17 nt, Human
ugucaauuacaggaagu

SEQ ID NO: 3060263 - RNA, 14 nt, Human
ugucaauuacagga

SEQ ID NO: 3060264 - RNA, 15 nt, Human
ugucaauuacaggaa

SEQ ID NO: 3060265 - RNA, 16 nt, Human
aguaugguggcugggu

SEQ ID NO: 3060266 - RNA, 15 nt, Human
aguaugguggcuggg

SEQ ID NO: 3060267 - RNA, 18 nt, Human
aguauuacuucugcuaca

SEQ ID NO: 3060268 - RNA, 18 nt, Human
aguauuagaauaccacag

SEQ ID NO: 3060269 - RNA, 17 nt, Human
aguaugguggcuggguu

SEQ ID NO: 3060270 - RNA, 15 nt, Human
aguauuacuucugcu

SEQ ID NO: 3060271 - RNA, 23 nt, Human
agucacacagugagucgaggaca

SEQ ID NO: 3060272 - RNA, 15 nt, Human
agucacacagugagu

SEQ ID NO: 3060273 - RNA, 19 nt, Human
agucaccccggccaccugc

SEQ ID NO: 3060274 - RNA, 17 nt, Human
agucaccucauggaauu

SEQ ID NO: 3060275 - RNA, 14 nt, Human
agucaccucaugga

SEQ ID NO: 3060276 - RNA, 15 nt, Human
agucaccucauggaa

SEQ ID NO: 3060277 - RNA, 23 nt, Human
agucacacaguauuacuucugcu

SEQ ID NO: 3060278 - RNA, 18 nt, Human
aguauuucuaugaaauau

SEQ ID NO: 3060279 - RNA, 17 nt, Human
aguauuucuaugaaaua

SEQ ID NO: 3060280 - RNA, 16 nt, Human
aguauuucuaugaaau

SEQ ID NO: 3060281 - RNA, 14 nt, Human
aguaugguggcugg

SEQ ID NO: 3060282 - RNA, 15 nt, Human
aguaauucaagaaaa

SEQ ID NO: 3060283 - RNA, 16 nt, Human
aguacauuuggagaca

SEQ ID NO: 3060284 - RNA, 20 nt, Human
aguagaagucuuagauguau

SEQ ID NO: 3060285 - RNA, 19 nt, Human
aguagaagucuuagaugua

SEQ ID NO: 3060286 - RNA, 21 nt, Human
aguagaagucuuagauguaua

SEQ ID NO: 3060287 - RNA, 17 nt, Human
aguagaagucuuagaug

SEQ ID NO: 3060288 - RNA, 17 nt, Human
uguaggcauaaagucag

SEQ ID NO: 3060289 - RNA, 20 nt, Human
uguaggcauaaagucagggg

SEQ ID NO: 3060290 - RNA, 11 nt, Human
aguagagacag

SEQ ID NO: 3060291 - RNA, 23 nt, Human
uguacuugcucuugaugccuggc

SEQ ID NO: 3060292 - RNA, 22 nt, Human
uguacuugcucuugaugccugg

SEQ ID NO: 3060293 - RNA, 19 nt, Human
uguacuugcucuugaugcc

SEQ ID NO: 3060294 - RNA, 18 nt, Human
uguagagccagggucuca

SEQ ID NO: 3060295 - RNA, 16 nt, Human
uguagagccagggucu

SEQ ID NO: 3060296 - RNA, 14 nt, Human
aguaauagagcaaa

SEQ ID NO: 3060297 - RNA, 15 nt, Human
aguaauaugcacaca

SEQ ID NO: 3060298 - RNA, 14 nt, Human
aguaauaugcacac

SEQ ID NO: 3060299 - RNA, 13 nt, Human
aguaaugauaacu

SEQ ID NO: 3060300 - RNA, 17 nt, Human
aguaaugauaacuggaa

SEQ ID NO: 3060301 - RNA, 18 nt, Human
aguaaugauaacuggaaa

SEQ ID NO: 3060302 - RNA, 20 nt, Human
aguaaugauaacuggaaacu

SEQ ID NO: 3060303 - RNA, 13 nt, Human
aguaaaauccaca

SEQ ID NO: 3060304 - RNA, 20 nt, Human
aguaaaaccacagcaguuga

SEQ ID NO: 3060305 - RNA, 16 nt, Human
ugcuuuuuauggccug

SEQ ID NO: 3060306 - RNA, 16 nt, Human
uggaagacagcucuua

SEQ ID NO: 3060307 - RNA, 15 nt, Human
uggaagacagcucuu

SEQ ID NO: 3060308 - RNA, 23 nt, Human
uggaaauuuguuauaaugaauga

SEQ ID NO: 3060309 - RNA, 21 nt, Human
uggaaauuuguuauaaugaau

SEQ ID NO: 3060310 - RNA, 18 nt, Human
ugcuuuuggucuguguga

SEQ ID NO: 3060311 - RNA, 23 nt, Human
ugcuuuuuaauauugauaugcuu

SEQ ID NO: 3060312 - RNA, 20 nt, Human
ugcuuuugucuaugggacuc

SEQ ID NO: 3060313 - RNA, 22 nt, Human
ugcuuugugauuuuuguaauuu

SEQ ID NO: 3060314 - RNA, 17 nt, Human
ugcuuugugauuuuugu

SEQ ID NO: 3060315 - RNA, 15 nt, Human
ugcuugagcucagga

SEQ ID NO: 3060316 - RNA, 13 nt, Human
aggaucagucuga

SEQ ID NO: 3060317 - RNA, 19 nt, Human
aggauucuuccucccuccc

SEQ ID NO: 3060318 - RNA, 17 nt, Human
aggauucuuccucccuc

SEQ ID NO: 3060319 - RNA, 22 nt, Human
aggaugaucuaggaagacuuug

SEQ ID NO: 3060320 - RNA, 23 nt, Human
aggaugaucuaggaagacuuugg

SEQ ID NO: 3060321 - RNA, 22 nt, Human
aggaugcacagaguuguuacau

SEQ ID NO: 3060322 - RNA, 16 nt, Human
aggauucuuccucccu

SEQ ID NO: 3060323 - RNA, 16 nt, Human
uggaagcacagcuuca

SEQ ID NO: 3060324 - RNA, 17 nt, Human
aggagaguagaacagau

SEQ ID NO: 3060325 - RNA, 12 nt, Human
aggagcagccac

SEQ ID NO: 3060326 - RNA, 13 nt, Human
aggagcagccaca

SEQ ID NO: 3060327 - RNA, 23 nt, Human
aggagcccugggaggcucuggag

SEQ ID NO: 3060328 - RNA, 17 nt, Human
aggagccccgaggccuu

SEQ ID NO: 3060329 - RNA, 16 nt, Human
aggagccuccugcccu

SEQ ID NO: 3060330 - RNA, 22 nt, Human
aggacuuuucuuuguggcuucc

SEQ ID NO: 3060331 - RNA, 17 nt, Human
aggagaaacuggaacuc

SEQ ID NO: 3060332 - RNA, 18 nt, Human
aggagaaacuggaacucu

SEQ ID NO: 3060333 - RNA, 19 nt, Human
aggagaaacuggaacucuc

SEQ ID NO: 3060334 - RNA, 19 nt, Human
aggacuuuucuuuguggcu

SEQ ID NO: 3060335 - RNA, 17 nt, Human
aggacuuuucuuugugg

SEQ ID NO: 3060336 - RNA, 13 nt, Human
aggacgcucucug

SEQ ID NO: 3060337 - RNA, 14 nt, Human
aggacgcucucugg

SEQ ID NO: 3060338 - RNA, 16 nt, Human
aggacgcucucuggcc

SEQ ID NO: 3060339 - RNA, 17 nt, Human
aggacgcucucuggccu

SEQ ID NO: 3060340 - RNA, 19 nt, Human
aggacgcucucuggccuuc

SEQ ID NO: 3060341 - RNA, 20 nt, Human
aggacgcucucuggccuucg

SEQ ID NO: 3060342 - RNA, 14 nt, Human
uggaguugaaaauc

SEQ ID NO: 3060343 - RNA, 14 nt, Human
uggagugcagugag

SEQ ID NO: 3060344 - RNA, 16 nt, Human
aggcauuugcugaaua

SEQ ID NO: 3060345 - RNA, 20 nt, Human
aggcauuugcugaauacaga

SEQ ID NO: 3060346 - RNA, 20 nt, Human
uggagguacgaaaagagggg

SEQ ID NO: 3060347 - RNA, 21 nt, Human
uggcacaucagcacgauuucu

SEQ ID NO: 3060348 - RNA, 23 nt, Human
uggcacaucagcacgauuucugu

SEQ ID NO: 3060349 - RNA, 23 nt, Human
uggaugccugguggcagcugcgg

SEQ ID NO: 3060350 - RNA, 21 nt, Human
uggaugccugguggcagcugc

SEQ ID NO: 3060351 - RNA, 20 nt, Human
uggaugccugguggcagcug

SEQ ID NO: 3060352 - RNA, 14 nt, Human
aggccccgcccagg

SEQ ID NO: 3060353 - RNA, 15 nt, Human
aggcccccaggugcc

SEQ ID NO: 3060354 - RNA, 17 nt, Human
aggcccggcuccaggcu

SEQ ID NO: 3060355 - RNA, 13 nt, Human
aggcccggcucca

SEQ ID NO: 3060356 - RNA, 13 nt, Human
aggcccagagggc

SEQ ID NO: 3060357 - RNA, 13 nt, Human
aggccagccuuga

SEQ ID NO: 3060358 - RNA, 15 nt, Human
aggccagccuugacc

SEQ ID NO: 3060359 - RNA, 23 nt, Human
uggcagcucaccucucccuugga

SEQ ID NO: 3060360 - RNA, 21 nt, Human
uggcagcucaccucucccuug

SEQ ID NO: 3060361 - RNA, 22 nt, Human
uggcagcucaccucucccuugg

SEQ ID NO: 3060362 - RNA, 20 nt, Human
uggcacccggccccugcugg

SEQ ID NO: 3060363 - RNA, 19 nt, Human
uggcacccggccccugcug

SEQ ID NO: 3060364 - RNA, 18 nt, Human
uggcacccggccccugcu

SEQ ID NO: 3060365 - RNA, 16 nt, Human
uggcacccggccccug

SEQ ID NO: 3060366 - RNA, 15 nt, Human
uggagcaaagcugau

SEQ ID NO: 3060367 - RNA, 18 nt, Human
aggauugcuacuguccua

SEQ ID NO: 3060368 - RNA, 17 nt, Human
aggauugcuacuguccu

SEQ ID NO: 3060369 - RNA, 15 nt, Human
aggauugcuacuguc

SEQ ID NO: 3060370 - RNA, 14 nt, Human
uggagaaaauggac

SEQ ID NO: 3060371 - RNA, 17 nt, Human
aggcaagcaccuccugc

SEQ ID NO: 3060372 - RNA, 17 nt, Human
uggagcucguggaacag

SEQ ID NO: 3060373 - RNA, 21 nt, Human
uggagcucguggaacaguuac

SEQ ID NO: 3060374 - RNA, 20 nt, Human
aggcaagcaccuccugccuc

SEQ ID NO: 3060375 - RNA, 14 nt, Human
uggagcucguggaa

SEQ ID NO: 3060376 - RNA, 19 nt, Human
aggcaagcaccuccugccu

SEQ ID NO: 3060377 - RNA, 18 nt, Human
aggcaagcaccuccugcc

SEQ ID NO: 3060378 - RNA, 17 nt, Human
aggcaaggcugucaauu

SEQ ID NO: 3060379 - RNA, 16 nt, Human
aggcaaggcugucaau

SEQ ID NO: 3060380 - RNA, 20 nt, Human
aggcagcucuaaaugucaau

SEQ ID NO: 3060381 - RNA, 15 nt, Human
aggcagcuugaaacu

SEQ ID NO: 3060382 - RNA, 22 nt, Human
aggcauaaagucagggguuccc

SEQ ID NO: 3060383 - RNA, 18 nt, Human
aggcauugugggaagggg

SEQ ID NO: 3060384 - RNA, 20 nt, Human
aggcauuuaggccaugggac

SEQ ID NO: 3060385 - RNA, 17 nt, Human
aggcaggugggauggau

SEQ ID NO: 3060386 - RNA, 15 nt, Human
aggcauaaagucagg

SEQ ID NO: 3060387 - RNA, 12 nt, Human
aggcagggucuc

SEQ ID NO: 3060388 - RNA, 22 nt, Human
aggcaggucuugaacuccuggc

SEQ ID NO: 3060389 - RNA, 21 nt, Human
ugccugcuuuuuauggccugu

SEQ ID NO: 3060390 - RNA, 20 nt, Human
ugccugcuuuuuauggccug

SEQ ID NO: 3060391 - RNA, 22 nt, Human
ugccugcuuuuuauggccugug

SEQ ID NO: 3060392 - RNA, 23 nt, Human
ugccugcccaggccccugccacc

SEQ ID NO: 3060393 - RNA, 22 nt, Human
ugccugcccaggccccugccac

SEQ ID NO: 3060394 - RNA, 20 nt, Human
ugccugcccaggccccugcc

SEQ ID NO: 3060395 - RNA, 17 nt, Human
ugccucugccucugaca

SEQ ID NO: 3060396 - RNA, 20 nt, Human
ugccucugccucugacacac

SEQ ID NO: 3060397 - RNA, 18 nt, Human
ugccucugccucugacac

SEQ ID NO: 3060398 - RNA, 14 nt, Human
ugccucagccuccc

SEQ ID NO: 3060399 - RNA, 16 nt, Human
ugccuggauggggcug

SEQ ID NO: 3060400 - RNA, 17 nt, Human
ugccuggauggggcugc

SEQ ID NO: 3060401 - RNA, 20 nt, Human
ugccuggauggggcugcacc

SEQ ID NO: 3060402 - RNA, 16 nt, Human
agcugccuguucagcu

SEQ ID NO: 3060403 - RNA, 14 nt, Human
agcugccuguucag

SEQ ID NO: 3060404 - RNA, 18 nt, Human
agcugccuguucagcucc

SEQ ID NO: 3060405 - RNA, 20 nt, Human
agcugcugagauccuggacu

SEQ ID NO: 3060406 - RNA, 16 nt, Human
agcugcuugggcuuca

SEQ ID NO: 3060407 - RNA, 21 nt, Human
agcugcugagauccuggacug

SEQ ID NO: 3060408 - RNA, 19 nt, Human
agcuguuacugucuucagu

SEQ ID NO: 3060409 - RNA, 14 nt, Human
agcuguucacagcc

SEQ ID NO: 3060410 - RNA, 16 nt, Human
ugccuguugggccagg

SEQ ID NO: 3060411 - RNA, 17 nt, Human
ugccuguugggccagga

SEQ ID NO: 3060412 - RNA, 20 nt, Human
ugccuuacccucauguucuu

SEQ ID NO: 3060413 - RNA, 16 nt, Human
ugccuuggggacaaga

SEQ ID NO: 3060414 - RNA, 21 nt, Human
ugccuuacccucauguucuua

SEQ ID NO: 3060415 - RNA, 18 nt, Human
agcuguuacugucuucag

SEQ ID NO: 3060416 - RNA, 14 nt, Human
agcuguuacugucu

SEQ ID NO: 3060417 - RNA, 23 nt, Human
agcugugcucuggacaggcaugu

SEQ ID NO: 3060418 - RNA, 18 nt, Human
agcugugcucuggacagg

SEQ ID NO: 3060419 - RNA, 17 nt, Human
agcugugcucuggacag

SEQ ID NO: 3060420 - RNA, 22 nt, Human
agcugggguggggaccucaggc

SEQ ID NO: 3060421 - RNA, 23 nt, Human
agcugggguggggaccucaggcc

SEQ ID NO: 3060422 - RNA, 20 nt, Human
agcugggguggggaccucag

SEQ ID NO: 3060423 - RNA, 16 nt, Human
agcugggacuacaggu

SEQ ID NO: 3060424 - RNA, 23 nt, Human
agcugggacuacaggcacccacc

SEQ ID NO: 3060425 - RNA, 20 nt, Human
agcugggacuacaggcaccc

SEQ ID NO: 3060426 - RNA, 23 nt, Human
agcucccaggcauuccccaggag

SEQ ID NO: 3060427 - RNA, 15 nt, Human
agcuccuucuguccu

SEQ ID NO: 3060428 - RNA, 13 nt, Human
agcucccaggcau

SEQ ID NO: 3060429 - RNA, 12 nt, Human
agcucuggucca

SEQ ID NO: 3060430 - RNA, 17 nt, Human
agcucugguccauagag

SEQ ID NO: 3060431 - RNA, 14 nt, Human
agcucuguccuggg

SEQ ID NO: 3060432 - RNA, 16 nt, Human
agcucucuccucccuu

SEQ ID NO: 3060433 - RNA, 21 nt, Human
agcuccuucuguccuacucug

SEQ ID NO: 3060434 - RNA, 16 nt, Human
agcuccuucuguccua

SEQ ID NO: 3060435 - RNA, 12 nt, Human
ugccgcagcccu

SEQ ID NO: 3060436 - RNA, 13 nt, Human
ugccucagccucc

SEQ ID NO: 3060437 - RNA, 12 nt, Human
ugccucagccuc

SEQ ID NO: 3060438 - RNA, 18 nt, Human
ugcccuuaccugccagga

SEQ ID NO: 3060439 - RNA, 19 nt, Human
ugcccuguuaaaagaugaa

SEQ ID NO: 3060440 - RNA, 20 nt, Human
ugcccuguuaaaagaugaaa

SEQ ID NO: 3060441 - RNA, 20 nt, Human
agcugccagccgagauagcc

SEQ ID NO: 3060442 - RNA, 14 nt, Human
agcugccagccgag

SEQ ID NO: 3060443 - RNA, 21 nt, Human
agcucuguccugggagugagc

SEQ ID NO: 3060444 - RNA, 16 nt, Human
agcucuguccugggag

SEQ ID NO: 3060445 - RNA, 14 nt, Human
ugcuaucuccccca

SEQ ID NO: 3060446 - RNA, 17 nt, Human
ugcuaucucccccagcc

SEQ ID NO: 3060447 - RNA, 13 nt, Human
ugcuaucuccccc

SEQ ID NO: 3060448 - RNA, 16 nt, Human
aggaaaagcugcugac

SEQ ID NO: 3060449 - RNA, 21 nt, Human
ugcuccagcuguucagcuggu

SEQ ID NO: 3060450 - RNA, 20 nt, Human
ugcuccagcuguucagcugg

SEQ ID NO: 3060451 - RNA, 15 nt, Human
ugcucccaccuggcu

SEQ ID NO: 3060452 - RNA, 15 nt, Human
ugcucugcugacaga

SEQ ID NO: 3060453 - RNA, 14 nt, Human
ugcucugcugacag

SEQ ID NO: 3060454 - RNA, 23 nt, Human
aggaaaggcuccaggagcagcca

SEQ ID NO: 3060455 - RNA, 14 nt, Human
ugcugagauccugg

SEQ ID NO: 3060456 - RNA, 18 nt, Human
ugcugagauccuggacug

SEQ ID NO: 3060457 - RNA, 19 nt, Human
aggaaaucaaauaugcaaa

SEQ ID NO: 3060458 - RNA, 20 nt, Human
aggaaaucaaauaugcaaag

SEQ ID NO: 3060459 - RNA, 22 nt, Human
aggaaaucaaauaugcaaagca

SEQ ID NO: 3060460 - RNA, 21 nt, Human
aggaaaucaaauaugcaaagc

SEQ ID NO: 3060461 - RNA, 13 nt, Human
aggaagcucaggg

SEQ ID NO: 3060462 - RNA, 14 nt, Human
aggaagcucagggc

SEQ ID NO: 3060463 - RNA, 12 nt, Human
aggaagcucagg

SEQ ID NO: 3060464 - RNA, 15 nt, Human
aggaagcucagggcc

SEQ ID NO: 3060465 - RNA, 14 nt, Human
aggaaaagcugcug

SEQ ID NO: 3060466 - RNA, 23 nt, Human
agcuugaccgugaggccagagac

SEQ ID NO: 3060467 - RNA, 22 nt, Human
agcuugaggguugggcuggugu

SEQ ID NO: 3060468 - RNA, 20 nt, Human
agcuugcccuggugccucac

SEQ ID NO: 3060469 - RNA, 20 nt, Human
agcuugaccgugaggccaga

SEQ ID NO: 3060470 - RNA, 22 nt, Human
agcuugaccgugaggccagaga

SEQ ID NO: 3060471 - RNA, 19 nt, Human
agcuugaccgugaggccag

SEQ ID NO: 3060472 - RNA, 19 nt, Human
agcuugcccuguuaaaaga

SEQ ID NO: 3060473 - RNA, 18 nt, Human
agcuugcccuguuaaaag

SEQ ID NO: 3060474 - RNA, 16 nt, Human
agcuugcccuguuaaa

SEQ ID NO: 3060475 - RNA, 20 nt, Human
ugcuaauuuugaaaaacugc

SEQ ID NO: 3060476 - RNA, 19 nt, Human
ugcuaauuuugaaaaacug

SEQ ID NO: 3060477 - RNA, 18 nt, Human
ugcuaauuuugaaaaacu

SEQ ID NO: 3060478 - RNA, 16 nt, Human
ugcuaauuuugaaaaa

SEQ ID NO: 3060479 - RNA, 11 nt, Human
ugcuacacacu

SEQ ID NO: 3060480 - RNA, 14 nt, Human
ugcuacaaaaacac

SEQ ID NO: 3060481 - RNA, 20 nt, Human
agcuuaaaggggcuagagug

SEQ ID NO: 3060482 - RNA, 17 nt, Human
ugccuuuucccaacucc

SEQ ID NO: 3060483 - RNA, 19 nt, Human
ugccuuuucccaacuccag

SEQ ID NO: 3060484 - RNA, 15 nt, Human
ugcgguccacccagg

SEQ ID NO: 3060485 - RNA, 14 nt, Human
ugcgguccacccag

SEQ ID NO: 3060486 - RNA, 13 nt, Human
ugauaaguucaua

SEQ ID NO: 3060487 - RNA, 15 nt, Human
ugauaaguucauaca

SEQ ID NO: 3060488 - RNA, 17 nt, Human
ugauaaguucauacauu

SEQ ID NO: 3060489 - RNA, 19 nt, Human
ugauaaguucauacauugu

SEQ ID NO: 3060490 - RNA, 16 nt, Human
ugauaaguaaaugcua

SEQ ID NO: 3060491 - RNA, 20 nt, Human
ugaguucuacauaaguaauu

SEQ ID NO: 3060492 - RNA, 15 nt, Human
ugaguucuacauaag

SEQ ID NO: 3060493 - RNA, 15 nt, Human
ugauacaaugcugug

SEQ ID NO: 3060494 - RNA, 14 nt, Human
ugauacaaugcugu

SEQ ID NO: 3060495 - RNA, 18 nt, Human
ugaguucauacccuguua

SEQ ID NO: 3060496 - RNA, 21 nt, Human
ugagugggggaucacagccuc

SEQ ID NO: 3060497 - RNA, 18 nt, Human
ugagugucuuaauuaaaa

SEQ ID NO: 3060498 - RNA, 17 nt, Human
ugagugcagcucuggag

SEQ ID NO: 3060499 - RNA, 13 nt, Human
ugagugccuuaca

SEQ ID NO: 3060500 - RNA, 14 nt, Human
ugagugccuuacac

SEQ ID NO: 3060501 - RNA, 20 nt, Human
ugaguacguugugcauuugg

SEQ ID NO: 3060502 - RNA, 18 nt, Human
ugagucaccaagcccagu

SEQ ID NO: 3060503 - RNA, 23 nt, Human
agcauaaaaauuagccaagugug

SEQ ID NO: 3060504 - RNA, 13 nt, Human
agcauaccaacac

SEQ ID NO: 3060505 - RNA, 22 nt, Human
agcauaccaacacgagcaggcu

SEQ ID NO: 3060506 - RNA, 19 nt, Human
agcauaccaacacgagcag

SEQ ID NO: 3060507 - RNA, 19 nt, Human
ugaguacguugugcauuug

SEQ ID NO: 3060508 - RNA, 18 nt, Human
ugaguacguugugcauuu

SEQ ID NO: 3060509 - RNA, 17 nt, Human
ugaguacguugugcauu

SEQ ID NO: 3060510 - RNA, 16 nt, Human
ugaguacguugugcau

SEQ ID NO: 3060511 - RNA, 20 nt, Human
agcaguuugguuucuagcau

SEQ ID NO: 3060512 - RNA, 19 nt, Human
agcauaaaaauuagccaag

SEQ ID NO: 3060513 - RNA, 23 nt, Human
agcaguuugguuucuagcaugaa

SEQ ID NO: 3060514 - RNA, 22 nt, Human
agcaguuugguuucuagcauga

SEQ ID NO: 3060515 - RNA, 19 nt, Human
agcagucaggaaagagaac

SEQ ID NO: 3060516 - RNA, 17 nt, Human
agcagucaggaaagaga

SEQ ID NO: 3060517 - RNA, 18 nt, Human
agcagucaggaaagagaa

SEQ ID NO: 3060518 - RNA, 22 nt, Human
agcagggcucagcggggacagc

SEQ ID NO: 3060519 - RNA, 20 nt, Human
agcagggagggcuucugcca

SEQ ID NO: 3060520 - RNA, 19 nt, Human
agcagggcauggcugggaa

SEQ ID NO: 3060521 - RNA, 15 nt, Human
agcagggcucagcgg

SEQ ID NO: 3060522 - RNA, 14 nt, Human
agcagggcucagcg

SEQ ID NO: 3060523 - RNA, 13 nt, Human
agcagggcucagc

SEQ ID NO: 3060524 - RNA, 17 nt, Human
agcaggcucgggcuccc

SEQ ID NO: 3060525 - RNA, 13 nt, Human
agcaggcucucag

SEQ ID NO: 3060526 - RNA, 14 nt, Human
agcaggcucucagg

SEQ ID NO: 3060527 - RNA, 15 nt, Human
agcaggcucucaggc

SEQ ID NO: 3060528 - RNA, 16 nt, Human
agcaggcucucaggcc

SEQ ID NO: 3060529 - RNA, 17 nt, Human
agcaggcucucaggcca

SEQ ID NO: 3060530 - RNA, 18 nt, Human
agcaggcucucaggccag

SEQ ID NO: 3060531 - RNA, 19 nt, Human
agcaggcucucaggccagc

SEQ ID NO: 3060532 - RNA, 21 nt, Human
agcaggcucucaggccagcug

SEQ ID NO: 3060533 - RNA, 22 nt, Human
agcaggcucucaggccagcugc

SEQ ID NO: 3060534 - RNA, 23 nt, Human
agcaggcucucaggccagcugcu

SEQ ID NO: 3060535 - RNA, 13 nt, Human
agcaggcugccag

SEQ ID NO: 3060536 - RNA, 14 nt, Human
agcaggcugccagu

SEQ ID NO: 3060537 - RNA, 17 nt, Human
agcaggcugccagugcc

SEQ ID NO: 3060538 - RNA, 18 nt, Human
agcaggcugccagugccu

SEQ ID NO: 3060539 - RNA, 20 nt, Human
agcaggcugccagugccugg

SEQ ID NO: 3060540 - RNA, 22 nt, Human
agcaggcugccagugccugggu

SEQ ID NO: 3060541 - RNA, 15 nt, Human
agcagggaaacagcu

SEQ ID NO: 3060542 - RNA, 14 nt, Human
agcagggaaacagc

SEQ ID NO: 3060543 - RNA, 13 nt, Human
agcagggaaacag

SEQ ID NO: 3060544 - RNA, 20 nt, Human
ugacccaugcugcccuguga

SEQ ID NO: 3060545 - RNA, 18 nt, Human
ugacccaugcugcccugu

SEQ ID NO: 3060546 - RNA, 19 nt, Human
ugacccaugcugcccugug

SEQ ID NO: 3060547 - RNA, 17 nt, Human
ugacccaugcugcccug

SEQ ID NO: 3060548 - RNA, 16 nt, Human
agcagcagggagggcu

SEQ ID NO: 3060549 - RNA, 11 nt, Human
agcagccacau

SEQ ID NO: 3060550 - RNA, 13 nt, Human
agcaggacaugga

SEQ ID NO: 3060551 - RNA, 20 nt, Human
agcaggaagcugugagagca

SEQ ID NO: 3060552 - RNA, 14 nt, Human
agcaggcuacuguc

SEQ ID NO: 3060553 - RNA, 20 nt, Human
agcaggcuacugucagcucc

SEQ ID NO: 3060554 - RNA, 19 nt, Human
agcaggcuacugucagcuc

SEQ ID NO: 3060555 - RNA, 17 nt, Human
agcaggcuacugucagc

SEQ ID NO: 3060556 - RNA, 16 nt, Human
agcaggcuacugucag

SEQ ID NO: 3060557 - RNA, 20 nt, Human
agcaucacaugaacuuguaa

SEQ ID NO: 3060558 - RNA, 21 nt, Human
agcauauucaggaagcucagg

SEQ ID NO: 3060559 - RNA, 17 nt, Human
agcauauucaggaagcu

SEQ ID NO: 3060560 - RNA, 19 nt, Human
agcauauucaggaagcuca

SEQ ID NO: 3060561 - RNA, 14 nt, Human
ugaucacggcucac

SEQ ID NO: 3060562 - RNA, 13 nt, Human
ugaucacggcuca

SEQ ID NO: 3060563 - RNA, 15 nt, Human
ugaucacggcucacu

SEQ ID NO: 3060564 - RNA, 21 nt, Human
ugauacagaaaaguugaauuu

SEQ ID NO: 3060565 - RNA, 13 nt, Human
agcauggcugcca

SEQ ID NO: 3060566 - RNA, 14 nt, Human
agcauccuggaaua

SEQ ID NO: 3060567 - RNA, 15 nt, Human
agcauccuggaauau

SEQ ID NO: 3060568 - RNA, 13 nt, Human
agcauccuggaau

SEQ ID NO: 3060569 - RNA, 16 nt, Human
agcauauucaggaagc

SEQ ID NO: 3060570 - RNA, 22 nt, Human
agcaucaggccaggcccucugc

SEQ ID NO: 3060571 - RNA, 21 nt, Human
agcaucaggccaggcccucug

SEQ ID NO: 3060572 - RNA, 23 nt, Human
agcaucaggccaggcccucugcc

SEQ ID NO: 3060573 - RNA, 15 nt, Human
agcauuuugcuaaau

SEQ ID NO: 3060574 - RNA, 22 nt, Human
agcauuuugcuaaaugugaaug

SEQ ID NO: 3060575 - RNA, 17 nt, Human
agcauuuguguugaaga

SEQ ID NO: 3060576 - RNA, 18 nt, Human
agcauuuguguugaagag

SEQ ID NO: 3060577 - RNA, 19 nt, Human
agcauggcugccaauggga

SEQ ID NO: 3060578 - RNA, 22 nt, Human
agcauuuagauguauagguuga

SEQ ID NO: 3060579 - RNA, 22 nt, Human
ugaugaaaugaggucagagccu

SEQ ID NO: 3060580 - RNA, 14 nt, Human
ugaucuaggaagac

SEQ ID NO: 3060581 - RNA, 15 nt, Human
ugaucuaggaagacu

SEQ ID NO: 3060582 - RNA, 17 nt, Human
ugaugaucuuuaaaaua

SEQ ID NO: 3060583 - RNA, 23 nt, Human
ugaugaaaugaggucagagccug

SEQ ID NO: 3060584 - RNA, 20 nt, Human
ugaugaucuuugcagacagg

SEQ ID NO: 3060585 - RNA, 19 nt, Human
ugaugaucuuugcagacag

SEQ ID NO: 3060586 - RNA, 21 nt, Human
ugaugaucuuugcagacaggc

SEQ ID NO: 3060587 - RNA, 13 nt, Human
ugauggggcccug

SEQ ID NO: 3060588 - RNA, 22 nt, Human
ugaugggcaacccccagccugc

SEQ ID NO: 3060589 - RNA, 21 nt, Human
ugaugggcaacccccagccug

SEQ ID NO: 3060590 - RNA, 22 nt, Human
ugauggggcccugccuccuuug

SEQ ID NO: 3060591 - RNA, 21 nt, Human
ugauguuuuaaggaugcuugu

SEQ ID NO: 3060592 - RNA, 17 nt, Human
ugauguuuuccaugagu

SEQ ID NO: 3060593 - RNA, 19 nt, Human
ugauguuuuccaugagucc

SEQ ID NO: 3060594 - RNA, 16 nt, Human
agccacggccaggcca

SEQ ID NO: 3060595 - RNA, 16 nt, Human
ugauuaaguaaugaua

SEQ ID NO: 3060596 - RNA, 15 nt, Human
ugauuaaguaaugau

SEQ ID NO: 3060597 - RNA, 16 nt, Human
ugauuaaauucuugca

SEQ ID NO: 3060598 - RNA, 13 nt, Human
ugauuaaauucuu

SEQ ID NO: 3060599 - RNA, 17 nt, Human
ugauuaaauucuugcaa

SEQ ID NO: 3060600 - RNA, 20 nt, Human
ugauuaaccacuucagcuga

SEQ ID NO: 3060601 - RNA, 23 nt, Human
ugauccagaaagaaaacuuguau

SEQ ID NO: 3060602 - RNA, 13 nt, Human
ugauccagaaaga

SEQ ID NO: 3060603 - RNA, 18 nt, Human
ugauccucccaccucagc

SEQ ID NO: 3060604 - RNA, 20 nt, Human
ugauccucccaccucagccu

SEQ ID NO: 3060605 - RNA, 19 nt, Human
ugauccucccaccucagcc

SEQ ID NO: 3060606 - RNA, 13 nt, Human
ugaucuaggaaga

SEQ ID NO: 3060607 - RNA, 16 nt, Human
ugauccucccaccuca

SEQ ID NO: 3060608 - RNA, 15 nt, Human
agccuguuuaagaga

SEQ ID NO: 3060609 - RNA, 20 nt, Human
agccuuagaagucacacagu

SEQ ID NO: 3060610 - RNA, 23 nt, Human
agccuugaacuuugaccucugca

SEQ ID NO: 3060611 - RNA, 19 nt, Human
agccuugcggaagguucua

SEQ ID NO: 3060612 - RNA, 21 nt, Human
agccuugaccauucuccaccu

SEQ ID NO: 3060613 - RNA, 18 nt, Human
agccuugaccauucucca

SEQ ID NO: 3060614 - RNA, 19 nt, Human
agccuugaccauucuccac

SEQ ID NO: 3060615 - RNA, 18 nt, Human
agccugugccucugggac

SEQ ID NO: 3060616 - RNA, 17 nt, Human
agccugugccucuggga

SEQ ID NO: 3060617 - RNA, 19 nt, Human
agccugagcgacagugaga

SEQ ID NO: 3060618 - RNA, 17 nt, Human
ugccagccgagauagcc

SEQ ID NO: 3060619 - RNA, 22 nt, Human
ugccagccgagauagccaaggc

SEQ ID NO: 3060620 - RNA, 17 nt, Human
ugccaguuauggcuaua

SEQ ID NO: 3060621 - RNA, 13 nt, Human
ugccauaauuacu

SEQ ID NO: 3060622 - RNA, 16 nt, Human
ugcauuuaaaagauac

SEQ ID NO: 3060623 - RNA, 13 nt, Human
ugccaauggacua

SEQ ID NO: 3060624 - RNA, 14 nt, Human
ugccaaugggagcu

SEQ ID NO: 3060625 - RNA, 17 nt, Human
ugcauagaauaaaauuu

SEQ ID NO: 3060626 - RNA, 20 nt, Human
ugcauagauucccugagcag

SEQ ID NO: 3060627 - RNA, 14 nt, Human
ugcauaccacuuuu

SEQ ID NO: 3060628 - RNA, 13 nt, Human
ugcauacucauua

SEQ ID NO: 3060629 - RNA, 19 nt, Human
ugcauacucauuaggaugg

SEQ ID NO: 3060630 - RNA, 20 nt, Human
ugcauaccacuuuuguucuu

SEQ ID NO: 3060631 - RNA, 18 nt, Human
ugcauaccacuuuuguuc

SEQ ID NO: 3060632 - RNA, 16 nt, Human
ugcauaccacuuuugu

SEQ ID NO: 3060633 - RNA, 19 nt, Human
ugcaugcugucccuuacgu

SEQ ID NO: 3060634 - RNA, 21 nt, Human
ugcaugcugucccuuacguga

SEQ ID NO: 3060635 - RNA, 18 nt, Human
ugcaugcugucccuuacg

SEQ ID NO: 3060636 - RNA, 17 nt, Human
ugcaucguuucaucuuc

SEQ ID NO: 3060637 - RNA, 22 nt, Human
ugcaggucccuaauaaagcugu

SEQ ID NO: 3060638 - RNA, 21 nt, Human
ugcaggucccuaauaaagcug

SEQ ID NO: 3060639 - RNA, 17 nt, Human
ugcagccucacaguccu

SEQ ID NO: 3060640 - RNA, 21 nt, Human
ugcagccucacaguccuuacc

SEQ ID NO: 3060641 - RNA, 18 nt, Human
ugcagccucacaguccuu

SEQ ID NO: 3060642 - RNA, 21 nt, Human
ugcagacaggcaagcaccucc

SEQ ID NO: 3060643 - RNA, 13 nt, Human
ugcagacaggcaa

SEQ ID NO: 3060644 - RNA, 12 nt, Human
ugcagacaggca

SEQ ID NO: 3060645 - RNA, 14 nt, Human
agccuccugcccuu

SEQ ID NO: 3060646 - RNA, 18 nt, Human
agccuccugcccuuaccu

SEQ ID NO: 3060647 - RNA, 13 nt, Human
agccuccugcccu

SEQ ID NO: 3060648 - RNA, 20 nt, Human
agcccugggaggcucuggag

SEQ ID NO: 3060649 - RNA, 18 nt, Human
agcccugggaggcucugg

SEQ ID NO: 3060650 - RNA, 17 nt, Human
agcccugggaggcucug

SEQ ID NO: 3060651 - RNA, 21 nt, Human
ugcaccacugcacuccagccu

SEQ ID NO: 3060652 - RNA, 13 nt, Human
ugcaccagcccuu

SEQ ID NO: 3060653 - RNA, 15 nt, Human
ugcaccacugcacuc

SEQ ID NO: 3060654 - RNA, 15 nt, Human
ugcacuccagccugg

SEQ ID NO: 3060655 - RNA, 17 nt, Human
ugcacuccagccugagc

SEQ ID NO: 3060656 - RNA, 16 nt, Human
ugcacuccagccuggg

SEQ ID NO: 3060657 - RNA, 22 nt, Human
ugcagaagacaguauggcagcu

SEQ ID NO: 3060658 - RNA, 14 nt, Human
ugcacuccagccug

SEQ ID NO: 3060659 - RNA, 15 nt, Human
ugcacuccagccuga

SEQ ID NO: 3060660 - RNA, 16 nt, Human
ugcaccggcuggccug

SEQ ID NO: 3060661 - RNA, 14 nt, Human
ugcaccggcuggcc

SEQ ID NO: 3060662 - RNA, 15 nt, Human
ugcaccggcuggccu

SEQ ID NO: 3060663 - RNA, 16 nt, Human
agcccgggcucugccu

SEQ ID NO: 3060664 - RNA, 14 nt, Human
agcccugcagaggg

SEQ ID NO: 3060665 - RNA, 15 nt, Human
agcccugcagagggc

SEQ ID NO: 3060666 - RNA, 16 nt, Human
agcccugcagagggca

SEQ ID NO: 3060667 - RNA, 19 nt, Human
agcccugcagagggcacag

SEQ ID NO: 3060668 - RNA, 19 nt, Human
agccccuucugacccaugc

SEQ ID NO: 3060669 - RNA, 13 nt, Human
agcccgggcucug

SEQ ID NO: 3060670 - RNA, 14 nt, Human
agcccgggcucugc

SEQ ID NO: 3060671 - RNA, 15 nt, Human
agcccgggcucugcc

SEQ ID NO: 3060672 - RNA, 15 nt, Human
agccccuucugaccc

SEQ ID NO: 3060673 - RNA, 16 nt, Human
agccccuucugaccca

SEQ ID NO: 3060674 - RNA, 14 nt, Human
agccccuucugacc

SEQ ID NO: 3060675 - RNA, 14 nt, Human
agccccgaggccuu

SEQ ID NO: 3060676 - RNA, 14 nt, Human
agcccaggccuccu

SEQ ID NO: 3060677 - RNA, 19 nt, Human
agcccaggccuccuacagc

SEQ ID NO: 3060678 - RNA, 22 nt, Human
agccccuggaugcagccucaca

SEQ ID NO: 3060679 - RNA, 13 nt, Human
ugcaacaggcugg

SEQ ID NO: 3060680 - RNA, 15 nt, Human
ugcaagccagauuuu

SEQ ID NO: 3060681 - RNA, 21 nt, Human
ugcaagccagauuuuccugaa

SEQ ID NO: 3060682 - RNA, 15 nt, Human
ugcaaggucauuuuu

SEQ ID NO: 3060683 - RNA, 12 nt, Human
agcccaggccuc

SEQ ID NO: 3060684 - RNA, 12 nt, Human
ugcaaaccauca

SEQ ID NO: 3060685 - RNA, 13 nt, Human
ugcaaaccaucau

SEQ ID NO: 3060686 - RNA, 18 nt, Human
agccacggccaggccaga

SEQ ID NO: 3060687 - RNA, 17 nt, Human
agccacggccaggccag

SEQ ID NO: 3060688 - RNA, 13 nt, Human
ugauuucauucaa

SEQ ID NO: 3060689 - RNA, 20 nt, Human
ugcaaaguaucccuacugua

SEQ ID NO: 3060690 - RNA, 21 nt, Human
ugcaaaggguaucaggugcug

SEQ ID NO: 3060691 - RNA, 18 nt, Human
ugcaaaccaucauugaaa

SEQ ID NO: 3060692 - RNA, 18 nt, Human
ugcaaagcacugacuucu

SEQ ID NO: 3060693 - RNA, 22 nt, Human
ugcaaagcacugacuucuaagu

SEQ ID NO: 3060694 - RNA, 20 nt, Human
ugcaaagcacugacuucuaa

SEQ ID NO: 3060695 - RNA, 21 nt, Human
agaauguguuuaaacuugguu

SEQ ID NO: 3060696 - RNA, 19 nt, Human
agaauuaguggcacuugcu

SEQ ID NO: 3060697 - RNA, 23 nt, Human
agaauuaacacaugauccugcaa

SEQ ID NO: 3060698 - RNA, 23 nt, Human
agaaccccaggguccuguagccc

SEQ ID NO: 3060699 - RNA, 14 nt, Human
agaauucucuaguu

SEQ ID NO: 3060700 - RNA, 20 nt, Human
agaauuauaauuaguuccuc

SEQ ID NO: 3060701 - RNA, 20 nt, Human
agaauucucagaaucucaaa

SEQ ID NO: 3060702 - RNA, 19 nt, Human
ucuguuuagauaauacacc

SEQ ID NO: 3060703 - RNA, 16 nt, Human
ucuguuuagauaauac

SEQ ID NO: 3060704 - RNA, 23 nt, Human
ucuguuuagauaauacaccacua

SEQ ID NO: 3060705 - RNA, 13 nt, Human
ucuguuuagauaa

SEQ ID NO: 3060706 - RNA, 18 nt, Human
ucuguacgucugacaggc

SEQ ID NO: 3060707 - RNA, 12 nt, Human
agacagaaaaaa

SEQ ID NO: 3060708 - RNA, 13 nt, Human
agacagcugccug

SEQ ID NO: 3060709 - RNA, 14 nt, Human
agacagcugccugg

SEQ ID NO: 3060710 - RNA, 21 nt, Human
agacacauguccaagaagccc

SEQ ID NO: 3060711 - RNA, 22 nt, Human
agacacauguccaagaagccca

SEQ ID NO: 3060712 - RNA, 16 nt, Human
agacacaggcccggcu

SEQ ID NO: 3060713 - RNA, 23 nt, Human
agacacaggcccggcuccaggcu

SEQ ID NO: 3060714 - RNA, 24 nt, Human
agacacauguccaagaagcccagg

SEQ ID NO: 3060715 - RNA, 19 nt, Human
agacaccuugacagggcac

SEQ ID NO: 3060716 - RNA, 22 nt, Human
agacaccuugacagggcacacc

SEQ ID NO: 3060717 - RNA, 20 nt, Human
agacacauguccaagaagcc

SEQ ID NO: 3060718 - RNA, 20 nt, Human
agacacaacuauuuuuccaa

SEQ ID NO: 3060719 - RNA, 19 nt, Human
agacacaacuauuuuucca

SEQ ID NO: 3060720 - RNA, 13 nt, Human
agacacaagccuu

SEQ ID NO: 3060721 - RNA, 14 nt, Human
agacacaagccuuc

SEQ ID NO: 3060722 - RNA, 15 nt, Human
agacacacaugaagu

SEQ ID NO: 3060723 - RNA, 19 nt, Human
agaauucucuaguuugauu

SEQ ID NO: 3060724 - RNA, 18 nt, Human
agaauucucuaguuugau

SEQ ID NO: 3060725 - RNA, 17 nt, Human
agaauucucuuauccaa

SEQ ID NO: 3060726 - RNA, 17 nt, Human
agacacaggcccggcuc

SEQ ID NO: 3060727 - RNA, 17 nt, Human
agacacacugaagaagc

SEQ ID NO: 3060728 - RNA, 16 nt, Human
agacacacugaagaag

SEQ ID NO: 3060729 - RNA, 22 nt, Human
agacacaggcccggcuccaggc

SEQ ID NO: 3060730 - RNA, 21 nt, Human
agacacaggcccggcuccagg

SEQ ID NO: 3060731 - RNA, 20 nt, Human
agacacaggcccggcuccag

SEQ ID NO: 3060732 - RNA, 19 nt, Human
agacacaggcccggcucca

SEQ ID NO: 3060733 - RNA, 19 nt, Human
ucuuacugucuuuuuucua

SEQ ID NO: 3060734 - RNA, 12 nt, Human
ucuuagauguau

SEQ ID NO: 3060735 - RNA, 23 nt, Human
ucuuagaugcaguucugaagaag

SEQ ID NO: 3060736 - RNA, 22 nt, Human
ucuuagaugcaguucugaagaa

SEQ ID NO: 3060737 - RNA, 18 nt, Human
ucuuaugggcuggguucu

SEQ ID NO: 3060738 - RNA, 12 nt, Human
agacagucccug

SEQ ID NO: 3060739 - RNA, 15 nt, Human
agacagcugccuggg

SEQ ID NO: 3060740 - RNA, 16 nt, Human
agacagcugccuggga

SEQ ID NO: 3060741 - RNA, 13 nt, Human
agacagucccugc

SEQ ID NO: 3060742 - RNA, 19 nt, Human
agacagucccugccaaugg

SEQ ID NO: 3060743 - RNA, 23 nt, Human
agacauacuaaccagcagaaaug

SEQ ID NO: 3060744 - RNA, 20 nt, Human
ucuucuguacgucugacagg

SEQ ID NO: 3060745 - RNA, 17 nt, Human
ucuuauuuaaugaaaga

SEQ ID NO: 3060746 - RNA, 15 nt, Human
ucuuauuucauuucu

SEQ ID NO: 3060747 - RNA, 16 nt, Human
ucuuauuucauuucuu

SEQ ID NO: 3060748 - RNA, 22 nt, Human
ucuucuguacgucugacaggca

SEQ ID NO: 3060749 - RNA, 21 nt, Human
ucuucuguacgucugacaggc

SEQ ID NO: 3060750 - RNA, 19 nt, Human
ucuucugcuucagccuccc

SEQ ID NO: 3060751 - RNA, 22 nt, Human
ucuucugcuucagccucccgag

SEQ ID NO: 3060752 - RNA, 14 nt, Human
agacccggcugcgu

SEQ ID NO: 3060753 - RNA, 16 nt, Human
ucuugagccuugaacu

SEQ ID NO: 3060754 - RNA, 17 nt, Human
ucuugagccuugaacuu

SEQ ID NO: 3060755 - RNA, 19 nt, Human
ucuugagccuugaacuuug

SEQ ID NO: 3060756 - RNA, 18 nt, Human
ucuugagccuugaacuuu

SEQ ID NO: 3060757 - RNA, 23 nt, Human
agacuauucaaacagucucagga

SEQ ID NO: 3060758 - RNA, 16 nt, Human
agacuguacaaaguag

SEQ ID NO: 3060759 - RNA, 15 nt, Human
agacuguacaaagua

SEQ ID NO: 3060760 - RNA, 14 nt, Human
agacuguacaaagu

SEQ ID NO: 3060761 - RNA, 20 nt, Human
agacucgcgacaaugcaaac

SEQ ID NO: 3060762 - RNA, 24 nt, Human
agagacagaaagcagaacagugau

SEQ ID NO: 3060763 - RNA, 15 nt, Human
agagacagaaagcag

SEQ ID NO: 3060764 - RNA, 19 nt, Human
agacuuuucuuucagccaa

SEQ ID NO: 3060765 - RNA, 22 nt, Human
agagaaaaaauauuuuccugcc

SEQ ID NO: 3060766 - RNA, 14 nt, Human
ucuugguuuguaaa

SEQ ID NO: 3060767 - RNA, 14 nt, Human
ucuuuaauuuuaca

SEQ ID NO: 3060768 - RNA, 22 nt, Human
ucuuuaaugucacaggcagguc

SEQ ID NO: 3060769 - RNA, 19 nt, Human
ucuuuaaugucacaggcag

SEQ ID NO: 3060770 - RNA, 20 nt, Human
ucuuuaaugucacaggcagg

SEQ ID NO: 3060771 - RNA, 16 nt, Human
ucuugguuuguaaauu

SEQ ID NO: 3060772 - RNA, 18 nt, Human
ucuuucuggcuaugcauu

SEQ ID NO: 3060773 - RNA, 20 nt, Human
ucuuuauaauucuacuuuga

SEQ ID NO: 3060774 - RNA, 13 nt, Human
ucuuucugcuuug

SEQ ID NO: 3060775 - RNA, 15 nt, Human
agacucgcgacaaug

SEQ ID NO: 3060776 - RNA, 17 nt, Human
agacucgcgacaaugca

SEQ ID NO: 3060777 - RNA, 18 nt, Human
agacucgcgacaaugcaa

SEQ ID NO: 3060778 - RNA, 19 nt, Human
agacucgcgacaaugcaaa

SEQ ID NO: 3060779 - RNA, 23 nt, Human
agacuccugcaggcagccaggcc

SEQ ID NO: 3060780 - RNA, 17 nt, Human
ugacauaaaaacaacuu

SEQ ID NO: 3060781 - RNA, 20 nt, Human
ugacagggcacaccgggcac

SEQ ID NO: 3060782 - RNA, 16 nt, Human
ugacagggcacaccgg

SEQ ID NO: 3060783 - RNA, 11 nt, Human
ugacagggcac

SEQ ID NO: 3060784 - RNA, 21 nt, Human
ugacacacagcucuguccugg

SEQ ID NO: 3060785 - RNA, 20 nt, Human
ugacaggcaaugcuggcugu

SEQ ID NO: 3060786 - RNA, 18 nt, Human
ugacauaaaaacaacuuu

SEQ ID NO: 3060787 - RNA, 20 nt, Human
ugacauaaaaacaacuuuau

SEQ ID NO: 3060788 - RNA, 21 nt, Human
ugacauuguuggccaaagcca

SEQ ID NO: 3060789 - RNA, 20 nt, Human
ugacauuguuggccaaagcc

SEQ ID NO: 3060790 - RNA, 18 nt, Human
ugaccaaugauggucacc

SEQ ID NO: 3060791 - RNA, 13 nt, Human
agaucagccuggg

SEQ ID NO: 3060792 - RNA, 15 nt, Human
agaucagccugggca

SEQ ID NO: 3060793 - RNA, 15 nt, Human
agaugcuucucacug

SEQ ID NO: 3060794 - RNA, 23 nt, Human
ugaccauucuccaccugccaggg

SEQ ID NO: 3060795 - RNA, 17 nt, Human
ugacccacaagaaauga

SEQ ID NO: 3060796 - RNA, 13 nt, Human
ugacccacugcuu

SEQ ID NO: 3060797 - RNA, 12 nt, Human
ugacccacugcu

SEQ ID NO: 3060798 - RNA, 15 nt, Human
agaugcaccagcccu

SEQ ID NO: 3060799 - RNA, 14 nt, Human
agaugcaccagccc

SEQ ID NO: 3060800 - RNA, 17 nt, Human
agaugcaguucugaaga

SEQ ID NO: 3060801 - RNA, 18 nt, Human
agaugcaguucugaagaa

SEQ ID NO: 3060802 - RNA, 19 nt, Human
agaugcaguucugaagaag

SEQ ID NO: 3060803 - RNA, 14 nt, Human
agaugcuagaacuc

SEQ ID NO: 3060804 - RNA, 17 nt, Human
agauaaagguucaugca

SEQ ID NO: 3060805 - RNA, 12 nt, Human
agauaaaugugc

SEQ ID NO: 3060806 - RNA, 12 nt, Human
agauacugaaau

SEQ ID NO: 3060807 - RNA, 13 nt, Human
agauacugaaaua

SEQ ID NO: 3060808 - RNA, 15 nt, Human
agauacugaaauaaa

SEQ ID NO: 3060809 - RNA, 16 nt, Human
agaucacgccacugca

SEQ ID NO: 3060810 - RNA, 15 nt, Human
agaucacgccacugc

SEQ ID NO: 3060811 - RNA, 14 nt, Human
agaucacgccacug

SEQ ID NO: 3060812 - RNA, 16 nt, Human
agauaugauucaaaug

SEQ ID NO: 3060813 - RNA, 18 nt, Human
agaucacgccacugcacu

SEQ ID NO: 3060814 - RNA, 17 nt, Human
agaucacgccacugcac

SEQ ID NO: 3060815 - RNA, 15 nt, Human
ugaauuucuuuugcc

SEQ ID NO: 3060816 - RNA, 16 nt, Human
ugaauuuuacauggcu

SEQ ID NO: 3060817 - RNA, 20 nt, Human
ugacacacagcucuguccug

SEQ ID NO: 3060818 - RNA, 20 nt, Human
agaguugaugguuguacaua

SEQ ID NO: 3060819 - RNA, 12 nt, Human
agaguuguuaca

SEQ ID NO: 3060820 - RNA, 21 nt, Human
agaguuguuacauuuuuaagu

SEQ ID NO: 3060821 - RNA, 16 nt, Human
agaguuuagcuggaaa

SEQ ID NO: 3060822 - RNA, 17 nt, Human
agaguuuagcuggaaaa

SEQ ID NO: 3060823 - RNA, 22 nt, Human
agaguugauacuacaguuuguu

SEQ ID NO: 3060824 - RNA, 20 nt, Human
agaguugauacuacaguuug

SEQ ID NO: 3060825 - RNA, 17 nt, Human
agaguugauacuacagu

SEQ ID NO: 3060826 - RNA, 22 nt, Human
agagucagaaguuucugccgca

SEQ ID NO: 3060827 - RNA, 20 nt, Human
ugaaugguuuucaaaauaaa

SEQ ID NO: 3060828 - RNA, 19 nt, Human
ugaaugucagugugacuga

SEQ ID NO: 3060829 - RNA, 15 nt, Human
ugaaauuguauuaca

SEQ ID NO: 3060830 - RNA, 23 nt, Human
ugaaauuuccugggagcuuuugu

SEQ ID NO: 3060831 - RNA, 18 nt, Human
agagcugccaccugccug

SEQ ID NO: 3060832 - RNA, 14 nt, Human
ugaaauaagccaga

SEQ ID NO: 3060833 - RNA, 17 nt, Human
ugaaauaagccagacau

SEQ ID NO: 3060834 - RNA, 18 nt, Human
ugaaauaagccagacauc

SEQ ID NO: 3060835 - RNA, 20 nt, Human
ugaaauaagccagacaucaa

SEQ ID NO: 3060836 - RNA, 23 nt, Human
ugaaauaagccagacaucaacag

SEQ ID NO: 3060837 - RNA, 21 nt, Human
agagccuugcggaagguucua

SEQ ID NO: 3060838 - RNA, 11 nt, Human
agagccuugcg

SEQ ID NO: 3060839 - RNA, 17 nt, Human
agagcagagaccauccc

SEQ ID NO: 3060840 - RNA, 18 nt, Human
agagcagagaccaucccu

SEQ ID NO: 3060841 - RNA, 20 nt, Human
agagcagagaccaucccuga

SEQ ID NO: 3060842 - RNA, 14 nt, Human
agagcaaaauugau

SEQ ID NO: 3060843 - RNA, 12 nt, Human
agagcagagacc

SEQ ID NO: 3060844 - RNA, 17 nt, Human
ucuuuggacccugaggc

SEQ ID NO: 3060845 - RNA, 21 nt, Human
ucuuuggacccugaggcccag

SEQ ID NO: 3060846 - RNA, 16 nt, Human
ucuuuggacccugagg

SEQ ID NO: 3060847 - RNA, 16 nt, Human
agagauugugguuuca

SEQ ID NO: 3060848 - RNA, 21 nt, Human
ugaacuaggauuguaguccca

SEQ ID NO: 3060849 - RNA, 23 nt, Human
ugaacuagaguuuagcuggaaaa

SEQ ID NO: 3060850 - RNA, 12 nt, Human
ugaacuccuggc

SEQ ID NO: 3060851 - RNA, 11 nt, Human
ugaacuccugg

SEQ ID NO: 3060852 - RNA, 15 nt, Human
ugaacuccuggccuc

SEQ ID NO: 3060853 - RNA, 14 nt, Human
ugaacuccuggccu

SEQ ID NO: 3060854 - RNA, 15 nt, Human
ugaaauuuuuauuaa

SEQ ID NO: 3060855 - RNA, 18 nt, Human
ugaacaaauuuacagaga

SEQ ID NO: 3060856 - RNA, 19 nt, Human
ugaacaaauuuacagagac

SEQ ID NO: 3060857 - RNA, 20 nt, Human
ugaacaaauuuacagagaca

SEQ ID NO: 3060858 - RNA, 22 nt, Human
ugaaccgaugagaaauaaaguu

SEQ ID NO: 3060859 - RNA, 19 nt, Human
agagcuguucacagccaga

SEQ ID NO: 3060860 - RNA, 21 nt, Human
agagcuguucacagccagacu

SEQ ID NO: 3060861 - RNA, 22 nt, Human
ugaacuuugaccucugcagcaa

SEQ ID NO: 3060862 - RNA, 17 nt, Human
ugaacuuugaccucugc

SEQ ID NO: 3060863 - RNA, 20 nt, Human
ugaacuuugaccucugcagc

SEQ ID NO: 3060864 - RNA, 19 nt, Human
ugaacuuugaccucugcag

SEQ ID NO: 3060865 - RNA, 22 nt, Human
agaguaauccaagcaaauguga

SEQ ID NO: 3060866 - RNA, 12 nt, Human
agagguuuuaaa

SEQ ID NO: 3060867 - RNA, 22 nt, Human
ugaagcacagugaucaaguuau

SEQ ID NO: 3060868 - RNA, 15 nt, Human
agagguugcagugag

SEQ ID NO: 3060869 - RNA, 19 nt, Human
agaggccaugggccuccug

SEQ ID NO: 3060870 - RNA, 17 nt, Human
agaggcuaugugagcac

SEQ ID NO: 3060871 - RNA, 13 nt, Human
agaggcagggucu

SEQ ID NO: 3060872 - RNA, 10 nt, Human
agaggcaggg

SEQ ID NO: 3060873 - RNA, 19 nt, Human
agaggcagccccauucugc

SEQ ID NO: 3060874 - RNA, 13 nt, Human
agaggcagcccca

SEQ ID NO: 3060875 - RNA, 24 nt, Human
agaggcagccccauucugccugcc

SEQ ID NO: 3060876 - RNA, 21 nt, Human
acugugugcucaggagcccug

SEQ ID NO: 3060877 - RNA, 20 nt, Human
acugugugcucaggagcccu

SEQ ID NO: 3060878 - RNA, 19 nt, Human
acugugugcucaggagccc

SEQ ID NO: 3060879 - RNA, 15 nt, Human
acugugugcucagga

SEQ ID NO: 3060880 - RNA, 12 nt, Human
acugugugcuca

SEQ ID NO: 3060881 - RNA, 13 nt, Human
acuguggguagac

SEQ ID NO: 3060882 - RNA, 18 nt, Human
acuguggguagacacaca

SEQ ID NO: 3060883 - RNA, 16 nt, Human
acugggagaaaugaaa

SEQ ID NO: 3060884 - RNA, 18 nt, Human
acugggacaggggagaac

SEQ ID NO: 3060885 - RNA, 21 nt, Human
acugucagcuccccucggaga

SEQ ID NO: 3060886 - RNA, 17 nt, Human
acuguccuacccacccu

SEQ ID NO: 3060887 - RNA, 18 nt, Human
acuguccuacccacccuc

SEQ ID NO: 3060888 - RNA, 22 nt, Human
acugugcugagucugaaggcug

SEQ ID NO: 3060889 - RNA, 13 nt, Human
ucguaaaauuaag

SEQ ID NO: 3060890 - RNA, 16 nt, Human
ucguaaaauuaagaaa

SEQ ID NO: 3060891 - RNA, 22 nt, Human
ucguuuucaaaauuguuacaaa

SEQ ID NO: 3060892 - RNA, 11 nt, Human
ucgggcaugac

SEQ ID NO: 3060893 - RNA, 12 nt, Human
ucgggcaugaca

SEQ ID NO: 3060894 - RNA, 22 nt, Human
ucggguuuuauuguuuaaaauc

SEQ ID NO: 3060895 - RNA, 19 nt, Human
ucgggaggucgaggcagga

SEQ ID NO: 3060896 - RNA, 21 nt, Human
ucgggaggucgaggcaggagg

SEQ ID NO: 3060897 - RNA, 17 nt, Human
ucgggaggucgaggcag

SEQ ID NO: 3060898 - RNA, 22 nt, Human
ucuacauaaguaauucaagaaa

SEQ ID NO: 3060899 - RNA, 17 nt, Human
ucuaccaaaaaucucaa

SEQ ID NO: 3060900 - RNA, 14 nt, Human
acuguucucugccc

SEQ ID NO: 3060901 - RNA, 20 nt, Human
acuguucucugcccuccaag

SEQ ID NO: 3060902 - RNA, 21 nt, Human
acuguucucugcccuccaaga

SEQ ID NO: 3060903 - RNA, 19 nt, Human
acuguucucugcccuccaa

SEQ ID NO: 3060904 - RNA, 20 nt, Human
ucuacauaaguaauucaaga

SEQ ID NO: 3060905 - RNA, 17 nt, Human
ucuacauaaguaauuca

SEQ ID NO: 3060906 - RNA, 16 nt, Human
ucuacauacuauggaa

SEQ ID NO: 3060907 - RNA, 23 nt, Human
ucuaaguaaaaccacagcaguug

SEQ ID NO: 3060908 - RNA, 20 nt, Human
ucuaaguaaaaccacagcag

SEQ ID NO: 3060909 - RNA, 22 nt, Human
ucuaaguaaaaccacagcaguu

SEQ ID NO: 3060910 - RNA, 21 nt, Human
ucuaaguaaaaccacagcagu

SEQ ID NO: 3060911 - RNA, 20 nt, Human
ucuaaagccauuguaguccu

SEQ ID NO: 3060912 - RNA, 13 nt, Human
ucuaaagcugcca

SEQ ID NO: 3060913 - RNA, 14 nt, Human
ucuaaagcugccag

SEQ ID NO: 3060914 - RNA, 15 nt, Human
ucuaaagcugccagc

SEQ ID NO: 3060915 - RNA, 15 nt, Human
acuuaaauaauguga

SEQ ID NO: 3060916 - RNA, 16 nt, Human
acuuaaauaaugugaa

SEQ ID NO: 3060917 - RNA, 18 nt, Human
acuuaaauaaugugaaac

SEQ ID NO: 3060918 - RNA, 17 nt, Human
acuuaaauaaugugaaa

SEQ ID NO: 3060919 - RNA, 14 nt, Human
acuguugcccaggc

SEQ ID NO: 3060920 - RNA, 13 nt, Human
acuguugcccagg

SEQ ID NO: 3060921 - RNA, 12 nt, Human
acuguugcccag

SEQ ID NO: 3060922 - RNA, 18 nt, Human
acuguugcccaggcuggc

SEQ ID NO: 3060923 - RNA, 17 nt, Human
acuguugcccaggcugg

SEQ ID NO: 3060924 - RNA, 16 nt, Human
acuuaaucuaaaugga

SEQ ID NO: 3060925 - RNA, 15 nt, Human
acuuaaucuaaaugg

SEQ ID NO: 3060926 - RNA, 13 nt, Human
acuuaaucuaaau

SEQ ID NO: 3060927 - RNA, 13 nt, Human
acugccuucucaa

SEQ ID NO: 3060928 - RNA, 19 nt, Human
acugccuucucaacuccaa

SEQ ID NO: 3060929 - RNA, 18 nt, Human
acugcuuaacuucacaua

SEQ ID NO: 3060930 - RNA, 15 nt, Human
acuggauuaaacuua

SEQ ID NO: 3060931 - RNA, 13 nt, Human
acuggcacaguuu

SEQ ID NO: 3060932 - RNA, 20 nt, Human
acuggcacaguuuucugaga

SEQ ID NO: 3060933 - RNA, 19 nt, Human
acuggcacaguuuucugag

SEQ ID NO: 3060934 - RNA, 21 nt, Human
acugcuugugaaaggaaagag

SEQ ID NO: 3060935 - RNA, 17 nt, Human
acugcuuccagugaggc

SEQ ID NO: 3060936 - RNA, 20 nt, Human
acugcuuaacuucacauauu

SEQ ID NO: 3060937 - RNA, 21 nt, Human
acugccuauuuuaauaaacac

SEQ ID NO: 3060938 - RNA, 16 nt, Human
acugccuauuuuaaua

SEQ ID NO: 3060939 - RNA, 15 nt, Human
acugcauuauauuua

SEQ ID NO: 3060940 - RNA, 14 nt, Human
acugcauuauauuu

SEQ ID NO: 3060941 - RNA, 16 nt, Human
acugcauaugaaagga

SEQ ID NO: 3060942 - RNA, 21 nt, Human
uccuagaaauuccccacccug

SEQ ID NO: 3060943 - RNA, 22 nt, Human
uccuagaaauuccccacccuga

SEQ ID NO: 3060944 - RNA, 16 nt, Human
acugcauguuugugau

SEQ ID NO: 3060945 - RNA, 15 nt, Human
acugcauguuuguga

SEQ ID NO: 3060946 - RNA, 20 nt, Human
acugcaucaagaugugacau

SEQ ID NO: 3060947 - RNA, 22 nt, Human
acugcaucaagaugugacaugu

SEQ ID NO: 3060948 - RNA, 14 nt, Human
uccuucagugccuu

SEQ ID NO: 3060949 - RNA, 15 nt, Human
uccuucagugccuua

SEQ ID NO: 3060950 - RNA, 16 nt, Human
uccuucagugccuuau

SEQ ID NO: 3060951 - RNA, 17 nt, Human
uccuucagugccuuaug

SEQ ID NO: 3060952 - RNA, 22 nt, Human
uccuuggugucgggcaugacac

SEQ ID NO: 3060953 - RNA, 23 nt, Human
uccuuguguuacuaaguuuuuau

SEQ ID NO: 3060954 - RNA, 14 nt, Human
uccuuguguuacua

SEQ ID NO: 3060955 - RNA, 19 nt, Human
uccuuuagcgcccaguugg

SEQ ID NO: 3060956 - RNA, 15 nt, Human
uccuuuagcgcccag

SEQ ID NO: 3060957 - RNA, 22 nt, Human
uccuuucuaacaaaaaaauaua

SEQ ID NO: 3060958 - RNA, 22 nt, Human
uccuuuagcgcccaguugggug

SEQ ID NO: 3060959 - RNA, 16 nt, Human
ucgagcaugccuggau

SEQ ID NO: 3060960 - RNA, 18 nt, Human
ucgagcaugccuggaugg

SEQ ID NO: 3060961 - RNA, 15 nt, Human
ucgagcaugccugga

SEQ ID NO: 3060962 - RNA, 16 nt, Human
ucgcgacaaugcaaac

SEQ ID NO: 3060963 - RNA, 14 nt, Human
ucgcgacaaugcaa

SEQ ID NO: 3060964 - RNA, 19 nt, Human
ucgcgacaaugcaaaccau

SEQ ID NO: 3060965 - RNA, 18 nt, Human
ucgcuccaccuugcagcu

SEQ ID NO: 3060966 - RNA, 15 nt, Human
ucucuggaauuugaa

SEQ ID NO: 3060967 - RNA, 19 nt, Human
ucucuggaauuugaaacac

SEQ ID NO: 3060968 - RNA, 12 nt, Human
ucucuggccuuc

SEQ ID NO: 3060969 - RNA, 11 nt, Human
ucucugcccuc

SEQ ID NO: 3060970 - RNA, 15 nt, Human
ucucugcccuccaag

SEQ ID NO: 3060971 - RNA, 16 nt, Human
ucucugcccuccaaga

SEQ ID NO: 3060972 - RNA, 17 nt, Human
ucucugcccuccaagac

SEQ ID NO: 3060973 - RNA, 14 nt, Human
ucucuccuguaccu

SEQ ID NO: 3060974 - RNA, 16 nt, Human
ucucuccuguaccucu

SEQ ID NO: 3060975 - RNA, 16 nt, Human
acuuugaccucugcag

SEQ ID NO: 3060976 - RNA, 15 nt, Human
acuuugaccucugca

SEQ ID NO: 3060977 - RNA, 18 nt, Human
acuuugaccucugcagca

SEQ ID NO: 3060978 - RNA, 13 nt, Human
ucucucacuccuu

SEQ ID NO: 3060979 - RNA, 15 nt, Human
ucucucacuccuuga

SEQ ID NO: 3060980 - RNA, 21 nt, Human
ucucucaggccaaacucaccu

SEQ ID NO: 3060981 - RNA, 17 nt, Human
ucucucacuuguuuuau

SEQ ID NO: 3060982 - RNA, 17 nt, Human
ucucuccagccccugga

SEQ ID NO: 3060983 - RNA, 16 nt, Human
ucucuccagccccugg

SEQ ID NO: 3060984 - RNA, 18 nt, Human
ucucuccagccccuggau

SEQ ID NO: 3060985 - RNA, 19 nt, Human
ucucuccagccccuggaug

SEQ ID NO: 3060986 - RNA, 19 nt, Human
agaaaacuuguauuaugug

SEQ ID NO: 3060987 - RNA, 21 nt, Human
agaaaacuuguauuaugugug

SEQ ID NO: 3060988 - RNA, 17 nt, Human
agaaaaaggaugcacag

SEQ ID NO: 3060989 - RNA, 23 nt, Human
agaaacuuaagguuaccuuuguu

SEQ ID NO: 3060990 - RNA, 17 nt, Human
ucucuugagccugggag

SEQ ID NO: 3060991 - RNA, 21 nt, Human
ucucuggccuucggccuccau

SEQ ID NO: 3060992 - RNA, 22 nt, Human
ucucuggccuucggccuccauc

SEQ ID NO: 3060993 - RNA, 14 nt, Human
ucucuugauucaua

SEQ ID NO: 3060994 - RNA, 16 nt, Human
ucucuugauucauaau

SEQ ID NO: 3060995 - RNA, 18 nt, Human
ucucuugagccugggagg

SEQ ID NO: 3060996 - RNA, 21 nt, Human
ucucuuuaaugucacaggcag

SEQ ID NO: 3060997 - RNA, 20 nt, Human
ucucuuuaaugucacaggca

SEQ ID NO: 3060998 - RNA, 13 nt, Human
agaaaaagaaaaa

SEQ ID NO: 3060999 - RNA, 23 nt, Human
agaaaugaaaaaauauauaucaa

SEQ ID NO: 3061000 - RNA, 18 nt, Human
agaaaugaaaaaauauau

SEQ ID NO: 3061001 - RNA, 16 nt, Human
agaaaugaaaaaauau

SEQ ID NO: 3061002 - RNA, 21 nt, Human
ucugaacuuggcgcugccccu

SEQ ID NO: 3061003 - RNA, 12 nt, Human
ucugaagaagau

SEQ ID NO: 3061004 - RNA, 12 nt, Human
agaaaucuaaaa

SEQ ID NO: 3061005 - RNA, 17 nt, Human
agaaaugaaaaaauaua

SEQ ID NO: 3061006 - RNA, 17 nt, Human
agaaaucaaagagagaa

SEQ ID NO: 3061007 - RNA, 20 nt, Human
agaaauaucugaaaauguau

SEQ ID NO: 3061008 - RNA, 19 nt, Human
agaaauaucugaaaaugua

SEQ ID NO: 3061009 - RNA, 14 nt, Human
agaaauauaauuga

SEQ ID NO: 3061010 - RNA, 21 nt, Human
agaaauuaugugccagauuua

SEQ ID NO: 3061011 - RNA, 13 nt, Human
agaaauuaugugc

SEQ ID NO: 3061012 - RNA, 18 nt, Human
ucugcaggucccuaauaa

SEQ ID NO: 3061013 - RNA, 14 nt, Human
ucugcaggucccua

SEQ ID NO: 3061014 - RNA, 12 nt, Human
agaaauuaugug

SEQ ID NO: 3061015 - RNA, 17 nt, Human
agaaauuuauaaacuuu

SEQ ID NO: 3061016 - RNA, 16 nt, Human
agaaauuuauaaacuu

SEQ ID NO: 3061017 - RNA, 22 nt, Human
agaaauuaugugccagauuuau

SEQ ID NO: 3061018 - RNA, 17 nt, Human
ucugcaggucccuaaua

SEQ ID NO: 3061019 - RNA, 16 nt, Human
ucugcaggucccuaau

SEQ ID NO: 3061020 - RNA, 15 nt, Human
ucugcaggucccuaa

SEQ ID NO: 3061021 - RNA, 20 nt, Human
ucugcacuccccugcugggu

SEQ ID NO: 3061022 - RNA, 18 nt, Human
ucugcagcaauaaagcag

SEQ ID NO: 3061023 - RNA, 14 nt, Human
ucugacuaugacau

SEQ ID NO: 3061024 - RNA, 16 nt, Human
ucugacuaugacauaa

SEQ ID NO: 3061025 - RNA, 22 nt, Human
ucugagacucgcgacaaugcaa

SEQ ID NO: 3061026 - RNA, 23 nt, Human
ucugagacucgcgacaaugcaaa

SEQ ID NO: 3061027 - RNA, 18 nt, Human
ucugcacuccccugcugg

SEQ ID NO: 3061028 - RNA, 19 nt, Human
ucugcacuccccugcuggg

SEQ ID NO: 3061029 - RNA, 17 nt, Human
ucugcacuccccugcug

SEQ ID NO: 3061030 - RNA, 14 nt, Human
ucucagggccuggu

SEQ ID NO: 3061031 - RNA, 15 nt, Human
ucucagggccugguc

SEQ ID NO: 3061032 - RNA, 19 nt, Human
ucucagggccuggucguuu

SEQ ID NO: 3061033 - RNA, 15 nt, Human
acuuguggacacagc

SEQ ID NO: 3061034 - RNA, 12 nt, Human
ucucagggccug

SEQ ID NO: 3061035 - RNA, 13 nt, Human
ucucagggccugg

SEQ ID NO: 3061036 - RNA, 16 nt, Human
ucuccaggcuguaucc

SEQ ID NO: 3061037 - RNA, 13 nt, Human
ucuccaaaauaaa

SEQ ID NO: 3061038 - RNA, 22 nt, Human
ucuccaaaauaaaacuuuuuaa

SEQ ID NO: 3061039 - RNA, 19 nt, Human
ucuccaaaauaaaacuuuu

SEQ ID NO: 3061040 - RNA, 17 nt, Human
ucuccaaaauaaaacuu

SEQ ID NO: 3061041 - RNA, 11 nt, Human
ucuccaggcug

SEQ ID NO: 3061042 - RNA, 16 nt, Human
ucuccauguuugaugu

SEQ ID NO: 3061043 - RNA, 16 nt, Human
acuuucuagccagagg

SEQ ID NO: 3061044 - RNA, 17 nt, Human
acuuucuagccagagga

SEQ ID NO: 3061045 - RNA, 14 nt, Human
acuuugaccucugc

SEQ ID NO: 3061046 - RNA, 21 nt, Human
ucuccuccuuuucacaguucu

SEQ ID NO: 3061047 - RNA, 16 nt, Human
acuuguguuuugcaag

SEQ ID NO: 3061048 - RNA, 16 nt, Human
acuuguggacacagcu

SEQ ID NO: 3061049 - RNA, 18 nt, Human
acuuguggacacagcucu

SEQ ID NO: 3061050 - RNA, 17 nt, Human
acuuguggacacagcuc

SEQ ID NO: 3061051 - RNA, 16 nt, Human
acuugucaauaaaauc

SEQ ID NO: 3061052 - RNA, 16 nt, Human
acuucuccacccugcu

SEQ ID NO: 3061053 - RNA, 15 nt, Human
acuucuccacccugc

SEQ ID NO: 3061054 - RNA, 21 nt, Human
acuugaacccauauuuguaca

SEQ ID NO: 3061055 - RNA, 19 nt, Human
acuugaacccgggaggcag

SEQ ID NO: 3061056 - RNA, 20 nt, Human
acuugaacccgggaggcaga

SEQ ID NO: 3061057 - RNA, 19 nt, Human
acuugagcccagagugaac

SEQ ID NO: 3061058 - RNA, 19 nt, Human
acuugagaauuacccuuuu

SEQ ID NO: 3061059 - RNA, 14 nt, Human
acuucuccacccug

SEQ ID NO: 3061060 - RNA, 21 nt, Human
acuucuaaguaaaaccacagc

SEQ ID NO: 3061061 - RNA, 23 nt, Human
acuucuaaguaaaaccacagcag

SEQ ID NO: 3061062 - RNA, 12 nt, Human
ucucacucuguc

SEQ ID NO: 3061063 - RNA, 13 nt, Human
ucucacuccuuga

SEQ ID NO: 3061064 - RNA, 22 nt, Human
acuucgggaggucgaggcagga

SEQ ID NO: 3061065 - RNA, 11 nt, Human
ucucacuccuu

SEQ ID NO: 3061066 - RNA, 11 nt, Human
acuucagcuga

SEQ ID NO: 3061067 - RNA, 16 nt, Human
acuucagcugacuuuu

SEQ ID NO: 3061068 - RNA, 23 nt, Human
ucucacacaugagcaucaggcca

SEQ ID NO: 3061069 - RNA, 20 nt, Human
acauaucuaguaugaaauua

SEQ ID NO: 3061070 - RNA, 22 nt, Human
acauaucuaguaugaaauuaua

SEQ ID NO: 3061071 - RNA, 23 nt, Human
acauaucuaguaugaaauuauau

SEQ ID NO: 3061072 - RNA, 17 nt, Human
acauaucuaguaugaaa

SEQ ID NO: 3061073 - RNA, 22 nt, Human
acauauugauuuccguuaaaau

SEQ ID NO: 3061074 - RNA, 18 nt, Human
acauauugauuuccguua

SEQ ID NO: 3061075 - RNA, 23 nt, Human
acauauugauuuccguuaaaaua

SEQ ID NO: 3061076 - RNA, 16 nt, Human
acauauugauuuccgu

SEQ ID NO: 3061077 - RNA, 14 nt, Human
acauauugauuucc

SEQ ID NO: 3061078 - RNA, 14 nt, Human
acauagaauuaaca

SEQ ID NO: 3061079 - RNA, 18 nt, Human
acauagaauuaacacaug

SEQ ID NO: 3061080 - RNA, 19 nt, Human
acauauauaacaaugcugu

SEQ ID NO: 3061081 - RNA, 18 nt, Human
acaucaacaucuugguca

SEQ ID NO: 3061082 - RNA, 16 nt, Human
acaucaacaucuuggu

SEQ ID NO: 3061083 - RNA, 13 nt, Human
acaucaacagaua

SEQ ID NO: 3061084 - RNA, 19 nt, Human
acaucuugcucugcugaca

SEQ ID NO: 3061085 - RNA, 18 nt, Human
acaucuugcucugcugac

SEQ ID NO: 3061086 - RNA, 17 nt, Human
acaugaaaacacauuuu

SEQ ID NO: 3061087 - RNA, 21 nt, Human
acaucuugcucugcugacaga

SEQ ID NO: 3061088 - RNA, 19 nt, Human
acaugaaaacacauuuuuc

SEQ ID NO: 3061089 - RNA, 18 nt, Human
acaugaaaacacauuuuu

SEQ ID NO: 3061090 - RNA, 16 nt, Human
acaugaaaacacauuu

SEQ ID NO: 3061091 - RNA, 13 nt, Human
acaucuugcucug

SEQ ID NO: 3061092 - RNA, 21 nt, Human
uauuuccauuaaaaaaucagu

SEQ ID NO: 3061093 - RNA, 13 nt, Human
uauuucauuucuu

SEQ ID NO: 3061094 - RNA, 22 nt, Human
uauuucccucaccuuucccauc

SEQ ID NO: 3061095 - RNA, 23 nt, Human
uauuuccuauauuguuuucagug

SEQ ID NO: 3061096 - RNA, 15 nt, Human
acaguugaaaaacag

SEQ ID NO: 3061097 - RNA, 16 nt, Human
acaguugaaaaacagc

SEQ ID NO: 3061098 - RNA, 20 nt, Human
acaguugaaaaacagcugag

SEQ ID NO: 3061099 - RNA, 16 nt, Human
acauaaaaacaacuuu

SEQ ID NO: 3061100 - RNA, 19 nt, Human
acauaaaaacaacuuuaua

SEQ ID NO: 3061101 - RNA, 21 nt, Human
acauaaaaacaacuuuauacc

SEQ ID NO: 3061102 - RNA, 21 nt, Human
acaguuuucugagaaagacua

SEQ ID NO: 3061103 - RNA, 20 nt, Human
acaguuuucugagaaagacu

SEQ ID NO: 3061104 - RNA, 19 nt, Human
acaguuuucugagaaagac

SEQ ID NO: 3061105 - RNA, 18 nt, Human
acaguuuucugagaaaga

SEQ ID NO: 3061106 - RNA, 20 nt, Human
acaguuuguuaguaugaggc

SEQ ID NO: 3061107 - RNA, 16 nt, Human
acaguuuguuaguaug

SEQ ID NO: 3061108 - RNA, 15 nt, Human
acaguuuucugagaa

SEQ ID NO: 3061109 - RNA, 17 nt, Human
acaguuuucugagaaag

SEQ ID NO: 3061110 - RNA, 16 nt, Human
acaguuuucugagaaa

SEQ ID NO: 3061111 - RNA, 13 nt, Human
acauacucccauc

SEQ ID NO: 3061112 - RNA, 22 nt, Human
acauacuaaccagcagaaaugc

SEQ ID NO: 3061113 - RNA, 21 nt, Human
acauacuaaccagcagaaaug

SEQ ID NO: 3061114 - RNA, 13 nt, Human
acauacuaaccag

SEQ ID NO: 3061115 - RNA, 14 nt, Human
acauacucugcuua

SEQ ID NO: 3061116 - RNA, 17 nt, Human
acauacucccaucugug

SEQ ID NO: 3061117 - RNA, 19 nt, Human
ucaaaauuguuacaaauug

SEQ ID NO: 3061118 - RNA, 16 nt, Human
ucaaaauuguuacaaa

SEQ ID NO: 3061119 - RNA, 14 nt, Human
ucaaaaugucuaag

SEQ ID NO: 3061120 - RNA, 21 nt, Human
ucaaaauaccaugccauuuaa

SEQ ID NO: 3061121 - RNA, 21 nt, Human
ucaaaauaugccccauucaac

SEQ ID NO: 3061122 - RNA, 23 nt, Human
ucaaaauaccaugccauuuaaag

SEQ ID NO: 3061123 - RNA, 14 nt, Human
uauuuuugacagaa

SEQ ID NO: 3061124 - RNA, 15 nt, Human
uauuuuugacagaau

SEQ ID NO: 3061125 - RNA, 13 nt, Human
uauuuuugacaga

SEQ ID NO: 3061126 - RNA, 19 nt, Human
uauuuuugacagaauaugu

SEQ ID NO: 3061127 - RNA, 23 nt, Human
uauuuuugacagaauauguuuca

SEQ ID NO: 3061128 - RNA, 13 nt, Human
ucaaaacugcacu

SEQ ID NO: 3061129 - RNA, 18 nt, Human
ucaaaagaaagaaaauca

SEQ ID NO: 3061130 - RNA, 17 nt, Human
ucaaagggugaaaauua

SEQ ID NO: 3061131 - RNA, 14 nt, Human
ucaaagcugaaaug

SEQ ID NO: 3061132 - RNA, 17 nt, Human
acaugagcaucaggcca

SEQ ID NO: 3061133 - RNA, 18 nt, Human
acaugagcaucaggccag

SEQ ID NO: 3061134 - RNA, 19 nt, Human
acaugagcaucaggccagg

SEQ ID NO: 3061135 - RNA, 19 nt, Human
acaugauccugcaauucca

SEQ ID NO: 3061136 - RNA, 17 nt, Human
acaugaucuucuuuaua

SEQ ID NO: 3061137 - RNA, 15 nt, Human
acaugaucuucuuua

SEQ ID NO: 3061138 - RNA, 22 nt, Human
acaugcuacacacugcauguuu

SEQ ID NO: 3061139 - RNA, 18 nt, Human
ucaaauaacuaaaaggua

SEQ ID NO: 3061140 - RNA, 16 nt, Human
ucaacagguuuuccug

SEQ ID NO: 3061141 - RNA, 17 nt, Human
ucaaauuucuaaaucuc

SEQ ID NO: 3061142 - RNA, 14 nt, Human
ucaaauuucuaaau

SEQ ID NO: 3061143 - RNA, 15 nt, Human
acauucuguuaauca

SEQ ID NO: 3061144 - RNA, 16 nt, Human
ucaaauuucuaaaucu

SEQ ID NO: 3061145 - RNA, 15 nt, Human
ucaaauuucuaaauc

SEQ ID NO: 3061146 - RNA, 12 nt, Human
acauucuguuaa

SEQ ID NO: 3061147 - RNA, 21 nt, Human
acaugcugaacaucacagcuu

SEQ ID NO: 3061148 - RNA, 14 nt, Human
acaugcugaacauc

SEQ ID NO: 3061149 - RNA, 21 nt, Human
acauguccaagaagcccagga

SEQ ID NO: 3061150 - RNA, 19 nt, Human
acauguccaagaagcccag

SEQ ID NO: 3061151 - RNA, 21 nt, Human
ucaaguauuauaccuuuuuua

SEQ ID NO: 3061152 - RNA, 16 nt, Human
ucaaguauuauaccuu

SEQ ID NO: 3061153 - RNA, 23 nt, Human
ucaaguauuauaccuuuuuuaga

SEQ ID NO: 3061154 - RNA, 15 nt, Human
ucaaguauuauaccu

SEQ ID NO: 3061155 - RNA, 11 nt, Human
ucaaguauuau

SEQ ID NO: 3061156 - RNA, 22 nt, Human
ucaagaugaugaugaucuuuaa

SEQ ID NO: 3061157 - RNA, 15 nt, Human
ucaauucuugccaaa

SEQ ID NO: 3061158 - RNA, 23 nt, Human
ucaauuuuucuuauuucauuucu

SEQ ID NO: 3061159 - RNA, 20 nt, Human
ucaauuuuucuuauuucauu

SEQ ID NO: 3061160 - RNA, 17 nt, Human
accaacauacucccauc

SEQ ID NO: 3061161 - RNA, 19 nt, Human
accaacauacucccaucug

SEQ ID NO: 3061162 - RNA, 21 nt, Human
accaacauacucccaucugug

SEQ ID NO: 3061163 - RNA, 22 nt, Human
accaacauacucccaucuguga

SEQ ID NO: 3061164 - RNA, 23 nt, Human
ucaagugaaaaaggaggaagaga

SEQ ID NO: 3061165 - RNA, 15 nt, Human
ucaagugaaaaagga

SEQ ID NO: 3061166 - RNA, 15 nt, Human
accaauguucucucu

SEQ ID NO: 3061167 - RNA, 15 nt, Human
accaaucaugaauua

SEQ ID NO: 3061168 - RNA, 13 nt, Human
accaaucaugaau

SEQ ID NO: 3061169 - RNA, 17 nt, Human
ucacauaucuaguauga

SEQ ID NO: 3061170 - RNA, 21 nt, Human
ucacauaucuaguaugaaauu

SEQ ID NO: 3061171 - RNA, 22 nt, Human
ucacauaucuaguaugaaauua

SEQ ID NO: 3061172 - RNA, 15 nt, Human
ucacaguucucuccu

SEQ ID NO: 3061173 - RNA, 15 nt, Human
ucacauaucugucau

SEQ ID NO: 3061174 - RNA, 12 nt, Human
ucacauaucugu

SEQ ID NO: 3061175 - RNA, 15 nt, Human
ucaccccggccaccu

SEQ ID NO: 3061176 - RNA, 14 nt, Human
ucaccccagcccca

SEQ ID NO: 3061177 - RNA, 20 nt, Human
ucaccccagccccaaaacuc

SEQ ID NO: 3061178 - RNA, 13 nt, Human
ucaccccagcccc

SEQ ID NO: 3061179 - RNA, 19 nt, Human
ucacccaguccugcccgcc

SEQ ID NO: 3061180 - RNA, 13 nt, Human
ucacccaguccug

SEQ ID NO: 3061181 - RNA, 22 nt, Human
accacuuuuguucuugguuugu

SEQ ID NO: 3061182 - RNA, 16 nt, Human
accagagcccaccuug

SEQ ID NO: 3061183 - RNA, 14 nt, Human
accagagcccaccu

SEQ ID NO: 3061184 - RNA, 12 nt, Human
accagagcccac

SEQ ID NO: 3061185 - RNA, 11 nt, Human
accagacaggu

SEQ ID NO: 3061186 - RNA, 14 nt, Human
accagacaccuuga

SEQ ID NO: 3061187 - RNA, 21 nt, Human
accacuuuuguucuugguuug

SEQ ID NO: 3061188 - RNA, 16 nt, Human
accacuuuuguucuug

SEQ ID NO: 3061189 - RNA, 15 nt, Human
accacuuuuguucuu

SEQ ID NO: 3061190 - RNA, 18 nt, Human
accacuuguguuuugcaa

SEQ ID NO: 3061191 - RNA, 17 nt, Human
accacugcacuccagcc

SEQ ID NO: 3061192 - RNA, 20 nt, Human
accacugcacuccagccugg

SEQ ID NO: 3061193 - RNA, 17 nt, Human
ucaccccggccaccugc

SEQ ID NO: 3061194 - RNA, 18 nt, Human
ucaccccggccaccugcg

SEQ ID NO: 3061195 - RNA, 21 nt, Human
accacugcacuccagccuggg

SEQ ID NO: 3061196 - RNA, 17 nt, Human
ucacuaccuucaugcau

SEQ ID NO: 3061197 - RNA, 19 nt, Human
ucacuauguugcccaggca

SEQ ID NO: 3061198 - RNA, 17 nt, Human
ucacuauguugcccagg

SEQ ID NO: 3061199 - RNA, 18 nt, Human
ucacuauguugcccaggc

SEQ ID NO: 3061200 - RNA, 15 nt, Human
ucaccucucccuugg

SEQ ID NO: 3061201 - RNA, 13 nt, Human
ucaccugccccuc

SEQ ID NO: 3061202 - RNA, 15 nt, Human
ucaccugccccucaa

SEQ ID NO: 3061203 - RNA, 23 nt, Human
ucacucuuauugcccacgcugga

SEQ ID NO: 3061204 - RNA, 21 nt, Human
ucacucuuauugcccacgcug

SEQ ID NO: 3061205 - RNA, 22 nt, Human
accauggucggaaaacaugcua

SEQ ID NO: 3061206 - RNA, 16 nt, Human
accauuggggcuccca

SEQ ID NO: 3061207 - RNA, 17 nt, Human
accauuggggcucccag

SEQ ID NO: 3061208 - RNA, 18 nt, Human
accauuggggcucccagc

SEQ ID NO: 3061209 - RNA, 23 nt, Human
accauuucuugagguaaaagcau

SEQ ID NO: 3061210 - RNA, 11 nt, Human
acccacugcuc

SEQ ID NO: 3061211 - RNA, 10 nt, Human
acccacugcu

SEQ ID NO: 3061212 - RNA, 11 nt, Human
acccacugcuu

SEQ ID NO: 3061213 - RNA, 15 nt, Human
acccacugcucuggu

SEQ ID NO: 3061214 - RNA, 14 nt, Human
acccacugcucugg

SEQ ID NO: 3061215 - RNA, 13 nt, Human
acccacugcucug

SEQ ID NO: 3061216 - RNA, 19 nt, Human
ucagaaguuucugccgcag

SEQ ID NO: 3061217 - RNA, 22 nt, Human
ucagaaguuucugccgcagccc

SEQ ID NO: 3061218 - RNA, 14 nt, Human
ucagaagacacuga

SEQ ID NO: 3061219 - RNA, 18 nt, Human
ucagagccugcaguuauu

SEQ ID NO: 3061220 - RNA, 15 nt, Human
ucagagccugcaguu

SEQ ID NO: 3061221 - RNA, 14 nt, Human
ucagagccugcagu

SEQ ID NO: 3061222 - RNA, 13 nt, Human
ucagagccugcag

SEQ ID NO: 3061223 - RNA, 16 nt, Human
ucagagagggugggag

SEQ ID NO: 3061224 - RNA, 21 nt, Human
ucagagagggugggagugggc

SEQ ID NO: 3061225 - RNA, 23 nt, Human
ucagagagggugggagugggccc

SEQ ID NO: 3061226 - RNA, 12 nt, Human
ucagagccugca

SEQ ID NO: 3061227 - RNA, 17 nt, Human
ucagagacuccugcagg

SEQ ID NO: 3061228 - RNA, 20 nt, Human
ucagagacuccugcaggcag

SEQ ID NO: 3061229 - RNA, 21 nt, Human
ucagagacuccugcaggcagc

SEQ ID NO: 3061230 - RNA, 16 nt, Human
ucagagacuccugcag

SEQ ID NO: 3061231 - RNA, 19 nt, Human
ucagaaucucaaauaacua

SEQ ID NO: 3061232 - RNA, 18 nt, Human
ucagaaucucaaauaacu

SEQ ID NO: 3061233 - RNA, 23 nt, Human
ucagccguguaaccauggaccca

SEQ ID NO: 3061234 - RNA, 23 nt, Human
acccagcgagcccugguggcagu

SEQ ID NO: 3061235 - RNA, 19 nt, Human
acccagcgagcccuggugg

SEQ ID NO: 3061236 - RNA, 22 nt, Human
ucagccaagaauucuuaaauau

SEQ ID NO: 3061237 - RNA, 23 nt, Human
accccagcuggggccaggcuggg

SEQ ID NO: 3061238 - RNA, 24 nt, Human
acccagcgagcccugguggcagug

SEQ ID NO: 3061239 - RNA, 13 nt, Human
ucaggaaagagaa

SEQ ID NO: 3061240 - RNA, 19 nt, Human
ucaggaaagagaacuucca

SEQ ID NO: 3061241 - RNA, 21 nt, Human
ucaggaaaucaaauaugcaaa

SEQ ID NO: 3061242 - RNA, 20 nt, Human
ucaggaaaucaaauaugcaa

SEQ ID NO: 3061243 - RNA, 20 nt, Human
ucagcuuguaaauagcucag

SEQ ID NO: 3061244 - RNA, 14 nt, Human
ucagcggggacagc

SEQ ID NO: 3061245 - RNA, 12 nt, Human
acccccacccaa

SEQ ID NO: 3061246 - RNA, 15 nt, Human
accccuucgcuccug

SEQ ID NO: 3061247 - RNA, 14 nt, Human
accccuucgcuccu

SEQ ID NO: 3061248 - RNA, 16 nt, Human
accccuucgcuccugu

SEQ ID NO: 3061249 - RNA, 18 nt, Human
ucaucuagguaaauuaca

SEQ ID NO: 3061250 - RNA, 14 nt, Human
ucaucuaggauuuu

SEQ ID NO: 3061251 - RNA, 22 nt, Human
ucauccuucuggaauaaggaga

SEQ ID NO: 3061252 - RNA, 16 nt, Human
ucaugaauuaguuuua

SEQ ID NO: 3061253 - RNA, 13 nt, Human
ucauccuccucag

SEQ ID NO: 3061254 - RNA, 19 nt, Human
ucauccuccucagaucuuc

SEQ ID NO: 3061255 - RNA, 18 nt, Human
ucauccucauacccaccc

SEQ ID NO: 3061256 - RNA, 14 nt, Human
ucauccuucuggaa

SEQ ID NO: 3061257 - RNA, 12 nt, Human
accuccugccuc

SEQ ID NO: 3061258 - RNA, 13 nt, Human
accuccugccucg

SEQ ID NO: 3061259 - RNA, 15 nt, Human
ucauccuaagcuauu

SEQ ID NO: 3061260 - RNA, 23 nt, Human
accuccugccucgaacuggcugc

SEQ ID NO: 3061261 - RNA, 19 nt, Human
accucaaaaugucuaagau

SEQ ID NO: 3061262 - RNA, 16 nt, Human
accucaaaaugucuaa

SEQ ID NO: 3061263 - RNA, 16 nt, Human
accuagggugauauua

SEQ ID NO: 3061264 - RNA, 21 nt, Human
accuagggugauauuaaccag

SEQ ID NO: 3061265 - RNA, 12 nt, Human
ucaggaagcuca

SEQ ID NO: 3061266 - RNA, 23 nt, Human
ucaggaaaucaaauaugcaaagc

SEQ ID NO: 3061267 - RNA, 22 nt, Human
ucaggaaaucaaauaugcaaag

SEQ ID NO: 3061268 - RNA, 13 nt, Human
ucaggaagcucag

SEQ ID NO: 3061269 - RNA, 14 nt, Human
ucaggaagcucagg

SEQ ID NO: 3061270 - RNA, 15 nt, Human
ucaggaagcucaggg

SEQ ID NO: 3061271 - RNA, 15 nt, Human
accgccuugcccagc

SEQ ID NO: 3061272 - RNA, 22 nt, Human
accgccuugcccagccuggaug

SEQ ID NO: 3061273 - RNA, 16 nt, Human
accgccuugcccagcc

SEQ ID NO: 3061274 - RNA, 17 nt, Human
accgccuugcccagccu

SEQ ID NO: 3061275 - RNA, 14 nt, Human
accugaggcccuuc

SEQ ID NO: 3061276 - RNA, 21 nt, Human
accucuugagccuugaacuuu

SEQ ID NO: 3061277 - RNA, 15 nt, Human
accugaggcccuucu

SEQ ID NO: 3061278 - RNA, 16 nt, Human
accugaggcccuucuc

SEQ ID NO: 3061279 - RNA, 20 nt, Human
accugaggcccuucucucca

SEQ ID NO: 3061280 - RNA, 21 nt, Human
accugaggcccuucucuccag

SEQ ID NO: 3061281 - RNA, 22 nt, Human
accugaggcccuucucuccagc

SEQ ID NO: 3061282 - RNA, 16 nt, Human
accugaggggccucuu

SEQ ID NO: 3061283 - RNA, 15 nt, Human
accugauugugucuc

SEQ ID NO: 3061284 - RNA, 17 nt, Human
accugauugugucucuu

SEQ ID NO: 3061285 - RNA, 18 nt, Human
accugauugugucucuug

SEQ ID NO: 3061286 - RNA, 14 nt, Human
accugauugugucu

SEQ ID NO: 3061287 - RNA, 19 nt, Human
accucggugccuuccucuu

SEQ ID NO: 3061288 - RNA, 13 nt, Human
accuccugggcua

SEQ ID NO: 3061289 - RNA, 22 nt, Human
ucauugaaaucuuuuugcuuug

SEQ ID NO: 3061290 - RNA, 12 nt, Human
ucauugaccuga

SEQ ID NO: 3061291 - RNA, 14 nt, Human
ucauugaccugagg

SEQ ID NO: 3061292 - RNA, 15 nt, Human
ucauugaccugaggc

SEQ ID NO: 3061293 - RNA, 12 nt, Human
ucauugaaaucu

SEQ ID NO: 3061294 - RNA, 13 nt, Human
ucauugaaaucuu

SEQ ID NO: 3061295 - RNA, 12 nt, Human
ucauucuucugu

SEQ ID NO: 3061296 - RNA, 14 nt, Human
uccaggcuguaucc

SEQ ID NO: 3061297 - RNA, 12 nt, Human
uccagccccugg

SEQ ID NO: 3061298 - RNA, 13 nt, Human
uccagccccugga

SEQ ID NO: 3061299 - RNA, 14 nt, Human
acgagaaaacaaua

SEQ ID NO: 3061300 - RNA, 21 nt, Human
accuuuuuuauacauaaacaa

SEQ ID NO: 3061301 - RNA, 20 nt, Human
accuuuuuuauacauaaaca

SEQ ID NO: 3061302 - RNA, 19 nt, Human
accuuuuuuauacauaaac

SEQ ID NO: 3061303 - RNA, 21 nt, Human
uccaggcuguaucccaugagc

SEQ ID NO: 3061304 - RNA, 19 nt, Human
acgccagauucuuuccuga

SEQ ID NO: 3061305 - RNA, 17 nt, Human
acgccagauucuuuccu

SEQ ID NO: 3061306 - RNA, 16 nt, Human
acgagcaggcuucuuc

SEQ ID NO: 3061307 - RNA, 20 nt, Human
acgagcaggcuacugucagc

SEQ ID NO: 3061308 - RNA, 19 nt, Human
acgagcaggcuacugucag

SEQ ID NO: 3061309 - RNA, 14 nt, Human
uccagacccggcug

SEQ ID NO: 3061310 - RNA, 20 nt, Human
uccagaauuucccaaagcag

SEQ ID NO: 3061311 - RNA, 22 nt, Human
uccagaauuucccaaagcagug

SEQ ID NO: 3061312 - RNA, 16 nt, Human
uccagaauuucccaaa

SEQ ID NO: 3061313 - RNA, 18 nt, Human
uccagacccggcugcgug

SEQ ID NO: 3061314 - RNA, 15 nt, Human
uccagacccggcugc

SEQ ID NO: 3061315 - RNA, 19 nt, Human
uccagacccggcugcgugg

SEQ ID NO: 3061316 - RNA, 17 nt, Human
accuuuugagugccuua

SEQ ID NO: 3061317 - RNA, 20 nt, Human
accuuuugagugccuuacac

SEQ ID NO: 3061318 - RNA, 14 nt, Human
accuuuugagugcc

SEQ ID NO: 3061319 - RNA, 23 nt, Human
uccaacccucaucaccaacgucu

SEQ ID NO: 3061320 - RNA, 16 nt, Human
uccaacccucaucacc

SEQ ID NO: 3061321 - RNA, 17 nt, Human
uccaacccucaucacca

SEQ ID NO: 3061322 - RNA, 14 nt, Human
uccaacccucauca

SEQ ID NO: 3061323 - RNA, 12 nt, Human
accugccaggaa

SEQ ID NO: 3061324 - RNA, 14 nt, Human
accugccaggaagc

SEQ ID NO: 3061325 - RNA, 20 nt, Human
uccaagcuggucccacucag

SEQ ID NO: 3061326 - RNA, 16 nt, Human
uccaagcuggucccac

SEQ ID NO: 3061327 - RNA, 21 nt, Human
uccaacuaucucauuuccaag

SEQ ID NO: 3061328 - RNA, 18 nt, Human
uccaaggguacuaaggaa

SEQ ID NO: 3061329 - RNA, 21 nt, Human
uccaagcuggucccacucagu

SEQ ID NO: 3061330 - RNA, 19 nt, Human
accuuagacagucccugcc

SEQ ID NO: 3061331 - RNA, 20 nt, Human
accuuagacagucccugcca

SEQ ID NO: 3061332 - RNA, 18 nt, Human
accuuagacagucccugc

SEQ ID NO: 3061333 - RNA, 19 nt, Human
accuguuucugcagccacu

SEQ ID NO: 3061334 - RNA, 23 nt, Human
accuggccucugcacuccccugc

SEQ ID NO: 3061335 - RNA, 14 nt, Human
accuggcucugugg

SEQ ID NO: 3061336 - RNA, 23 nt, Human
accuggcucuguggcgagccauu

SEQ ID NO: 3061337 - RNA, 18 nt, Human
accuggccucugcacucc

SEQ ID NO: 3061338 - RNA, 20 nt, Human
accuggccucugcacucccc

SEQ ID NO: 3061339 - RNA, 16 nt, Human
accuggccucugcacu

SEQ ID NO: 3061340 - RNA, 17 nt, Human
accuggccucugcacuc

SEQ ID NO: 3061341 - RNA, 14 nt, Human
accuggccucugca

SEQ ID NO: 3061342 - RNA, 15 nt, Human
uccacccaggagccc

SEQ ID NO: 3061343 - RNA, 14 nt, Human
uccacccaggagcc

SEQ ID NO: 3061344 - RNA, 12 nt, Human
uccacccaggag

SEQ ID NO: 3061345 - RNA, 19 nt, Human
uccacccaccucagccucc

SEQ ID NO: 3061346 - RNA, 18 nt, Human
uccacccaccucagccuc

SEQ ID NO: 3061347 - RNA, 17 nt, Human
uccacccaccucagccu

SEQ ID NO: 3061348 - RNA, 22 nt, Human
acguauaaaagccuguuuaaga

SEQ ID NO: 3061349 - RNA, 15 nt, Human
acgguuuuacugcag

SEQ ID NO: 3061350 - RNA, 23 nt, Human
acguggcugcuucaaggauccug

SEQ ID NO: 3061351 - RNA, 17 nt, Human
acgugggcauucaaaug

SEQ ID NO: 3061352 - RNA, 20 nt, Human
acgugggcauucaaauguau

SEQ ID NO: 3061353 - RNA, 15 nt, Human
ucccaccccacacac

SEQ ID NO: 3061354 - RNA, 20 nt, Human
ucccaccccacacacgccag

SEQ ID NO: 3061355 - RNA, 16 nt, Human
ucccacaaaggagagc

SEQ ID NO: 3061356 - RNA, 12 nt, Human
ucccaagugcca

SEQ ID NO: 3061357 - RNA, 13 nt, Human
ucccaagugccaa

SEQ ID NO: 3061358 - RNA, 15 nt, Human
ucccaagugccaaag

SEQ ID NO: 3061359 - RNA, 23 nt, Human
ucccaagugccaaagaagcagac

SEQ ID NO: 3061360 - RNA, 20 nt, Human
acgggaggguaaggcugugg

SEQ ID NO: 3061361 - RNA, 13 nt, Human
ucccacagcgcug

SEQ ID NO: 3061362 - RNA, 22 nt, Human
acgccagauucuuuccugaggc

SEQ ID NO: 3061363 - RNA, 23 nt, Human
acgccagauucuuuccugaggcu

SEQ ID NO: 3061364 - RNA, 20 nt, Human
uccauccugaggcuccacuu

SEQ ID NO: 3061365 - RNA, 21 nt, Human
uccauccugaggcuccacuug

SEQ ID NO: 3061366 - RNA, 19 nt, Human
uccauccugaggcuccacu

SEQ ID NO: 3061367 - RNA, 13 nt, Human
uccaugaagaugu

SEQ ID NO: 3061368 - RNA, 21 nt, Human
uccaugaagauguagaggaga

SEQ ID NO: 3061369 - RNA, 21 nt, Human
ucccaaagcagugcaugcugu

SEQ ID NO: 3061370 - RNA, 17 nt, Human
ucccaaagcagugcaug

SEQ ID NO: 3061371 - RNA, 18 nt, Human
ucccaaagcagugcaugc

SEQ ID NO: 3061372 - RNA, 14 nt, Human
ucccaaagugcugg

SEQ ID NO: 3061373 - RNA, 13 nt, Human
ucccaaagugcug

SEQ ID NO: 3061374 - RNA, 18 nt, Human
ucccaaacccuucagugc

SEQ ID NO: 3061375 - RNA, 16 nt, Human
ucccaaagcagugcau

SEQ ID NO: 3061376 - RNA, 15 nt, Human
ucccaucacccgcua

SEQ ID NO: 3061377 - RNA, 16 nt, Human
ucccauaugccugggc

SEQ ID NO: 3061378 - RNA, 22 nt, Human
ucccauaugccugggcagaagg

SEQ ID NO: 3061379 - RNA, 22 nt, Human
ucccagucauuuaauaaaugug

SEQ ID NO: 3061380 - RNA, 14 nt, Human
ucccagucauuuaa

SEQ ID NO: 3061381 - RNA, 18 nt, Human
uccccaccgcagacagga

SEQ ID NO: 3061382 - RNA, 21 nt, Human
uccccaccgcagacaggacca

SEQ ID NO: 3061383 - RNA, 17 nt, Human
uccccaccgcagacagg

SEQ ID NO: 3061384 - RNA, 15 nt, Human
acuacauucuguuaa

SEQ ID NO: 3061385 - RNA, 17 nt, Human
ucccagcugugcucugg

SEQ ID NO: 3061386 - RNA, 13 nt, Human
ucccagccaggcc

SEQ ID NO: 3061387 - RNA, 14 nt, Human
ucccagccaggccc

SEQ ID NO: 3061388 - RNA, 15 nt, Human
ucccagccaggcccu

SEQ ID NO: 3061389 - RNA, 13 nt, Human
acuacauucuguu

SEQ ID NO: 3061390 - RNA, 12 nt, Human
acuacauucugu

SEQ ID NO: 3061391 - RNA, 11 nt, Human
acuacauucug

SEQ ID NO: 3061392 - RNA, 15 nt, Human
acuacaguuuguuag

SEQ ID NO: 3061393 - RNA, 14 nt, Human
acuacauucuguua

SEQ ID NO: 3061394 - RNA, 14 nt, Human
acuacaguuuguua

SEQ ID NO: 3061395 - RNA, 13 nt, Human
acuacaguuuguu

SEQ ID NO: 3061396 - RNA, 17 nt, Human
acuacaguccucccauc

SEQ ID NO: 3061397 - RNA, 15 nt, Human
acuacaggcacccac

SEQ ID NO: 3061398 - RNA, 11 nt, Human
acuacaggcac

SEQ ID NO: 3061399 - RNA, 21 nt, Human
acuacuagggaaaugccuuug

SEQ ID NO: 3061400 - RNA, 14 nt, Human
acuacuagggaaau

SEQ ID NO: 3061401 - RNA, 17 nt, Human
acuacucccccaggugg

SEQ ID NO: 3061402 - RNA, 21 nt, Human
acucacauuuauucugcucac

SEQ ID NO: 3061403 - RNA, 12 nt, Human
acucaccccagc

SEQ ID NO: 3061404 - RNA, 17 nt, Human
ucccgaguagcugggac

SEQ ID NO: 3061405 - RNA, 16 nt, Human
ucccgaguagcuggga

SEQ ID NO: 3061406 - RNA, 18 nt, Human
ucccgaguagcugggacu

SEQ ID NO: 3061407 - RNA, 15 nt, Human
ucccgaguagcuggg

SEQ ID NO: 3061408 - RNA, 20 nt, Human
ucccgaauagcugggacuac

SEQ ID NO: 3061409 - RNA, 17 nt, Human
uccccucggagaagagc

SEQ ID NO: 3061410 - RNA, 16 nt, Human
uccccucggagaagag

SEQ ID NO: 3061411 - RNA, 16 nt, Human
ucccugaaggccccgc

SEQ ID NO: 3061412 - RNA, 11 nt, Human
ucccugagcag

SEQ ID NO: 3061413 - RNA, 21 nt, Human
ucccucuuucccucccuuccu

SEQ ID NO: 3061414 - RNA, 11 nt, Human
ucccugaaggc

SEQ ID NO: 3061415 - RNA, 15 nt, Human
ucccugaaggccccg

SEQ ID NO: 3061416 - RNA, 20 nt, Human
ucccucuuucccucccuucc

SEQ ID NO: 3061417 - RNA, 18 nt, Human
ucccucuuucccucccuu

SEQ ID NO: 3061418 - RNA, 14 nt, Human
ucccucuuucccuc

SEQ ID NO: 3061419 - RNA, 16 nt, Human
ucccggcuuuggugcg

SEQ ID NO: 3061420 - RNA, 19 nt, Human
uccuaaauauauuuuaaga

SEQ ID NO: 3061421 - RNA, 17 nt, Human
uccggucccugucccag

SEQ ID NO: 3061422 - RNA, 16 nt, Human
uccuagaaauucccca

SEQ ID NO: 3061423 - RNA, 19 nt, Human
ucccuuucugcuuguguua

SEQ ID NO: 3061424 - RNA, 12 nt, Human
ucccuuuuccuu

SEQ ID NO: 3061425 - RNA, 21 nt, Human
acuccugcaggcagccaggcc

SEQ ID NO: 3061426 - RNA, 12 nt, Human
ucccugucccag

SEQ ID NO: 3061427 - RNA, 15 nt, Human
ucccugguggcagcu

SEQ ID NO: 3061428 - RNA, 17 nt, Human
ucccuuacgugaguccu

SEQ ID NO: 3061429 - RNA, 13 nt, Human
acuccagccuggg

SEQ ID NO: 3061430 - RNA, 12 nt, Human
acuccagccugg

SEQ ID NO: 3061431 - RNA, 23 nt, Human
acuccagaauuucccaaagcagu

SEQ ID NO: 3061432 - RNA, 18 nt, Human
acuccugcaggcagccag

SEQ ID NO: 3061433 - RNA, 19 nt, Human
acuccugcaggcagccagg

SEQ ID NO: 3061434 - RNA, 17 nt, Human
acuccugcaggcagcca

SEQ ID NO: 3061435 - RNA, 14 nt, Human
acucauugaccuga

SEQ ID NO: 3061436 - RNA, 15 nt, Human
acucauucuucugua

SEQ ID NO: 3061437 - RNA, 15 nt, Human
acucauugaccugag

SEQ ID NO: 3061438 - RNA, 14 nt, Human
acuccaaagaaaug

SEQ ID NO: 3061439 - RNA, 18 nt, Human
acuccaaagaaauguaag

SEQ ID NO: 3061440 - RNA, 15 nt, Human
acuccaaagaaaugu

SEQ ID NO: 3061441 - RNA, 15 nt, Human
acuccagaauuuccc

SEQ ID NO: 3061442 - RNA, 17 nt, Human
acuccagaauuucccaa

SEQ ID NO: 3061443 - RNA, 18 nt, Human
acuccagaaagugacaag

SEQ ID NO: 3061444 - RNA, 17 nt, Human
uaauuuauacaggucau

SEQ ID NO: 3061445 - RNA, 13 nt, Human
uaauucaagaaaa

SEQ ID NO: 3061446 - RNA, 14 nt, Human
aaugagccuggcaa

SEQ ID NO: 3061447 - RNA, 15 nt, Human
uacaaaaagcauaaa

SEQ ID NO: 3061448 - RNA, 15 nt, Human
uacaaaaacacagca

SEQ ID NO: 3061449 - RNA, 20 nt, Human
uacaaaaagcauaaaaauua

SEQ ID NO: 3061450 - RNA, 15 nt, Human
uacaaaagcauguga

SEQ ID NO: 3061451 - RNA, 14 nt, Human
uacaaaaacacagc

SEQ ID NO: 3061452 - RNA, 13 nt, Human
uacaaaaacacag

SEQ ID NO: 3061453 - RNA, 20 nt, Human
aaugcccagccccuucugac

SEQ ID NO: 3061454 - RNA, 22 nt, Human
aaugcccagccccuucugaccc

SEQ ID NO: 3061455 - RNA, 23 nt, Human
aaugcccagccccuucugaccca

SEQ ID NO: 3061456 - RNA, 24 nt, Human
aaugcccagccccuucugacccau

SEQ ID NO: 3061457 - RNA, 21 nt, Human
aaugcugugcccuaaagugua

SEQ ID NO: 3061458 - RNA, 20 nt, Human
aaugcugugcccuaaagugu

SEQ ID NO: 3061459 - RNA, 13 nt, Human
aaugcugugcccu

SEQ ID NO: 3061460 - RNA, 21 nt, Human
aaugccccugaauuuaaauag

SEQ ID NO: 3061461 - RNA, 16 nt, Human
aauggacguguuauga

SEQ ID NO: 3061462 - RNA, 18 nt, Human
aauggaagacagcucuua

SEQ ID NO: 3061463 - RNA, 14 nt, Human
aaugcccagccccu

SEQ ID NO: 3061464 - RNA, 15 nt, Human
aaugcccagccccuu

SEQ ID NO: 3061465 - RNA, 13 nt, Human
aaugcccagcccc

SEQ ID NO: 3061466 - RNA, 21 nt, Human
uacaagcgugagccacugcac

SEQ ID NO: 3061467 - RNA, 19 nt, Human
aauggacuuuuguacauag

SEQ ID NO: 3061468 - RNA, 18 nt, Human
aauggacuuugcacacuu

SEQ ID NO: 3061469 - RNA, 23 nt, Human
aauggacuuugcacacuuuggcc

SEQ ID NO: 3061470 - RNA, 23 nt, Human
uacacauuuuauuuuauuaugca

SEQ ID NO: 3061471 - RNA, 18 nt, Human
uacaccacuacauucugu

SEQ ID NO: 3061472 - RNA, 17 nt, Human
uacaccacuacauucug

SEQ ID NO: 3061473 - RNA, 16 nt, Human
uacaccacuacauucu

SEQ ID NO: 3061474 - RNA, 15 nt, Human
uacaccacuacauuc

SEQ ID NO: 3061475 - RNA, 20 nt, Human
uacaccacuacauucuguua

SEQ ID NO: 3061476 - RNA, 19 nt, Human
uacaccacuacauucuguu

SEQ ID NO: 3061477 - RNA, 23 nt, Human
uacagagcccacgcccccacugg

SEQ ID NO: 3061478 - RNA, 18 nt, Human
uacacuaagagagaauga

SEQ ID NO: 3061479 - RNA, 19 nt, Human
uacacuaagagagaaugag

SEQ ID NO: 3061480 - RNA, 19 nt, Human
uacauauaagugauugcug

SEQ ID NO: 3061481 - RNA, 17 nt, Human
uacauauuuuuguagca

SEQ ID NO: 3061482 - RNA, 18 nt, Human
uacauauuuuuguagcac

SEQ ID NO: 3061483 - RNA, 12 nt, Human
aauguacugcau

SEQ ID NO: 3061484 - RNA, 15 nt, Human
uacaguaucucaggg

SEQ ID NO: 3061485 - RNA, 17 nt, Human
uacauaaugcgugcaua

SEQ ID NO: 3061486 - RNA, 20 nt, Human
uacauaaugcgugcauacca

SEQ ID NO: 3061487 - RNA, 19 nt, Human
uacauaaugcgugcauacc

SEQ ID NO: 3061488 - RNA, 15 nt, Human
uacauaaugcgugca

SEQ ID NO: 3061489 - RNA, 18 nt, Human
aauguacugcauaugaaa

SEQ ID NO: 3061490 - RNA, 14 nt, Human
aauguacugcauau

SEQ ID NO: 3061491 - RNA, 14 nt, Human
aauguauguguaag

SEQ ID NO: 3061492 - RNA, 12 nt, Human
aauguaugugua

SEQ ID NO: 3061493 - RNA, 11 nt, Human
aaugugauaug

SEQ ID NO: 3061494 - RNA, 15 nt, Human
aaugaaaaccacauu

SEQ ID NO: 3061495 - RNA, 15 nt, Human
aaugagccuggcaag

SEQ ID NO: 3061496 - RNA, 21 nt, Human
aaugagagacacacugaagaa

SEQ ID NO: 3061497 - RNA, 17 nt, Human
aaugacuuacuguacau

SEQ ID NO: 3061498 - RNA, 14 nt, Human
aaugacuuacugua

SEQ ID NO: 3061499 - RNA, 18 nt, Human
aaugacuuacuguacaug

SEQ ID NO: 3061500 - RNA, 14 nt, Human
uaaugguguuuuaa

SEQ ID NO: 3061501 - RNA, 13 nt, Human
uaaugaggaaacu

SEQ ID NO: 3061502 - RNA, 23 nt, Human
uaaugaaagacuguacaaaguag

SEQ ID NO: 3061503 - RNA, 22 nt, Human
uaaugaaagacuguacaaagua

SEQ ID NO: 3061504 - RNA, 15 nt, Human
uaaugacuuaagcac

SEQ ID NO: 3061505 - RNA, 21 nt, Human
uaaugacuuaagcacacuuga

SEQ ID NO: 3061506 - RNA, 19 nt, Human
uaaugaaagacuguacaaa

SEQ ID NO: 3061507 - RNA, 18 nt, Human
uaaugaaagacuguacaa

SEQ ID NO: 3061508 - RNA, 17 nt, Human
uaaugaaagacuguaca

SEQ ID NO: 3061509 - RNA, 14 nt, Human
uaaugaaagacugu

SEQ ID NO: 3061510 - RNA, 23 nt, Human
uaaucagugugucuaaauuugaa

SEQ ID NO: 3061511 - RNA, 14 nt, Human
uaauagguuuggac

SEQ ID NO: 3061512 - RNA, 19 nt, Human
uaauagguuuggacaaaau

SEQ ID NO: 3061513 - RNA, 13 nt, Human
aaucuucugaacu

SEQ ID NO: 3061514 - RNA, 20 nt, Human
aaucuucugaacuuggcgcu

SEQ ID NO: 3061515 - RNA, 15 nt, Human
aaucaucaagucuuu

SEQ ID NO: 3061516 - RNA, 17 nt, Human
aaucauggugcucagag

SEQ ID NO: 3061517 - RNA, 23 nt, Human
aaucaugaauuaguuuuauaugc

SEQ ID NO: 3061518 - RNA, 19 nt, Human
aaucaugaauuaguuuuau

SEQ ID NO: 3061519 - RNA, 17 nt, Human
aaucaugaauuaguuuu

SEQ ID NO: 3061520 - RNA, 17 nt, Human
aaucagacuaugaaguu

SEQ ID NO: 3061521 - RNA, 14 nt, Human
aaucagacuaugaa

SEQ ID NO: 3061522 - RNA, 20 nt, Human
uaaguauguguaaaauguga

SEQ ID NO: 3061523 - RNA, 19 nt, Human
uaaguacuauguaucaaug

SEQ ID NO: 3061524 - RNA, 12 nt, Human
uaaguucauaca

SEQ ID NO: 3061525 - RNA, 13 nt, Human
uaaguucauacau

SEQ ID NO: 3061526 - RNA, 20 nt, Human
uaaguuuuuauggcuuuugu

SEQ ID NO: 3061527 - RNA, 14 nt, Human
aaucuuauaauuua

SEQ ID NO: 3061528 - RNA, 15 nt, Human
aaucucaaauaacua

SEQ ID NO: 3061529 - RNA, 12 nt, Human
aaucucaaauuu

SEQ ID NO: 3061530 - RNA, 14 nt, Human
aaucucaaauuucu

SEQ ID NO: 3061531 - RNA, 13 nt, Human
aaucucaaauaac

SEQ ID NO: 3061532 - RNA, 12 nt, Human
aaucuaaaugga

SEQ ID NO: 3061533 - RNA, 13 nt, Human
aauccuugaagau

SEQ ID NO: 3061534 - RNA, 15 nt, Human
aaucuaaauggaacc

SEQ ID NO: 3061535 - RNA, 13 nt, Human
aaucuaaauggaa

SEQ ID NO: 3061536 - RNA, 18 nt, Human
aaucuaaauggaaccacu

SEQ ID NO: 3061537 - RNA, 15 nt, Human
aauaguauuugagag

SEQ ID NO: 3061538 - RNA, 12 nt, Human
aauaucacuugu

SEQ ID NO: 3061539 - RNA, 15 nt, Human
aauaucacuugucaa

SEQ ID NO: 3061540 - RNA, 14 nt, Human
uaacaugauuuggg

SEQ ID NO: 3061541 - RNA, 14 nt, Human
uaacauggaaguac

SEQ ID NO: 3061542 - RNA, 14 nt, Human
uaacuaaaagguau

SEQ ID NO: 3061543 - RNA, 15 nt, Human
uaacuaaaagguaug

SEQ ID NO: 3061544 - RNA, 15 nt, Human
uaacauggaaguacu

SEQ ID NO: 3061545 - RNA, 16 nt, Human
uaaccucuaaauucuu

SEQ ID NO: 3061546 - RNA, 19 nt, Human
uaaauuuugaguucuacau

SEQ ID NO: 3061547 - RNA, 18 nt, Human
uaaauuuugaguucuaca

SEQ ID NO: 3061548 - RNA, 20 nt, Human
uaaauuuugucuuuaacuca

SEQ ID NO: 3061549 - RNA, 18 nt, Human
aauagacaauuuauuaug

SEQ ID NO: 3061550 - RNA, 23 nt, Human
aauagacaauuuauuauggcaca

SEQ ID NO: 3061551 - RNA, 14 nt, Human
aauagcugggacua

SEQ ID NO: 3061552 - RNA, 13 nt, Human
aauagcugggacu

SEQ ID NO: 3061553 - RNA, 18 nt, Human
aauaggcguaacuaauuu

SEQ ID NO: 3061554 - RNA, 15 nt, Human
aauaggaaaaacuga

SEQ ID NO: 3061555 - RNA, 16 nt, Human
aauaggaaaaacugau

SEQ ID NO: 3061556 - RNA, 17 nt, Human
aauaggaaaaacugauu

SEQ ID NO: 3061557 - RNA, 18 nt, Human
aauaggaaaaacugauuu

SEQ ID NO: 3061558 - RNA, 19 nt, Human
aauaggaaaaacugauuuu

SEQ ID NO: 3061559 - RNA, 24 nt, Human
aauagcuuuuuucucugauacaga

SEQ ID NO: 3061560 - RNA, 18 nt, Human
uaacuuuuauaaacuuua

SEQ ID NO: 3061561 - RNA, 17 nt, Human
uaacuuuuauaaacuuu

SEQ ID NO: 3061562 - RNA, 15 nt, Human
uaacuuuuauaaacu

SEQ ID NO: 3061563 - RNA, 20 nt, Human
aauaucugaaaauguaugug

SEQ ID NO: 3061564 - RNA, 19 nt, Human
aauaucuuuuuuuuaauaa

SEQ ID NO: 3061565 - RNA, 19 nt, Human
aauaucugaaaauguaugu

SEQ ID NO: 3061566 - RNA, 18 nt, Human
aauaucugaaaauguaug

SEQ ID NO: 3061567 - RNA, 17 nt, Human
aauaucugaaaauguau

SEQ ID NO: 3061568 - RNA, 16 nt, Human
aauaucugaaaaugua

SEQ ID NO: 3061569 - RNA, 16 nt, Human
aauaucuccgucaacu

SEQ ID NO: 3061570 - RNA, 21 nt, Human
aauaucuccgucaacucauau

SEQ ID NO: 3061571 - RNA, 18 nt, Human
aauauuguguugugaaug

SEQ ID NO: 3061572 - RNA, 20 nt, Human
aauauugcuuuggucauaug

SEQ ID NO: 3061573 - RNA, 14 nt, Human
aauauuucagauaa

SEQ ID NO: 3061574 - RNA, 15 nt, Human
aauauuucagauaau

SEQ ID NO: 3061575 - RNA, 11 nt, Human
aauauugcuga

SEQ ID NO: 3061576 - RNA, 12 nt, Human
aauauugcugau

SEQ ID NO: 3061577 - RNA, 13 nt, Human
aauauugcugaug

SEQ ID NO: 3061578 - RNA, 15 nt, Human
aauauugcugauggu

SEQ ID NO: 3061579 - RNA, 18 nt, Human
aauauugcugauggugca

SEQ ID NO: 3061580 - RNA, 21 nt, Human
aauauugcugauggugcaaug

SEQ ID NO: 3061581 - RNA, 22 nt, Human
aauauugcugauggugcaauga

SEQ ID NO: 3061582 - RNA, 15 nt, Human
aauaugcacacauuu

SEQ ID NO: 3061583 - RNA, 24 nt, Human
aauaugcaaagcacugacuucuaa

SEQ ID NO: 3061584 - RNA, 18 nt, Human
aauauugauaugcuuaua

SEQ ID NO: 3061585 - RNA, 17 nt, Human
aauauugauaugcuuau

SEQ ID NO: 3061586 - RNA, 17 nt, Human
aauaugcaaagcacuga

SEQ ID NO: 3061587 - RNA, 15 nt, Human
aauaugcaaagcacu

SEQ ID NO: 3061588 - RNA, 24 nt, Human
uaaauguuuuuuuuuaaagacuuu

SEQ ID NO: 3061589 - RNA, 14 nt, Human
uaaauuaacuuuua

SEQ ID NO: 3061590 - RNA, 12 nt, Human
uaaauuaacuuu

SEQ ID NO: 3061591 - RNA, 17 nt, Human
uaaauuuugaguucuac

SEQ ID NO: 3061592 - RNA, 17 nt, Human
uaaauuaacuuuuauaa

SEQ ID NO: 3061593 - RNA, 16 nt, Human
uaaauuaacuuuuaua

SEQ ID NO: 3061594 - RNA, 15 nt, Human
uaaauuaacuuuuau

SEQ ID NO: 3061595 - RNA, 23 nt, Human
uaaauguuuuuuuuuaaagacuu

SEQ ID NO: 3061596 - RNA, 20 nt, Human
uaaauguugaaagaucaaaa

SEQ ID NO: 3061597 - RNA, 15 nt, Human
uaaauguugaaagau

SEQ ID NO: 3061598 - RNA, 23 nt, Human
uaaaugcaccuggaauauauaac

SEQ ID NO: 3061599 - RNA, 22 nt, Human
uaaaucuccaaaauaaaacuuu

SEQ ID NO: 3061600 - RNA, 15 nt, Human
uaaaucuccaaaaua

SEQ ID NO: 3061601 - RNA, 14 nt, Human
uaaaucuccaaaau

SEQ ID NO: 3061602 - RNA, 16 nt, Human
aauaacugugaaguuu

SEQ ID NO: 3061603 - RNA, 14 nt, Human
aauaacugugaagu

SEQ ID NO: 3061604 - RNA, 20 nt, Human
aauaacugugaaguuuacau

SEQ ID NO: 3061605 - RNA, 21 nt, Human
aauaauuuuaagaaaucaaag

SEQ ID NO: 3061606 - RNA, 17 nt, Human
aauaauuuuuauauuug

SEQ ID NO: 3061607 - RNA, 19 nt, Human
aauaauuuuuauauuugaa

SEQ ID NO: 3061608 - RNA, 16 nt, Human
aauaauuuuuauauuu

SEQ ID NO: 3061609 - RNA, 21 nt, Human
uaaauaaaguuuguugaaaca

SEQ ID NO: 3061610 - RNA, 12 nt, Human
uaaauaaaguuu

SEQ ID NO: 3061611 - RNA, 20 nt, Human
aauaauuuuuauauuugaaa

SEQ ID NO: 3061612 - RNA, 19 nt, Human
uaaauaaugugaaacugga

SEQ ID NO: 3061613 - RNA, 21 nt, Human
aauaacaaugaaaguugauaa

SEQ ID NO: 3061614 - RNA, 13 nt, Human
aauaacugugaag

SEQ ID NO: 3061615 - RNA, 22 nt, Human
aauaacauguaauuaaguacua

SEQ ID NO: 3061616 - RNA, 16 nt, Human
aauaaaucauaaaacu

SEQ ID NO: 3061617 - RNA, 15 nt, Human
aauaaaacuuuuuaa

SEQ ID NO: 3061618 - RNA, 14 nt, Human
aauaaaacuuuuua

SEQ ID NO: 3061619 - RNA, 12 nt, Human
aauaaaacuuuu

SEQ ID NO: 3061620 - RNA, 18 nt, Human
aauaaaacuuuuuaaaau

SEQ ID NO: 3061621 - RNA, 22 nt, Human
uaaaguaaaaacaaagaaauua

SEQ ID NO: 3061622 - RNA, 21 nt, Human
uaaaguaaaaacaaagaaauu

SEQ ID NO: 3061623 - RNA, 19 nt, Human
uaaaguaaaaacaaagaaa

SEQ ID NO: 3061624 - RNA, 22 nt, Human
uaaagguucaugcaaacuuuau

SEQ ID NO: 3061625 - RNA, 20 nt, Human
aaguuuuuauggcuuuugug

SEQ ID NO: 3061626 - RNA, 23 nt, Human
uacuguacagacagaaaaaacug

SEQ ID NO: 3061627 - RNA, 19 nt, Human
uacuguacagacagaaaaa

SEQ ID NO: 3061628 - RNA, 23 nt, Human
uacuguaauuugugauacaaugc

SEQ ID NO: 3061629 - RNA, 18 nt, Human
aauugaggacacugauau

SEQ ID NO: 3061630 - RNA, 23 nt, Human
uacugggaaagggauuuucagcc

SEQ ID NO: 3061631 - RNA, 17 nt, Human
uacuguaauuugugaua

SEQ ID NO: 3061632 - RNA, 16 nt, Human
uacuguaauuugugau

SEQ ID NO: 3061633 - RNA, 15 nt, Human
uacuguaauuuguga

SEQ ID NO: 3061634 - RNA, 19 nt, Human
uacugaaauaaacgucuua

SEQ ID NO: 3061635 - RNA, 22 nt, Human
uacugaaauaaacgucuuaaau

SEQ ID NO: 3061636 - RNA, 17 nt, Human
uacugagagugaacaaa

SEQ ID NO: 3061637 - RNA, 18 nt, Human
uacuagggaaaugccuuu

SEQ ID NO: 3061638 - RNA, 16 nt, Human
uacucuacccucuuag

SEQ ID NO: 3061639 - RNA, 22 nt, Human
uacucuacccucuuagaaaaac

SEQ ID NO: 3061640 - RNA, 13 nt, Human
uacgugaguccug

SEQ ID NO: 3061641 - RNA, 14 nt, Human
uacuaaaaauacaa

SEQ ID NO: 3061642 - RNA, 16 nt, Human
uacgucugacaggcaa

SEQ ID NO: 3061643 - RNA, 18 nt, Human
uacuaaaaauacaaaaaa

SEQ ID NO: 3061644 - RNA, 15 nt, Human
uacgucugacaggca

SEQ ID NO: 3061645 - RNA, 22 nt, Human
aauuuauaaacuuuuuucuuac

SEQ ID NO: 3061646 - RNA, 16 nt, Human
aauuuauacaggucau

SEQ ID NO: 3061647 - RNA, 17 nt, Human
aauuuauacaggucaua

SEQ ID NO: 3061648 - RNA, 14 nt, Human
aauuuauuauggca

SEQ ID NO: 3061649 - RNA, 13 nt, Human
aauuuauuauggc

SEQ ID NO: 3061650 - RNA, 17 nt, Human
aauuucuaggacugaau

SEQ ID NO: 3061651 - RNA, 18 nt, Human
aauuucuaggacugaauu

SEQ ID NO: 3061652 - RNA, 22 nt, Human
aauuucuaggacugaauuauga

SEQ ID NO: 3061653 - RNA, 23 nt, Human
aauuucuaggacugaauuaugaa

SEQ ID NO: 3061654 - RNA, 15 nt, Human
aauuuaccugaaguc

SEQ ID NO: 3061655 - RNA, 17 nt, Human
aauuuaccugaagucuu

SEQ ID NO: 3061656 - RNA, 17 nt, Human
aauuuacagagacagaa

SEQ ID NO: 3061657 - RNA, 18 nt, Human
aauuuacagagacagaaa

SEQ ID NO: 3061658 - RNA, 13 nt, Human
aauuuaguauuuu

SEQ ID NO: 3061659 - RNA, 15 nt, Human
uacuugaaaauuaac

SEQ ID NO: 3061660 - RNA, 16 nt, Human
uacuucuuauacauuu

SEQ ID NO: 3061661 - RNA, 15 nt, Human
uacuucuuauacauu

SEQ ID NO: 3061662 - RNA, 14 nt, Human
uacuucuuauacau

SEQ ID NO: 3061663 - RNA, 15 nt, Human
uacuucugcuacaua

SEQ ID NO: 3061664 - RNA, 19 nt, Human
uacuucuuaggguuaugau

SEQ ID NO: 3061665 - RNA, 20 nt, Human
uacuucuccacccugcucuc

SEQ ID NO: 3061666 - RNA, 18 nt, Human
uacuucuccacccugcuc

SEQ ID NO: 3061667 - RNA, 13 nt, Human
uacuucuccaccc

SEQ ID NO: 3061668 - RNA, 16 nt, Human
uacuucaugcugucua

SEQ ID NO: 3061669 - RNA, 22 nt, Human
aauuuuuaaucuuuaauuuuac

SEQ ID NO: 3061670 - RNA, 21 nt, Human
aauuuuucuuauuucauuucu

SEQ ID NO: 3061671 - RNA, 22 nt, Human
aauuuuuucucuaggaaauauu

SEQ ID NO: 3061672 - RNA, 20 nt, Human
aauuugugauacaaugcugu

SEQ ID NO: 3061673 - RNA, 15 nt, Human
aauuugguuuucaca

SEQ ID NO: 3061674 - RNA, 21 nt, Human
aauuugguuuucacauuggaa

SEQ ID NO: 3061675 - RNA, 16 nt, Human
aauuuguuauaaugaa

SEQ ID NO: 3061676 - RNA, 13 nt, Human
aauuugguuuuca

SEQ ID NO: 3061677 - RNA, 18 nt, Human
aauuugggggaaaauuua

SEQ ID NO: 3061678 - RNA, 22 nt, Human
uagauaggucagugcaaauacu

SEQ ID NO: 3061679 - RNA, 17 nt, Human
uagauaggccaugggca

SEQ ID NO: 3061680 - RNA, 21 nt, Human
uagaugcaguucugaagaaga

SEQ ID NO: 3061681 - RNA, 20 nt, Human
uagaugcaguucugaagaag

SEQ ID NO: 3061682 - RNA, 14 nt, Human
acaaaacuuuucua

SEQ ID NO: 3061683 - RNA, 21 nt, Human
acaaagcgugguggacaugca

SEQ ID NO: 3061684 - RNA, 18 nt, Human
acaaugaagauaaaaaga

SEQ ID NO: 3061685 - RNA, 16 nt, Human
uagcuacuaauuuuaa

SEQ ID NO: 3061686 - RNA, 16 nt, Human
uagcucaggugucccu

SEQ ID NO: 3061687 - RNA, 15 nt, Human
acaagcuccaagcuc

SEQ ID NO: 3061688 - RNA, 16 nt, Human
acaagcuccaagcucc

SEQ ID NO: 3061689 - RNA, 17 nt, Human
acaagcuccaagcuccc

SEQ ID NO: 3061690 - RNA, 19 nt, Human
acaagcuccaagcucccag

SEQ ID NO: 3061691 - RNA, 22 nt, Human
acaagcuccaagcucccaggca

SEQ ID NO: 3061692 - RNA, 21 nt, Human
acaaauucugucucuggauua

SEQ ID NO: 3061693 - RNA, 18 nt, Human
acaaauucugucucugga

SEQ ID NO: 3061694 - RNA, 17 nt, Human
acaaauuuacagagaca

SEQ ID NO: 3061695 - RNA, 17 nt, Human
acaacaucuuuuucuac

SEQ ID NO: 3061696 - RNA, 17 nt, Human
acaagaugguucuagca

SEQ ID NO: 3061697 - RNA, 22 nt, Human
acaagagcccaggccuccuaca

SEQ ID NO: 3061698 - RNA, 18 nt, Human
acaagagcccaggccucc

SEQ ID NO: 3061699 - RNA, 17 nt, Human
acaagaccacguuucua

SEQ ID NO: 3061700 - RNA, 16 nt, Human
acaagaccacguuucu

SEQ ID NO: 3061701 - RNA, 13 nt, Human
acaagcuccaagc

SEQ ID NO: 3061702 - RNA, 22 nt, Human
acaagcucacagaccuuugaac

SEQ ID NO: 3061703 - RNA, 17 nt, Human
acaagcgugagccacug

SEQ ID NO: 3061704 - RNA, 16 nt, Human
uauaaguauucuaaau

SEQ ID NO: 3061705 - RNA, 22 nt, Human
acacucacauuuauucugcuca

SEQ ID NO: 3061706 - RNA, 13 nt, Human
acacuccuucaca

SEQ ID NO: 3061707 - RNA, 14 nt, Human
acacuccagugaga

SEQ ID NO: 3061708 - RNA, 11 nt, Human
acacucugaga

SEQ ID NO: 3061709 - RNA, 13 nt, Human
acacucugagacu

SEQ ID NO: 3061710 - RNA, 22 nt, Human
acacuguucucugcccuccaag

SEQ ID NO: 3061711 - RNA, 23 nt, Human
acacuguucucugcccuccaaga

SEQ ID NO: 3061712 - RNA, 16 nt, Human
acacuguucucugccc

SEQ ID NO: 3061713 - RNA, 17 nt, Human
acacuguucucugcccu

SEQ ID NO: 3061714 - RNA, 18 nt, Human
acacuguucucugcccuc

SEQ ID NO: 3061715 - RNA, 20 nt, Human
acacuguucucugcccucca

SEQ ID NO: 3061716 - RNA, 14 nt, Human
acacuguucucugc

SEQ ID NO: 3061717 - RNA, 15 nt, Human
acacuguucucugcc

SEQ ID NO: 3061718 - RNA, 12 nt, Human
acacugaagaag

SEQ ID NO: 3061719 - RNA, 14 nt, Human
acacugaagaagca

SEQ ID NO: 3061720 - RNA, 15 nt, Human
uauauuuaaugauaa

SEQ ID NO: 3061721 - RNA, 12 nt, Human
uauauuuacaaa

SEQ ID NO: 3061722 - RNA, 15 nt, Human
acagacacaggcccg

SEQ ID NO: 3061723 - RNA, 17 nt, Human
acagacacaggcccggc

SEQ ID NO: 3061724 - RNA, 22 nt, Human
acagacacaggcccggcuccag

SEQ ID NO: 3061725 - RNA, 18 nt, Human
acagacacaggcccggcu

SEQ ID NO: 3061726 - RNA, 19 nt, Human
acagacuggaagcacagcu

SEQ ID NO: 3061727 - RNA, 17 nt, Human
acagacuggaagcacag

SEQ ID NO: 3061728 - RNA, 21 nt, Human
acagacuggaagcacagcuuc

SEQ ID NO: 3061729 - RNA, 18 nt, Human
acagaaaauucuucucca

SEQ ID NO: 3061730 - RNA, 17 nt, Human
acacuuuggcccagggu

SEQ ID NO: 3061731 - RNA, 18 nt, Human
acacuuuggcccagggug

SEQ ID NO: 3061732 - RNA, 15 nt, Human
acacuguuucaaacu

SEQ ID NO: 3061733 - RNA, 13 nt, Human
acacuuaaaaaug

SEQ ID NO: 3061734 - RNA, 15 nt, Human
acacuuaaaaauggu

SEQ ID NO: 3061735 - RNA, 23 nt, Human
acacuguuucaaacuuuacuaug

SEQ ID NO: 3061736 - RNA, 16 nt, Human
uaucuuguagcuuuau

SEQ ID NO: 3061737 - RNA, 19 nt, Human
acagcccuucuuuccacag

SEQ ID NO: 3061738 - RNA, 23 nt, Human
acagcccgggcucugccucccau

SEQ ID NO: 3061739 - RNA, 20 nt, Human
acagcccuucuuuccacaga

SEQ ID NO: 3061740 - RNA, 21 nt, Human
acagcccuucuuuccacagaa

SEQ ID NO: 3061741 - RNA, 21 nt, Human
acagcccgggcucugccuccc

SEQ ID NO: 3061742 - RNA, 22 nt, Human
acagcccgggcucugccuccca

SEQ ID NO: 3061743 - RNA, 20 nt, Human
acagcccgggcucugccucc

SEQ ID NO: 3061744 - RNA, 14 nt, Human
acagauaaucagug

SEQ ID NO: 3061745 - RNA, 15 nt, Human
acagaguuguuacau

SEQ ID NO: 3061746 - RNA, 22 nt, Human
acagaguuguuacauuuuuaag

SEQ ID NO: 3061747 - RNA, 21 nt, Human
acagaguuguuacauuuuuaa

SEQ ID NO: 3061748 - RNA, 20 nt, Human
acagauacuccuccaagguu

SEQ ID NO: 3061749 - RNA, 20 nt, Human
acagauagauauaugcucug

SEQ ID NO: 3061750 - RNA, 23 nt, Human
acagaugggugcuuggaggaagg

SEQ ID NO: 3061751 - RNA, 21 nt, Human
acagagcaagugagacccugu

SEQ ID NO: 3061752 - RNA, 18 nt, Human
acagagcuacacagggga

SEQ ID NO: 3061753 - RNA, 20 nt, Human
acagaguuguuacauuuuua

SEQ ID NO: 3061754 - RNA, 19 nt, Human
acagaguuguuacauuuuu

SEQ ID NO: 3061755 - RNA, 18 nt, Human
acagaguuguuacauuuu

SEQ ID NO: 3061756 - RNA, 17 nt, Human
acagaguuguuacauuu

SEQ ID NO: 3061757 - RNA, 16 nt, Human
acagaguuguuacauu

SEQ ID NO: 3061758 - RNA, 20 nt, Human
uaucccuacuguaauuugug

SEQ ID NO: 3061759 - RNA, 19 nt, Human
uaucccuacuguaauuugu

SEQ ID NO: 3061760 - RNA, 15 nt, Human
uauauuuauuacugu

SEQ ID NO: 3061761 - RNA, 19 nt, Human
uauauuuauuacuguaaga

SEQ ID NO: 3061762 - RNA, 13 nt, Human
uaucucagggccu

SEQ ID NO: 3061763 - RNA, 15 nt, Human
uaucucagggccugg

SEQ ID NO: 3061764 - RNA, 17 nt, Human
uaucucaaaacugcacu

SEQ ID NO: 3061765 - RNA, 13 nt, Human
uaguguucauaaa

SEQ ID NO: 3061766 - RNA, 12 nt, Human
uaguguuggaga

SEQ ID NO: 3061767 - RNA, 16 nt, Human
uaguguuggagaagaa

SEQ ID NO: 3061768 - RNA, 20 nt, Human
uaguaauagagcaaaauuga

SEQ ID NO: 3061769 - RNA, 13 nt, Human
uaguagagacagg

SEQ ID NO: 3061770 - RNA, 14 nt, Human
uaguaauagagcaa

SEQ ID NO: 3061771 - RNA, 21 nt, Human
uagguuggcaaaaaggcagga

SEQ ID NO: 3061772 - RNA, 22 nt, Human
acacagcucuucuccaggcugu

SEQ ID NO: 3061773 - RNA, 14 nt, Human
acacacugaagaag

SEQ ID NO: 3061774 - RNA, 11 nt, Human
acacagugagu

SEQ ID NO: 3061775 - RNA, 22 nt, Human
acacaguauuacuucugcuaca

SEQ ID NO: 3061776 - RNA, 18 nt, Human
acacaacuauuuuuccaa

SEQ ID NO: 3061777 - RNA, 21 nt, Human
acaaugguuuucuuguguguu

SEQ ID NO: 3061778 - RNA, 14 nt, Human
acacaacuauauug

SEQ ID NO: 3061779 - RNA, 17 nt, Human
acacaacuauauuguuu

SEQ ID NO: 3061780 - RNA, 15 nt, Human
acaaugguuuucuug

SEQ ID NO: 3061781 - RNA, 14 nt, Human
acaaugcuguauuu

SEQ ID NO: 3061782 - RNA, 17 nt, Human
acaaugcuguauuuuaa

SEQ ID NO: 3061783 - RNA, 13 nt, Human
acacacugaagaa

SEQ ID NO: 3061784 - RNA, 20 nt, Human
acacacucaaaucaagaaac

SEQ ID NO: 3061785 - RNA, 19 nt, Human
acacacagcucuguccugg

SEQ ID NO: 3061786 - RNA, 12 nt, Human
acacacagcucu

SEQ ID NO: 3061787 - RNA, 11 nt, Human
acacacagcuc

SEQ ID NO: 3061788 - RNA, 21 nt, Human
uauaaaaauaaaaaacacugg

SEQ ID NO: 3061789 - RNA, 20 nt, Human
uauaaaaauaaaaaacacug

SEQ ID NO: 3061790 - RNA, 23 nt, Human
uauaaaauaauuuuuauauuuga

SEQ ID NO: 3061791 - RNA, 18 nt, Human
acacaugcugaacaucac

SEQ ID NO: 3061792 - RNA, 18 nt, Human
acacauguccaagaagcc

SEQ ID NO: 3061793 - RNA, 19 nt, Human
acacauguccaagaagccc

SEQ ID NO: 3061794 - RNA, 13 nt, Human
acacauguccaag

SEQ ID NO: 3061795 - RNA, 21 nt, Human
acacauguccaagaagcccag

SEQ ID NO: 3061796 - RNA, 22 nt, Human
acacauguccaagaagcccagg

SEQ ID NO: 3061797 - RNA, 13 nt, Human
acacccagcccac

SEQ ID NO: 3061798 - RNA, 12 nt, Human
acacccagccca

SEQ ID NO: 3061799 - RNA, 18 nt, Human
acaccucugcacaagcug

SEQ ID NO: 3061800 - RNA, 16 nt, Human
acaccuugacagggca

SEQ ID NO: 3061801 - RNA, 15 nt, Human
acaccuugacagggc

SEQ ID NO: 3061802 - RNA, 14 nt, Human
acaccuugacaggg

SEQ ID NO: 3061803 - RNA, 19 nt, Human
acacuaaccacgcuggacc

SEQ ID NO: 3061804 - RNA, 17 nt, Human
acacuaagagagaauga

SEQ ID NO: 3061805 - RNA, 17 nt, Human
acacuaaccacgcugga

SEQ ID NO: 3061806 - RNA, 16 nt, Human
acacuaaccacgcugg

SEQ ID NO: 3061807 - RNA, 14 nt, Human
acacuaagagagaa

SEQ ID NO: 3061808 - RNA, 18 nt, Human
acacuaagagagaaugag

SEQ ID NO: 3061809 - RNA, 22 nt, Human
uauaaccaguguuguggauuua

SEQ ID NO: 3061810 - RNA, 16 nt, Human
guuuaaaaucauuucu

SEQ ID NO: 3061811 - RNA, 10 nt, Human
guuuaaaauc

SEQ ID NO: 3061812 - RNA, 18 nt, Human
guuguaccgcaaugugac

SEQ ID NO: 3061813 - RNA, 18 nt, Human
guuggucccccuuccaug

SEQ ID NO: 3061814 - RNA, 13 nt, Human
guuggguggaugc

SEQ ID NO: 3061815 - RNA, 19 nt, Human
aaggcuaccuuuguauucu

SEQ ID NO: 3061816 - RNA, 16 nt, Human
aaggccaaaggaagca

SEQ ID NO: 3061817 - RNA, 18 nt, Human
aaggccaaaggaagcaca

SEQ ID NO: 3061818 - RNA, 17 nt, Human
guugcccaggcuggcgu

SEQ ID NO: 3061819 - RNA, 15 nt, Human
guugcccaggcaggu

SEQ ID NO: 3061820 - RNA, 21 nt, Human
guugcccaggcuggcgugcag

SEQ ID NO: 3061821 - RNA, 18 nt, Human
guugcccaggcaggucuu

SEQ ID NO: 3061822 - RNA, 14 nt, Human
aaggcuccaggagc

SEQ ID NO: 3061823 - RNA, 17 nt, Human
guugcccaggcaggucu

SEQ ID NO: 3061824 - RNA, 15 nt, Human
aaggauccugagcca

SEQ ID NO: 3061825 - RNA, 17 nt, Human
aaggauccugagccaga

SEQ ID NO: 3061826 - RNA, 18 nt, Human
aaggaugaucuaggaaga

SEQ ID NO: 3061827 - RNA, 23 nt, Human
aaggaugaucuaggaagacuuug

SEQ ID NO: 3061828 - RNA, 14 nt, Human
aaggauccugagcc

SEQ ID NO: 3061829 - RNA, 13 nt, Human
aaggauccugagc

SEQ ID NO: 3061830 - RNA, 23 nt, Human
guugaugaucuuugcagacaggc

SEQ ID NO: 3061831 - RNA, 16 nt, Human
aaggaugcuuguacau

SEQ ID NO: 3061832 - RNA, 15 nt, Human
aaggaugcuuguaca

SEQ ID NO: 3061833 - RNA, 19 nt, Human
aaggaugcccaaagaugca

SEQ ID NO: 3061834 - RNA, 18 nt, Human
aaggaugcacagaguugu

SEQ ID NO: 3061835 - RNA, 19 nt, Human
aaggaugcuuguacauaau

SEQ ID NO: 3061836 - RNA, 17 nt, Human
aaggaugcuuguacaua

SEQ ID NO: 3061837 - RNA, 20 nt, Human
guuuucuuaaccagaucauu

SEQ ID NO: 3061838 - RNA, 19 nt, Human
guuuucuguucuuucuggc

SEQ ID NO: 3061839 - RNA, 11 nt, Human
guuuucuguuc

SEQ ID NO: 3061840 - RNA, 23 nt, Human
guuuucugagaaagacuauucaa

SEQ ID NO: 3061841 - RNA, 19 nt, Human
guuugcaucugaaaauuga

SEQ ID NO: 3061842 - RNA, 16 nt, Human
guuugccucugccucu

SEQ ID NO: 3061843 - RNA, 13 nt, Human
guuugccucugcc

SEQ ID NO: 3061844 - RNA, 23 nt, Human
guuucuaaaggcuaccuuuguau

SEQ ID NO: 3061845 - RNA, 22 nt, Human
guuucuaaaggcuaccuuugua

SEQ ID NO: 3061846 - RNA, 22 nt, Human
guuugauucagacagcugccug

SEQ ID NO: 3061847 - RNA, 20 nt, Human
aaguaaaaacaaagaaauua

SEQ ID NO: 3061848 - RNA, 13 nt, Human
aaguaaaaacaaa

SEQ ID NO: 3061849 - RNA, 12 nt, Human
aaguaauaugca

SEQ ID NO: 3061850 - RNA, 19 nt, Human
guuucuaaaggcuaccuuu

SEQ ID NO: 3061851 - RNA, 20 nt, Human
guuucuaaagcugccagccg

SEQ ID NO: 3061852 - RNA, 16 nt, Human
aaguaauaugcacaca

SEQ ID NO: 3061853 - RNA, 15 nt, Human
aaguaauaugcacac

SEQ ID NO: 3061854 - RNA, 16 nt, Human
aaggguaucaggugcu

SEQ ID NO: 3061855 - RNA, 23 nt, Human
aaggggaauguuugccucugccu

SEQ ID NO: 3061856 - RNA, 22 nt, Human
aaggggaauguuugccucugcc

SEQ ID NO: 3061857 - RNA, 19 nt, Human
aagggccuggccugagcug

SEQ ID NO: 3061858 - RNA, 14 nt, Human
aagggccuggccug

SEQ ID NO: 3061859 - RNA, 17 nt, Human
aagggccuggccugagc

SEQ ID NO: 3061860 - RNA, 13 nt, Human
aagggccuggccu

SEQ ID NO: 3061861 - RNA, 21 nt, Human
guuucaaacauauauaacaau

SEQ ID NO: 3061862 - RNA, 17 nt, Human
aagcuaucguaaaauua

SEQ ID NO: 3061863 - RNA, 22 nt, Human
aagcuauucaguaauaacucua

SEQ ID NO: 3061864 - RNA, 18 nt, Human
aagcuuauuaaaacucau

SEQ ID NO: 3061865 - RNA, 23 nt, Human
aagcuuguauuccuuuuucucuc

SEQ ID NO: 3061866 - RNA, 20 nt, Human
guucccauuugcuccuuucu

SEQ ID NO: 3061867 - RNA, 16 nt, Human
guucccauuugcuccu

SEQ ID NO: 3061868 - RNA, 20 nt, Human
guuccauggccucuucagau

SEQ ID NO: 3061869 - RNA, 18 nt, Human
guucuagcauggcauauu

SEQ ID NO: 3061870 - RNA, 20 nt, Human
guucccuuugacgccauccc

SEQ ID NO: 3061871 - RNA, 21 nt, Human
guucccuuugacgccauccca

SEQ ID NO: 3061872 - RNA, 22 nt, Human
guucccuuugacgccaucccag

SEQ ID NO: 3061873 - RNA, 16 nt, Human
guucuacccaggugcu

SEQ ID NO: 3061874 - RNA, 23 nt, Human
guucugggacacaguucaauucu

SEQ ID NO: 3061875 - RNA, 22 nt, Human
guugaugaucuuugcagacagg

SEQ ID NO: 3061876 - RNA, 14 nt, Human
guugacaugggaca

SEQ ID NO: 3061877 - RNA, 18 nt, Human
guugacaugggacauuug

SEQ ID NO: 3061878 - RNA, 17 nt, Human
guucuuaguuugcaguu

SEQ ID NO: 3061879 - RNA, 21 nt, Human
guucuugguuuguaaauuaac

SEQ ID NO: 3061880 - RNA, 13 nt, Human
guugacaugggac

SEQ ID NO: 3061881 - RNA, 10 nt, Human
guucauacau

SEQ ID NO: 3061882 - RNA, 13 nt, Human
guucauacauauu

SEQ ID NO: 3061883 - RNA, 14 nt, Human
guucauacauauuu

SEQ ID NO: 3061884 - RNA, 23 nt, Human
guucauacauauuuuuguagcac

SEQ ID NO: 3061885 - RNA, 9 nt, Human
guucauaca

SEQ ID NO: 3061886 - RNA, 19 nt, Human
guucaggguuggccccugc

SEQ ID NO: 3061887 - RNA, 18 nt, Human
guucaggguuggccccug

SEQ ID NO: 3061888 - RNA, 17 nt, Human
guucaggguuggccccu

SEQ ID NO: 3061889 - RNA, 17 nt, Human
guucagcuccagcucac

SEQ ID NO: 3061890 - RNA, 16 nt, Human
guucagcuccagcuca

SEQ ID NO: 3061891 - RNA, 18 nt, Human
guucagcuccagcucacc

SEQ ID NO: 3061892 - RNA, 15 nt, Human
guucagcuccagcuc

SEQ ID NO: 3061893 - RNA, 11 nt, Human
guucauacauu

SEQ ID NO: 3061894 - RNA, 14 nt, Human
guucauacauugua

SEQ ID NO: 3061895 - RNA, 19 nt, Human
aagccuccuccagccgcca

SEQ ID NO: 3061896 - RNA, 16 nt, Human
aagcuaggccuggcca

SEQ ID NO: 3061897 - RNA, 18 nt, Human
aagcuaggccuggccaga

SEQ ID NO: 3061898 - RNA, 17 nt, Human
aagcuaggccuggccag

SEQ ID NO: 3061899 - RNA, 18 nt, Human
guguuuuaaaaugagaaa

SEQ ID NO: 3061900 - RNA, 14 nt, Human
guuaaguaugugua

SEQ ID NO: 3061901 - RNA, 18 nt, Human
guuaaucauuagguguga

SEQ ID NO: 3061902 - RNA, 18 nt, Human
guuaaugauagcuacugu

SEQ ID NO: 3061903 - RNA, 17 nt, Human
guuaguaugaggcauuu

SEQ ID NO: 3061904 - RNA, 20 nt, Human
guuaguaugaggcauuuguu

SEQ ID NO: 3061905 - RNA, 18 nt, Human
guguuuccauauuuuaua

SEQ ID NO: 3061906 - RNA, 23 nt, Human
guguuuccuggcacugcuuccag

SEQ ID NO: 3061907 - RNA, 18 nt, Human
gugucuugcaauggcagc

SEQ ID NO: 3061908 - RNA, 17 nt, Human
gugucuugcaauggcag

SEQ ID NO: 3061909 - RNA, 17 nt, Human
gugugacuacuccccca

SEQ ID NO: 3061910 - RNA, 21 nt, Human
gugugaccacugcagaagaca

SEQ ID NO: 3061911 - RNA, 18 nt, Human
gugucuuuuuucacuaca

SEQ ID NO: 3061912 - RNA, 17 nt, Human
gugguuuucuguucuuu

SEQ ID NO: 3061913 - RNA, 18 nt, Human
aagagguuuuaaaaaaau

SEQ ID NO: 3061914 - RNA, 14 nt, Human
aagagguuuuaaag

SEQ ID NO: 3061915 - RNA, 18 nt, Human
aagagguuuuaaagcuuc

SEQ ID NO: 3061916 - RNA, 12 nt, Human
aagaugcagccg

SEQ ID NO: 3061917 - RNA, 12 nt, Human
aagcaaaggaga

SEQ ID NO: 3061918 - RNA, 13 nt, Human
aagcaaaggagau

SEQ ID NO: 3061919 - RNA, 14 nt, Human
aagaugugacaugu

SEQ ID NO: 3061920 - RNA, 18 nt, Human
aagaugugacauguuuua

SEQ ID NO: 3061921 - RNA, 13 nt, Human
gugggauccucca

SEQ ID NO: 3061922 - RNA, 13 nt, Human
gugggagugggcc

SEQ ID NO: 3061923 - RNA, 14 nt, Human
gugggagugggccc

SEQ ID NO: 3061924 - RNA, 23 nt, Human
gugggaggaucucuugagccugg

SEQ ID NO: 3061925 - RNA, 22 nt, Human
gugggacacccugugauggggc

SEQ ID NO: 3061926 - RNA, 21 nt, Human
gugggacagucaccucaugga

SEQ ID NO: 3061927 - RNA, 22 nt, Human
guggcgcagcauauucaggaag

SEQ ID NO: 3061928 - RNA, 23 nt, Human
guggcgcagcauauucaggaagc

SEQ ID NO: 3061929 - RNA, 14 nt, Human
guggugguuuucug

SEQ ID NO: 3061930 - RNA, 16 nt, Human
gugguuucagaaaugu

SEQ ID NO: 3061931 - RNA, 20 nt, Human
gugggggaucacagccucug

SEQ ID NO: 3061932 - RNA, 14 nt, Human
guggguacgggagg

SEQ ID NO: 3061933 - RNA, 16 nt, Human
aagacuguacaaagua

SEQ ID NO: 3061934 - RNA, 21 nt, Human
aagacugaguacguugugcau

SEQ ID NO: 3061935 - RNA, 17 nt, Human
aagacuguacaaaguag

SEQ ID NO: 3061936 - RNA, 17 nt, Human
aagacugaguacguugu

SEQ ID NO: 3061937 - RNA, 18 nt, Human
aagacuaucuaaauguug

SEQ ID NO: 3061938 - RNA, 17 nt, Human
aagacuaucuaaauguu

SEQ ID NO: 3061939 - RNA, 16 nt, Human
aagacuaucuaaaugu

SEQ ID NO: 3061940 - RNA, 18 nt, Human
aagacccuugugguccca

SEQ ID NO: 3061941 - RNA, 21 nt, Human
aagacccuuguggucccaccc

SEQ ID NO: 3061942 - RNA, 22 nt, Human
aagacccuuguggucccacccc

SEQ ID NO: 3061943 - RNA, 19 nt, Human
aagagcuguucacagccag

SEQ ID NO: 3061944 - RNA, 16 nt, Human
aacuuguauuaugugu

SEQ ID NO: 3061945 - RNA, 15 nt, Human
aacuuguauuaugug

SEQ ID NO: 3061946 - RNA, 18 nt, Human
aacuugucuuuggacccu

SEQ ID NO: 3061947 - RNA, 11 nt, Human
gugccuuaugg

SEQ ID NO: 3061948 - RNA, 17 nt, Human
aacuuggcgcugccccu

SEQ ID NO: 3061949 - RNA, 13 nt, Human
aacuuuaccuuuu

SEQ ID NO: 3061950 - RNA, 21 nt, Human
gugccuuauggaacacucuga

SEQ ID NO: 3061951 - RNA, 23 nt, Human
gugccuuauggaacacucugaga

SEQ ID NO: 3061952 - RNA, 14 nt, Human
gugccuuauggaac

SEQ ID NO: 3061953 - RNA, 13 nt, Human
gugccucugggac

SEQ ID NO: 3061954 - RNA, 12 nt, Human
gugccucuggga

SEQ ID NO: 3061955 - RNA, 22 nt, Human
gugccgagaaggaagccuccca

SEQ ID NO: 3061956 - RNA, 21 nt, Human
gugaaccaccacacccagccc

SEQ ID NO: 3061957 - RNA, 15 nt, Human
gugccucaagagaag

SEQ ID NO: 3061958 - RNA, 13 nt, Human
aagaaauauaccu

SEQ ID NO: 3061959 - RNA, 22 nt, Human
aagaaagacuaucuaaauguug

SEQ ID NO: 3061960 - RNA, 20 nt, Human
aagaaagacuaucuaaaugu

SEQ ID NO: 3061961 - RNA, 18 nt, Human
aagaaaaaggaugcacag

SEQ ID NO: 3061962 - RNA, 17 nt, Human
aagaaaaaggaugcaca

SEQ ID NO: 3061963 - RNA, 15 nt, Human
aagaaaaaggaugca

SEQ ID NO: 3061964 - RNA, 21 nt, Human
gugcuaucucccccagcccca

SEQ ID NO: 3061965 - RNA, 22 nt, Human
gugcuaggaacacuccuucaca

SEQ ID NO: 3061966 - RNA, 17 nt, Human
gugcuaggaacacuccu

SEQ ID NO: 3061967 - RNA, 18 nt, Human
gugcuaggaacacuccuu

SEQ ID NO: 3061968 - RNA, 16 nt, Human
aagaagugaaaaucua

SEQ ID NO: 3061969 - RNA, 22 nt, Human
aagaagugaaaaucuacacucc

SEQ ID NO: 3061970 - RNA, 15 nt, Human
gugcucaggagcccu

SEQ ID NO: 3061971 - RNA, 12 nt, Human
gugcuauguucu

SEQ ID NO: 3061972 - RNA, 19 nt, Human
gugcuaucucccccagccc

SEQ ID NO: 3061973 - RNA, 22 nt, Human
gugcuaucucccccagccccau

SEQ ID NO: 3061974 - RNA, 20 nt, Human
gugcugggauuacaggugug

SEQ ID NO: 3061975 - RNA, 22 nt, Human
gugcugggauuacaagcgugag

SEQ ID NO: 3061976 - RNA, 21 nt, Human
gugcugggauuacaagcguga

SEQ ID NO: 3061977 - RNA, 17 nt, Human
guggacacagcucuucu

SEQ ID NO: 3061978 - RNA, 23 nt, Human
guggacacagcucuucuccaggc

SEQ ID NO: 3061979 - RNA, 22 nt, Human
guggacacagcucuucuccagg

SEQ ID NO: 3061980 - RNA, 18 nt, Human
guggacacagcucuucuc

SEQ ID NO: 3061981 - RNA, 21 nt, Human
guggaugccugguggcagcug

SEQ ID NO: 3061982 - RNA, 20 nt, Human
guggaugcugcugccccugc

SEQ ID NO: 3061983 - RNA, 20 nt, Human
aagacaaaaagcuacuuauu

SEQ ID NO: 3061984 - RNA, 23 nt, Human
aagacaaaaagcuacuuauugua

SEQ ID NO: 3061985 - RNA, 16 nt, Human
aagacaaaaagcuacu

SEQ ID NO: 3061986 - RNA, 16 nt, Human
aagaauugaagcagga

SEQ ID NO: 3061987 - RNA, 18 nt, Human
aagaaugauuaugaauua

SEQ ID NO: 3061988 - RNA, 18 nt, Human
guggcaccagcagccugg

SEQ ID NO: 3061989 - RNA, 19 nt, Human
guggauuuaacagaaaugu

SEQ ID NO: 3061990 - RNA, 18 nt, Human
guggauuuaacagaaaug

SEQ ID NO: 3061991 - RNA, 19 nt, Human
guggcaccagcagccugga

SEQ ID NO: 3061992 - RNA, 14 nt, Human
guggcagcucaccu

SEQ ID NO: 3061993 - RNA, 16 nt, Human
guggcagcucaccucu

SEQ ID NO: 3061994 - RNA, 20 nt, Human
guggcagcucaccucucccu

SEQ ID NO: 3061995 - RNA, 16 nt, Human
aagaaugauuaugaau

SEQ ID NO: 3061996 - RNA, 13 nt, Human
aaaugcauguugc

SEQ ID NO: 3061997 - RNA, 22 nt, Human
aaaugcaccuggaauauauaac

SEQ ID NO: 3061998 - RNA, 18 nt, Human
aaaugcaccuggaauaua

SEQ ID NO: 3061999 - RNA, 14 nt, Human
aaaugcaccuggaa

SEQ ID NO: 3062000 - RNA, 14 nt, Human
aaaugcauuucuaa

SEQ ID NO: 3062001 - RNA, 13 nt, Human
aaaugcccagccc

SEQ ID NO: 3062002 - RNA, 13 nt, Human
aaaugcccagcuu

SEQ ID NO: 3062003 - RNA, 18 nt, Human
aaaugcccagccccuucu

SEQ ID NO: 3062004 - RNA, 14 nt, Human
aaaugcccagcccc

SEQ ID NO: 3062005 - RNA, 15 nt, Human
aaaugcccagccccu

SEQ ID NO: 3062006 - RNA, 18 nt, Human
aaaugggcagagcagaga

SEQ ID NO: 3062007 - RNA, 20 nt, Human
aaaugggcagagcagagacc

SEQ ID NO: 3062008 - RNA, 15 nt, Human
aaaugggcagagcag

SEQ ID NO: 3062009 - RNA, 19 nt, Human
aaauggcuuccuggcaaua

SEQ ID NO: 3062010 - RNA, 18 nt, Human
aaauggcuuccuggcaau

SEQ ID NO: 3062011 - RNA, 11 nt, Human
aaaugagaaau

SEQ ID NO: 3062012 - RNA, 21 nt, Human
aaaugaaagcagggacuugaa

SEQ ID NO: 3062013 - RNA, 22 nt, Human
aaaugaaagcagggacuugaac

SEQ ID NO: 3062014 - RNA, 14 nt, Human
aaaugagaaaucua

SEQ ID NO: 3062015 - RNA, 13 nt, Human
aaaugagaaaucu

SEQ ID NO: 3062016 - RNA, 16 nt, Human
aaaugagaaaucuaaa

SEQ ID NO: 3062017 - RNA, 13 nt, Human
aaaugagccuggc

SEQ ID NO: 3062018 - RNA, 19 nt, Human
aaaugagccuggcaagaau

SEQ ID NO: 3062019 - RNA, 23 nt, Human
aaaugagguacucuccuggaaau

SEQ ID NO: 3062020 - RNA, 16 nt, Human
aaaugagguacucucc

SEQ ID NO: 3062021 - RNA, 19 nt, Human
aaaugaggucagagccugc

SEQ ID NO: 3062022 - RNA, 17 nt, Human
aaaugaggucagagccu

SEQ ID NO: 3062023 - RNA, 18 nt, Human
aaauccauacauuugugu

SEQ ID NO: 3062024 - RNA, 15 nt, Human
guaggaagacuuugg

SEQ ID NO: 3062025 - RNA, 18 nt, Human
guaggaagguuaauguuc

SEQ ID NO: 3062026 - RNA, 21 nt, Human
guagcugggacuacaggcacc

SEQ ID NO: 3062027 - RNA, 19 nt, Human
guagcugggacuacaggca

SEQ ID NO: 3062028 - RNA, 18 nt, Human
guagcugggacuacaggc

SEQ ID NO: 3062029 - RNA, 12 nt, Human
guagcugggacu

SEQ ID NO: 3062030 - RNA, 22 nt, Human
guagcucuaggagggcuggcaa

SEQ ID NO: 3062031 - RNA, 19 nt, Human
aaaucuacacuccagugag

SEQ ID NO: 3062032 - RNA, 14 nt, Human
aaaugaaaaaauau

SEQ ID NO: 3062033 - RNA, 17 nt, Human
aaaugaaaaucgugaca

SEQ ID NO: 3062034 - RNA, 17 nt, Human
aaaucucaaauuucuaa

SEQ ID NO: 3062035 - RNA, 16 nt, Human
aaaucucaaauuucua

SEQ ID NO: 3062036 - RNA, 15 nt, Human
aaaucucaaauuucu

SEQ ID NO: 3062037 - RNA, 15 nt, Human
aaaucccauuuaaaa

SEQ ID NO: 3062038 - RNA, 18 nt, Human
aaaucccuuaccucggug

SEQ ID NO: 3062039 - RNA, 13 nt, Human
aaaucgaugcagu

SEQ ID NO: 3062040 - RNA, 14 nt, Human
aaauccuugaagau

SEQ ID NO: 3062041 - RNA, 17 nt, Human
aaauuucagcagcugca

SEQ ID NO: 3062042 - RNA, 18 nt, Human
aaauuucagcagcugcag

SEQ ID NO: 3062043 - RNA, 20 nt, Human
aaauuuaguauuuuguuuca

SEQ ID NO: 3062044 - RNA, 20 nt, Human
guauuuuugacagaauaugu

SEQ ID NO: 3062045 - RNA, 16 nt, Human
guauuuuugacagaau

SEQ ID NO: 3062046 - RNA, 22 nt, Human
aaauuuccugggagcuuuugua

SEQ ID NO: 3062047 - RNA, 15 nt, Human
guauuuuuuuacuaa

SEQ ID NO: 3062048 - RNA, 14 nt, Human
guauuuuuuuacua

SEQ ID NO: 3062049 - RNA, 19 nt, Human
gucaaaguggugagaggca

SEQ ID NO: 3062050 - RNA, 18 nt, Human
gucaaaguggugagaggc

SEQ ID NO: 3062051 - RNA, 21 nt, Human
guauuuuuuuacuaauagaca

SEQ ID NO: 3062052 - RNA, 17 nt, Human
guauuuuuuuacuaaua

SEQ ID NO: 3062053 - RNA, 20 nt, Human
gucacacaguauuacuucug

SEQ ID NO: 3062054 - RNA, 16 nt, Human
gucacacacuuuggcu

SEQ ID NO: 3062055 - RNA, 19 nt, Human
gucaacucauauuuucaug

SEQ ID NO: 3062056 - RNA, 17 nt, Human
aaauuauuuuguucaua

SEQ ID NO: 3062057 - RNA, 19 nt, Human
aaauuauuuuguucauaca

SEQ ID NO: 3062058 - RNA, 22 nt, Human
aaauuauauaaguauucuaaau

SEQ ID NO: 3062059 - RNA, 16 nt, Human
aaauuauauaaguauu

SEQ ID NO: 3062060 - RNA, 18 nt, Human
aaauuauauaaguauucu

SEQ ID NO: 3062061 - RNA, 20 nt, Human
aaauuauuuuguucauacau

SEQ ID NO: 3062062 - RNA, 21 nt, Human
aaauuauuuuguucauacaua

SEQ ID NO: 3062063 - RNA, 22 nt, Human
aaauuauuuuguucauacauau

SEQ ID NO: 3062064 - RNA, 14 nt, Human
aaauucaugcugcu

SEQ ID NO: 3062065 - RNA, 16 nt, Human
aaauuccccacccuga

SEQ ID NO: 3062066 - RNA, 16 nt, Human
guauuuaauucauguu

SEQ ID NO: 3062067 - RNA, 22 nt, Human
guauuggcuagagguucaaaga

SEQ ID NO: 3062068 - RNA, 20 nt, Human
guauuuaauagguuuggaca

SEQ ID NO: 3062069 - RNA, 23 nt, Human
aaauuaacuuuuauaaacuuuac

SEQ ID NO: 3062070 - RNA, 22 nt, Human
aaauuaacuuuuauaaacuuua

SEQ ID NO: 3062071 - RNA, 21 nt, Human
aaauuaacuuuuauaaacuuu

SEQ ID NO: 3062072 - RNA, 19 nt, Human
aaauuaacuuuuauaaacu

SEQ ID NO: 3062073 - RNA, 21 nt, Human
guauaaaagccuguuuaagag

SEQ ID NO: 3062074 - RNA, 18 nt, Human
guauaaaagccuguuuaa

SEQ ID NO: 3062075 - RNA, 22 nt, Human
guauauugauccagaaagaaaa

SEQ ID NO: 3062076 - RNA, 17 nt, Human
guauaaaagccuguuua

SEQ ID NO: 3062077 - RNA, 16 nt, Human
aaaugggggugcauuu

SEQ ID NO: 3062078 - RNA, 15 nt, Human
aaaugggggugcauu

SEQ ID NO: 3062079 - RNA, 18 nt, Human
aaaugggggugcauuuga

SEQ ID NO: 3062080 - RNA, 17 nt, Human
aaaugggggugcauuug

SEQ ID NO: 3062081 - RNA, 22 nt, Human
aaauguaagggaaacugccagc

SEQ ID NO: 3062082 - RNA, 15 nt, Human
guaugggagagaaga

SEQ ID NO: 3062083 - RNA, 21 nt, Human
guauucucuccuguaccucuu

SEQ ID NO: 3062084 - RNA, 15 nt, Human
guauucuuauuuaau

SEQ ID NO: 3062085 - RNA, 14 nt, Human
guaugggagagaag

SEQ ID NO: 3062086 - RNA, 14 nt, Human
guaugauucccagc

SEQ ID NO: 3062087 - RNA, 21 nt, Human
guaucccaugagccucagcau

SEQ ID NO: 3062088 - RNA, 22 nt, Human
guaugaucacggcucacugcag

SEQ ID NO: 3062089 - RNA, 15 nt, Human
guaucccuacuguaa

SEQ ID NO: 3062090 - RNA, 17 nt, Human
aaccucaaaaugucuaa

SEQ ID NO: 3062091 - RNA, 17 nt, Human
aaccuagggugauauua

SEQ ID NO: 3062092 - RNA, 20 nt, Human
aaccuagggugauauuaacc

SEQ ID NO: 3062093 - RNA, 15 nt, Human
aacccccagccugcu

SEQ ID NO: 3062094 - RNA, 14 nt, Human
aacccccagccugc

SEQ ID NO: 3062095 - RNA, 13 nt, Human
aacccccagccug

SEQ ID NO: 3062096 - RNA, 14 nt, Human
aaccuccugggcua

SEQ ID NO: 3062097 - RNA, 24 nt, Human
aaccucuaaauucuuucauuuuag

SEQ ID NO: 3062098 - RNA, 17 nt, Human
aaccuccgccucuuggg

SEQ ID NO: 3062099 - RNA, 23 nt, Human
aaccauuuugcugucccuuuucc

SEQ ID NO: 3062100 - RNA, 13 nt, Human
aacccaaauguuc

SEQ ID NO: 3062101 - RNA, 13 nt, Human
aacccagcucugg

SEQ ID NO: 3062102 - RNA, 14 nt, Human
aacccagcucuggu

SEQ ID NO: 3062103 - RNA, 11 nt, Human
aacccagcucu

SEQ ID NO: 3062104 - RNA, 18 nt, Human
aacccaaauguucaucaa

SEQ ID NO: 3062105 - RNA, 17 nt, Human
aacccagcucuggucca

SEQ ID NO: 3062106 - RNA, 20 nt, Human
aacccauauuuguacaccaa

SEQ ID NO: 3062107 - RNA, 18 nt, Human
aaccacaucuugcucugc

SEQ ID NO: 3062108 - RNA, 12 nt, Human
aaccacagcagu

SEQ ID NO: 3062109 - RNA, 21 nt, Human
aaccaucauugaaaucuuuuu

SEQ ID NO: 3062110 - RNA, 19 nt, Human
aaccaucauugaaaucuuu

SEQ ID NO: 3062111 - RNA, 20 nt, Human
aaccaucauugaaaucuuuu

SEQ ID NO: 3062112 - RNA, 22 nt, Human
aaccacaucuugcucugcugac

SEQ ID NO: 3062113 - RNA, 20 nt, Human
aaccacaucuugcucugcug

SEQ ID NO: 3062114 - RNA, 16 nt, Human
aacauuuugucauaua

SEQ ID NO: 3062115 - RNA, 13 nt, Human
gucuccauguuug

SEQ ID NO: 3062116 - RNA, 22 nt, Human
gucuuaauuaaaagaauauuuu

SEQ ID NO: 3062117 - RNA, 21 nt, Human
gucuuaauuaaaagaauauuu

SEQ ID NO: 3062118 - RNA, 19 nt, Human
gucuuaauuaaaagaauau

SEQ ID NO: 3062119 - RNA, 14 nt, Human
gucuuuggacccug

SEQ ID NO: 3062120 - RNA, 15 nt, Human
gucuuuggacccuga

SEQ ID NO: 3062121 - RNA, 17 nt, Human
gucuuuggacccugagg

SEQ ID NO: 3062122 - RNA, 14 nt, Human
gucuuuucuugcau

SEQ ID NO: 3062123 - RNA, 19 nt, Human
gucuuuucuugcaugaggc

SEQ ID NO: 3062124 - RNA, 24 nt, Human
gucuuuucuugcaugaggcuagug

SEQ ID NO: 3062125 - RNA, 15 nt, Human
gucuuagauguauau

SEQ ID NO: 3062126 - RNA, 18 nt, Human
aacucguuaauuuguagu

SEQ ID NO: 3062127 - RNA, 13 nt, Human
aacucccuuucaa

SEQ ID NO: 3062128 - RNA, 14 nt, Human
aacucccuuucaac

SEQ ID NO: 3062129 - RNA, 19 nt, Human
gugaaccaccacacccagc

SEQ ID NO: 3062130 - RNA, 15 nt, Human
gugaacacaucagcu

SEQ ID NO: 3062131 - RNA, 21 nt, Human
aacuccagaaagugacaagcu

SEQ ID NO: 3062132 - RNA, 14 nt, Human
aacuccagaaagug

SEQ ID NO: 3062133 - RNA, 22 nt, Human
aacguggcugcuucaaggaucc

SEQ ID NO: 3062134 - RNA, 16 nt, Human
aacguggcugcuucaa

SEQ ID NO: 3062135 - RNA, 19 nt, Human
aacguggcugcuucaagga

SEQ ID NO: 3062136 - RNA, 15 nt, Human
aacguggcugcuuca

SEQ ID NO: 3062137 - RNA, 20 nt, Human
aacauuuguucuauagcuuu

SEQ ID NO: 3062138 - RNA, 18 nt, Human
aacauuugguaaggggaa

SEQ ID NO: 3062139 - RNA, 14 nt, Human
aacauacucccauc

SEQ ID NO: 3062140 - RNA, 15 nt, Human
aacauacucccaucu

SEQ ID NO: 3062141 - RNA, 15 nt, Human
aacagaaauguacag

SEQ ID NO: 3062142 - RNA, 10 nt, Human
aacagaaaug

SEQ ID NO: 3062143 - RNA, 21 nt, Human
aacagaaauguacagcaagga

SEQ ID NO: 3062144 - RNA, 21 nt, Human
guccggucccugucccagugc

SEQ ID NO: 3062145 - RNA, 13 nt, Human
guccgagcuuuga

SEQ ID NO: 3062146 - RNA, 19 nt, Human
aacaguuguguuugaagca

SEQ ID NO: 3062147 - RNA, 13 nt, Human
aacaggcugggcu

SEQ ID NO: 3062148 - RNA, 22 nt, Human
aacaggcugggcuucaguggca

SEQ ID NO: 3062149 - RNA, 19 nt, Human
aacagacuggaagcacagc

SEQ ID NO: 3062150 - RNA, 23 nt, Human
aacaggcugggcuucaguggcag

SEQ ID NO: 3062151 - RNA, 19 nt, Human
aacagguuuuccugaagaa

SEQ ID NO: 3062152 - RNA, 22 nt, Human
aacaguagugauaguuguaccg

SEQ ID NO: 3062153 - RNA, 14 nt, Human
aacaaugaagauaa

SEQ ID NO: 3062154 - RNA, 18 nt, Human
aacaaugaagauaaaaag

SEQ ID NO: 3062155 - RNA, 23 nt, Human
aacaaggcaaggcugucaauuac

SEQ ID NO: 3062156 - RNA, 18 nt, Human
aacaagucagucauucag

SEQ ID NO: 3062157 - RNA, 15 nt, Human
aacaagucagucauu

SEQ ID NO: 3062158 - RNA, 23 nt, Human
aaauuuuuaaucuuuaauuuuac

SEQ ID NO: 3062159 - RNA, 15 nt, Human
gucacaggcaggucc

SEQ ID NO: 3062160 - RNA, 13 nt, Human
gucacaggcaggu

SEQ ID NO: 3062161 - RNA, 16 nt, Human
gucacaggcaggucca

SEQ ID NO: 3062162 - RNA, 12 nt, Human
gucacaggcagg

SEQ ID NO: 3062163 - RNA, 21 nt, Human
aacaagccuccuuuuaaagua

SEQ ID NO: 3062164 - RNA, 15 nt, Human
aacaaggaugaauua

SEQ ID NO: 3062165 - RNA, 17 nt, Human
aacaagaccacguuucu

SEQ ID NO: 3062166 - RNA, 16 nt, Human
aacaagaccacguuuc

SEQ ID NO: 3062167 - RNA, 19 nt, Human
aacaagaccacguuucuaa

SEQ ID NO: 3062168 - RNA, 15 nt, Human
aacacuguucucugc

SEQ ID NO: 3062169 - RNA, 20 nt, Human
aacacuguucucugcccucc

SEQ ID NO: 3062170 - RNA, 17 nt, Human
aacacucauugaccuga

SEQ ID NO: 3062171 - RNA, 21 nt, Human
aacacucauugaccugaggcc

SEQ ID NO: 3062172 - RNA, 12 nt, Human
aacacuccuuca

SEQ ID NO: 3062173 - RNA, 11 nt, Human
aacacucugag

SEQ ID NO: 3062174 - RNA, 12 nt, Human
aacacucugaga

SEQ ID NO: 3062175 - RNA, 13 nt, Human
aacacucugagac

SEQ ID NO: 3062176 - RNA, 14 nt, Human
aacacucugagacu

SEQ ID NO: 3062177 - RNA, 22 nt, Human
gucauuugagcagggcucagcg

SEQ ID NO: 3062178 - RNA, 24 nt, Human
guccaagcauaccaacacgagcag

SEQ ID NO: 3062179 - RNA, 21 nt, Human
gucauuugagcagggcucagc

SEQ ID NO: 3062180 - RNA, 21 nt, Human
aacacuguucucugcccucca

SEQ ID NO: 3062181 - RNA, 21 nt, Human
guccaagcauuuagauguaua

SEQ ID NO: 3062182 - RNA, 16 nt, Human
caagcauuuagaugua

SEQ ID NO: 3062183 - RNA, 19 nt, Human
caagcauuuagauguauag

SEQ ID NO: 3062184 - RNA, 21 nt, Human
caagcauaccaacacgagcag

SEQ ID NO: 3062185 - RNA, 16 nt, Human
caagcauaccaacacg

SEQ ID NO: 3062186 - RNA, 14 nt, Human
caaggauccugagc

SEQ ID NO: 3062187 - RNA, 15 nt, Human
caaggauccugagcc

SEQ ID NO: 3062188 - RNA, 16 nt, Human
caaggauccugagcca

SEQ ID NO: 3062189 - RNA, 17 nt, Human
caaggauccugagccag

SEQ ID NO: 3062190 - RNA, 18 nt, Human
caaggcugggggaagaag

SEQ ID NO: 3062191 - RNA, 21 nt, Human
caaggcugggggaagaagcuc

SEQ ID NO: 3062192 - RNA, 13 nt, Human
caaggcugucaau

SEQ ID NO: 3062193 - RNA, 14 nt, Human
caaggcugucaauu

SEQ ID NO: 3062194 - RNA, 17 nt, Human
caagagcccaggccucc

SEQ ID NO: 3062195 - RNA, 17 nt, Human
caagagggucugaggaa

SEQ ID NO: 3062196 - RNA, 16 nt, Human
caagagggucugagga

SEQ ID NO: 3062197 - RNA, 12 nt, Human
caagagggucug

SEQ ID NO: 3062198 - RNA, 13 nt, Human
caagaccuucucc

SEQ ID NO: 3062199 - RNA, 19 nt, Human
caagacgcugugcugcccu

SEQ ID NO: 3062200 - RNA, 20 nt, Human
caagacgcugugcugcccug

SEQ ID NO: 3062201 - RNA, 21 nt, Human
caagacgcugugcugcccugc

SEQ ID NO: 3062202 - RNA, 22 nt, Human
caagacgcugugcugcccugcc

SEQ ID NO: 3062203 - RNA, 19 nt, Human
caagacugcacaucaaaau

SEQ ID NO: 3062204 - RNA, 23 nt, Human
caagacccuuguggucccacccc

SEQ ID NO: 3062205 - RNA, 13 nt, Human
caagaaaugaaag

SEQ ID NO: 3062206 - RNA, 23 nt, Human
caaggggaauguuugccucugcc

SEQ ID NO: 3062207 - RNA, 13 nt, Human
caagggccuggcc

SEQ ID NO: 3062208 - RNA, 14 nt, Human
caagggccuggccu

SEQ ID NO: 3062209 - RNA, 15 nt, Human
caagggccuggccug

SEQ ID NO: 3062210 - RNA, 21 nt, Human
caaggggaauguuugccucug

SEQ ID NO: 3062211 - RNA, 20 nt, Human
caagugauucuccugccuca

SEQ ID NO: 3062212 - RNA, 15 nt, Human
caagugagacccugu

SEQ ID NO: 3062213 - RNA, 19 nt, Human
caagugagacccugucuca

SEQ ID NO: 3062214 - RNA, 18 nt, Human
caagugauucuccugccu

SEQ ID NO: 3062215 - RNA, 19 nt, Human
caagugauucuccugccuc

SEQ ID NO: 3062216 - RNA, 22 nt, Human
caagugaaaaaggaggaagaga

SEQ ID NO: 3062217 - RNA, 23 nt, Human
caagugaaaaaggaggaagagaa

SEQ ID NO: 3062218 - RNA, 14 nt, Human
caagugagacccug

SEQ ID NO: 3062219 - RNA, 14 nt, Human
caacaggcugggcu

SEQ ID NO: 3062220 - RNA, 23 nt, Human
caaauuuacagagacagaaagca

SEQ ID NO: 3062221 - RNA, 16 nt, Human
caaauuuacagagaca

SEQ ID NO: 3062222 - RNA, 17 nt, Human
caaauuuacagagacag

SEQ ID NO: 3062223 - RNA, 17 nt, Human
caacaggcugggcuuca

SEQ ID NO: 3062224 - RNA, 13 nt, Human
caacaggcugggc

SEQ ID NO: 3062225 - RNA, 16 nt, Human
caacauacucccaucu

SEQ ID NO: 3062226 - RNA, 14 nt, Human
caacauacucccau

SEQ ID NO: 3062227 - RNA, 15 nt, Human
caacauacucccauc

SEQ ID NO: 3062228 - RNA, 19 nt, Human
caaccugauugugucucuu

SEQ ID NO: 3062229 - RNA, 21 nt, Human
caaccugauugugucucuugg

SEQ ID NO: 3062230 - RNA, 17 nt, Human
caaccugauugugucuc

SEQ ID NO: 3062231 - RNA, 20 nt, Human
caacugcaucaagaugugac

SEQ ID NO: 3062232 - RNA, 23 nt, Human
caacugcaucaagaugugacaug

SEQ ID NO: 3062233 - RNA, 17 nt, Human
caacugcaucaagaugu

SEQ ID NO: 3062234 - RNA, 13 nt, Human
caaagaaauuaug

SEQ ID NO: 3062235 - RNA, 12 nt, Human
caaagaaauuau

SEQ ID NO: 3062236 - RNA, 14 nt, Human
caaagaaauguaag

SEQ ID NO: 3062237 - RNA, 14 nt, Human
caaagagguuuuaa

SEQ ID NO: 3062238 - RNA, 21 nt, Human
caaagagguuuuaaaaaaauc

SEQ ID NO: 3062239 - RNA, 18 nt, Human
auuuuaauaauguuucaa

SEQ ID NO: 3062240 - RNA, 19 nt, Human
auuuuaauaauguuucaaa

SEQ ID NO: 3062241 - RNA, 16 nt, Human
auuuuaauaauguuuc

SEQ ID NO: 3062242 - RNA, 18 nt, Human
caaauucugucucuggau

SEQ ID NO: 3062243 - RNA, 14 nt, Human
caaaggagauugga

SEQ ID NO: 3062244 - RNA, 20 nt, Human
caaaggagauuggaaggaac

SEQ ID NO: 3062245 - RNA, 16 nt, Human
caaaguggugagaggc

SEQ ID NO: 3062246 - RNA, 17 nt, Human
caaaguggugagaggca

SEQ ID NO: 3062247 - RNA, 23 nt, Human
caaaggguaucaggugcugccau

SEQ ID NO: 3062248 - RNA, 21 nt, Human
caaaggguaucaggugcugcc

SEQ ID NO: 3062249 - RNA, 20 nt, Human
caaaggguaucaggugcugc

SEQ ID NO: 3062250 - RNA, 20 nt, Human
caacaggcugggcuucagug

SEQ ID NO: 3062251 - RNA, 14 nt, Human
cacacacuuuggcu

SEQ ID NO: 3062252 - RNA, 21 nt, Human
cacacagaggcugccucuccc

SEQ ID NO: 3062253 - RNA, 20 nt, Human
cacacaccagagcccaccuu

SEQ ID NO: 3062254 - RNA, 16 nt, Human
cacacaccagagccca

SEQ ID NO: 3062255 - RNA, 15 nt, Human
cacacaccagagccc

SEQ ID NO: 3062256 - RNA, 13 nt, Human
cacacccagccca

SEQ ID NO: 3062257 - RNA, 22 nt, Human
cacaccagagcccaccuuggcu

SEQ ID NO: 3062258 - RNA, 21 nt, Human
cacaccagagcccaccuuggc

SEQ ID NO: 3062259 - RNA, 15 nt, Human
cacacagcucugucc

SEQ ID NO: 3062260 - RNA, 14 nt, Human
cacacagcucuguc

SEQ ID NO: 3062261 - RNA, 13 nt, Human
cacacagcucugu

SEQ ID NO: 3062262 - RNA, 20 nt, Human
cacacccagcccacuucugc

SEQ ID NO: 3062263 - RNA, 14 nt, Human
cacacccagcccac

SEQ ID NO: 3062264 - RNA, 17 nt, Human
cacaccgggcacucaga

SEQ ID NO: 3062265 - RNA, 18 nt, Human
caaugguuuucuugugug

SEQ ID NO: 3062266 - RNA, 14 nt, Human
caaugcacuuuguu

SEQ ID NO: 3062267 - RNA, 15 nt, Human
cacaaacagaggccg

SEQ ID NO: 3062268 - RNA, 17 nt, Human
cacaaacgggcucagca

SEQ ID NO: 3062269 - RNA, 17 nt, Human
cacaaagguagcuuuuc

SEQ ID NO: 3062270 - RNA, 15 nt, Human
cacaagaaaugaaag

SEQ ID NO: 3062271 - RNA, 21 nt, Human
cacaagaaaugaaagcaggga

SEQ ID NO: 3062272 - RNA, 13 nt, Human
cacaagaaaugaa

SEQ ID NO: 3062273 - RNA, 23 nt, Human
cacaagaaaugaaagcagggacu

SEQ ID NO: 3062274 - RNA, 15 nt, Human
caaugaccuuucaau

SEQ ID NO: 3062275 - RNA, 16 nt, Human
caaugaccuuucaaua

SEQ ID NO: 3062276 - RNA, 13 nt, Human
caaugauggucac

SEQ ID NO: 3062277 - RNA, 14 nt, Human
caaugaccuuucaa

SEQ ID NO: 3062278 - RNA, 13 nt, Human
caaugaccuuuca

SEQ ID NO: 3062279 - RNA, 21 nt, Human
caaugcaaaccaucauugaaa

SEQ ID NO: 3062280 - RNA, 22 nt, Human
caaugcaaaccaucauugaaau

SEQ ID NO: 3062281 - RNA, 14 nt, Human
caaugauggucacc

SEQ ID NO: 3062282 - RNA, 13 nt, Human
caaugcacuuugu

SEQ ID NO: 3062283 - RNA, 14 nt, Human
caaugcacugacau

SEQ ID NO: 3062284 - RNA, 23 nt, Human
caaugcaaaccaucauugaaauc

SEQ ID NO: 3062285 - RNA, 20 nt, Human
caaugcaaaccaucauugaa

SEQ ID NO: 3062286 - RNA, 17 nt, Human
caccacacccagcccac

SEQ ID NO: 3062287 - RNA, 19 nt, Human
caccacacccagcccacuu

SEQ ID NO: 3062288 - RNA, 15 nt, Human
caccagagcccaccu

SEQ ID NO: 3062289 - RNA, 22 nt, Human
caccagagcccaccuuggcuca

SEQ ID NO: 3062290 - RNA, 20 nt, Human
caccagagcccaccuuggcu

SEQ ID NO: 3062291 - RNA, 18 nt, Human
caccagagcccaccuugg

SEQ ID NO: 3062292 - RNA, 17 nt, Human
caccagagcccaccuug

SEQ ID NO: 3062293 - RNA, 18 nt, Human
cacauguccaagaagccc

SEQ ID NO: 3062294 - RNA, 19 nt, Human
cacauguccaagaagccca

SEQ ID NO: 3062295 - RNA, 21 nt, Human
cacauguccaagaagcccagg

SEQ ID NO: 3062296 - RNA, 22 nt, Human
cacauguccaagaagcccagga

SEQ ID NO: 3062297 - RNA, 16 nt, Human
caccaacgucugugcc

SEQ ID NO: 3062298 - RNA, 17 nt, Human
caccaacgucugugcca

SEQ ID NO: 3062299 - RNA, 13 nt, Human
caccaagcccagu

SEQ ID NO: 3062300 - RNA, 12 nt, Human
caccaagcccag

SEQ ID NO: 3062301 - RNA, 21 nt, Human
caccauauuaccacagacaua

SEQ ID NO: 3062302 - RNA, 20 nt, Human
caccauaagcuacugccauc

SEQ ID NO: 3062303 - RNA, 21 nt, Human
caccauaagcuacugccaucc

SEQ ID NO: 3062304 - RNA, 16 nt, Human
caccauaagcuacugc

SEQ ID NO: 3062305 - RNA, 18 nt, Human
caccauaagcuacugcca

SEQ ID NO: 3062306 - RNA, 19 nt, Human
caccauaagcuacugccau

SEQ ID NO: 3062307 - RNA, 14 nt, Human
caccaucaagccac

SEQ ID NO: 3062308 - RNA, 15 nt, Human
caccaucaagccacc

SEQ ID NO: 3062309 - RNA, 13 nt, Human
caccaucaagcca

SEQ ID NO: 3062310 - RNA, 12 nt, Human
caccagugccuc

SEQ ID NO: 3062311 - RNA, 13 nt, Human
caccagugccucu

SEQ ID NO: 3062312 - RNA, 14 nt, Human
caccagugccucuc

SEQ ID NO: 3062313 - RNA, 17 nt, Human
caccagugccucucccu

SEQ ID NO: 3062314 - RNA, 11 nt, Human
caccagugccu

SEQ ID NO: 3062315 - RNA, 16 nt, Human
caccaucaagccacca

SEQ ID NO: 3062316 - RNA, 17 nt, Human
caccaucaagccaccaa

SEQ ID NO: 3062317 - RNA, 19 nt, Human
caccaucaagccaccaaca

SEQ ID NO: 3062318 - RNA, 24 nt, Human
caccaucaagccaccaacauacuc

SEQ ID NO: 3062319 - RNA, 17 nt, Human
caccaucaugucuggcu

SEQ ID NO: 3062320 - RNA, 15 nt, Human
caccaucaugucugg

SEQ ID NO: 3062321 - RNA, 18 nt, Human
caccaucaugucuggcua

SEQ ID NO: 3062322 - RNA, 22 nt, Human
cacacggacacucaaaagcugg

SEQ ID NO: 3062323 - RNA, 18 nt, Human
cacagcucuucuccaggc

SEQ ID NO: 3062324 - RNA, 19 nt, Human
cacaggcagguccaggguu

SEQ ID NO: 3062325 - RNA, 23 nt, Human
cacaguccuuaccagcagagcac

SEQ ID NO: 3062326 - RNA, 14 nt, Human
cacaggcccggcuc

SEQ ID NO: 3062327 - RNA, 20 nt, Human
cacagcucuucuccaggcug

SEQ ID NO: 3062328 - RNA, 19 nt, Human
cacagcucuucuccaggcu

SEQ ID NO: 3062329 - RNA, 17 nt, Human
cacaggaucagucugau

SEQ ID NO: 3062330 - RNA, 13 nt, Human
cacaugagcauca

SEQ ID NO: 3062331 - RNA, 17 nt, Human
cacaugagcaucaggcc

SEQ ID NO: 3062332 - RNA, 18 nt, Human
cacaugagcaucaggcca

SEQ ID NO: 3062333 - RNA, 19 nt, Human
cacaugagcaucaggccag

SEQ ID NO: 3062334 - RNA, 20 nt, Human
cacaugagcaucaggccagg

SEQ ID NO: 3062335 - RNA, 21 nt, Human
cacaugagcaucaggccaggc

SEQ ID NO: 3062336 - RNA, 22 nt, Human
cacaguuuucugagaaagacua

SEQ ID NO: 3062337 - RNA, 21 nt, Human
cacaguuuucugagaaagacu

SEQ ID NO: 3062338 - RNA, 17 nt, Human
cacaugaaguccaagca

SEQ ID NO: 3062339 - RNA, 20 nt, Human
cacaugaaguccaagcauuu

SEQ ID NO: 3062340 - RNA, 16 nt, Human
cacaugaaguccaagc

SEQ ID NO: 3062341 - RNA, 20 nt, Human
cacaguuuucugagaaagac

SEQ ID NO: 3062342 - RNA, 19 nt, Human
cacaugcaaggucauuuuu

SEQ ID NO: 3062343 - RNA, 17 nt, Human
cacaugcaaggucauuu

SEQ ID NO: 3062344 - RNA, 20 nt, Human
cacaugcaaggucauuuuuu

SEQ ID NO: 3062345 - RNA, 18 nt, Human
cacaugcacgugugugca

SEQ ID NO: 3062346 - RNA, 16 nt, Human
cacauguccaagaagc

SEQ ID NO: 3062347 - RNA, 17 nt, Human
cacauguccaagaagcc

SEQ ID NO: 3062348 - RNA, 20 nt, Human
cacaugccucucucaggcca

SEQ ID NO: 3062349 - RNA, 21 nt, Human
cacaugccucucucaggccaa

SEQ ID NO: 3062350 - RNA, 13 nt, Human
cacccaagggccu

SEQ ID NO: 3062351 - RNA, 13 nt, Human
uuuuuucuuacug

SEQ ID NO: 3062352 - RNA, 23 nt, Human
uuugcauaacguauaaaagccug

SEQ ID NO: 3062353 - RNA, 19 nt, Human
uuugcauaacguauaaaag

SEQ ID NO: 3062354 - RNA, 14 nt, Human
uuugcagacaggca

SEQ ID NO: 3062355 - RNA, 23 nt, Human
uuuggaacaagaugguucuagca

SEQ ID NO: 3062356 - RNA, 18 nt, Human
uuugccauguuggccagg

SEQ ID NO: 3062357 - RNA, 21 nt, Human
uuugcauagauucccugagca

SEQ ID NO: 3062358 - RNA, 22 nt, Human
uuugaggucuguucuuuccaaa

SEQ ID NO: 3062359 - RNA, 17 nt, Human
uuugaggucuguucuuu

SEQ ID NO: 3062360 - RNA, 22 nt, Human
uuucuuacugucuuuuuucuaa

SEQ ID NO: 3062361 - RNA, 15 nt, Human
uuugagcagggcuca

SEQ ID NO: 3062362 - RNA, 16 nt, Human
uuuguucauacauauu

SEQ ID NO: 3062363 - RNA, 13 nt, Human
uuuguucauacau

SEQ ID NO: 3062364 - RNA, 16 nt, Human
uuuguugucagcugaa

SEQ ID NO: 3062365 - RNA, 13 nt, Human
uuuguccccaccg

SEQ ID NO: 3062366 - RNA, 21 nt, Human
uuuguccccaccgcagacagg

SEQ ID NO: 3062367 - RNA, 16 nt, Human
uuugucccaagugcca

SEQ ID NO: 3062368 - RNA, 21 nt, Human
uuuguauaaaauaauuuuuau

SEQ ID NO: 3062369 - RNA, 19 nt, Human
uuuguauaaaauaauuuuu

SEQ ID NO: 3062370 - RNA, 15 nt, Human
uuuguaaauuaacuu

SEQ ID NO: 3062371 - RNA, 17 nt, Human
uuuguaaauuaacuuuu

SEQ ID NO: 3062372 - RNA, 16 nt, Human
uuuguaaauuaacuuu

SEQ ID NO: 3062373 - RNA, 19 nt, Human
uuuggugguuucagaaaug

SEQ ID NO: 3062374 - RNA, 13 nt, Human
uuuucacauaucu

SEQ ID NO: 3062375 - RNA, 15 nt, Human
uuuucagaaaauauu

SEQ ID NO: 3062376 - RNA, 15 nt, Human
uuuucacaguucucu

SEQ ID NO: 3062377 - RNA, 16 nt, Human
uuuucagaaaauauua

SEQ ID NO: 3062378 - RNA, 18 nt, Human
uuuuccaugaguccccug

SEQ ID NO: 3062379 - RNA, 19 nt, Human
uuuuccaugaguccccugu

SEQ ID NO: 3062380 - RNA, 14 nt, Human
uuuucuucucccuc

SEQ ID NO: 3062381 - RNA, 17 nt, Human
uuuucuugcaugaggcu

SEQ ID NO: 3062382 - RNA, 16 nt, Human
uuuucuugcaugguuu

SEQ ID NO: 3062383 - RNA, 15 nt, Human
uuuuccuucagugcc

SEQ ID NO: 3062384 - RNA, 15 nt, Human
uuuuaaaaugagaaa

SEQ ID NO: 3062385 - RNA, 22 nt, Human
uuuuaaaaugagaaaucuaaaa

SEQ ID NO: 3062386 - RNA, 22 nt, Human
uuuuacauaaauuuaguauuuu

SEQ ID NO: 3062387 - RNA, 21 nt, Human
uuuuaauuugguuuucacauu

SEQ ID NO: 3062388 - RNA, 17 nt, Human
uuuuaauuugguuuuca

SEQ ID NO: 3062389 - RNA, 14 nt, Human
uuuuacuguacaga

SEQ ID NO: 3062390 - RNA, 20 nt, Human
uuuuauaucaauuuaaaaaa

SEQ ID NO: 3062391 - RNA, 15 nt, Human
uuuuauaugcuucug

SEQ ID NO: 3062392 - RNA, 20 nt, Human
uuuuauaugcuucuguuuua

SEQ ID NO: 3062393 - RNA, 20 nt, Human
uuuuaugauacuugaaaauu

SEQ ID NO: 3062394 - RNA, 16 nt, Human
uuuuaugauacuugaa

SEQ ID NO: 3062395 - RNA, 18 nt, Human
uuuuaucgucacugcuua

SEQ ID NO: 3062396 - RNA, 10 nt, Human
uuuuauauuu

SEQ ID NO: 3062397 - RNA, 15 nt, Human
uuucagcagcugcag

SEQ ID NO: 3062398 - RNA, 15 nt, Human
uuucagauaaucaca

SEQ ID NO: 3062399 - RNA, 20 nt, Human
uuucaauaggaaaaacugau

SEQ ID NO: 3062400 - RNA, 22 nt, Human
uuucaauaggaaaaacugauuu

SEQ ID NO: 3062401 - RNA, 19 nt, Human
uuucaauaggaaaaacuga

SEQ ID NO: 3062402 - RNA, 14 nt, Human
uuuccaaaauaauu

SEQ ID NO: 3062403 - RNA, 15 nt, Human
uuuccaaaguacacu

SEQ ID NO: 3062404 - RNA, 12 nt, Human
uuuccaaaguac

SEQ ID NO: 3062405 - RNA, 13 nt, Human
uuuccaggaaggc

SEQ ID NO: 3062406 - RNA, 22 nt, Human
uuucauugcugggcuugucugu

SEQ ID NO: 3062407 - RNA, 15 nt, Human
uuucagccaagaauu

SEQ ID NO: 3062408 - RNA, 15 nt, Human
uuucuagccagagga

SEQ ID NO: 3062409 - RNA, 16 nt, Human
uuucuaggacugaauu

SEQ ID NO: 3062410 - RNA, 22 nt, Human
uuucugagaaagacuauucaaa

SEQ ID NO: 3062411 - RNA, 15 nt, Human
uuucugagaaagacu

SEQ ID NO: 3062412 - RNA, 14 nt, Human
uuucuaaagcugcc

SEQ ID NO: 3062413 - RNA, 17 nt, Human
uuucuaaagcugccagc

SEQ ID NO: 3062414 - RNA, 14 nt, Human
uuucuaaaggcuac

SEQ ID NO: 3062415 - RNA, 21 nt, Human
uuuccucuuuggucuacacug

SEQ ID NO: 3062416 - RNA, 20 nt, Human
uuuagaaacacaacuauauu

SEQ ID NO: 3062417 - RNA, 13 nt, Human
uuuacauuguaaa

SEQ ID NO: 3062418 - RNA, 22 nt, Human
uuuacauggcuggagcuagaau

SEQ ID NO: 3062419 - RNA, 15 nt, Human
uuuacauuguaaaua

SEQ ID NO: 3062420 - RNA, 15 nt, Human
uuuacuuuguguuca

SEQ ID NO: 3062421 - RNA, 12 nt, Human
uuuagaaacaca

SEQ ID NO: 3062422 - RNA, 17 nt, Human
uuuacauggcuggagcu

SEQ ID NO: 3062423 - RNA, 16 nt, Human
uuuacauggcuggagc

SEQ ID NO: 3062424 - RNA, 14 nt, Human
uuuaugcauauuau

SEQ ID NO: 3062425 - RNA, 14 nt, Human
uuuauugucaaagu

SEQ ID NO: 3062426 - RNA, 16 nt, Human
uuuauugucaaagugg

SEQ ID NO: 3062427 - RNA, 19 nt, Human
uuuauuuaguuccuugagu

SEQ ID NO: 3062428 - RNA, 22 nt, Human
uuuaugauacuugaaaauuaac

SEQ ID NO: 3062429 - RNA, 14 nt, Human
uuuauaaacuuuac

SEQ ID NO: 3062430 - RNA, 16 nt, Human
uuuauaaacuuuaccu

SEQ ID NO: 3062431 - RNA, 16 nt, Human
uuuaucgucacugcuu

SEQ ID NO: 3062432 - RNA, 21 nt, Human
uuuaucgucacugcuuaacuu

SEQ ID NO: 3062433 - RNA, 13 nt, Human
uuuugaaaaacug

SEQ ID NO: 3062434 - RNA, 20 nt, Human
uuuuuuauacaggaugauga

SEQ ID NO: 3062435 - RNA, 12 nt, Human
uuuuuuacuaau

SEQ ID NO: 3062436 - RNA, 17 nt, Human
uuuuuuccuucagugcc

SEQ ID NO: 3062437 - RNA, 12 nt, Human
uuuuuucugaaa

SEQ ID NO: 3062438 - RNA, 20 nt, Human
uuccuucugugaaaguacau

SEQ ID NO: 3062439 - RNA, 17 nt, Human
uuccuucugugaaagua

SEQ ID NO: 3062440 - RNA, 15 nt, Human
uuccuucagugccuu

SEQ ID NO: 3062441 - RNA, 19 nt, Human
uuccuucauucaacccacc

SEQ ID NO: 3062442 - RNA, 23 nt, Human
uuccuucagugccuuauggaaca

SEQ ID NO: 3062443 - RNA, 16 nt, Human
uuccuucagugccuua

SEQ ID NO: 3062444 - RNA, 19 nt, Human
uuccuucagugccuuaugg

SEQ ID NO: 3062445 - RNA, 16 nt, Human
uucuaaaggcuaccuu

SEQ ID NO: 3062446 - RNA, 18 nt, Human
uucuaaaggcuaccuuug

SEQ ID NO: 3062447 - RNA, 17 nt, Human
uucuaaaggcuaccuuu

SEQ ID NO: 3062448 - RNA, 18 nt, Human
uucggccuccauccugag

SEQ ID NO: 3062449 - RNA, 19 nt, Human
uucggccuccauccugagg

SEQ ID NO: 3062450 - RNA, 19 nt, Human
uucccuuugacgccauccc

SEQ ID NO: 3062451 - RNA, 18 nt, Human
uucccuugaugaagaagu

SEQ ID NO: 3062452 - RNA, 22 nt, Human
uuccccacuugagaauuacccu

SEQ ID NO: 3062453 - RNA, 20 nt, Human
uuccuagguauaauucacau

SEQ ID NO: 3062454 - RNA, 12 nt, Human
uuccuagugaaa

SEQ ID NO: 3062455 - RNA, 23 nt, Human
uuccucauaguaugguggcuggg

SEQ ID NO: 3062456 - RNA, 22 nt, Human
uuccucccucccucuuucccuc

SEQ ID NO: 3062457 - RNA, 21 nt, Human
uuccucccucccucuuucccu

SEQ ID NO: 3062458 - RNA, 19 nt, Human
uuccucccucccucuuucc

SEQ ID NO: 3062459 - RNA, 12 nt, Human
uuccucccuccc

SEQ ID NO: 3062460 - RNA, 17 nt, Human
uucuaugacacaugcaa

SEQ ID NO: 3062461 - RNA, 16 nt, Human
uucuaugacacaugca

SEQ ID NO: 3062462 - RNA, 21 nt, Human
uucuaugaaauauuauguuaa

SEQ ID NO: 3062463 - RNA, 14 nt, Human
uucuauuguuucuu

SEQ ID NO: 3062464 - RNA, 16 nt, Human
uucugacccaugcugc

SEQ ID NO: 3062465 - RNA, 18 nt, Human
uucugacccaugcugccc

SEQ ID NO: 3062466 - RNA, 20 nt, Human
uucugacccaugcugcccug

SEQ ID NO: 3062467 - RNA, 21 nt, Human
uucugacccaugcugcccugu

SEQ ID NO: 3062468 - RNA, 21 nt, Human
uucugacccugcuucaaauau

SEQ ID NO: 3062469 - RNA, 15 nt, Human
uucucugauacagaa

SEQ ID NO: 3062470 - RNA, 16 nt, Human
uucucugauacagaaa

SEQ ID NO: 3062471 - RNA, 14 nt, Human
uucucugauacaga

SEQ ID NO: 3062472 - RNA, 17 nt, Human
uucucugauacagaaaa

SEQ ID NO: 3062473 - RNA, 17 nt, Human
uucucugcccuccaaga

SEQ ID NO: 3062474 - RNA, 22 nt, Human
uucucuccuguaccucuugagc

SEQ ID NO: 3062475 - RNA, 18 nt, Human
uucucuccagccccugga

SEQ ID NO: 3062476 - RNA, 16 nt, Human
uucucuccagccccug

SEQ ID NO: 3062477 - RNA, 16 nt, Human
uucuccaagcaggaca

SEQ ID NO: 3062478 - RNA, 13 nt, Human
uucuccacccugc

SEQ ID NO: 3062479 - RNA, 11 nt, Human
uucuccaggcu

SEQ ID NO: 3062480 - RNA, 15 nt, Human
uucaucuaggauuuu

SEQ ID NO: 3062481 - RNA, 13 nt, Human
uucauaaugacuu

SEQ ID NO: 3062482 - RNA, 23 nt, Human
uucauaaugacuuaagcacacuu

SEQ ID NO: 3062483 - RNA, 19 nt, Human
uucagugccuuauggaaca

SEQ ID NO: 3062484 - RNA, 21 nt, Human
uucagugccuuauggaacacu

SEQ ID NO: 3062485 - RNA, 18 nt, Human
uucagugccuuauggaac

SEQ ID NO: 3062486 - RNA, 20 nt, Human
uucaucugacuaugacauaa

SEQ ID NO: 3062487 - RNA, 12 nt, Human
uucaucuugaau

SEQ ID NO: 3062488 - RNA, 18 nt, Human
uucaugaaagauucaaug

SEQ ID NO: 3062489 - RNA, 17 nt, Human
uucaucugacuaugaca

SEQ ID NO: 3062490 - RNA, 20 nt, Human
uucaucuuccaacucaaacu

SEQ ID NO: 3062491 - RNA, 11 nt, Human
uucaucuugaa

SEQ ID NO: 3062492 - RNA, 19 nt, Human
uucauuuaggugaggaagc

SEQ ID NO: 3062493 - RNA, 18 nt, Human
uucauuuaggugaggaag

SEQ ID NO: 3062494 - RNA, 21 nt, Human
uuccauccuagucacuaccuu

SEQ ID NO: 3062495 - RNA, 19 nt, Human
uuccacuuauaggaauuga

SEQ ID NO: 3062496 - RNA, 17 nt, Human
uuccaugaguccccugu

SEQ ID NO: 3062497 - RNA, 23 nt, Human
uucaaauuguaagcaugcacaaa

SEQ ID NO: 3062498 - RNA, 13 nt, Human
uucaaagauauuu

SEQ ID NO: 3062499 - RNA, 13 nt, Human
uuacgugaguccu

SEQ ID NO: 3062500 - RNA, 14 nt, Human
uuacgugaguccug

SEQ ID NO: 3062501 - RNA, 18 nt, Human
uucaauucucauuuguca

SEQ ID NO: 3062502 - RNA, 19 nt, Human
uucaaugccccugaauuua

SEQ ID NO: 3062503 - RNA, 14 nt, Human
uucacucuccuugg

SEQ ID NO: 3062504 - RNA, 22 nt, Human
uucagcuccagcucaccagccc

SEQ ID NO: 3062505 - RNA, 15 nt, Human
uucagagacuccugc

SEQ ID NO: 3062506 - RNA, 15 nt, Human
uucaggaagcucagg

SEQ ID NO: 3062507 - RNA, 20 nt, Human
uucaggaagcucagggccug

SEQ ID NO: 3062508 - RNA, 17 nt, Human
uucaggaagcucagggc

SEQ ID NO: 3062509 - RNA, 19 nt, Human
uucaggaagcucagggccu

SEQ ID NO: 3062510 - RNA, 18 nt, Human
uucagcugcauacaguuu

SEQ ID NO: 3062511 - RNA, 17 nt, Human
uucagcugacuuuucug

SEQ ID NO: 3062512 - RNA, 16 nt, Human
uucaggaagcucaggg

SEQ ID NO: 3062513 - RNA, 17 nt, Human
uucagcucugcaagaau

SEQ ID NO: 3062514 - RNA, 24 nt, Human
uucagcucugcaagaauugaagca

SEQ ID NO: 3062515 - RNA, 23 nt, Human
uucagcuccagcucaccagcccc

SEQ ID NO: 3062516 - RNA, 20 nt, Human
uugaccgugaggccagagac

SEQ ID NO: 3062517 - RNA, 21 nt, Human
uugaccgugaggccagagaca

SEQ ID NO: 3062518 - RNA, 15 nt, Human
uugaccucaggugau

SEQ ID NO: 3062519 - RNA, 16 nt, Human
uugaccucugcagcaa

SEQ ID NO: 3062520 - RNA, 14 nt, Human
uugacgccauccca

SEQ ID NO: 3062521 - RNA, 22 nt, Human
uugacgccaucccagccccaau

SEQ ID NO: 3062522 - RNA, 12 nt, Human
uugaccugaggc

SEQ ID NO: 3062523 - RNA, 19 nt, Human
uugaccugaggcccuucuc

SEQ ID NO: 3062524 - RNA, 22 nt, Human
uugaccugaggcccuucucucc

SEQ ID NO: 3062525 - RNA, 19 nt, Human
uugauagcacagacccugc

SEQ ID NO: 3062526 - RNA, 20 nt, Human
uugauagcacagacccugcc

SEQ ID NO: 3062527 - RNA, 15 nt, Human
uugaggacacugaua

SEQ ID NO: 3062528 - RNA, 14 nt, Human
uugaggacacugau

SEQ ID NO: 3062529 - RNA, 20 nt, Human
uugacgccaucccagcccca

SEQ ID NO: 3062530 - RNA, 14 nt, Human
uugcauagaauaaa

SEQ ID NO: 3062531 - RNA, 18 nt, Human
uugcauagauucccugag

SEQ ID NO: 3062532 - RNA, 16 nt, Human
uugcagacaggcaagc

SEQ ID NO: 3062533 - RNA, 18 nt, Human
uugauuuccguuaaaaua

SEQ ID NO: 3062534 - RNA, 17 nt, Human
uugcaacaggcugggcu

SEQ ID NO: 3062535 - RNA, 14 nt, Human
uugcaacaggcugg

SEQ ID NO: 3062536 - RNA, 18 nt, Human
uugauagcacagacccug

SEQ ID NO: 3062537 - RNA, 21 nt, Human
uugauagcacagacccugccc

SEQ ID NO: 3062538 - RNA, 12 nt, Human
uugaugaagaag

SEQ ID NO: 3062539 - RNA, 15 nt, Human
uugaaaaaugcaugu

SEQ ID NO: 3062540 - RNA, 19 nt, Human
uugaaaacacuguucucug

SEQ ID NO: 3062541 - RNA, 21 nt, Human
uugaaaacacuguucucugcc

SEQ ID NO: 3062542 - RNA, 18 nt, Human
uucuuuauaauucuacuu

SEQ ID NO: 3062543 - RNA, 23 nt, Human
uugaaacugagaugugaacacau

SEQ ID NO: 3062544 - RNA, 23 nt, Human
uugaaaagacuccaaagaaaugu

SEQ ID NO: 3062545 - RNA, 22 nt, Human
uugaaaagacuccaaagaaaug

SEQ ID NO: 3062546 - RNA, 18 nt, Human
uugaaaagacuccaaaga

SEQ ID NO: 3062547 - RNA, 16 nt, Human
uugaaaagacuccaaa

SEQ ID NO: 3062548 - RNA, 16 nt, Human
uugaacugauaaagau

SEQ ID NO: 3062549 - RNA, 19 nt, Human
uugaacucuucaaucucuu

SEQ ID NO: 3062550 - RNA, 20 nt, Human
uugaacuuugaccucugcag

SEQ ID NO: 3062551 - RNA, 22 nt, Human
uugaacuuugaccucugcagca

SEQ ID NO: 3062552 - RNA, 21 nt, Human
uugaaucucauaauuuauaca

SEQ ID NO: 3062553 - RNA, 15 nt, Human
uugaaucucauaauu

SEQ ID NO: 3062554 - RNA, 17 nt, Human
uugaagacagagcuaca

SEQ ID NO: 3062555 - RNA, 19 nt, Human
uugaagacuuuucuuucag

SEQ ID NO: 3062556 - RNA, 14 nt, Human
uucugagcauuuaa

SEQ ID NO: 3062557 - RNA, 15 nt, Human
uucugagaaagacua

SEQ ID NO: 3062558 - RNA, 17 nt, Human
uucuguccgagcuuuga

SEQ ID NO: 3062559 - RNA, 21 nt, Human
uucuguccgagcuuugaaaau

SEQ ID NO: 3062560 - RNA, 23 nt, Human
uucuguggguuucuaaagcugcc

SEQ ID NO: 3062561 - RNA, 17 nt, Human
uucuguccuacucugug

SEQ ID NO: 3062562 - RNA, 18 nt, Human
uucuugguuuguaaauua

SEQ ID NO: 3062563 - RNA, 17 nt, Human
uucuugguuuguaaauu

SEQ ID NO: 3062564 - RNA, 23 nt, Human
uucuugguuuguaaauuaacuuu

SEQ ID NO: 3062565 - RNA, 16 nt, Human
uucuugguuuguaaau

SEQ ID NO: 3062566 - RNA, 13 nt, Human
uucuugguuugua

SEQ ID NO: 3062567 - RNA, 23 nt, Human
uucuuauuuaaugaaagacugua

SEQ ID NO: 3062568 - RNA, 19 nt, Human
uucuuauuuaaugaaagac

SEQ ID NO: 3062569 - RNA, 15 nt, Human
uucuuauuucauuuc

SEQ ID NO: 3062570 - RNA, 16 nt, Human
uuguaaaggaauuuaa

SEQ ID NO: 3062571 - RNA, 12 nt, Human
uugguccugcug

SEQ ID NO: 3062572 - RNA, 22 nt, Human
uuggucccccuuccauggacuu

SEQ ID NO: 3062573 - RNA, 16 nt, Human
uuggucccccuuccau

SEQ ID NO: 3062574 - RNA, 12 nt, Human
uuguacagacaa

SEQ ID NO: 3062575 - RNA, 13 nt, Human
uuguacagacaac

SEQ ID NO: 3062576 - RNA, 18 nt, Human
uuguaaaugugcuuuuaa

SEQ ID NO: 3062577 - RNA, 14 nt, Human
uuguaaaugugcuu

SEQ ID NO: 3062578 - RNA, 11 nt, Human
uuguaaaugug

SEQ ID NO: 3062579 - RNA, 14 nt, Human
uuguauuacaaauc

SEQ ID NO: 3062580 - RNA, 14 nt, Human
uuguauucagaguu

SEQ ID NO: 3062581 - RNA, 21 nt, Human
uuguauucucuccuguaccuc

SEQ ID NO: 3062582 - RNA, 15 nt, Human
uuguagagccagggu

SEQ ID NO: 3062583 - RNA, 14 nt, Human
uuguagagccaggg

SEQ ID NO: 3062584 - RNA, 19 nt, Human
uuguaucacaaaucuuaac

SEQ ID NO: 3062585 - RNA, 13 nt, Human
uuggcauucccca

SEQ ID NO: 3062586 - RNA, 24 nt, Human
uuggccaaagccaaagcuaggccu

SEQ ID NO: 3062587 - RNA, 14 nt, Human
uuggccaggcuggu

SEQ ID NO: 3062588 - RNA, 22 nt, Human
uuggcugggggccucagugcca

SEQ ID NO: 3062589 - RNA, 21 nt, Human
uuggcugggggccucagugcc

SEQ ID NO: 3062590 - RNA, 18 nt, Human
uuggcugggggccucagu

SEQ ID NO: 3062591 - RNA, 16 nt, Human
uuggcugcugaaggcu

SEQ ID NO: 3062592 - RNA, 14 nt, Human
uugguaaaccuuuu

SEQ ID NO: 3062593 - RNA, 12 nt, Human
uugguaaaccuu

SEQ ID NO: 3062594 - RNA, 16 nt, Human
uuggguggaugccugg

SEQ ID NO: 3062595 - RNA, 16 nt, Human
uugggaggccauuugu

SEQ ID NO: 3062596 - RNA, 12 nt, Human
uugggaggcuga

SEQ ID NO: 3062597 - RNA, 22 nt, Human
uuggcuuuggguugcaggaccu

SEQ ID NO: 3062598 - RNA, 17 nt, Human
uuggcaaaaaggcagga

SEQ ID NO: 3062599 - RNA, 14 nt, Human
uuggauuguccccg

SEQ ID NO: 3062600 - RNA, 11 nt, Human
uuggaaggaac

SEQ ID NO: 3062601 - RNA, 19 nt, Human
uuggaaggaacguccccug

SEQ ID NO: 3062602 - RNA, 20 nt, Human
uugcuggggccgaaagaaca

SEQ ID NO: 3062603 - RNA, 23 nt, Human
uuggaaagaguaggaagacuuug

SEQ ID NO: 3062604 - RNA, 18 nt, Human
uugccucugccucugaca

SEQ ID NO: 3062605 - RNA, 16 nt, Human
uugccucugccucuga

SEQ ID NO: 3062606 - RNA, 14 nt, Human
uugccucugccucu

SEQ ID NO: 3062607 - RNA, 11 nt, Human
uugccucugcc

SEQ ID NO: 3062608 - RNA, 15 nt, Human
uugcccagccuggau

SEQ ID NO: 3062609 - RNA, 18 nt, Human
uugccagucaccccggcc

SEQ ID NO: 3062610 - RNA, 13 nt, Human
uugccagucaccc

SEQ ID NO: 3062611 - RNA, 23 nt, Human
uugcccacgcuggagugcaguga

SEQ ID NO: 3062612 - RNA, 22 nt, Human
uugcugauggugcaaugaccuu

SEQ ID NO: 3062613 - RNA, 20 nt, Human
uugcugauggugcaaugacc

SEQ ID NO: 3062614 - RNA, 19 nt, Human
uugcugauggugcaaugac

SEQ ID NO: 3062615 - RNA, 23 nt, Human
uguuuuaaaaugagaaaucuaaa

SEQ ID NO: 3062616 - RNA, 13 nt, Human
uguuuuugucuua

SEQ ID NO: 3062617 - RNA, 12 nt, Human
uguuuuaaaaaa

SEQ ID NO: 3062618 - RNA, 18 nt, Human
uguuuuaaaaugagaaau

SEQ ID NO: 3062619 - RNA, 17 nt, Human
uguuuguugucagcuga

SEQ ID NO: 3062620 - RNA, 16 nt, Human
uguuuguugucagcug

SEQ ID NO: 3062621 - RNA, 20 nt, Human
uguuuccuggcacugcuucc

SEQ ID NO: 3062622 - RNA, 21 nt, Human
uguuuccuggcacugcuucca

SEQ ID NO: 3062623 - RNA, 22 nt, Human
uguuuccuggcacugcuuccag

SEQ ID NO: 3062624 - RNA, 15 nt, Human
uguuuccuggcacug

SEQ ID NO: 3062625 - RNA, 14 nt, Human
uuaaagacuuuuau

SEQ ID NO: 3062626 - RNA, 20 nt, Human
uuaaacuuaaucuaaaugga

SEQ ID NO: 3062627 - RNA, 20 nt, Human
uuaaagcuuauuaaaacuca

SEQ ID NO: 3062628 - RNA, 18 nt, Human
uuaaacuuaaucuaaaug

SEQ ID NO: 3062629 - RNA, 16 nt, Human
uuaaacuuaaucuaaa

SEQ ID NO: 3062630 - RNA, 13 nt, Human
uuaaaagaaugau

SEQ ID NO: 3062631 - RNA, 19 nt, Human
uuaaaagaaugauuaugaa

SEQ ID NO: 3062632 - RNA, 11 nt, Human
uuaaaugcacc

SEQ ID NO: 3062633 - RNA, 16 nt, Human
uuaaaugcaccuggaa

SEQ ID NO: 3062634 - RNA, 18 nt, Human
uuaaaugcaccuggaaua

SEQ ID NO: 3062635 - RNA, 17 nt, Human
uuaaaugcaccuggaau

SEQ ID NO: 3062636 - RNA, 19 nt, Human
uuaaauagcuuuuuucucu

SEQ ID NO: 3062637 - RNA, 15 nt, Human
uuaaagcuuccauug

SEQ ID NO: 3062638 - RNA, 17 nt, Human
uuaaaugcccagccccu

SEQ ID NO: 3062639 - RNA, 18 nt, Human
uuaaaugcccagccccuu

SEQ ID NO: 3062640 - RNA, 14 nt, Human
uuacauuuccuaaa

SEQ ID NO: 3062641 - RNA, 14 nt, Human
uuacauuuguauaa

SEQ ID NO: 3062642 - RNA, 15 nt, Human
uuacauuuguauaaa

SEQ ID NO: 3062643 - RNA, 23 nt, Human
uuacauggcuggagcuagaauuu

SEQ ID NO: 3062644 - RNA, 22 nt, Human
uuacauggcuggagcuagaauu

SEQ ID NO: 3062645 - RNA, 20 nt, Human
uuacagagacagaaagcaga

SEQ ID NO: 3062646 - RNA, 22 nt, Human
uuacauuuuuaagugcugcauu

SEQ ID NO: 3062647 - RNA, 21 nt, Human
uuacauuuuuaagugcugcau

SEQ ID NO: 3062648 - RNA, 20 nt, Human
uuacauuuuuaagugcugca

SEQ ID NO: 3062649 - RNA, 21 nt, Human
uuaccacuuguguuuugcaag

SEQ ID NO: 3062650 - RNA, 20 nt, Human
uuaccuuuuuuauacauaaa

SEQ ID NO: 3062651 - RNA, 19 nt, Human
uuaccuuuuuuauacauaa

SEQ ID NO: 3062652 - RNA, 22 nt, Human
uuaccuuuuuuauacauaaaca

SEQ ID NO: 3062653 - RNA, 20 nt, Human
uuacgguuuuccagguuuaa

SEQ ID NO: 3062654 - RNA, 16 nt, Human
uuacggaacucaaaua

SEQ ID NO: 3062655 - RNA, 22 nt, Human
uuaaugucaauucuugccaaau

SEQ ID NO: 3062656 - RNA, 17 nt, Human
uuaaugucacaggcagg

SEQ ID NO: 3062657 - RNA, 18 nt, Human
uuaaugucacaggcaggu

SEQ ID NO: 3062658 - RNA, 21 nt, Human
uuaauagguuuggacaaaaug

SEQ ID NO: 3062659 - RNA, 22 nt, Human
uuaaggaugcuuguacauaaug

SEQ ID NO: 3062660 - RNA, 16 nt, Human
uuaauaauguuucaaa

SEQ ID NO: 3062661 - RNA, 16 nt, Human
uuaauagguuuggaca

SEQ ID NO: 3062662 - RNA, 18 nt, Human
uuaauaauguuucaaaca

SEQ ID NO: 3062663 - RNA, 20 nt, Human
uuaaggaugcuuguacauaa

SEQ ID NO: 3062664 - RNA, 19 nt, Human
uuaaggaugcuuguacaua

SEQ ID NO: 3062665 - RNA, 18 nt, Human
uuaaggaugcuuguacau

SEQ ID NO: 3062666 - RNA, 17 nt, Human
uuaaggaugcuuguaca

SEQ ID NO: 3062667 - RNA, 21 nt, Human
uuaaggaagacaaugugaaaa

SEQ ID NO: 3062668 - RNA, 13 nt, Human
uguucauaaauaa

SEQ ID NO: 3062669 - RNA, 20 nt, Human
uguucaugaaagauucaaug

SEQ ID NO: 3062670 - RNA, 12 nt, Human
uguucuauagcu

SEQ ID NO: 3062671 - RNA, 12 nt, Human
uguucucugccc

SEQ ID NO: 3062672 - RNA, 18 nt, Human
uguucucugaggacacua

SEQ ID NO: 3062673 - RNA, 16 nt, Human
uguucucugaggacac

SEQ ID NO: 3062674 - RNA, 13 nt, Human
uguucucugagga

SEQ ID NO: 3062675 - RNA, 15 nt, Human
uguucugacccugcu

SEQ ID NO: 3062676 - RNA, 19 nt, Human
uguucucugcccuccaaga

SEQ ID NO: 3062677 - RNA, 18 nt, Human
uguucugacccugcuuca

SEQ ID NO: 3062678 - RNA, 14 nt, Human
uguucuuucuggcu

SEQ ID NO: 3062679 - RNA, 22 nt, Human
uguucuuucuggcuaugcauuu

SEQ ID NO: 3062680 - RNA, 20 nt, Human
uguucuuucuggcuaugcau

SEQ ID NO: 3062681 - RNA, 20 nt, Human
uguucuuuccaaaguacacu

SEQ ID NO: 3062682 - RNA, 11 nt, Human
uguugaaagau

SEQ ID NO: 3062683 - RNA, 13 nt, Human
uguuuaaaaucau

SEQ ID NO: 3062684 - RNA, 14 nt, Human
uguuggccaggcug

SEQ ID NO: 3062685 - RNA, 11 nt, Human
uguuggccagg

SEQ ID NO: 3062686 - RNA, 15 nt, Human
uguuggccaaagcca

SEQ ID NO: 3062687 - RNA, 21 nt, Human
uguuggagaagaacugaaauc

SEQ ID NO: 3062688 - RNA, 20 nt, Human
uguuggagaagaacugaaau

SEQ ID NO: 3062689 - RNA, 19 nt, Human
uguugaagagguuuuaaag

SEQ ID NO: 3062690 - RNA, 22 nt, Human
uguguuuaggaacuacugagga

SEQ ID NO: 3062691 - RNA, 13 nt, Human
uguguuugaagca

SEQ ID NO: 3062692 - RNA, 19 nt, Human
ugugugcguccugucggag

SEQ ID NO: 3062693 - RNA, 16 nt, Human
uguguagggcgggagg

SEQ ID NO: 3062694 - RNA, 18 nt, Human
ugugugaauaccccaaga

SEQ ID NO: 3062695 - RNA, 14 nt, Human
uguuagugcaaauu

SEQ ID NO: 3062696 - RNA, 14 nt, Human
uguucagcuccagc

SEQ ID NO: 3062697 - RNA, 16 nt, Human
uguucacagccagacu

SEQ ID NO: 3062698 - RNA, 11 nt, Human
uguucagcugg

SEQ ID NO: 3062699 - RNA, 22 nt, Human
uguucagcuccagcucaccagc

SEQ ID NO: 3062700 - RNA, 16 nt, Human
uguucagcuccagcuc

SEQ ID NO: 3062701 - RNA, 15 nt, Human
uguucagcuccagcu

SEQ ID NO: 3062702 - RNA, 13 nt, Human
uguuacauuuuua

SEQ ID NO: 3062703 - RNA, 22 nt, Human
uguuacauuuuuaagugcugca

SEQ ID NO: 3062704 - RNA, 15 nt, Human
uguuacugucuucag

SEQ ID NO: 3062705 - RNA, 16 nt, Human
uguuacugucuucagu

SEQ ID NO: 3062706 - RNA, 12 nt, Human
ugugggaagggg

SEQ ID NO: 3062707 - RNA, 22 nt, Human
ugugggcuaguugggcuuccuc

SEQ ID NO: 3062708 - RNA, 13 nt, Human
uguggacacagcu

SEQ ID NO: 3062709 - RNA, 14 nt, Human
uguggacacagcuc

SEQ ID NO: 3062710 - RNA, 12 nt, Human
uguggagaagcg

SEQ ID NO: 3062711 - RNA, 21 nt, Human
uguggagaagcggcuggcagc

SEQ ID NO: 3062712 - RNA, 15 nt, Human
uguggacacagcucu

SEQ ID NO: 3062713 - RNA, 16 nt, Human
ugugccucugggacug

SEQ ID NO: 3062714 - RNA, 15 nt, Human
ugugccucugggacu

SEQ ID NO: 3062715 - RNA, 13 nt, Human
ugugccucuggga

SEQ ID NO: 3062716 - RNA, 22 nt, Human
ugugcacaugcacgugugugca

SEQ ID NO: 3062717 - RNA, 16 nt, Human
ugugcacaugcacgug

SEQ ID NO: 3062718 - RNA, 17 nt, Human
ugugccucugggacugg

SEQ ID NO: 3062719 - RNA, 20 nt, Human
ugugcgugcauguguguuca

SEQ ID NO: 3062720 - RNA, 14 nt, Human
ugugcguccugucg

SEQ ID NO: 3062721 - RNA, 21 nt, Human
ugucucaguccaugaagaugu

SEQ ID NO: 3062722 - RNA, 13 nt, Human
ugugaaacauguu

SEQ ID NO: 3062723 - RNA, 14 nt, Human
ugugaaguuuacau

SEQ ID NO: 3062724 - RNA, 20 nt, Human
ugugaaguuuacauuguaaa

SEQ ID NO: 3062725 - RNA, 14 nt, Human
ugugaaaggaaaga

SEQ ID NO: 3062726 - RNA, 13 nt, Human
ugugaaaggaaag

SEQ ID NO: 3062727 - RNA, 14 nt, Human
ugucuuuuuucuaa

SEQ ID NO: 3062728 - RNA, 16 nt, Human
ugucuuuuuucacuac

SEQ ID NO: 3062729 - RNA, 19 nt, Human
ugucuuuggacccugaggc

SEQ ID NO: 3062730 - RNA, 22 nt, Human
ugucuuuggacccugaggccca

SEQ ID NO: 3062731 - RNA, 17 nt, Human
ugucuuuggacccugag

SEQ ID NO: 3062732 - RNA, 18 nt, Human
ugucuuuggacccugagg

SEQ ID NO: 3062733 - RNA, 18 nt, Human
ugugaguacuacaguccu

SEQ ID NO: 3062734 - RNA, 19 nt, Human
ugugaguacuacaguccuc

SEQ ID NO: 3062735 - RNA, 20 nt, Human
ugugaguacuacaguccucc

SEQ ID NO: 3062736 - RNA, 23 nt, Human
ugugaguacuacaguccucccau

SEQ ID NO: 3062737 - RNA, 21 nt, Human
ugugauacaaugcugugcccu

SEQ ID NO: 3062738 - RNA, 16 nt, Human
ugugaaucauuuuacc

SEQ ID NO: 3062739 - RNA, 16 nt, Human
ugugaauaccccaaga

SEQ ID NO: 3062740 - RNA, 21 nt, Human
ugugacaaggauugcuacugu

SEQ ID NO: 3062741 - RNA, 22 nt, Human
ugugaccacugcagaagacagu

SEQ ID NO: 3062742 - RNA, 14 nt, Human
uguaaucacagcua

SEQ ID NO: 3062743 - RNA, 15 nt, Human
uguaaucacagcuac

SEQ ID NO: 3062744 - RNA, 20 nt, Human
uguaaaaugugaagugaaug

SEQ ID NO: 3062745 - RNA, 17 nt, Human
uguaaauuaacuuuuau

SEQ ID NO: 3062746 - RNA, 16 nt, Human
uguaaauuaacuuuua

SEQ ID NO: 3062747 - RNA, 15 nt, Human
uguaaauuaacuuuu

SEQ ID NO: 3062748 - RNA, 14 nt, Human
uguaaauuaacuuu

SEQ ID NO: 3062749 - RNA, 13 nt, Human
uguaaauuaacuu

SEQ ID NO: 3062750 - RNA, 14 nt, Human
uguagagugggagc

SEQ ID NO: 3062751 - RNA, 16 nt, Human
uguacgucugacaggc

SEQ ID NO: 3062752 - RNA, 17 nt, Human
uguacgucugacaggca

SEQ ID NO: 3062753 - RNA, 14 nt, Human
uguaccucuugagc

SEQ ID NO: 3062754 - RNA, 22 nt, Human
uguaccucuugagccuugaacu

SEQ ID NO: 3062755 - RNA, 23 nt, Human
uguaccucuugagccuugaacuu

SEQ ID NO: 3062756 - RNA, 16 nt, Human
uguagcacugacagau

SEQ ID NO: 3062757 - RNA, 17 nt, Human
uguagcacugacagauu

SEQ ID NO: 3062758 - RNA, 22 nt, Human
uguagcacugacagauuuccau

SEQ ID NO: 3062759 - RNA, 23 nt, Human
uguaucccaugagccucagcauc

SEQ ID NO: 3062760 - RNA, 19 nt, Human
uguaucccaugagccucag

SEQ ID NO: 3062761 - RNA, 16 nt, Human
uguaucccaugagccu

SEQ ID NO: 3062762 - RNA, 16 nt, Human
uguaugauucccagcc

SEQ ID NO: 3062763 - RNA, 12 nt, Human
ugucagugugac

SEQ ID NO: 3062764 - RNA, 20 nt, Human
ugucagugugacugaucucu

SEQ ID NO: 3062765 - RNA, 23 nt, Human
ugcuagguuaauuccaauuauau

SEQ ID NO: 3062766 - RNA, 16 nt, Human
ugcuagguuaauucca

SEQ ID NO: 3062767 - RNA, 14 nt, Human
ugcucaggagcccu

SEQ ID NO: 3062768 - RNA, 19 nt, Human
ugcuccucuccccagcaag

SEQ ID NO: 3062769 - RNA, 18 nt, Human
ugcuccucuccccagcaa

SEQ ID NO: 3062770 - RNA, 15 nt, Human
ugcgugcauaccacu

SEQ ID NO: 3062771 - RNA, 19 nt, Human
ugcuagaacucccuuucaa

SEQ ID NO: 3062772 - RNA, 18 nt, Human
ugcuagaacucccuuuca

SEQ ID NO: 3062773 - RNA, 17 nt, Human
ugcuaggaacacuccuu

SEQ ID NO: 3062774 - RNA, 19 nt, Human
ugcuaggaacacuccuuca

SEQ ID NO: 3062775 - RNA, 16 nt, Human
ugcuaggaacacuccu

SEQ ID NO: 3062776 - RNA, 20 nt, Human
ugcuagaacucccuuucaac

SEQ ID NO: 3062777 - RNA, 21 nt, Human
ugcuagaacucccuuucaaca

SEQ ID NO: 3062778 - RNA, 16 nt, Human
ugcugacagacacagg

SEQ ID NO: 3062779 - RNA, 23 nt, Human
ugcugagucugaaggcuggguuc

SEQ ID NO: 3062780 - RNA, 15 nt, Human
ugcugacagacacag

SEQ ID NO: 3062781 - RNA, 18 nt, Human
ugcugauggugcaaugac

SEQ ID NO: 3062782 - RNA, 20 nt, Human
ugcugauggugcaaugaccu

SEQ ID NO: 3062783 - RNA, 23 nt, Human
ugcugauggugcaaugaccuuuc

SEQ ID NO: 3062784 - RNA, 15 nt, Human
ugcugcaguugccag

SEQ ID NO: 3062785 - RNA, 19 nt, Human
ugcuccuggcccacugcau

SEQ ID NO: 3062786 - RNA, 22 nt, Human
ugcugaaugguuuucaaaauaa

SEQ ID NO: 3062787 - RNA, 18 nt, Human
ugcugaaugguuuucaaa

SEQ ID NO: 3062788 - RNA, 17 nt, Human
ugcugaaugguuuucaa

SEQ ID NO: 3062789 - RNA, 18 nt, Human
ugcugaauacagaggcaa

SEQ ID NO: 3062790 - RNA, 23 nt, Human
ugcugaauacagaggcaacugca

SEQ ID NO: 3062791 - RNA, 21 nt, Human
ugcugaaggcucgagcaugcc

SEQ ID NO: 3062792 - RNA, 21 nt, Human
ugcggugcuaucucccccagc

SEQ ID NO: 3062793 - RNA, 23 nt, Human
ugcggugcuaucucccccagccc

SEQ ID NO: 3062794 - RNA, 17 nt, Human
ugccuucucaacuccaa

SEQ ID NO: 3062795 - RNA, 22 nt, Human
ugccuucucaacuccaaacuga

SEQ ID NO: 3062796 - RNA, 18 nt, Human
ugccuuauggaacacucu

SEQ ID NO: 3062797 - RNA, 20 nt, Human
ugccuuauggaacacucuga

SEQ ID NO: 3062798 - RNA, 21 nt, Human
ugccuuauggaacacucugag

SEQ ID NO: 3062799 - RNA, 22 nt, Human
ugccuuauggaacacucugaga

SEQ ID NO: 3062800 - RNA, 21 nt, Human
ugccuggauggggcugcaccg

SEQ ID NO: 3062801 - RNA, 17 nt, Human
ugccugaagucacacag

SEQ ID NO: 3062802 - RNA, 18 nt, Human
ugccugaagucacacagu

SEQ ID NO: 3062803 - RNA, 22 nt, Human
ugccugaagucacacagugagu

SEQ ID NO: 3062804 - RNA, 17 nt, Human
ugccuccuuugugagga

SEQ ID NO: 3062805 - RNA, 18 nt, Human
ugccuccuuugugaggaa

SEQ ID NO: 3062806 - RNA, 16 nt, Human
ugccuccuuugugagg

SEQ ID NO: 3062807 - RNA, 14 nt, Human
ugccucugggacug

SEQ ID NO: 3062808 - RNA, 11 nt, Human
ugcccagcccc

SEQ ID NO: 3062809 - RNA, 23 nt, Human
ugcccaggcuggcgugcaguggu

SEQ ID NO: 3062810 - RNA, 14 nt, Human
ugcaggaccucagg

SEQ ID NO: 3062811 - RNA, 15 nt, Human
ugcaggaccucaggu

SEQ ID NO: 3062812 - RNA, 16 nt, Human
ugcaggaccucaggug

SEQ ID NO: 3062813 - RNA, 18 nt, Human
ugcaggaccucaggugag

SEQ ID NO: 3062814 - RNA, 16 nt, Human
ugcagcaauaaagcag

SEQ ID NO: 3062815 - RNA, 15 nt, Human
ugcagcaauaaagca

SEQ ID NO: 3062816 - RNA, 14 nt, Human
ugcagcaauaaagc

SEQ ID NO: 3062817 - RNA, 15 nt, Human
ugcacuuuguucugg

SEQ ID NO: 3062818 - RNA, 18 nt, Human
ugcacuuuguucuggcuc

SEQ ID NO: 3062819 - RNA, 19 nt, Human
ugcacuuuguucuggcucu

SEQ ID NO: 3062820 - RNA, 16 nt, Human
ugcagauaaacaguag

SEQ ID NO: 3062821 - RNA, 16 nt, Human
ugcacguacacacaca

SEQ ID NO: 3062822 - RNA, 16 nt, Human
ugcacuugcagacucu

SEQ ID NO: 3062823 - RNA, 21 nt, Human
ugcacuugcagacucuacaga

SEQ ID NO: 3062824 - RNA, 21 nt, Human
ugcacacuuuggcccagggug

SEQ ID NO: 3062825 - RNA, 20 nt, Human
ugcacagaguuguuacauuu

SEQ ID NO: 3062826 - RNA, 22 nt, Human
ugcacagaguuguuacauuuuu

SEQ ID NO: 3062827 - RNA, 21 nt, Human
ugcacagaguuguuacauuuu

SEQ ID NO: 3062828 - RNA, 23 nt, Human
ugcacagaguuguuacauuuuua

SEQ ID NO: 3062829 - RNA, 18 nt, Human
ugcacagcaggcugccag

SEQ ID NO: 3062830 - RNA, 17 nt, Human
ugcacagcuaacaugga

SEQ ID NO: 3062831 - RNA, 21 nt, Human
ugcacagcaggcugccagugc

SEQ ID NO: 3062832 - RNA, 22 nt, Human
ugcacagcaggcugccagugcc

SEQ ID NO: 3062833 - RNA, 23 nt, Human
ugcacagcaggcugccagugccu

SEQ ID NO: 3062834 - RNA, 17 nt, Human
ugaagucuuuguacaga

SEQ ID NO: 3062835 - RNA, 20 nt, Human
ugaagucuuuguacagacaa

SEQ ID NO: 3062836 - RNA, 22 nt, Human
ugaagucuuuguacagacaaca

SEQ ID NO: 3062837 - RNA, 17 nt, Human
ugcacacuuuggcccag

SEQ ID NO: 3062838 - RNA, 18 nt, Human
ugcacacuuuggcccagg

SEQ ID NO: 3062839 - RNA, 19 nt, Human
ugcacacuuuggcccaggg

SEQ ID NO: 3062840 - RNA, 20 nt, Human
ugcacacuuuggcccagggu

SEQ ID NO: 3062841 - RNA, 16 nt, Human
ugcacacuuuggccca

SEQ ID NO: 3062842 - RNA, 13 nt, Human
ugcacacuuuggc

SEQ ID NO: 3062843 - RNA, 18 nt, Human
ugcacagcuaacauggaa

SEQ ID NO: 3062844 - RNA, 20 nt, Human
ugcacagcuaacauggaagu

SEQ ID NO: 3062845 - RNA, 23 nt, Human
ugcacagcuaacauggaaguacu

SEQ ID NO: 3062846 - RNA, 15 nt, Human
ugcacaucaaaauau

SEQ ID NO: 3062847 - RNA, 15 nt, Human
ugccauccuggccca

SEQ ID NO: 3062848 - RNA, 16 nt, Human
ugccauccuggcccag

SEQ ID NO: 3062849 - RNA, 18 nt, Human
ugccauccuggcccaggg

SEQ ID NO: 3062850 - RNA, 21 nt, Human
ugccauccuggcccagggcau

SEQ ID NO: 3062851 - RNA, 15 nt, Human
ugcccaccuggccuc

SEQ ID NO: 3062852 - RNA, 17 nt, Human
ugcccaccuggccucug

SEQ ID NO: 3062853 - RNA, 18 nt, Human
ugcccaccuggccucugc

SEQ ID NO: 3062854 - RNA, 14 nt, Human
ugcccaccuggccu

SEQ ID NO: 3062855 - RNA, 10 nt, Human
ugcccagccc

SEQ ID NO: 3062856 - RNA, 14 nt, Human
ugccagucaccccg

SEQ ID NO: 3062857 - RNA, 24 nt, Human
ugccagguuuuuggucugacccac

SEQ ID NO: 3062858 - RNA, 13 nt, Human
ugccauccuggcc

SEQ ID NO: 3062859 - RNA, 11 nt, Human
ugccagggaca

SEQ ID NO: 3062860 - RNA, 22 nt, Human
ugccagggacagaggggguggc

SEQ ID NO: 3062861 - RNA, 17 nt, Human
ugcaggcagccaggcca

SEQ ID NO: 3062862 - RNA, 18 nt, Human
ugcaggcagccaggccac

SEQ ID NO: 3062863 - RNA, 22 nt, Human
ugcaucagcugcugaaacaaca

SEQ ID NO: 3062864 - RNA, 19 nt, Human
ugcaucagcugcugaaaca

SEQ ID NO: 3062865 - RNA, 16 nt, Human
ugcaggcagccaggcc

SEQ ID NO: 3062866 - RNA, 15 nt, Human
ugcaucguuucaucu

SEQ ID NO: 3062867 - RNA, 19 nt, Human
ugcauguuacauaagauaa

SEQ ID NO: 3062868 - RNA, 15 nt, Human
ugcauuauauuuauu

SEQ ID NO: 3062869 - RNA, 14 nt, Human
ugcauuauauuuau

SEQ ID NO: 3062870 - RNA, 20 nt, Human
ugcauuauauuuauuacugu

SEQ ID NO: 3062871 - RNA, 22 nt, Human
ugggguggggggggugcugggc

SEQ ID NO: 3062872 - RNA, 21 nt, Human
ugggguggggggggugcuggg

SEQ ID NO: 3062873 - RNA, 17 nt, Human
uggguagacacacauga

SEQ ID NO: 3062874 - RNA, 16 nt, Human
uggguagacacacaug

SEQ ID NO: 3062875 - RNA, 19 nt, Human
ugggguggggggggugcug

SEQ ID NO: 3062876 - RNA, 17 nt, Human
ugggguggggaccucag

SEQ ID NO: 3062877 - RNA, 23 nt, Human
ugggugucaagagggucugagga

SEQ ID NO: 3062878 - RNA, 21 nt, Human
ugggugucaagagggucugag

SEQ ID NO: 3062879 - RNA, 16 nt, Human
uggguucacugcaacc

SEQ ID NO: 3062880 - RNA, 23 nt, Human
uggguucaagcgauucuucugcu

SEQ ID NO: 3062881 - RNA, 19 nt, Human
ugggcuucaguggcagcug

SEQ ID NO: 3062882 - RNA, 18 nt, Human
ugggcuucaguggcagcu

SEQ ID NO: 3062883 - RNA, 13 nt, Human
uggggcagcuuga

SEQ ID NO: 3062884 - RNA, 21 nt, Human
ugggcuuggggaccagagcug

SEQ ID NO: 3062885 - RNA, 16 nt, Human
uggggcagcuugaggg

SEQ ID NO: 3062886 - RNA, 19 nt, Human
ugggcuuggggaccagagc

SEQ ID NO: 3062887 - RNA, 20 nt, Human
ugggcuucaguggcagcugc

SEQ ID NO: 3062888 - RNA, 24 nt, Human
ugggagcugccuguucagcuccag

SEQ ID NO: 3062889 - RNA, 16 nt, Human
ugggagcuuuuguaga

SEQ ID NO: 3062890 - RNA, 22 nt, Human
ugggccuccugugugugcgccu

SEQ ID NO: 3062891 - RNA, 16 nt, Human
ugggccuccugugugu

SEQ ID NO: 3062892 - RNA, 14 nt, Human
ugggccuccugugu

SEQ ID NO: 3062893 - RNA, 15 nt, Human
uggccagaugcacca

SEQ ID NO: 3062894 - RNA, 17 nt, Human
uggccuucggccuccau

SEQ ID NO: 3062895 - RNA, 18 nt, Human
uggccuucggccuccauc

SEQ ID NO: 3062896 - RNA, 14 nt, Human
uggccuucggccuc

SEQ ID NO: 3062897 - RNA, 14 nt, Human
uggcgcugccccug

SEQ ID NO: 3062898 - RNA, 22 nt, Human
uggcgugcaguggugcgaucug

SEQ ID NO: 3062899 - RNA, 14 nt, Human
uggcgagccauuug

SEQ ID NO: 3062900 - RNA, 19 nt, Human
uggcgagccauuuguccca

SEQ ID NO: 3062901 - RNA, 13 nt, Human
uggcucuuccagg

SEQ ID NO: 3062902 - RNA, 15 nt, Human
uggcucuuccaggcu

SEQ ID NO: 3062903 - RNA, 12 nt, Human
uggcugggggcc

SEQ ID NO: 3062904 - RNA, 16 nt, Human
uggcucuuccaggcug

SEQ ID NO: 3062905 - RNA, 20 nt, Human
uggcucagguggggucacuc

SEQ ID NO: 3062906 - RNA, 22 nt, Human
uggcucagguggggucacucug

SEQ ID NO: 3062907 - RNA, 20 nt, Human
uggcuccaaacccucgaggc

SEQ ID NO: 3062908 - RNA, 18 nt, Human
uggcuccaaacccucgag

SEQ ID NO: 3062909 - RNA, 16 nt, Human
uggcuccaaacccucg

SEQ ID NO: 3062910 - RNA, 16 nt, Human
ugggacaugggaaagg

SEQ ID NO: 3062911 - RNA, 19 nt, Human
ugggacauuugcucaugga

SEQ ID NO: 3062912 - RNA, 20 nt, Human
ugggacauuugcucauggaa

SEQ ID NO: 3062913 - RNA, 23 nt, Human
ugggagcugccuguucagcucca

SEQ ID NO: 3062914 - RNA, 21 nt, Human
ugggaaugaaugucaguguga

SEQ ID NO: 3062915 - RNA, 22 nt, Human
ugggaaugaaugucagugugac

SEQ ID NO: 3062916 - RNA, 18 nt, Human
ugggacagucaccucaug

SEQ ID NO: 3062917 - RNA, 20 nt, Human
ugggacagucaccucaugga

SEQ ID NO: 3062918 - RNA, 21 nt, Human
ugggacagucaccucauggaa

SEQ ID NO: 3062919 - RNA, 22 nt, Human
uggcugguuagagguucccuuu

SEQ ID NO: 3062920 - RNA, 14 nt, Human
uggcugggggccuc

SEQ ID NO: 3062921 - RNA, 13 nt, Human
uggagauguuuag

SEQ ID NO: 3062922 - RNA, 16 nt, Human
uggacaggcauguucu

SEQ ID NO: 3062923 - RNA, 12 nt, Human
uggacaggcaug

SEQ ID NO: 3062924 - RNA, 22 nt, Human
uggaggcaugugaugagaggaa

SEQ ID NO: 3062925 - RNA, 22 nt, Human
uggcagcugcgguccacccagg

SEQ ID NO: 3062926 - RNA, 21 nt, Human
uggcagcugcgguccacccag

SEQ ID NO: 3062927 - RNA, 23 nt, Human
uggcagcugcgguccacccagga

SEQ ID NO: 3062928 - RNA, 19 nt, Human
uggcagcugcgguccaccc

SEQ ID NO: 3062929 - RNA, 14 nt, Human
uggaugccuggugg

SEQ ID NO: 3062930 - RNA, 14 nt, Human
uggcacugcuucca

SEQ ID NO: 3062931 - RNA, 16 nt, Human
uggcacugcuuccagu

SEQ ID NO: 3062932 - RNA, 18 nt, Human
uggcacugcuuccaguga

SEQ ID NO: 3062933 - RNA, 19 nt, Human
uggcagugggagcugccug

SEQ ID NO: 3062934 - RNA, 16 nt, Human
uggcagugggagcugc

SEQ ID NO: 3062935 - RNA, 15 nt, Human
uggcagugggagcug

SEQ ID NO: 3062936 - RNA, 14 nt, Human
uggcagugggagcu

SEQ ID NO: 3062937 - RNA, 13 nt, Human
uggcagugggagc

SEQ ID NO: 3062938 - RNA, 20 nt, Human
uggcagugggagcugccugu

SEQ ID NO: 3062939 - RNA, 16 nt, Human
uggaauaucuccguca

SEQ ID NO: 3062940 - RNA, 14 nt, Human
uggaagacagcucu

SEQ ID NO: 3062941 - RNA, 16 nt, Human
uggaauacucuuauau

SEQ ID NO: 3062942 - RNA, 11 nt, Human
uggaagacagc

SEQ ID NO: 3062943 - RNA, 12 nt, Human
uggaagacagcu

SEQ ID NO: 3062944 - RNA, 14 nt, Human
uggaacucucgagc

SEQ ID NO: 3062945 - RNA, 16 nt, Human
uggaaaauaaauuauu

SEQ ID NO: 3062946 - RNA, 15 nt, Human
uggaaaauaaauuau

SEQ ID NO: 3062947 - RNA, 22 nt, Human
uggaaaaguauguuagugcaaa

SEQ ID NO: 3062948 - RNA, 16 nt, Human
ugcuucuucagagacu

SEQ ID NO: 3062949 - RNA, 14 nt, Human
ugcuucuguuuuau

SEQ ID NO: 3062950 - RNA, 19 nt, Human
ugcuuccagugaggcucug

SEQ ID NO: 3062951 - RNA, 20 nt, Human
ugcuuccagugaggcucugc

SEQ ID NO: 3062952 - RNA, 18 nt, Human
ugcuuccagugaggcucu

SEQ ID NO: 3062953 - RNA, 18 nt, Human
ucuuaaaaaguggaaaaa

SEQ ID NO: 3062954 - RNA, 22 nt, Human
ucuguuuuauaauuuugugaag

SEQ ID NO: 3062955 - RNA, 20 nt, Human
ucuguuuuauaauuuuguga

SEQ ID NO: 3062956 - RNA, 23 nt, Human
ucuguggguuucuaaagcugcca

SEQ ID NO: 3062957 - RNA, 22 nt, Human
ucugugucagguggggcagcuu

SEQ ID NO: 3062958 - RNA, 17 nt, Human
ucuguacgucugacagg

SEQ ID NO: 3062959 - RNA, 22 nt, Human
ucuguggguuucuaaagcugcc

SEQ ID NO: 3062960 - RNA, 19 nt, Human
ucuguccgagcuuugaaaa

SEQ ID NO: 3062961 - RNA, 23 nt, Human
ucuggagcccacuguacuugcuc

SEQ ID NO: 3062962 - RNA, 14 nt, Human
ucuggcuaugcauu

SEQ ID NO: 3062963 - RNA, 23 nt, Human
ucuggccuucggccuccauccug

SEQ ID NO: 3062964 - RNA, 12 nt, Human
ucugggacacag

SEQ ID NO: 3062965 - RNA, 15 nt, Human
ucuggcucuuccagg

SEQ ID NO: 3062966 - RNA, 16 nt, Human
ucuggcucuuccaggc

SEQ ID NO: 3062967 - RNA, 17 nt, Human
ucuggcucuuccaggcu

SEQ ID NO: 3062968 - RNA, 23 nt, Human
ucuguacagagcccacgccccca

SEQ ID NO: 3062969 - RNA, 24 nt, Human
ucuguaauaaacucauuucuagca

SEQ ID NO: 3062970 - RNA, 23 nt, Human
ucuguaauaaacucauuucuagc

SEQ ID NO: 3062971 - RNA, 19 nt, Human
ucuguaauaaacucauuuc

SEQ ID NO: 3062972 - RNA, 21 nt, Human
ucuugaauuguaaggaaugau

SEQ ID NO: 3062973 - RNA, 12 nt, Human
ucuucuccaggc

SEQ ID NO: 3062974 - RNA, 14 nt, Human
ucuucuccaggcug

SEQ ID NO: 3062975 - RNA, 13 nt, Human
ucuucuccaggcu

SEQ ID NO: 3062976 - RNA, 18 nt, Human
ucuugaacuccuggccuc

SEQ ID NO: 3062977 - RNA, 17 nt, Human
ucuugaacuccuggccu

SEQ ID NO: 3062978 - RNA, 16 nt, Human
ucuugaacuccuggcc

SEQ ID NO: 3062979 - RNA, 11 nt, Human
ucuugcucugc

SEQ ID NO: 3062980 - RNA, 13 nt, Human
ucuugcucugcug

SEQ ID NO: 3062981 - RNA, 12 nt, Human
ucuugcucugcu

SEQ ID NO: 3062982 - RNA, 16 nt, Human
ucuucaguaagccgug

SEQ ID NO: 3062983 - RNA, 21 nt, Human
ucuuccacaagagcccaggcc

SEQ ID NO: 3062984 - RNA, 14 nt, Human
ucuuccaggcuggg

SEQ ID NO: 3062985 - RNA, 19 nt, Human
ucuucuccacuuucuagcc

SEQ ID NO: 3062986 - RNA, 21 nt, Human
ucuucuccacuuucuagccag

SEQ ID NO: 3062987 - RNA, 14 nt, Human
ucuuauacauuuga

SEQ ID NO: 3062988 - RNA, 15 nt, Human
ucuuauacauuugau

SEQ ID NO: 3062989 - RNA, 16 nt, Human
ucuuaguggauguucu

SEQ ID NO: 3062990 - RNA, 14 nt, Human
ucuuagugugugca

SEQ ID NO: 3062991 - RNA, 13 nt, Human
ucuuaaaaagugg

SEQ ID NO: 3062992 - RNA, 15 nt, Human
ucuucaguaagccgu

SEQ ID NO: 3062993 - RNA, 15 nt, Human
ugaacugauaaagau

SEQ ID NO: 3062994 - RNA, 13 nt, Human
ugaacugauaaag

SEQ ID NO: 3062995 - RNA, 15 nt, Human
ugaacucuucaaucu

SEQ ID NO: 3062996 - RNA, 22 nt, Human
ugaaccacaucuugcucugcug

SEQ ID NO: 3062997 - RNA, 21 nt, Human
ugaaccacaucuugcucugcu

SEQ ID NO: 3062998 - RNA, 20 nt, Human
ugaaccacaucuugcucugc

SEQ ID NO: 3062999 - RNA, 18 nt, Human
ugaacucuucaaucucuu

SEQ ID NO: 3063000 - RNA, 19 nt, Human
ugaaccacaucuugcucug

SEQ ID NO: 3063001 - RNA, 14 nt, Human
ugaacacaucagcu

SEQ ID NO: 3063002 - RNA, 14 nt, Human
ugaagacagagcua

SEQ ID NO: 3063003 - RNA, 16 nt, Human
ugaagacagagcuaca

SEQ ID NO: 3063004 - RNA, 13 nt, Human
ugaagacagagcu

SEQ ID NO: 3063005 - RNA, 14 nt, Human
ugaacuuggcgcug

SEQ ID NO: 3063006 - RNA, 12 nt, Human
ugaacuugguuc

SEQ ID NO: 3063007 - RNA, 19 nt, Human
ugaacuggguacuugugga

SEQ ID NO: 3063008 - RNA, 17 nt, Human
ugaagacuuuucuuuca

SEQ ID NO: 3063009 - RNA, 22 nt, Human
ugaagacuuuucuuucagccaa

SEQ ID NO: 3063010 - RNA, 14 nt, Human
ugaagacuuuucuu

SEQ ID NO: 3063011 - RNA, 21 nt, Human
ugaaggcucgagcaugccugg

SEQ ID NO: 3063012 - RNA, 21 nt, Human
ugaaguccaagcauuuagaug

SEQ ID NO: 3063013 - RNA, 22 nt, Human
ugaaguccaagcauuuagaugu

SEQ ID NO: 3063014 - RNA, 20 nt, Human
ugaaggcucgagcaugccug

SEQ ID NO: 3063015 - RNA, 15 nt, Human
ugaaaucauucauuu

SEQ ID NO: 3063016 - RNA, 17 nt, Human
ugaaaucuuuuugcuuu

SEQ ID NO: 3063017 - RNA, 17 nt, Human
ugaaagggcccagagag

SEQ ID NO: 3063018 - RNA, 16 nt, Human
ugaaagggcccagaga

SEQ ID NO: 3063019 - RNA, 15 nt, Human
ugaaagggcccagag

SEQ ID NO: 3063020 - RNA, 22 nt, Human
ugaaaugaggucagagccugca

SEQ ID NO: 3063021 - RNA, 21 nt, Human
ugaaaugaggucagagccugc

SEQ ID NO: 3063022 - RNA, 23 nt, Human
ugaaaugaggucagagccugcag

SEQ ID NO: 3063023 - RNA, 20 nt, Human
ugaaaugaggucagagccug

SEQ ID NO: 3063024 - RNA, 19 nt, Human
ugaaaugaggucagagccu

SEQ ID NO: 3063025 - RNA, 22 nt, Human
ugaaaagacuccaaagaaaugu

SEQ ID NO: 3063026 - RNA, 18 nt, Human
ugaaacccugucucuacu

SEQ ID NO: 3063027 - RNA, 17 nt, Human
ugaaaggaaagaggcuc

SEQ ID NO: 3063028 - RNA, 12 nt, Human
ugaaaggaaaga

SEQ ID NO: 3063029 - RNA, 13 nt, Human
ugaaagauucaau

SEQ ID NO: 3063030 - RNA, 18 nt, Human
ugaaagcagggacuugaa

SEQ ID NO: 3063031 - RNA, 19 nt, Human
ugaaagcagggacuugaac

SEQ ID NO: 3063032 - RNA, 19 nt, Human
ucuuuugccguuauuaaaa

SEQ ID NO: 3063033 - RNA, 17 nt, Human
ucuuuugccguuauuaa

SEQ ID NO: 3063034 - RNA, 16 nt, Human
ucuuuuugcuuugcuu

SEQ ID NO: 3063035 - RNA, 19 nt, Human
ugaaaacuuuaugcuaagu

SEQ ID NO: 3063036 - RNA, 19 nt, Human
ugaaaagacuccaaagaaa

SEQ ID NO: 3063037 - RNA, 17 nt, Human
ugaaaagacuccaaaga

SEQ ID NO: 3063038 - RNA, 16 nt, Human
ugaaaagacuccaaag

SEQ ID NO: 3063039 - RNA, 15 nt, Human
ugaaaagacuccaaa

SEQ ID NO: 3063040 - RNA, 21 nt, Human
ucucagugucaaugcagcccc

SEQ ID NO: 3063041 - RNA, 15 nt, Human
ucucccccagcccca

SEQ ID NO: 3063042 - RNA, 17 nt, Human
ucucccccagccccauc

SEQ ID NO: 3063043 - RNA, 14 nt, Human
ucucccccagcccc

SEQ ID NO: 3063044 - RNA, 22 nt, Human
ucucccccagccccauccucug

SEQ ID NO: 3063045 - RNA, 13 nt, Human
ucucccccagccc

SEQ ID NO: 3063046 - RNA, 18 nt, Human
ucucccccagccccaucc

SEQ ID NO: 3063047 - RNA, 20 nt, Human
ucucccccagccccauccuc

SEQ ID NO: 3063048 - RNA, 19 nt, Human
ucuccugccucagccuccc

SEQ ID NO: 3063049 - RNA, 22 nt, Human
ucuccugccucagccucccaaa

SEQ ID NO: 3063050 - RNA, 15 nt, Human
ucucucgugaguaua

SEQ ID NO: 3063051 - RNA, 13 nt, Human
ucucugaggacac

SEQ ID NO: 3063052 - RNA, 19 nt, Human
ucucuaguuugauuaaauu

SEQ ID NO: 3063053 - RNA, 18 nt, Human
ucucuaguuugauuaaau

SEQ ID NO: 3063054 - RNA, 16 nt, Human
ucucuaguuugauuaa

SEQ ID NO: 3063055 - RNA, 13 nt, Human
ucucuaggaaaua

SEQ ID NO: 3063056 - RNA, 15 nt, Human
ucucuacaaaaagca

SEQ ID NO: 3063057 - RNA, 11 nt, Human
ucucugcaggu

SEQ ID NO: 3063058 - RNA, 18 nt, Human
ucucuucacagucacauu

SEQ ID NO: 3063059 - RNA, 13 nt, Human
ucugaaagggacg

SEQ ID NO: 3063060 - RNA, 23 nt, Human
ucugaaaauguauguguaaguau

SEQ ID NO: 3063061 - RNA, 14 nt, Human
ucugaaaauguaug

SEQ ID NO: 3063062 - RNA, 14 nt, Human
ucugaaauuuccug

SEQ ID NO: 3063063 - RNA, 16 nt, Human
ucucuuuucaaaacau

SEQ ID NO: 3063064 - RNA, 15 nt, Human
ucucuuuucaaaaca

SEQ ID NO: 3063065 - RNA, 16 nt, Human
ucugaaaauguaugug

SEQ ID NO: 3063066 - RNA, 23 nt, Human
ucugaggacacuaaccacgcugg

SEQ ID NO: 3063067 - RNA, 20 nt, Human
ucugaggacacuaaccacgc

SEQ ID NO: 3063068 - RNA, 17 nt, Human
ucugaggaauccagacc

SEQ ID NO: 3063069 - RNA, 16 nt, Human
ucugaggaauccagac

SEQ ID NO: 3063070 - RNA, 23 nt, Human
ucugauucccaagcucugcuccu

SEQ ID NO: 3063071 - RNA, 14 nt, Human
ucugcacaagcugc

SEQ ID NO: 3063072 - RNA, 19 nt, Human
ucugcacaagcugcacccu

SEQ ID NO: 3063073 - RNA, 15 nt, Human
ucugacccaugcugc

SEQ ID NO: 3063074 - RNA, 16 nt, Human
ucugacccaugcugcc

SEQ ID NO: 3063075 - RNA, 17 nt, Human
ucugacccaugcugccc

SEQ ID NO: 3063076 - RNA, 18 nt, Human
ucugacccaugcugcccu

SEQ ID NO: 3063077 - RNA, 24 nt, Human
ucugagaucaaaacgguuuuacug

SEQ ID NO: 3063078 - RNA, 20 nt, Human
ucugaacuuggcgcugcccc

SEQ ID NO: 3063079 - RNA, 15 nt, Human
ucugacccacugcuu

SEQ ID NO: 3063080 - RNA, 14 nt, Human
ucugacccaugcug

SEQ ID NO: 3063081 - RNA, 15 nt, Human
ucuaguaugaaauua

SEQ ID NO: 3063082 - RNA, 17 nt, Human
ucuaguaugaaauuaua

SEQ ID NO: 3063083 - RNA, 21 nt, Human
ucucaaauuuggauugcuaau

SEQ ID NO: 3063084 - RNA, 21 nt, Human
ucucaaacucuugaccucagg

SEQ ID NO: 3063085 - RNA, 13 nt, Human
ucucaaacucuug

SEQ ID NO: 3063086 - RNA, 22 nt, Human
ucucaaacucuugaccucaggu

SEQ ID NO: 3063087 - RNA, 17 nt, Human
ucucacucugucgccca

SEQ ID NO: 3063088 - RNA, 16 nt, Human
ucucacucugucgccc

SEQ ID NO: 3063089 - RNA, 18 nt, Human
ucucacucugucgcccag

SEQ ID NO: 3063090 - RNA, 21 nt, Human
ucucacuguugcccaggcugg

SEQ ID NO: 3063091 - RNA, 20 nt, Human
ucucacuguugcccaggcug

SEQ ID NO: 3063092 - RNA, 19 nt, Human
ucucacuguugcccaggcu

SEQ ID NO: 3063093 - RNA, 18 nt, Human
ucucacuguugcccaggc

SEQ ID NO: 3063094 - RNA, 21 nt, Human
ucucagaaucucaaauaacua

SEQ ID NO: 3063095 - RNA, 17 nt, Human
ucucagaaucucaaaua

SEQ ID NO: 3063096 - RNA, 17 nt, Human
ucucacuguugcccagg

SEQ ID NO: 3063097 - RNA, 18 nt, Human
ucuaaauuuuauaucuug

SEQ ID NO: 3063098 - RNA, 23 nt, Human
ucuaaauuuuauaucuuguagcu

SEQ ID NO: 3063099 - RNA, 23 nt, Human
ucuaaauuugaauguuaagcaga

SEQ ID NO: 3063100 - RNA, 22 nt, Human
ucuaaauuugaauguuaagcag

SEQ ID NO: 3063101 - RNA, 19 nt, Human
ucuaacaaaaaaauauauu

SEQ ID NO: 3063102 - RNA, 17 nt, Human
ucuaaauuugaauguua

SEQ ID NO: 3063103 - RNA, 13 nt, Human
ucuaaauuugaau

SEQ ID NO: 3063104 - RNA, 16 nt, Human
ucuaaauucuuucauu

SEQ ID NO: 3063105 - RNA, 22 nt, Human
ucuaaaucuccaaaauaaaacu

SEQ ID NO: 3063106 - RNA, 16 nt, Human
ucuaacuucaccauau

SEQ ID NO: 3063107 - RNA, 15 nt, Human
ucuaacuucaccaua

SEQ ID NO: 3063108 - RNA, 21 nt, Human
ucuacacuaagagagaaugag

SEQ ID NO: 3063109 - RNA, 12 nt, Human
ucuacacugugc

SEQ ID NO: 3063110 - RNA, 14 nt, Human
ucuacacugugcug

SEQ ID NO: 3063111 - RNA, 17 nt, Human
ucuacacuaagagagaa

SEQ ID NO: 3063112 - RNA, 17 nt, Human
ucuacacuccagugaga

SEQ ID NO: 3063113 - RNA, 19 nt, Human
ucuacugaggugcuauguu

SEQ ID NO: 3063114 - RNA, 18 nt, Human
ucuacugaggugcuaugu

SEQ ID NO: 3063115 - RNA, 15 nt, Human
ucuacacugugcuga

SEQ ID NO: 3063116 - RNA, 22 nt, Human
ucuacugaggugcuauguucuu

SEQ ID NO: 3063117 - RNA, 22 nt, Human
ucuagggaaaaaccagcgugug

SEQ ID NO: 3063118 - RNA, 19 nt, Human
ucuagggaaaaaccagcgu

SEQ ID NO: 3063119 - RNA, 20 nt, Human
uccuucugugaaaguacauu

SEQ ID NO: 3063120 - RNA, 19 nt, Human
uccuucuguccuacucugu

SEQ ID NO: 3063121 - RNA, 12 nt, Human
uccuucuguccu

SEQ ID NO: 3063122 - RNA, 10 nt, Human
ucccucccuu

SEQ ID NO: 3063123 - RNA, 22 nt, Human
uccuggcaugggaaugaauguc

SEQ ID NO: 3063124 - RNA, 17 nt, Human
uccuggcccacugcauc

SEQ ID NO: 3063125 - RNA, 23 nt, Human
uccugguccccucagcucugccu

SEQ ID NO: 3063126 - RNA, 15 nt, Human
uccugguguggaaga

SEQ ID NO: 3063127 - RNA, 15 nt, Human
ucgaguuacagacaa

SEQ ID NO: 3063128 - RNA, 17 nt, Human
ucgaguuacagacaaag

SEQ ID NO: 3063129 - RNA, 23 nt, Human
ucgcugugucagcauagaaguaa

SEQ ID NO: 3063130 - RNA, 13 nt, Human
ucaguuguacagu

SEQ ID NO: 3063131 - RNA, 13 nt, Human
ucauaaugacuua

SEQ ID NO: 3063132 - RNA, 15 nt, Human
ucauaauuauuauuu

SEQ ID NO: 3063133 - RNA, 15 nt, Human
ucauaauuuauacag

SEQ ID NO: 3063134 - RNA, 13 nt, Human
ucauacauuguac

SEQ ID NO: 3063135 - RNA, 15 nt, Human
ucauacauuguacga

SEQ ID NO: 3063136 - RNA, 16 nt, Human
ucauacauuguacgaa

SEQ ID NO: 3063137 - RNA, 13 nt, Human
ucauacccacccc

SEQ ID NO: 3063138 - RNA, 17 nt, Human
ucagugugacugaucuc

SEQ ID NO: 3063139 - RNA, 13 nt, Human
ucagugugacuga

SEQ ID NO: 3063140 - RNA, 11 nt, Human
ucaguguacau

SEQ ID NO: 3063141 - RNA, 23 nt, Human
ucagugguuggcaauuguuucaa

SEQ ID NO: 3063142 - RNA, 15 nt, Human
ucagucuggcccuuc

SEQ ID NO: 3063143 - RNA, 24 nt, Human
ucagucugauucccaagcucugcu

SEQ ID NO: 3063144 - RNA, 21 nt, Human
ucauuaggugugacugaauuu

SEQ ID NO: 3063145 - RNA, 18 nt, Human
ucauuaggugugacugaa

SEQ ID NO: 3063146 - RNA, 16 nt, Human
ucauuaggugugacug

SEQ ID NO: 3063147 - RNA, 20 nt, Human
ucauacccacccccacccaa

SEQ ID NO: 3063148 - RNA, 14 nt, Human
ucauacccaccccc

SEQ ID NO: 3063149 - RNA, 15 nt, Human
ucauacccaccccca

SEQ ID NO: 3063150 - RNA, 13 nt, Human
uccaagcaaaugu

SEQ ID NO: 3063151 - RNA, 17 nt, Human
uccaagcauuuagaugu

SEQ ID NO: 3063152 - RNA, 23 nt, Human
uccaagcauaccaacacgagcag

SEQ ID NO: 3063153 - RNA, 20 nt, Human
uccaagaagcccaggaaagg

SEQ ID NO: 3063154 - RNA, 22 nt, Human
uccaagaagcccaggaaaggcu

SEQ ID NO: 3063155 - RNA, 19 nt, Human
uccaagaagcccaggaaag

SEQ ID NO: 3063156 - RNA, 14 nt, Human
uccaagaauuucua

SEQ ID NO: 3063157 - RNA, 16 nt, Human
uccaaaauaaaacuuu

SEQ ID NO: 3063158 - RNA, 17 nt, Human
uccaaaauaaaacuuuu

SEQ ID NO: 3063159 - RNA, 12 nt, Human
uccaaagaaaug

SEQ ID NO: 3063160 - RNA, 23 nt, Human
uccaaacugacucuuaagaagac

SEQ ID NO: 3063161 - RNA, 22 nt, Human
ucauucagauaugauucaaaug

SEQ ID NO: 3063162 - RNA, 14 nt, Human
ucauuucuuugagu

SEQ ID NO: 3063163 - RNA, 22 nt, Human
ucauuucugcaucagcugcuga

SEQ ID NO: 3063164 - RNA, 16 nt, Human
ucauuucugcaucagc

SEQ ID NO: 3063165 - RNA, 12 nt, Human
uccaccugccag

SEQ ID NO: 3063166 - RNA, 14 nt, Human
uccaccuacaugag

SEQ ID NO: 3063167 - RNA, 22 nt, Human
uccaagcaggacauggacaagg

SEQ ID NO: 3063168 - RNA, 14 nt, Human
uccacaagagccca

SEQ ID NO: 3063169 - RNA, 13 nt, Human
uccaccugccagg

SEQ ID NO: 3063170 - RNA, 12 nt, Human
uccacuuggucu

SEQ ID NO: 3063171 - RNA, 13 nt, Human
uccacuuggucug

SEQ ID NO: 3063172 - RNA, 14 nt, Human
uccagauccuggaa

SEQ ID NO: 3063173 - RNA, 16 nt, Human
uccagauccuggaaau

SEQ ID NO: 3063174 - RNA, 17 nt, Human
uccagauccuggaaauc

SEQ ID NO: 3063175 - RNA, 22 nt, Human
uccccacuugagaauuacccuu

SEQ ID NO: 3063176 - RNA, 20 nt, Human
ucccaucucacacaugagca

SEQ ID NO: 3063177 - RNA, 23 nt, Human
ucccaucucacacaugagcauca

SEQ ID NO: 3063178 - RNA, 22 nt, Human
ucccaggcauuccccaggaggc

SEQ ID NO: 3063179 - RNA, 19 nt, Human
ucccaggcauuccccagga

SEQ ID NO: 3063180 - RNA, 20 nt, Human
ucccaggcauuccccaggag

SEQ ID NO: 3063181 - RNA, 21 nt, Human
ucccaggcauuccccaggagg

SEQ ID NO: 3063182 - RNA, 15 nt, Human
ucccaccucagccuc

SEQ ID NO: 3063183 - RNA, 14 nt, Human
ucccaccucagccu

SEQ ID NO: 3063184 - RNA, 13 nt, Human
ucccaccucagcc

SEQ ID NO: 3063185 - RNA, 13 nt, Human
ucccaacucaccc

SEQ ID NO: 3063186 - RNA, 16 nt, Human
ucccaaauuucauacc

SEQ ID NO: 3063187 - RNA, 14 nt, Human
ucccaacucacccc

SEQ ID NO: 3063188 - RNA, 15 nt, Human
ucccaacucacccca

SEQ ID NO: 3063189 - RNA, 16 nt, Human
ucccaacucaccccag

SEQ ID NO: 3063190 - RNA, 15 nt, Human
ucccaagcucugcuc

SEQ ID NO: 3063191 - RNA, 14 nt, Human
ucccaagcucugcu

SEQ ID NO: 3063192 - RNA, 13 nt, Human
ucccaagcucugc

SEQ ID NO: 3063193 - RNA, 12 nt, Human
ucccaagcucug

SEQ ID NO: 3063194 - RNA, 17 nt, Human
ucccaagcucugcuccu

SEQ ID NO: 3063195 - RNA, 13 nt, Human
uccauggacuuug

SEQ ID NO: 3063196 - RNA, 20 nt, Human
uccaugggccauaugaaaag

SEQ ID NO: 3063197 - RNA, 14 nt, Human
uccauggacuuugu

SEQ ID NO: 3063198 - RNA, 15 nt, Human
uccauggacuuuguu

SEQ ID NO: 3063199 - RNA, 21 nt, Human
ucccaaagugcugggauuaca

SEQ ID NO: 3063200 - RNA, 23 nt, Human
uccagcucaccagccccagugcc

SEQ ID NO: 3063201 - RNA, 12 nt, Human
ucccuaauaaag

SEQ ID NO: 3063202 - RNA, 11 nt, Human
ucccuaauaaa

SEQ ID NO: 3063203 - RNA, 13 nt, Human
ucccuaauaaagc

SEQ ID NO: 3063204 - RNA, 15 nt, Human
ucccuacuguaauuu

SEQ ID NO: 3063205 - RNA, 17 nt, Human
ucccucccucuuucccu

SEQ ID NO: 3063206 - RNA, 15 nt, Human
ucccucccucuuucc

SEQ ID NO: 3063207 - RNA, 14 nt, Human
uccccugcugggug

SEQ ID NO: 3063208 - RNA, 15 nt, Human
uccccugcugggugu

SEQ ID NO: 3063209 - RNA, 20 nt, Human
uccccugcuggguguggcgc

SEQ ID NO: 3063210 - RNA, 21 nt, Human
uccccugcuggguguggcgca

SEQ ID NO: 3063211 - RNA, 22 nt, Human
uccccuguagagugggagcuga

SEQ ID NO: 3063212 - RNA, 23 nt, Human
uccccuguccccgcacugggcuu

SEQ ID NO: 3063213 - RNA, 24 nt, Human
uccccugcuggguguggcgcagca

SEQ ID NO: 3063214 - RNA, 19 nt, Human
uccccuguagagugggagc

SEQ ID NO: 3063215 - RNA, 15 nt, Human
uccccuggcacuggc

SEQ ID NO: 3063216 - RNA, 22 nt, Human
ucccccagccccauccucugua

SEQ ID NO: 3063217 - RNA, 20 nt, Human
uccccgcacugggcuugggg

SEQ ID NO: 3063218 - RNA, 21 nt, Human
ucccccuuccauggacuuugu

SEQ ID NO: 3063219 - RNA, 16 nt, Human
uauuuuauguugcaua

SEQ ID NO: 3063220 - RNA, 15 nt, Human
uauuuuauguugcau

SEQ ID NO: 3063221 - RNA, 15 nt, Human
uauuuuuuuacuaau

SEQ ID NO: 3063222 - RNA, 16 nt, Human
uauuuuuuucugaaau

SEQ ID NO: 3063223 - RNA, 17 nt, Human
uauuuuuuucugaaauu

SEQ ID NO: 3063224 - RNA, 22 nt, Human
ucaaaacgguuuuacugcagcu

SEQ ID NO: 3063225 - RNA, 14 nt, Human
ucaaacucuuaaaa

SEQ ID NO: 3063226 - RNA, 16 nt, Human
uauuugagaguucuaa

SEQ ID NO: 3063227 - RNA, 15 nt, Human
uauuugagaguucua

SEQ ID NO: 3063228 - RNA, 19 nt, Human
uauuugagaguucuaaauu

SEQ ID NO: 3063229 - RNA, 18 nt, Human
uauuugagaguucuaaau

SEQ ID NO: 3063230 - RNA, 23 nt, Human
uauuuauuaaaugcccagccccu

SEQ ID NO: 3063231 - RNA, 15 nt, Human
uaucugaaaauguau

SEQ ID NO: 3063232 - RNA, 14 nt, Human
uaucugaaaaugua

SEQ ID NO: 3063233 - RNA, 20 nt, Human
uaucugaaaauguaugugua

SEQ ID NO: 3063234 - RNA, 22 nt, Human
uauuucuaugaaauauuauguu

SEQ ID NO: 3063235 - RNA, 21 nt, Human
uauuucuaugaaauauuaugu

SEQ ID NO: 3063236 - RNA, 16 nt, Human
ucaaacuuuacuaugg

SEQ ID NO: 3063237 - RNA, 13 nt, Human
ucaaacuuuacua

SEQ ID NO: 3063238 - RNA, 15 nt, Human
ucaaacuuuacuaug

SEQ ID NO: 3063239 - RNA, 22 nt, Human
ucaaacucuugaccucagguga

SEQ ID NO: 3063240 - RNA, 14 nt, Human
ucaaccuccugggc

SEQ ID NO: 3063241 - RNA, 13 nt, Human
ucaaccuccuggg

SEQ ID NO: 3063242 - RNA, 16 nt, Human
ucaagcgauucuucug

SEQ ID NO: 3063243 - RNA, 20 nt, Human
ucaaggauccugagccagau

SEQ ID NO: 3063244 - RNA, 21 nt, Human
ucaagugauucuccugccuca

SEQ ID NO: 3063245 - RNA, 17 nt, Human
ucaaggauccugagcca

SEQ ID NO: 3063246 - RNA, 22 nt, Human
ucaagugauucuccugccucag

SEQ ID NO: 3063247 - RNA, 18 nt, Human
ucaaggauccugagccag

SEQ ID NO: 3063248 - RNA, 19 nt, Human
ucaaggauccugagccaga

SEQ ID NO: 3063249 - RNA, 13 nt, Human
ucaauuacaggaa

SEQ ID NO: 3063250 - RNA, 18 nt, Human
ucaauuacaggaaguacu

SEQ ID NO: 3063251 - RNA, 18 nt, Human
ucaaugcacugacauugu

SEQ ID NO: 3063252 - RNA, 22 nt, Human
ucaaugccccugaauuuaaaua

SEQ ID NO: 3063253 - RNA, 14 nt, Human
ucaauaggaaaaac

SEQ ID NO: 3063254 - RNA, 14 nt, Human
ucaaugcacugaca

SEQ ID NO: 3063255 - RNA, 13 nt, Human
ucaauaggaaaaa

SEQ ID NO: 3063256 - RNA, 11 nt, Human
ucacaggcagg

SEQ ID NO: 3063257 - RNA, 23 nt, Human
ucacaggacagcccuucuuucca

SEQ ID NO: 3063258 - RNA, 14 nt, Human
ucacaggaaguaga

SEQ ID NO: 3063259 - RNA, 19 nt, Human
ucacaggaaguagaggagg

SEQ ID NO: 3063260 - RNA, 23 nt, Human
ucacacagugagucgaggacagg

SEQ ID NO: 3063261 - RNA, 22 nt, Human
ucacacagugagucgaggacag

SEQ ID NO: 3063262 - RNA, 21 nt, Human
ucacacaugagcaucaggcca

SEQ ID NO: 3063263 - RNA, 13 nt, Human
ucacacagugagu

SEQ ID NO: 3063264 - RNA, 22 nt, Human
ucacacaguauuacuucugcua

SEQ ID NO: 3063265 - RNA, 21 nt, Human
ucacacaguauuacuucugcu

SEQ ID NO: 3063266 - RNA, 19 nt, Human
ucaauuacaggaaguacug

SEQ ID NO: 3063267 - RNA, 17 nt, Human
ucagaaaauauuaugug

SEQ ID NO: 3063268 - RNA, 20 nt, Human
ucagaaaauauuauguguuu

SEQ ID NO: 3063269 - RNA, 19 nt, Human
ucagaaaauauuauguguu

SEQ ID NO: 3063270 - RNA, 18 nt, Human
ucacugcuuaacuucaca

SEQ ID NO: 3063271 - RNA, 17 nt, Human
ucacugcuuaacuucac

SEQ ID NO: 3063272 - RNA, 15 nt, Human
ucacugcuuaacuuc

SEQ ID NO: 3063273 - RNA, 16 nt, Human
ucacucugucgcccag

SEQ ID NO: 3063274 - RNA, 12 nt, Human
ucacucugucgc

SEQ ID NO: 3063275 - RNA, 19 nt, Human
ucacucugucgcccagucu

SEQ ID NO: 3063276 - RNA, 17 nt, Human
ucacuugucaauaaaau

SEQ ID NO: 3063277 - RNA, 22 nt, Human
ucagaguugaugguuguacaua

SEQ ID NO: 3063278 - RNA, 19 nt, Human
ucagcacgauuucuguuua

SEQ ID NO: 3063279 - RNA, 18 nt, Human
ucagcacgauuucuguuu

SEQ ID NO: 3063280 - RNA, 15 nt, Human
ucagacagcugccug

SEQ ID NO: 3063281 - RNA, 16 nt, Human
ucagacagcugccugg

SEQ ID NO: 3063282 - RNA, 17 nt, Human
ucagacagcugccuggg

SEQ ID NO: 3063283 - RNA, 18 nt, Human
ucagacagcugccuggga

SEQ ID NO: 3063284 - RNA, 19 nt, Human
ucagacagcugccugggau

SEQ ID NO: 3063285 - RNA, 20 nt, Human
ucagacagcugccugggauc

SEQ ID NO: 3063286 - RNA, 14 nt, Human
ucagacagcugccu

SEQ ID NO: 3063287 - RNA, 19 nt, Human
ucagacauagaauuaacac

SEQ ID NO: 3063288 - RNA, 22 nt, Human
ucagacauagaauuaacacaug

SEQ ID NO: 3063289 - RNA, 16 nt, Human
ucacgccacugcacua

SEQ ID NO: 3063290 - RNA, 14 nt, Human
ucacgccacugcac

SEQ ID NO: 3063291 - RNA, 13 nt, Human
ucacgccacugca

SEQ ID NO: 3063292 - RNA, 20 nt, Human
ucacgccuguaauccuagca

SEQ ID NO: 3063293 - RNA, 19 nt, Human
ucacgccuguaauccuagc

SEQ ID NO: 3063294 - RNA, 14 nt, Human
ucaccuuugucccc

SEQ ID NO: 3063295 - RNA, 15 nt, Human
ucaccuuugucccca

SEQ ID NO: 3063296 - RNA, 17 nt, Human
ucaccuuuguccccacc

SEQ ID NO: 3063297 - RNA, 18 nt, Human
ucaccuuuguccccaccg

SEQ ID NO: 3063298 - RNA, 22 nt, Human
ucaccuuuguccccaccgcaga

SEQ ID NO: 3063299 - RNA, 15 nt, Human
ucacaggcaggucca

SEQ ID NO: 3063300 - RNA, 12 nt, Human
ucacaggcaggu

SEQ ID NO: 3063301 - RNA, 19 nt, Human
ucacaggcagguccagggu

SEQ ID NO: 3063302 - RNA, 14 nt, Human
ucaccuuucccauc

SEQ ID NO: 3063303 - RNA, 12 nt, Human
ucaccuuugucc

SEQ ID NO: 3063304 - RNA, 14 nt, Human
ucacucuggcagcu

SEQ ID NO: 3063305 - RNA, 15 nt, Human
ucacucuggcagcuc

SEQ ID NO: 3063306 - RNA, 16 nt, Human
ucacucuggcagcuca

SEQ ID NO: 3063307 - RNA, 17 nt, Human
ucacucuggcagcucag

SEQ ID NO: 3063308 - RNA, 18 nt, Human
ucacucuggcagcucaga

SEQ ID NO: 3063309 - RNA, 19 nt, Human
ucacucuggcagcucagag

SEQ ID NO: 3063310 - RNA, 20 nt, Human
ucacucuggcagcucagaga

SEQ ID NO: 3063311 - RNA, 22 nt, Human
ucacucuggcagcucagagagg

SEQ ID NO: 3063312 - RNA, 12 nt, Human
ucacucuccuug

SEQ ID NO: 3063313 - RNA, 14 nt, Human
ucacucuccuuggu

SEQ ID NO: 3063314 - RNA, 12 nt, Human
ucacucuggcag

SEQ ID NO: 3063315 - RNA, 13 nt, Human
ucacucuggcagc

SEQ ID NO: 3063316 - RNA, 23 nt, Human
ucacucuccuuggugucgggcau

SEQ ID NO: 3063317 - RNA, 13 nt, Human
ucacuccuugaaa

SEQ ID NO: 3063318 - RNA, 20 nt, Human
ucacggcucacugcagccuc

SEQ ID NO: 3063319 - RNA, 15 nt, Human
ucacggcucacugca

SEQ ID NO: 3063320 - RNA, 13 nt, Human
ucacggcucacug

SEQ ID NO: 3063321 - RNA, 16 nt, Human
ucacggaagagccuug

SEQ ID NO: 3063322 - RNA, 17 nt, Human
ucacggaagagccuugc

SEQ ID NO: 3063323 - RNA, 14 nt, Human
ucacggaagagccu

SEQ ID NO: 3063324 - RNA, 14 nt, Human
uaaaagaugaaaau

SEQ ID NO: 3063325 - RNA, 21 nt, Human
uaaaagggacugagaaauuua

SEQ ID NO: 3063326 - RNA, 20 nt, Human
uaaaagggacugagaaauuu

SEQ ID NO: 3063327 - RNA, 19 nt, Human
uaaaagggacugagaaauu

SEQ ID NO: 3063328 - RNA, 17 nt, Human
uaaaagggacugagaaa

SEQ ID NO: 3063329 - RNA, 13 nt, Human
uaaaaugagaaau

SEQ ID NO: 3063330 - RNA, 16 nt, Human
uaaaaugagaaaucua

SEQ ID NO: 3063331 - RNA, 15 nt, Human
uaaaaugagaaaucu

SEQ ID NO: 3063332 - RNA, 19 nt, Human
uaaaauccauacauuugug

SEQ ID NO: 3063333 - RNA, 18 nt, Human
uaaaauccauacauuugu

SEQ ID NO: 3063334 - RNA, 21 nt, Human
uaaacacucuugaaaaaugca

SEQ ID NO: 3063335 - RNA, 23 nt, Human
uaaacaagaccacguuucuaaag

SEQ ID NO: 3063336 - RNA, 18 nt, Human
uaaacaagaccacguuuc

SEQ ID NO: 3063337 - RNA, 19 nt, Human
uaaacuuaaucuaaaugga

SEQ ID NO: 3063338 - RNA, 18 nt, Human
uaaacuuaaucuaaaugg

SEQ ID NO: 3063339 - RNA, 13 nt, Human
uaaacuuaaucua

SEQ ID NO: 3063340 - RNA, 14 nt, Human
uaaacuuaaucuaa

SEQ ID NO: 3063341 - RNA, 22 nt, Human
uaaacuuuaccuuuuuuauaca

SEQ ID NO: 3063342 - RNA, 16 nt, Human
uaaacuuuaccuuuuu

SEQ ID NO: 3063343 - RNA, 22 nt, Human
uaaauaaaccucaaaaugucua

SEQ ID NO: 3063344 - RNA, 18 nt, Human
uaaauauaugcuaagucu

SEQ ID NO: 3063345 - RNA, 22 nt, Human
uaaauauauuuuaagacgaaac

SEQ ID NO: 3063346 - RNA, 16 nt, Human
uaaauauauuuuaaga

SEQ ID NO: 3063347 - RNA, 20 nt, Human
uaaaucagacuaugaaguuu

SEQ ID NO: 3063348 - RNA, 19 nt, Human
uaaaucagccguguaacca

SEQ ID NO: 3063349 - RNA, 20 nt, Human
uaaacuuuuuucuuacuguc

SEQ ID NO: 3063350 - RNA, 14 nt, Human
uaaaggaauuuaaa

SEQ ID NO: 3063351 - RNA, 17 nt, Human
uaaauaaaaauaauccu

SEQ ID NO: 3063352 - RNA, 14 nt, Human
uaaaguuuguugaa

SEQ ID NO: 3063353 - RNA, 13 nt, Human
uaaaguuucuguu

SEQ ID NO: 3063354 - RNA, 20 nt, Human
uaaaguguauuuuuuuacua

SEQ ID NO: 3063355 - RNA, 23 nt, Human
uaaaguguauuuuuuuacuaaua

SEQ ID NO: 3063356 - RNA, 22 nt, Human
uaaaguguauuuuuuuacuaau

SEQ ID NO: 3063357 - RNA, 21 nt, Human
uaaaguguauuuuuuuacuaa

SEQ ID NO: 3063358 - RNA, 11 nt, Human
uaaaaaacacu

SEQ ID NO: 3063359 - RNA, 16 nt, Human
uaaaaaagaaacauuu

SEQ ID NO: 3063360 - RNA, 12 nt, Human
uaaaaaacacug

SEQ ID NO: 3063361 - RNA, 20 nt, Human
uaaaaaacugcugacuguuu

SEQ ID NO: 3063362 - RNA, 23 nt, Human
uaaaaaacugcugacuguuuucu

SEQ ID NO: 3063363 - RNA, 16 nt, Human
guuuucaguguacaug

SEQ ID NO: 3063364 - RNA, 18 nt, Human
guuuucaggcuagaugua

SEQ ID NO: 3063365 - RNA, 17 nt, Human
guuuucaguguacaugg

SEQ ID NO: 3063366 - RNA, 16 nt, Human
guuuucauuaucucaa

SEQ ID NO: 3063367 - RNA, 13 nt, Human
guuuuccugaaga

SEQ ID NO: 3063368 - RNA, 23 nt, Human
guuuuuauggcuuuugugcauua

SEQ ID NO: 3063369 - RNA, 22 nt, Human
guuuuuauggcuuuugugcauu

SEQ ID NO: 3063370 - RNA, 19 nt, Human
guuuuuauggcuuuugugc

SEQ ID NO: 3063371 - RNA, 12 nt, Human
guuuucucuuga

SEQ ID NO: 3063372 - RNA, 19 nt, Human
guuuucucuugagagggug

SEQ ID NO: 3063373 - RNA, 16 nt, Human
guuuaguaaucauauu

SEQ ID NO: 3063374 - RNA, 13 nt, Human
guuuagcaguaua

SEQ ID NO: 3063375 - RNA, 20 nt, Human
guuuaggauguugaaaaagu

SEQ ID NO: 3063376 - RNA, 15 nt, Human
guuuagauaauacac

SEQ ID NO: 3063377 - RNA, 13 nt, Human
guuuagaaagcuu

SEQ ID NO: 3063378 - RNA, 21 nt, Human
gguuggccccugcccggcugc

SEQ ID NO: 3063379 - RNA, 18 nt, Human
gguuggcaaaaaggcagg

SEQ ID NO: 3063380 - RNA, 16 nt, Human
guuuccuuauauuaug

SEQ ID NO: 3063381 - RNA, 21 nt, Human
guuuccuggcacugcuuccag

SEQ ID NO: 3063382 - RNA, 22 nt, Human
guuuccuggcacugcuuccagu

SEQ ID NO: 3063383 - RNA, 16 nt, Human
guuuccuggcacugcu

SEQ ID NO: 3063384 - RNA, 20 nt, Human
guuuccuggcacugcuucca

SEQ ID NO: 3063385 - RNA, 18 nt, Human
guuucagaaauguguuau

SEQ ID NO: 3063386 - RNA, 14 nt, Human
guuucagaaaugug

SEQ ID NO: 3063387 - RNA, 17 nt, Human
guuucuuuguaaugaaa

SEQ ID NO: 3063388 - RNA, 14 nt, Human
guuucuuuguaaug

SEQ ID NO: 3063389 - RNA, 16 nt, Human
guuugaaccaagaacu

SEQ ID NO: 3063390 - RNA, 18 nt, Human
guuugagaucagccuggg

SEQ ID NO: 3063391 - RNA, 14 nt, Human
guuucuaaagcugc

SEQ ID NO: 3063392 - RNA, 15 nt, Human
guuucuaaagcugcc

SEQ ID NO: 3063393 - RNA, 16 nt, Human
guuucuaaagcugcca

SEQ ID NO: 3063394 - RNA, 19 nt, Human
guuuguaaauuaacuuuua

SEQ ID NO: 3063395 - RNA, 17 nt, Human
guuuguaaauuaacuuu

SEQ ID NO: 3063396 - RNA, 19 nt, Human
guuugauuaaauucuugca

SEQ ID NO: 3063397 - RNA, 17 nt, Human
guuugauuaaauucuug

SEQ ID NO: 3063398 - RNA, 22 nt, Human
guuugauuaaauucuugcaaag

SEQ ID NO: 3063399 - RNA, 13 nt, Human
uaauuuuaagaaa

SEQ ID NO: 3063400 - RNA, 22 nt, Human
uaauuugugauacaaugcugug

SEQ ID NO: 3063401 - RNA, 19 nt, Human
uaauuugugauacaaugcu

SEQ ID NO: 3063402 - RNA, 18 nt, Human
uaauuugugauacaaugc

SEQ ID NO: 3063403 - RNA, 15 nt, Human
uaauuugugauacaa

SEQ ID NO: 3063404 - RNA, 14 nt, Human
uaauuugugauaca

SEQ ID NO: 3063405 - RNA, 23 nt, Human
uaauuuguaguguuggagaagaa

SEQ ID NO: 3063406 - RNA, 15 nt, Human
uaauuugguuuucac

SEQ ID NO: 3063407 - RNA, 17 nt, Human
uaauuugguuuucacau

SEQ ID NO: 3063408 - RNA, 18 nt, Human
uaauuugguuuucacauu

SEQ ID NO: 3063409 - RNA, 20 nt, Human
uaauuuguaguguuggagaa

SEQ ID NO: 3063410 - RNA, 22 nt, Human
uaauuggaaaggcagcucuaaa

SEQ ID NO: 3063411 - RNA, 23 nt, Human
uaauuaaauuuugaguucuacau

SEQ ID NO: 3063412 - RNA, 17 nt, Human
uaauuaaaacacaacau

SEQ ID NO: 3063413 - RNA, 20 nt, Human
uaauuaaaagaauauuuuaa

SEQ ID NO: 3063414 - RNA, 20 nt, Human
uaauuaaguacuauguauca

SEQ ID NO: 3063415 - RNA, 14 nt, Human
uaaugcgugcauac

SEQ ID NO: 3063416 - RNA, 14 nt, Human
uaauguuucaaaca

SEQ ID NO: 3063417 - RNA, 15 nt, Human
uaauguuucaaacau

SEQ ID NO: 3063418 - RNA, 20 nt, Human
uaauugacaggauuauugga

SEQ ID NO: 3063419 - RNA, 22 nt, Human
uaauugacaggauuauuggaaa

SEQ ID NO: 3063420 - RNA, 18 nt, Human
uaauucuuagcucauucu

SEQ ID NO: 3063421 - RNA, 19 nt, Human
uaaugauaaguaaaugcua

SEQ ID NO: 3063422 - RNA, 23 nt, Human
uaaugauaacuggaaacuucagc

SEQ ID NO: 3063423 - RNA, 19 nt, Human
uaaugccacuaaauugaca

SEQ ID NO: 3063424 - RNA, 11 nt, Human
uaaucuaaaug

SEQ ID NO: 3063425 - RNA, 14 nt, Human
uaauauauuuccau

SEQ ID NO: 3063426 - RNA, 20 nt, Human
uaauccucuaggaggucucu

SEQ ID NO: 3063427 - RNA, 15 nt, Human
uaauaacugugaagu

SEQ ID NO: 3063428 - RNA, 19 nt, Human
uaauaaauauuuuugccau

SEQ ID NO: 3063429 - RNA, 21 nt, Human
uaauaguucagguaacaggca

SEQ ID NO: 3063430 - RNA, 15 nt, Human
uaauaauguuucaaa

SEQ ID NO: 3063431 - RNA, 14 nt, Human
uaauaauguuucaa

SEQ ID NO: 3063432 - RNA, 15 nt, Human
uaagcaugcacaaau

SEQ ID NO: 3063433 - RNA, 20 nt, Human
uaagcauuccaacuaucuca

SEQ ID NO: 3063434 - RNA, 16 nt, Human
uaagcauuccaacuau

SEQ ID NO: 3063435 - RNA, 18 nt, Human
uaagcauuccaacuaucu

SEQ ID NO: 3063436 - RNA, 13 nt, Human
uaagccagacauc

SEQ ID NO: 3063437 - RNA, 15 nt, Human
uaaggcaaucauggu

SEQ ID NO: 3063438 - RNA, 14 nt, Human
uaaggcaaucaugg

SEQ ID NO: 3063439 - RNA, 18 nt, Human
uaaggaugcuuguacaua

SEQ ID NO: 3063440 - RNA, 23 nt, Human
uaaggaugcuuguacauaaugcg

SEQ ID NO: 3063441 - RNA, 22 nt, Human
uaaggaugcuuguacauaaugc

SEQ ID NO: 3063442 - RNA, 21 nt, Human
uaaggaugcuuguacauaaug

SEQ ID NO: 3063443 - RNA, 20 nt, Human
uaaggaugcuuguacauaau

SEQ ID NO: 3063444 - RNA, 19 nt, Human
uaaggaugcuuguacauaa

SEQ ID NO: 3063445 - RNA, 20 nt, Human
uaagccagacaucaacagau

SEQ ID NO: 3063446 - RNA, 21 nt, Human
uaagccagacaucaacagaua

SEQ ID NO: 3063447 - RNA, 12 nt, Human
uaagagggaggg

SEQ ID NO: 3063448 - RNA, 22 nt, Human
uaagagggagggagggcuccag

SEQ ID NO: 3063449 - RNA, 23 nt, Human
uaagagggagggagggcuccaga

SEQ ID NO: 3063450 - RNA, 23 nt, Human
uaagagggauuagggagagaaga

SEQ ID NO: 3063451 - RNA, 14 nt, Human
uaagauaaaugugc

SEQ ID NO: 3063452 - RNA, 17 nt, Human
uaagauaaaugugcuga

SEQ ID NO: 3063453 - RNA, 16 nt, Human
uaagauaaaugugcug

SEQ ID NO: 3063454 - RNA, 24 nt, Human
uaagaaagacuaucuaaauguuga

SEQ ID NO: 3063455 - RNA, 19 nt, Human
uaacuuuuauaaacuuuac

SEQ ID NO: 3063456 - RNA, 22 nt, Human
uaacuuuuauaaacuuuaccuu

SEQ ID NO: 3063457 - RNA, 21 nt, Human
uaacuuuuauaaacuuuaccu

SEQ ID NO: 3063458 - RNA, 22 nt, Human
uaagaaccuuuugagugccuua

SEQ ID NO: 3063459 - RNA, 22 nt, Human
uaagaggcagggucucacucug

SEQ ID NO: 3063460 - RNA, 17 nt, Human
uaagagagucuauuuac

SEQ ID NO: 3063461 - RNA, 23 nt, Human
uaagagagaaugagagacacacu

SEQ ID NO: 3063462 - RNA, 13 nt, Human
uaacagaaaugua

SEQ ID NO: 3063463 - RNA, 15 nt, Human
uaacagaaauguaca

SEQ ID NO: 3063464 - RNA, 14 nt, Human
uaacagaaauguac

SEQ ID NO: 3063465 - RNA, 12 nt, Human
uaacagaaaugu

SEQ ID NO: 3063466 - RNA, 23 nt, Human
uaaauugacacuuaaaaaugguu

SEQ ID NO: 3063467 - RNA, 14 nt, Human
uaaauuuaguauuu

SEQ ID NO: 3063468 - RNA, 19 nt, Human
uaacaaugcuguauuuuaa

SEQ ID NO: 3063469 - RNA, 20 nt, Human
uaacuuuuauaaacuuuacc

SEQ ID NO: 3063470 - RNA, 14 nt, Human
uaaccagcagaaau

SEQ ID NO: 3063471 - RNA, 19 nt, Human
uaaccagcagaaaugccuu

SEQ ID NO: 3063472 - RNA, 16 nt, Human
uaaccagcagaaaugc

SEQ ID NO: 3063473 - RNA, 19 nt, Human
uaacaggcagauacaggaa

SEQ ID NO: 3063474 - RNA, 21 nt, Human
uacuugcucuugaugccuggc

SEQ ID NO: 3063475 - RNA, 20 nt, Human
uacuugcucuugaugccugg

SEQ ID NO: 3063476 - RNA, 14 nt, Human
uacuuguggacaca

SEQ ID NO: 3063477 - RNA, 18 nt, Human
uacuuguggacacagcuc

SEQ ID NO: 3063478 - RNA, 15 nt, Human
uacuuguggacacag

SEQ ID NO: 3063479 - RNA, 19 nt, Human
uacuuguggacacagcucu

SEQ ID NO: 3063480 - RNA, 21 nt, Human
uacuguaucaugacaaagacu

SEQ ID NO: 3063481 - RNA, 17 nt, Human
uagaacagauaaucagu

SEQ ID NO: 3063482 - RNA, 23 nt, Human
uagaaauaucugaaaauguaugu

SEQ ID NO: 3063483 - RNA, 21 nt, Human
uagaaauaucugaaaauguau

SEQ ID NO: 3063484 - RNA, 20 nt, Human
uagaaauaucugaaaaugua

SEQ ID NO: 3063485 - RNA, 15 nt, Human
uagaaauauaauuga

SEQ ID NO: 3063486 - RNA, 19 nt, Human
uaccuuugacaaagguaaa

SEQ ID NO: 3063487 - RNA, 20 nt, Human
uaccuuuguauucucuccug

SEQ ID NO: 3063488 - RNA, 20 nt, Human
uaccuuuuuuauacauaaac

SEQ ID NO: 3063489 - RNA, 19 nt, Human
uaccuuuuuuauacauaaa

SEQ ID NO: 3063490 - RNA, 18 nt, Human
uaccuuuuuuauacauaa

SEQ ID NO: 3063491 - RNA, 22 nt, Human
uacccaucccauaugccugggc

SEQ ID NO: 3063492 - RNA, 23 nt, Human
uacgaagaguauuuuugacagaa

SEQ ID NO: 3063493 - RNA, 20 nt, Human
uacgaagaguauuuuugaca

SEQ ID NO: 3063494 - RNA, 22 nt, Human
uacgaagaguauuuuugacaga

SEQ ID NO: 3063495 - RNA, 17 nt, Human
uacuaaccagcagaaau

SEQ ID NO: 3063496 - RNA, 18 nt, Human
uacuaaccagcagaaaug

SEQ ID NO: 3063497 - RNA, 19 nt, Human
uacuaaccagcagaaaugc

SEQ ID NO: 3063498 - RNA, 22 nt, Human
uacuaauaaaauuuaaaagucu

SEQ ID NO: 3063499 - RNA, 17 nt, Human
uacuaauagacaauuua

SEQ ID NO: 3063500 - RNA, 15 nt, Human
uacuaauagacaauu

SEQ ID NO: 3063501 - RNA, 12 nt, Human
uacuacaguccu

SEQ ID NO: 3063502 - RNA, 17 nt, Human
uacuacaguccucccau

SEQ ID NO: 3063503 - RNA, 20 nt, Human
uacuacaguuuguuaguaug

SEQ ID NO: 3063504 - RNA, 14 nt, Human
uacucaccucaccc

SEQ ID NO: 3063505 - RNA, 12 nt, Human
uacucaccucac

SEQ ID NO: 3063506 - RNA, 22 nt, Human
uacucagaauucucuaguuuga

SEQ ID NO: 3063507 - RNA, 16 nt, Human
uacucagaauucucua

SEQ ID NO: 3063508 - RNA, 15 nt, Human
uacugaggugcuaug

SEQ ID NO: 3063509 - RNA, 19 nt, Human
uacugagagugaacaaauu

SEQ ID NO: 3063510 - RNA, 23 nt, Human
uacugauguuccuagugaaagag

SEQ ID NO: 3063511 - RNA, 12 nt, Human
uacucccaucug

SEQ ID NO: 3063512 - RNA, 14 nt, Human
uacucccaucugug

SEQ ID NO: 3063513 - RNA, 16 nt, Human
uacucccaucugugaa

SEQ ID NO: 3063514 - RNA, 17 nt, Human
uacucccaucugugaaa

SEQ ID NO: 3063515 - RNA, 23 nt, Human
uacauuuggagacacaacuauuu

SEQ ID NO: 3063516 - RNA, 16 nt, Human
uacauuuguauaaaau

SEQ ID NO: 3063517 - RNA, 17 nt, Human
uacauuuguauaaaaua

SEQ ID NO: 3063518 - RNA, 11 nt, Human
uacauuugugu

SEQ ID NO: 3063519 - RNA, 21 nt, Human
uacaugagguacugagaguga

SEQ ID NO: 3063520 - RNA, 22 nt, Human
uacaugagguacugagagugaa

SEQ ID NO: 3063521 - RNA, 16 nt, Human
uaccaacacgagcagg

SEQ ID NO: 3063522 - RNA, 19 nt, Human
uacaguuacucagaauucu

SEQ ID NO: 3063523 - RNA, 23 nt, Human
uacaguuacucagaauucucuag

SEQ ID NO: 3063524 - RNA, 19 nt, Human
uacauaagauaaaugugcu

SEQ ID NO: 3063525 - RNA, 18 nt, Human
uacauaagauaaaugugc

SEQ ID NO: 3063526 - RNA, 22 nt, Human
uacauaagauaaaugugcugaa

SEQ ID NO: 3063527 - RNA, 20 nt, Human
uacaucccuuaccugggaaa

SEQ ID NO: 3063528 - RNA, 22 nt, Human
uacccaggugcuaggaacacuc

SEQ ID NO: 3063529 - RNA, 18 nt, Human
uacccagcgagcccuggu

SEQ ID NO: 3063530 - RNA, 16 nt, Human
uacccagcgagcccug

SEQ ID NO: 3063531 - RNA, 14 nt, Human
uacccacugcucug

SEQ ID NO: 3063532 - RNA, 13 nt, Human
uacccacugcucu

SEQ ID NO: 3063533 - RNA, 12 nt, Human
uacccacugcuc

SEQ ID NO: 3063534 - RNA, 11 nt, Human
uacccacugcu

SEQ ID NO: 3063535 - RNA, 17 nt, Human
uacccacccccacccaa

SEQ ID NO: 3063536 - RNA, 19 nt, Human
uacccacccccacccaagg

SEQ ID NO: 3063537 - RNA, 23 nt, Human
uacccacccccacccaagggccu

SEQ ID NO: 3063538 - RNA, 12 nt, Human
uacccaccccca

SEQ ID NO: 3063539 - RNA, 15 nt, Human
uacccacccccaccc

SEQ ID NO: 3063540 - RNA, 15 nt, Human
uacccaaauuaagag

SEQ ID NO: 3063541 - RNA, 23 nt, Human
uaccauuuugggguacccacugc

SEQ ID NO: 3063542 - RNA, 23 nt, Human
uaccacaggaaccacaagacugc

SEQ ID NO: 3063543 - RNA, 13 nt, Human
uaccacagacaua

SEQ ID NO: 3063544 - RNA, 21 nt, Human
uacagcuugaccgugaggcca

SEQ ID NO: 3063545 - RNA, 22 nt, Human
uacagcuugaccgugaggccag

SEQ ID NO: 3063546 - RNA, 18 nt, Human
uacaggaaaagcugcuga

SEQ ID NO: 3063547 - RNA, 17 nt, Human
uacaggaaaagcugcug

SEQ ID NO: 3063548 - RNA, 23 nt, Human
uacagcuugaccgugaggccaga

SEQ ID NO: 3063549 - RNA, 14 nt, Human
uacaggauuugaaa

SEQ ID NO: 3063550 - RNA, 16 nt, Human
uacaggcacccaccau

SEQ ID NO: 3063551 - RNA, 19 nt, Human
uacaggaaaagcugcugac

SEQ ID NO: 3063552 - RNA, 24 nt, Human
uacagcaaggagauuuacaacugg

SEQ ID NO: 3063553 - RNA, 13 nt, Human
uacacuuuaugca

SEQ ID NO: 3063554 - RNA, 18 nt, Human
uacagaaaaguugaauuu

SEQ ID NO: 3063555 - RNA, 22 nt, Human
uacagaaaaguugaauuuuaca

SEQ ID NO: 3063556 - RNA, 18 nt, Human
uacacuguuucaaacuuu

SEQ ID NO: 3063557 - RNA, 17 nt, Human
uacacuguuucaaacuu

SEQ ID NO: 3063558 - RNA, 19 nt, Human
uacacuguuucaaacuuua

SEQ ID NO: 3063559 - RNA, 17 nt, Human
uaauuuugaaaaacugc

SEQ ID NO: 3063560 - RNA, 13 nt, Human
uaauuuugaaaaa

SEQ ID NO: 3063561 - RNA, 17 nt, Human
uacacacugcauguuug

SEQ ID NO: 3063562 - RNA, 15 nt, Human
uacacacacauacac

SEQ ID NO: 3063563 - RNA, 21 nt, Human
uacacacacacgcgugcacac

SEQ ID NO: 3063564 - RNA, 21 nt, Human
uacacaaugguuuucuugugu

SEQ ID NO: 3063565 - RNA, 17 nt, Human
uacacaaugguuuucuu

SEQ ID NO: 3063566 - RNA, 14 nt, Human
uacacuguuucaaa

SEQ ID NO: 3063567 - RNA, 16 nt, Human
uacacugugcugaguc

SEQ ID NO: 3063568 - RNA, 22 nt, Human
uacacacugcauguuugugauu

SEQ ID NO: 3063569 - RNA, 21 nt, Human
uaggaacuuaaauaaugugaa

SEQ ID NO: 3063570 - RNA, 17 nt, Human
uaggaacacuccuucac

SEQ ID NO: 3063571 - RNA, 13 nt, Human
uaggaacacuccu

SEQ ID NO: 3063572 - RNA, 14 nt, Human
uaggaacacuccuu

SEQ ID NO: 3063573 - RNA, 16 nt, Human
uaggaagacuuuggaa

SEQ ID NO: 3063574 - RNA, 17 nt, Human
uaggaagacuuuggaaa

SEQ ID NO: 3063575 - RNA, 14 nt, Human
uaggaagacuuugg

SEQ ID NO: 3063576 - RNA, 15 nt, Human
uaggaagacuuugga

SEQ ID NO: 3063577 - RNA, 13 nt, Human
uaggaagacuuug

SEQ ID NO: 3063578 - RNA, 14 nt, Human
uaggaauuguguuu

SEQ ID NO: 3063579 - RNA, 23 nt, Human
uaggaauugacccacaagaaaug

SEQ ID NO: 3063580 - RNA, 20 nt, Human
uaggaauugacccacaagaa

SEQ ID NO: 3063581 - RNA, 15 nt, Human
uaggaagguuaaugu

SEQ ID NO: 3063582 - RNA, 14 nt, Human
uaggccuggccaga

SEQ ID NO: 3063583 - RNA, 13 nt, Human
uaggccuggccag

SEQ ID NO: 3063584 - RNA, 13 nt, Human
uaggccaugggac

SEQ ID NO: 3063585 - RNA, 16 nt, Human
uagccuaggugacaga

SEQ ID NO: 3063586 - RNA, 14 nt, Human
uagcccaaaaccaa

SEQ ID NO: 3063587 - RNA, 21 nt, Human
uagcucuaggagggcuggcaa

SEQ ID NO: 3063588 - RNA, 17 nt, Human
uagccugccucuucucu

SEQ ID NO: 3063589 - RNA, 22 nt, Human
uagcucauucuccuuguguuac

SEQ ID NO: 3063590 - RNA, 19 nt, Human
uagcugggacuacaggcac

SEQ ID NO: 3063591 - RNA, 20 nt, Human
uagcugggacuacaggcacc

SEQ ID NO: 3063592 - RNA, 18 nt, Human
uagcugggacuacaggug

SEQ ID NO: 3063593 - RNA, 11 nt, Human
uagcugggacu

SEQ ID NO: 3063594 - RNA, 16 nt, Human
uagauguauguacuuc

SEQ ID NO: 3063595 - RNA, 20 nt, Human
uagauguauguacuucaugc

SEQ ID NO: 3063596 - RNA, 18 nt, Human
uagauaauacaccacuac

SEQ ID NO: 3063597 - RNA, 12 nt, Human
uagauguauaua

SEQ ID NO: 3063598 - RNA, 16 nt, Human
uagcacuuugggaggc

SEQ ID NO: 3063599 - RNA, 23 nt, Human
uagcagagaaugaaagggcccag

SEQ ID NO: 3063600 - RNA, 19 nt, Human
uagcagagaaugaaagggc

SEQ ID NO: 3063601 - RNA, 20 nt, Human
uagcagggcauggcugggaa

SEQ ID NO: 3063602 - RNA, 17 nt, Human
uagaguuuagcuggaaa

SEQ ID NO: 3063603 - RNA, 18 nt, Human
uagaguuuagcuggaaaa

SEQ ID NO: 3063604 - RNA, 16 nt, Human
uagagagagaccacuu

SEQ ID NO: 3063605 - RNA, 16 nt, Human
uagagguucaaagaua

SEQ ID NO: 3063606 - RNA, 19 nt, Human
uagagguucaaagauauuu

SEQ ID NO: 3063607 - RNA, 21 nt, Human
uagagguucaaagauauuuug

SEQ ID NO: 3063608 - RNA, 11 nt, Human
uagagacaggg

SEQ ID NO: 3063609 - RNA, 22 nt, Human
uaucaugugaaaucauucauuu

SEQ ID NO: 3063610 - RNA, 17 nt, Human
uaucaugugaaaucauu

SEQ ID NO: 3063611 - RNA, 15 nt, Human
uaucuaaauguugaa

SEQ ID NO: 3063612 - RNA, 16 nt, Human
uaucgucacugcuuaa

SEQ ID NO: 3063613 - RNA, 19 nt, Human
uaucgucacugcuuaacuu

SEQ ID NO: 3063614 - RNA, 16 nt, Human
uaucaugacaaagacu

SEQ ID NO: 3063615 - RNA, 20 nt, Human
uauauuuauuacuguaagaa

SEQ ID NO: 3063616 - RNA, 23 nt, Human
uauauuuauuacuguaagaaaau

SEQ ID NO: 3063617 - RNA, 14 nt, Human
uauauuuuaagacg

SEQ ID NO: 3063618 - RNA, 13 nt, Human
uauauuuuaagac

SEQ ID NO: 3063619 - RNA, 14 nt, Human
uauauuugaaauau

SEQ ID NO: 3063620 - RNA, 13 nt, Human
uauauuugaaaua

SEQ ID NO: 3063621 - RNA, 18 nt, Human
uauauaaguauucuaaau

SEQ ID NO: 3063622 - RNA, 16 nt, Human
uauacccagaaaguua

SEQ ID NO: 3063623 - RNA, 20 nt, Human
uauaauucacauuguauuca

SEQ ID NO: 3063624 - RNA, 21 nt, Human
uauaauucagaaggaucuuca

SEQ ID NO: 3063625 - RNA, 17 nt, Human
uauaauucuacuuugag

SEQ ID NO: 3063626 - RNA, 20 nt, Human
uauaauguaagcucuacuga

SEQ ID NO: 3063627 - RNA, 19 nt, Human
uauaauguaagcucuacug

SEQ ID NO: 3063628 - RNA, 14 nt, Human
uauaauguaagcuc

SEQ ID NO: 3063629 - RNA, 21 nt, Human
uaguuugauuaaauucuugca

SEQ ID NO: 3063630 - RNA, 20 nt, Human
uauaaugaaugaaacauuuu

SEQ ID NO: 3063631 - RNA, 18 nt, Human
uauaaugaaugaaacauu

SEQ ID NO: 3063632 - RNA, 18 nt, Human
uagucaaauugugugaaa

SEQ ID NO: 3063633 - RNA, 14 nt, Human
uagucaaauugugu

SEQ ID NO: 3063634 - RNA, 15 nt, Human
uaguggauguucuga

SEQ ID NO: 3063635 - RNA, 12 nt, Human
uaguuugcaguu

SEQ ID NO: 3063636 - RNA, 23 nt, Human
uaguuugauuaaauucuugcaaa

SEQ ID NO: 3063637 - RNA, 13 nt, Human
uaguuucuccaag

SEQ ID NO: 3063638 - RNA, 21 nt, Human
uaguuguaccgcaaugugacu

SEQ ID NO: 3063639 - RNA, 17 nt, Human
gggugcugggccccugc

SEQ ID NO: 3063640 - RNA, 22 nt, Human
ggguucaagcgauucuucugcu

SEQ ID NO: 3063641 - RNA, 23 nt, Human
ggguucaagcgauucuucugcuu

SEQ ID NO: 3063642 - RNA, 12 nt, Human
ggguucuaccca

SEQ ID NO: 3063643 - RNA, 17 nt, Human
gggugaagugaagacaa

SEQ ID NO: 3063644 - RNA, 19 nt, Human
gggugacagagcaagugag

SEQ ID NO: 3063645 - RNA, 15 nt, Human
ggucccaccccacac

SEQ ID NO: 3063646 - RNA, 16 nt, Human
ggucccaccccacaca

SEQ ID NO: 3063647 - RNA, 11 nt, Human
ggucagagccu

SEQ ID NO: 3063648 - RNA, 13 nt, Human
gguacccacugcu

SEQ ID NO: 3063649 - RNA, 11 nt, Human
gguacccacug

SEQ ID NO: 3063650 - RNA, 22 nt, Human
gguagaaauaucugaaaaugua

SEQ ID NO: 3063651 - RNA, 17 nt, Human
gguacuuguggacacag

SEQ ID NO: 3063652 - RNA, 16 nt, Human
gguacuuguggacaca

SEQ ID NO: 3063653 - RNA, 23 nt, Human
gguagaaauaucugaaaauguau

SEQ ID NO: 3063654 - RNA, 22 nt, Human
gguagaagcccuucuaccuucc

SEQ ID NO: 3063655 - RNA, 18 nt, Human
gguagcauuuguguugaa

SEQ ID NO: 3063656 - RNA, 18 nt, Human
ggggugcugggccccugc

SEQ ID NO: 3063657 - RNA, 12 nt, Human
gggguggccucc

SEQ ID NO: 3063658 - RNA, 20 nt, Human
gggguggggggggugcuggg

SEQ ID NO: 3063659 - RNA, 17 nt, Human
gggguggggaccucagg

SEQ ID NO: 3063660 - RNA, 22 nt, Human
gggggaggugggauccuccagg

SEQ ID NO: 3063661 - RNA, 19 nt, Human
ggggcugaggugggaggau

SEQ ID NO: 3063662 - RNA, 12 nt, Human
ggggcugcaccg

SEQ ID NO: 3063663 - RNA, 21 nt, Human
ggggcugcaccggcuggccug

SEQ ID NO: 3063664 - RNA, 22 nt, Human
ggggcugcaccggcuggccugg

SEQ ID NO: 3063665 - RNA, 17 nt, Human
ggguaagugagagaggg

SEQ ID NO: 3063666 - RNA, 14 nt, Human
gggucucacucugu

SEQ ID NO: 3063667 - RNA, 12 nt, Human
gggucucacucu

SEQ ID NO: 3063668 - RNA, 21 nt, Human
gggucugaggaauccagaccc

SEQ ID NO: 3063669 - RNA, 12 nt, Human
gggucugaggaa

SEQ ID NO: 3063670 - RNA, 21 nt, Human
ggggaaaaucagccugcucca

SEQ ID NO: 3063671 - RNA, 22 nt, Human
gggcuuggggaccagagcugcc

SEQ ID NO: 3063672 - RNA, 17 nt, Human
ggggaaaaucagccugc

SEQ ID NO: 3063673 - RNA, 19 nt, Human
ggggaaaaucagccugcuc

SEQ ID NO: 3063674 - RNA, 16 nt, Human
ggggaaaaucagccug

SEQ ID NO: 3063675 - RNA, 13 nt, Human
ggggcagugcuca

SEQ ID NO: 3063676 - RNA, 16 nt, Human
ggggcaacccugguga

SEQ ID NO: 3063677 - RNA, 17 nt, Human
ggggcagugcucaccca

SEQ ID NO: 3063678 - RNA, 20 nt, Human
ggggcagugcucacccacac

SEQ ID NO: 3063679 - RNA, 17 nt, Human
ggggcugaggugggagg

SEQ ID NO: 3063680 - RNA, 20 nt, Human
ggggcucccagccaggcccu

SEQ ID NO: 3063681 - RNA, 13 nt, Human
ggggcucccagcc

SEQ ID NO: 3063682 - RNA, 16 nt, Human
ggggcucccagccagg

SEQ ID NO: 3063683 - RNA, 12 nt, Human
ggggcucccagc

SEQ ID NO: 3063684 - RNA, 21 nt, Human
ggugaccucugccugaaguca

SEQ ID NO: 3063685 - RNA, 22 nt, Human
ggugaccagcaccaucucuccu

SEQ ID NO: 3063686 - RNA, 14 nt, Human
ggucugacccacug

SEQ ID NO: 3063687 - RNA, 21 nt, Human
ggugacagagugagacucugu

SEQ ID NO: 3063688 - RNA, 17 nt, Human
ggucccaccccacacac

SEQ ID NO: 3063689 - RNA, 14 nt, Human
ggucccaccccaca

SEQ ID NO: 3063690 - RNA, 23 nt, Human
ggucucacucugucgcccagucu

SEQ ID NO: 3063691 - RNA, 22 nt, Human
ggucucacucugucgcccaguc

SEQ ID NO: 3063692 - RNA, 16 nt, Human
ggucucacucugucgc

SEQ ID NO: 3063693 - RNA, 16 nt, Human
ggugcuaucuccccca

SEQ ID NO: 3063694 - RNA, 17 nt, Human
ggugcuaucucccccag

SEQ ID NO: 3063695 - RNA, 19 nt, Human
ggugcuaucucccccagcc

SEQ ID NO: 3063696 - RNA, 20 nt, Human
ggugcuaucucccccagccc

SEQ ID NO: 3063697 - RNA, 23 nt, Human
ggugcuacaaaaacacagcaagg

SEQ ID NO: 3063698 - RNA, 21 nt, Human
ggugcuacaaaaacacagcaa

SEQ ID NO: 3063699 - RNA, 16 nt, Human
ggugagaggggaacag

SEQ ID NO: 3063700 - RNA, 15 nt, Human
ggugagaagcagagg

SEQ ID NO: 3063701 - RNA, 23 nt, Human
gguggccucccaacucaccccag

SEQ ID NO: 3063702 - RNA, 22 nt, Human
gguggccucccaacucacccca

SEQ ID NO: 3063703 - RNA, 16 nt, Human
gguggcagugggagcu

SEQ ID NO: 3063704 - RNA, 22 nt, Human
gguggcagugggagcugccugu

SEQ ID NO: 3063705 - RNA, 19 nt, Human
gguggcagugggagcugcc

SEQ ID NO: 3063706 - RNA, 15 nt, Human
ggugcugccauccag

SEQ ID NO: 3063707 - RNA, 21 nt, Human
gguucaaagauauuuugcuuu

SEQ ID NO: 3063708 - RNA, 13 nt, Human
gguucaaagauau

SEQ ID NO: 3063709 - RNA, 13 nt, Human
gguugagguuuca

SEQ ID NO: 3063710 - RNA, 21 nt, Human
gguuacccaguuagcucucaa

SEQ ID NO: 3063711 - RNA, 17 nt, Human
gguuaggcauuguggga

SEQ ID NO: 3063712 - RNA, 13 nt, Human
gguuauggagagg

SEQ ID NO: 3063713 - RNA, 21 nt, Human
ggugguuauggagaggguguc

SEQ ID NO: 3063714 - RNA, 18 nt, Human
ggugguuucagaaaugug

SEQ ID NO: 3063715 - RNA, 17 nt, Human
ggugguuucagaaaugu

SEQ ID NO: 3063716 - RNA, 18 nt, Human
ggugguuuucuguucuuu

SEQ ID NO: 3063717 - RNA, 15 nt, Human
ggugguuuucuguuc

SEQ ID NO: 3063718 - RNA, 17 nt, Human
ggugucaagagggucug

SEQ ID NO: 3063719 - RNA, 19 nt, Human
ggugucaagagggucugag

SEQ ID NO: 3063720 - RNA, 19 nt, Human
ggugucaccugaagacuca

SEQ ID NO: 3063721 - RNA, 16 nt, Human
gguggugaccucugcc

SEQ ID NO: 3063722 - RNA, 15 nt, Human
gguggugaccucugc

SEQ ID NO: 3063723 - RNA, 14 nt, Human
gguggugaccucug

SEQ ID NO: 3063724 - RNA, 20 nt, Human
gggcagugcucacccacacc

SEQ ID NO: 3063725 - RNA, 12 nt, Human
gggcaugacacg

SEQ ID NO: 3063726 - RNA, 19 nt, Human
gggccaccgccuugcccag

SEQ ID NO: 3063727 - RNA, 23 nt, Human
gggccacagagaaaguacuucuc

SEQ ID NO: 3063728 - RNA, 16 nt, Human
gggccacagagaaagu

SEQ ID NO: 3063729 - RNA, 17 nt, Human
gggcccagagagggugg

SEQ ID NO: 3063730 - RNA, 21 nt, Human
gggccccugccucucugcagg

SEQ ID NO: 3063731 - RNA, 19 nt, Human
gggccccugccucucugca

SEQ ID NO: 3063732 - RNA, 18 nt, Human
gggccccugccucucugc

SEQ ID NO: 3063733 - RNA, 17 nt, Human
gggccccugccucucug

SEQ ID NO: 3063734 - RNA, 15 nt, Human
gggccccugccucuc

SEQ ID NO: 3063735 - RNA, 13 nt, Human
gggccccugccuc

SEQ ID NO: 3063736 - RNA, 22 nt, Human
gggccccugccucucugcaggu

SEQ ID NO: 3063737 - RNA, 13 nt, Human
gggcccugccucc

SEQ ID NO: 3063738 - RNA, 13 nt, Human
gggccuggccuga

SEQ ID NO: 3063739 - RNA, 12 nt, Human
gggccuggccug

SEQ ID NO: 3063740 - RNA, 14 nt, Human
gggccuggccugag

SEQ ID NO: 3063741 - RNA, 18 nt, Human
gggccuggccugagcugg

SEQ ID NO: 3063742 - RNA, 17 nt, Human
gggccuggcucaggugg

SEQ ID NO: 3063743 - RNA, 13 nt, Human
gggccuggcuccc

SEQ ID NO: 3063744 - RNA, 13 nt, Human
gggauagagagag

SEQ ID NO: 3063745 - RNA, 21 nt, Human
gggauaugauuuaaaucagcc

SEQ ID NO: 3063746 - RNA, 15 nt, Human
gggauccuccaggug

SEQ ID NO: 3063747 - RNA, 16 nt, Human
gggauccuccaggugc

SEQ ID NO: 3063748 - RNA, 18 nt, Human
gggcaacccuggugacca

SEQ ID NO: 3063749 - RNA, 20 nt, Human
gggcaacccccagccugcua

SEQ ID NO: 3063750 - RNA, 23 nt, Human
gggauccuggaguucugguuccu

SEQ ID NO: 3063751 - RNA, 14 nt, Human
gggagugagcuggu

SEQ ID NO: 3063752 - RNA, 11 nt, Human
gggagugagcu

SEQ ID NO: 3063753 - RNA, 18 nt, Human
gggagugacagaggcagc

SEQ ID NO: 3063754 - RNA, 17 nt, Human
gggagugacagaggcag

SEQ ID NO: 3063755 - RNA, 13 nt, Human
gggacugagaaau

SEQ ID NO: 3063756 - RNA, 17 nt, Human
gggaggugggauccucc

SEQ ID NO: 3063757 - RNA, 16 nt, Human
gggaggugaccccagg

SEQ ID NO: 3063758 - RNA, 17 nt, Human
gggcagguugguggggg

SEQ ID NO: 3063759 - RNA, 11 nt, Human
gggcagagcag

SEQ ID NO: 3063760 - RNA, 18 nt, Human
gggcagaaggaagacuuc

SEQ ID NO: 3063761 - RNA, 14 nt, Human
gggcagaaggaaga

SEQ ID NO: 3063762 - RNA, 20 nt, Human
gggcacucagaagacacuga

SEQ ID NO: 3063763 - RNA, 23 nt, Human
gggcacaccgggcacucagaaga

SEQ ID NO: 3063764 - RNA, 18 nt, Human
gggcacagaaaauggaag

SEQ ID NO: 3063765 - RNA, 20 nt, Human
gggcacagaaaauggaagac

SEQ ID NO: 3063766 - RNA, 21 nt, Human
gggcacagaaaauggaagaca

SEQ ID NO: 3063767 - RNA, 19 nt, Human
gggcacucagaagacacug

SEQ ID NO: 3063768 - RNA, 16 nt, Human
gggcacucagaagaca

SEQ ID NO: 3063769 - RNA, 13 nt, Human
gggcacagggucu

SEQ ID NO: 3063770 - RNA, 16 nt, Human
gggcacagggucucua

SEQ ID NO: 3063771 - RNA, 14 nt, Human
ggcucuggagccca

SEQ ID NO: 3063772 - RNA, 13 nt, Human
ggcucuggagccc

SEQ ID NO: 3063773 - RNA, 17 nt, Human
ggccccugcccggcugc

SEQ ID NO: 3063774 - RNA, 16 nt, Human
ggccccugcccggcug

SEQ ID NO: 3063775 - RNA, 17 nt, Human
ggcucugccucccauca

SEQ ID NO: 3063776 - RNA, 20 nt, Human
ggccccugcccggcugcgga

SEQ ID NO: 3063777 - RNA, 13 nt, Human
ggcugagguggga

SEQ ID NO: 3063778 - RNA, 15 nt, Human
ggcugaggugggagg

SEQ ID NO: 3063779 - RNA, 18 nt, Human
ggcugcaccggcuggccu

SEQ ID NO: 3063780 - RNA, 19 nt, Human
ggcugcaccggcuggccug

SEQ ID NO: 3063781 - RNA, 17 nt, Human
ggcugcaccggcuggcc

SEQ ID NO: 3063782 - RNA, 24 nt, Human
ggcugcaaaggguaucaggugcug

SEQ ID NO: 3063783 - RNA, 23 nt, Human
ggcugcaaaggguaucaggugcu

SEQ ID NO: 3063784 - RNA, 22 nt, Human
ggcugcaaaggguaucaggugc

SEQ ID NO: 3063785 - RNA, 18 nt, Human
ggcugcaaaggguaucag

SEQ ID NO: 3063786 - RNA, 23 nt, Human
ggcugcuucaaggauccugagcc

SEQ ID NO: 3063787 - RNA, 21 nt, Human
ggcugcuucaaggauccugag

SEQ ID NO: 3063788 - RNA, 19 nt, Human
ggcugggagagccuuccag

SEQ ID NO: 3063789 - RNA, 18 nt, Human
ggcugggagagccuucca

SEQ ID NO: 3063790 - RNA, 15 nt, Human
ggcugggcagaggaa

SEQ ID NO: 3063791 - RNA, 19 nt, Human
ggcugggcagaggaaagca

SEQ ID NO: 3063792 - RNA, 13 nt, Human
ggcugggcagagg

SEQ ID NO: 3063793 - RNA, 14 nt, Human
ggcugggcagagga

SEQ ID NO: 3063794 - RNA, 20 nt, Human
ggcugggagagccuuccagg

SEQ ID NO: 3063795 - RNA, 23 nt, Human
ggcugggagagccuuccaggggu

SEQ ID NO: 3063796 - RNA, 13 nt, Human
ggcugcugaaggc

SEQ ID NO: 3063797 - RNA, 18 nt, Human
ggcugcugaaggcucgag

SEQ ID NO: 3063798 - RNA, 15 nt, Human
ggcugcugaaggcuc

SEQ ID NO: 3063799 - RNA, 17 nt, Human
ggcugcugaaggcucga

SEQ ID NO: 3063800 - RNA, 14 nt, Human
ggcugcugaaggcu

SEQ ID NO: 3063801 - RNA, 13 nt, Human
ggcugcagggagu

SEQ ID NO: 3063802 - RNA, 12 nt, Human
ggcugcagggag

SEQ ID NO: 3063803 - RNA, 11 nt, Human
ggcugcuucaa

SEQ ID NO: 3063804 - RNA, 12 nt, Human
ggcugcuucaag

SEQ ID NO: 3063805 - RNA, 14 nt, Human
ggcugcuucaagga

SEQ ID NO: 3063806 - RNA, 22 nt, Human
ggcugcuucaaggauccugagc

SEQ ID NO: 3063807 - RNA, 22 nt, Human
ggcuugaguuuaaauuguaaua

SEQ ID NO: 3063808 - RNA, 19 nt, Human
ggcuuggggaccagagcug

SEQ ID NO: 3063809 - RNA, 21 nt, Human
ggcuuggggaccagagcugcc

SEQ ID NO: 3063810 - RNA, 10 nt, Human
ggcuuuugug

SEQ ID NO: 3063811 - RNA, 15 nt, Human
ggcuuagucacugag

SEQ ID NO: 3063812 - RNA, 21 nt, Human
ggcuuagucacugagacagcc

SEQ ID NO: 3063813 - RNA, 17 nt, Human
ggcugggcuucaguggc

SEQ ID NO: 3063814 - RNA, 13 nt, Human
ggcugggcuucag

SEQ ID NO: 3063815 - RNA, 15 nt, Human
ggcuuaaaacaacac

SEQ ID NO: 3063816 - RNA, 12 nt, Human
ggcugggcuuca

SEQ ID NO: 3063817 - RNA, 17 nt, Human
ggcugggcucccuuccc

SEQ ID NO: 3063818 - RNA, 16 nt, Human
gggaccccgagccugg

SEQ ID NO: 3063819 - RNA, 20 nt, Human
gggaccccgagccuggcucc

SEQ ID NO: 3063820 - RNA, 18 nt, Human
gggaccccgagccuggcu

SEQ ID NO: 3063821 - RNA, 14 nt, Human
gggaauugaggaca

SEQ ID NO: 3063822 - RNA, 12 nt, Human
gggaccucaggc

SEQ ID NO: 3063823 - RNA, 13 nt, Human
gggaccucaggcc

SEQ ID NO: 3063824 - RNA, 15 nt, Human
gggaccucaggccug

SEQ ID NO: 3063825 - RNA, 17 nt, Human
gggacuacaggcaccca

SEQ ID NO: 3063826 - RNA, 23 nt, Human
gggaaggauacaaaagcauguga

SEQ ID NO: 3063827 - RNA, 21 nt, Human
gggaaggauacaaaagcaugu

SEQ ID NO: 3063828 - RNA, 14 nt, Human
ggcuuuugugcauu

SEQ ID NO: 3063829 - RNA, 16 nt, Human
gggaaggauacaaaag

SEQ ID NO: 3063830 - RNA, 14 nt, Human
gggaagggggcugg

SEQ ID NO: 3063831 - RNA, 16 nt, Human
gggaagggggcuggga

SEQ ID NO: 3063832 - RNA, 17 nt, Human
gggaagggggcugggac

SEQ ID NO: 3063833 - RNA, 13 nt, Human
gggaaugaagaua

SEQ ID NO: 3063834 - RNA, 16 nt, Human
gcugcgguccacccag

SEQ ID NO: 3063835 - RNA, 12 nt, Human
gcugcccuguga

SEQ ID NO: 3063836 - RNA, 14 nt, Human
gcugcccugugagu

SEQ ID NO: 3063837 - RNA, 11 nt, Human
gcugcccugug

SEQ ID NO: 3063838 - RNA, 16 nt, Human
gcuagauguauguacu

SEQ ID NO: 3063839 - RNA, 18 nt, Human
gcuagauguauguacuuc

SEQ ID NO: 3063840 - RNA, 13 nt, Human
gcugcuucaagga

SEQ ID NO: 3063841 - RNA, 10 nt, Human
gcugcuccca

SEQ ID NO: 3063842 - RNA, 18 nt, Human
gcugcgguccacccagga

SEQ ID NO: 3063843 - RNA, 17 nt, Human
gcugcgguccacccagg

SEQ ID NO: 3063844 - RNA, 16 nt, Human
gcugcuugggcuucau

SEQ ID NO: 3063845 - RNA, 21 nt, Human
gcugcuucaaggauccugagc

SEQ ID NO: 3063846 - RNA, 22 nt, Human
gcugcuucaaggauccugagcc

SEQ ID NO: 3063847 - RNA, 23 nt, Human
gcugcuucaaggauccugagcca

SEQ ID NO: 3063848 - RNA, 20 nt, Human
gcugggacaugggaaagggg

SEQ ID NO: 3063849 - RNA, 13 nt, Human
gcuggccgggacc

SEQ ID NO: 3063850 - RNA, 20 nt, Human
gcugggacuacaggcaccca

SEQ ID NO: 3063851 - RNA, 19 nt, Human
gcugggacuacaggcaccc

SEQ ID NO: 3063852 - RNA, 18 nt, Human
gcugggacuacaggcacc

SEQ ID NO: 3063853 - RNA, 13 nt, Human
gcugggacuacag

SEQ ID NO: 3063854 - RNA, 19 nt, Human
gcugggacuacagguguga

SEQ ID NO: 3063855 - RNA, 21 nt, Human
gcuggaccuugaacuggguac

SEQ ID NO: 3063856 - RNA, 17 nt, Human
gcugcuugggcuucauc

SEQ ID NO: 3063857 - RNA, 22 nt, Human
gcugcuugggcuucauccuccu

SEQ ID NO: 3063858 - RNA, 18 nt, Human
gcuggaccuugaacuggg

SEQ ID NO: 3063859 - RNA, 16 nt, Human
gcuggaccuugaacug

SEQ ID NO: 3063860 - RNA, 19 nt, Human
gcuggggccaggcuggguc

SEQ ID NO: 3063861 - RNA, 16 nt, Human
gcuggggccaggcugg

SEQ ID NO: 3063862 - RNA, 18 nt, Human
gcugggcuucaguggcag

SEQ ID NO: 3063863 - RNA, 23 nt, Human
gcugggggaagaagcucucuccu

SEQ ID NO: 3063864 - RNA, 12 nt, Human
gcuggggccagu

SEQ ID NO: 3063865 - RNA, 19 nt, Human
gcuggucccacucagucca

SEQ ID NO: 3063866 - RNA, 15 nt, Human
gcuggucccacucag

SEQ ID NO: 3063867 - RNA, 20 nt, Human
gcugggggccucagugccac

SEQ ID NO: 3063868 - RNA, 19 nt, Human
gcugggggccucagugcca

SEQ ID NO: 3063869 - RNA, 21 nt, Human
gcugggaugauuggagggggg

SEQ ID NO: 3063870 - RNA, 17 nt, Human
gcugggcuucaguggca

SEQ ID NO: 3063871 - RNA, 12 nt, Human
gcugggagagcc

SEQ ID NO: 3063872 - RNA, 13 nt, Human
gcugggagagccu

SEQ ID NO: 3063873 - RNA, 17 nt, Human
gcugggagagccuucca

SEQ ID NO: 3063874 - RNA, 18 nt, Human
gcugggagagccuuccag

SEQ ID NO: 3063875 - RNA, 19 nt, Human
gcugggagagccuuccagg

SEQ ID NO: 3063876 - RNA, 22 nt, Human
gcugggagagccuuccaggggu

SEQ ID NO: 3063877 - RNA, 22 nt, Human
gcugguucaggguuggccccug

SEQ ID NO: 3063878 - RNA, 22 nt, Human
gcuguauuuuaaaagaaugauu

SEQ ID NO: 3063879 - RNA, 16 nt, Human
gcugucaauuacagga

SEQ ID NO: 3063880 - RNA, 21 nt, Human
gcugguuagagguucccuuug

SEQ ID NO: 3063881 - RNA, 15 nt, Human
gcugguucaggguug

SEQ ID NO: 3063882 - RNA, 14 nt, Human
gcuggucccacuca

SEQ ID NO: 3063883 - RNA, 20 nt, Human
gcuggucccacucaguccau

SEQ ID NO: 3063884 - RNA, 18 nt, Human
gcuggugucaccugaaga

SEQ ID NO: 3063885 - RNA, 16 nt, Human
gcuggugucaccugaa

SEQ ID NO: 3063886 - RNA, 17 nt, Human
gcugucaauuacaggaa

SEQ ID NO: 3063887 - RNA, 19 nt, Human
gcugucaauuacaggaagu

SEQ ID NO: 3063888 - RNA, 22 nt, Human
gcugucaauuacaggaaguacu

SEQ ID NO: 3063889 - RNA, 23 nt, Human
gcugucaauuacaggaaguacug

SEQ ID NO: 3063890 - RNA, 21 nt, Human
gcugucccuuacgugaguccu

SEQ ID NO: 3063891 - RNA, 19 nt, Human
gcugucccuuacgugaguc

SEQ ID NO: 3063892 - RNA, 17 nt, Human
gcugucuccauguuuga

SEQ ID NO: 3063893 - RNA, 13 nt, Human
ggaagagccuugc

SEQ ID NO: 3063894 - RNA, 13 nt, Human
ggaagcacaugcc

SEQ ID NO: 3063895 - RNA, 14 nt, Human
ggaagcacaugccu

SEQ ID NO: 3063896 - RNA, 15 nt, Human
ggaagcacaugccuc

SEQ ID NO: 3063897 - RNA, 17 nt, Human
ggaagcacaugccucuc

SEQ ID NO: 3063898 - RNA, 17 nt, Human
ggaagcacagcuucauu

SEQ ID NO: 3063899 - RNA, 21 nt, Human
ggaagcacaugccucucucag

SEQ ID NO: 3063900 - RNA, 22 nt, Human
ggaagcacaugccucucucagg

SEQ ID NO: 3063901 - RNA, 23 nt, Human
ggaagcacaugccucucucaggc

SEQ ID NO: 3063902 - RNA, 15 nt, Human
ggaagccagcaggcu

SEQ ID NO: 3063903 - RNA, 16 nt, Human
ggaagccagcaggcuc

SEQ ID NO: 3063904 - RNA, 17 nt, Human
ggaagccagcaggcucu

SEQ ID NO: 3063905 - RNA, 18 nt, Human
ggaagccagcaggcucuc

SEQ ID NO: 3063906 - RNA, 13 nt, Human
ggaagccagcagg

SEQ ID NO: 3063907 - RNA, 14 nt, Human
ggaagccagcaggc

SEQ ID NO: 3063908 - RNA, 23 nt, Human
ggaaccgagggggcugcucccac

SEQ ID NO: 3063909 - RNA, 20 nt, Human
ggaacagacuggaagcacag

SEQ ID NO: 3063910 - RNA, 19 nt, Human
ggaacagacuggaagcaca

SEQ ID NO: 3063911 - RNA, 17 nt, Human
ggaacagacuggaagca

SEQ ID NO: 3063912 - RNA, 17 nt, Human
ggaaauauuuauuuuaa

SEQ ID NO: 3063913 - RNA, 18 nt, Human
ggaaauauuuauuuuaau

SEQ ID NO: 3063914 - RNA, 12 nt, Human
ggaaauauuuau

SEQ ID NO: 3063915 - RNA, 13 nt, Human
ggaaauauuuauu

SEQ ID NO: 3063916 - RNA, 15 nt, Human
ggaaauauuuauuuu

SEQ ID NO: 3063917 - RNA, 15 nt, Human
ggaaaaucagccugc

SEQ ID NO: 3063918 - RNA, 14 nt, Human
ggaaaauaaauuau

SEQ ID NO: 3063919 - RNA, 14 nt, Human
gcuuuaucaaaggg

SEQ ID NO: 3063920 - RNA, 20 nt, Human
ggaaaaaauaacaaugaaag

SEQ ID NO: 3063921 - RNA, 14 nt, Human
gcuuuuacuuaaac

SEQ ID NO: 3063922 - RNA, 17 nt, Human
gcuuuuaaaaaaaaaua

SEQ ID NO: 3063923 - RNA, 15 nt, Human
ggaaaaauagccugc

SEQ ID NO: 3063924 - RNA, 14 nt, Human
ggaaaaacugauuu

SEQ ID NO: 3063925 - RNA, 13 nt, Human
ggaaaaauagccu

SEQ ID NO: 3063926 - RNA, 22 nt, Human
gcuugaggguugggcugguguc

SEQ ID NO: 3063927 - RNA, 13 nt, Human
gcuuggaggaagg

SEQ ID NO: 3063928 - RNA, 14 nt, Human
gcuuggaggaagga

SEQ ID NO: 3063929 - RNA, 15 nt, Human
gcuuggaggaaggaa

SEQ ID NO: 3063930 - RNA, 17 nt, Human
gcuugcccuggugccuc

SEQ ID NO: 3063931 - RNA, 19 nt, Human
gcuugcccuggugccucac

SEQ ID NO: 3063932 - RNA, 21 nt, Human
gcuuccagugaggcucugccc

SEQ ID NO: 3063933 - RNA, 19 nt, Human
gcuuccagugaggcucugc

SEQ ID NO: 3063934 - RNA, 20 nt, Human
gcuuccagugaggcucugcc

SEQ ID NO: 3063935 - RNA, 18 nt, Human
gcuuccagugaggcucug

SEQ ID NO: 3063936 - RNA, 23 nt, Human
gcuguucacagccagacuggcac

SEQ ID NO: 3063937 - RNA, 16 nt, Human
gcuguucacagccaga

SEQ ID NO: 3063938 - RNA, 15 nt, Human
gcuguucacagccag

SEQ ID NO: 3063939 - RNA, 23 nt, Human
ggcaggucuugaacuccuggccu

SEQ ID NO: 3063940 - RNA, 13 nt, Human
ggcagguccaggg

SEQ ID NO: 3063941 - RNA, 18 nt, Human
ggcagcucaccucucccu

SEQ ID NO: 3063942 - RNA, 21 nt, Human
ggcagcucaccucucccuugg

SEQ ID NO: 3063943 - RNA, 22 nt, Human
ggcagcucaccucucccuugga

SEQ ID NO: 3063944 - RNA, 16 nt, Human
ggcagcucaccucucc

SEQ ID NO: 3063945 - RNA, 21 nt, Human
ggcagcuugaggguugggcug

SEQ ID NO: 3063946 - RNA, 19 nt, Human
ggcagcugcgguccaccca

SEQ ID NO: 3063947 - RNA, 23 nt, Human
ggcagaguugaagacagagcuac

SEQ ID NO: 3063948 - RNA, 23 nt, Human
ggcagauacaggaaaagcugcug

SEQ ID NO: 3063949 - RNA, 17 nt, Human
ggcagaggaaagcaaag

SEQ ID NO: 3063950 - RNA, 18 nt, Human
ggcaacugcauuggcuuu

SEQ ID NO: 3063951 - RNA, 19 nt, Human
ggcaacugcauuggcuuug

SEQ ID NO: 3063952 - RNA, 15 nt, Human
ggcaaggcugucaau

SEQ ID NO: 3063953 - RNA, 19 nt, Human
ggcaacccccagccugcua

SEQ ID NO: 3063954 - RNA, 21 nt, Human
ggaucagucugauucccaagc

SEQ ID NO: 3063955 - RNA, 20 nt, Human
ggcagagcagagaccauccc

SEQ ID NO: 3063956 - RNA, 15 nt, Human
ggcagagcagagacc

SEQ ID NO: 3063957 - RNA, 16 nt, Human
ggcagagcagagacca

SEQ ID NO: 3063958 - RNA, 12 nt, Human
ggcagagcagag

SEQ ID NO: 3063959 - RNA, 16 nt, Human
ggcacccggccccugc

SEQ ID NO: 3063960 - RNA, 15 nt, Human
ggcacccggccccug

SEQ ID NO: 3063961 - RNA, 16 nt, Human
ggcaaggcugucaauu

SEQ ID NO: 3063962 - RNA, 13 nt, Human
ggccccugcccgg

SEQ ID NO: 3063963 - RNA, 18 nt, Human
ggccccugccacccuggg

SEQ ID NO: 3063964 - RNA, 17 nt, Human
ggccccugccacccugg

SEQ ID NO: 3063965 - RNA, 12 nt, Human
ggccccugccac

SEQ ID NO: 3063966 - RNA, 16 nt, Human
ggccccugccacccug

SEQ ID NO: 3063967 - RNA, 13 nt, Human
ggccccugccacc

SEQ ID NO: 3063968 - RNA, 16 nt, Human
ggccccucaggguccc

SEQ ID NO: 3063969 - RNA, 19 nt, Human
ggccccucagggucccugg

SEQ ID NO: 3063970 - RNA, 20 nt, Human
ggccccucagggucccuggu

SEQ ID NO: 3063971 - RNA, 21 nt, Human
ggccccucagggucccuggug

SEQ ID NO: 3063972 - RNA, 13 nt, Human
ggccaugggccuc

SEQ ID NO: 3063973 - RNA, 22 nt, Human
ggccaugggacagggaggacgc

SEQ ID NO: 3063974 - RNA, 22 nt, Human
ggccaggcugggucgcccugga

SEQ ID NO: 3063975 - RNA, 18 nt, Human
ggccaggcugggucgccc

SEQ ID NO: 3063976 - RNA, 11 nt, Human
ggccaggcugg

SEQ ID NO: 3063977 - RNA, 16 nt, Human
ggccaggccagaggga

SEQ ID NO: 3063978 - RNA, 14 nt, Human
ggccaggccagagg

SEQ ID NO: 3063979 - RNA, 16 nt, Human
ggccacugugaagaga

SEQ ID NO: 3063980 - RNA, 14 nt, Human
ggccaggagccucc

SEQ ID NO: 3063981 - RNA, 16 nt, Human
ggccaggagccuccug

SEQ ID NO: 3063982 - RNA, 11 nt, Human
ggccacuguga

SEQ ID NO: 3063983 - RNA, 15 nt, Human
ggcagguuggugggg

SEQ ID NO: 3063984 - RNA, 23 nt, Human
ggcauguucucugaggacacuaa

SEQ ID NO: 3063985 - RNA, 19 nt, Human
ggcagugcucacccacacc

SEQ ID NO: 3063986 - RNA, 15 nt, Human
ggcauuccccaggag

SEQ ID NO: 3063987 - RNA, 16 nt, Human
ggccacaagacccuug

SEQ ID NO: 3063988 - RNA, 17 nt, Human
ggccacaagacccuugu

SEQ ID NO: 3063989 - RNA, 16 nt, Human
ggccaccugcggugcu

SEQ ID NO: 3063990 - RNA, 22 nt, Human
ggccaccugcggugcuaucucc

SEQ ID NO: 3063991 - RNA, 16 nt, Human
ggaucacagccucuga

SEQ ID NO: 3063992 - RNA, 21 nt, Human
ggagugacagaggcagcccca

SEQ ID NO: 3063993 - RNA, 19 nt, Human
ggagugacagaggcagccc

SEQ ID NO: 3063994 - RNA, 18 nt, Human
ggagugacagaggcagcc

SEQ ID NO: 3063995 - RNA, 17 nt, Human
ggagugacagaggcagc

SEQ ID NO: 3063996 - RNA, 21 nt, Human
ggagugaguugauagcacaga

SEQ ID NO: 3063997 - RNA, 14 nt, Human
ggagugagcugguu

SEQ ID NO: 3063998 - RNA, 12 nt, Human
ggagugagcugg

SEQ ID NO: 3063999 - RNA, 16 nt, Human
ggagugacagaggcag

SEQ ID NO: 3064000 - RNA, 11 nt, Human
ggagugacaga

SEQ ID NO: 3064001 - RNA, 20 nt, Human
ggagucccaccuuggcugca

SEQ ID NO: 3064002 - RNA, 17 nt, Human
ggagggcuccagacaca

SEQ ID NO: 3064003 - RNA, 14 nt, Human
ggagggcuccagac

SEQ ID NO: 3064004 - RNA, 15 nt, Human
ggagggcuccagaca

SEQ ID NO: 3064005 - RNA, 12 nt, Human
ggagggagggcu

SEQ ID NO: 3064006 - RNA, 12 nt, Human
ggagggcuccag

SEQ ID NO: 3064007 - RNA, 13 nt, Human
ggagggcuccaga

SEQ ID NO: 3064008 - RNA, 23 nt, Human
ggaggaucacuugaguccagaag

SEQ ID NO: 3064009 - RNA, 17 nt, Human
ggaggaucucuugagcc

SEQ ID NO: 3064010 - RNA, 21 nt, Human
ggaggaucucuugagccuggg

SEQ ID NO: 3064011 - RNA, 19 nt, Human
ggaggacgcucucuggccu

SEQ ID NO: 3064012 - RNA, 20 nt, Human
ggaggacgcucucuggccuu

SEQ ID NO: 3064013 - RNA, 21 nt, Human
ggaggacgcucucuggccuuc

SEQ ID NO: 3064014 - RNA, 12 nt, Human
ggagcccuggga

SEQ ID NO: 3064015 - RNA, 13 nt, Human
ggagcccugggag

SEQ ID NO: 3064016 - RNA, 23 nt, Human
ggagcccugucuccucucucugu

SEQ ID NO: 3064017 - RNA, 20 nt, Human
ggagcaaaaucgaugcagug

SEQ ID NO: 3064018 - RNA, 15 nt, Human
ggagaggggcacagg

SEQ ID NO: 3064019 - RNA, 20 nt, Human
ggagauuuacaacuggggga

SEQ ID NO: 3064020 - RNA, 17 nt, Human
ggagagcuagcagcagg

SEQ ID NO: 3064021 - RNA, 21 nt, Human
ggagagcuagcagcagggagg

SEQ ID NO: 3064022 - RNA, 21 nt, Human
ggagaccccuuggggagcagg

SEQ ID NO: 3064023 - RNA, 20 nt, Human
ggaagccagcaggcucucag

SEQ ID NO: 3064024 - RNA, 23 nt, Human
ggaccccacuccggcccuccaga

SEQ ID NO: 3064025 - RNA, 22 nt, Human
gcuacacaggggaaaagaggag

SEQ ID NO: 3064026 - RNA, 17 nt, Human
gcuaacauggaaguacu

SEQ ID NO: 3064027 - RNA, 18 nt, Human
gcuaacauggaaguacua

SEQ ID NO: 3064028 - RNA, 14 nt, Human
gcuaacauggaagu

SEQ ID NO: 3064029 - RNA, 15 nt, Human
gcgugagccacugca

SEQ ID NO: 3064030 - RNA, 14 nt, Human
gcgugagccacugc

SEQ ID NO: 3064031 - RNA, 22 nt, Human
gcguccugucggagcccugucu

SEQ ID NO: 3064032 - RNA, 21 nt, Human
gcuagacgagcaggcuucuuc

SEQ ID NO: 3064033 - RNA, 22 nt, Human
gcuagacgagcaggcuucuucc

SEQ ID NO: 3064034 - RNA, 23 nt, Human
gcggacagccacggccaggccag

SEQ ID NO: 3064035 - RNA, 19 nt, Human
gcggggacagcuccuucug

SEQ ID NO: 3064036 - RNA, 18 nt, Human
gcggggacagcuccuucu

SEQ ID NO: 3064037 - RNA, 19 nt, Human
gcggacagccacggccagg

SEQ ID NO: 3064038 - RNA, 16 nt, Human
gcggacagccacggcc

SEQ ID NO: 3064039 - RNA, 19 nt, Human
gcggaaugaaccacaucuu

SEQ ID NO: 3064040 - RNA, 23 nt, Human
gcgguccacccaggagccccgag

SEQ ID NO: 3064041 - RNA, 20 nt, Human
gcgguccacccaggagcccc

SEQ ID NO: 3064042 - RNA, 23 nt, Human
gcggggacagcuccuucuguccu

SEQ ID NO: 3064043 - RNA, 19 nt, Human
gcguccugucggagcccug

SEQ ID NO: 3064044 - RNA, 18 nt, Human
gcgccuacaggagugagc

SEQ ID NO: 3064045 - RNA, 21 nt, Human
gcgccuacaggagugagcacu

SEQ ID NO: 3064046 - RNA, 20 nt, Human
gcgccuacaggagugagcac

SEQ ID NO: 3064047 - RNA, 14 nt, Human
gcgcugccccuggc

SEQ ID NO: 3064048 - RNA, 19 nt, Human
gcgcuggccgggaccccga

SEQ ID NO: 3064049 - RNA, 17 nt, Human
gccugguggcagcugcg

SEQ ID NO: 3064050 - RNA, 16 nt, Human
gccugguggcagcugc

SEQ ID NO: 3064051 - RNA, 18 nt, Human
gccuguaaucacagcuac

SEQ ID NO: 3064052 - RNA, 15 nt, Human
gccugguggcagcug

SEQ ID NO: 3064053 - RNA, 14 nt, Human
gccugguggcagcu

SEQ ID NO: 3064054 - RNA, 20 nt, Human
gccuuagaagucacacagua

SEQ ID NO: 3064055 - RNA, 19 nt, Human
gccuuacccucauguucuu

SEQ ID NO: 3064056 - RNA, 21 nt, Human
gccuuauggaacacucugaga

SEQ ID NO: 3064057 - RNA, 22 nt, Human
gccuuauggaacacucugagac

SEQ ID NO: 3064058 - RNA, 23 nt, Human
gccuuauggaacacucugagacu

SEQ ID NO: 3064059 - RNA, 21 nt, Human
gccuuccaggggugggacacc

SEQ ID NO: 3064060 - RNA, 19 nt, Human
gccuuccccuggcacuggc

SEQ ID NO: 3064061 - RNA, 18 nt, Human
gccuucggccuccauccu

SEQ ID NO: 3064062 - RNA, 20 nt, Human
gccuuccccuggcacuggca

SEQ ID NO: 3064063 - RNA, 22 nt, Human
gcgacagugagacucugucuca

SEQ ID NO: 3064064 - RNA, 14 nt, Human
gccuggacccugug

SEQ ID NO: 3064065 - RNA, 12 nt, Human
gccugcccaggc

SEQ ID NO: 3064066 - RNA, 11 nt, Human
gccugcccagg

SEQ ID NO: 3064067 - RNA, 21 nt, Human
gccucugcacuccccugcugg

SEQ ID NO: 3064068 - RNA, 15 nt, Human
gccucugcacucccc

SEQ ID NO: 3064069 - RNA, 17 nt, Human
gccucugcacuccccug

SEQ ID NO: 3064070 - RNA, 18 nt, Human
gccucugcacuccccugc

SEQ ID NO: 3064071 - RNA, 19 nt, Human
gccucugcacuccccugcu

SEQ ID NO: 3064072 - RNA, 20 nt, Human
gccucugcacuccccugcug

SEQ ID NO: 3064073 - RNA, 16 nt, Human
gccucugcacuccccu

SEQ ID NO: 3064074 - RNA, 15 nt, Human
gccucugacacacag

SEQ ID NO: 3064075 - RNA, 14 nt, Human
gccucucugcaggu

SEQ ID NO: 3064076 - RNA, 10 nt, Human
gccucucugc

SEQ ID NO: 3064077 - RNA, 17 nt, Human
gccucucugcagguccc

SEQ ID NO: 3064078 - RNA, 16 nt, Human
gccucucugcaggucc

SEQ ID NO: 3064079 - RNA, 23 nt, Human
gccucucugcaggucccuaauaa

SEQ ID NO: 3064080 - RNA, 15 nt, Human
gccucucccaucacu

SEQ ID NO: 3064081 - RNA, 19 nt, Human
gccucccgaauagcuggga

SEQ ID NO: 3064082 - RNA, 18 nt, Human
gccucccgaauagcuggg

SEQ ID NO: 3064083 - RNA, 23 nt, Human
gccucccgaguagcugggacuac

SEQ ID NO: 3064084 - RNA, 21 nt, Human
gccucccgaguagcugggacu

SEQ ID NO: 3064085 - RNA, 20 nt, Human
gccucccgaauagcugggac

SEQ ID NO: 3064086 - RNA, 20 nt, Human
gccucccgaguagcugggac

SEQ ID NO: 3064087 - RNA, 14 nt, Human
gccucagccuccca

SEQ ID NO: 3064088 - RNA, 12 nt, Human
gccucagccucc

SEQ ID NO: 3064089 - RNA, 17 nt, Human
gccucccaucacccgcu

SEQ ID NO: 3064090 - RNA, 22 nt, Human
gccucagccucccaaagugcug

SEQ ID NO: 3064091 - RNA, 17 nt, Human
gccuauuuuaauaaaca

SEQ ID NO: 3064092 - RNA, 21 nt, Human
gccucagcauccuggcacccg

SEQ ID NO: 3064093 - RNA, 17 nt, Human
gccucagcauccuggca

SEQ ID NO: 3064094 - RNA, 18 nt, Human
gccucagcauccuggcac

SEQ ID NO: 3064095 - RNA, 24 nt, Human
gccucaagugauucuccugccuca

SEQ ID NO: 3064096 - RNA, 22 nt, Human
gccucaagugauucuccugccu

SEQ ID NO: 3064097 - RNA, 18 nt, Human
gccgucuaccugaggggc

SEQ ID NO: 3064098 - RNA, 20 nt, Human
gccgucuaccugaggggccu

SEQ ID NO: 3064099 - RNA, 22 nt, Human
gccgucuaccugaggggccucu

SEQ ID NO: 3064100 - RNA, 23 nt, Human
gccgucuaccugaggggccucuu

SEQ ID NO: 3064101 - RNA, 16 nt, Human
gccgagauagccaagg

SEQ ID NO: 3064102 - RNA, 13 nt, Human
gcccuucucucca

SEQ ID NO: 3064103 - RNA, 23 nt, Human
gcccuucucuccagccccuggau

SEQ ID NO: 3064104 - RNA, 19 nt, Human
gcccuucuuuccacagaag

SEQ ID NO: 3064105 - RNA, 13 nt, Human
gccgcagcccugc

SEQ ID NO: 3064106 - RNA, 16 nt, Human
gccgcagcccugcaga

SEQ ID NO: 3064107 - RNA, 17 nt, Human
gccgcagcccugcagag

SEQ ID NO: 3064108 - RNA, 15 nt, Human
gccgcagcccugcag

SEQ ID NO: 3064109 - RNA, 17 nt, Human
gccgagauagccaaggc

SEQ ID NO: 3064110 - RNA, 18 nt, Human
gccacugcaccgggccac

SEQ ID NO: 3064111 - RNA, 17 nt, Human
gccacugcaccgggcca

SEQ ID NO: 3064112 - RNA, 18 nt, Human
gccagagggagugacaga

SEQ ID NO: 3064113 - RNA, 17 nt, Human
gccagagggagugacag

SEQ ID NO: 3064114 - RNA, 12 nt, Human
gccagagacaca

SEQ ID NO: 3064115 - RNA, 15 nt, Human
gccagagacacaagc

SEQ ID NO: 3064116 - RNA, 15 nt, Human
gccacggccaggcca

SEQ ID NO: 3064117 - RNA, 14 nt, Human
gccacggccaggcc

SEQ ID NO: 3064118 - RNA, 12 nt, Human
gccaaaggaagc

SEQ ID NO: 3064119 - RNA, 16 nt, Human
gccacggccaggccag

SEQ ID NO: 3064120 - RNA, 22 nt, Human
gccacguucuuacuaguuuccc

SEQ ID NO: 3064121 - RNA, 21 nt, Human
gccacuauuguuagucucuug

SEQ ID NO: 3064122 - RNA, 20 nt, Human
gccacuauuguuagucucuu

SEQ ID NO: 3064123 - RNA, 14 nt, Human
gccagcugcuuggg

SEQ ID NO: 3064124 - RNA, 15 nt, Human
gccagcugcuugggc

SEQ ID NO: 3064125 - RNA, 14 nt, Human
gccagccuugacca

SEQ ID NO: 3064126 - RNA, 20 nt, Human
gccagccuugaccauucucc

SEQ ID NO: 3064127 - RNA, 21 nt, Human
gccagccuugaccauucucca

SEQ ID NO: 3064128 - RNA, 22 nt, Human
gccagccuugaccauucuccac

SEQ ID NO: 3064129 - RNA, 20 nt, Human
gccagccgagauagccaagg

SEQ ID NO: 3064130 - RNA, 12 nt, Human
gccagccuugac

SEQ ID NO: 3064131 - RNA, 16 nt, Human
gccagauucuuuccug

SEQ ID NO: 3064132 - RNA, 20 nt, Human
gccagagggagugacagagg

SEQ ID NO: 3064133 - RNA, 19 nt, Human
gccagagggagugacagag

SEQ ID NO: 3064134 - RNA, 17 nt, Human
gccagauucuuuccuga

SEQ ID NO: 3064135 - RNA, 14 nt, Human
gccaugggacaggg

SEQ ID NO: 3064136 - RNA, 19 nt, Human
gccaugggacagggaggac

SEQ ID NO: 3064137 - RNA, 20 nt, Human
gccauuucuuccacaagagc

SEQ ID NO: 3064138 - RNA, 22 nt, Human
gccauuucuuccacaagagccc

SEQ ID NO: 3064139 - RNA, 13 nt, Human
gccauuuguccca

SEQ ID NO: 3064140 - RNA, 14 nt, Human
gccauuugucccaa

SEQ ID NO: 3064141 - RNA, 16 nt, Human
gccauuugucccaagu

SEQ ID NO: 3064142 - RNA, 18 nt, Human
gccauuugucccaagugc

SEQ ID NO: 3064143 - RNA, 20 nt, Human
gccauuugucccaagugcca

SEQ ID NO: 3064144 - RNA, 17 nt, Human
gccauuucuuccacaag

SEQ ID NO: 3064145 - RNA, 22 nt, Human
gccauuuaaagcuuauuaaaac

SEQ ID NO: 3064146 - RNA, 16 nt, Human
gcccacagcuguauga

SEQ ID NO: 3064147 - RNA, 15 nt, Human
gcccaaagaugcagc

SEQ ID NO: 3064148 - RNA, 16 nt, Human
gcccaaagaugcagcc

SEQ ID NO: 3064149 - RNA, 18 nt, Human
gcccacaggaucagucug

SEQ ID NO: 3064150 - RNA, 13 nt, Human
gcccacaggauca

SEQ ID NO: 3064151 - RNA, 19 nt, Human
gcccacaggaucagucuga

SEQ ID NO: 3064152 - RNA, 15 nt, Human
gcccaccccucaaca

SEQ ID NO: 3064153 - RNA, 13 nt, Human
gccaucccagccc

SEQ ID NO: 3064154 - RNA, 14 nt, Human
gccaucccagcccc

SEQ ID NO: 3064155 - RNA, 15 nt, Human
gccaucccagcccca

SEQ ID NO: 3064156 - RNA, 16 nt, Human
gccaucccagccccaa

SEQ ID NO: 3064157 - RNA, 17 nt, Human
gccaucccagccccaau

SEQ ID NO: 3064158 - RNA, 14 nt, Human
gccauccagguuca

SEQ ID NO: 3064159 - RNA, 20 nt, Human
gccauccagguucagcuugu

SEQ ID NO: 3064160 - RNA, 19 nt, Human
gccauccagguucagcuug

SEQ ID NO: 3064161 - RNA, 17 nt, Human
gccaggaagccagcagg

SEQ ID NO: 3064162 - RNA, 18 nt, Human
gccaggaagccagcaggc

SEQ ID NO: 3064163 - RNA, 15 nt, Human
gccaggaagccagca

SEQ ID NO: 3064164 - RNA, 19 nt, Human
gccaggaagccagcaggcu

SEQ ID NO: 3064165 - RNA, 21 nt, Human
gccaggggaaaaucagccugc

SEQ ID NO: 3064166 - RNA, 22 nt, Human
gccaggggaaaaucagccugcu

SEQ ID NO: 3064167 - RNA, 17 nt, Human
gccaggggaaaaucagc

SEQ ID NO: 3064168 - RNA, 23 nt, Human
gccaggggaaaaucagccugcuc

SEQ ID NO: 3064169 - RNA, 22 nt, Human
gcccaucugggggccucuucug

SEQ ID NO: 3064170 - RNA, 17 nt, Human
gccccagugcccacagg

SEQ ID NO: 3064171 - RNA, 16 nt, Human
gccccagugcccacag

SEQ ID NO: 3064172 - RNA, 15 nt, Human
gccccagugcccaca

SEQ ID NO: 3064173 - RNA, 21 nt, Human
gccccauucugccugcccagg

SEQ ID NO: 3064174 - RNA, 20 nt, Human
gccccauucugccugcccag

SEQ ID NO: 3064175 - RNA, 18 nt, Human
gccccauucugccugccc

SEQ ID NO: 3064176 - RNA, 17 nt, Human
gccccauucugccugcc

SEQ ID NO: 3064177 - RNA, 23 nt, Human
gccccauccucuguacagagccc

SEQ ID NO: 3064178 - RNA, 15 nt, Human
gccccaucugcgggg

SEQ ID NO: 3064179 - RNA, 15 nt, Human
gcccaggcuggcgug

SEQ ID NO: 3064180 - RNA, 14 nt, Human
gcccaggcuggcgu

SEQ ID NO: 3064181 - RNA, 16 nt, Human
gcccaggcuggcgugc

SEQ ID NO: 3064182 - RNA, 20 nt, Human
gcccagucuggaaugcagug

SEQ ID NO: 3064183 - RNA, 22 nt, Human
gcccagucuggaaugcaguggu

SEQ ID NO: 3064184 - RNA, 12 nt, Human
gcccaggaaagg

SEQ ID NO: 3064185 - RNA, 15 nt, Human
gcccaggaaaggcuc

SEQ ID NO: 3064186 - RNA, 16 nt, Human
gcccaggaaaggcucc

SEQ ID NO: 3064187 - RNA, 18 nt, Human
gcccaggccuccuacagc

SEQ ID NO: 3064188 - RNA, 11 nt, Human
gcccaggcugg

SEQ ID NO: 3064189 - RNA, 23 nt, Human
gccccuggcagccccuguucugg

SEQ ID NO: 3064190 - RNA, 19 nt, Human
gccccugcacuccagccug

SEQ ID NO: 3064191 - RNA, 23 nt, Human
gccccugcacagcaggcugccag

SEQ ID NO: 3064192 - RNA, 14 nt, Human
gccccugcacagca

SEQ ID NO: 3064193 - RNA, 17 nt, Human
gccccugcacagcaggc

SEQ ID NO: 3064194 - RNA, 22 nt, Human
gccccugcacagcaggcugcca

SEQ ID NO: 3064195 - RNA, 19 nt, Human
gccccucagggucccuggu

SEQ ID NO: 3064196 - RNA, 21 nt, Human
gccccucagggucccuggugg

SEQ ID NO: 3064197 - RNA, 18 nt, Human
gccccucagggucccugg

SEQ ID NO: 3064198 - RNA, 14 nt, Human
gccccgcccaggcu

SEQ ID NO: 3064199 - RNA, 22 nt, Human
gccccgaggccuucucugaagg

SEQ ID NO: 3064200 - RNA, 23 nt, Human
gccccauucugccugcccaggcc

SEQ ID NO: 3064201 - RNA, 22 nt, Human
gccccauucugccugcccaggc

SEQ ID NO: 3064202 - RNA, 23 nt, Human
gccccgaggccuucucugaagga

SEQ ID NO: 3064203 - RNA, 15 nt, Human
gccccauucugccug

SEQ ID NO: 3064204 - RNA, 17 nt, Human
gccccgugggguuccuc

SEQ ID NO: 3064205 - RNA, 22 nt, Human
gcccucugcccacucccugcaa

SEQ ID NO: 3064206 - RNA, 19 nt, Human
gcccgggcucugccuccca

SEQ ID NO: 3064207 - RNA, 20 nt, Human
gcccgggcucugccucccau

SEQ ID NO: 3064208 - RNA, 21 nt, Human
gcccgggcucugccucccauc

SEQ ID NO: 3064209 - RNA, 13 nt, Human
gcccgggcucugc

SEQ ID NO: 3064210 - RNA, 14 nt, Human
gcccgggcucugcc

SEQ ID NO: 3064211 - RNA, 15 nt, Human
gcccgggcucugccu

SEQ ID NO: 3064212 - RNA, 18 nt, Human
gcccgggcucugccuccc

SEQ ID NO: 3064213 - RNA, 12 nt, Human
gcccgggcucug

SEQ ID NO: 3064214 - RNA, 14 nt, Human
gcccggcuccaggc

SEQ ID NO: 3064215 - RNA, 13 nt, Human
gcccggcuccagg

SEQ ID NO: 3064216 - RNA, 12 nt, Human
gcccggcuccag

SEQ ID NO: 3064217 - RNA, 19 nt, Human
gccccuucugacccaugcu

SEQ ID NO: 3064218 - RNA, 11 nt, Human
gcaggucccua

SEQ ID NO: 3064219 - RNA, 10 nt, Human
gcaggucccu

SEQ ID NO: 3064220 - RNA, 13 nt, Human
gcaggucccuaau

SEQ ID NO: 3064221 - RNA, 12 nt, Human
gcaggucccuaa

SEQ ID NO: 3064222 - RNA, 23 nt, Human
gcagugcuuccaaggauggacca

SEQ ID NO: 3064223 - RNA, 16 nt, Human
gcagugggagcugccu

SEQ ID NO: 3064224 - RNA, 14 nt, Human
gcagugcucaccca

SEQ ID NO: 3064225 - RNA, 20 nt, Human
gcaggauucuuccucccucc

SEQ ID NO: 3064226 - RNA, 15 nt, Human
gcaggcuacugucag

SEQ ID NO: 3064227 - RNA, 12 nt, Human
gcagggcucagc

SEQ ID NO: 3064228 - RNA, 16 nt, Human
gcagggagggcuucug

SEQ ID NO: 3064229 - RNA, 18 nt, Human
gcauauuauuuuauguug

SEQ ID NO: 3064230 - RNA, 23 nt, Human
gcauauuauuuuauguugcauag

SEQ ID NO: 3064231 - RNA, 15 nt, Human
gcauauucaggaagc

SEQ ID NO: 3064232 - RNA, 17 nt, Human
gcauauucaggaagcuc

SEQ ID NO: 3064233 - RNA, 18 nt, Human
gcauauucaggaagcuca

SEQ ID NO: 3064234 - RNA, 20 nt, Human
gcauauucaggaagcucagg

SEQ ID NO: 3064235 - RNA, 21 nt, Human
gcaucaagaugugacauguuu

SEQ ID NO: 3064236 - RNA, 18 nt, Human
gcagugggagcugccugu

SEQ ID NO: 3064237 - RNA, 17 nt, Human
gcagugggagcugccug

SEQ ID NO: 3064238 - RNA, 18 nt, Human
gcauagauucccugagca

SEQ ID NO: 3064239 - RNA, 13 nt, Human
gcaguucugaaga

SEQ ID NO: 3064240 - RNA, 16 nt, Human
gcauuuuacuguacag

SEQ ID NO: 3064241 - RNA, 17 nt, Human
gcauuuuacuguacaga

SEQ ID NO: 3064242 - RNA, 17 nt, Human
gcauuugcugaauacag

SEQ ID NO: 3064243 - RNA, 21 nt, Human
gcauuuggugguuucagaaau

SEQ ID NO: 3064244 - RNA, 23 nt, Human
gcauuugcugaauacagaggcaa

SEQ ID NO: 3064245 - RNA, 12 nt, Human
gcauuccccacu

SEQ ID NO: 3064246 - RNA, 22 nt, Human
gcauuuugcuaaaugugaauga

SEQ ID NO: 3064247 - RNA, 16 nt, Human
gccaaaggaagcacau

SEQ ID NO: 3064248 - RNA, 20 nt, Human
gccaaaggaagcacaugccu

SEQ ID NO: 3064249 - RNA, 14 nt, Human
gccaaaggaagcac

SEQ ID NO: 3064250 - RNA, 16 nt, Human
gccaaagaagcagacc

SEQ ID NO: 3064251 - RNA, 21 nt, Human
gccaaacucaccugccccuca

SEQ ID NO: 3064252 - RNA, 19 nt, Human
gccaaacucaccugccccu

SEQ ID NO: 3064253 - RNA, 17 nt, Human
gcaugaauuugugaagg

SEQ ID NO: 3064254 - RNA, 17 nt, Human
gcaugccuggauggggc

SEQ ID NO: 3064255 - RNA, 22 nt, Human
gcaugccuggauggggcugcac

SEQ ID NO: 3064256 - RNA, 15 nt, Human
gcaugaauuugugaa

SEQ ID NO: 3064257 - RNA, 23 nt, Human
gcaugaaguaauaugcacacauu

SEQ ID NO: 3064258 - RNA, 16 nt, Human
gcaucaggccaggccc

SEQ ID NO: 3064259 - RNA, 17 nt, Human
gcaucaggccaggcccu

SEQ ID NO: 3064260 - RNA, 13 nt, Human
gcaucaggccagg

SEQ ID NO: 3064261 - RNA, 15 nt, Human
gcaucaggccaggcc

SEQ ID NO: 3064262 - RNA, 15 nt, Human
gcaugcugucccuua

SEQ ID NO: 3064263 - RNA, 15 nt, Human
gcaugccuggauggg

SEQ ID NO: 3064264 - RNA, 17 nt, Human
gcauguuugugauugac

SEQ ID NO: 3064265 - RNA, 18 nt, Human
gcagauggaaugcugugu

SEQ ID NO: 3064266 - RNA, 16 nt, Human
gcagaguugaagacag

SEQ ID NO: 3064267 - RNA, 17 nt, Human
gcagaguugaagacaga

SEQ ID NO: 3064268 - RNA, 19 nt, Human
gcagaguugaagacagagc

SEQ ID NO: 3064269 - RNA, 17 nt, Human
gcagagaccaucccuga

SEQ ID NO: 3064270 - RNA, 14 nt, Human
gcagagaccauccc

SEQ ID NO: 3064271 - RNA, 15 nt, Human
gcagagaccaucccu

SEQ ID NO: 3064272 - RNA, 15 nt, Human
gcagaguugaagaca

SEQ ID NO: 3064273 - RNA, 23 nt, Human
gcagagaaugaaagggcccagag

SEQ ID NO: 3064274 - RNA, 22 nt, Human
gcagagaaugaaagggcccaga

SEQ ID NO: 3064275 - RNA, 21 nt, Human
gcagagaauucucuuauccaa

SEQ ID NO: 3064276 - RNA, 21 nt, Human
gcagagaaugaaagggcccag

SEQ ID NO: 3064277 - RNA, 20 nt, Human
gcagagaaugaaagggccca

SEQ ID NO: 3064278 - RNA, 19 nt, Human
gcagagaaugaaagggccc

SEQ ID NO: 3064279 - RNA, 21 nt, Human
gcaggaguuucguuuucaaaa

SEQ ID NO: 3064280 - RNA, 20 nt, Human
gcaggaguuucguuuucaaa

SEQ ID NO: 3064281 - RNA, 14 nt, Human
gcagccuggacccu

SEQ ID NO: 3064282 - RNA, 22 nt, Human
gcagccucaaccuccugggcua

SEQ ID NO: 3064283 - RNA, 21 nt, Human
gcagccucaaccuccugggcu

SEQ ID NO: 3064284 - RNA, 20 nt, Human
gcagccucaaccuccugggc

SEQ ID NO: 3064285 - RNA, 19 nt, Human
gcagccucaaccuccuggg

SEQ ID NO: 3064286 - RNA, 20 nt, Human
gcagcagggagggcuucugc

SEQ ID NO: 3064287 - RNA, 19 nt, Human
gcacagcuaacauggaagu

SEQ ID NO: 3064288 - RNA, 13 nt, Human
gcaaugaccuuuc

SEQ ID NO: 3064289 - RNA, 14 nt, Human
gcaaugaccuuuca

SEQ ID NO: 3064290 - RNA, 18 nt, Human
gcacagccucuuagaugc

SEQ ID NO: 3064291 - RNA, 20 nt, Human
gcacagccucuuagaugcag

SEQ ID NO: 3064292 - RNA, 22 nt, Human
gcacaugccucucucaggccaa

SEQ ID NO: 3064293 - RNA, 16 nt, Human
gcacagcuucauuucc

SEQ ID NO: 3064294 - RNA, 19 nt, Human
gcaccacugcacuccagcc

SEQ ID NO: 3064295 - RNA, 15 nt, Human
gcaccuccugccucg

SEQ ID NO: 3064296 - RNA, 14 nt, Human
gcaccuccugccuc

SEQ ID NO: 3064297 - RNA, 17 nt, Human
gcacccggccccugcug

SEQ ID NO: 3064298 - RNA, 15 nt, Human
gcacccggccccugc

SEQ ID NO: 3064299 - RNA, 14 nt, Human
gcacccggccccug

SEQ ID NO: 3064300 - RNA, 13 nt, Human
gcagaaggaagac

SEQ ID NO: 3064301 - RNA, 14 nt, Human
gcagaaggaagacu

SEQ ID NO: 3064302 - RNA, 12 nt, Human
gcagaaggaaga

SEQ ID NO: 3064303 - RNA, 14 nt, Human
gcagaagacaguau

SEQ ID NO: 3064304 - RNA, 22 nt, Human
gcacugggcuuggggaccagag

SEQ ID NO: 3064305 - RNA, 23 nt, Human
gcacugggcuuggggaccagagc

SEQ ID NO: 3064306 - RNA, 14 nt, Human
gcacugggcuuggg

SEQ ID NO: 3064307 - RNA, 15 nt, Human
gcacugucaagauga

SEQ ID NO: 3064308 - RNA, 18 nt, Human
gcacuaaggugugcucug

SEQ ID NO: 3064309 - RNA, 17 nt, Human
gcacuaaggugugcucu

SEQ ID NO: 3064310 - RNA, 18 nt, Human
gcaaacuuuauuuugugu

SEQ ID NO: 3064311 - RNA, 15 nt, Human
gcaaaccaucauuga

SEQ ID NO: 3064312 - RNA, 17 nt, Human
gcaaaccaucauugaaa

SEQ ID NO: 3064313 - RNA, 19 nt, Human
gcaaaccaucauugaaauc

SEQ ID NO: 3064314 - RNA, 20 nt, Human
gcaaaccaucauugaaaucu

SEQ ID NO: 3064315 - RNA, 21 nt, Human
gcaaaccaucauugaaaucuu

SEQ ID NO: 3064316 - RNA, 16 nt, Human
gcaaaccaucauugaa

SEQ ID NO: 3064317 - RNA, 20 nt, Human
gcaaacuuuauuuuguguuu

SEQ ID NO: 3064318 - RNA, 12 nt, Human
gcaaaugugaau

SEQ ID NO: 3064319 - RNA, 18 nt, Human
gcaacugcauuggcuuug

SEQ ID NO: 3064320 - RNA, 22 nt, Human
gcaacuuuguauaaaagggacu

SEQ ID NO: 3064321 - RNA, 16 nt, Human
gcaagaugugggcagu

SEQ ID NO: 3064322 - RNA, 12 nt, Human
gcaagauguggg

SEQ ID NO: 3064323 - RNA, 16 nt, Human
gcaagcaccuccugcc

SEQ ID NO: 3064324 - RNA, 15 nt, Human
gcaagcaccuccugc

SEQ ID NO: 3064325 - RNA, 20 nt, Human
gcaagcaccuccugccucga

SEQ ID NO: 3064326 - RNA, 18 nt, Human
gcaagcaccuccugccuc

SEQ ID NO: 3064327 - RNA, 14 nt, Human
gcaaggcugucaau

SEQ ID NO: 3064328 - RNA, 18 nt, Human
gcaaggcugucaauuaca

SEQ ID NO: 3064329 - RNA, 14 nt, Human
gcaaggucauuuuu

SEQ ID NO: 3064330 - RNA, 13 nt, Human
gcaaggcugucaa

SEQ ID NO: 3064331 - RNA, 17 nt, Human
gcaauccugcaagaaca

SEQ ID NO: 3064332 - RNA, 16 nt, Human
gauugggaauccgccc

SEQ ID NO: 3064333 - RNA, 21 nt, Human
gauuucuguuuagauaauaca

SEQ ID NO: 3064334 - RNA, 22 nt, Human
gauuucuguuuagauaauacac

SEQ ID NO: 3064335 - RNA, 19 nt, Human
gauuuguuaaugauagcua

SEQ ID NO: 3064336 - RNA, 19 nt, Human
gauucuuuccugaggcugg

SEQ ID NO: 3064337 - RNA, 17 nt, Human
gauucccaagcucugcu

SEQ ID NO: 3064338 - RNA, 16 nt, Human
gauucccaagcucugc

SEQ ID NO: 3064339 - RNA, 20 nt, Human
gauucuuuccugaggcuggg

SEQ ID NO: 3064340 - RNA, 22 nt, Human
gauucuuuccugaggcugggcu

SEQ ID NO: 3064341 - RNA, 16 nt, Human
gauugcaacaggcugg

SEQ ID NO: 3064342 - RNA, 18 nt, Human
gauugcaacaggcugggc

SEQ ID NO: 3064343 - RNA, 17 nt, Human
gauugcaacaggcuggg

SEQ ID NO: 3064344 - RNA, 15 nt, Human
gauugcaacaggcug

SEQ ID NO: 3064345 - RNA, 18 nt, Human
gauguucuagcauggcug

SEQ ID NO: 3064346 - RNA, 16 nt, Human
gaugcuagaacucccu

SEQ ID NO: 3064347 - RNA, 14 nt, Human
gauuaaguaaugau

SEQ ID NO: 3064348 - RNA, 22 nt, Human
gauuaaguaaugauaacuggaa

SEQ ID NO: 3064349 - RNA, 13 nt, Human
gauucagacagcu

SEQ ID NO: 3064350 - RNA, 14 nt, Human
gauucagacagcug

SEQ ID NO: 3064351 - RNA, 17 nt, Human
gauucagacagcugccu

SEQ ID NO: 3064352 - RNA, 18 nt, Human
gauucagacagcugccug

SEQ ID NO: 3064353 - RNA, 21 nt, Human
gauuacaagcgugagccacug

SEQ ID NO: 3064354 - RNA, 13 nt, Human
gauuacaagcgug

SEQ ID NO: 3064355 - RNA, 15 nt, Human
gauucccaagcucug

SEQ ID NO: 3064356 - RNA, 11 nt, Human
gaguucuacau

SEQ ID NO: 3064357 - RNA, 24 nt, Human
gauaauacaccacuacauucuguu

SEQ ID NO: 3064358 - RNA, 23 nt, Human
gauaauacaccacuacauucugu

SEQ ID NO: 3064359 - RNA, 12 nt, Human
gauaauacacca

SEQ ID NO: 3064360 - RNA, 13 nt, Human
gauaaacaguagu

SEQ ID NO: 3064361 - RNA, 22 nt, Human
gauaaauggcuuccuggcaaua

SEQ ID NO: 3064362 - RNA, 20 nt, Human
gaucacggcucacugcagcc

SEQ ID NO: 3064363 - RNA, 23 nt, Human
gaucacggcucacugcagccuca

SEQ ID NO: 3064364 - RNA, 23 nt, Human
gaucagcuuauugucuagugaaa

SEQ ID NO: 3064365 - RNA, 14 nt, Human
gaucacagccucug

SEQ ID NO: 3064366 - RNA, 18 nt, Human
gauauaugcucugcaugu

SEQ ID NO: 3064367 - RNA, 20 nt, Human
gauagugucccacggugccu

SEQ ID NO: 3064368 - RNA, 16 nt, Human
gauacaaaagcaugug

SEQ ID NO: 3064369 - RNA, 21 nt, Human
gaugaaaugaggucagagccu

SEQ ID NO: 3064370 - RNA, 15 nt, Human
gaugaaaugagguca

SEQ ID NO: 3064371 - RNA, 19 nt, Human
gaucuucuuuauaauucua

SEQ ID NO: 3064372 - RNA, 22 nt, Human
gaucuucuguggguuucuaaag

SEQ ID NO: 3064373 - RNA, 23 nt, Human
gaugcaccagcccuuagcaggga

SEQ ID NO: 3064374 - RNA, 15 nt, Human
gaugcaccagcccuu

SEQ ID NO: 3064375 - RNA, 14 nt, Human
gaugagaggaaauc

SEQ ID NO: 3064376 - RNA, 14 nt, Human
gaugcaccagcccu

SEQ ID NO: 3064377 - RNA, 23 nt, Human
gaugagaaauaaaguuucuguug

SEQ ID NO: 3064378 - RNA, 18 nt, Human
gaugaccuugaaugaugc

SEQ ID NO: 3064379 - RNA, 16 nt, Human
gaugccugguggcagc

SEQ ID NO: 3064380 - RNA, 15 nt, Human
gaugccugguggcag

SEQ ID NO: 3064381 - RNA, 14 nt, Human
gaugcagugcuucc

SEQ ID NO: 3064382 - RNA, 14 nt, Human
gaugccugguggca

SEQ ID NO: 3064383 - RNA, 19 nt, Human
gaugcagccucacaguccu

SEQ ID NO: 3064384 - RNA, 12 nt, Human
gauccugagcca

SEQ ID NO: 3064385 - RNA, 13 nt, Human
gauccuggaaauc

SEQ ID NO: 3064386 - RNA, 14 nt, Human
gauccuggaaauca

SEQ ID NO: 3064387 - RNA, 20 nt, Human
gaucuaggaagacuuuggaa

SEQ ID NO: 3064388 - RNA, 14 nt, Human
gaucuaggaagacu

SEQ ID NO: 3064389 - RNA, 18 nt, Human
gaucuaggaagacuuugg

SEQ ID NO: 3064390 - RNA, 13 nt, Human
gaucuaggaagac

SEQ ID NO: 3064391 - RNA, 17 nt, Human
gauccucccaccucagc

SEQ ID NO: 3064392 - RNA, 21 nt, Human
gauccucccaccucagccucc

SEQ ID NO: 3064393 - RNA, 14 nt, Human
gauccuccaggugc

SEQ ID NO: 3064394 - RNA, 16 nt, Human
gauccucccaccucag

SEQ ID NO: 3064395 - RNA, 13 nt, Human
gaucauccacugu

SEQ ID NO: 3064396 - RNA, 17 nt, Human
gacauaaaaacaacuuu

SEQ ID NO: 3064397 - RNA, 16 nt, Human
gacaucaacugcauca

SEQ ID NO: 3064398 - RNA, 14 nt, Human
gacaucaacagaua

SEQ ID NO: 3064399 - RNA, 23 nt, Human
gacaucaacugcaucaagaugug

SEQ ID NO: 3064400 - RNA, 22 nt, Human
gacaggcauguucucugaggac

SEQ ID NO: 3064401 - RNA, 22 nt, Human
gacaguuaagagaaaugagcuu

SEQ ID NO: 3064402 - RNA, 18 nt, Human
gacaggcaagcaccuccu

SEQ ID NO: 3064403 - RNA, 17 nt, Human
gacaggcaagcaccucc

SEQ ID NO: 3064404 - RNA, 13 nt, Human
gacaggcaagcac

SEQ ID NO: 3064405 - RNA, 23 nt, Human
gacaggaugguucccuugaugaa

SEQ ID NO: 3064406 - RNA, 19 nt, Human
gacaggcaaugcuggcugu

SEQ ID NO: 3064407 - RNA, 18 nt, Human
gacaggcaaugcuggcug

SEQ ID NO: 3064408 - RNA, 20 nt, Human
gacaggcaagcaccuccugc

SEQ ID NO: 3064409 - RNA, 21 nt, Human
gacaggcauguucucugagga

SEQ ID NO: 3064410 - RNA, 20 nt, Human
gacaggcauguucucugagg

SEQ ID NO: 3064411 - RNA, 23 nt, Human
gacaggcaaugcuggcuguuggc

SEQ ID NO: 3064412 - RNA, 22 nt, Human
gaauuucccaaagcagugcaug

SEQ ID NO: 3064413 - RNA, 16 nt, Human
gaauuucccaaagcag

SEQ ID NO: 3064414 - RNA, 18 nt, Human
gaauuucccaaagcagug

SEQ ID NO: 3064415 - RNA, 22 nt, Human
gacacgaauauugcugauggug

SEQ ID NO: 3064416 - RNA, 22 nt, Human
gacagacacaggcccggcucca

SEQ ID NO: 3064417 - RNA, 20 nt, Human
gacagacacaggcccggcuc

SEQ ID NO: 3064418 - RNA, 16 nt, Human
gacacuagaagauuuu

SEQ ID NO: 3064419 - RNA, 17 nt, Human
gacagacacaggcccgg

SEQ ID NO: 3064420 - RNA, 16 nt, Human
gacagagugagacucu

SEQ ID NO: 3064421 - RNA, 21 nt, Human
gacagagucucacuguugccc

SEQ ID NO: 3064422 - RNA, 23 nt, Human
gacagaggcagccccauucugcc

SEQ ID NO: 3064423 - RNA, 14 nt, Human
gacagagucucacu

SEQ ID NO: 3064424 - RNA, 20 nt, Human
gacagagcuacacaggggaa

SEQ ID NO: 3064425 - RNA, 21 nt, Human
gacagagccccacccucagau

SEQ ID NO: 3064426 - RNA, 10 nt, Human
gacccugagg

SEQ ID NO: 3064427 - RNA, 11 nt, Human
gacccugaggc

SEQ ID NO: 3064428 - RNA, 12 nt, Human
gacccugaggcc

SEQ ID NO: 3064429 - RNA, 16 nt, Human
gacccugaggcccaga

SEQ ID NO: 3064430 - RNA, 17 nt, Human
gacccugcccugugggc

SEQ ID NO: 3064431 - RNA, 20 nt, Human
gacccugcccugugggcccc

SEQ ID NO: 3064432 - RNA, 22 nt, Human
gacccugcccugugggccccca

SEQ ID NO: 3064433 - RNA, 17 nt, Human
gacccaugcugcccugu

SEQ ID NO: 3064434 - RNA, 15 nt, Human
gaccccacuccggcc

SEQ ID NO: 3064435 - RNA, 17 nt, Human
gaccccacuccggcccu

SEQ ID NO: 3064436 - RNA, 22 nt, Human
gaccccacuccggcccuccaga

SEQ ID NO: 3064437 - RNA, 12 nt, Human
gacccacugcuu

SEQ ID NO: 3064438 - RNA, 18 nt, Human
gacccaaaaggcagaagc

SEQ ID NO: 3064439 - RNA, 19 nt, Human
gacccaaaaggcagaagca

SEQ ID NO: 3064440 - RNA, 19 nt, Human
gacccaugcugcccuguga

SEQ ID NO: 3064441 - RNA, 20 nt, Human
gacccaugcugcccugugag

SEQ ID NO: 3064442 - RNA, 18 nt, Human
gacccaugcugcccugug

SEQ ID NO: 3064443 - RNA, 18 nt, Human
gaccacaaaacuuuucua

SEQ ID NO: 3064444 - RNA, 21 nt, Human
gaccagacaccuugacagggc

SEQ ID NO: 3064445 - RNA, 22 nt, Human
gaccagacaccuugacagggca

SEQ ID NO: 3064446 - RNA, 16 nt, Human
gaccacugcagaagac

SEQ ID NO: 3064447 - RNA, 16 nt, Human
gaccacguuucuaaag

SEQ ID NO: 3064448 - RNA, 20 nt, Human
gaccagcaccaucucuccuc

SEQ ID NO: 3064449 - RNA, 21 nt, Human
gaccagcaccaucucuccucc

SEQ ID NO: 3064450 - RNA, 23 nt, Human
gaccagacaccuugacagggcac

SEQ ID NO: 3064451 - RNA, 21 nt, Human
gaccagagcugccaccugccu

SEQ ID NO: 3064452 - RNA, 13 nt, Human
gacugagaaauuu

SEQ ID NO: 3064453 - RNA, 19 nt, Human
gacugagggggccuggaug

SEQ ID NO: 3064454 - RNA, 17 nt, Human
gacugagggggccugga

SEQ ID NO: 3064455 - RNA, 18 nt, Human
gacugagggggccuggau

SEQ ID NO: 3064456 - RNA, 15 nt, Human
gacugagggggccug

SEQ ID NO: 3064457 - RNA, 16 nt, Human
gacugagggggccugg

SEQ ID NO: 3064458 - RNA, 16 nt, Human
gacugaggggagggga

SEQ ID NO: 3064459 - RNA, 24 nt, Human
gacugcauuauauuuauuacugua

SEQ ID NO: 3064460 - RNA, 11 nt, Human
gacugagaaau

SEQ ID NO: 3064461 - RNA, 16 nt, Human
gacugaauuucuuuug

SEQ ID NO: 3064462 - RNA, 21 nt, Human
gacucuacagaggccaugggc

SEQ ID NO: 3064463 - RNA, 15 nt, Human
gacucuacagaggcc

SEQ ID NO: 3064464 - RNA, 18 nt, Human
gacuccugcaggcagcca

SEQ ID NO: 3064465 - RNA, 19 nt, Human
gacuccugcaggcagccag

SEQ ID NO: 3064466 - RNA, 20 nt, Human
gacuccugcaggcagccagg

SEQ ID NO: 3064467 - RNA, 15 nt, Human
gacuacaggcaccca

SEQ ID NO: 3064468 - RNA, 13 nt, Human
gacuacaggcacc

SEQ ID NO: 3064469 - RNA, 18 nt, Human
gacuacaggcacccacca

SEQ ID NO: 3064470 - RNA, 12 nt, Human
gacuucaucccu

SEQ ID NO: 3064471 - RNA, 20 nt, Human
gacuucaucccucuggggcu

SEQ ID NO: 3064472 - RNA, 12 nt, Human
gacuuacuguac

SEQ ID NO: 3064473 - RNA, 16 nt, Human
gacuuacuguacauga

SEQ ID NO: 3064474 - RNA, 15 nt, Human
gacuuacuguacaug

SEQ ID NO: 3064475 - RNA, 23 nt, Human
gacuuacuguacaugaaaacaca

SEQ ID NO: 3064476 - RNA, 18 nt, Human
gacuuacuguacaugaaa

SEQ ID NO: 3064477 - RNA, 23 nt, Human
gacuggccaagguuuggggaaga

SEQ ID NO: 3064478 - RNA, 22 nt, Human
gacuggauaguccgucucugcu

SEQ ID NO: 3064479 - RNA, 16 nt, Human
gacuggauaguccguc

SEQ ID NO: 3064480 - RNA, 17 nt, Human
gacuggauaguccgucu

SEQ ID NO: 3064481 - RNA, 14 nt, Human
gacuggcacaguuu

SEQ ID NO: 3064482 - RNA, 22 nt, Human
gacuggcacaguuuucugagaa

SEQ ID NO: 3064483 - RNA, 18 nt, Human
gacuggcacaguuuucug

SEQ ID NO: 3064484 - RNA, 20 nt, Human
gaccuucuccuucaccuuug

SEQ ID NO: 3064485 - RNA, 21 nt, Human
gaccuucuccuucaccuuugu

SEQ ID NO: 3064486 - RNA, 14 nt, Human
gaccuugaacuggg

SEQ ID NO: 3064487 - RNA, 15 nt, Human
gaccuucuccuucac

SEQ ID NO: 3064488 - RNA, 16 nt, Human
gaccuucuccuucacc

SEQ ID NO: 3064489 - RNA, 14 nt, Human
gaccuucuccuuca

SEQ ID NO: 3064490 - RNA, 20 nt, Human
gacccuugccgucuaccuga

SEQ ID NO: 3064491 - RNA, 23 nt, Human
gacccuugccgucuaccugaggg

SEQ ID NO: 3064492 - RNA, 19 nt, Human
gacccuugccgucuaccug

SEQ ID NO: 3064493 - RNA, 16 nt, Human
gacuaacuugucuuug

SEQ ID NO: 3064494 - RNA, 23 nt, Human
gacuaacuugucuuuggacccug

SEQ ID NO: 3064495 - RNA, 11 nt, Human
gacguguuaug

SEQ ID NO: 3064496 - RNA, 14 nt, Human
gacguguuaugacu

SEQ ID NO: 3064497 - RNA, 22 nt, Human
gaccuuuaagagaaaugagcug

SEQ ID NO: 3064498 - RNA, 11 nt, Human
gaccuuucaau

SEQ ID NO: 3064499 - RNA, 19 nt, Human
gaccuuucaauaggaaaaa

SEQ ID NO: 3064500 - RNA, 20 nt, Human
gaccuuucaauaggaaaaac

SEQ ID NO: 3064501 - RNA, 22 nt, Human
gacgcugugcugcccugcccac

SEQ ID NO: 3064502 - RNA, 21 nt, Human
gacgcugugcugcccugccca

SEQ ID NO: 3064503 - RNA, 13 nt, Human
gacggagucccac

SEQ ID NO: 3064504 - RNA, 23 nt, Human
gacggagucccaccuuggcugca

SEQ ID NO: 3064505 - RNA, 20 nt, Human
gaagauaauauuaaggaaga

SEQ ID NO: 3064506 - RNA, 20 nt, Human
gaagagguuuuaaagcuucc

SEQ ID NO: 3064507 - RNA, 15 nt, Human
gaagauacugaaaua

SEQ ID NO: 3064508 - RNA, 17 nt, Human
gaagauguagaggagaa

SEQ ID NO: 3064509 - RNA, 18 nt, Human
gaagauguagaggagaaa

SEQ ID NO: 3064510 - RNA, 17 nt, Human
gaagcauuuacuuugug

SEQ ID NO: 3064511 - RNA, 20 nt, Human
gaagccagcaggcucucagg

SEQ ID NO: 3064512 - RNA, 19 nt, Human
gaagccagcaggcucucag

SEQ ID NO: 3064513 - RNA, 21 nt, Human
gaagccagcaggcucucaggc

SEQ ID NO: 3064514 - RNA, 22 nt, Human
gaagccagcaggcucucaggcc

SEQ ID NO: 3064515 - RNA, 13 nt, Human
gaagcccaggaaa

SEQ ID NO: 3064516 - RNA, 15 nt, Human
gaagcccaggaaagg

SEQ ID NO: 3064517 - RNA, 16 nt, Human
gaagcccaggaaaggc

SEQ ID NO: 3064518 - RNA, 19 nt, Human
gaagcccaggaaaggcucc

SEQ ID NO: 3064519 - RNA, 23 nt, Human
gaagcccuucuaccuuccugcaa

SEQ ID NO: 3064520 - RNA, 23 nt, Human
gaagcccaggaaaggcuccagga

SEQ ID NO: 3064521 - RNA, 20 nt, Human
gaacucaucuagguaaauua

SEQ ID NO: 3064522 - RNA, 21 nt, Human
gaacucaucuagguaaauuac

SEQ ID NO: 3064523 - RNA, 23 nt, Human
gaacuuugaccucugcagcaaua

SEQ ID NO: 3064524 - RNA, 11 nt, Human
gaagacuuugg

SEQ ID NO: 3064525 - RNA, 13 nt, Human
gaagacuuuggaa

SEQ ID NO: 3064526 - RNA, 17 nt, Human
gaagacugcauuauauu

SEQ ID NO: 3064527 - RNA, 12 nt, Human
gaagaacugaaa

SEQ ID NO: 3064528 - RNA, 19 nt, Human
gaagacugcauuauauuua

SEQ ID NO: 3064529 - RNA, 19 nt, Human
gaagagaaugcacaaacag

SEQ ID NO: 3064530 - RNA, 14 nt, Human
gaagacuuuggaaa

SEQ ID NO: 3064531 - RNA, 17 nt, Human
gaagacuuuggaaagag

SEQ ID NO: 3064532 - RNA, 20 nt, Human
gaagacuuuucuuucagcca

SEQ ID NO: 3064533 - RNA, 14 nt, Human
gaacuacugaggau

SEQ ID NO: 3064534 - RNA, 22 nt, Human
gaaccuuuugagugccuuacac

SEQ ID NO: 3064535 - RNA, 19 nt, Human
gaaccuuuugagugccuua

SEQ ID NO: 3064536 - RNA, 21 nt, Human
gaaccuuuugagugccuuaca

SEQ ID NO: 3064537 - RNA, 18 nt, Human
gaaccuuuugagugccuu

SEQ ID NO: 3064538 - RNA, 16 nt, Human
gaacagugauuaccag

SEQ ID NO: 3064539 - RNA, 20 nt, Human
gaacagugauuaccagggac

SEQ ID NO: 3064540 - RNA, 15 nt, Human
gaacacucugagacu

SEQ ID NO: 3064541 - RNA, 14 nt, Human
gaacaucacagcuu

SEQ ID NO: 3064542 - RNA, 15 nt, Human
gaacauaaaauacaa

SEQ ID NO: 3064543 - RNA, 17 nt, Human
gaaauuuauaaacuuuu

SEQ ID NO: 3064544 - RNA, 16 nt, Human
gaaauuuauaaacuuu

SEQ ID NO: 3064545 - RNA, 13 nt, Human
gaacacucugaga

SEQ ID NO: 3064546 - RNA, 14 nt, Human
gaacacucugagac

SEQ ID NO: 3064547 - RNA, 16 nt, Human
gaaauuguauuacaaa

SEQ ID NO: 3064548 - RNA, 23 nt, Human
gaauucuugaaggaaaaugauac

SEQ ID NO: 3064549 - RNA, 19 nt, Human
gaauucucuaguuugauua

SEQ ID NO: 3064550 - RNA, 14 nt, Human
gaauugaaaaacca

SEQ ID NO: 3064551 - RNA, 17 nt, Human
gaauucucagaaucuca

SEQ ID NO: 3064552 - RNA, 17 nt, Human
gaauucucuaguuugau

SEQ ID NO: 3064553 - RNA, 20 nt, Human
gaaugucagugugacugauc

SEQ ID NO: 3064554 - RNA, 21 nt, Human
gaaugucagugugacugaucu

SEQ ID NO: 3064555 - RNA, 23 nt, Human
gaauuguguuuauaauuuuaaau

SEQ ID NO: 3064556 - RNA, 15 nt, Human
gaauuguguuuauaa

SEQ ID NO: 3064557 - RNA, 22 nt, Human
gaauuuaaauagcuuuuuucuc

SEQ ID NO: 3064558 - RNA, 22 nt, Human
gaauuguaaggaaugauuaauu

SEQ ID NO: 3064559 - RNA, 15 nt, Human
gaauuucccaaagca

SEQ ID NO: 3064560 - RNA, 14 nt, Human
gaaugucaguguga

SEQ ID NO: 3064561 - RNA, 22 nt, Human
gaaugguuuucaaaauaaaaau

SEQ ID NO: 3064562 - RNA, 23 nt, Human
gaaugaaccacaucuugcucugc

SEQ ID NO: 3064563 - RNA, 18 nt, Human
gaaugaaccacaucuugc

SEQ ID NO: 3064564 - RNA, 22 nt, Human
gaaugaaccacaucuugcucug

SEQ ID NO: 3064565 - RNA, 11 nt, Human
gaaugcagugg

SEQ ID NO: 3064566 - RNA, 19 nt, Human
gaaugaagauacugaaaua

SEQ ID NO: 3064567 - RNA, 17 nt, Human
gaaugaagauacugaaa

SEQ ID NO: 3064568 - RNA, 18 nt, Human
gaaugaagauacugaaau

SEQ ID NO: 3064569 - RNA, 21 nt, Human
gaaugaagauacugaaauaaa

SEQ ID NO: 3064570 - RNA, 16 nt, Human
gaauauuuuaacuucc

SEQ ID NO: 3064571 - RNA, 22 nt, Human
gaauagcugggacuacaggugu

SEQ ID NO: 3064572 - RNA, 20 nt, Human
gaauacucuuauaucuauau

SEQ ID NO: 3064573 - RNA, 23 nt, Human
gaauagcugggacuacaggugug

SEQ ID NO: 3064574 - RNA, 15 nt, Human
gaauaccuguccccc

SEQ ID NO: 3064575 - RNA, 13 nt, Human
gaauaccuguccc

SEQ ID NO: 3064576 - RNA, 21 nt, Human
gaauaccccaagacucccaug

SEQ ID NO: 3064577 - RNA, 17 nt, Human
gaauaauacaguaucuc

SEQ ID NO: 3064578 - RNA, 21 nt, Human
gaauacagaggcaacugcauu

SEQ ID NO: 3064579 - RNA, 19 nt, Human
gaauaacauguaauuaagu

SEQ ID NO: 3064580 - RNA, 18 nt, Human
gaauaacauguaauuaag

SEQ ID NO: 3064581 - RNA, 20 nt, Human
gaaguuugagaucagccugg

SEQ ID NO: 3064582 - RNA, 16 nt, Human
gaagggggcugggaca

SEQ ID NO: 3064583 - RNA, 19 nt, Human
gaagggggcugggacaugg

SEQ ID NO: 3064584 - RNA, 14 nt, Human
gaagcggcuggcag

SEQ ID NO: 3064585 - RNA, 15 nt, Human
gaagggggcugggac

SEQ ID NO: 3064586 - RNA, 22 nt, Human
gaaguaauaugcacacauuuuu

SEQ ID NO: 3064587 - RNA, 21 nt, Human
gaaguaauaugcacacauuuu

SEQ ID NO: 3064588 - RNA, 15 nt, Human
gaaguacuggagaaa

SEQ ID NO: 3064589 - RNA, 18 nt, Human
gaaguacuauaauuuacc

SEQ ID NO: 3064590 - RNA, 21 nt, Human
gaaguuucugccgcagcccug

SEQ ID NO: 3064591 - RNA, 15 nt, Human
gaagucuuagaugua

SEQ ID NO: 3064592 - RNA, 20 nt, Human
gaaguuucugccgcagcccu

SEQ ID NO: 3064593 - RNA, 12 nt, Human
gaaguccaagca

SEQ ID NO: 3064594 - RNA, 22 nt, Human
gaaguccaagcauuuagaugua

SEQ ID NO: 3064595 - RNA, 14 nt, Human
gaaguauccuucag

SEQ ID NO: 3064596 - RNA, 16 nt, Human
gaaguauccuucagcc

SEQ ID NO: 3064597 - RNA, 17 nt, Human
cuuguacuuuauuuucu

SEQ ID NO: 3064598 - RNA, 15 nt, Human
cuugguuuguaaauu

SEQ ID NO: 3064599 - RNA, 14 nt, Human
cuugguuuguaaau

SEQ ID NO: 3064600 - RNA, 18 nt, Human
cuuggggcugaugcaguu

SEQ ID NO: 3064601 - RNA, 16 nt, Human
cuuggggcugaugcag

SEQ ID NO: 3064602 - RNA, 16 nt, Human
cuuggacucauuuuaa

SEQ ID NO: 3064603 - RNA, 18 nt, Human
cuugggccacugugaaga

SEQ ID NO: 3064604 - RNA, 20 nt, Human
cuugggccacugugaagaga

SEQ ID NO: 3064605 - RNA, 16 nt, Human
cuuguuaagauaguua

SEQ ID NO: 3064606 - RNA, 16 nt, Human
cuuguggucccacccc

SEQ ID NO: 3064607 - RNA, 19 nt, Human
cuuguggucccaccccaca

SEQ ID NO: 3064608 - RNA, 15 nt, Human
cuuguggucccaccc

SEQ ID NO: 3064609 - RNA, 15 nt, Human
cuugucggccccacc

SEQ ID NO: 3064610 - RNA, 20 nt, Human
cuugucggccccaccagugc

SEQ ID NO: 3064611 - RNA, 21 nt, Human
cuugucggccccaccagugcc

SEQ ID NO: 3064612 - RNA, 22 nt, Human
cuugucggccccaccagugccu

SEQ ID NO: 3064613 - RNA, 20 nt, Human
cuuuaccuuuuuuauacaua

SEQ ID NO: 3064614 - RNA, 19 nt, Human
cuuuaccuuuuuuauacau

SEQ ID NO: 3064615 - RNA, 17 nt, Human
cuuuaccuuuuuuauac

SEQ ID NO: 3064616 - RNA, 20 nt, Human
cuugcuugauuguauggugg

SEQ ID NO: 3064617 - RNA, 14 nt, Human
cuuggaagcuccgc

SEQ ID NO: 3064618 - RNA, 20 nt, Human
cuuggaagcuccgcuuucua

SEQ ID NO: 3064619 - RNA, 20 nt, Human
cuugcuucaaccccaugaga

SEQ ID NO: 3064620 - RNA, 18 nt, Human
cuugcucuugaugccugg

SEQ ID NO: 3064621 - RNA, 17 nt, Human
cuugcucuugaugccug

SEQ ID NO: 3064622 - RNA, 19 nt, Human
cuugcucuugaugccuggc

SEQ ID NO: 3064623 - RNA, 22 nt, Human
cuugcucugcugacagacacag

SEQ ID NO: 3064624 - RNA, 17 nt, Human
cuugcucugcugacaga

SEQ ID NO: 3064625 - RNA, 22 nt, Human
cuugcccuguuaaaagaugaaa

SEQ ID NO: 3064626 - RNA, 13 nt, Human
cuugcaugaggcu

SEQ ID NO: 3064627 - RNA, 14 nt, Human
cuugcaugaggcua

SEQ ID NO: 3064628 - RNA, 18 nt, Human
cuugcccagccuggaugc

SEQ ID NO: 3064629 - RNA, 18 nt, Human
cuugcccuggugccucac

SEQ ID NO: 3064630 - RNA, 14 nt, Human
cuugcccuguuaaa

SEQ ID NO: 3064631 - RNA, 12 nt, Human
cuugagccuggg

SEQ ID NO: 3064632 - RNA, 15 nt, Human
cuugagccugggagg

SEQ ID NO: 3064633 - RNA, 17 nt, Human
cuugaggguugggcugg

SEQ ID NO: 3064634 - RNA, 15 nt, Human
cuugaggguugggcu

SEQ ID NO: 3064635 - RNA, 20 nt, Human
cuugaguugauucagcucug

SEQ ID NO: 3064636 - RNA, 18 nt, Human
cuugaguugauucagcuc

SEQ ID NO: 3064637 - RNA, 19 nt, Human
cuugaguugauucagcucu

SEQ ID NO: 3064638 - RNA, 18 nt, Human
cuugcaauggcagccuug

SEQ ID NO: 3064639 - RNA, 17 nt, Human
cuugcaauggcagccuu

SEQ ID NO: 3064640 - RNA, 16 nt, Human
cuugcaauggcagccu

SEQ ID NO: 3064641 - RNA, 15 nt, Human
cuugcaauggcagcc

SEQ ID NO: 3064642 - RNA, 20 nt, Human
cuugcagacucuacagaggc

SEQ ID NO: 3064643 - RNA, 21 nt, Human
cuugcagacucuacagaggcc

SEQ ID NO: 3064644 - RNA, 23 nt, Human
cuugcaucaauuuuucuuauuuc

SEQ ID NO: 3064645 - RNA, 22 nt, Human
cuuugcauaacguauaaaagcc

SEQ ID NO: 3064646 - RNA, 19 nt, Human
cuuugacaaagguaaauca

SEQ ID NO: 3064647 - RNA, 14 nt, Human
cuuugcuugaaaga

SEQ ID NO: 3064648 - RNA, 23 nt, Human
cuuuggaaagacuuuuccaaccc

SEQ ID NO: 3064649 - RNA, 12 nt, Human
cuuuggaaagac

SEQ ID NO: 3064650 - RNA, 16 nt, Human
cuuuguucuggcucuu

SEQ ID NO: 3064651 - RNA, 21 nt, Human
cuuuguucuggcucuuccagg

SEQ ID NO: 3064652 - RNA, 12 nt, Human
cuuugugauuuu

SEQ ID NO: 3064653 - RNA, 19 nt, Human
cuuugugaggaagccgcug

SEQ ID NO: 3064654 - RNA, 13 nt, Human
cuuuguggcuucc

SEQ ID NO: 3064655 - RNA, 23 nt, Human
cuuugugaggaagccgcuggggc

SEQ ID NO: 3064656 - RNA, 23 nt, Human
cuuugggaggccaaggugggagg

SEQ ID NO: 3064657 - RNA, 17 nt, Human
cuuugacaaagguaaau

SEQ ID NO: 3064658 - RNA, 15 nt, Human
cuuuagcgcccaguu

SEQ ID NO: 3064659 - RNA, 19 nt, Human
cuuuccucaaaacuucaga

SEQ ID NO: 3064660 - RNA, 13 nt, Human
cuuucugaaauaa

SEQ ID NO: 3064661 - RNA, 20 nt, Human
gaaaaguauguuagugcaaa

SEQ ID NO: 3064662 - RNA, 14 nt, Human
gaaaaguauguuag

SEQ ID NO: 3064663 - RNA, 19 nt, Human
gaaaacaugcuacacacug

SEQ ID NO: 3064664 - RNA, 18 nt, Human
gaaaacaugcuacacacu

SEQ ID NO: 3064665 - RNA, 16 nt, Human
gaaaacaugcuacaca

SEQ ID NO: 3064666 - RNA, 20 nt, Human
gaaaacacuguucucugccc

SEQ ID NO: 3064667 - RNA, 21 nt, Human
gaaaacacuguucucugcccu

SEQ ID NO: 3064668 - RNA, 18 nt, Human
gaaaacacuguucucugc

SEQ ID NO: 3064669 - RNA, 19 nt, Human
gaaaacacuguucucugcc

SEQ ID NO: 3064670 - RNA, 16 nt, Human
cuuuuuuagaguugau

SEQ ID NO: 3064671 - RNA, 21 nt, Human
cuuuguuuguugucagcugaa

SEQ ID NO: 3064672 - RNA, 15 nt, Human
cuuuucuguuugcua

SEQ ID NO: 3064673 - RNA, 23 nt, Human
cuuuucuguccgagcuuugaaaa

SEQ ID NO: 3064674 - RNA, 20 nt, Human
cuuuuguucuugguuuguaa

SEQ ID NO: 3064675 - RNA, 22 nt, Human
cuuuuguucuugguuuguaaau

SEQ ID NO: 3064676 - RNA, 11 nt, Human
cuuaacuauuc

SEQ ID NO: 3064677 - RNA, 14 nt, Human
cuuaacuucacaua

SEQ ID NO: 3064678 - RNA, 12 nt, Human
cuuaacuucaca

SEQ ID NO: 3064679 - RNA, 22 nt, Human
cuuaacuucacauauugauuuc

SEQ ID NO: 3064680 - RNA, 17 nt, Human
cuuaacuucacauauug

SEQ ID NO: 3064681 - RNA, 16 nt, Human
cuuaacuucacauauu

SEQ ID NO: 3064682 - RNA, 15 nt, Human
cuuaacuucacauau

SEQ ID NO: 3064683 - RNA, 14 nt, Human
cuuaaucuaaaugg

SEQ ID NO: 3064684 - RNA, 18 nt, Human
cuuaaugccacuaaauug

SEQ ID NO: 3064685 - RNA, 12 nt, Human
cuguuuagauaa

SEQ ID NO: 3064686 - RNA, 18 nt, Human
cuguuuguuucugaaagg

SEQ ID NO: 3064687 - RNA, 18 nt, Human
cuguuuugaaucucauaa

SEQ ID NO: 3064688 - RNA, 17 nt, Human
cuguuuucucuugagag

SEQ ID NO: 3064689 - RNA, 13 nt, Human
cuguuuucucuug

SEQ ID NO: 3064690 - RNA, 14 nt, Human
cuguuuucucuuga

SEQ ID NO: 3064691 - RNA, 21 nt, Human
cuguuuguuucugaaagggac

SEQ ID NO: 3064692 - RNA, 23 nt, Human
cuguuuguuucugaaagggacgc

SEQ ID NO: 3064693 - RNA, 19 nt, Human
cuguuuuauaauuuuguga

SEQ ID NO: 3064694 - RNA, 15 nt, Human
cuuaugauugcagau

SEQ ID NO: 3064695 - RNA, 23 nt, Human
cuuauuguagcauccuggaauau

SEQ ID NO: 3064696 - RNA, 15 nt, Human
cuuauuuaaugaaag

SEQ ID NO: 3064697 - RNA, 14 nt, Human
cuuauaauuuaaaa

SEQ ID NO: 3064698 - RNA, 19 nt, Human
cuuauaggaauugacccac

SEQ ID NO: 3064699 - RNA, 13 nt, Human
cuuauaauuuaaa

SEQ ID NO: 3064700 - RNA, 17 nt, Human
cuuagguuggcaaaaag

SEQ ID NO: 3064701 - RNA, 21 nt, Human
cuuaggguuaugauuaaguaa

SEQ ID NO: 3064702 - RNA, 13 nt, Human
cuuacuguacaug

SEQ ID NO: 3064703 - RNA, 16 nt, Human
cuuacuguacaugaaa

SEQ ID NO: 3064704 - RNA, 19 nt, Human
cuuacuaguuucccuugca

SEQ ID NO: 3064705 - RNA, 15 nt, Human
cuuacgugaguccug

SEQ ID NO: 3064706 - RNA, 15 nt, Human
cuuagacagucccug

SEQ ID NO: 3064707 - RNA, 16 nt, Human
cuuagacagucccugc

SEQ ID NO: 3064708 - RNA, 14 nt, Human
cuuagacagucccu

SEQ ID NO: 3064709 - RNA, 15 nt, Human
cuuagaagucacaca

SEQ ID NO: 3064710 - RNA, 17 nt, Human
cuuagacagucccugcc

SEQ ID NO: 3064711 - RNA, 18 nt, Human
cuuagacagucccugcca

SEQ ID NO: 3064712 - RNA, 19 nt, Human
cuuagacagucccugccaa

SEQ ID NO: 3064713 - RNA, 11 nt, Human
cuuagacaguc

SEQ ID NO: 3064714 - RNA, 19 nt, Human
cuuagaugcaguucugaag

SEQ ID NO: 3064715 - RNA, 22 nt, Human
cuuccacaagagcccaggccuc

SEQ ID NO: 3064716 - RNA, 23 nt, Human
cuuccacaagagcccaggccucc

SEQ ID NO: 3064717 - RNA, 11 nt, Human
cuucagugccu

SEQ ID NO: 3064718 - RNA, 12 nt, Human
cuucagugccuu

SEQ ID NO: 3064719 - RNA, 13 nt, Human
cuucagugccuua

SEQ ID NO: 3064720 - RNA, 14 nt, Human
cuucagugccuuau

SEQ ID NO: 3064721 - RNA, 18 nt, Human
cuucauuuccugugucuu

SEQ ID NO: 3064722 - RNA, 11 nt, Human
cuucagcugac

SEQ ID NO: 3064723 - RNA, 16 nt, Human
cuucagcgguuuauau

SEQ ID NO: 3064724 - RNA, 18 nt, Human
cuucagcgguuuauauaa

SEQ ID NO: 3064725 - RNA, 21 nt, Human
cuuccaggggugggacacccu

SEQ ID NO: 3064726 - RNA, 22 nt, Human
cuuccaggggugggacacccug

SEQ ID NO: 3064727 - RNA, 24 nt, Human
cuuccaggggugggacacccugug

SEQ ID NO: 3064728 - RNA, 19 nt, Human
cuuccagauccuggaaauc

SEQ ID NO: 3064729 - RNA, 15 nt, Human
cuuccagugaggcuc

SEQ ID NO: 3064730 - RNA, 14 nt, Human
cuuccagugaggcu

SEQ ID NO: 3064731 - RNA, 15 nt, Human
cuucgcuccuguguc

SEQ ID NO: 3064732 - RNA, 14 nt, Human
cuucgcuccugugu

SEQ ID NO: 3064733 - RNA, 13 nt, Human
cuucgcuccugug

SEQ ID NO: 3064734 - RNA, 19 nt, Human
cuuccuuggacucauuuua

SEQ ID NO: 3064735 - RNA, 20 nt, Human
cuucgggaggucgaggcagg

SEQ ID NO: 3064736 - RNA, 21 nt, Human
cuucgggaggucgaggcagga

SEQ ID NO: 3064737 - RNA, 17 nt, Human
cuucggccuccauccug

SEQ ID NO: 3064738 - RNA, 18 nt, Human
cuucggccuccauccuga

SEQ ID NO: 3064739 - RNA, 17 nt, Human
cuucugccauauucugu

SEQ ID NO: 3064740 - RNA, 15 nt, Human
cuucugccauauucu

SEQ ID NO: 3064741 - RNA, 21 nt, Human
cuucugccauauucuguuggc

SEQ ID NO: 3064742 - RNA, 17 nt, Human
cuucugcuucagccucc

SEQ ID NO: 3064743 - RNA, 16 nt, Human
cuucugcuucagccuc

SEQ ID NO: 3064744 - RNA, 13 nt, Human
cuucugcuucagc

SEQ ID NO: 3064745 - RNA, 18 nt, Human
cuucugcuucagccuccc

SEQ ID NO: 3064746 - RNA, 22 nt, Human
cuucuccuucaccuuugucccc

SEQ ID NO: 3064747 - RNA, 19 nt, Human
cuucuccuucaccuuuguc

SEQ ID NO: 3064748 - RNA, 21 nt, Human
cuucucccccacccccuaggg

SEQ ID NO: 3064749 - RNA, 15 nt, Human
cuucuccacccugcu

SEQ ID NO: 3064750 - RNA, 14 nt, Human
cuucuccacccugc

SEQ ID NO: 3064751 - RNA, 14 nt, Human
cuucuccaggcugu

SEQ ID NO: 3064752 - RNA, 17 nt, Human
cuucuccaggcuguauc

SEQ ID NO: 3064753 - RNA, 15 nt, Human
cucuggagcccacug

SEQ ID NO: 3064754 - RNA, 17 nt, Human
cucuggcagcucagaga

SEQ ID NO: 3064755 - RNA, 18 nt, Human
cucuggcagcucagagag

SEQ ID NO: 3064756 - RNA, 19 nt, Human
cucuggcagcucagagagg

SEQ ID NO: 3064757 - RNA, 24 nt, Human
cucuuaaaacccaagugccuuagc

SEQ ID NO: 3064758 - RNA, 13 nt, Human
cucuuaaaaccca

SEQ ID NO: 3064759 - RNA, 22 nt, Human
cucuuccaggcugggagagccu

SEQ ID NO: 3064760 - RNA, 21 nt, Human
cucuuccaggcugggagagcc

SEQ ID NO: 3064761 - RNA, 23 nt, Human
cucuuccaggcugggagagccuu

SEQ ID NO: 3064762 - RNA, 12 nt, Human
cucuucuccagg

SEQ ID NO: 3064763 - RNA, 18 nt, Human
cucuugguccugcugcag

SEQ ID NO: 3064764 - RNA, 19 nt, Human
cucuugguccugcugcagu

SEQ ID NO: 3064765 - RNA, 17 nt, Human
cucuugguccugcugca

SEQ ID NO: 3064766 - RNA, 15 nt, Human
cucuugaccucaggu

SEQ ID NO: 3064767 - RNA, 13 nt, Human
cucuugaccucag

SEQ ID NO: 3064768 - RNA, 16 nt, Human
cucuugaccucaggug

SEQ ID NO: 3064769 - RNA, 17 nt, Human
cucuuuccaucuacccu

SEQ ID NO: 3064770 - RNA, 15 nt, Human
cucuuuggacacuca

SEQ ID NO: 3064771 - RNA, 18 nt, Human
cucuuuggacacucacac

SEQ ID NO: 3064772 - RNA, 17 nt, Human
cucuuucuauuguuucu

SEQ ID NO: 3064773 - RNA, 21 nt, Human
cugaagacucauucuucugua

SEQ ID NO: 3064774 - RNA, 19 nt, Human
cugaagacucauucuucug

SEQ ID NO: 3064775 - RNA, 16 nt, Human
cugaacuuggcgcugc

SEQ ID NO: 3064776 - RNA, 21 nt, Human
cugaacuuggcgcugccccug

SEQ ID NO: 3064777 - RNA, 15 nt, Human
cugaacuuggcgcug

SEQ ID NO: 3064778 - RNA, 19 nt, Human
cucuuuggucuacacugug

SEQ ID NO: 3064779 - RNA, 21 nt, Human
cucuuuggucuacacugugcu

SEQ ID NO: 3064780 - RNA, 18 nt, Human
cucuuugggccuggcucc

SEQ ID NO: 3064781 - RNA, 21 nt, Human
cugaaccuggguaacuaggga

SEQ ID NO: 3064782 - RNA, 16 nt, Human
cugaauacagaggcaa

SEQ ID NO: 3064783 - RNA, 24 nt, Human
cugaagucuuuguacagacaacaa

SEQ ID NO: 3064784 - RNA, 15 nt, Human
cugaagucacacagu

SEQ ID NO: 3064785 - RNA, 14 nt, Human
cugaagucacacag

SEQ ID NO: 3064786 - RNA, 19 nt, Human
cugacagacacaggcccgg

SEQ ID NO: 3064787 - RNA, 23 nt, Human
cugaauuuaaauagcuuuuuucu

SEQ ID NO: 3064788 - RNA, 14 nt, Human
cugaauuuaaauag

SEQ ID NO: 3064789 - RNA, 18 nt, Human
cugaauuuaaauagcuuu

SEQ ID NO: 3064790 - RNA, 21 nt, Human
cugacagacacaggcccggcu

SEQ ID NO: 3064791 - RNA, 11 nt, Human
cugacaggcaa

SEQ ID NO: 3064792 - RNA, 19 nt, Human
cugacaggcaaugcuggcu

SEQ ID NO: 3064793 - RNA, 18 nt, Human
cugacaggcaaugcuggc

SEQ ID NO: 3064794 - RNA, 17 nt, Human
cugacaggcaaugcugg

SEQ ID NO: 3064795 - RNA, 16 nt, Human
cugacaggcaaugcug

SEQ ID NO: 3064796 - RNA, 20 nt, Human
cugacaggcaaugcuggcug

SEQ ID NO: 3064797 - RNA, 17 nt, Human
cugacauuguuggccaa

SEQ ID NO: 3064798 - RNA, 11 nt, Human
cugacccacug

SEQ ID NO: 3064799 - RNA, 12 nt, Human
cucuggagccca

SEQ ID NO: 3064800 - RNA, 14 nt, Human
cucuggaauuugaa

SEQ ID NO: 3064801 - RNA, 17 nt, Human
cucugcggagcacacug

SEQ ID NO: 3064802 - RNA, 18 nt, Human
cucugcggagcacacugg

SEQ ID NO: 3064803 - RNA, 19 nt, Human
cucugcggagcacacuggc

SEQ ID NO: 3064804 - RNA, 21 nt, Human
cucugcggagcacacuggcuc

SEQ ID NO: 3064805 - RNA, 14 nt, Human
cucugccucugaca

SEQ ID NO: 3064806 - RNA, 14 nt, Human
cucugcccuccaag

SEQ ID NO: 3064807 - RNA, 15 nt, Human
cucugcccuccaaga

SEQ ID NO: 3064808 - RNA, 16 nt, Human
cucugcccuccaagac

SEQ ID NO: 3064809 - RNA, 23 nt, Human
cucugcccuccaagaccuucucc

SEQ ID NO: 3064810 - RNA, 22 nt, Human
cucugcaggucccuaauaaagc

SEQ ID NO: 3064811 - RNA, 23 nt, Human
cucugcaggucccuaauaaagcu

SEQ ID NO: 3064812 - RNA, 23 nt, Human
cucugcauacucauuaggauggc

SEQ ID NO: 3064813 - RNA, 22 nt, Human
cucugcaagaauugaagcagga

SEQ ID NO: 3064814 - RNA, 16 nt, Human
cucugaggacacuaac

SEQ ID NO: 3064815 - RNA, 22 nt, Human
cucucugcaggucccuaauaaa

SEQ ID NO: 3064816 - RNA, 19 nt, Human
cucucugcaggucccuaau

SEQ ID NO: 3064817 - RNA, 17 nt, Human
cucucugcaggucccua

SEQ ID NO: 3064818 - RNA, 16 nt, Human
cucucugcaggucccu

SEQ ID NO: 3064819 - RNA, 14 nt, Human
cucucugcaggucc

SEQ ID NO: 3064820 - RNA, 13 nt, Human
cucucugcagguc

SEQ ID NO: 3064821 - RNA, 12 nt, Human
cucucugcaggu

SEQ ID NO: 3064822 - RNA, 15 nt, Human
cucucucacuccuug

SEQ ID NO: 3064823 - RNA, 16 nt, Human
cucucucacuccuuga

SEQ ID NO: 3064824 - RNA, 12 nt, Human
cucucucaggcc

SEQ ID NO: 3064825 - RNA, 14 nt, Human
cucucucacuccuu

SEQ ID NO: 3064826 - RNA, 15 nt, Human
cucuccuguaccucu

SEQ ID NO: 3064827 - RNA, 14 nt, Human
cucuccuguaccuc

SEQ ID NO: 3064828 - RNA, 13 nt, Human
cucuccuguaccu

SEQ ID NO: 3064829 - RNA, 18 nt, Human
cucuccuguaccucuuga

SEQ ID NO: 3064830 - RNA, 17 nt, Human
cucuccuguaccucuug

SEQ ID NO: 3064831 - RNA, 22 nt, Human
cucuccuguaccucuugagccu

SEQ ID NO: 3064832 - RNA, 23 nt, Human
cucucaggccagcugcuugggcu

SEQ ID NO: 3064833 - RNA, 22 nt, Human
cucucaggccagcugcuugggc

SEQ ID NO: 3064834 - RNA, 13 nt, Human
cucuccagccccu

SEQ ID NO: 3064835 - RNA, 12 nt, Human
cucuccagcccc

SEQ ID NO: 3064836 - RNA, 18 nt, Human
cucucccaucacuucccu

SEQ ID NO: 3064837 - RNA, 14 nt, Human
cucucccaucacuu

SEQ ID NO: 3064838 - RNA, 20 nt, Human
cucucccaucacuucccuac

SEQ ID NO: 3064839 - RNA, 13 nt, Human
cucucccaucacu

SEQ ID NO: 3064840 - RNA, 12 nt, Human
cucauucuucug

SEQ ID NO: 3064841 - RNA, 14 nt, Human
cucauucuucugua

SEQ ID NO: 3064842 - RNA, 13 nt, Human
cucauucuucugu

SEQ ID NO: 3064843 - RNA, 13 nt, Human
cucauugaccuga

SEQ ID NO: 3064844 - RNA, 15 nt, Human
cucauugaccugagg

SEQ ID NO: 3064845 - RNA, 23 nt, Human
cucauucuucuguacgucugaca

SEQ ID NO: 3064846 - RNA, 16 nt, Human
cucauugaccugaggc

SEQ ID NO: 3064847 - RNA, 21 nt, Human
cucaucuagguaaauuacagu

SEQ ID NO: 3064848 - RNA, 17 nt, Human
cucaucuccccaucauu

SEQ ID NO: 3064849 - RNA, 21 nt, Human
cucauuagcauuuugcuaaau

SEQ ID NO: 3064850 - RNA, 17 nt, Human
cucauuaggauggcuag

SEQ ID NO: 3064851 - RNA, 18 nt, Human
cucauuaggauggcuagu

SEQ ID NO: 3064852 - RNA, 14 nt, Human
cucauauuuucaug

SEQ ID NO: 3064853 - RNA, 19 nt, Human
cucaggugucccugcacuu

SEQ ID NO: 3064854 - RNA, 18 nt, Human
cucaggugucccugcacu

SEQ ID NO: 3064855 - RNA, 17 nt, Human
cucaggugucccugcac

SEQ ID NO: 3064856 - RNA, 22 nt, Human
cucauaauuuauacaggucaua

SEQ ID NO: 3064857 - RNA, 13 nt, Human
cucauaauuuaua

SEQ ID NO: 3064858 - RNA, 15 nt, Human
cucauaauuuauaca

SEQ ID NO: 3064859 - RNA, 19 nt, Human
cucauaguaugguggcugg

SEQ ID NO: 3064860 - RNA, 18 nt, Human
cucauaguaugguggcug

SEQ ID NO: 3064861 - RNA, 22 nt, Human
cucagguggggucacucuggca

SEQ ID NO: 3064862 - RNA, 23 nt, Human
cucagguggggucacucuggcag

SEQ ID NO: 3064863 - RNA, 16 nt, Human
cucaggugucccugca

SEQ ID NO: 3064864 - RNA, 15 nt, Human
cucaggugucccugc

SEQ ID NO: 3064865 - RNA, 12 nt, Human
cucagggucccu

SEQ ID NO: 3064866 - RNA, 23 nt, Human
cuaaaagguaugcaaucaaaucu

SEQ ID NO: 3064867 - RNA, 20 nt, Human
cuccagcucaccagccccag

SEQ ID NO: 3064868 - RNA, 19 nt, Human
cuccagcucaccagcccca

SEQ ID NO: 3064869 - RNA, 15 nt, Human
cuccaccugccaggg

SEQ ID NO: 3064870 - RNA, 17 nt, Human
cuccaccugccagggac

SEQ ID NO: 3064871 - RNA, 18 nt, Human
cuccaccugccagggaca

SEQ ID NO: 3064872 - RNA, 21 nt, Human
cuccaccugccagggacagag

SEQ ID NO: 3064873 - RNA, 12 nt, Human
cuccacccugcu

SEQ ID NO: 3064874 - RNA, 11 nt, Human
cuccacccugc

SEQ ID NO: 3064875 - RNA, 14 nt, Human
cuccaugugggcua

SEQ ID NO: 3064876 - RNA, 22 nt, Human
cucccaaggggcccaaauucuu

SEQ ID NO: 3064877 - RNA, 21 nt, Human
cucccaaggggcccaaauucu

SEQ ID NO: 3064878 - RNA, 15 nt, Human
cucccaggcauuccc

SEQ ID NO: 3064879 - RNA, 17 nt, Human
cucccaggcauucccca

SEQ ID NO: 3064880 - RNA, 19 nt, Human
cucccaggcauuccccagg

SEQ ID NO: 3064881 - RNA, 20 nt, Human
cucccaggcauuccccagga

SEQ ID NO: 3064882 - RNA, 21 nt, Human
cucccaggcauuccccaggag

SEQ ID NO: 3064883 - RNA, 22 nt, Human
cucccaggcauuccccaggagg

SEQ ID NO: 3064884 - RNA, 17 nt, Human
cucccagucauuuaaua

SEQ ID NO: 3064885 - RNA, 11 nt, Human
cuccaggcucc

SEQ ID NO: 3064886 - RNA, 21 nt, Human
cuccauccugaggcuccacuu

SEQ ID NO: 3064887 - RNA, 20 nt, Human
cuccauccugaggcuccacu

SEQ ID NO: 3064888 - RNA, 23 nt, Human
cuccauccugaggcuccacuugg

SEQ ID NO: 3064889 - RNA, 13 nt, Human
cuccagcuguuca

SEQ ID NO: 3064890 - RNA, 18 nt, Human
cuccagcuguucagcugg

SEQ ID NO: 3064891 - RNA, 19 nt, Human
cuccagcuguucagcuggu

SEQ ID NO: 3064892 - RNA, 14 nt, Human
cuccuucaccuuug

SEQ ID NO: 3064893 - RNA, 16 nt, Human
cuccuucaccuuuguc

SEQ ID NO: 3064894 - RNA, 19 nt, Human
cuccuucaccuuugucccc

SEQ ID NO: 3064895 - RNA, 21 nt, Human
cuccuucaccuuuguccccac

SEQ ID NO: 3064896 - RNA, 15 nt, Human
cuccugcaggcagcc

SEQ ID NO: 3064897 - RNA, 21 nt, Human
cuccugcaggcagccaggcca

SEQ ID NO: 3064898 - RNA, 22 nt, Human
cuccugcaggcagccaggccac

SEQ ID NO: 3064899 - RNA, 11 nt, Human
cuccugugugu

SEQ ID NO: 3064900 - RNA, 23 nt, Human
cuccugugucuugcaauggcagc

SEQ ID NO: 3064901 - RNA, 15 nt, Human
cuccugugucuugca

SEQ ID NO: 3064902 - RNA, 20 nt, Human
cuccuucuguccuacucugu

SEQ ID NO: 3064903 - RNA, 15 nt, Human
cuccuucuguccuac

SEQ ID NO: 3064904 - RNA, 14 nt, Human
cuccuucuguccua

SEQ ID NO: 3064905 - RNA, 13 nt, Human
cuccuucaccuuu

SEQ ID NO: 3064906 - RNA, 16 nt, Human
cucgaacuggcugcaa

SEQ ID NO: 3064907 - RNA, 11 nt, Human
cuccuucuucc

SEQ ID NO: 3064908 - RNA, 21 nt, Human
cuccuugaaaacacuguucuc

SEQ ID NO: 3064909 - RNA, 13 nt, Human
cucgcgacaaugc

SEQ ID NO: 3064910 - RNA, 15 nt, Human
cucgcgacaaugcaa

SEQ ID NO: 3064911 - RNA, 16 nt, Human
cucgaguuacagacaa

SEQ ID NO: 3064912 - RNA, 20 nt, Human
cucgaguuacagacaaagcg

SEQ ID NO: 3064913 - RNA, 13 nt, Human
cucuaaauucuuu

SEQ ID NO: 3064914 - RNA, 17 nt, Human
cucuaaauucuuucauu

SEQ ID NO: 3064915 - RNA, 21 nt, Human
cucggaccccacuccggcccu

SEQ ID NO: 3064916 - RNA, 19 nt, Human
cucggaccccacuccggcc

SEQ ID NO: 3064917 - RNA, 12 nt, Human
cucggagaagag

SEQ ID NO: 3064918 - RNA, 20 nt, Human
cucggagaagagcuguucac

SEQ ID NO: 3064919 - RNA, 13 nt, Human
cucggagaagagc

SEQ ID NO: 3064920 - RNA, 12 nt, Human
cuccucagaucu

SEQ ID NO: 3064921 - RNA, 14 nt, Human
cuccucagaucuuc

SEQ ID NO: 3064922 - RNA, 13 nt, Human
cuccugcaggcag

SEQ ID NO: 3064923 - RNA, 14 nt, Human
cuccugcaggcagc

SEQ ID NO: 3064924 - RNA, 12 nt, Human
cuccugcaggca

SEQ ID NO: 3064925 - RNA, 14 nt, Human
cucccaucucacac

SEQ ID NO: 3064926 - RNA, 15 nt, Human
cucccaucucacaca

SEQ ID NO: 3064927 - RNA, 18 nt, Human
cucccaucucacacauga

SEQ ID NO: 3064928 - RNA, 10 nt, Human
cucccuuccu

SEQ ID NO: 3064929 - RNA, 23 nt, Human
cucccuucccaccucucucacuc

SEQ ID NO: 3064930 - RNA, 17 nt, Human
cucccuuggauuguccc

SEQ ID NO: 3064931 - RNA, 12 nt, Human
cucccuuucaac

SEQ ID NO: 3064932 - RNA, 13 nt, Human
cucccuuucaaca

SEQ ID NO: 3064933 - RNA, 20 nt, Human
cuccuaggacccgucuccag

SEQ ID NO: 3064934 - RNA, 21 nt, Human
cuccuaggacccgucuccagc

SEQ ID NO: 3064935 - RNA, 22 nt, Human
cuccuaggacccgucuccagcu

SEQ ID NO: 3064936 - RNA, 14 nt, Human
cucccuuccucuuu

SEQ ID NO: 3064937 - RNA, 13 nt, Human
cucccuuccucuu

SEQ ID NO: 3064938 - RNA, 16 nt, Human
cucccuucucuucaca

SEQ ID NO: 3064939 - RNA, 14 nt, Human
cugaucgcuucucc

SEQ ID NO: 3064940 - RNA, 15 nt, Human
cugauucccaagcuc

SEQ ID NO: 3064941 - RNA, 18 nt, Human
cugauucccaagcucugc

SEQ ID NO: 3064942 - RNA, 17 nt, Human
cugauucccaagcucug

SEQ ID NO: 3064943 - RNA, 20 nt, Human
cugauucccaagcucugcuc

SEQ ID NO: 3064944 - RNA, 19 nt, Human
cugauucccaagcucugcu

SEQ ID NO: 3064945 - RNA, 22 nt, Human
cugauucccaagcucugcuccu

SEQ ID NO: 3064946 - RNA, 21 nt, Human
cugauguuccuagugaaagag

SEQ ID NO: 3064947 - RNA, 20 nt, Human
cugauguuccuagugaaaga

SEQ ID NO: 3064948 - RNA, 18 nt, Human
cugauguuccuagugaaa

SEQ ID NO: 3064949 - RNA, 13 nt, Human
cugauguuccuag

SEQ ID NO: 3064950 - RNA, 13 nt, Human
cugagucugaagg

SEQ ID NO: 3064951 - RNA, 14 nt, Human
cugagucugaaggc

SEQ ID NO: 3064952 - RNA, 15 nt, Human
cugagucugaaggcu

SEQ ID NO: 3064953 - RNA, 16 nt, Human
cugagucugaaggcug

SEQ ID NO: 3064954 - RNA, 13 nt, Human
cugauaaagauga

SEQ ID NO: 3064955 - RNA, 18 nt, Human
cugcaauuucauaugcug

SEQ ID NO: 3064956 - RNA, 20 nt, Human
cugcaauuucauaugcugua

SEQ ID NO: 3064957 - RNA, 17 nt, Human
cugcacccucaggcagg

SEQ ID NO: 3064958 - RNA, 16 nt, Human
cugcacccucaggcag

SEQ ID NO: 3064959 - RNA, 18 nt, Human
cugcacccucaggcaggu

SEQ ID NO: 3064960 - RNA, 13 nt, Human
cugcacaagcugc

SEQ ID NO: 3064961 - RNA, 14 nt, Human
cugcacaagcugca

SEQ ID NO: 3064962 - RNA, 15 nt, Human
cugcacaagcugcac

SEQ ID NO: 3064963 - RNA, 16 nt, Human
cugcacaagcugcacc

SEQ ID NO: 3064964 - RNA, 22 nt, Human
cugcacagcaggcugccagugc

SEQ ID NO: 3064965 - RNA, 21 nt, Human
cugcacagcaggcugccagug

SEQ ID NO: 3064966 - RNA, 20 nt, Human
cugcacagcaggcugccagu

SEQ ID NO: 3064967 - RNA, 11 nt, Human
cugcagccuca

SEQ ID NO: 3064968 - RNA, 20 nt, Human
cugcagccucaaccuccugg

SEQ ID NO: 3064969 - RNA, 19 nt, Human
cugcagccucaaccuccug

SEQ ID NO: 3064970 - RNA, 22 nt, Human
cugcagccucaaccuccugggc

SEQ ID NO: 3064971 - RNA, 22 nt, Human
cugcagggaguccgaaagggac

SEQ ID NO: 3064972 - RNA, 23 nt, Human
cugcagaagacaguauggcagcu

SEQ ID NO: 3064973 - RNA, 13 nt, Human
cugcagaagacag

SEQ ID NO: 3064974 - RNA, 17 nt, Human
cugcaccggcuggccug

SEQ ID NO: 3064975 - RNA, 18 nt, Human
cugcaccggcuggccugg

SEQ ID NO: 3064976 - RNA, 19 nt, Human
cugcaccggcuggccuggc

SEQ ID NO: 3064977 - RNA, 17 nt, Human
cugcacuugcagacucu

SEQ ID NO: 3064978 - RNA, 16 nt, Human
cugcacuugcagacuc

SEQ ID NO: 3064979 - RNA, 14 nt, Human
cugcacuugcagac

SEQ ID NO: 3064980 - RNA, 16 nt, Human
cugcaccggcuggccu

SEQ ID NO: 3064981 - RNA, 13 nt, Human
cugccucucugca

SEQ ID NO: 3064982 - RNA, 12 nt, Human
cugccucucugc

SEQ ID NO: 3064983 - RNA, 14 nt, Human
cugccucucugcag

SEQ ID NO: 3064984 - RNA, 13 nt, Human
cugccucuucucu

SEQ ID NO: 3064985 - RNA, 23 nt, Human
cugccugaagucacacagugagu

SEQ ID NO: 3064986 - RNA, 23 nt, Human
cugccuguugggccaggagccuc

SEQ ID NO: 3064987 - RNA, 14 nt, Human
cugccugcccaggc

SEQ ID NO: 3064988 - RNA, 13 nt, Human
cugccugcccagg

SEQ ID NO: 3064989 - RNA, 13 nt, Human
cugccuauuuuaa

SEQ ID NO: 3064990 - RNA, 15 nt, Human
cugccuaagugcagc

SEQ ID NO: 3064991 - RNA, 13 nt, Human
cugccucagccuc

SEQ ID NO: 3064992 - RNA, 18 nt, Human
cugcuccucuccccagca

SEQ ID NO: 3064993 - RNA, 17 nt, Human
cugcuccucuccccagc

SEQ ID NO: 3064994 - RNA, 16 nt, Human
cugcuccucuccccag

SEQ ID NO: 3064995 - RNA, 20 nt, Human
cugcggaaugaaccacaucu

SEQ ID NO: 3064996 - RNA, 15 nt, Human
cugcgguccacccag

SEQ ID NO: 3064997 - RNA, 21 nt, Human
cugcggaaugaaccacaucuu

SEQ ID NO: 3064998 - RNA, 16 nt, Human
cugcgguccacccagg

SEQ ID NO: 3064999 - RNA, 14 nt, Human
cugcuccagcuguu

SEQ ID NO: 3065000 - RNA, 15 nt, Human
cugccaugccagcuu

SEQ ID NO: 3065001 - RNA, 17 nt, Human
cugccaugccagcuuau

SEQ ID NO: 3065002 - RNA, 19 nt, Human
cugccaugccagcuuaucu

SEQ ID NO: 3065003 - RNA, 15 nt, Human
cugccaggaagccag

SEQ ID NO: 3065004 - RNA, 16 nt, Human
cugccaggaagccagc

SEQ ID NO: 3065005 - RNA, 18 nt, Human
cugccaggaagccagcag

SEQ ID NO: 3065006 - RNA, 19 nt, Human
cugccaggaagccagcagg

SEQ ID NO: 3065007 - RNA, 19 nt, Human
cugccagccgagauagcca

SEQ ID NO: 3065008 - RNA, 14 nt, Human
cugccacccugggg

SEQ ID NO: 3065009 - RNA, 20 nt, Human
cugccacccuggggagaaag

SEQ ID NO: 3065010 - RNA, 16 nt, Human
cugccacccuggggag

SEQ ID NO: 3065011 - RNA, 15 nt, Human
cugccacccugggga

SEQ ID NO: 3065012 - RNA, 19 nt, Human
cugcccuccaagaccuucu

SEQ ID NO: 3065013 - RNA, 15 nt, Human
cugcccggcugcgga

SEQ ID NO: 3065014 - RNA, 11 nt, Human
cugcccggcug

SEQ ID NO: 3065015 - RNA, 13 nt, Human
cugcccugcccac

SEQ ID NO: 3065016 - RNA, 14 nt, Human
cugcccugcccacc

SEQ ID NO: 3065017 - RNA, 15 nt, Human
cugcccugcccaccu

SEQ ID NO: 3065018 - RNA, 16 nt, Human
cugcccugcccaccug

SEQ ID NO: 3065019 - RNA, 16 nt, Human
cugccauuucugagau

SEQ ID NO: 3065020 - RNA, 14 nt, Human
cugccccuggcagc

SEQ ID NO: 3065021 - RNA, 15 nt, Human
cugccccuggcagcc

SEQ ID NO: 3065022 - RNA, 16 nt, Human
cugccccuggcagccc

SEQ ID NO: 3065023 - RNA, 20 nt, Human
cugcccggcaggguccuaga

SEQ ID NO: 3065024 - RNA, 17 nt, Human
cugggccccugccucuc

SEQ ID NO: 3065025 - RNA, 16 nt, Human
cugggccccugccucu

SEQ ID NO: 3065026 - RNA, 12 nt, Human
cugggccccugc

SEQ ID NO: 3065027 - RNA, 10 nt, Human
cugggccccu

SEQ ID NO: 3065028 - RNA, 20 nt, Human
cugggcaaugugauaaaacc

SEQ ID NO: 3065029 - RNA, 12 nt, Human
cugggagugagc

SEQ ID NO: 3065030 - RNA, 13 nt, Human
cugggagugagcu

SEQ ID NO: 3065031 - RNA, 16 nt, Human
cugggagugagcuggu

SEQ ID NO: 3065032 - RNA, 16 nt, Human
cugggaggcucuggag

SEQ ID NO: 3065033 - RNA, 15 nt, Human
cugggaggcucugga

SEQ ID NO: 3065034 - RNA, 18 nt, Human
cugggaggaaccgagggg

SEQ ID NO: 3065035 - RNA, 22 nt, Human
cugggaggcucuggagcccacu

SEQ ID NO: 3065036 - RNA, 18 nt, Human
cugggaggucaaggcugc

SEQ ID NO: 3065037 - RNA, 16 nt, Human
cugggagcuuuuguag

SEQ ID NO: 3065038 - RNA, 12 nt, Human
cugggaggaacc

SEQ ID NO: 3065039 - RNA, 22 nt, Human
cugggaacccaaguccaagcau

SEQ ID NO: 3065040 - RNA, 20 nt, Human
cuggcuguuggcugggggcc

SEQ ID NO: 3065041 - RNA, 18 nt, Human
cuggcuguuggcuggggg

SEQ ID NO: 3065042 - RNA, 21 nt, Human
cuggcuggguggcaccagcag

SEQ ID NO: 3065043 - RNA, 19 nt, Human
cuggcuguuggcugggggc

SEQ ID NO: 3065044 - RNA, 18 nt, Human
cuggcucuuccaggcugg

SEQ ID NO: 3065045 - RNA, 19 nt, Human
cuggcucuuccaggcuggg

SEQ ID NO: 3065046 - RNA, 20 nt, Human
cuggcucuuccaggcuggga

SEQ ID NO: 3065047 - RNA, 17 nt, Human
cuggcucuuccaggcug

SEQ ID NO: 3065048 - RNA, 13 nt, Human
cuggccugagcug

SEQ ID NO: 3065049 - RNA, 18 nt, Human
cugguccauagagagcaa

SEQ ID NO: 3065050 - RNA, 14 nt, Human
cuggucccacucag

SEQ ID NO: 3065051 - RNA, 18 nt, Human
cuggucccacucagucca

SEQ ID NO: 3065052 - RNA, 15 nt, Human
cuggucccacucagu

SEQ ID NO: 3065053 - RNA, 15 nt, Human
cugguccauagagag

SEQ ID NO: 3065054 - RNA, 17 nt, Human
cugguccauagagagca

SEQ ID NO: 3065055 - RNA, 13 nt, Human
cuggguuggaggg

SEQ ID NO: 3065056 - RNA, 19 nt, Human
cuggguucuacccaggugc

SEQ ID NO: 3065057 - RNA, 23 nt, Human
cugguggcagugggagcugccug

SEQ ID NO: 3065058 - RNA, 19 nt, Human
cugguggcagugggagcug

SEQ ID NO: 3065059 - RNA, 18 nt, Human
cugggguggggaccucag

SEQ ID NO: 3065060 - RNA, 19 nt, Human
cugggguggggaccucagg

SEQ ID NO: 3065061 - RNA, 17 nt, Human
cugggguggggaccuca

SEQ ID NO: 3065062 - RNA, 18 nt, Human
cugggggccucagugcca

SEQ ID NO: 3065063 - RNA, 17 nt, Human
cugggggccucagugcc

SEQ ID NO: 3065064 - RNA, 13 nt, Human
cugggggccucag

SEQ ID NO: 3065065 - RNA, 21 nt, Human
cugggguggggaccucaggcc

SEQ ID NO: 3065066 - RNA, 22 nt, Human
cugggguggggaccucaggccu

SEQ ID NO: 3065067 - RNA, 23 nt, Human
cugggguggggaccucaggccug

SEQ ID NO: 3065068 - RNA, 20 nt, Human
cuggguacuuguggacacag

SEQ ID NO: 3065069 - RNA, 23 nt, Human
cuggguacuuguggacacagcuc

SEQ ID NO: 3065070 - RNA, 21 nt, Human
cuggguacuuguggacacagc

SEQ ID NO: 3065071 - RNA, 19 nt, Human
cuggguacuuguggacaca

SEQ ID NO: 3065072 - RNA, 20 nt, Human
cugggcuucaguggcagcug

SEQ ID NO: 3065073 - RNA, 19 nt, Human
cugggcuucaguggcagcu

SEQ ID NO: 3065074 - RNA, 17 nt, Human
cugggcuucaguggcag

SEQ ID NO: 3065075 - RNA, 18 nt, Human
cugggcuucaguggcagc

SEQ ID NO: 3065076 - RNA, 21 nt, Human
cugggcuuggggaccagagcu

SEQ ID NO: 3065077 - RNA, 17 nt, Human
cugggcuuggggaccag

SEQ ID NO: 3065078 - RNA, 20 nt, Human
cugggcuuggggaccagagc

SEQ ID NO: 3065079 - RNA, 13 nt, Human
cugggcuugggga

SEQ ID NO: 3065080 - RNA, 22 nt, Human
cugggcuucaguggcagcugcu

SEQ ID NO: 3065081 - RNA, 21 nt, Human
cugggcuucaguggcagcugc

SEQ ID NO: 3065082 - RNA, 17 nt, Human
cuggauuauauuaugaa

SEQ ID NO: 3065083 - RNA, 16 nt, Human
cuggauggggcugcac

SEQ ID NO: 3065084 - RNA, 23 nt, Human
cuggauuaaacuuaaucuaaaug

SEQ ID NO: 3065085 - RNA, 13 nt, Human
cuggauuaaacuu

SEQ ID NO: 3065086 - RNA, 15 nt, Human
cuggauggggcugca

SEQ ID NO: 3065087 - RNA, 19 nt, Human
cuggcacaguuuucugaga

SEQ ID NO: 3065088 - RNA, 18 nt, Human
cuggcacaguuuucugag

SEQ ID NO: 3065089 - RNA, 22 nt, Human
cuggcacuauaauguaagcucu

SEQ ID NO: 3065090 - RNA, 23 nt, Human
cuggcacuauaauguaagcucua

SEQ ID NO: 3065091 - RNA, 13 nt, Human
cuggcacugcuuc

SEQ ID NO: 3065092 - RNA, 14 nt, Human
cuggcacugcuucc

SEQ ID NO: 3065093 - RNA, 23 nt, Human
cuggcaaacagggccucugcgga

SEQ ID NO: 3065094 - RNA, 20 nt, Human
cuggcaaacagggccucugc

SEQ ID NO: 3065095 - RNA, 21 nt, Human
cuggcaaacagggccucugcg

SEQ ID NO: 3065096 - RNA, 16 nt, Human
cuggcaaacagggccu

SEQ ID NO: 3065097 - RNA, 17 nt, Human
cuggcaaacagggccuc

SEQ ID NO: 3065098 - RNA, 19 nt, Human
cuggcaaacagggccucug

SEQ ID NO: 3065099 - RNA, 16 nt, Human
cuggccagaugcacca

SEQ ID NO: 3065100 - RNA, 16 nt, Human
cuggccaacgggguga

SEQ ID NO: 3065101 - RNA, 15 nt, Human
cuggcacugcuucca

SEQ ID NO: 3065102 - RNA, 16 nt, Human
cuggcacugcuuccag

SEQ ID NO: 3065103 - RNA, 17 nt, Human
cuggcacugcuuccagu

SEQ ID NO: 3065104 - RNA, 20 nt, Human
cuggccagaugcaccagccc

SEQ ID NO: 3065105 - RNA, 19 nt, Human
cuggccagaugcaccagcc

SEQ ID NO: 3065106 - RNA, 18 nt, Human
cuggccagaugcaccagc

SEQ ID NO: 3065107 - RNA, 17 nt, Human
cuggccagaugcaccag

SEQ ID NO: 3065108 - RNA, 21 nt, Human
cuggccagaugcaccagcccu

SEQ ID NO: 3065109 - RNA, 17 nt, Human
cuggccuagcauacgua

SEQ ID NO: 3065110 - RNA, 17 nt, Human
cuggcccagggcaucug

SEQ ID NO: 3065111 - RNA, 18 nt, Human
cuggcccagggcaucugg

SEQ ID NO: 3065112 - RNA, 14 nt, Human
cuggcccagggcau

SEQ ID NO: 3065113 - RNA, 13 nt, Human
cuggcccagggca

SEQ ID NO: 3065114 - RNA, 12 nt, Human
cuggcccacugc

SEQ ID NO: 3065115 - RNA, 13 nt, Human
cuggcccacugca

SEQ ID NO: 3065116 - RNA, 23 nt, Human
cuggccuagcauacguacacauu

SEQ ID NO: 3065117 - RNA, 20 nt, Human
cuggcccagggcaucuggga

SEQ ID NO: 3065118 - RNA, 14 nt, Human
cuggccuagcauac

SEQ ID NO: 3065119 - RNA, 13 nt, Human
cugcugaaacaac

SEQ ID NO: 3065120 - RNA, 21 nt, Human
cuggaagugcuaauuuugaaa

SEQ ID NO: 3065121 - RNA, 23 nt, Human
cuggaauaauccuaaacauauga

SEQ ID NO: 3065122 - RNA, 15 nt, Human
cuggaagcacagcuu

SEQ ID NO: 3065123 - RNA, 18 nt, Human
cuggaagcacagcuucau

SEQ ID NO: 3065124 - RNA, 14 nt, Human
cuggaagcacagcu

SEQ ID NO: 3065125 - RNA, 15 nt, Human
cuggaaugcaguggu

SEQ ID NO: 3065126 - RNA, 14 nt, Human
cuggaaugcagugg

SEQ ID NO: 3065127 - RNA, 20 nt, Human
cuggagcccacuguacuugc

SEQ ID NO: 3065128 - RNA, 17 nt, Human
cuggagcccacuguacu

SEQ ID NO: 3065129 - RNA, 16 nt, Human
cuggagcccacuguac

SEQ ID NO: 3065130 - RNA, 15 nt, Human
cuggagcccacugua

SEQ ID NO: 3065131 - RNA, 13 nt, Human
cuggagcccacug

SEQ ID NO: 3065132 - RNA, 21 nt, Human
cuggagcccacuguacuugcu

SEQ ID NO: 3065133 - RNA, 17 nt, Human
cuggagcuagaauuuga

SEQ ID NO: 3065134 - RNA, 22 nt, Human
cuggagcuagaauuugauaugu

SEQ ID NO: 3065135 - RNA, 16 nt, Human
cuggagcuagaauuug

SEQ ID NO: 3065136 - RNA, 19 nt, Human
cccuuuuuuggcugcugaa

SEQ ID NO: 3065137 - RNA, 17 nt, Human
ccgagaaggaagccucc

SEQ ID NO: 3065138 - RNA, 18 nt, Human
ccgagauagccaaggcca

SEQ ID NO: 3065139 - RNA, 19 nt, Human
ccgagauagccaaggccaa

SEQ ID NO: 3065140 - RNA, 22 nt, Human
ccgagauagccaaggccaaagg

SEQ ID NO: 3065141 - RNA, 11 nt, Human
cccuuuuccuu

SEQ ID NO: 3065142 - RNA, 13 nt, Human
cccuuuucuguuu

SEQ ID NO: 3065143 - RNA, 17 nt, Human
cccuuuuuuggcugcug

SEQ ID NO: 3065144 - RNA, 18 nt, Human
cccuuuuuuggcugcuga

SEQ ID NO: 3065145 - RNA, 17 nt, Human
ccgaggccuucucugaa

SEQ ID NO: 3065146 - RNA, 19 nt, Human
ccgagccuggcuccaaacc

SEQ ID NO: 3065147 - RNA, 18 nt, Human
ccgagaucacgccacugc

SEQ ID NO: 3065148 - RNA, 16 nt, Human
ccgagccuggcuccaa

SEQ ID NO: 3065149 - RNA, 16 nt, Human
ccgagggggcugcucc

SEQ ID NO: 3065150 - RNA, 18 nt, Human
ccgagggggcugcuccca

SEQ ID NO: 3065151 - RNA, 19 nt, Human
ccgagggggcugcucccac

SEQ ID NO: 3065152 - RNA, 17 nt, Human
cccuugccgucuaccug

SEQ ID NO: 3065153 - RNA, 18 nt, Human
cccuugccgucuaccuga

SEQ ID NO: 3065154 - RNA, 22 nt, Human
cccuugccgucuaccugagggg

SEQ ID NO: 3065155 - RNA, 16 nt, Human
cccuugaugaagaagu

SEQ ID NO: 3065156 - RNA, 15 nt, Human
cccuugaugaagaag

SEQ ID NO: 3065157 - RNA, 18 nt, Human
cccuuggggagcaggcuc

SEQ ID NO: 3065158 - RNA, 14 nt, Human
cccuugugguccca

SEQ ID NO: 3065159 - RNA, 16 nt, Human
cccuuguggucccacc

SEQ ID NO: 3065160 - RNA, 18 nt, Human
cccuuguggucccacccc

SEQ ID NO: 3065161 - RNA, 20 nt, Human
cccuuugacgccaucccagc

SEQ ID NO: 3065162 - RNA, 18 nt, Human
ccccucagggucccuggu

SEQ ID NO: 3065163 - RNA, 20 nt, Human
ccccucagggucccuggugg

SEQ ID NO: 3065164 - RNA, 17 nt, Human
ccccucagggucccugg

SEQ ID NO: 3065165 - RNA, 19 nt, Human
cccugguggcagugggagc

SEQ ID NO: 3065166 - RNA, 16 nt, Human
cccugguggcaguggg

SEQ ID NO: 3065167 - RNA, 15 nt, Human
cccugguggcagugg

SEQ ID NO: 3065168 - RNA, 16 nt, Human
cccugugggcccccaa

SEQ ID NO: 3065169 - RNA, 15 nt, Human
cccugugggccccca

SEQ ID NO: 3065170 - RNA, 15 nt, Human
cccuguuuguuucug

SEQ ID NO: 3065171 - RNA, 18 nt, Human
cccugugggcccccaaau

SEQ ID NO: 3065172 - RNA, 12 nt, Human
cccccagcccca

SEQ ID NO: 3065173 - RNA, 21 nt, Human
cccccgcugucagccauuccu

SEQ ID NO: 3065174 - RNA, 12 nt, Human
ccccacugguga

SEQ ID NO: 3065175 - RNA, 13 nt, Human
ccccacuggugac

SEQ ID NO: 3065176 - RNA, 13 nt, Human
ccccaggaggcca

SEQ ID NO: 3065177 - RNA, 14 nt, Human
ccccaggaggccag

SEQ ID NO: 3065178 - RNA, 15 nt, Human
ccccaggaggccagc

SEQ ID NO: 3065179 - RNA, 21 nt, Human
ccccaggaggccagccuugac

SEQ ID NO: 3065180 - RNA, 22 nt, Human
ccccaggaggccagccuugacc

SEQ ID NO: 3065181 - RNA, 23 nt, Human
ccgcuuucuacccagcgagcccu

SEQ ID NO: 3065182 - RNA, 13 nt, Human
ccggcuggccugg

SEQ ID NO: 3065183 - RNA, 22 nt, Human
ccgggaggcagagguugcagug

SEQ ID NO: 3065184 - RNA, 15 nt, Human
ccgggcacucagaag

SEQ ID NO: 3065185 - RNA, 12 nt, Human
ccggcuggccug

SEQ ID NO: 3065186 - RNA, 20 nt, Human
ccucacaguccuuaccagca

SEQ ID NO: 3065187 - RNA, 22 nt, Human
ccucacaguccuuaccagcaga

SEQ ID NO: 3065188 - RNA, 12 nt, Human
ccucaccccacu

SEQ ID NO: 3065189 - RNA, 15 nt, Human
ccucaccccacugug

SEQ ID NO: 3065190 - RNA, 17 nt, Human
ccucaccuuucccaucu

SEQ ID NO: 3065191 - RNA, 17 nt, Human
ccucacaguccuuacca

SEQ ID NO: 3065192 - RNA, 23 nt, Human
ccugaagcuaucguaaaauuaag

SEQ ID NO: 3065193 - RNA, 22 nt, Human
ccugaagcuaucguaaaauuaa

SEQ ID NO: 3065194 - RNA, 20 nt, Human
ccugaagcuaucguaaaauu

SEQ ID NO: 3065195 - RNA, 20 nt, Human
ccugaacaggauauucucac

SEQ ID NO: 3065196 - RNA, 17 nt, Human
ccugaagucacacagug

SEQ ID NO: 3065197 - RNA, 16 nt, Human
ccugaagucacacagu

SEQ ID NO: 3065198 - RNA, 13 nt, Human
ccugaaggccccg

SEQ ID NO: 3065199 - RNA, 15 nt, Human
ccugaagucacacag

SEQ ID NO: 3065200 - RNA, 22 nt, Human
ccucuuuggucuacacugugcu

SEQ ID NO: 3065201 - RNA, 17 nt, Human
ccucuuaugggcugggu

SEQ ID NO: 3065202 - RNA, 18 nt, Human
ccugaaagaggaaugaag

SEQ ID NO: 3065203 - RNA, 13 nt, Human
ccugaaagaggaa

SEQ ID NO: 3065204 - RNA, 23 nt, Human
ccugaaagaggaaugaaguacuc

SEQ ID NO: 3065205 - RNA, 15 nt, Human
ccucuuaugggcugg

SEQ ID NO: 3065206 - RNA, 16 nt, Human
ccucuuaugggcuggg

SEQ ID NO: 3065207 - RNA, 14 nt, Human
ccucuuaugggcug

SEQ ID NO: 3065208 - RNA, 23 nt, Human
ccucuuagaugcaguucugaaga

SEQ ID NO: 3065209 - RNA, 14 nt, Human
ccucuuagaaaaac

SEQ ID NO: 3065210 - RNA, 14 nt, Human
ccucuguacagagc

SEQ ID NO: 3065211 - RNA, 15 nt, Human
ccucuguacagagcc

SEQ ID NO: 3065212 - RNA, 16 nt, Human
ccucuguacagagccc

SEQ ID NO: 3065213 - RNA, 17 nt, Human
ccucuguacagagccca

SEQ ID NO: 3065214 - RNA, 18 nt, Human
ccucuguacagagcccac

SEQ ID NO: 3065215 - RNA, 23 nt, Human
ccucuguacagagcccacgcccc

SEQ ID NO: 3065216 - RNA, 12 nt, Human
ccugaggcccag

SEQ ID NO: 3065217 - RNA, 13 nt, Human
ccugaggcccaga

SEQ ID NO: 3065218 - RNA, 14 nt, Human
ccugaggcccagag

SEQ ID NO: 3065219 - RNA, 12 nt, Human
ccugacaacacu

SEQ ID NO: 3065220 - RNA, 14 nt, Human
ccugacaacacuca

SEQ ID NO: 3065221 - RNA, 15 nt, Human
ccugacaacacucau

SEQ ID NO: 3065222 - RNA, 16 nt, Human
ccugacaacacucauu

SEQ ID NO: 3065223 - RNA, 17 nt, Human
ccugaggcuccacuugg

SEQ ID NO: 3065224 - RNA, 23 nt, Human
ccugaggcccuucucuccagccc

SEQ ID NO: 3065225 - RNA, 21 nt, Human
ccugaggcccuucucuccagc

SEQ ID NO: 3065226 - RNA, 22 nt, Human
ccugaggcccuucucuccagcc

SEQ ID NO: 3065227 - RNA, 16 nt, Human
ccugaggcccuucucu

SEQ ID NO: 3065228 - RNA, 17 nt, Human
ccugaggcccuucucuc

SEQ ID NO: 3065229 - RNA, 19 nt, Human
ccugaggcccuucucucca

SEQ ID NO: 3065230 - RNA, 20 nt, Human
ccugaggcccuucucuccag

SEQ ID NO: 3065231 - RNA, 14 nt, Human
ccugaggcccuucu

SEQ ID NO: 3065232 - RNA, 18 nt, Human
ccugaggcuccacuuggu

SEQ ID NO: 3065233 - RNA, 20 nt, Human
ccugaggcuccacuuggucu

SEQ ID NO: 3065234 - RNA, 14 nt, Human
ccugaugcuucuuc

SEQ ID NO: 3065235 - RNA, 23 nt, Human
ccugauugugucucuugguccug

SEQ ID NO: 3065236 - RNA, 17 nt, Human
ccugaugcuucuucaga

SEQ ID NO: 3065237 - RNA, 18 nt, Human
ccugaugcuucuucagag

SEQ ID NO: 3065238 - RNA, 17 nt, Human
ccuccugggaaugaagc

SEQ ID NO: 3065239 - RNA, 13 nt, Human
ccuccugggcuaa

SEQ ID NO: 3065240 - RNA, 22 nt, Human
ccuccugugugugcgccuacag

SEQ ID NO: 3065241 - RNA, 15 nt, Human
ccuccugugugugcg

SEQ ID NO: 3065242 - RNA, 13 nt, Human
ccuccugugugug

SEQ ID NO: 3065243 - RNA, 15 nt, Human
ccucccucccucuuu

SEQ ID NO: 3065244 - RNA, 13 nt, Human
ccucccucccucu

SEQ ID NO: 3065245 - RNA, 16 nt, Human
ccucccucccucuuuc

SEQ ID NO: 3065246 - RNA, 15 nt, Human
ccucagucuggcccu

SEQ ID NO: 3065247 - RNA, 19 nt, Human
ccucaggugauccacccac

SEQ ID NO: 3065248 - RNA, 17 nt, Human
ccucaggugauccaccc

SEQ ID NO: 3065249 - RNA, 22 nt, Human
ccucaggugagaagcagaggaa

SEQ ID NO: 3065250 - RNA, 22 nt, Human
ccucaggugauccacccaccuc

SEQ ID NO: 3065251 - RNA, 15 nt, Human
ccucagggucccugg

SEQ ID NO: 3065252 - RNA, 22 nt, Human
ccucagggucccugguggcagc

SEQ ID NO: 3065253 - RNA, 16 nt, Human
ccucaggugagaagca

SEQ ID NO: 3065254 - RNA, 14 nt, Human
ccucagcauccugg

SEQ ID NO: 3065255 - RNA, 17 nt, Human
ccucagcauccuggcac

SEQ ID NO: 3065256 - RNA, 16 nt, Human
ccucagcauccuggca

SEQ ID NO: 3065257 - RNA, 20 nt, Human
ccucagaaaacaaggaugaa

SEQ ID NO: 3065258 - RNA, 14 nt, Human
ccucaggccugggg

SEQ ID NO: 3065259 - RNA, 21 nt, Human
ccucaggccugggggcugggc

SEQ ID NO: 3065260 - RNA, 10 nt, Human
ccucaggccu

SEQ ID NO: 3065261 - RNA, 11 nt, Human
ccucaggccug

SEQ ID NO: 3065262 - RNA, 14 nt, Human
ccucagggucccug

SEQ ID NO: 3065263 - RNA, 23 nt, Human
ccuccugugugugcgccuacagg

SEQ ID NO: 3065264 - RNA, 12 nt, Human
ccucucccauca

SEQ ID NO: 3065265 - RNA, 23 nt, Human
ccucugaaaaccaauguucucuc

SEQ ID NO: 3065266 - RNA, 15 nt, Human
ccucugacacacagc

SEQ ID NO: 3065267 - RNA, 16 nt, Human
ccucugacacacagcu

SEQ ID NO: 3065268 - RNA, 12 nt, Human
ccucugggacug

SEQ ID NO: 3065269 - RNA, 14 nt, Human
ccucugcacucccc

SEQ ID NO: 3065270 - RNA, 19 nt, Human
ccucugcacuccccugcug

SEQ ID NO: 3065271 - RNA, 20 nt, Human
ccucugcacuccccugcugg

SEQ ID NO: 3065272 - RNA, 21 nt, Human
ccucugcacuccccugcuggg

SEQ ID NO: 3065273 - RNA, 22 nt, Human
ccucugcacuccccugcugggu

SEQ ID NO: 3065274 - RNA, 19 nt, Human
ccucugcagcaauaaagca

SEQ ID NO: 3065275 - RNA, 20 nt, Human
ccucugcacaagcugcaccc

SEQ ID NO: 3065276 - RNA, 17 nt, Human
ccucugcacaagcugca

SEQ ID NO: 3065277 - RNA, 19 nt, Human
ccucugcacaagcugcacc

SEQ ID NO: 3065278 - RNA, 11 nt, Human
ccucugcacaa

SEQ ID NO: 3065279 - RNA, 15 nt, Human
ccucugcacaagcug

SEQ ID NO: 3065280 - RNA, 18 nt, Human
ccucugacacacagcucu

SEQ ID NO: 3065281 - RNA, 17 nt, Human
ccucugacacacagcuc

SEQ ID NO: 3065282 - RNA, 14 nt, Human
ccuuugacaaaggu

SEQ ID NO: 3065283 - RNA, 23 nt, Human
ccuuugacgccaucccagcccca

SEQ ID NO: 3065284 - RNA, 16 nt, Human
ccuuugcuugaaagaa

SEQ ID NO: 3065285 - RNA, 13 nt, Human
ccuuuaagagaaa

SEQ ID NO: 3065286 - RNA, 16 nt, Human
ccuuguggucccaccc

SEQ ID NO: 3065287 - RNA, 19 nt, Human
ccuuguggucccaccccac

SEQ ID NO: 3065288 - RNA, 20 nt, Human
ccuuguggucccaccccaca

SEQ ID NO: 3065289 - RNA, 13 nt, Human
ccuuggcugcagg

SEQ ID NO: 3065290 - RNA, 12 nt, Human
ccuuggcugcag

SEQ ID NO: 3065291 - RNA, 21 nt, Human
cgauucuucugcuucagccuc

SEQ ID NO: 3065292 - RNA, 19 nt, Human
cgauucuucugcuucagcc

SEQ ID NO: 3065293 - RNA, 13 nt, Human
cgauucuucugcu

SEQ ID NO: 3065294 - RNA, 19 nt, Human
cgaucuggguucacugcaa

SEQ ID NO: 3065295 - RNA, 12 nt, Human
cgauuucuguuu

SEQ ID NO: 3065296 - RNA, 11 nt, Human
cgcaaugugac

SEQ ID NO: 3065297 - RNA, 23 nt, Human
cgcacuucgggaggucgaggcag

SEQ ID NO: 3065298 - RNA, 12 nt, Human
cgaggacaggga

SEQ ID NO: 3065299 - RNA, 13 nt, Human
cgaggacagggag

SEQ ID NO: 3065300 - RNA, 19 nt, Human
cgaggccuucucugaagga

SEQ ID NO: 3065301 - RNA, 18 nt, Human
cgaggccuucucugaagg

SEQ ID NO: 3065302 - RNA, 20 nt, Human
ccuuuguauucucuccugua

SEQ ID NO: 3065303 - RNA, 18 nt, Human
ccuuuguauucucuccug

SEQ ID NO: 3065304 - RNA, 15 nt, Human
ccuuuguauucucuc

SEQ ID NO: 3065305 - RNA, 20 nt, Human
cgcgugcacacaccagagcc

SEQ ID NO: 3065306 - RNA, 19 nt, Human
cgcgugcacacaccagagc

SEQ ID NO: 3065307 - RNA, 16 nt, Human
cgcgugcacacaccag

SEQ ID NO: 3065308 - RNA, 15 nt, Human
cgcuaagagggaggg

SEQ ID NO: 3065309 - RNA, 16 nt, Human
cgcuaagagggaggga

SEQ ID NO: 3065310 - RNA, 14 nt, Human
cgcuaagagggagg

SEQ ID NO: 3065311 - RNA, 16 nt, Human
cgcgacaaugcaaacc

SEQ ID NO: 3065312 - RNA, 17 nt, Human
cgcgacaaugcaaacca

SEQ ID NO: 3065313 - RNA, 15 nt, Human
cgcgacaaugcaaac

SEQ ID NO: 3065314 - RNA, 15 nt, Human
cgcccccacugguga

SEQ ID NO: 3065315 - RNA, 13 nt, Human
cgcagacaggacc

SEQ ID NO: 3065316 - RNA, 14 nt, Human
cgcagacaggacca

SEQ ID NO: 3065317 - RNA, 20 nt, Human
cgggaggauguucugggaca

SEQ ID NO: 3065318 - RNA, 12 nt, Human
cgggcaugacac

SEQ ID NO: 3065319 - RNA, 15 nt, Human
cgggcaugacacgaa

SEQ ID NO: 3065320 - RNA, 17 nt, Human
cgggaggucgaggcagg

SEQ ID NO: 3065321 - RNA, 16 nt, Human
cgggaggucgaggcag

SEQ ID NO: 3065322 - RNA, 15 nt, Human
cggcuggccuggccc

SEQ ID NO: 3065323 - RNA, 16 nt, Human
cggcuggccuggcccc

SEQ ID NO: 3065324 - RNA, 14 nt, Human
cggcuggccuggcc

SEQ ID NO: 3065325 - RNA, 18 nt, Human
cggcuggccuggccccuc

SEQ ID NO: 3065326 - RNA, 21 nt, Human
cggccccaccagugccucucc

SEQ ID NO: 3065327 - RNA, 18 nt, Human
cggccccaccagugccuc

SEQ ID NO: 3065328 - RNA, 20 nt, Human
cggccccaccagugccucuc

SEQ ID NO: 3065329 - RNA, 15 nt, Human
cggccccaccagugc

SEQ ID NO: 3065330 - RNA, 16 nt, Human
cggccccaccagugcc

SEQ ID NO: 3065331 - RNA, 17 nt, Human
cggccccaccagugccu

SEQ ID NO: 3065332 - RNA, 13 nt, Human
cggccccaccagu

SEQ ID NO: 3065333 - RNA, 14 nt, Human
cggccuccauccug

SEQ ID NO: 3065334 - RNA, 16 nt, Human
cggccuccauccugag

SEQ ID NO: 3065335 - RNA, 17 nt, Human
cggccuccauccugagg

SEQ ID NO: 3065336 - RNA, 17 nt, Human
cggaccccacuccggcc

SEQ ID NO: 3065337 - RNA, 21 nt, Human
cggaccccacuccggcccucc

SEQ ID NO: 3065338 - RNA, 16 nt, Human
cggaucuuuggacaga

SEQ ID NO: 3065339 - RNA, 19 nt, Human
cggaucuuuggacagaagc

SEQ ID NO: 3065340 - RNA, 20 nt, Human
cggaaugaaccacaucuugc

SEQ ID NO: 3065341 - RNA, 18 nt, Human
cggacagccacggccagg

SEQ ID NO: 3065342 - RNA, 16 nt, Human
cggacagccacggcca

SEQ ID NO: 3065343 - RNA, 15 nt, Human
cggacagccacggcc

SEQ ID NO: 3065344 - RNA, 13 nt, Human
cgcuccugugucu

SEQ ID NO: 3065345 - RNA, 22 nt, Human
cguauaaaagccuguuuaagag

SEQ ID NO: 3065346 - RNA, 21 nt, Human
cguauaaaagccuguuuaaga

SEQ ID NO: 3065347 - RNA, 17 nt, Human
cguauaaaagccuguuu

SEQ ID NO: 3065348 - RNA, 16 nt, Human
cguauaaaagccuguu

SEQ ID NO: 3065349 - RNA, 23 nt, Human
cggugcuaucucccccagcccca

SEQ ID NO: 3065350 - RNA, 16 nt, Human
cgucaacucauauuuu

SEQ ID NO: 3065351 - RNA, 20 nt, Human
cgucaacucauauuuucaug

SEQ ID NO: 3065352 - RNA, 14 nt, Human
cgucuaccugaggg

SEQ ID NO: 3065353 - RNA, 14 nt, Human
cgucugacaggcaa

SEQ ID NO: 3065354 - RNA, 13 nt, Human
cgucugacaggca

SEQ ID NO: 3065355 - RNA, 11 nt, Human
cguccccuguc

SEQ ID NO: 3065356 - RNA, 14 nt, Human
cguccccugucccc

SEQ ID NO: 3065357 - RNA, 21 nt, Human
cgugcacacaccagagcccac

SEQ ID NO: 3065358 - RNA, 20 nt, Human
cgugcacacaccagagccca

SEQ ID NO: 3065359 - RNA, 19 nt, Human
cgugcauaccacuuuuguu

SEQ ID NO: 3065360 - RNA, 18 nt, Human
cgugcauaccacuuuugu

SEQ ID NO: 3065361 - RNA, 14 nt, Human
cgugcauaccacuu

SEQ ID NO: 3065362 - RNA, 22 nt, Human
cgugcacacaccagagcccacc

SEQ ID NO: 3065363 - RNA, 22 nt, Human
cgugcaguggugcgaucugggu

SEQ ID NO: 3065364 - RNA, 12 nt, Human
cguggcugcuuc

SEQ ID NO: 3065365 - RNA, 14 nt, Human
cguggcugcuucaa

SEQ ID NO: 3065366 - RNA, 15 nt, Human
cguggcugcuucaag

SEQ ID NO: 3065367 - RNA, 21 nt, Human
cguuucuaaaggcuaccuuug

SEQ ID NO: 3065368 - RNA, 19 nt, Human
cguuucuaaaggcuaccuu

SEQ ID NO: 3065369 - RNA, 20 nt, Human
cguuucuaugacacaugcaa

SEQ ID NO: 3065370 - RNA, 13 nt, Human
cguuuucaaaauu

SEQ ID NO: 3065371 - RNA, 13 nt, Human
ccuugacagggca

SEQ ID NO: 3065372 - RNA, 14 nt, Human
ccuugacagggcac

SEQ ID NO: 3065373 - RNA, 19 nt, Human
ccuugaccauucuccaccu

SEQ ID NO: 3065374 - RNA, 20 nt, Human
ccuugaccauucuccaccug

SEQ ID NO: 3065375 - RNA, 17 nt, Human
ccuugacagggcacacc

SEQ ID NO: 3065376 - RNA, 15 nt, Human
ccuugacagggcaca

SEQ ID NO: 3065377 - RNA, 19 nt, Human
ccuuggauuguccccgacc

SEQ ID NO: 3065378 - RNA, 22 nt, Human
ccuugaguugauucagcucugc

SEQ ID NO: 3065379 - RNA, 23 nt, Human
ccuugaguugauucagcucugca

SEQ ID NO: 3065380 - RNA, 21 nt, Human
ccuugaccauucuccaccugc

SEQ ID NO: 3065381 - RNA, 20 nt, Human
ccuugaguugauucagcucu

SEQ ID NO: 3065382 - RNA, 17 nt, Human
ccuugaaugaugccaug

SEQ ID NO: 3065383 - RNA, 17 nt, Human
ccuugaacuuugaccuc

SEQ ID NO: 3065384 - RNA, 16 nt, Human
ccuugaacuggguacu

SEQ ID NO: 3065385 - RNA, 19 nt, Human
ccuugaaaacacuguucuc

SEQ ID NO: 3065386 - RNA, 21 nt, Human
ccuugaaaacacuguucucug

SEQ ID NO: 3065387 - RNA, 22 nt, Human
ccuugaaaacacuguucucugc

SEQ ID NO: 3065388 - RNA, 14 nt, Human
ccuugaacugggua

SEQ ID NO: 3065389 - RNA, 18 nt, Human
ccuucgcuccugugucuu

SEQ ID NO: 3065390 - RNA, 15 nt, Human
ccuucgcuccugugu

SEQ ID NO: 3065391 - RNA, 14 nt, Human
ccuucgcuccugug

SEQ ID NO: 3065392 - RNA, 13 nt, Human
ccuucgcuccugu

SEQ ID NO: 3065393 - RNA, 15 nt, Human
ccuugaaaacacugu

SEQ ID NO: 3065394 - RNA, 11 nt, Human
ccuuuggcuuc

SEQ ID NO: 3065395 - RNA, 14 nt, Human
ccuuaccagcagag

SEQ ID NO: 3065396 - RNA, 15 nt, Human
ccuuaccagcagagc

SEQ ID NO: 3065397 - RNA, 16 nt, Human
ccuuaccagcagagca

SEQ ID NO: 3065398 - RNA, 17 nt, Human
ccuuaccagcagagcac

SEQ ID NO: 3065399 - RNA, 19 nt, Human
ccuuacccucauguucuua

SEQ ID NO: 3065400 - RNA, 20 nt, Human
ccuuaccucggugccuuccu

SEQ ID NO: 3065401 - RNA, 14 nt, Human
ccuuaccugccagg

SEQ ID NO: 3065402 - RNA, 14 nt, Human
ccuuagacaguccc

SEQ ID NO: 3065403 - RNA, 21 nt, Human
ccuuagacagucccugccaau

SEQ ID NO: 3065404 - RNA, 18 nt, Human
ccuuagacagucccugcc

SEQ ID NO: 3065405 - RNA, 19 nt, Human
ccuuagacagucccugcca

SEQ ID NO: 3065406 - RNA, 16 nt, Human
ccuuagacagucccug

SEQ ID NO: 3065407 - RNA, 17 nt, Human
ccuuagacagucccugc

SEQ ID NO: 3065408 - RNA, 15 nt, Human
ccuuccagggguggg

SEQ ID NO: 3065409 - RNA, 16 nt, Human
ccuuccagggguggga

SEQ ID NO: 3065410 - RNA, 18 nt, Human
ccuuccaggggugggaca

SEQ ID NO: 3065411 - RNA, 22 nt, Human
ccuuccaggggugggacacccu

SEQ ID NO: 3065412 - RNA, 14 nt, Human
ccuuccucuuucca

SEQ ID NO: 3065413 - RNA, 20 nt, Human
ccuucagugccuuauggaac

SEQ ID NO: 3065414 - RNA, 15 nt, Human
ccuucagugccuuau

SEQ ID NO: 3065415 - RNA, 19 nt, Human
ccuucagugccuuauggaa

SEQ ID NO: 3065416 - RNA, 13 nt, Human
ccuucagugccuu

SEQ ID NO: 3065417 - RNA, 14 nt, Human
ccuucagugccuua

SEQ ID NO: 3065418 - RNA, 12 nt, Human
ccuucagugccu

SEQ ID NO: 3065419 - RNA, 12 nt, Human
ccuucagccuga

SEQ ID NO: 3065420 - RNA, 22 nt, Human
ccugugagcuaggaauuguguu

SEQ ID NO: 3065421 - RNA, 20 nt, Human
ccugugaguacuacaguccu

SEQ ID NO: 3065422 - RNA, 17 nt, Human
ccugucccccugacaac

SEQ ID NO: 3065423 - RNA, 16 nt, Human
ccugucccccugacaa

SEQ ID NO: 3065424 - RNA, 18 nt, Human
ccuguccccgcacugggc

SEQ ID NO: 3065425 - RNA, 17 nt, Human
ccugugccucugggacu

SEQ ID NO: 3065426 - RNA, 15 nt, Human
ccugugccucuggga

SEQ ID NO: 3065427 - RNA, 19 nt, Human
ccugugccucugggacugg

SEQ ID NO: 3065428 - RNA, 20 nt, Human
ccugugauggggcccugccu

SEQ ID NO: 3065429 - RNA, 21 nt, Human
ccugugauggggcccugccuc

SEQ ID NO: 3065430 - RNA, 22 nt, Human
ccugugauggggcccugccucc

SEQ ID NO: 3065431 - RNA, 18 nt, Human
ccugugauggggcccugc

SEQ ID NO: 3065432 - RNA, 19 nt, Human
ccugugauggggcccugcc

SEQ ID NO: 3065433 - RNA, 17 nt, Human
ccugugauggggcccug

SEQ ID NO: 3065434 - RNA, 13 nt, Human
ccugguggcagcu

SEQ ID NO: 3065435 - RNA, 12 nt, Human
ccugguggcagc

SEQ ID NO: 3065436 - RNA, 14 nt, Human
ccugguggcagcuc

SEQ ID NO: 3065437 - RNA, 16 nt, Human
ccugguggcagcucac

SEQ ID NO: 3065438 - RNA, 17 nt, Human
ccugguggcagcucacc

SEQ ID NO: 3065439 - RNA, 18 nt, Human
ccugguggcagcucaccu

SEQ ID NO: 3065440 - RNA, 12 nt, Human
ccuguaccucuu

SEQ ID NO: 3065441 - RNA, 20 nt, Human
ccuguaauccuagcacuuug

SEQ ID NO: 3065442 - RNA, 21 nt, Human
ccuguagagugggagcugagu

SEQ ID NO: 3065443 - RNA, 19 nt, Human
ccuguagagugggagcuga

SEQ ID NO: 3065444 - RNA, 23 nt, Human
ccuguagagugggagcugagugg

SEQ ID NO: 3065445 - RNA, 20 nt, Human
ccugcuuuuuauggccugug

SEQ ID NO: 3065446 - RNA, 21 nt, Human
ccugcuggguguggcgcagca

SEQ ID NO: 3065447 - RNA, 13 nt, Human
ccugcugguucag

SEQ ID NO: 3065448 - RNA, 19 nt, Human
ccugcugguucaggguugg

SEQ ID NO: 3065449 - RNA, 23 nt, Human
ccugcgucucauacucaccucac

SEQ ID NO: 3065450 - RNA, 19 nt, Human
ccugcaacaccuuguuucc

SEQ ID NO: 3065451 - RNA, 16 nt, Human
ccugcaaccugauugu

SEQ ID NO: 3065452 - RNA, 18 nt, Human
ccugcaacaccuuguuuc

SEQ ID NO: 3065453 - RNA, 13 nt, Human
ccugcuccagcug

SEQ ID NO: 3065454 - RNA, 14 nt, Human
ccugcuccagcugu

SEQ ID NO: 3065455 - RNA, 22 nt, Human
ccugcuccagcuguucagcugg

SEQ ID NO: 3065456 - RNA, 12 nt, Human
ccugcuccagcu

SEQ ID NO: 3065457 - RNA, 12 nt, Human
ccuggcggggug

SEQ ID NO: 3065458 - RNA, 14 nt, Human
ccuggccccucagg

SEQ ID NO: 3065459 - RNA, 12 nt, Human
ccuggcucugug

SEQ ID NO: 3065460 - RNA, 18 nt, Human
ccuggcucuguggcgagc

SEQ ID NO: 3065461 - RNA, 18 nt, Human
ccuggcaugggaaugaau

SEQ ID NO: 3065462 - RNA, 21 nt, Human
ccugggaggcucuggagccca

SEQ ID NO: 3065463 - RNA, 13 nt, Human
ccugggaggcucu

SEQ ID NO: 3065464 - RNA, 16 nt, Human
ccugggaucccucauc

SEQ ID NO: 3065465 - RNA, 20 nt, Human
ccugggaucccucauccuca

SEQ ID NO: 3065466 - RNA, 20 nt, Human
ccugggaggucaaggcugca

SEQ ID NO: 3065467 - RNA, 12 nt, Human
ccugggcagaag

SEQ ID NO: 3065468 - RNA, 14 nt, Human
ccugggcagaagga

SEQ ID NO: 3065469 - RNA, 20 nt, Human
ccuggacugugugcucagga

SEQ ID NO: 3065470 - RNA, 17 nt, Human
ccuggacugugugcuca

SEQ ID NO: 3065471 - RNA, 13 nt, Human
ccuggacugaggg

SEQ ID NO: 3065472 - RNA, 14 nt, Human
ccuggacugagggg

SEQ ID NO: 3065473 - RNA, 21 nt, Human
ccuggacugagggggccugga

SEQ ID NO: 3065474 - RNA, 22 nt, Human
ccuggacugagggggccuggau

SEQ ID NO: 3065475 - RNA, 13 nt, Human
ccuggacccugug

SEQ ID NO: 3065476 - RNA, 14 nt, Human
ccuggacccugugg

SEQ ID NO: 3065477 - RNA, 20 nt, Human
ccuggcacugcuuccaguga

SEQ ID NO: 3065478 - RNA, 17 nt, Human
ccuggcacugcuuccag

SEQ ID NO: 3065479 - RNA, 23 nt, Human
ccuggacugagggggccuggaug

SEQ ID NO: 3065480 - RNA, 21 nt, Human
ccuggcacugcuuccagugag

SEQ ID NO: 3065481 - RNA, 13 nt, Human
ccuggcacuggca

SEQ ID NO: 3065482 - RNA, 14 nt, Human
ccuggcagccccug

SEQ ID NO: 3065483 - RNA, 22 nt, Human
ccuggcacuggcaaacagggcc

SEQ ID NO: 3065484 - RNA, 23 nt, Human
ccuggcacuggcaaacagggccu

SEQ ID NO: 3065485 - RNA, 16 nt, Human
ccuggcagccccuguu

SEQ ID NO: 3065486 - RNA, 16 nt, Human
ccuggcaugggaauga

SEQ ID NO: 3065487 - RNA, 17 nt, Human
ccuggcaugggaaugaa

SEQ ID NO: 3065488 - RNA, 14 nt, Human
ccuggcaugggaau

SEQ ID NO: 3065489 - RNA, 22 nt, Human
ccacacccagcccacuucugcc

SEQ ID NO: 3065490 - RNA, 21 nt, Human
ccacacccagcccacuucugc

SEQ ID NO: 3065491 - RNA, 15 nt, Human
ccacacccagcccac

SEQ ID NO: 3065492 - RNA, 20 nt, Human
ccacacccagcccacuucug

SEQ ID NO: 3065493 - RNA, 20 nt, Human
ccacaccauaagcuacugcc

SEQ ID NO: 3065494 - RNA, 21 nt, Human
ccacaccauaagcuacugcca

SEQ ID NO: 3065495 - RNA, 22 nt, Human
ccacaccauaagcuacugccau

SEQ ID NO: 3065496 - RNA, 20 nt, Human
ccacaggaaccacaagacug

SEQ ID NO: 3065497 - RNA, 16 nt, Human
ccacaggaucagucug

SEQ ID NO: 3065498 - RNA, 21 nt, Human
ccaccaacauacucccaucug

SEQ ID NO: 3065499 - RNA, 17 nt, Human
ccacaucuugcucugcu

SEQ ID NO: 3065500 - RNA, 18 nt, Human
ccacaucuugcucugcug

SEQ ID NO: 3065501 - RNA, 19 nt, Human
ccacaucuugcucugcuga

SEQ ID NO: 3065502 - RNA, 16 nt, Human
ccacauuccugaugcu

SEQ ID NO: 3065503 - RNA, 16 nt, Human
ccacaugugcacaugc

SEQ ID NO: 3065504 - RNA, 16 nt, Human
ccaauauucauagcag

SEQ ID NO: 3065505 - RNA, 17 nt, Human
ccacccccacccaaggg

SEQ ID NO: 3065506 - RNA, 23 nt, Human
ccacccaggagccccgaggccuu

SEQ ID NO: 3065507 - RNA, 21 nt, Human
ccacccaggagccccgaggcc

SEQ ID NO: 3065508 - RNA, 22 nt, Human
ccagaaguuugagaucagccug

SEQ ID NO: 3065509 - RNA, 23 nt, Human
ccagaaguuugagaucagccugg

SEQ ID NO: 3065510 - RNA, 23 nt, Human
ccacugcacuccagccuggguga

SEQ ID NO: 3065511 - RNA, 13 nt, Human
ccacugcagaaga

SEQ ID NO: 3065512 - RNA, 18 nt, Human
ccacugcagaagacagua

SEQ ID NO: 3065513 - RNA, 13 nt, Human
ccacuucagcuga

SEQ ID NO: 3065514 - RNA, 14 nt, Human
ccacuucagcugac

SEQ ID NO: 3065515 - RNA, 20 nt, Human
ccagacaccuugacagggca

SEQ ID NO: 3065516 - RNA, 21 nt, Human
ccagacaccuugacagggcac

SEQ ID NO: 3065517 - RNA, 21 nt, Human
ccagaauuucccaaagcagug

SEQ ID NO: 3065518 - RNA, 18 nt, Human
ccagaauuucccaaagca

SEQ ID NO: 3065519 - RNA, 12 nt, Human
ccagaauuuccc

SEQ ID NO: 3065520 - RNA, 19 nt, Human
ccagaauuucccaaagcag

SEQ ID NO: 3065521 - RNA, 14 nt, Human
ccacgguguucugu

SEQ ID NO: 3065522 - RNA, 23 nt, Human
ccacggccaggccagagggagug

SEQ ID NO: 3065523 - RNA, 18 nt, Human
ccacggccaggccagagg

SEQ ID NO: 3065524 - RNA, 16 nt, Human
ccacggccaggccaga

SEQ ID NO: 3065525 - RNA, 19 nt, Human
ccacgcuggagugcaguga

SEQ ID NO: 3065526 - RNA, 18 nt, Human
ccacgcuggagugcagug

SEQ ID NO: 3065527 - RNA, 15 nt, Human
ccacccccacccaag

SEQ ID NO: 3065528 - RNA, 13 nt, Human
ccacgcuggagug

SEQ ID NO: 3065529 - RNA, 16 nt, Human
ccacgcuggagugcag

SEQ ID NO: 3065530 - RNA, 15 nt, Human
ccaccccacacacgc

SEQ ID NO: 3065531 - RNA, 14 nt, Human
ccacuacauucugu

SEQ ID NO: 3065532 - RNA, 15 nt, Human
ccacuacauucuguu

SEQ ID NO: 3065533 - RNA, 11 nt, Human
ccacuacauuc

SEQ ID NO: 3065534 - RNA, 17 nt, Human
ccacuacauucuguuaa

SEQ ID NO: 3065535 - RNA, 16 nt, Human
ccacuacauucuguua

SEQ ID NO: 3065536 - RNA, 15 nt, Human
cauuuccuaaauaua

SEQ ID NO: 3065537 - RNA, 17 nt, Human
cauuuaggccaugggac

SEQ ID NO: 3065538 - RNA, 16 nt, Human
cauuuaaaagauacag

SEQ ID NO: 3065539 - RNA, 15 nt, Human
cauuuaaaagauaca

SEQ ID NO: 3065540 - RNA, 12 nt, Human
cauuuaaaagau

SEQ ID NO: 3065541 - RNA, 13 nt, Human
cauuuccuguguc

SEQ ID NO: 3065542 - RNA, 12 nt, Human
cauuuccugugu

SEQ ID NO: 3065543 - RNA, 23 nt, Human
cauuguauucagaguugaugguu

SEQ ID NO: 3065544 - RNA, 18 nt, Human
cauuguuggccaaagcca

SEQ ID NO: 3065545 - RNA, 17 nt, Human
cauuguuggccaaagcc

SEQ ID NO: 3065546 - RNA, 14 nt, Human
cacccaagggccug

SEQ ID NO: 3065547 - RNA, 15 nt, Human
cacccaagggccugg

SEQ ID NO: 3065548 - RNA, 17 nt, Human
ccaaacucaccugcccc

SEQ ID NO: 3065549 - RNA, 19 nt, Human
cauuuuagggguagcauuu

SEQ ID NO: 3065550 - RNA, 20 nt, Human
cauuugaaaauuuugauguu

SEQ ID NO: 3065551 - RNA, 22 nt, Human
cauuugaaaauuuugauguuuu

SEQ ID NO: 3065552 - RNA, 13 nt, Human
cauuugcuccuuu

SEQ ID NO: 3065553 - RNA, 14 nt, Human
cauuugcuccuuuc

SEQ ID NO: 3065554 - RNA, 13 nt, Human
cauuugcucaugg

SEQ ID NO: 3065555 - RNA, 18 nt, Human
cauuugcucauggaauug

SEQ ID NO: 3065556 - RNA, 22 nt, Human
cauuuguuugaacugauaaaga

SEQ ID NO: 3065557 - RNA, 20 nt, Human
cauuuguuugaacugauaaa

SEQ ID NO: 3065558 - RNA, 17 nt, Human
cauuuguuugaacugau

SEQ ID NO: 3065559 - RNA, 18 nt, Human
cauuugagcagggcucag

SEQ ID NO: 3065560 - RNA, 17 nt, Human
cauuugagcagggcuca

SEQ ID NO: 3065561 - RNA, 20 nt, Human
cauuugagcagggcucagcg

SEQ ID NO: 3065562 - RNA, 16 nt, Human
cauuugagcagggcuc

SEQ ID NO: 3065563 - RNA, 15 nt, Human
ccaagcucccaggca

SEQ ID NO: 3065564 - RNA, 16 nt, Human
ccaagcucccaggcau

SEQ ID NO: 3065565 - RNA, 22 nt, Human
ccaagcucccaggcauucccca

SEQ ID NO: 3065566 - RNA, 17 nt, Human
ccaaggccaaaggaagc

SEQ ID NO: 3065567 - RNA, 14 nt, Human
ccaagcucccaggc

SEQ ID NO: 3065568 - RNA, 22 nt, Human
ccaagcauaccaacacgagcag

SEQ ID NO: 3065569 - RNA, 17 nt, Human
ccaagcauuuagaugua

SEQ ID NO: 3065570 - RNA, 23 nt, Human
ccaagguuuggggaagaacgaag

SEQ ID NO: 3065571 - RNA, 13 nt, Human
ccaaggugggagg

SEQ ID NO: 3065572 - RNA, 20 nt, Human
ccaagucaagugaaaaagga

SEQ ID NO: 3065573 - RNA, 19 nt, Human
ccaagggccuggccugagc

SEQ ID NO: 3065574 - RNA, 16 nt, Human
ccaagggccuggccug

SEQ ID NO: 3065575 - RNA, 18 nt, Human
ccaagggccuggccugag

SEQ ID NO: 3065576 - RNA, 22 nt, Human
ccaaggggaauguuugccucug

SEQ ID NO: 3065577 - RNA, 18 nt, Human
ccaaggccaaaggaagca

SEQ ID NO: 3065578 - RNA, 21 nt, Human
ccaaggccaaaggaagcacau

SEQ ID NO: 3065579 - RNA, 15 nt, Human
ccaagggccuggccu

SEQ ID NO: 3065580 - RNA, 14 nt, Human
ccaagcaaguauua

SEQ ID NO: 3065581 - RNA, 15 nt, Human
ccaagaagcccagga

SEQ ID NO: 3065582 - RNA, 12 nt, Human
ccaacccucauc

SEQ ID NO: 3065583 - RNA, 19 nt, Human
ccaagaagcccaggaaagg

SEQ ID NO: 3065584 - RNA, 20 nt, Human
ccaagaagcccaggaaaggc

SEQ ID NO: 3065585 - RNA, 17 nt, Human
ccaaagccuccuccagc

SEQ ID NO: 3065586 - RNA, 22 nt, Human
ccaaagccuccuccagccgcca

SEQ ID NO: 3065587 - RNA, 19 nt, Human
ccaaagcagugcaugcugu

SEQ ID NO: 3065588 - RNA, 22 nt, Human
ccaaacugacucuuaagaagac

SEQ ID NO: 3065589 - RNA, 23 nt, Human
ccaaagcagugcaugcugucccu

SEQ ID NO: 3065590 - RNA, 19 nt, Human
ccaaagccaaagcuaggcc

SEQ ID NO: 3065591 - RNA, 20 nt, Human
ccaaacucaccugccccuca

SEQ ID NO: 3065592 - RNA, 15 nt, Human
ccaaagcuaggccug

SEQ ID NO: 3065593 - RNA, 17 nt, Human
ccaaagcuaggccuggc

SEQ ID NO: 3065594 - RNA, 16 nt, Human
ccaaagcuaggccugg

SEQ ID NO: 3065595 - RNA, 21 nt, Human
ccaaagcuaggccuggccaga

SEQ ID NO: 3065596 - RNA, 16 nt, Human
ccaaaggcucucuccu

SEQ ID NO: 3065597 - RNA, 15 nt, Human
ccaaaggaagcacau

SEQ ID NO: 3065598 - RNA, 23 nt, Human
ccaaaggaagcacaugccucucu

SEQ ID NO: 3065599 - RNA, 20 nt, Human
ccaaaguacacuguuucaaa

SEQ ID NO: 3065600 - RNA, 23 nt, Human
ccaaauuucauaccuaucaucuu

SEQ ID NO: 3065601 - RNA, 18 nt, Human
ccaaaguacacuguuuca

SEQ ID NO: 3065602 - RNA, 15 nt, Human
ccaaaguacacuguu

SEQ ID NO: 3065603 - RNA, 17 nt, Human
ccaacauacucccaucu

SEQ ID NO: 3065604 - RNA, 18 nt, Human
ccaacauacucccaucug

SEQ ID NO: 3065605 - RNA, 19 nt, Human
ccaacauacucccaucugu

SEQ ID NO: 3065606 - RNA, 20 nt, Human
ccaacauacucccaucugug

SEQ ID NO: 3065607 - RNA, 16 nt, Human
ccaacauacucccauc

SEQ ID NO: 3065608 - RNA, 21 nt, Human
ccaacauacucccaucuguga

SEQ ID NO: 3065609 - RNA, 22 nt, Human
ccaacauacucccaucugugaa

SEQ ID NO: 3065610 - RNA, 17 nt, Human
cccaagggccuggccug

SEQ ID NO: 3065611 - RNA, 23 nt, Human
cccaaauggaaaugggcagagca

SEQ ID NO: 3065612 - RNA, 18 nt, Human
cccaagggccuggccuga

SEQ ID NO: 3065613 - RNA, 19 nt, Human
cccaagggccuggccugag

SEQ ID NO: 3065614 - RNA, 23 nt, Human
cccaagggccuggccugagcugg

SEQ ID NO: 3065615 - RNA, 17 nt, Human
cccacaccauaagcuac

SEQ ID NO: 3065616 - RNA, 21 nt, Human
cccacaccauaagcuacugcc

SEQ ID NO: 3065617 - RNA, 23 nt, Human
cccaaugcacuuuguucuggcuc

SEQ ID NO: 3065618 - RNA, 18 nt, Human
cccagcaagugagagcug

SEQ ID NO: 3065619 - RNA, 16 nt, Human
cccagcaagugagagc

SEQ ID NO: 3065620 - RNA, 22 nt, Human
cccagauugcaacaggcugggc

SEQ ID NO: 3065621 - RNA, 21 nt, Human
cccagauugcaacaggcuggg

SEQ ID NO: 3065622 - RNA, 20 nt, Human
cccagauugcaacaggcugg

SEQ ID NO: 3065623 - RNA, 20 nt, Human
cccagagggccugcaaggga

SEQ ID NO: 3065624 - RNA, 18 nt, Human
cccagagggccugcaagg

SEQ ID NO: 3065625 - RNA, 15 nt, Human
cccagcgagcccugg

SEQ ID NO: 3065626 - RNA, 19 nt, Human
cccagccuggaugccaucc

SEQ ID NO: 3065627 - RNA, 18 nt, Human
cccagcgagcccuggugg

SEQ ID NO: 3065628 - RNA, 17 nt, Human
cccagcgagcccuggug

SEQ ID NO: 3065629 - RNA, 23 nt, Human
cccagcgagcccugguggcagug

SEQ ID NO: 3065630 - RNA, 19 nt, Human
cccagcgagcccugguggc

SEQ ID NO: 3065631 - RNA, 12 nt, Human
cccagccugcua

SEQ ID NO: 3065632 - RNA, 18 nt, Human
cccagccuggaugccauc

SEQ ID NO: 3065633 - RNA, 14 nt, Human
cccagccuggaugc

SEQ ID NO: 3065634 - RNA, 22 nt, Human
cccagcaagugagagcugggug

SEQ ID NO: 3065635 - RNA, 21 nt, Human
cccagcaagugagagcugggu

SEQ ID NO: 3065636 - RNA, 20 nt, Human
cccagcaagugagagcuggg

SEQ ID NO: 3065637 - RNA, 19 nt, Human
cccagcaagugagagcugg

SEQ ID NO: 3065638 - RNA, 11 nt, Human
cccagccccuu

SEQ ID NO: 3065639 - RNA, 17 nt, Human
cccaggccuccuacagc

SEQ ID NO: 3065640 - RNA, 18 nt, Human
cccaggccuccuacagcu

SEQ ID NO: 3065641 - RNA, 22 nt, Human
cccaggugcuaggaacacuccu

SEQ ID NO: 3065642 - RNA, 13 nt, Human
cccaggugccagu

SEQ ID NO: 3065643 - RNA, 23 nt, Human
cccaggugcuaggaacacuccuu

SEQ ID NO: 3065644 - RNA, 13 nt, Human
cccagugcccaca

SEQ ID NO: 3065645 - RNA, 20 nt, Human
cccagucuggaaugcagugg

SEQ ID NO: 3065646 - RNA, 22 nt, Human
cccaggccccugccacccuggg

SEQ ID NO: 3065647 - RNA, 21 nt, Human
cccaggccccugccacccugg

SEQ ID NO: 3065648 - RNA, 18 nt, Human
cccaggccccugccaccc

SEQ ID NO: 3065649 - RNA, 16 nt, Human
cccaggccccugccac

SEQ ID NO: 3065650 - RNA, 11 nt, Human
cccaggccccu

SEQ ID NO: 3065651 - RNA, 22 nt, Human
cccaggcauuccccaggaggcc

SEQ ID NO: 3065652 - RNA, 23 nt, Human
cccaggcauuccccaggaggcca

SEQ ID NO: 3065653 - RNA, 20 nt, Human
cccaggcauuccccaggagg

SEQ ID NO: 3065654 - RNA, 21 nt, Human
cccaggcauuccccaggaggc

SEQ ID NO: 3065655 - RNA, 18 nt, Human
cccaggcauuccccagga

SEQ ID NO: 3065656 - RNA, 17 nt, Human
cccaggcaggucuugaa

SEQ ID NO: 3065657 - RNA, 13 nt, Human
cccaggaggccag

SEQ ID NO: 3065658 - RNA, 22 nt, Human
cccaggaggccagccuugacca

SEQ ID NO: 3065659 - RNA, 18 nt, Human
cccaggagccccgaggcc

SEQ ID NO: 3065660 - RNA, 21 nt, Human
cccaggagccccgaggccuuc

SEQ ID NO: 3065661 - RNA, 13 nt, Human
cccaggcaggucu

SEQ ID NO: 3065662 - RNA, 11 nt, Human
cccaggcaggu

SEQ ID NO: 3065663 - RNA, 17 nt, Human
ccccaggaggccagccu

SEQ ID NO: 3065664 - RNA, 17 nt, Human
cccaugcugcccuguga

SEQ ID NO: 3065665 - RNA, 18 nt, Human
cccaugcugcccugugag

SEQ ID NO: 3065666 - RNA, 15 nt, Human
cccaugcugcccugu

SEQ ID NO: 3065667 - RNA, 16 nt, Human
cccaugcugcccugug

SEQ ID NO: 3065668 - RNA, 18 nt, Human
cccagugccgagaaggaa

SEQ ID NO: 3065669 - RNA, 17 nt, Human
cccagugccgagaagga

SEQ ID NO: 3065670 - RNA, 20 nt, Human
cccagugcccacaggaucag

SEQ ID NO: 3065671 - RNA, 15 nt, Human
cccagugcccacagg

SEQ ID NO: 3065672 - RNA, 14 nt, Human
ccccacccaagggc

SEQ ID NO: 3065673 - RNA, 20 nt, Human
ccccacccaagggccuggcc

SEQ ID NO: 3065674 - RNA, 16 nt, Human
ccccaccagugccucu

SEQ ID NO: 3065675 - RNA, 15 nt, Human
ccccaccagugccuc

SEQ ID NO: 3065676 - RNA, 22 nt, Human
ccccaccagugccucucccugc

SEQ ID NO: 3065677 - RNA, 17 nt, Human
ccccaccagugccucuc

SEQ ID NO: 3065678 - RNA, 18 nt, Human
ccccaccagugccucucc

SEQ ID NO: 3065679 - RNA, 22 nt, Human
ccccaaauggaaaugggcagag

SEQ ID NO: 3065680 - RNA, 17 nt, Human
ccccaagacucccauga

SEQ ID NO: 3065681 - RNA, 23 nt, Human
ccagcuggggccaggcugggucg

SEQ ID NO: 3065682 - RNA, 22 nt, Human
ccagcuggggccaggcuggguc

SEQ ID NO: 3065683 - RNA, 21 nt, Human
ccagcuggggccaggcugggu

SEQ ID NO: 3065684 - RNA, 20 nt, Human
ccagcuggggccaggcuggg

SEQ ID NO: 3065685 - RNA, 19 nt, Human
ccagcuggggccaggcugg

SEQ ID NO: 3065686 - RNA, 18 nt, Human
ccagcuggggccaggcug

SEQ ID NO: 3065687 - RNA, 17 nt, Human
ccagcuggggccaggcu

SEQ ID NO: 3065688 - RNA, 20 nt, Human
ccaggaagccagcaggcucu

SEQ ID NO: 3065689 - RNA, 22 nt, Human
ccaggaagccagcaggcucuca

SEQ ID NO: 3065690 - RNA, 14 nt, Human
ccagcucuggucca

SEQ ID NO: 3065691 - RNA, 17 nt, Human
ccagcucugguccauag

SEQ ID NO: 3065692 - RNA, 21 nt, Human
ccagcucugguccauagagag

SEQ ID NO: 3065693 - RNA, 22 nt, Human
ccagcucugguccauagagagc

SEQ ID NO: 3065694 - RNA, 20 nt, Human
ccagcugcuugggcuucauc

SEQ ID NO: 3065695 - RNA, 22 nt, Human
ccagcugcugagauccuggacu

SEQ ID NO: 3065696 - RNA, 23 nt, Human
ccagcugcugagauccuggacug

SEQ ID NO: 3065697 - RNA, 21 nt, Human
ccagcugcugagauccuggac

SEQ ID NO: 3065698 - RNA, 20 nt, Human
ccagcugcugagauccugga

SEQ ID NO: 3065699 - RNA, 23 nt, Human
ccagcugcuugggcuucauccuc

SEQ ID NO: 3065700 - RNA, 19 nt, Human
ccagccuugaccauucucc

SEQ ID NO: 3065701 - RNA, 20 nt, Human
ccagccuugaccauucucca

SEQ ID NO: 3065702 - RNA, 16 nt, Human
ccagagcccaccuugg

SEQ ID NO: 3065703 - RNA, 22 nt, Human
ccagagcccaccuuggcucaag

SEQ ID NO: 3065704 - RNA, 16 nt, Human
ccagcgagcccuggug

SEQ ID NO: 3065705 - RNA, 15 nt, Human
ccagcgagcccuggu

SEQ ID NO: 3065706 - RNA, 13 nt, Human
ccagcgagcccug

SEQ ID NO: 3065707 - RNA, 14 nt, Human
ccagcgagcccugg

SEQ ID NO: 3065708 - RNA, 12 nt, Human
ccagcucugguc

SEQ ID NO: 3065709 - RNA, 13 nt, Human
ccagcucuggucc

SEQ ID NO: 3065710 - RNA, 11 nt, Human
ccagcucuggu

SEQ ID NO: 3065711 - RNA, 19 nt, Human
ccaggcuuuuuuaucaugu

SEQ ID NO: 3065712 - RNA, 15 nt, Human
ccagggcaucuggga

SEQ ID NO: 3065713 - RNA, 16 nt, Human
ccagggcaucugggag

SEQ ID NO: 3065714 - RNA, 13 nt, Human
ccaggccccugcc

SEQ ID NO: 3065715 - RNA, 19 nt, Human
ccaggcuggucucaaacuc

SEQ ID NO: 3065716 - RNA, 14 nt, Human
ccaggcuggucuca

SEQ ID NO: 3065717 - RNA, 20 nt, Human
ccaggcuguaucccaugagc

SEQ ID NO: 3065718 - RNA, 20 nt, Human
ccagugaauucuugaaggaa

SEQ ID NO: 3065719 - RNA, 16 nt, Human
ccagugaauucuugaa

SEQ ID NO: 3065720 - RNA, 14 nt, Human
ccagguucagcuug

SEQ ID NO: 3065721 - RNA, 23 nt, Human
ccaguaaaugggggugcauuuga

SEQ ID NO: 3065722 - RNA, 19 nt, Human
ccaggugcuaggaacacuc

SEQ ID NO: 3065723 - RNA, 17 nt, Human
ccaggugccaguuaugg

SEQ ID NO: 3065724 - RNA, 13 nt, Human
ccaggugccaguu

SEQ ID NO: 3065725 - RNA, 15 nt, Human
ccaggagcagccaca

SEQ ID NO: 3065726 - RNA, 16 nt, Human
ccaggagcagccacau

SEQ ID NO: 3065727 - RNA, 15 nt, Human
ccaggagccccgagg

SEQ ID NO: 3065728 - RNA, 13 nt, Human
ccaggcauggugg

SEQ ID NO: 3065729 - RNA, 14 nt, Human
ccaggcauucccca

SEQ ID NO: 3065730 - RNA, 24 nt, Human
ccaggcauuccccaggaggccagc

SEQ ID NO: 3065731 - RNA, 23 nt, Human
ccaggcauuccccaggaggccag

SEQ ID NO: 3065732 - RNA, 22 nt, Human
ccaggcauuccccaggaggcca

SEQ ID NO: 3065733 - RNA, 13 nt, Human
ccaggagccuccu

SEQ ID NO: 3065734 - RNA, 14 nt, Human
ccaggagccuccug

SEQ ID NO: 3065735 - RNA, 18 nt, Human
ccaggagccuccugcccu

SEQ ID NO: 3065736 - RNA, 12 nt, Human
ccaggagccucc

SEQ ID NO: 3065737 - RNA, 12 nt, Human
ccaggaggccag

SEQ ID NO: 3065738 - RNA, 13 nt, Human
ccaggaggccagc

SEQ ID NO: 3065739 - RNA, 12 nt, Human
cccaaagaugca

SEQ ID NO: 3065740 - RNA, 15 nt, Human
cccaaagaugcagcc

SEQ ID NO: 3065741 - RNA, 16 nt, Human
cccaaagcagugcaug

SEQ ID NO: 3065742 - RNA, 20 nt, Human
cccaaaacucuccucugcug

SEQ ID NO: 3065743 - RNA, 13 nt, Human
cccaaaaggcaga

SEQ ID NO: 3065744 - RNA, 18 nt, Human
cccaaaaggcagaagcaa

SEQ ID NO: 3065745 - RNA, 23 nt, Human
ccauuuuggauucuuauggacaa

SEQ ID NO: 3065746 - RNA, 20 nt, Human
ccauuuugggguacccacug

SEQ ID NO: 3065747 - RNA, 22 nt, Human
ccauuuugggguacccacugcu

SEQ ID NO: 3065748 - RNA, 18 nt, Human
ccauucugccugcccagg

SEQ ID NO: 3065749 - RNA, 17 nt, Human
ccauucugccugcccag

SEQ ID NO: 3065750 - RNA, 17 nt, Human
ccauucuccaccugcca

SEQ ID NO: 3065751 - RNA, 16 nt, Human
ccauucugccugccca

SEQ ID NO: 3065752 - RNA, 20 nt, Human
ccauucugccugcccaggcc

SEQ ID NO: 3065753 - RNA, 19 nt, Human
ccauucugccugcccaggc

SEQ ID NO: 3065754 - RNA, 14 nt, Human
ccauucuccaccug

SEQ ID NO: 3065755 - RNA, 21 nt, Human
ccauucugccugcccaggccc

SEQ ID NO: 3065756 - RNA, 13 nt, Human
ccauggacuuugu

SEQ ID NO: 3065757 - RNA, 14 nt, Human
ccauggacuuuguu

SEQ ID NO: 3065758 - RNA, 15 nt, Human
ccauucuccaccugc

SEQ ID NO: 3065759 - RNA, 16 nt, Human
ccauucuccaccugcc

SEQ ID NO: 3065760 - RNA, 22 nt, Human
ccaucauugaaaucuuuuugcu

SEQ ID NO: 3065761 - RNA, 12 nt, Human
ccauccucugua

SEQ ID NO: 3065762 - RNA, 19 nt, Human
ccauccucuguacagagcc

SEQ ID NO: 3065763 - RNA, 13 nt, Human
ccaucaccagaca

SEQ ID NO: 3065764 - RNA, 18 nt, Human
ccaucaaggguacacugc

SEQ ID NO: 3065765 - RNA, 17 nt, Human
ccagugaggcucugccc

SEQ ID NO: 3065766 - RNA, 14 nt, Human
ccauacauuugugu

SEQ ID NO: 3065767 - RNA, 20 nt, Human
ccagugaggcucugcccuug

SEQ ID NO: 3065768 - RNA, 18 nt, Human
ccagugaggcucugcccu

SEQ ID NO: 3065769 - RNA, 19 nt, Human
ccagugaggcucugcccuu

SEQ ID NO: 3065770 - RNA, 19 nt, Human
ccaugauuaaccacuucag

SEQ ID NO: 3065771 - RNA, 21 nt, Human
ccaugauuaaccacuucagcu

SEQ ID NO: 3065772 - RNA, 18 nt, Human
ccaugauguuuuccauga

SEQ ID NO: 3065773 - RNA, 16 nt, Human
ccaugauguuuagaaa

SEQ ID NO: 3065774 - RNA, 14 nt, Human
ccaugaagauguag

SEQ ID NO: 3065775 - RNA, 14 nt, Human
ccaugcugcccugu

SEQ ID NO: 3065776 - RNA, 11 nt, Human
ccaugcugccc

SEQ ID NO: 3065777 - RNA, 13 nt, Human
ccaugcugcccug

SEQ ID NO: 3065778 - RNA, 20 nt, Human
ccauccucuguacagagccc

SEQ ID NO: 3065779 - RNA, 17 nt, Human
cucugcacaagcugcac

SEQ ID NO: 3065780 - RNA, 18 nt, Human
cucugcacaagcugcacc

SEQ ID NO: 3065781 - RNA, 24 nt, Human
cucuugauucauaaugacuuaagc

SEQ ID NO: 3065782 - RNA, 13 nt, Human
cugaaagaggaau

SEQ ID NO: 3065783 - RNA, 17 nt, Human
cugaaagaggaaugaag

SEQ ID NO: 3065784 - RNA, 13 nt, Human
cucuugagccugg

SEQ ID NO: 3065785 - RNA, 14 nt, Human
cucuugagccuggg

SEQ ID NO: 3065786 - RNA, 22 nt, Human
cucuugauucauaaugacuuaa

SEQ ID NO: 3065787 - RNA, 15 nt, Human
cucuugagccuggga

SEQ ID NO: 3065788 - RNA, 16 nt, Human
cucuugagccugggag

SEQ ID NO: 3065789 - RNA, 23 nt, Human
cucuugagccuugaacuuugacc

SEQ ID NO: 3065790 - RNA, 23 nt, Human
cugacacacagcucuguccuggg

SEQ ID NO: 3065791 - RNA, 22 nt, Human
cugacacacagcucuguccugg

SEQ ID NO: 3065792 - RNA, 21 nt, Human
cugacacacagcucuguccug

SEQ ID NO: 3065793 - RNA, 20 nt, Human
cugacacacagcucuguccu

SEQ ID NO: 3065794 - RNA, 19 nt, Human
cugacacacagcucugucc

SEQ ID NO: 3065795 - RNA, 18 nt, Human
cugacacacagcucuguc

SEQ ID NO: 3065796 - RNA, 17 nt, Human
cugacacacagcucugu

SEQ ID NO: 3065797 - RNA, 16 nt, Human
cugacacacagcucug

SEQ ID NO: 3065798 - RNA, 15 nt, Human
cugacacacagcucu

SEQ ID NO: 3065799 - RNA, 13 nt, Human
cugacacacagcu

SEQ ID NO: 3065800 - RNA, 21 nt, Human
cugacacaugcugaacaucac

SEQ ID NO: 3065801 - RNA, 17 nt, Human
cugaucucucgugauug

SEQ ID NO: 3065802 - RNA, 18 nt, Human
cugaucucucgugauuga

SEQ ID NO: 3065803 - RNA, 14 nt, Human
cugaucucucguga

SEQ ID NO: 3065804 - RNA, 22 nt, Human
cugaggugggaggaucucuuga

SEQ ID NO: 3065805 - RNA, 13 nt, Human
cugaggugggagg

SEQ ID NO: 3065806 - RNA, 12 nt, Human
cugaggugggag

SEQ ID NO: 3065807 - RNA, 18 nt, Human
cugagggggccuggaugc

SEQ ID NO: 3065808 - RNA, 23 nt, Human
cugaggaauccagacccggcugc

SEQ ID NO: 3065809 - RNA, 14 nt, Human
cugaggggccucuu

SEQ ID NO: 3065810 - RNA, 21 nt, Human
cugaggaauccagacccggcu

SEQ ID NO: 3065811 - RNA, 19 nt, Human
cugacccugcuucaaauau

SEQ ID NO: 3065812 - RNA, 12 nt, Human
cugagcugggau

SEQ ID NO: 3065813 - RNA, 22 nt, Human
cugagcugggaugauuggaggg

SEQ ID NO: 3065814 - RNA, 22 nt, Human
cuccuagccugugccucuggga

SEQ ID NO: 3065815 - RNA, 17 nt, Human
cuccuuuagcgcccagu

SEQ ID NO: 3065816 - RNA, 16 nt, Human
cuccuuuagcgcccag

SEQ ID NO: 3065817 - RNA, 22 nt, Human
cuccuuuagcgcccaguugggu

SEQ ID NO: 3065818 - RNA, 23 nt, Human
cuccuuugugaggaagccgcugg

SEQ ID NO: 3065819 - RNA, 24 nt, Human
cuccuuuucacaguucucuccuuc

SEQ ID NO: 3065820 - RNA, 11 nt, Human
cucggugccuu

SEQ ID NO: 3065821 - RNA, 23 nt, Human
cucgguguggagaagcggcuggc

SEQ ID NO: 3065822 - RNA, 10 nt, Human
cucuccucug

SEQ ID NO: 3065823 - RNA, 17 nt, Human
cucucuggccuucggcc

SEQ ID NO: 3065824 - RNA, 19 nt, Human
cucucuggccuucggccuc

SEQ ID NO: 3065825 - RNA, 13 nt, Human
cucucccuuggau

SEQ ID NO: 3065826 - RNA, 20 nt, Human
cucucccugcugcuccuagg

SEQ ID NO: 3065827 - RNA, 13 nt, Human
cucuccuccuuuu

SEQ ID NO: 3065828 - RNA, 20 nt, Human
cucuccuccuuuucacaguu

SEQ ID NO: 3065829 - RNA, 16 nt, Human
cucuccgaccagacac

SEQ ID NO: 3065830 - RNA, 16 nt, Human
cucugcacaagcugca

SEQ ID NO: 3065831 - RNA, 22 nt, Human
cuccgcuuucuacccagcgagc

SEQ ID NO: 3065832 - RNA, 14 nt, Human
cuccgucaacucau

SEQ ID NO: 3065833 - RNA, 20 nt, Human
cuccgcuuucuacccagcga

SEQ ID NO: 3065834 - RNA, 21 nt, Human
cuccgcuuucuacccagcgag

SEQ ID NO: 3065835 - RNA, 19 nt, Human
cucccucuuucccucccuu

SEQ ID NO: 3065836 - RNA, 16 nt, Human
cucccucccucuuucc

SEQ ID NO: 3065837 - RNA, 15 nt, Human
cucccucuuucccuc

SEQ ID NO: 3065838 - RNA, 22 nt, Human
cuccagaauuucccaaagcagu

SEQ ID NO: 3065839 - RNA, 11 nt, Human
cuccagacaca

SEQ ID NO: 3065840 - RNA, 17 nt, Human
cucagaaucucaaauaa

SEQ ID NO: 3065841 - RNA, 16 nt, Human
cucagaaucucaaaua

SEQ ID NO: 3065842 - RNA, 21 nt, Human
cuccagaauuucccaaagcag

SEQ ID NO: 3065843 - RNA, 22 nt, Human
cuccaggcuguaucccaugagc

SEQ ID NO: 3065844 - RNA, 23 nt, Human
cuccaggcuguaucccaugagcc

SEQ ID NO: 3065845 - RNA, 19 nt, Human
cuccaggugcacaagcucc

SEQ ID NO: 3065846 - RNA, 20 nt, Human
cuccaggugcacaagcucca

SEQ ID NO: 3065847 - RNA, 18 nt, Human
cuccaggugcacaagcuc

SEQ ID NO: 3065848 - RNA, 21 nt, Human
cuccagugagacagcucugca

SEQ ID NO: 3065849 - RNA, 13 nt, Human
cucccaccucagc

SEQ ID NO: 3065850 - RNA, 11 nt, Human
cucccagccag

SEQ ID NO: 3065851 - RNA, 13 nt, Human
cucccagccaggc

SEQ ID NO: 3065852 - RNA, 14 nt, Human
cucccagccaggcc

SEQ ID NO: 3065853 - RNA, 16 nt, Human
cucccagccaggcccu

SEQ ID NO: 3065854 - RNA, 17 nt, Human
cucccaccucagccucc

SEQ ID NO: 3065855 - RNA, 16 nt, Human
cucccaccucagccuc

SEQ ID NO: 3065856 - RNA, 14 nt, Human
cucccaccucagcc

SEQ ID NO: 3065857 - RNA, 12 nt, Human
cucagaauauug

SEQ ID NO: 3065858 - RNA, 19 nt, Human
cucagaaaacaaggaugaa

SEQ ID NO: 3065859 - RNA, 23 nt, Human
cucagaaaacaaggaugaauuaa

SEQ ID NO: 3065860 - RNA, 18 nt, Human
cucacuuguuuuauuuaa

SEQ ID NO: 3065861 - RNA, 14 nt, Human
cucaccugccccuc

SEQ ID NO: 3065862 - RNA, 16 nt, Human
cucaccugccccucaa

SEQ ID NO: 3065863 - RNA, 18 nt, Human
cucaccugccccucaacu

SEQ ID NO: 3065864 - RNA, 13 nt, Human
cucaccugccccu

SEQ ID NO: 3065865 - RNA, 14 nt, Human
cucaccucucccuu

SEQ ID NO: 3065866 - RNA, 15 nt, Human
cucaccucucccuug

SEQ ID NO: 3065867 - RNA, 16 nt, Human
cucaccucucccuugg

SEQ ID NO: 3065868 - RNA, 17 nt, Human
cucaccucucccuugga

SEQ ID NO: 3065869 - RNA, 13 nt, Human
cucaccucucccu

SEQ ID NO: 3065870 - RNA, 18 nt, Human
cucaaaaaaagaaaaaga

SEQ ID NO: 3065871 - RNA, 17 nt, Human
cucaaaaaaagaaaaag

SEQ ID NO: 3065872 - RNA, 17 nt, Human
cuauguugcccaggcag

SEQ ID NO: 3065873 - RNA, 16 nt, Human
cuauguugcccaggca

SEQ ID NO: 3065874 - RNA, 13 nt, Human
cucaaaacugcac

SEQ ID NO: 3065875 - RNA, 20 nt, Human
cuaucucccccagccccauc

SEQ ID NO: 3065876 - RNA, 19 nt, Human
cuauguaucaaugaguaac

SEQ ID NO: 3065877 - RNA, 18 nt, Human
cuaucucccccagcccca

SEQ ID NO: 3065878 - RNA, 17 nt, Human
cuaugugagcacaaagg

SEQ ID NO: 3065879 - RNA, 16 nt, Human
cuauguaucaaugagu

SEQ ID NO: 3065880 - RNA, 22 nt, Human
cuauguguagggcgggaggaug

SEQ ID NO: 3065881 - RNA, 15 nt, Human
cuauguugcccaggc

SEQ ID NO: 3065882 - RNA, 14 nt, Human
cuauguugcccagg

SEQ ID NO: 3065883 - RNA, 14 nt, Human
cucacacaugagca

SEQ ID NO: 3065884 - RNA, 21 nt, Human
cucacacaugagcaucaggcc

SEQ ID NO: 3065885 - RNA, 14 nt, Human
cucacaaaggaugc

SEQ ID NO: 3065886 - RNA, 12 nt, Human
cucaaauaacua

SEQ ID NO: 3065887 - RNA, 20 nt, Human
cuacuagggaaaugccuuug

SEQ ID NO: 3065888 - RNA, 15 nt, Human
cuaccugaggggccu

SEQ ID NO: 3065889 - RNA, 16 nt, Human
cuaccugaggggccuc

SEQ ID NO: 3065890 - RNA, 19 nt, Human
cuaccugaggggccucuua

SEQ ID NO: 3065891 - RNA, 23 nt, Human
cuaccugaggggccucuuauggg

SEQ ID NO: 3065892 - RNA, 14 nt, Human
cuagggaagauaau

SEQ ID NO: 3065893 - RNA, 19 nt, Human
cuaguuugauuaaauucuu

SEQ ID NO: 3065894 - RNA, 17 nt, Human
cuaguuugauuaaauuc

SEQ ID NO: 3065895 - RNA, 20 nt, Human
cuaguuugauuaaauucuug

SEQ ID NO: 3065896 - RNA, 15 nt, Human
cuaguuugauuaaau

SEQ ID NO: 3065897 - RNA, 19 nt, Human
cuagcauacguacacauuu

SEQ ID NO: 3065898 - RNA, 18 nt, Human
cuagcauacguacacauu

SEQ ID NO: 3065899 - RNA, 16 nt, Human
cuagcauacguacaca

SEQ ID NO: 3065900 - RNA, 19 nt, Human
cuaggccuggccagaugca

SEQ ID NO: 3065901 - RNA, 18 nt, Human
cuaggccuggccagaugc

SEQ ID NO: 3065902 - RNA, 15 nt, Human
cuaggccuggccaga

SEQ ID NO: 3065903 - RNA, 14 nt, Human
cuaggccuggccag

SEQ ID NO: 3065904 - RNA, 12 nt, Human
cuaggccugggg

SEQ ID NO: 3065905 - RNA, 13 nt, Human
cuaggccugggga

SEQ ID NO: 3065906 - RNA, 13 nt, Human
cuaggccuggcca

SEQ ID NO: 3065907 - RNA, 19 nt, Human
cuagccagaggagagagga

SEQ ID NO: 3065908 - RNA, 17 nt, Human
cuagccagaggagagag

SEQ ID NO: 3065909 - RNA, 20 nt, Human
cgcuggggccaguugguccc

SEQ ID NO: 3065910 - RNA, 17 nt, Human
cgcuggggccaguuggu

SEQ ID NO: 3065911 - RNA, 23 nt, Human
cgcuggccgggaccccgagccug

SEQ ID NO: 3065912 - RNA, 18 nt, Human
cgcuggccgggaccccga

SEQ ID NO: 3065913 - RNA, 16 nt, Human
cgcugccccuggcagc

SEQ ID NO: 3065914 - RNA, 17 nt, Human
cgcugccccuggcagcc

SEQ ID NO: 3065915 - RNA, 13 nt, Human
cgcugccccuggc

SEQ ID NO: 3065916 - RNA, 23 nt, Human
cgcuggaccuugaacuggguacu

SEQ ID NO: 3065917 - RNA, 19 nt, Human
cgcuggaccuugaacuggg

SEQ ID NO: 3065918 - RNA, 18 nt, Human
cgcugccccuggcagccc

SEQ ID NO: 3065919 - RNA, 16 nt, Human
cgccuuaaggauguuc

SEQ ID NO: 3065920 - RNA, 24 nt, Human
cggagaagagcuguucacagccag

SEQ ID NO: 3065921 - RNA, 23 nt, Human
cggagaagagcuguucacagcca

SEQ ID NO: 3065922 - RNA, 13 nt, Human
cguacacauuuua

SEQ ID NO: 3065923 - RNA, 15 nt, Human
cgguuuauauaagcu

SEQ ID NO: 3065924 - RNA, 13 nt, Human
cguuaaaauacca

SEQ ID NO: 3065925 - RNA, 15 nt, Human
cuaaagcugccagcc

SEQ ID NO: 3065926 - RNA, 16 nt, Human
cuaaaggcuaccuuug

SEQ ID NO: 3065927 - RNA, 15 nt, Human
cuaaaggcuaccuuu

SEQ ID NO: 3065928 - RNA, 14 nt, Human
cuaaagcugccagc

SEQ ID NO: 3065929 - RNA, 19 nt, Human
cuaaaguguauuuuuuuac

SEQ ID NO: 3065930 - RNA, 19 nt, Human
cuaaaggcuaccuuuguau

SEQ ID NO: 3065931 - RNA, 17 nt, Human
cuaaaggcuaccuuugu

SEQ ID NO: 3065932 - RNA, 22 nt, Human
cuaaaguguauuuuuuuacuaa

SEQ ID NO: 3065933 - RNA, 14 nt, Human
ccuccgccucuugg

SEQ ID NO: 3065934 - RNA, 13 nt, Human
ccuccgccucuug

SEQ ID NO: 3065935 - RNA, 16 nt, Human
ccucccuucucuucac

SEQ ID NO: 3065936 - RNA, 18 nt, Human
ccuccuuuucacaguucu

SEQ ID NO: 3065937 - RNA, 23 nt, Human
ccuccuuugugaggaagccgcug

SEQ ID NO: 3065938 - RNA, 20 nt, Human
ccuccuuugugaggaagccg

SEQ ID NO: 3065939 - RNA, 20 nt, Human
ccucggaccccacuccggcc

SEQ ID NO: 3065940 - RNA, 22 nt, Human
ccucggaccccacuccggcccu

SEQ ID NO: 3065941 - RNA, 14 nt, Human
ccucggagaagagc

SEQ ID NO: 3065942 - RNA, 12 nt, Human
ccucggagaaga

SEQ ID NO: 3065943 - RNA, 16 nt, Human
ccucaacaccucugca

SEQ ID NO: 3065944 - RNA, 21 nt, Human
ccucaacucuccuccagaguc

SEQ ID NO: 3065945 - RNA, 23 nt, Human
ccucaacucuccuccagagucag

SEQ ID NO: 3065946 - RNA, 19 nt, Human
ccucaacucuccuccagag

SEQ ID NO: 3065947 - RNA, 15 nt, Human
ccucaaccuccuggg

SEQ ID NO: 3065948 - RNA, 18 nt, Human
ccucauuagcauuuugcu

SEQ ID NO: 3065949 - RNA, 12 nt, Human
ccucaggcaggu

SEQ ID NO: 3065950 - RNA, 18 nt, Human
ccucaggcaggugggaug

SEQ ID NO: 3065951 - RNA, 20 nt, Human
ccucaagugauucuccugcc

SEQ ID NO: 3065952 - RNA, 23 nt, Human
ccucaagugauucuccugccuca

SEQ ID NO: 3065953 - RNA, 17 nt, Human
ccucccaucacccgcua

SEQ ID NO: 3065954 - RNA, 17 nt, Human
ccuccaagaccuucucc

SEQ ID NO: 3065955 - RNA, 19 nt, Human
ccuccaagaccuucuccuu

SEQ ID NO: 3065956 - RNA, 16 nt, Human
ccuccaagaccuucuc

SEQ ID NO: 3065957 - RNA, 12 nt, Human
ccucccaucacc

SEQ ID NO: 3065958 - RNA, 12 nt, Human
ccuaauaaagcu

SEQ ID NO: 3065959 - RNA, 21 nt, Human
ccuagcauacguacacauuuu

SEQ ID NO: 3065960 - RNA, 23 nt, Human
ccuagccugugccucugggacug

SEQ ID NO: 3065961 - RNA, 19 nt, Human
ccuagccuuagaagucaca

SEQ ID NO: 3065962 - RNA, 22 nt, Human
ccuagccuuagaagucacacag

SEQ ID NO: 3065963 - RNA, 18 nt, Human
ccggccaccugcggugcu

SEQ ID NO: 3065964 - RNA, 17 nt, Human
ccggccaccugcggugc

SEQ ID NO: 3065965 - RNA, 14 nt, Human
cccuucucuccagc

SEQ ID NO: 3065966 - RNA, 19 nt, Human
cccuucucuccagccccug

SEQ ID NO: 3065967 - RNA, 21 nt, Human
cccuuuuuuggcugcugaagg

SEQ ID NO: 3065968 - RNA, 22 nt, Human
cccuuuuuuggcugcugaaggc

SEQ ID NO: 3065969 - RNA, 23 nt, Human
cccuuuuuuggcugcugaaggcu

SEQ ID NO: 3065970 - RNA, 23 nt, Human
cccugugaguacuacaguccucc

SEQ ID NO: 3065971 - RNA, 15 nt, Human
cccugugauggggcc

SEQ ID NO: 3065972 - RNA, 21 nt, Human
cccugugaguacuacaguccu

SEQ ID NO: 3065973 - RNA, 14 nt, Human
cccuccuuucacca

SEQ ID NO: 3065974 - RNA, 19 nt, Human
cccuguggaugcugcugcc

SEQ ID NO: 3065975 - RNA, 14 nt, Human
ccgcagcccugcag

SEQ ID NO: 3065976 - RNA, 18 nt, Human
ccgcagcccugcagaggg

SEQ ID NO: 3065977 - RNA, 13 nt, Human
ccugguguggaag

SEQ ID NO: 3065978 - RNA, 15 nt, Human
ccugguggcaguggg

SEQ ID NO: 3065979 - RNA, 20 nt, Human
ccugguggcagugggagcug

SEQ ID NO: 3065980 - RNA, 19 nt, Human
ccugguggcagugggagcu

SEQ ID NO: 3065981 - RNA, 18 nt, Human
ccugguggcagugggagc

SEQ ID NO: 3065982 - RNA, 15 nt, Human
ccuggggagaaagua

SEQ ID NO: 3065983 - RNA, 15 nt, Human
ccuggauggggcugc

SEQ ID NO: 3065984 - RNA, 13 nt, Human
ccuggaugccauc

SEQ ID NO: 3065985 - RNA, 14 nt, Human
ccuggaugccaucc

SEQ ID NO: 3065986 - RNA, 18 nt, Human
ccuggaugccauccaagu

SEQ ID NO: 3065987 - RNA, 14 nt, Human
ccuggaugcccccu

SEQ ID NO: 3065988 - RNA, 17 nt, Human
ccuggauggggcugcac

SEQ ID NO: 3065989 - RNA, 18 nt, Human
ccuggauggggcugcacc

SEQ ID NO: 3065990 - RNA, 19 nt, Human
ccuggaugcccccugugga

SEQ ID NO: 3065991 - RNA, 16 nt, Human
ccuggaugcccccugu

SEQ ID NO: 3065992 - RNA, 18 nt, Human
ccuggaugcccccugugg

SEQ ID NO: 3065993 - RNA, 16 nt, Human
ccuggccccucagggu

SEQ ID NO: 3065994 - RNA, 18 nt, Human
ccuggccccucagggucc

SEQ ID NO: 3065995 - RNA, 20 nt, Human
ccuggccccucagggucccu

SEQ ID NO: 3065996 - RNA, 21 nt, Human
ccuggccccucagggucccug

SEQ ID NO: 3065997 - RNA, 22 nt, Human
ccuggccucaagugauucuccu

SEQ ID NO: 3065998 - RNA, 20 nt, Human
ccuggccugagcugggauga

SEQ ID NO: 3065999 - RNA, 17 nt, Human
ccugucucuacuaaaaa

SEQ ID NO: 3066000 - RNA, 13 nt, Human
ccugccucucugc

SEQ ID NO: 3066001 - RNA, 15 nt, Human
ccugccucucugcag

SEQ ID NO: 3066002 - RNA, 14 nt, Human
ccugccucucugca

SEQ ID NO: 3066003 - RNA, 18 nt, Human
ccugcccaccuggccucu

SEQ ID NO: 3066004 - RNA, 19 nt, Human
ccugcccaccuggccucug

SEQ ID NO: 3066005 - RNA, 19 nt, Human
ccugcccaggccccugcca

SEQ ID NO: 3066006 - RNA, 18 nt, Human
ccugcccaggccccugcc

SEQ ID NO: 3066007 - RNA, 21 nt, Human
ccugcccaggccccugccacc

SEQ ID NO: 3066008 - RNA, 15 nt, Human
ccugccucagccucc

SEQ ID NO: 3066009 - RNA, 16 nt, Human
ccugccucagccuccc

SEQ ID NO: 3066010 - RNA, 15 nt, Human
ccugcccaccuggcc

SEQ ID NO: 3066011 - RNA, 17 nt, Human
ccugcccaccuggccuc

SEQ ID NO: 3066012 - RNA, 12 nt, Human
ccugcaggcagc

SEQ ID NO: 3066013 - RNA, 13 nt, Human
ccugcaggcagcc

SEQ ID NO: 3066014 - RNA, 14 nt, Human
ccugcaggcagcca

SEQ ID NO: 3066015 - RNA, 15 nt, Human
ccucuuugagugaag

SEQ ID NO: 3066016 - RNA, 19 nt, Human
ccucuuucccucccuuccu

SEQ ID NO: 3066017 - RNA, 16 nt, Human
ccucuuucccucccuu

SEQ ID NO: 3066018 - RNA, 22 nt, Human
ccccugcacagcaggcugccag

SEQ ID NO: 3066019 - RNA, 23 nt, Human
ccccugcacagcaggcugccagu

SEQ ID NO: 3066020 - RNA, 16 nt, Human
ccccugccacccuggg

SEQ ID NO: 3066021 - RNA, 14 nt, Human
ccccugccacccug

SEQ ID NO: 3066022 - RNA, 15 nt, Human
ccccugacaacacuc

SEQ ID NO: 3066023 - RNA, 13 nt, Human
ccccugaauuuaa

SEQ ID NO: 3066024 - RNA, 17 nt, Human
ccccugaauuuaaauag

SEQ ID NO: 3066025 - RNA, 15 nt, Human
ccccugcacagcagg

SEQ ID NO: 3066026 - RNA, 16 nt, Human
ccccugcacagcaggc

SEQ ID NO: 3066027 - RNA, 21 nt, Human
ccccugcacagcaggcugcca

SEQ ID NO: 3066028 - RNA, 13 nt, Human
ccccugcacucca

SEQ ID NO: 3066029 - RNA, 18 nt, Human
cccgggaagggggcuggg

SEQ ID NO: 3066030 - RNA, 21 nt, Human
cccgggaagggggcugggaca

SEQ ID NO: 3066031 - RNA, 16 nt, Human
cccucaacaccucugc

SEQ ID NO: 3066032 - RNA, 16 nt, Human
cccucaacucuccucc

SEQ ID NO: 3066033 - RNA, 17 nt, Human
cccggccaccugcggug

SEQ ID NO: 3066034 - RNA, 18 nt, Human
cccgaauagcugggacua

SEQ ID NO: 3066035 - RNA, 17 nt, Human
cccgaauagcugggacu

SEQ ID NO: 3066036 - RNA, 16 nt, Human
cccgaauagcugggac

SEQ ID NO: 3066037 - RNA, 14 nt, Human
ccccuucugaccca

SEQ ID NO: 3066038 - RNA, 13 nt, Human
ccccuucugaccc

SEQ ID NO: 3066039 - RNA, 15 nt, Human
cccgggaagggggcu

SEQ ID NO: 3066040 - RNA, 12 nt, Human
cccgggaagggg

SEQ ID NO: 3066041 - RNA, 15 nt, Human
cccggccccugcugg

SEQ ID NO: 3066042 - RNA, 16 nt, Human
cccggccccugcuggu

SEQ ID NO: 3066043 - RNA, 14 nt, Human
ccccgcacugggcu

SEQ ID NO: 3066044 - RNA, 23 nt, Human
ccccgaggccuucucugaaggac

SEQ ID NO: 3066045 - RNA, 15 nt, Human
cccauucugccugcc

SEQ ID NO: 3066046 - RNA, 14 nt, Human
cccauucugccugc

SEQ ID NO: 3066047 - RNA, 19 nt, Human
cccauucugccugcccagg

SEQ ID NO: 3066048 - RNA, 13 nt, Human
cccauucugccug

SEQ ID NO: 3066049 - RNA, 15 nt, Human
cccauuugcuccuuu

SEQ ID NO: 3066050 - RNA, 20 nt, Human
ccccagauugcaacaggcug

SEQ ID NO: 3066051 - RNA, 15 nt, Human
ccccagauugcaaca

SEQ ID NO: 3066052 - RNA, 21 nt, Human
cccauccucuguacagagccc

SEQ ID NO: 3066053 - RNA, 22 nt, Human
cccauccucuguacagagccca

SEQ ID NO: 3066054 - RNA, 20 nt, Human
cccauccucuguacagagcc

SEQ ID NO: 3066055 - RNA, 17 nt, Human
cccaggaaaggcuccag

SEQ ID NO: 3066056 - RNA, 18 nt, Human
cccaggaaaggcuccagg

SEQ ID NO: 3066057 - RNA, 20 nt, Human
cccaggcuuagucacugaga

SEQ ID NO: 3066058 - RNA, 22 nt, Human
cccaggcuuagucacugagaca

SEQ ID NO: 3066059 - RNA, 20 nt, Human
cccauauuuguacaccaaua

SEQ ID NO: 3066060 - RNA, 15 nt, Human
cccaggaaaggcucc

SEQ ID NO: 3066061 - RNA, 16 nt, Human
cccaggaaaggcucca

SEQ ID NO: 3066062 - RNA, 23 nt, Human
cccagcaagugagagcugggugu

SEQ ID NO: 3066063 - RNA, 14 nt, Human
cccagccaggcccu

SEQ ID NO: 3066064 - RNA, 12 nt, Human
cccagccaggcc

SEQ ID NO: 3066065 - RNA, 12 nt, Human
ccaguccugccc

SEQ ID NO: 3066066 - RNA, 13 nt, Human
ccaguccugcccg

SEQ ID NO: 3066067 - RNA, 15 nt, Human
ccaguccugcccgcc

SEQ ID NO: 3066068 - RNA, 14 nt, Human
ccaggcaggucuug

SEQ ID NO: 3066069 - RNA, 12 nt, Human
ccaggcaggucu

SEQ ID NO: 3066070 - RNA, 23 nt, Human
ccaggcaggucuugaacuccugg

SEQ ID NO: 3066071 - RNA, 12 nt, Human
ccaggcuggcgu

SEQ ID NO: 3066072 - RNA, 21 nt, Human
ccaggggaaaaucagccugcu

SEQ ID NO: 3066073 - RNA, 23 nt, Human
ccagccccuucugacccaugcug

SEQ ID NO: 3066074 - RNA, 24 nt, Human
ccagccccuucugacccaugcugc

SEQ ID NO: 3066075 - RNA, 12 nt, Human
ccagcagagcac

SEQ ID NO: 3066076 - RNA, 13 nt, Human
ccagcagagcacc

SEQ ID NO: 3066077 - RNA, 14 nt, Human
ccagcagagcaccu

SEQ ID NO: 3066078 - RNA, 17 nt, Human
ccagccccagugcccac

SEQ ID NO: 3066079 - RNA, 15 nt, Human
ccagccccauccucu

SEQ ID NO: 3066080 - RNA, 17 nt, Human
ccagccccauccucugu

SEQ ID NO: 3066081 - RNA, 15 nt, Human
cccaacucaccccag

SEQ ID NO: 3066082 - RNA, 16 nt, Human
cccaacucaccccagc

SEQ ID NO: 3066083 - RNA, 15 nt, Human
ccauuggggcuccca

SEQ ID NO: 3066084 - RNA, 16 nt, Human
ccauuggggcucccag

SEQ ID NO: 3066085 - RNA, 17 nt, Human
ccauuggggcucccagc

SEQ ID NO: 3066086 - RNA, 22 nt, Human
cccacugcuuuuggucugugug

SEQ ID NO: 3066087 - RNA, 23 nt, Human
cccacugcuuuuggucuguguga

SEQ ID NO: 3066088 - RNA, 19 nt, Human
cccacuccggcccuccaga

SEQ ID NO: 3066089 - RNA, 21 nt, Human
cccacuccggcccuccagagc

SEQ ID NO: 3066090 - RNA, 13 nt, Human
cccacucccugca

SEQ ID NO: 3066091 - RNA, 12 nt, Human
cccacucccugc

SEQ ID NO: 3066092 - RNA, 14 nt, Human
cccacuccggcccu

SEQ ID NO: 3066093 - RNA, 17 nt, Human
cccaacucaccccagcc

SEQ ID NO: 3066094 - RNA, 20 nt, Human
cccaacucaccccagcccca

SEQ ID NO: 3066095 - RNA, 13 nt, Human
cccaacuccagaa

SEQ ID NO: 3066096 - RNA, 16 nt, Human
cccaagacucccauga

SEQ ID NO: 3066097 - RNA, 20 nt, Human
cccaagacucccaugaggga

SEQ ID NO: 3066098 - RNA, 12 nt, Human
cccaagcucugc

SEQ ID NO: 3066099 - RNA, 14 nt, Human
cccaagcucugcuc

SEQ ID NO: 3066100 - RNA, 13 nt, Human
cccaagcucugcu

SEQ ID NO: 3066101 - RNA, 22 nt, Human
ccauccccuguagagugggagc

SEQ ID NO: 3066102 - RNA, 21 nt, Human
ccaucccauaugccugggcag

SEQ ID NO: 3066103 - RNA, 19 nt, Human
ccaucccauaugccugggc

SEQ ID NO: 3066104 - RNA, 20 nt, Human
ccaucccauaugccugggca

SEQ ID NO: 3066105 - RNA, 19 nt, Human
ccauccagguucagcuugu

SEQ ID NO: 3066106 - RNA, 18 nt, Human
ccauccagguucagcuug

SEQ ID NO: 3066107 - RNA, 18 nt, Human
ccaguuggucccccuucc

SEQ ID NO: 3066108 - RNA, 20 nt, Human
ccaguuggucccccuuccau

SEQ ID NO: 3066109 - RNA, 17 nt, Human
ccauaagcuacugccau

SEQ ID NO: 3066110 - RNA, 18 nt, Human
ccauaagcuacugccauc

SEQ ID NO: 3066111 - RNA, 21 nt, Human
ccauaagcuacugccauccug

SEQ ID NO: 3066112 - RNA, 16 nt, Human
ccauaagcuacugcca

SEQ ID NO: 3066113 - RNA, 13 nt, Human
ccaguuggucccc

SEQ ID NO: 3066114 - RNA, 23 nt, Human
ccaguuggguggaugccuggugg

SEQ ID NO: 3066115 - RNA, 20 nt, Human
ccaugaggaacaaggcaagg

SEQ ID NO: 3066116 - RNA, 23 nt, Human
ccaugaggaacaaggcaaggcug

SEQ ID NO: 3066117 - RNA, 17 nt, Human
ccaugagggagaugcca

SEQ ID NO: 3066118 - RNA, 18 nt, Human
ccaugaguccccuguuug

SEQ ID NO: 3066119 - RNA, 23 nt, Human
ccaugagggagaugccaugagcc

SEQ ID NO: 3066120 - RNA, 18 nt, Human
ccaugagggagaugccau

SEQ ID NO: 3066121 - RNA, 19 nt, Human
ccaugagggagaugccaug

SEQ ID NO: 3066122 - RNA, 20 nt, Human
ccaugagggagaugccauga

SEQ ID NO: 3066123 - RNA, 21 nt, Human
ccaugagggagaugccaugag

SEQ ID NO: 3066124 - RNA, 12 nt, Human
auuuuauaucuu

SEQ ID NO: 3066125 - RNA, 21 nt, Human
auuuuauaucaauuuaaaaaa

SEQ ID NO: 3066126 - RNA, 19 nt, Human
auuuuagggguagcauuug

SEQ ID NO: 3066127 - RNA, 14 nt, Human
auuuuauaucuugu

SEQ ID NO: 3066128 - RNA, 16 nt, Human
auuuuauaucuuguag

SEQ ID NO: 3066129 - RNA, 19 nt, Human
auuuuuaagugcugcauuu

SEQ ID NO: 3066130 - RNA, 18 nt, Human
auuuuuaagugcugcauu

SEQ ID NO: 3066131 - RNA, 16 nt, Human
auuuuuaagugcugca

SEQ ID NO: 3066132 - RNA, 14 nt, Human
auuuuuagacagag

SEQ ID NO: 3066133 - RNA, 21 nt, Human
caaaaggauaaugaauacuuu

SEQ ID NO: 3066134 - RNA, 15 nt, Human
caaacagucucagga

SEQ ID NO: 3066135 - RNA, 17 nt, Human
caaacagucucaggaaa

SEQ ID NO: 3066136 - RNA, 16 nt, Human
caaacagucucaggaa

SEQ ID NO: 3066137 - RNA, 14 nt, Human
caaaccaaauaaaa

SEQ ID NO: 3066138 - RNA, 15 nt, Human
caaaccaaauaaaaa

SEQ ID NO: 3066139 - RNA, 24 nt, Human
caaacccaguguuuuaggagcaug

SEQ ID NO: 3066140 - RNA, 18 nt, Human
auuuuuuuuuccuucagu

SEQ ID NO: 3066141 - RNA, 16 nt, Human
auuuuuuugagacaga

SEQ ID NO: 3066142 - RNA, 15 nt, Human
auuuuuauauuugaa

SEQ ID NO: 3066143 - RNA, 20 nt, Human
auuuuuuuuuccuucagugc

SEQ ID NO: 3066144 - RNA, 22 nt, Human
auuuuuuuuuccuucagugccu

SEQ ID NO: 3066145 - RNA, 17 nt, Human
auuuuuuuuuccuucag

SEQ ID NO: 3066146 - RNA, 19 nt, Human
caaaagcugggcagguugg

SEQ ID NO: 3066147 - RNA, 14 nt, Human
caaagguaaaucag

SEQ ID NO: 3066148 - RNA, 22 nt, Human
caaaguagaagucuuagaugua

SEQ ID NO: 3066149 - RNA, 21 nt, Human
caaaguaucccuacuguaauu

SEQ ID NO: 3066150 - RNA, 19 nt, Human
caaaguaucccuacuguaa

SEQ ID NO: 3066151 - RNA, 18 nt, Human
caaagggugaaaauuauu

SEQ ID NO: 3066152 - RNA, 22 nt, Human
caaagcagugcaugcugucccu

SEQ ID NO: 3066153 - RNA, 16 nt, Human
caaagauauuuugcuu

SEQ ID NO: 3066154 - RNA, 14 nt, Human
caaagauauuuugc

SEQ ID NO: 3066155 - RNA, 18 nt, Human
caaagcagugcaugcugu

SEQ ID NO: 3066156 - RNA, 21 nt, Human
caaagcagugcaugcuguccc

SEQ ID NO: 3066157 - RNA, 21 nt, Human
caaaucugcuuuuuaaagaau

SEQ ID NO: 3066158 - RNA, 21 nt, Human
caaaucuuaacuugaaggagu

SEQ ID NO: 3066159 - RNA, 23 nt, Human
caaaugcuguaacuuucugaaau

SEQ ID NO: 3066160 - RNA, 13 nt, Human
caagaugguucua

SEQ ID NO: 3066161 - RNA, 16 nt, Human
caagaugguucuagca

SEQ ID NO: 3066162 - RNA, 18 nt, Human
caagaccacguuucuaaa

SEQ ID NO: 3066163 - RNA, 17 nt, Human
caagaccacguuucuaa

SEQ ID NO: 3066164 - RNA, 19 nt, Human
caagacccaaaaggcagaa

SEQ ID NO: 3066165 - RNA, 16 nt, Human
caagaccacguuucua

SEQ ID NO: 3066166 - RNA, 14 nt, Human
caacucuccuccag

SEQ ID NO: 3066167 - RNA, 22 nt, Human
caagaauugaagcaggacuaaa

SEQ ID NO: 3066168 - RNA, 17 nt, Human
caacucaccccagcccc

SEQ ID NO: 3066169 - RNA, 17 nt, Human
caacucauauuuucaug

SEQ ID NO: 3066170 - RNA, 18 nt, Human
caacucaccccagcccca

SEQ ID NO: 3066171 - RNA, 20 nt, Human
auuaguacuccccuccuuga

SEQ ID NO: 3066172 - RNA, 19 nt, Human
auuaugaauuacauuugua

SEQ ID NO: 3066173 - RNA, 20 nt, Human
auuaugaauuacauuuguau

SEQ ID NO: 3066174 - RNA, 17 nt, Human
auuaaaugcccagcccc

SEQ ID NO: 3066175 - RNA, 19 nt, Human
auuaaaugcccagccccuu

SEQ ID NO: 3066176 - RNA, 18 nt, Human
auucaacagguuuuccug

SEQ ID NO: 3066177 - RNA, 16 nt, Human
auucaaaugucuauaa

SEQ ID NO: 3066178 - RNA, 18 nt, Human
auucaaauguauuacagu

SEQ ID NO: 3066179 - RNA, 16 nt, Human
auucuugcaaaguauc

SEQ ID NO: 3066180 - RNA, 15 nt, Human
auucuugcaaaguau

SEQ ID NO: 3066181 - RNA, 14 nt, Human
auucuugcaaagua

SEQ ID NO: 3066182 - RNA, 14 nt, Human
auucuucugcuuca

SEQ ID NO: 3066183 - RNA, 22 nt, Human
auucuucuguacgucugacagg

SEQ ID NO: 3066184 - RNA, 20 nt, Human
auucuucugcuucagccucc

SEQ ID NO: 3066185 - RNA, 19 nt, Human
auucuucugcuucagccuc

SEQ ID NO: 3066186 - RNA, 18 nt, Human
auucucuaguuugauuaa

SEQ ID NO: 3066187 - RNA, 17 nt, Human
auucucuaguuugauua

SEQ ID NO: 3066188 - RNA, 22 nt, Human
auucuccuuguguuacuaaguu

SEQ ID NO: 3066189 - RNA, 21 nt, Human
auucuccuuguguuacuaagu

SEQ ID NO: 3066190 - RNA, 19 nt, Human
auucuccuuguguuacuaa

SEQ ID NO: 3066191 - RNA, 18 nt, Human
auucuccuuguguuacua

SEQ ID NO: 3066192 - RNA, 17 nt, Human
auucuccuuguguuacu

SEQ ID NO: 3066193 - RNA, 16 nt, Human
auuucauaugcuguau

SEQ ID NO: 3066194 - RNA, 20 nt, Human
auuucuaugaaauauuaugu

SEQ ID NO: 3066195 - RNA, 20 nt, Human
auuucauaccuaucaucuua

SEQ ID NO: 3066196 - RNA, 22 nt, Human
auuuaugcauauuauuuuaugu

SEQ ID NO: 3066197 - RNA, 16 nt, Human
auuuaugcauauuauu

SEQ ID NO: 3066198 - RNA, 14 nt, Human
auuucacucuccuu

SEQ ID NO: 3066199 - RNA, 21 nt, Human
auuuaaugaaagacuguacaa

SEQ ID NO: 3066200 - RNA, 20 nt, Human
auuuaaugaaagacuguaca

SEQ ID NO: 3066201 - RNA, 15 nt, Human
auuuaaugaaagacu

SEQ ID NO: 3066202 - RNA, 16 nt, Human
auuuaaugaaagacug

SEQ ID NO: 3066203 - RNA, 16 nt, Human
auuuaauaaaugugcc

SEQ ID NO: 3066204 - RNA, 14 nt, Human
auuguguugugaau

SEQ ID NO: 3066205 - RNA, 17 nt, Human
auuguguugugaauguu

SEQ ID NO: 3066206 - RNA, 16 nt, Human
auuguugucugcaacu

SEQ ID NO: 3066207 - RNA, 18 nt, Human
auugcuugagcucaggag

SEQ ID NO: 3066208 - RNA, 16 nt, Human
cagaaaguuauugaua

SEQ ID NO: 3066209 - RNA, 11 nt, Human
cagaaaguuau

SEQ ID NO: 3066210 - RNA, 14 nt, Human
cagaaguuucugcc

SEQ ID NO: 3066211 - RNA, 16 nt, Human
cagaaguuucugccgc

SEQ ID NO: 3066212 - RNA, 11 nt, Human
cagaacaguga

SEQ ID NO: 3066213 - RNA, 12 nt, Human
cagaacagugau

SEQ ID NO: 3066214 - RNA, 17 nt, Human
cagaacagugauuacca

SEQ ID NO: 3066215 - RNA, 16 nt, Human
cagaaauguacagcaa

SEQ ID NO: 3066216 - RNA, 19 nt, Human
cacugggagaaaugaaaaa

SEQ ID NO: 3066217 - RNA, 22 nt, Human
cacuguuuugaaucucauaauu

SEQ ID NO: 3066218 - RNA, 15 nt, Human
cacuuaaaaaugguu

SEQ ID NO: 3066219 - RNA, 19 nt, Human
cacuguugcccaggcuggc

SEQ ID NO: 3066220 - RNA, 18 nt, Human
cacuguugcccaggcugg

SEQ ID NO: 3066221 - RNA, 23 nt, Human
cacuguugcccaggcuggcgugc

SEQ ID NO: 3066222 - RNA, 17 nt, Human
cacuguugcccaggcug

SEQ ID NO: 3066223 - RNA, 14 nt, Human
cacugcagccucaa

SEQ ID NO: 3066224 - RNA, 19 nt, Human
cacugcagccucaaccucc

SEQ ID NO: 3066225 - RNA, 23 nt, Human
cacugcagccucaaccuccuggg

SEQ ID NO: 3066226 - RNA, 22 nt, Human
cacugcagccucaaccuccugg

SEQ ID NO: 3066227 - RNA, 21 nt, Human
cacugcagccucaaccuccug

SEQ ID NO: 3066228 - RNA, 20 nt, Human
cacugcagccucaaccuccu

SEQ ID NO: 3066229 - RNA, 17 nt, Human
cacugccaugccagcuu

SEQ ID NO: 3066230 - RNA, 18 nt, Human
cacuuguguuaugaagca

SEQ ID NO: 3066231 - RNA, 16 nt, Human
cacuuucuagccagag

SEQ ID NO: 3066232 - RNA, 17 nt, Human
cacuuucuagccagagg

SEQ ID NO: 3066233 - RNA, 13 nt, Human
cacuuucuagcca

SEQ ID NO: 3066234 - RNA, 21 nt, Human
cacuacauucuguuaaucauu

SEQ ID NO: 3066235 - RNA, 13 nt, Human
cacuccagccuga

SEQ ID NO: 3066236 - RNA, 12 nt, Human
cacuccagccug

SEQ ID NO: 3066237 - RNA, 17 nt, Human
cacuacauucuguuaau

SEQ ID NO: 3066238 - RNA, 16 nt, Human
cacuacauucuguuaa

SEQ ID NO: 3066239 - RNA, 14 nt, Human
cacuccagccuggg

SEQ ID NO: 3066240 - RNA, 13 nt, Human
cacuccagccugg

SEQ ID NO: 3066241 - RNA, 23 nt, Human
cacuccagccugagcgacaguga

SEQ ID NO: 3066242 - RNA, 20 nt, Human
cacucugucgcccagucugg

SEQ ID NO: 3066243 - RNA, 13 nt, Human
cacggccaggcca

SEQ ID NO: 3066244 - RNA, 12 nt, Human
cacggccaggcc

SEQ ID NO: 3066245 - RNA, 17 nt, Human
cacggccaggccagagg

SEQ ID NO: 3066246 - RNA, 14 nt, Human
cacggcucacugca

SEQ ID NO: 3066247 - RNA, 22 nt, Human
cacucuuauugcccacgcugga

SEQ ID NO: 3066248 - RNA, 21 nt, Human
cacucuuauugcccacgcugg

SEQ ID NO: 3066249 - RNA, 20 nt, Human
cacucuuauugcccacgcug

SEQ ID NO: 3066250 - RNA, 16 nt, Human
caccuuggcugcaggg

SEQ ID NO: 3066251 - RNA, 15 nt, Human
caccuuggcugcagg

SEQ ID NO: 3066252 - RNA, 18 nt, Human
caccuuggcugcagggag

SEQ ID NO: 3066253 - RNA, 14 nt, Human
caccuuucccaucu

SEQ ID NO: 3066254 - RNA, 15 nt, Human
cacacuuuggcccag

SEQ ID NO: 3066255 - RNA, 18 nt, Human
cacacuuuggcccagggu

SEQ ID NO: 3066256 - RNA, 19 nt, Human
cacacuuuggcccagggug

SEQ ID NO: 3066257 - RNA, 20 nt, Human
cacacauuuuuuaaaugcac

SEQ ID NO: 3066258 - RNA, 19 nt, Human
cacacauuuuuuaaaugca

SEQ ID NO: 3066259 - RNA, 16 nt, Human
cacacauuuuuuaaau

SEQ ID NO: 3066260 - RNA, 12 nt, Human
cacacauuuuuu

SEQ ID NO: 3066261 - RNA, 11 nt, Human
cacacauuuuu

SEQ ID NO: 3066262 - RNA, 10 nt, Human
cacacauuuu

SEQ ID NO: 3066263 - RNA, 10 nt, Human
cacagcucuu

SEQ ID NO: 3066264 - RNA, 18 nt, Human
cacagcucuguccuggga

SEQ ID NO: 3066265 - RNA, 16 nt, Human
cacagcucuguccugg

SEQ ID NO: 3066266 - RNA, 15 nt, Human
cacagcucuguccug

SEQ ID NO: 3066267 - RNA, 15 nt, Human
cacagcucuucucca

SEQ ID NO: 3066268 - RNA, 14 nt, Human
cacagcucuucucc

SEQ ID NO: 3066269 - RNA, 17 nt, Human
cacagcucuucuccagg

SEQ ID NO: 3066270 - RNA, 14 nt, Human
cacagcucuguccu

SEQ ID NO: 3066271 - RNA, 11 nt, Human
cacagcucugu

SEQ ID NO: 3066272 - RNA, 16 nt, Human
cacagacccugcccug

SEQ ID NO: 3066273 - RNA, 17 nt, Human
cacagacccugcccugu

SEQ ID NO: 3066274 - RNA, 14 nt, Human
cacagacccugccc

SEQ ID NO: 3066275 - RNA, 14 nt, Human
caccaacgucugug

SEQ ID NO: 3066276 - RNA, 17 nt, Human
cacauuuuauuuuauua

SEQ ID NO: 3066277 - RNA, 20 nt, Human
cacauuuuauuuuauuaugc

SEQ ID NO: 3066278 - RNA, 19 nt, Human
cacauuuuauuuuauuaug

SEQ ID NO: 3066279 - RNA, 21 nt, Human
cacauuuuauuuuauuaugca

SEQ ID NO: 3066280 - RNA, 17 nt, Human
cacccaccucagccucc

SEQ ID NO: 3066281 - RNA, 13 nt, Human
caccagccccagu

SEQ ID NO: 3066282 - RNA, 18 nt, Human
cacccaccucagccuccc

SEQ ID NO: 3066283 - RNA, 16 nt, Human
cacccaggagccccga

SEQ ID NO: 3066284 - RNA, 18 nt, Human
caaggcaaggcugucaau

SEQ ID NO: 3066285 - RNA, 17 nt, Human
caaggcaaggcugucaa

SEQ ID NO: 3066286 - RNA, 16 nt, Human
caaggcaaggcuguca

SEQ ID NO: 3066287 - RNA, 19 nt, Human
caaggccaaaggaagcaca

SEQ ID NO: 3066288 - RNA, 20 nt, Human
caaggccaaaggaagcacau

SEQ ID NO: 3066289 - RNA, 21 nt, Human
caaggccaaaggaagcacaug

SEQ ID NO: 3066290 - RNA, 21 nt, Human
caaggccuuccccuggcacug

SEQ ID NO: 3066291 - RNA, 18 nt, Human
caaggccuuccccuggca

SEQ ID NO: 3066292 - RNA, 21 nt, Human
caagucagucauucagauaug

SEQ ID NO: 3066293 - RNA, 20 nt, Human
caauaaaauccauacauuug

SEQ ID NO: 3066294 - RNA, 23 nt, Human
caauaaaauccauacauuugugu

SEQ ID NO: 3066295 - RNA, 20 nt, Human
cacaagcuccaagcucccag

SEQ ID NO: 3066296 - RNA, 13 nt, Human
caaugcuggcugu

SEQ ID NO: 3066297 - RNA, 21 nt, Human
caaugcuggcuguuggcuggg

SEQ ID NO: 3066298 - RNA, 20 nt, Human
caaugcuggcuguuggcugg

SEQ ID NO: 3066299 - RNA, 12 nt, Human
caaugcuggcug

SEQ ID NO: 3066300 - RNA, 16 nt, Human
caauggcagccuuggc

SEQ ID NO: 3066301 - RNA, 17 nt, Human
cacaagagcccaggccu

SEQ ID NO: 3066302 - RNA, 20 nt, Human
cacaagagcccaggccuccu

SEQ ID NO: 3066303 - RNA, 18 nt, Human
cacaagcuccaagcuccc

SEQ ID NO: 3066304 - RNA, 19 nt, Human
cacaagcuccaagcuccca

SEQ ID NO: 3066305 - RNA, 18 nt, Human
cacaagagcccaggccuc

SEQ ID NO: 3066306 - RNA, 19 nt, Human
cacaagagcccaggccucc

SEQ ID NO: 3066307 - RNA, 15 nt, Human
caaugggagcucaug

SEQ ID NO: 3066308 - RNA, 19 nt, Human
cauuguaaauaguauuuga

SEQ ID NO: 3066309 - RNA, 21 nt, Human
cauuuggagacacaacuauuu

SEQ ID NO: 3066310 - RNA, 15 nt, Human
cauuuggauuggaug

SEQ ID NO: 3066311 - RNA, 17 nt, Human
cauuugucacacacuuu

SEQ ID NO: 3066312 - RNA, 12 nt, Human
cauuugucccaa

SEQ ID NO: 3066313 - RNA, 13 nt, Human
cauuugucccaag

SEQ ID NO: 3066314 - RNA, 14 nt, Human
cauuugucccaagu

SEQ ID NO: 3066315 - RNA, 16 nt, Human
cauuugucccaagugc

SEQ ID NO: 3066316 - RNA, 18 nt, Human
cauuugucccaagugcca

SEQ ID NO: 3066317 - RNA, 19 nt, Human
cauuugucccaagugccaa

SEQ ID NO: 3066318 - RNA, 14 nt, Human
cauuuauucugcuc

SEQ ID NO: 3066319 - RNA, 16 nt, Human
cauuuuuuaaaugcac

SEQ ID NO: 3066320 - RNA, 15 nt, Human
cauuuuuuaaaugca

SEQ ID NO: 3066321 - RNA, 19 nt, Human
cauuuuuuaaaugcaccug

SEQ ID NO: 3066322 - RNA, 16 nt, Human
ccaaggccaaaggaag

SEQ ID NO: 3066323 - RNA, 13 nt, Human
ccaagaagcccag

SEQ ID NO: 3066324 - RNA, 13 nt, Human
ccaacgucugugc

SEQ ID NO: 3066325 - RNA, 15 nt, Human
ccaacgucugugcca

SEQ ID NO: 3066326 - RNA, 22 nt, Human
ccaaauggaaaugggcagagca

SEQ ID NO: 3066327 - RNA, 15 nt, Human
ccaaggccaaaggaa

SEQ ID NO: 3066328 - RNA, 14 nt, Human
ccaagaagcccagg

SEQ ID NO: 3066329 - RNA, 19 nt, Human
ccaagcuggucccacucag

SEQ ID NO: 3066330 - RNA, 12 nt, Human
ccaagcuggucc

SEQ ID NO: 3066331 - RNA, 16 nt, Human
ccaccgccuugcccag

SEQ ID NO: 3066332 - RNA, 17 nt, Human
ccaccgccuugcccagc

SEQ ID NO: 3066333 - RNA, 19 nt, Human
ccaccgccuugcccagccu

SEQ ID NO: 3066334 - RNA, 18 nt, Human
ccaccaucaugucuggcu

SEQ ID NO: 3066335 - RNA, 12 nt, Human
ccaccagugccu

SEQ ID NO: 3066336 - RNA, 13 nt, Human
ccaccagugccuc

SEQ ID NO: 3066337 - RNA, 14 nt, Human
ccaccagugccucu

SEQ ID NO: 3066338 - RNA, 15 nt, Human
ccaccagugccucuc

SEQ ID NO: 3066339 - RNA, 17 nt, Human
ccaccagugccucuccc

SEQ ID NO: 3066340 - RNA, 18 nt, Human
ccaccaucaccagacagg

SEQ ID NO: 3066341 - RNA, 19 nt, Human
ccaccagugccucucccug

SEQ ID NO: 3066342 - RNA, 19 nt, Human
ccaccaucaugucuggcua

SEQ ID NO: 3066343 - RNA, 16 nt, Human
ccaccuuggcugcagg

SEQ ID NO: 3066344 - RNA, 15 nt, Human
ccaccuuggcugcag

SEQ ID NO: 3066345 - RNA, 14 nt, Human
ccaccuuggcugca

SEQ ID NO: 3066346 - RNA, 12 nt, Human
ccaccuuggcug

SEQ ID NO: 3066347 - RNA, 19 nt, Human
ccaccuuggcugcagggag

SEQ ID NO: 3066348 - RNA, 18 nt, Human
ccaccuuggcugcaggga

SEQ ID NO: 3066349 - RNA, 18 nt, Human
ccacgcuggaccuugaac

SEQ ID NO: 3066350 - RNA, 22 nt, Human
ccacagagaaaguacuucucca

SEQ ID NO: 3066351 - RNA, 18 nt, Human
ccacagaagcuccaggua

SEQ ID NO: 3066352 - RNA, 18 nt, Human
ccaccagucugacuguuu

SEQ ID NO: 3066353 - RNA, 16 nt, Human
ccacagaagcuccagg

SEQ ID NO: 3066354 - RNA, 12 nt, Human
caugcacaaauu

SEQ ID NO: 3066355 - RNA, 24 nt, Human
caugauuaaccacuucagcugacu

SEQ ID NO: 3066356 - RNA, 22 nt, Human
caugauuaaccacuucagcuga

SEQ ID NO: 3066357 - RNA, 23 nt, Human
caugauuaaccacuucagcugac

SEQ ID NO: 3066358 - RNA, 12 nt, Human
caugcugcccug

SEQ ID NO: 3066359 - RNA, 13 nt, Human
caugcugcccugu

SEQ ID NO: 3066360 - RNA, 13 nt, Human
caugcuccuggcc

SEQ ID NO: 3066361 - RNA, 16 nt, Human
caugcacgugugugca

SEQ ID NO: 3066362 - RNA, 23 nt, Human
caugaaguaauaugcacacauuu

SEQ ID NO: 3066363 - RNA, 22 nt, Human
caugaaguaauaugcacacauu

SEQ ID NO: 3066364 - RNA, 19 nt, Human
caugaaguaauaugcacac

SEQ ID NO: 3066365 - RNA, 15 nt, Human
caugaaguaauaugc

SEQ ID NO: 3066366 - RNA, 21 nt, Human
caugacacgaauauugcugau

SEQ ID NO: 3066367 - RNA, 23 nt, Human
caugacacgaauauugcugaugg

SEQ ID NO: 3066368 - RNA, 14 nt, Human
caugcugcccugug

SEQ ID NO: 3066369 - RNA, 15 nt, Human
caugcugcccuguga

SEQ ID NO: 3066370 - RNA, 12 nt, Human
cauuccuguucc

SEQ ID NO: 3066371 - RNA, 19 nt, Human
cauguccaagaagcccagg

SEQ ID NO: 3066372 - RNA, 20 nt, Human
cauguccaagaagcccagga

SEQ ID NO: 3066373 - RNA, 18 nt, Human
cauguccaagaagcccag

SEQ ID NO: 3066374 - RNA, 16 nt, Human
cauguccaagaagccc

SEQ ID NO: 3066375 - RNA, 13 nt, Human
cauguuggccagg

SEQ ID NO: 3066376 - RNA, 12 nt, Human
cauguuggccag

SEQ ID NO: 3066377 - RNA, 23 nt, Human
cauuaucuagauacuguaucaug

SEQ ID NO: 3066378 - RNA, 12 nt, Human
cauuaucucaaa

SEQ ID NO: 3066379 - RNA, 13 nt, Human
cauuaucucaaaa

SEQ ID NO: 3066380 - RNA, 22 nt, Human
cauuaggugugacugaauuucu

SEQ ID NO: 3066381 - RNA, 17 nt, Human
caucccagccccaauga

SEQ ID NO: 3066382 - RNA, 14 nt, Human
caucaggccaggcc

SEQ ID NO: 3066383 - RNA, 16 nt, Human
caucaggccaggcccu

SEQ ID NO: 3066384 - RNA, 19 nt, Human
caucaggccaggcccucug

SEQ ID NO: 3066385 - RNA, 15 nt, Human
caucaggccaggccc

SEQ ID NO: 3066386 - RNA, 19 nt, Human
caucccauaugccugggca

SEQ ID NO: 3066387 - RNA, 14 nt, Human
cauccccuguagag

SEQ ID NO: 3066388 - RNA, 21 nt, Human
caucugcgggggcagugcuca

SEQ ID NO: 3066389 - RNA, 19 nt, Human
caucugcgggggcagugcu

SEQ ID NO: 3066390 - RNA, 20 nt, Human
caucugcgggggcagugcuc

SEQ ID NO: 3066391 - RNA, 17 nt, Human
caucugcgggggcagug

SEQ ID NO: 3066392 - RNA, 13 nt, Human
cauaauuuauaca

SEQ ID NO: 3066393 - RNA, 20 nt, Human
cauaauuuauacaggucaua

SEQ ID NO: 3066394 - RNA, 22 nt, Human
cauagcagagaaugaaagggcc

SEQ ID NO: 3066395 - RNA, 19 nt, Human
cauagcagagaaugaaagg

SEQ ID NO: 3066396 - RNA, 22 nt, Human
cauaugccugggcagaaggaag

SEQ ID NO: 3066397 - RNA, 13 nt, Human
cauaugccugggc

SEQ ID NO: 3066398 - RNA, 15 nt, Human
cauaugccugggcag

SEQ ID NO: 3066399 - RNA, 20 nt, Human
cauaugccugggcagaagga

SEQ ID NO: 3066400 - RNA, 20 nt, Human
cauauucaggaagcucaggg

SEQ ID NO: 3066401 - RNA, 21 nt, Human
cauauuauuuuauguugcaua

SEQ ID NO: 3066402 - RNA, 14 nt, Human
cauauucaggaagc

SEQ ID NO: 3066403 - RNA, 15 nt, Human
cauauucaggaagcu

SEQ ID NO: 3066404 - RNA, 19 nt, Human
cagcauauucaggaagcuc

SEQ ID NO: 3066405 - RNA, 22 nt, Human
cagcauauucaggaagcucagg

SEQ ID NO: 3066406 - RNA, 23 nt, Human
cagcauauucaggaagcucaggg

SEQ ID NO: 3066407 - RNA, 17 nt, Human
cagcaguugaaaagacu

SEQ ID NO: 3066408 - RNA, 21 nt, Human
cagcaguugaaaagacuccaa

SEQ ID NO: 3066409 - RNA, 20 nt, Human
cagcaguugaaaagacucca

SEQ ID NO: 3066410 - RNA, 12 nt, Human
cagccaggccac

SEQ ID NO: 3066411 - RNA, 13 nt, Human
cagccaggccaca

SEQ ID NO: 3066412 - RNA, 20 nt, Human
cagaaguuugagaucagccu

SEQ ID NO: 3066413 - RNA, 23 nt, Human
cagaaguuucugccgcagcccug

SEQ ID NO: 3066414 - RNA, 22 nt, Human
cagaaguuugagaucagccugg

SEQ ID NO: 3066415 - RNA, 16 nt, Human
cagagcugccaccugc

SEQ ID NO: 3066416 - RNA, 18 nt, Human
cagagcugccaccugccu

SEQ ID NO: 3066417 - RNA, 22 nt, Human
cagagggccugcaagggaguga

SEQ ID NO: 3066418 - RNA, 18 nt, Human
cagaggggguggccuccc

SEQ ID NO: 3066419 - RNA, 17 nt, Human
cagaggggguggccucc

SEQ ID NO: 3066420 - RNA, 19 nt, Human
cagaggggguggccuccca

SEQ ID NO: 3066421 - RNA, 20 nt, Human
cagaggggguggccucccaa

SEQ ID NO: 3066422 - RNA, 20 nt, Human
cagagucagaaguuucugcc

SEQ ID NO: 3066423 - RNA, 15 nt, Human
cagauaugauucaaa

SEQ ID NO: 3066424 - RNA, 16 nt, Human
cagauaugauucaaau

SEQ ID NO: 3066425 - RNA, 17 nt, Human
cagauaugauucaaaug

SEQ ID NO: 3066426 - RNA, 19 nt, Human
cagauaugauucaaauguc

SEQ ID NO: 3066427 - RNA, 16 nt, Human
cagcuccccucggaga

SEQ ID NO: 3066428 - RNA, 18 nt, Human
cagcuccccucggagaag

SEQ ID NO: 3066429 - RNA, 17 nt, Human
cagcuccccucggagaa

SEQ ID NO: 3066430 - RNA, 14 nt, Human
caggaaaggcucca

SEQ ID NO: 3066431 - RNA, 15 nt, Human
caggaaaggcuccag

SEQ ID NO: 3066432 - RNA, 23 nt, Human
caggaaaucaaauaugcaaagca

SEQ ID NO: 3066433 - RNA, 22 nt, Human
caggaaaucaaauaugcaaagc

SEQ ID NO: 3066434 - RNA, 18 nt, Human
cagcuucauuuccugugu

SEQ ID NO: 3066435 - RNA, 20 nt, Human
caggaaagagaacuuccaga

SEQ ID NO: 3066436 - RNA, 15 nt, Human
cagcuucauuuccug

SEQ ID NO: 3066437 - RNA, 18 nt, Human
cagcugugcucuggacag

SEQ ID NO: 3066438 - RNA, 15 nt, Human
cagcuccagcucacc

SEQ ID NO: 3066439 - RNA, 14 nt, Human
cagcuccagcucac

SEQ ID NO: 3066440 - RNA, 13 nt, Human
cagcuccagcuca

SEQ ID NO: 3066441 - RNA, 19 nt, Human
cagcuccaagaauuucuag

SEQ ID NO: 3066442 - RNA, 16 nt, Human
cagcuccaagaauuuc

SEQ ID NO: 3066443 - RNA, 20 nt, Human
cagcuccagcucaccagccc

SEQ ID NO: 3066444 - RNA, 18 nt, Human
cagcuccagcucaccagc

SEQ ID NO: 3066445 - RNA, 17 nt, Human
cagcuccagcucaccag

SEQ ID NO: 3066446 - RNA, 16 nt, Human
cagcuccagcucacca

SEQ ID NO: 3066447 - RNA, 22 nt, Human
cagcuccagcucaccagcccca

SEQ ID NO: 3066448 - RNA, 20 nt, Human
cagccgagauagccaaggcc

SEQ ID NO: 3066449 - RNA, 21 nt, Human
cagccgagauagccaaggcca

SEQ ID NO: 3066450 - RNA, 15 nt, Human
cagcccuucuuucca

SEQ ID NO: 3066451 - RNA, 19 nt, Human
cagcccuucuuuccacaga

SEQ ID NO: 3066452 - RNA, 20 nt, Human
cagcccuucuuuccacagaa

SEQ ID NO: 3066453 - RNA, 12 nt, Human
cagccccuggau

SEQ ID NO: 3066454 - RNA, 13 nt, Human
cagccccuggaug

SEQ ID NO: 3066455 - RNA, 14 nt, Human
cagccccuggaugc

SEQ ID NO: 3066456 - RNA, 17 nt, Human
cagccccuggaugcagc

SEQ ID NO: 3066457 - RNA, 18 nt, Human
cagccccuggaugcagcc

SEQ ID NO: 3066458 - RNA, 19 nt, Human
cagccccuggaugcagccu

SEQ ID NO: 3066459 - RNA, 21 nt, Human
cagccccuggaugcagccuca

SEQ ID NO: 3066460 - RNA, 21 nt, Human
cagcccuuagcagggaaacag

SEQ ID NO: 3066461 - RNA, 16 nt, Human
cagcccuuagcaggga

SEQ ID NO: 3066462 - RNA, 15 nt, Human
cagcccuuagcaggg

SEQ ID NO: 3066463 - RNA, 17 nt, Human
cagcggggacagcuccu

SEQ ID NO: 3066464 - RNA, 16 nt, Human
cagcggggacagcucc

SEQ ID NO: 3066465 - RNA, 14 nt, Human
cagcggggacagcu

SEQ ID NO: 3066466 - RNA, 15 nt, Human
cagcggggacagcuc

SEQ ID NO: 3066467 - RNA, 18 nt, Human
cagccugagcgacaguga

SEQ ID NO: 3066468 - RNA, 19 nt, Human
cagccugagcgacagugag

SEQ ID NO: 3066469 - RNA, 18 nt, Human
caggcacccaccaucaug

SEQ ID NO: 3066470 - RNA, 23 nt, Human
caggcacccaccaucaugucugg

SEQ ID NO: 3066471 - RNA, 22 nt, Human
caggcacccaccaucaugucug

SEQ ID NO: 3066472 - RNA, 17 nt, Human
caggaggccagccuuga

SEQ ID NO: 3066473 - RNA, 14 nt, Human
caggaggccagccu

SEQ ID NO: 3066474 - RNA, 15 nt, Human
caggaggccagccuu

SEQ ID NO: 3066475 - RNA, 16 nt, Human
caggaggccagccuug

SEQ ID NO: 3066476 - RNA, 21 nt, Human
caggccagagggagugacaga

SEQ ID NO: 3066477 - RNA, 19 nt, Human
caggccagagggagugaca

SEQ ID NO: 3066478 - RNA, 16 nt, Human
caggccagagggagug

SEQ ID NO: 3066479 - RNA, 23 nt, Human
caggccagagggagugacagagg

SEQ ID NO: 3066480 - RNA, 19 nt, Human
caggcugggcuucaguggc

SEQ ID NO: 3066481 - RNA, 17 nt, Human
caggcugggcuucagug

SEQ ID NO: 3066482 - RNA, 17 nt, Human
cagggaggacgcucucu

SEQ ID NO: 3066483 - RNA, 18 nt, Human
cagggaggacgcucucug

SEQ ID NO: 3066484 - RNA, 15 nt, Human
caggcugggcuucag

SEQ ID NO: 3066485 - RNA, 16 nt, Human
caggcugggcuucagu

SEQ ID NO: 3066486 - RNA, 18 nt, Human
cagggaggugaccccagg

SEQ ID NO: 3066487 - RNA, 22 nt, Human
cagggaguccgaaagggacuug

SEQ ID NO: 3066488 - RNA, 18 nt, Human
cagguuuaagcuguuacu

SEQ ID NO: 3066489 - RNA, 16 nt, Human
cagguuuaagcuguua

SEQ ID NO: 3066490 - RNA, 22 nt, Human
cagucaccccggccaccugcgg

SEQ ID NO: 3066491 - RNA, 20 nt, Human
cagucaccccggccaccugc

SEQ ID NO: 3066492 - RNA, 19 nt, Human
cagucaccccggccaccug

SEQ ID NO: 3066493 - RNA, 22 nt, Human
caggugcacaagcuccaagcuc

SEQ ID NO: 3066494 - RNA, 17 nt, Human
caggugauccacccacc

SEQ ID NO: 3066495 - RNA, 16 nt, Human
caggugauccacccac

SEQ ID NO: 3066496 - RNA, 12 nt, Human
caggguuggccc

SEQ ID NO: 3066497 - RNA, 14 nt, Human
cagguugguggggg

SEQ ID NO: 3066498 - RNA, 18 nt, Human
caggugcuaggaacacuc

SEQ ID NO: 3066499 - RNA, 20 nt, Human
caggugcuaggaacacuccu

SEQ ID NO: 3066500 - RNA, 14 nt, Human
caggugcgaaagga

SEQ ID NO: 3066501 - RNA, 18 nt, Human
cagggucucacucugucg

SEQ ID NO: 3066502 - RNA, 17 nt, Human
cagggucucacucuguc

SEQ ID NO: 3066503 - RNA, 21 nt, Human
cagggucucacucugucgccc

SEQ ID NO: 3066504 - RNA, 15 nt, Human
cagucucaggaaauc

SEQ ID NO: 3066505 - RNA, 22 nt, Human
cagugcaugcugucccuuacgu

SEQ ID NO: 3066506 - RNA, 23 nt, Human
cagugcaugcugucccuuacgug

SEQ ID NO: 3066507 - RNA, 19 nt, Human
cagugcaugcugucccuua

SEQ ID NO: 3066508 - RNA, 20 nt, Human
cagucugauucccaagcucu

SEQ ID NO: 3066509 - RNA, 19 nt, Human
cagucugauucccaagcuc

SEQ ID NO: 3066510 - RNA, 22 nt, Human
cagugcacuaauguguaagaca

SEQ ID NO: 3066511 - RNA, 12 nt, Human
cagugcccacag

SEQ ID NO: 3066512 - RNA, 11 nt, Human
cagugggagcu

SEQ ID NO: 3066513 - RNA, 15 nt, Human
cagugccaaaaacaa

SEQ ID NO: 3066514 - RNA, 11 nt, Human
gcuacugccau

SEQ ID NO: 3066515 - RNA, 16 nt, Human
gcuagaacucccuuuc

SEQ ID NO: 3066516 - RNA, 12 nt, Human
gcuagaacuccc

SEQ ID NO: 3066517 - RNA, 13 nt, Human
gcuagaacucccu

SEQ ID NO: 3066518 - RNA, 14 nt, Human
gcuagaacucccuu

SEQ ID NO: 3066519 - RNA, 15 nt, Human
gcuagaacucccuuu

SEQ ID NO: 3066520 - RNA, 20 nt, Human
gcgggaggauguucugggac

SEQ ID NO: 3066521 - RNA, 22 nt, Human
gcgggaggauguucugggacac

SEQ ID NO: 3066522 - RNA, 21 nt, Human
gcgggaggauguucugggaca

SEQ ID NO: 3066523 - RNA, 20 nt, Human
gcgugcacacaccagagccc

SEQ ID NO: 3066524 - RNA, 18 nt, Human
gcguuucuaugacacaug

SEQ ID NO: 3066525 - RNA, 23 nt, Human
gcgugcacacaccagagcccacc

SEQ ID NO: 3066526 - RNA, 19 nt, Human
gcgugcacacaccagagcc

SEQ ID NO: 3066527 - RNA, 23 nt, Human
gcuaagugauccucccaccucag

SEQ ID NO: 3066528 - RNA, 15 nt, Human
gcuaaugggacacua

SEQ ID NO: 3066529 - RNA, 13 nt, Human
gcuaaugggacac

SEQ ID NO: 3066530 - RNA, 12 nt, Human
gcuaugcauuug

SEQ ID NO: 3066531 - RNA, 21 nt, Human
gcuagugugguguuuccuggc

SEQ ID NO: 3066532 - RNA, 22 nt, Human
gcuagugugguguuuccuggca

SEQ ID NO: 3066533 - RNA, 13 nt, Human
gcuaugcauuuga

SEQ ID NO: 3066534 - RNA, 19 nt, Human
gcuauucaguaauaacucu

SEQ ID NO: 3066535 - RNA, 16 nt, Human
gcuaggccuggccaga

SEQ ID NO: 3066536 - RNA, 23 nt, Human
gcuaggccuggccagaugcacca

SEQ ID NO: 3066537 - RNA, 17 nt, Human
gcuaggccuggccagau

SEQ ID NO: 3066538 - RNA, 14 nt, Human
gcucagagagggug

SEQ ID NO: 3066539 - RNA, 13 nt, Human
gcucagagagggu

SEQ ID NO: 3066540 - RNA, 23 nt, Human
gcucagguggggucacucuggca

SEQ ID NO: 3066541 - RNA, 14 nt, Human
gcucaggugucccu

SEQ ID NO: 3066542 - RNA, 16 nt, Human
gcucaggugucccugc

SEQ ID NO: 3066543 - RNA, 20 nt, Human
gcuauucaguaauaacucua

SEQ ID NO: 3066544 - RNA, 18 nt, Human
gcuauucaguaauaacuc

SEQ ID NO: 3066545 - RNA, 14 nt, Human
gcucacugcagccu

SEQ ID NO: 3066546 - RNA, 13 nt, Human
gcucacugcagcc

SEQ ID NO: 3066547 - RNA, 12 nt, Human
gcucacugcagc

SEQ ID NO: 3066548 - RNA, 11 nt, Human
gcucacugcag

SEQ ID NO: 3066549 - RNA, 16 nt, Human
gcucacugcagccuca

SEQ ID NO: 3066550 - RNA, 15 nt, Human
gcucacugcagccuc

SEQ ID NO: 3066551 - RNA, 17 nt, Human
gcucacugcagccucaa

SEQ ID NO: 3066552 - RNA, 11 nt, Human
gcucugcccuu

SEQ ID NO: 3066553 - RNA, 23 nt, Human
gcucugcaagaauugaagcagga

SEQ ID NO: 3066554 - RNA, 17 nt, Human
gcucugaucauccacug

SEQ ID NO: 3066555 - RNA, 23 nt, Human
gcucugaucauccacugugccau

SEQ ID NO: 3066556 - RNA, 19 nt, Human
gcuccaccuugcagcucuc

SEQ ID NO: 3066557 - RNA, 15 nt, Human
gcuccacuuggucug

SEQ ID NO: 3066558 - RNA, 18 nt, Human
gcuccccucggagaagag

SEQ ID NO: 3066559 - RNA, 21 nt, Human
gcuccccucggagaagagcug

SEQ ID NO: 3066560 - RNA, 18 nt, Human
gcuccuggcccacugcau

SEQ ID NO: 3066561 - RNA, 19 nt, Human
gcuccuggcccacugcauc

SEQ ID NO: 3066562 - RNA, 20 nt, Human
gcuccuggcccacugcaucg

SEQ ID NO: 3066563 - RNA, 14 nt, Human
gcuccuggcccacu

SEQ ID NO: 3066564 - RNA, 15 nt, Human
gcuccuggcccacug

SEQ ID NO: 3066565 - RNA, 18 nt, Human
gcuccagcucaccagccc

SEQ ID NO: 3066566 - RNA, 17 nt, Human
gcuccagcucaccagcc

SEQ ID NO: 3066567 - RNA, 18 nt, Human
gcuccacuuggucuguga

SEQ ID NO: 3066568 - RNA, 21 nt, Human
gcuccagcucaccagccccag

SEQ ID NO: 3066569 - RNA, 20 nt, Human
gcuccagcucaccagcccca

SEQ ID NO: 3066570 - RNA, 18 nt, Human
gcucccaccuggcucugu

SEQ ID NO: 3066571 - RNA, 14 nt, Human
gcucccaccuggcu

SEQ ID NO: 3066572 - RNA, 16 nt, Human
gcucccaccuggcucu

SEQ ID NO: 3066573 - RNA, 18 nt, Human
gcucccagccaggcccuu

SEQ ID NO: 3066574 - RNA, 16 nt, Human
gcucccagccaggccc

SEQ ID NO: 3066575 - RNA, 17 nt, Human
gcucccagccaggcccu

SEQ ID NO: 3066576 - RNA, 14 nt, Human
gcucccagccaggc

SEQ ID NO: 3066577 - RNA, 15 nt, Human
gcucccagccaggcc

SEQ ID NO: 3066578 - RNA, 22 nt, Human
gcgaucuggguucacugcaacc

SEQ ID NO: 3066579 - RNA, 16 nt, Human
gccuugaccauucucc

SEQ ID NO: 3066580 - RNA, 21 nt, Human
gccuucggccuccauccugag

SEQ ID NO: 3066581 - RNA, 20 nt, Human
gccuucggccuccauccuga

SEQ ID NO: 3066582 - RNA, 19 nt, Human
gccuucggccuccauccug

SEQ ID NO: 3066583 - RNA, 17 nt, Human
gccuugaccauucucca

SEQ ID NO: 3066584 - RNA, 19 nt, Human
gccuugaccauucuccacc

SEQ ID NO: 3066585 - RNA, 20 nt, Human
gccuugaccauucuccaccu

SEQ ID NO: 3066586 - RNA, 15 nt, Human
gcgagcccugguggc

SEQ ID NO: 3066587 - RNA, 17 nt, Human
gcgagcccugguggcag

SEQ ID NO: 3066588 - RNA, 18 nt, Human
gccuugcccagccuggau

SEQ ID NO: 3066589 - RNA, 19 nt, Human
gccuugcccagccuggaug

SEQ ID NO: 3066590 - RNA, 14 nt, Human
gccuugcccagccu

SEQ ID NO: 3066591 - RNA, 15 nt, Human
gccuugcccagccug

SEQ ID NO: 3066592 - RNA, 17 nt, Human
gccuugcccagccugga

SEQ ID NO: 3066593 - RNA, 13 nt, Human
gccuugcccagcc

SEQ ID NO: 3066594 - RNA, 15 nt, Human
gccuguugggccagg

SEQ ID NO: 3066595 - RNA, 16 nt, Human
gccuguugggccagga

SEQ ID NO: 3066596 - RNA, 18 nt, Human
gccuguugggccaggagc

SEQ ID NO: 3066597 - RNA, 20 nt, Human
gccuguugggccaggagccu

SEQ ID NO: 3066598 - RNA, 14 nt, Human
gccuguugggccag

SEQ ID NO: 3066599 - RNA, 17 nt, Human
gccugugccucugggac

SEQ ID NO: 3066600 - RNA, 16 nt, Human
gccugugccucuggga

SEQ ID NO: 3066601 - RNA, 13 nt, Human
gccuggcucaggu

SEQ ID NO: 3066602 - RNA, 18 nt, Human
gccugugccucugggacu

SEQ ID NO: 3066603 - RNA, 13 nt, Human
gccuggccugagc

SEQ ID NO: 3066604 - RNA, 14 nt, Human
gccuggccugagcu

SEQ ID NO: 3066605 - RNA, 18 nt, Human
gccuggccugagcuggga

SEQ ID NO: 3066606 - RNA, 20 nt, Human
gccuggccugagcugggaug

SEQ ID NO: 3066607 - RNA, 20 nt, Human
gccugcccaggccccugcca

SEQ ID NO: 3066608 - RNA, 15 nt, Human
gccugcccaggcccc

SEQ ID NO: 3066609 - RNA, 22 nt, Human
gccugcccaggccccugccacc

SEQ ID NO: 3066610 - RNA, 22 nt, Human
gccucgaacuggcugcaaaggg

SEQ ID NO: 3066611 - RNA, 20 nt, Human
gccucgaacuggcugcaaag

SEQ ID NO: 3066612 - RNA, 17 nt, Human
gccucuuaugggcuggg

SEQ ID NO: 3066613 - RNA, 18 nt, Human
gccucuuaugggcugggu

SEQ ID NO: 3066614 - RNA, 16 nt, Human
gccucuuaugggcugg

SEQ ID NO: 3066615 - RNA, 15 nt, Human
gccucuuagaugcag

SEQ ID NO: 3066616 - RNA, 21 nt, Human
gccucuuaugggcuggguucu

SEQ ID NO: 3066617 - RNA, 14 nt, Human
gccucuuggguuca

SEQ ID NO: 3066618 - RNA, 14 nt, Human
gccugcccaggccc

SEQ ID NO: 3066619 - RNA, 13 nt, Human
gccugcccaggcc

SEQ ID NO: 3066620 - RNA, 17 nt, Human
gccucccaaagugcugg

SEQ ID NO: 3066621 - RNA, 13 nt, Human
gccuccugugugu

SEQ ID NO: 3066622 - RNA, 16 nt, Human
gccucccaaagugcug

SEQ ID NO: 3066623 - RNA, 23 nt, Human
gccuccugugugugcgccuacag

SEQ ID NO: 3066624 - RNA, 19 nt, Human
gccuccugugugugcgccu

SEQ ID NO: 3066625 - RNA, 17 nt, Human
gccucgaacuggcugca

SEQ ID NO: 3066626 - RNA, 18 nt, Human
gcccugcagagggcacag

SEQ ID NO: 3066627 - RNA, 16 nt, Human
gcccugcagagggcac

SEQ ID NO: 3066628 - RNA, 17 nt, Human
gcccugcccaccuggcc

SEQ ID NO: 3066629 - RNA, 20 nt, Human
gcccugcccaccuggccucu

SEQ ID NO: 3066630 - RNA, 21 nt, Human
gcccugcccaccuggccucug

SEQ ID NO: 3066631 - RNA, 22 nt, Human
gcccugcccaccuggccucugc

SEQ ID NO: 3066632 - RNA, 11 nt, Human
gcccugccucc

SEQ ID NO: 3066633 - RNA, 15 nt, Human
gcccugcccaccugg

SEQ ID NO: 3066634 - RNA, 20 nt, Human
gcccuuagcagggaaacagc

SEQ ID NO: 3066635 - RNA, 19 nt, Human
gcccuuagcagggaaacag

SEQ ID NO: 3066636 - RNA, 12 nt, Human
gcccugccuccu

SEQ ID NO: 3066637 - RNA, 13 nt, Human
gcccugccuccuu

SEQ ID NO: 3066638 - RNA, 22 nt, Human
gcccuuagcagggaaacagcua

SEQ ID NO: 3066639 - RNA, 20 nt, Human
gccgcagcccugcagagggc

SEQ ID NO: 3066640 - RNA, 19 nt, Human
gccgcagcccugcagaggg

SEQ ID NO: 3066641 - RNA, 23 nt, Human
gccgcccaaggccuuccccuggc

SEQ ID NO: 3066642 - RNA, 14 nt, Human
gccgcccaaggccu

SEQ ID NO: 3066643 - RNA, 20 nt, Human
gccuaggugacagagugaga

SEQ ID NO: 3066644 - RNA, 15 nt, Human
gccuaggugacagag

SEQ ID NO: 3066645 - RNA, 14 nt, Human
gccuaggugacaga

SEQ ID NO: 3066646 - RNA, 13 nt, Human
gccuaggugacag

SEQ ID NO: 3066647 - RNA, 20 nt, Human
gccuagcauacguacacauu

SEQ ID NO: 3066648 - RNA, 22 nt, Human
gccuagcauacguacacauuuu

SEQ ID NO: 3066649 - RNA, 21 nt, Human
gccuagcauacguacacauuu

SEQ ID NO: 3066650 - RNA, 23 nt, Human
gccuagcauacguacacauuuua

SEQ ID NO: 3066651 - RNA, 19 nt, Human
gccuagcauacguacacau

SEQ ID NO: 3066652 - RNA, 12 nt, Human
gcccccacuggu

SEQ ID NO: 3066653 - RNA, 16 nt, Human
gccccugccacccugg

SEQ ID NO: 3066654 - RNA, 17 nt, Human
gccccugccacccuggg

SEQ ID NO: 3066655 - RNA, 23 nt, Human
gccccugccucucugcagguccc

SEQ ID NO: 3066656 - RNA, 20 nt, Human
gccccugccucucugcaggu

SEQ ID NO: 3066657 - RNA, 23 nt, Human
gcccgggcucugccucccaucac

SEQ ID NO: 3066658 - RNA, 17 nt, Human
gcuucacggaagagccu

SEQ ID NO: 3066659 - RNA, 15 nt, Human
gcuucacggaagagc

SEQ ID NO: 3066660 - RNA, 20 nt, Human
gcuucaaggauccugagcca

SEQ ID NO: 3066661 - RNA, 21 nt, Human
gcuucaaggauccugagccag

SEQ ID NO: 3066662 - RNA, 19 nt, Human
gcuucaaggauccugagcc

SEQ ID NO: 3066663 - RNA, 18 nt, Human
gcuucaaggauccugagc

SEQ ID NO: 3066664 - RNA, 18 nt, Human
gcuucacggaagagccuu

SEQ ID NO: 3066665 - RNA, 12 nt, Human
gcuucagccucc

SEQ ID NO: 3066666 - RNA, 22 nt, Human
gcuuccucauaguaugguggcu

SEQ ID NO: 3066667 - RNA, 23 nt, Human
gcuucuucagagacuccugcagg

SEQ ID NO: 3066668 - RNA, 12 nt, Human
gcuuguacauaa

SEQ ID NO: 3066669 - RNA, 22 nt, Human
gcuugaccuuuaagagaaauga

SEQ ID NO: 3066670 - RNA, 14 nt, Human
gcuugagcucagga

SEQ ID NO: 3066671 - RNA, 20 nt, Human
gcuuguaaauagcucaggug

SEQ ID NO: 3066672 - RNA, 13 nt, Human
gcugcugaaggcu

SEQ ID NO: 3066673 - RNA, 14 nt, Human
gcugcugaaggcuc

SEQ ID NO: 3066674 - RNA, 15 nt, Human
gcugcugaaggcucg

SEQ ID NO: 3066675 - RNA, 15 nt, Human
gcucugguccauaga

SEQ ID NO: 3066676 - RNA, 16 nt, Human
gcucugguccauagag

SEQ ID NO: 3066677 - RNA, 13 nt, Human
gcugcuggcuggu

SEQ ID NO: 3066678 - RNA, 20 nt, Human
gcuggccuggccccucaggg

SEQ ID NO: 3066679 - RNA, 22 nt, Human
gcuggagugcagugagccgaga

SEQ ID NO: 3066680 - RNA, 17 nt, Human
gcuggagugcagugagc

SEQ ID NO: 3066681 - RNA, 18 nt, Human
gcuggagugcagugagcc

SEQ ID NO: 3066682 - RNA, 20 nt, Human
gcuggcgugcaguggugcga

SEQ ID NO: 3066683 - RNA, 21 nt, Human
gcuggguggcaccagcagccu

SEQ ID NO: 3066684 - RNA, 22 nt, Human
gcuggguggcaccagcagccug

SEQ ID NO: 3066685 - RNA, 23 nt, Human
gcuggguggcaccagcagccugg

SEQ ID NO: 3066686 - RNA, 22 nt, Human
gcugggccccugccucucugca

SEQ ID NO: 3066687 - RNA, 21 nt, Human
gcugggccccugccucucugc

SEQ ID NO: 3066688 - RNA, 23 nt, Human
gcugggccccugccucucugcag

SEQ ID NO: 3066689 - RNA, 23 nt, Human
gcugggguggggaccucaggccu

SEQ ID NO: 3066690 - RNA, 16 nt, Human
gcuggcuguuggcugg

SEQ ID NO: 3066691 - RNA, 20 nt, Human
gcugggccccugccucucug

SEQ ID NO: 3066692 - RNA, 15 nt, Human
gcuggcuguuggcug

SEQ ID NO: 3066693 - RNA, 11 nt, Human
ggacccugagg

SEQ ID NO: 3066694 - RNA, 12 nt, Human
ggacccccugaa

SEQ ID NO: 3066695 - RNA, 15 nt, Human
ggaccccgagccugg

SEQ ID NO: 3066696 - RNA, 14 nt, Human
ggaccucaggccug

SEQ ID NO: 3066697 - RNA, 15 nt, Human
ggaccucaggccugg

SEQ ID NO: 3066698 - RNA, 20 nt, Human
ggacguguuaugacuccaga

SEQ ID NO: 3066699 - RNA, 13 nt, Human
ggaccucaggccu

SEQ ID NO: 3066700 - RNA, 12 nt, Human
ggaccucaggcc

SEQ ID NO: 3066701 - RNA, 12 nt, Human
ggacccugaggc

SEQ ID NO: 3066702 - RNA, 13 nt, Human
ggacccugaggcc

SEQ ID NO: 3066703 - RNA, 19 nt, Human
ggacccugaggcccagagg

SEQ ID NO: 3066704 - RNA, 14 nt, Human
ggacuuggaagcuc

SEQ ID NO: 3066705 - RNA, 14 nt, Human
ggacuuugcacacu

SEQ ID NO: 3066706 - RNA, 23 nt, Human
ggacuuugcacacuuuggcccag

SEQ ID NO: 3066707 - RNA, 16 nt, Human
ggagaaaggaagggcu

SEQ ID NO: 3066708 - RNA, 13 nt, Human
ggagaaacuggaa

SEQ ID NO: 3066709 - RNA, 16 nt, Human
ggacucaaugcacuga

SEQ ID NO: 3066710 - RNA, 22 nt, Human
ggacucauuuuaaaaaauggaa

SEQ ID NO: 3066711 - RNA, 24 nt, Human
ggacuaacuugucuuuggacccug

SEQ ID NO: 3066712 - RNA, 14 nt, Human
ggacuacaggugug

SEQ ID NO: 3066713 - RNA, 15 nt, Human
ggacucaaugcacug

SEQ ID NO: 3066714 - RNA, 20 nt, Human
ggacuaacuugucuuuggac

SEQ ID NO: 3066715 - RNA, 12 nt, Human
ggaacacucuga

SEQ ID NO: 3066716 - RNA, 14 nt, Human
ggaacacucugaga

SEQ ID NO: 3066717 - RNA, 19 nt, Human
ggaacacuccuucacagau

SEQ ID NO: 3066718 - RNA, 15 nt, Human
ggaacacucugagac

SEQ ID NO: 3066719 - RNA, 16 nt, Human
ggaacacucugagacu

SEQ ID NO: 3066720 - RNA, 13 nt, Human
ggaagacuuugga

SEQ ID NO: 3066721 - RNA, 17 nt, Human
ggaagacuuuggaaaga

SEQ ID NO: 3066722 - RNA, 12 nt, Human
ggaagacuuugg

SEQ ID NO: 3066723 - RNA, 13 nt, Human
ggaagacagcucu

SEQ ID NO: 3066724 - RNA, 14 nt, Human
ggaagacagcucuu

SEQ ID NO: 3066725 - RNA, 22 nt, Human
ggaagacaaugugaaaagaaaa

SEQ ID NO: 3066726 - RNA, 13 nt, Human
ggaagagaaaaaa

SEQ ID NO: 3066727 - RNA, 18 nt, Human
ggaagacuuuggaaagag

SEQ ID NO: 3066728 - RNA, 15 nt, Human
ggaagagaaaaaaua

SEQ ID NO: 3066729 - RNA, 19 nt, Human
ggaaggaaacccagcucug

SEQ ID NO: 3066730 - RNA, 20 nt, Human
ggaaggaaacccagcucugg

SEQ ID NO: 3066731 - RNA, 16 nt, Human
ggaaggaaacccagcu

SEQ ID NO: 3066732 - RNA, 15 nt, Human
ggaagcucagggccu

SEQ ID NO: 3066733 - RNA, 23 nt, Human
ggaagcucagggccuggcucagg

SEQ ID NO: 3066734 - RNA, 11 nt, Human
ggaagcuccgc

SEQ ID NO: 3066735 - RNA, 22 nt, Human
ggaagcucagggccuggcucag

SEQ ID NO: 3066736 - RNA, 15 nt, Human
ggaagccgcuggggc

SEQ ID NO: 3066737 - RNA, 19 nt, Human
ggaaugaagauacugaaau

SEQ ID NO: 3066738 - RNA, 22 nt, Human
ggacaaggaugaucuaggaaga

SEQ ID NO: 3066739 - RNA, 23 nt, Human
ggacaaggaugaucuaggaagac

SEQ ID NO: 3066740 - RNA, 13 nt, Human
ggacaagagcagg

SEQ ID NO: 3066741 - RNA, 18 nt, Human
ggaauaacauguaauuaa

SEQ ID NO: 3066742 - RNA, 16 nt, Human
ggaauccagacccggc

SEQ ID NO: 3066743 - RNA, 18 nt, Human
ggacacagcucuucucca

SEQ ID NO: 3066744 - RNA, 15 nt, Human
ggacacagcucuucu

SEQ ID NO: 3066745 - RNA, 14 nt, Human
ggacacagcucuuc

SEQ ID NO: 3066746 - RNA, 17 nt, Human
ggacagcuccuucuguc

SEQ ID NO: 3066747 - RNA, 20 nt, Human
ggacagcuccuucuguccua

SEQ ID NO: 3066748 - RNA, 19 nt, Human
ggacagcuccuucuguccu

SEQ ID NO: 3066749 - RNA, 22 nt, Human
ggacacuaaccacgcuggaccu

SEQ ID NO: 3066750 - RNA, 17 nt, Human
ggacacuaaccacgcug

SEQ ID NO: 3066751 - RNA, 13 nt, Human
ggcugggagagcc

SEQ ID NO: 3066752 - RNA, 14 nt, Human
ggcugggagagccu

SEQ ID NO: 3066753 - RNA, 15 nt, Human
ggcugggagagccuu

SEQ ID NO: 3066754 - RNA, 16 nt, Human
ggcugggagagccuuc

SEQ ID NO: 3066755 - RNA, 21 nt, Human
ggcugcucccaccuggcucug

SEQ ID NO: 3066756 - RNA, 22 nt, Human
ggcugcucccaccuggcucugu

SEQ ID NO: 3066757 - RNA, 13 nt, Human
ggcugcucccacc

SEQ ID NO: 3066758 - RNA, 15 nt, Human
ggcugcucccaccug

SEQ ID NO: 3066759 - RNA, 18 nt, Human
ggcugcucccaccuggcu

SEQ ID NO: 3066760 - RNA, 19 nt, Human
ggcugcucccaccuggcuc

SEQ ID NO: 3066761 - RNA, 11 nt, Human
ggcugcuccca

SEQ ID NO: 3066762 - RNA, 12 nt, Human
ggcugcucccac

SEQ ID NO: 3066763 - RNA, 12 nt, Human
ggcucuuccagg

SEQ ID NO: 3066764 - RNA, 13 nt, Human
ggcucucaggcca

SEQ ID NO: 3066765 - RNA, 11 nt, Human
ggcucucaggc

SEQ ID NO: 3066766 - RNA, 22 nt, Human
ggcugcggaaugaaccacaucu

SEQ ID NO: 3066767 - RNA, 19 nt, Human
ggcugccaaugggagcuca

SEQ ID NO: 3066768 - RNA, 20 nt, Human
ggcugccaaugggagcucau

SEQ ID NO: 3066769 - RNA, 22 nt, Human
ggcugcaugcgggcuuccuccu

SEQ ID NO: 3066770 - RNA, 14 nt, Human
ggcuccacuugguc

SEQ ID NO: 3066771 - RNA, 17 nt, Human
ggcuccaaacccucgag

SEQ ID NO: 3066772 - RNA, 18 nt, Human
ggcucagcggggacagcu

SEQ ID NO: 3066773 - RNA, 20 nt, Human
ggcucagcggggacagcucc

SEQ ID NO: 3066774 - RNA, 19 nt, Human
ggcucagcggggacagcuc

SEQ ID NO: 3066775 - RNA, 19 nt, Human
ggcucagguggggucacuc

SEQ ID NO: 3066776 - RNA, 20 nt, Human
ggcucagguggggucacucu

SEQ ID NO: 3066777 - RNA, 23 nt, Human
gggacuuggaagcuccgcuuucu

SEQ ID NO: 3066778 - RNA, 18 nt, Human
gggacuuggaagcuccgc

SEQ ID NO: 3066779 - RNA, 17 nt, Human
gggacuuggaagcuccg

SEQ ID NO: 3066780 - RNA, 15 nt, Human
gggacuuggaagcuc

SEQ ID NO: 3066781 - RNA, 21 nt, Human
gggagaaccaaaaagaggcua

SEQ ID NO: 3066782 - RNA, 18 nt, Human
gggaggucaaggcugcag

SEQ ID NO: 3066783 - RNA, 15 nt, Human
gggagggagggcucc

SEQ ID NO: 3066784 - RNA, 16 nt, Human
gggagggagggcucca

SEQ ID NO: 3066785 - RNA, 15 nt, Human
gggagagccuuccag

SEQ ID NO: 3066786 - RNA, 19 nt, Human
gggagagccuuccaggggu

SEQ ID NO: 3066787 - RNA, 23 nt, Human
gggagcaggcucgggcuccccag

SEQ ID NO: 3066788 - RNA, 21 nt, Human
aaaagauuuucagaaaauauu

SEQ ID NO: 3066789 - RNA, 15 nt, Human
aaaacuucagacaua

SEQ ID NO: 3066790 - RNA, 18 nt, Human
aaaacucuccucugcugc

SEQ ID NO: 3066791 - RNA, 14 nt, Human
gggaccagagcugc

SEQ ID NO: 3066792 - RNA, 20 nt, Human
gggaccagagcugccaccug

SEQ ID NO: 3066793 - RNA, 17 nt, Human
aaaaaugguuuaaaugg

SEQ ID NO: 3066794 - RNA, 12 nt, Human
aaaacccaagug

SEQ ID NO: 3066795 - RNA, 14 nt, Human
aaaaccacagcagu

SEQ ID NO: 3066796 - RNA, 14 nt, Human
aaaacaugcuacac

SEQ ID NO: 3066797 - RNA, 13 nt, Human
aaaacaugcuaca

SEQ ID NO: 3066798 - RNA, 22 nt, Human
ggcuucauccuccucagaucuu

SEQ ID NO: 3066799 - RNA, 18 nt, Human
ggcuucauccuccucaga

SEQ ID NO: 3066800 - RNA, 16 nt, Human
ggcuuccucauaguau

SEQ ID NO: 3066801 - RNA, 18 nt, Human
ggcuguaucccaugagcc

SEQ ID NO: 3066802 - RNA, 20 nt, Human
ggcuucaguggcagcugcuu

SEQ ID NO: 3066803 - RNA, 19 nt, Human
ggcuucaguggcagcugcu

SEQ ID NO: 3066804 - RNA, 17 nt, Human
ggcuucaguggcagcug

SEQ ID NO: 3066805 - RNA, 18 nt, Human
ggcuucaguggcagcugc

SEQ ID NO: 3066806 - RNA, 20 nt, Human
ggcugggucgcccuggacug

SEQ ID NO: 3066807 - RNA, 17 nt, Human
ggcugggucgcccugga

SEQ ID NO: 3066808 - RNA, 14 nt, Human
ggcugggucgcccu

SEQ ID NO: 3066809 - RNA, 19 nt, Human
ggcuggguucuacccaggu

SEQ ID NO: 3066810 - RNA, 21 nt, Human
ggcuggguucuacccaggugc

SEQ ID NO: 3066811 - RNA, 19 nt, Human
ggcuggguggcaccagcag

SEQ ID NO: 3066812 - RNA, 14 nt, Human
aaaaauaacaauga

SEQ ID NO: 3066813 - RNA, 19 nt, Human
ggcugggggccucagugcc

SEQ ID NO: 3066814 - RNA, 17 nt, Human
ggcugggggccucagug

SEQ ID NO: 3066815 - RNA, 16 nt, Human
ggcugggggccucagu

SEQ ID NO: 3066816 - RNA, 15 nt, Human
ggcugggggccucag

SEQ ID NO: 3066817 - RNA, 15 nt, Human
gggacagcuccuucu

SEQ ID NO: 3066818 - RNA, 22 nt, Human
gggacagucaccucauggaauu

SEQ ID NO: 3066819 - RNA, 20 nt, Human
gggacagucaccucauggaa

SEQ ID NO: 3066820 - RNA, 21 nt, Human
gggacagucaccucauggaau

SEQ ID NO: 3066821 - RNA, 13 nt, Human
gggaagagacuug

SEQ ID NO: 3066822 - RNA, 13 nt, Human
gggacagcuccuu

SEQ ID NO: 3066823 - RNA, 12 nt, Human
gggacagcuccu

SEQ ID NO: 3066824 - RNA, 18 nt, Human
gggaagaagcucucuccu

SEQ ID NO: 3066825 - RNA, 20 nt, Human
gggaacccaaguccaagcau

SEQ ID NO: 3066826 - RNA, 21 nt, Human
ggcuuccuccugguguggaag

SEQ ID NO: 3066827 - RNA, 14 nt, Human
ggccaguugguccc

SEQ ID NO: 3066828 - RNA, 17 nt, Human
ggccaguuggucccccu

SEQ ID NO: 3066829 - RNA, 20 nt, Human
ggccagugugacaaggauug

SEQ ID NO: 3066830 - RNA, 14 nt, Human
ggccccugcugguu

SEQ ID NO: 3066831 - RNA, 13 nt, Human
ggccccugcuggu

SEQ ID NO: 3066832 - RNA, 21 nt, Human
ggccccugccucucugcaggu

SEQ ID NO: 3066833 - RNA, 23 nt, Human
ggccccugcugguucaggguugg

SEQ ID NO: 3066834 - RNA, 13 nt, Human
ggcccggcuccag

SEQ ID NO: 3066835 - RNA, 19 nt, Human
ggcccuucucuccagcccc

SEQ ID NO: 3066836 - RNA, 20 nt, Human
ggcccuucucuccagccccu

SEQ ID NO: 3066837 - RNA, 21 nt, Human
ggcccuucucuccagccccug

SEQ ID NO: 3066838 - RNA, 15 nt, Human
ggcccggcuccaggc

SEQ ID NO: 3066839 - RNA, 23 nt, Human
ggccucaagugauucuccugccu

SEQ ID NO: 3066840 - RNA, 22 nt, Human
ggcccuucucuccagccccugg

SEQ ID NO: 3066841 - RNA, 23 nt, Human
ggcccuucucuccagccccugga

SEQ ID NO: 3066842 - RNA, 17 nt, Human
ggcccuugucggcccca

SEQ ID NO: 3066843 - RNA, 14 nt, Human
ggccuccauccuga

SEQ ID NO: 3066844 - RNA, 15 nt, Human
ggccuccauccugag

SEQ ID NO: 3066845 - RNA, 13 nt, Human
ggccuccauccug

SEQ ID NO: 3066846 - RNA, 20 nt, Human
ggcacagaaaauggaagaca

SEQ ID NO: 3066847 - RNA, 21 nt, Human
ggcacagaaaauggaagacag

SEQ ID NO: 3066848 - RNA, 19 nt, Human
ggcacagaaaauggaagac

SEQ ID NO: 3066849 - RNA, 23 nt, Human
ggcacagaaaauggaagacagcu

SEQ ID NO: 3066850 - RNA, 21 nt, Human
ggcacaguuuucugagaaaga

SEQ ID NO: 3066851 - RNA, 13 nt, Human
ggcacaucagcac

SEQ ID NO: 3066852 - RNA, 20 nt, Human
ggcacucagaagacacugau

SEQ ID NO: 3066853 - RNA, 23 nt, Human
ggcacucagaagacacugauggg

SEQ ID NO: 3066854 - RNA, 11 nt, Human
ggcagccccug

SEQ ID NO: 3066855 - RNA, 23 nt, Human
ggcagccccauucugccugccca

SEQ ID NO: 3066856 - RNA, 16 nt, Human
ggagagaagagaaugc

SEQ ID NO: 3066857 - RNA, 21 nt, Human
ggcaguggugguuuucuguuc

SEQ ID NO: 3066858 - RNA, 20 nt, Human
ggcaguggugguuuucuguu

SEQ ID NO: 3066859 - RNA, 22 nt, Human
ggcagccccuguucuggcagag

SEQ ID NO: 3066860 - RNA, 14 nt, Human
guacuuaacuauuc

SEQ ID NO: 3066861 - RNA, 21 nt, Human
guacuucaaauccuugaagau

SEQ ID NO: 3066862 - RNA, 22 nt, Human
guacuucaaauccuugaagauu

SEQ ID NO: 3066863 - RNA, 16 nt, Human
guacuggagaaaaugg

SEQ ID NO: 3066864 - RNA, 18 nt, Human
guacuacaguccucccau

SEQ ID NO: 3066865 - RNA, 19 nt, Human
guacuacaguccucccauc

SEQ ID NO: 3066866 - RNA, 14 nt, Human
guacccacugcucu

SEQ ID NO: 3066867 - RNA, 13 nt, Human
guacccacugcuc

SEQ ID NO: 3066868 - RNA, 13 nt, Human
guacuauguauca

SEQ ID NO: 3066869 - RNA, 17 nt, Human
guacuacaguccuccca

SEQ ID NO: 3066870 - RNA, 17 nt, Human
guacuauguaucaauga

SEQ ID NO: 3066871 - RNA, 15 nt, Human
guacuauguaucaau

SEQ ID NO: 3066872 - RNA, 11 nt, Human
guagagccagg

SEQ ID NO: 3066873 - RNA, 10 nt, Human
guagagccag

SEQ ID NO: 3066874 - RNA, 13 nt, Human
guagagacagggu

SEQ ID NO: 3066875 - RNA, 15 nt, Human
guagagccagggucu

SEQ ID NO: 3066876 - RNA, 12 nt, Human
guagagacaggg

SEQ ID NO: 3066877 - RNA, 11 nt, Human
guagagacagg

SEQ ID NO: 3066878 - RNA, 23 nt, Human
guagacgugcacgcacacugucu

SEQ ID NO: 3066879 - RNA, 20 nt, Human
guagacgugcacgcacacug

SEQ ID NO: 3066880 - RNA, 23 nt, Human
guagaaauaucugaaaauguaug

SEQ ID NO: 3066881 - RNA, 21 nt, Human
guagaaauaucugaaaaugua

SEQ ID NO: 3066882 - RNA, 20 nt, Human
guagaaauaucugaaaaugu

SEQ ID NO: 3066883 - RNA, 21 nt, Human
guagaagucuuagauguauau

SEQ ID NO: 3066884 - RNA, 18 nt, Human
guagaagcccuucuaccu

SEQ ID NO: 3066885 - RNA, 15 nt, Human
guacauuuggagaca

SEQ ID NO: 3066886 - RNA, 23 nt, Human
guaccaagacuacuagggaaaug

SEQ ID NO: 3066887 - RNA, 20 nt, Human
guaccaagacuacuagggaa

SEQ ID NO: 3066888 - RNA, 12 nt, Human
guacccacugcu

SEQ ID NO: 3066889 - RNA, 16 nt, Human
guacaugaaaacacau

SEQ ID NO: 3066890 - RNA, 15 nt, Human
guacaugaaaacaca

SEQ ID NO: 3066891 - RNA, 14 nt, Human
guacaugaaaacac

SEQ ID NO: 3066892 - RNA, 15 nt, Human
aaauccauacauuug

SEQ ID NO: 3066893 - RNA, 20 nt, Human
guacaugaaaacacauuuuu

SEQ ID NO: 3066894 - RNA, 19 nt, Human
guacaugaaaacacauuuu

SEQ ID NO: 3066895 - RNA, 18 nt, Human
guacaugaaaacacauuu

SEQ ID NO: 3066896 - RNA, 17 nt, Human
guacaugaaaacacauu

SEQ ID NO: 3066897 - RNA, 19 nt, Human
guacauggaauaacaugua

SEQ ID NO: 3066898 - RNA, 15 nt, Human
aaauccacuuuaucu

SEQ ID NO: 3066899 - RNA, 11 nt, Human
aaaucauuucu

SEQ ID NO: 3066900 - RNA, 23 nt, Human
aaaucauuucugcaucagcugcu

SEQ ID NO: 3066901 - RNA, 22 nt, Human
aaaucauuucugcaucagcugc

SEQ ID NO: 3066902 - RNA, 21 nt, Human
aaaucauuucugcaucagcug

SEQ ID NO: 3066903 - RNA, 19 nt, Human
aaaucauuucugcaucagc

SEQ ID NO: 3066904 - RNA, 19 nt, Human
aaaucagccguguaaccau

SEQ ID NO: 3066905 - RNA, 12 nt, Human
aaaucagccugc

SEQ ID NO: 3066906 - RNA, 18 nt, Human
aaaucagccugcuccagc

SEQ ID NO: 3066907 - RNA, 16 nt, Human
aaaucagcugcuacua

SEQ ID NO: 3066908 - RNA, 12 nt, Human
aaaucauuucug

SEQ ID NO: 3066909 - RNA, 21 nt, Human
aaaucagacuaugaaguuuuu

SEQ ID NO: 3066910 - RNA, 14 nt, Human
aaaucagacuauga

SEQ ID NO: 3066911 - RNA, 15 nt, Human
aaauauuauguguuu

SEQ ID NO: 3066912 - RNA, 14 nt, Human
aaauauuauguguu

SEQ ID NO: 3066913 - RNA, 17 nt, Human
aaauauuauguuaaaac

SEQ ID NO: 3066914 - RNA, 19 nt, Human
aaauauuaagaaagacuau

SEQ ID NO: 3066915 - RNA, 22 nt, Human
guaauuugugauacaaugcugu

SEQ ID NO: 3066916 - RNA, 21 nt, Human
guaauccaagcaaaugugaau

SEQ ID NO: 3066917 - RNA, 18 nt, Human
guaauaugcacacauuuu

SEQ ID NO: 3066918 - RNA, 17 nt, Human
guaauaugcacacauuu

SEQ ID NO: 3066919 - RNA, 16 nt, Human
guaauaugcacacauu

SEQ ID NO: 3066920 - RNA, 14 nt, Human
guaauaugcacaca

SEQ ID NO: 3066921 - RNA, 22 nt, Human
guaauaacugugaaguuuacau

SEQ ID NO: 3066922 - RNA, 16 nt, Human
guaauaacugugaagu

SEQ ID NO: 3066923 - RNA, 15 nt, Human
guaauaacugugaag

SEQ ID NO: 3066924 - RNA, 19 nt, Human
guaauagagcaaaauugau

SEQ ID NO: 3066925 - RNA, 20 nt, Human
guaauaggcguaacuaauuu

SEQ ID NO: 3066926 - RNA, 17 nt, Human
aaauacagauagauaua

SEQ ID NO: 3066927 - RNA, 19 nt, Human
aaauacacacucaaaucaa

SEQ ID NO: 3066928 - RNA, 18 nt, Human
aaauaccagccaguaaau

SEQ ID NO: 3066929 - RNA, 22 nt, Human
aaauacgugggcauucaaaugu

SEQ ID NO: 3066930 - RNA, 14 nt, Human
aaauauaauugaca

SEQ ID NO: 3066931 - RNA, 22 nt, Human
aaauaauuuuuauauuugaaau

SEQ ID NO: 3066932 - RNA, 23 nt, Human
aaauaauuuuuauauuugaaaua

SEQ ID NO: 3066933 - RNA, 15 nt, Human
aaauacacacucaaa

SEQ ID NO: 3066934 - RNA, 21 nt, Human
aaauaauuuuuauauuugaaa

SEQ ID NO: 3066935 - RNA, 20 nt, Human
aaaguuauugauaaguucau

SEQ ID NO: 3066936 - RNA, 23 nt, Human
aaaguucugcagauaaacaguag

SEQ ID NO: 3066937 - RNA, 17 nt, Human
aaaguauguuagugcaa

SEQ ID NO: 3066938 - RNA, 18 nt, Human
aaaguaucccuacuguaa

SEQ ID NO: 3066939 - RNA, 18 nt, Human
aaaguauguuagugcaaa

SEQ ID NO: 3066940 - RNA, 21 nt, Human
aaaguacuucuccacccugcu

SEQ ID NO: 3066941 - RNA, 20 nt, Human
aaaguacuucuccacccugc

SEQ ID NO: 3066942 - RNA, 23 nt, Human
aaaguacuucuccacccugcucu

SEQ ID NO: 3066943 - RNA, 19 nt, Human
aaaguacuucuccacccug

SEQ ID NO: 3066944 - RNA, 20 nt, Human
aaaguacacuguuucaaacu

SEQ ID NO: 3066945 - RNA, 20 nt, Human
aaagguauuuuaaucaccaa

SEQ ID NO: 3066946 - RNA, 14 nt, Human
aaauaaaaauauug

SEQ ID NO: 3066947 - RNA, 16 nt, Human
aaaguugguaaaccuu

SEQ ID NO: 3066948 - RNA, 17 nt, Human
aaaguugguaaaccuuu

SEQ ID NO: 3066949 - RNA, 18 nt, Human
gggggccucagugccacu

SEQ ID NO: 3066950 - RNA, 17 nt, Human
gggggccucagugccac

SEQ ID NO: 3066951 - RNA, 15 nt, Human
gggggccucagugcc

SEQ ID NO: 3066952 - RNA, 12 nt, Human
gggggccucagu

SEQ ID NO: 3066953 - RNA, 16 nt, Human
ggggaccagagcugcc

SEQ ID NO: 3066954 - RNA, 15 nt, Human
ggggaccagagcugc

SEQ ID NO: 3066955 - RNA, 19 nt, Human
ggggaauugaggacacuga

SEQ ID NO: 3066956 - RNA, 22 nt, Human
ggggaauguuugccucugccuc

SEQ ID NO: 3066957 - RNA, 18 nt, Human
ggggaauguuugccucug

SEQ ID NO: 3066958 - RNA, 16 nt, Human
aaacauggccuuugcu

SEQ ID NO: 3066959 - RNA, 15 nt, Human
aaacagucucaggaa

SEQ ID NO: 3066960 - RNA, 14 nt, Human
aaacaguagugaua

SEQ ID NO: 3066961 - RNA, 17 nt, Human
aaacauggccuuugcuu

SEQ ID NO: 3066962 - RNA, 13 nt, Human
gggaugagaaagg

SEQ ID NO: 3066963 - RNA, 19 nt, Human
aaaauuuagaaauauaauu

SEQ ID NO: 3066964 - RNA, 20 nt, Human
aaaauuuugauguuuuaagg

SEQ ID NO: 3066965 - RNA, 11 nt, Human
aaacacagcaa

SEQ ID NO: 3066966 - RNA, 11 nt, Human
aaacagggccu

SEQ ID NO: 3066967 - RNA, 11 nt, Human
aaacacauuuu

SEQ ID NO: 3066968 - RNA, 14 nt, Human
aaacacagcaaggg

SEQ ID NO: 3066969 - RNA, 12 nt, Human
aaacacagcaag

SEQ ID NO: 3066970 - RNA, 22 nt, Human
aaacuaggugcauauuuauaaa

SEQ ID NO: 3066971 - RNA, 18 nt, Human
aaacuaggugcauauuua

SEQ ID NO: 3066972 - RNA, 14 nt, Human
aaacgucuuaaaua

SEQ ID NO: 3066973 - RNA, 13 nt, Human
aaacgucuuaaau

SEQ ID NO: 3066974 - RNA, 15 nt, Human
aaacucguuaauuug

SEQ ID NO: 3066975 - RNA, 14 nt, Human
aaacuuaaucuaaa

SEQ ID NO: 3066976 - RNA, 16 nt, Human
aaacuuaaucuaaaug

SEQ ID NO: 3066977 - RNA, 18 nt, Human
aaacuuaaucuaaaugga

SEQ ID NO: 3066978 - RNA, 17 nt, Human
aaacuuaaucuaaaugg

SEQ ID NO: 3066979 - RNA, 19 nt, Human
ggguggcaccagcagccug

SEQ ID NO: 3066980 - RNA, 18 nt, Human
aaaccuuuuauauuuagu

SEQ ID NO: 3066981 - RNA, 18 nt, Human
aaaccuuuguuugcaucu

SEQ ID NO: 3066982 - RNA, 15 nt, Human
aaacgggcucagcaa

SEQ ID NO: 3066983 - RNA, 23 nt, Human
aaaccaagucaagugaaaaagga

SEQ ID NO: 3066984 - RNA, 12 nt, Human
aaaccacagcag

SEQ ID NO: 3066985 - RNA, 15 nt, Human
gggucgcccuggacu

SEQ ID NO: 3066986 - RNA, 13 nt, Human
gggucgcccugga

SEQ ID NO: 3066987 - RNA, 19 nt, Human
gggggugcugggccccugc

SEQ ID NO: 3066988 - RNA, 15 nt, Human
gggggccuggaugcc

SEQ ID NO: 3066989 - RNA, 14 nt, Human
aaagacuguacaaa

SEQ ID NO: 3066990 - RNA, 13 nt, Human
aaagacuguacaa

SEQ ID NO: 3066991 - RNA, 23 nt, Human
aaagacugaguacguugugcauu

SEQ ID NO: 3066992 - RNA, 17 nt, Human
aaagaugcuucucacug

SEQ ID NO: 3066993 - RNA, 14 nt, Human
aaagaugcuucuca

SEQ ID NO: 3066994 - RNA, 19 nt, Human
aaagaugcuucucacugcc

SEQ ID NO: 3066995 - RNA, 15 nt, Human
aaagaggaaugaagu

SEQ ID NO: 3066996 - RNA, 15 nt, Human
aaagaggcagcuuga

SEQ ID NO: 3066997 - RNA, 12 nt, Human
gguccugcugca

SEQ ID NO: 3066998 - RNA, 11 nt, Human
gguccugcugc

SEQ ID NO: 3066999 - RNA, 22 nt, Human
aaagaccuuuggagcaaagcug

SEQ ID NO: 3067000 - RNA, 17 nt, Human
aaagacuauucaaacag

SEQ ID NO: 3067001 - RNA, 19 nt, Human
aaagacuauucaaacaguc

SEQ ID NO: 3067002 - RNA, 18 nt, Human
aaagacuauucaaacagu

SEQ ID NO: 3067003 - RNA, 14 nt, Human
aaagacuccaaaga

SEQ ID NO: 3067004 - RNA, 21 nt, Human
aaagacuccaaagaaauguaa

SEQ ID NO: 3067005 - RNA, 15 nt, Human
aaagacuccaaagaa

SEQ ID NO: 3067006 - RNA, 21 nt, Human
aaagacuauucaaacagucuc

SEQ ID NO: 3067007 - RNA, 13 nt, Human
aaagacagugaaa

SEQ ID NO: 3067008 - RNA, 16 nt, Human
aaacuuguauuaugug

SEQ ID NO: 3067009 - RNA, 19 nt, Human
aaacuucagacauagaauu

SEQ ID NO: 3067010 - RNA, 23 nt, Human
aaacuucagcgguuuauauaagc

SEQ ID NO: 3067011 - RNA, 17 nt, Human
aaagggugaaaauuauu

SEQ ID NO: 3067012 - RNA, 14 nt, Human
aaagguaaaucaga

SEQ ID NO: 3067013 - RNA, 14 nt, Human
aaagguacuucaaa

SEQ ID NO: 3067014 - RNA, 20 nt, Human
aaagggacugagaaauuuau

SEQ ID NO: 3067015 - RNA, 22 nt, Human
aaagggacuuggaagcuccgcu

SEQ ID NO: 3067016 - RNA, 21 nt, Human
aaaggagagcuagcagcaggg

SEQ ID NO: 3067017 - RNA, 17 nt, Human
aaaggagagcuagcagc

SEQ ID NO: 3067018 - RNA, 17 nt, Human
aaaggagauuggaagga

SEQ ID NO: 3067019 - RNA, 22 nt, Human
aaaggaaagagggagguaagga

SEQ ID NO: 3067020 - RNA, 15 nt, Human
aaagcucacuuuacu

SEQ ID NO: 3067021 - RNA, 21 nt, Human
aaagcacugacuucuaaguaa

SEQ ID NO: 3067022 - RNA, 17 nt, Human
aaagcacugacuucuaa

SEQ ID NO: 3067023 - RNA, 13 nt, Human
aaagcugcugaca

SEQ ID NO: 3067024 - RNA, 15 nt, Human
aaagcuuguuaagau

SEQ ID NO: 3067025 - RNA, 13 nt, Human
ggugaaaauuauu

SEQ ID NO: 3067026 - RNA, 14 nt, Human
ggugaaaauuauuu

SEQ ID NO: 3067027 - RNA, 22 nt, Human
ggugaaaauuauuuuguucaua

SEQ ID NO: 3067028 - RNA, 13 nt, Human
ggugaacagaaca

SEQ ID NO: 3067029 - RNA, 14 nt, Human
ggucgcccuggacu

SEQ ID NO: 3067030 - RNA, 13 nt, Human
ggucgaggcagga

SEQ ID NO: 3067031 - RNA, 24 nt, Human
ggugauccacccaccucagccucc

SEQ ID NO: 3067032 - RNA, 23 nt, Human
ggugauccacccaccucagccuc

SEQ ID NO: 3067033 - RNA, 18 nt, Human
ggugauccacccaccuca

SEQ ID NO: 3067034 - RNA, 13 nt, Human
ggugcaaugaccu

SEQ ID NO: 3067035 - RNA, 12 nt, Human
ggugcaaugacc

SEQ ID NO: 3067036 - RNA, 16 nt, Human
ggugcugggccccugc

SEQ ID NO: 3067037 - RNA, 15 nt, Human
ggugcugggccccug

SEQ ID NO: 3067038 - RNA, 13 nt, Human
ggugcugggcccc

SEQ ID NO: 3067039 - RNA, 11 nt, Human
ggugcugggcc

SEQ ID NO: 3067040 - RNA, 21 nt, Human
ggugcauauuuauaaaaauaa

SEQ ID NO: 3067041 - RNA, 13 nt, Human
gguggaugccugg

SEQ ID NO: 3067042 - RNA, 13 nt, Human
gacgcugugcugc

SEQ ID NO: 3067043 - RNA, 12 nt, Human
gacgcugugcug

SEQ ID NO: 3067044 - RNA, 16 nt, Human
gacuauucaaacaguc

SEQ ID NO: 3067045 - RNA, 15 nt, Human
gacuauucaaacagu

SEQ ID NO: 3067046 - RNA, 17 nt, Human
gagaagcggcuggcagc

SEQ ID NO: 3067047 - RNA, 16 nt, Human
gagaagcggcuggcag

SEQ ID NO: 3067048 - RNA, 20 nt, Human
gacugugugcucaggagccc

SEQ ID NO: 3067049 - RNA, 17 nt, Human
gacugugugcucaggag

SEQ ID NO: 3067050 - RNA, 16 nt, Human
gacugugugcucagga

SEQ ID NO: 3067051 - RNA, 14 nt, Human
gacugugugcucag

SEQ ID NO: 3067052 - RNA, 14 nt, Human
gacucaaugcacug

SEQ ID NO: 3067053 - RNA, 17 nt, Human
gacucaaugcacugaca

SEQ ID NO: 3067054 - RNA, 22 nt, Human
gacuguacaaaguagaagucuu

SEQ ID NO: 3067055 - RNA, 16 nt, Human
gacuguuuucucuuga

SEQ ID NO: 3067056 - RNA, 18 nt, Human
gacuguuuucucuugaga

SEQ ID NO: 3067057 - RNA, 14 nt, Human
gacuuuggaaagac

SEQ ID NO: 3067058 - RNA, 14 nt, Human
gacuuuggaaagag

SEQ ID NO: 3067059 - RNA, 21 nt, Human
gacuuuucuguccgagcuuug

SEQ ID NO: 3067060 - RNA, 22 nt, Human
gacuuuguuaguuucuccaagc

SEQ ID NO: 3067061 - RNA, 20 nt, Human
gacuuuuccaacccucauca

SEQ ID NO: 3067062 - RNA, 15 nt, Human
gacagcuccuucugu

SEQ ID NO: 3067063 - RNA, 14 nt, Human
gacagcuccuucug

SEQ ID NO: 3067064 - RNA, 13 nt, Human
gacagcuccuucu

SEQ ID NO: 3067065 - RNA, 14 nt, Human
gacagaaagcagaa

SEQ ID NO: 3067066 - RNA, 21 nt, Human
gacagcccuucuuuccacaga

SEQ ID NO: 3067067 - RNA, 20 nt, Human
gacagaaagcagaacaguga

SEQ ID NO: 3067068 - RNA, 16 nt, Human
gacccuauugcugcuu

SEQ ID NO: 3067069 - RNA, 14 nt, Human
gacccgucuccagc

SEQ ID NO: 3067070 - RNA, 15 nt, Human
gacccgucuccagcu

SEQ ID NO: 3067071 - RNA, 18 nt, Human
gacccgucuccagcugcu

SEQ ID NO: 3067072 - RNA, 13 nt, Human
gacccggcugcgu

SEQ ID NO: 3067073 - RNA, 12 nt, Human
gacccggcugcg

SEQ ID NO: 3067074 - RNA, 16 nt, Human
gaccaucccugaaggc

SEQ ID NO: 3067075 - RNA, 17 nt, Human
gaccaucccugaaggcc

SEQ ID NO: 3067076 - RNA, 16 nt, Human
gaccauucuccaccug

SEQ ID NO: 3067077 - RNA, 14 nt, Human
gaccaucccugaag

SEQ ID NO: 3067078 - RNA, 15 nt, Human
gaccaucccugaagg

SEQ ID NO: 3067079 - RNA, 14 nt, Human
gagucacuggaaca

SEQ ID NO: 3067080 - RNA, 21 nt, Human
gagucacuggaacacuaauga

SEQ ID NO: 3067081 - RNA, 17 nt, Human
gaggugggauccuccag

SEQ ID NO: 3067082 - RNA, 15 nt, Human
gaggugggauccucc

SEQ ID NO: 3067083 - RNA, 16 nt, Human
gaggugggauccucca

SEQ ID NO: 3067084 - RNA, 13 nt, Human
gaggugggauccu

SEQ ID NO: 3067085 - RNA, 18 nt, Human
gagugagacucugucuca

SEQ ID NO: 3067086 - RNA, 14 nt, Human
gagugagacucugu

SEQ ID NO: 3067087 - RNA, 18 nt, Human
gagucagaaguuucugcc

SEQ ID NO: 3067088 - RNA, 18 nt, Human
gagugcagugagccgaga

SEQ ID NO: 3067089 - RNA, 13 nt, Human
gagugcagugagc

SEQ ID NO: 3067090 - RNA, 22 nt, Human
gaguugauacuacaguuuguua

SEQ ID NO: 3067091 - RNA, 21 nt, Human
gaguugauagcacagacccug

SEQ ID NO: 3067092 - RNA, 19 nt, Human
gaguugauacuacaguuug

SEQ ID NO: 3067093 - RNA, 19 nt, Human
gaggcucuggagcccacug

SEQ ID NO: 3067094 - RNA, 14 nt, Human
gaggcucuggagcc

SEQ ID NO: 3067095 - RNA, 15 nt, Human
gaggcucugcccuug

SEQ ID NO: 3067096 - RNA, 17 nt, Human
gaggcucugcccuuggu

SEQ ID NO: 3067097 - RNA, 12 nt, Human
gaggcucugccc

SEQ ID NO: 3067098 - RNA, 13 nt, Human
gaggcucugcccu

SEQ ID NO: 3067099 - RNA, 14 nt, Human
gaggcucugcccuu

SEQ ID NO: 3067100 - RNA, 20 nt, Human
gaggccagagacacaagccu

SEQ ID NO: 3067101 - RNA, 19 nt, Human
gaggccagagacacaagcc

SEQ ID NO: 3067102 - RNA, 12 nt, Human
gagggcuccaga

SEQ ID NO: 3067103 - RNA, 13 nt, Human
gagggcuccagac

SEQ ID NO: 3067104 - RNA, 14 nt, Human
gagggcuccagaca

SEQ ID NO: 3067105 - RNA, 15 nt, Human
gagggcuccagacac

SEQ ID NO: 3067106 - RNA, 12 nt, Human
gaggggaacaga

SEQ ID NO: 3067107 - RNA, 20 nt, Human
gagcaucaggccaggcccuc

SEQ ID NO: 3067108 - RNA, 22 nt, Human
gagcaucaggccaggcccucug

SEQ ID NO: 3067109 - RNA, 19 nt, Human
gagcugccuguucagcucc

SEQ ID NO: 3067110 - RNA, 16 nt, Human
gagcugccuguucagc

SEQ ID NO: 3067111 - RNA, 15 nt, Human
gagcugccuguucag

SEQ ID NO: 3067112 - RNA, 12 nt, Human
gagccuuccagg

SEQ ID NO: 3067113 - RNA, 13 nt, Human
gagccuuccaggg

SEQ ID NO: 3067114 - RNA, 13 nt, Human
gagcgacagugag

SEQ ID NO: 3067115 - RNA, 15 nt, Human
gagcgacagugagac

SEQ ID NO: 3067116 - RNA, 17 nt, Human
gagcaucaggccaggcc

SEQ ID NO: 3067117 - RNA, 16 nt, Human
gcacuuuguucuggcu

SEQ ID NO: 3067118 - RNA, 19 nt, Human
gcagcugcgguccacccag

SEQ ID NO: 3067119 - RNA, 20 nt, Human
gcagcugcuuuugucuaugg

SEQ ID NO: 3067120 - RNA, 13 nt, Human
gcagcugcuuuug

SEQ ID NO: 3067121 - RNA, 23 nt, Human
gcagcugcgguccacccaggagc

SEQ ID NO: 3067122 - RNA, 22 nt, Human
gcagcugcgguccacccaggag

SEQ ID NO: 3067123 - RNA, 16 nt, Human
gcagcuugaggguugg

SEQ ID NO: 3067124 - RNA, 15 nt, Human
gcagcuuauucacaa

SEQ ID NO: 3067125 - RNA, 13 nt, Human
gcaggcucucagg

SEQ ID NO: 3067126 - RNA, 14 nt, Human
gcaggcucucaggc

SEQ ID NO: 3067127 - RNA, 15 nt, Human
gcaggcucucaggcc

SEQ ID NO: 3067128 - RNA, 16 nt, Human
gcaggcucucaggcca

SEQ ID NO: 3067129 - RNA, 22 nt, Human
gcaggcucgggcuccccagccc

SEQ ID NO: 3067130 - RNA, 12 nt, Human
gcaggcucucag

SEQ ID NO: 3067131 - RNA, 21 nt, Human
gcagcuugaggguugggcugg

SEQ ID NO: 3067132 - RNA, 19 nt, Human
gcagcuugaggguugggcu

SEQ ID NO: 3067133 - RNA, 22 nt, Human
gcagggaaacagcuaaugggac

SEQ ID NO: 3067134 - RNA, 13 nt, Human
gcagggaaacagc

SEQ ID NO: 3067135 - RNA, 17 nt, Human
gcaggcucucaggccag

SEQ ID NO: 3067136 - RNA, 18 nt, Human
gcaggcugccagugccug

SEQ ID NO: 3067137 - RNA, 17 nt, Human
gcaggcugccagugccu

SEQ ID NO: 3067138 - RNA, 15 nt, Human
gcauaccacuuuugu

SEQ ID NO: 3067139 - RNA, 14 nt, Human
gcaguugccaguca

SEQ ID NO: 3067140 - RNA, 23 nt, Human
gcaguugccagucaccccggcca

SEQ ID NO: 3067141 - RNA, 15 nt, Human
gcauaaaaauuagcc

SEQ ID NO: 3067142 - RNA, 22 nt, Human
gcaguugaaaagacuccaaaga

SEQ ID NO: 3067143 - RNA, 21 nt, Human
gcauccuggcacccggccccu

SEQ ID NO: 3067144 - RNA, 17 nt, Human
gcauccuggcacccggc

SEQ ID NO: 3067145 - RNA, 18 nt, Human
gcauggcauauuuuucac

SEQ ID NO: 3067146 - RNA, 23 nt, Human
gcauccuggcacccggccccugc

SEQ ID NO: 3067147 - RNA, 22 nt, Human
gcauccuggcacccggccccug

SEQ ID NO: 3067148 - RNA, 14 nt, Human
gcauccuggcaccc

SEQ ID NO: 3067149 - RNA, 17 nt, Human
gcaugugaugagaggaa

SEQ ID NO: 3067150 - RNA, 16 nt, Human
gcauuguaaaugugcu

SEQ ID NO: 3067151 - RNA, 13 nt, Human
gcaugggaaugaa

SEQ ID NO: 3067152 - RNA, 16 nt, Human
gcaugggaaugaaugu

SEQ ID NO: 3067153 - RNA, 19 nt, Human
gcaugggaaugaaugucag

SEQ ID NO: 3067154 - RNA, 19 nt, Human
gccaacuauggccugugga

SEQ ID NO: 3067155 - RNA, 15 nt, Human
gccaacuauggccug

SEQ ID NO: 3067156 - RNA, 14 nt, Human
gccaacuauggccu

SEQ ID NO: 3067157 - RNA, 14 nt, Human
gccaagaauucuua

SEQ ID NO: 3067158 - RNA, 18 nt, Human
gccaagaauucuuaaaua

SEQ ID NO: 3067159 - RNA, 15 nt, Human
gcauuuaaaagauac

SEQ ID NO: 3067160 - RNA, 12 nt, Human
gcauuuaaaaga

SEQ ID NO: 3067161 - RNA, 16 nt, Human
gcauuugaaaauuuug

SEQ ID NO: 3067162 - RNA, 14 nt, Human
gcauuugaaaauuu

SEQ ID NO: 3067163 - RNA, 17 nt, Human
gccaaggccaaaggaag

SEQ ID NO: 3067164 - RNA, 11 nt, Human
gccaaggccaa

SEQ ID NO: 3067165 - RNA, 15 nt, Human
gcaaaagaugcuucu

SEQ ID NO: 3067166 - RNA, 18 nt, Human
gcaacccccagccugcua

SEQ ID NO: 3067167 - RNA, 16 nt, Human
gcaaaagaugcuucuc

SEQ ID NO: 3067168 - RNA, 17 nt, Human
gcaacccccagccugcu

SEQ ID NO: 3067169 - RNA, 22 nt, Human
gcaacccuggugaccagcacca

SEQ ID NO: 3067170 - RNA, 18 nt, Human
gcaaccuccgccucuugg

SEQ ID NO: 3067171 - RNA, 11 nt, Human
gcaauaaagca

SEQ ID NO: 3067172 - RNA, 23 nt, Human
gcaauaaggggagaguaacccug

SEQ ID NO: 3067173 - RNA, 18 nt, Human
gcaauagucaaauugugu

SEQ ID NO: 3067174 - RNA, 19 nt, Human
gcacacaccagagcccacc

SEQ ID NO: 3067175 - RNA, 18 nt, Human
gcacacaccagagcccac

SEQ ID NO: 3067176 - RNA, 17 nt, Human
gcacacaccagagccca

SEQ ID NO: 3067177 - RNA, 16 nt, Human
gcacacaccagagccc

SEQ ID NO: 3067178 - RNA, 15 nt, Human
gcacacaccagagcc

SEQ ID NO: 3067179 - RNA, 14 nt, Human
gcacacaccagagc

SEQ ID NO: 3067180 - RNA, 12 nt, Human
gcacacaccaga

SEQ ID NO: 3067181 - RNA, 17 nt, Human
gcacuccagccugggug

SEQ ID NO: 3067182 - RNA, 15 nt, Human
gcacuccagccuggg

SEQ ID NO: 3067183 - RNA, 22 nt, Human
gcacuauagccuaggugacaga

SEQ ID NO: 3067184 - RNA, 22 nt, Human
gcacuauaauguaagcucuacu

SEQ ID NO: 3067185 - RNA, 12 nt, Human
gcaccuccugcc

SEQ ID NO: 3067186 - RNA, 20 nt, Human
gcacacaccagagcccaccu

SEQ ID NO: 3067187 - RNA, 12 nt, Human
gcacacauuuuu

SEQ ID NO: 3067188 - RNA, 11 nt, Human
gcacacauuuu

SEQ ID NO: 3067189 - RNA, 17 nt, Human
gcaccggcuggccuggc

SEQ ID NO: 3067190 - RNA, 15 nt, Human
gcaccggcuggccug

SEQ ID NO: 3067191 - RNA, 16 nt, Human
gcaccggcuggccugg

SEQ ID NO: 3067192 - RNA, 17 nt, Human
gauuucacucuccuugg

SEQ ID NO: 3067193 - RNA, 18 nt, Human
gauuucacucuccuuggu

SEQ ID NO: 3067194 - RNA, 13 nt, Human
gauuucacucucc

SEQ ID NO: 3067195 - RNA, 16 nt, Human
gauuucacucuccuug

SEQ ID NO: 3067196 - RNA, 23 nt, Human
gauuuuuuuuuccuucagugccu

SEQ ID NO: 3067197 - RNA, 22 nt, Human
gauuuuuuuuuccuucagugcc

SEQ ID NO: 3067198 - RNA, 21 nt, Human
gauucuccugccucagccucc

SEQ ID NO: 3067199 - RNA, 20 nt, Human
gauucuccugccucagccuc

SEQ ID NO: 3067200 - RNA, 19 nt, Human
gauucuccugccucagccu

SEQ ID NO: 3067201 - RNA, 23 nt, Human
gauucuuauggacaaugacccag

SEQ ID NO: 3067202 - RNA, 20 nt, Human
gauucuucugcuucagccuc

SEQ ID NO: 3067203 - RNA, 21 nt, Human
gauucuucugcuucagccucc

SEQ ID NO: 3067204 - RNA, 23 nt, Human
gauuuaacagaaauguacagcaa

SEQ ID NO: 3067205 - RNA, 20 nt, Human
gauuuaacagaaauguacag

SEQ ID NO: 3067206 - RNA, 18 nt, Human
gaucuggguucacugcaa

SEQ ID NO: 3067207 - RNA, 20 nt, Human
gaucuggguucacugcaacc

SEQ ID NO: 3067208 - RNA, 14 nt, Human
gaugaugacuaugg

SEQ ID NO: 3067209 - RNA, 21 nt, Human
gaugaugaaaugaggucagag

SEQ ID NO: 3067210 - RNA, 21 nt, Human
gaugcugucuucguacuggga

SEQ ID NO: 3067211 - RNA, 16 nt, Human
gaugcuuguacauaau

SEQ ID NO: 3067212 - RNA, 14 nt, Human
gaugcuuguacaua

SEQ ID NO: 3067213 - RNA, 23 nt, Human
cuucugaacuuggcgcugccccu

SEQ ID NO: 3067214 - RNA, 13 nt, Human
cuucuucagagac

SEQ ID NO: 3067215 - RNA, 14 nt, Human
cuucuucagagacu

SEQ ID NO: 3067216 - RNA, 13 nt, Human
cuuccuccuggug

SEQ ID NO: 3067217 - RNA, 21 nt, Human
cuuccucuuuccaucuacccu

SEQ ID NO: 3067218 - RNA, 22 nt, Human
cuuccucuuuccaucuacccuc

SEQ ID NO: 3067219 - RNA, 13 nt, Human
cuucucacauuua

SEQ ID NO: 3067220 - RNA, 20 nt, Human
cuucucacauuuauauuuuu

SEQ ID NO: 3067221 - RNA, 21 nt, Human
cuucuaaguaaaaccacagca

SEQ ID NO: 3067222 - RNA, 17 nt, Human
cuucuaaguaaaaccac

SEQ ID NO: 3067223 - RNA, 13 nt, Human
cuucuaaguaaaa

SEQ ID NO: 3067224 - RNA, 12 nt, Human
cuugcaaaguau

SEQ ID NO: 3067225 - RNA, 23 nt, Human
cuuggauuguccccgacccuugc

SEQ ID NO: 3067226 - RNA, 24 nt, Human
cuuggauuguccccgacccuugcc

SEQ ID NO: 3067227 - RNA, 22 nt, Human
cuuggauuguccccgacccuug

SEQ ID NO: 3067228 - RNA, 15 nt, Human
cuugauguguuaucu

SEQ ID NO: 3067229 - RNA, 18 nt, Human
cuugauguguuaucucuu

SEQ ID NO: 3067230 - RNA, 22 nt, Human
cuugauauccucuuugagugaa

SEQ ID NO: 3067231 - RNA, 17 nt, Human
cuugauauccucuuuga

SEQ ID NO: 3067232 - RNA, 16 nt, Human
cuugacaucaacugca

SEQ ID NO: 3067233 - RNA, 20 nt, Human
cuugacagggcacaccgggc

SEQ ID NO: 3067234 - RNA, 21 nt, Human
cuuuuauaaacuuuaccuuuu

SEQ ID NO: 3067235 - RNA, 20 nt, Human
cuuuuauaaacuuuaccuuu

SEQ ID NO: 3067236 - RNA, 22 nt, Human
cuuuguauucucuccuguaccu

SEQ ID NO: 3067237 - RNA, 19 nt, Human
cuuuuauaaacuuuaccuu

SEQ ID NO: 3067238 - RNA, 15 nt, Human
cuuuguaaugaaaac

SEQ ID NO: 3067239 - RNA, 14 nt, Human
cuuuguaaugaaaa

SEQ ID NO: 3067240 - RNA, 16 nt, Human
cuuuguaaugaaaacc

SEQ ID NO: 3067241 - RNA, 13 nt, Human
cuuuguaaugaaa

SEQ ID NO: 3067242 - RNA, 17 nt, Human
cuuuguauucucuccug

SEQ ID NO: 3067243 - RNA, 22 nt, Human
cuuugcacacuuuggcccaggg

SEQ ID NO: 3067244 - RNA, 19 nt, Human
cuuugcacacuuuggccca

SEQ ID NO: 3067245 - RNA, 20 nt, Human
cuuugcacacuuuggcccag

SEQ ID NO: 3067246 - RNA, 15 nt, Human
cuuugcacacuuugg

SEQ ID NO: 3067247 - RNA, 16 nt, Human
cuuugacgccauccca

SEQ ID NO: 3067248 - RNA, 17 nt, Human
cuuugacgccaucccag

SEQ ID NO: 3067249 - RNA, 16 nt, Human
cuuucuacccagcgag

SEQ ID NO: 3067250 - RNA, 15 nt, Human
cuuucuacccagcga

SEQ ID NO: 3067251 - RNA, 23 nt, Human
cuuuaaugucacaggcaggucca

SEQ ID NO: 3067252 - RNA, 14 nt, Human
cuuucacccuuuuc

SEQ ID NO: 3067253 - RNA, 15 nt, Human
cuuucacccuuuucu

SEQ ID NO: 3067254 - RNA, 20 nt, Human
cuuucacccuuuucuguuug

SEQ ID NO: 3067255 - RNA, 14 nt, Human
cuugguccugcugc

SEQ ID NO: 3067256 - RNA, 16 nt, Human
cuuggucugugagaug

SEQ ID NO: 3067257 - RNA, 19 nt, Human
cuuggucugugagaugcua

SEQ ID NO: 3067258 - RNA, 22 nt, Human
cuugguagaagcccuucuaccu

SEQ ID NO: 3067259 - RNA, 19 nt, Human
cuuggugucgggcaugaca

SEQ ID NO: 3067260 - RNA, 23 nt, Human
cuugucggccccaccagugccuc

SEQ ID NO: 3067261 - RNA, 13 nt, Human
cuugucuuuggac

SEQ ID NO: 3067262 - RNA, 15 nt, Human
cuugucuuuggaccc

SEQ ID NO: 3067263 - RNA, 18 nt, Human
cuugucuuuggacccuga

SEQ ID NO: 3067264 - RNA, 23 nt, Human
gaaaauuauuuuguucauacaua

SEQ ID NO: 3067265 - RNA, 22 nt, Human
gaaaacuuguauuauguguguu

SEQ ID NO: 3067266 - RNA, 19 nt, Human
gaaaacuuguauuaugugu

SEQ ID NO: 3067267 - RNA, 18 nt, Human
gaaaacuuguauuaugug

SEQ ID NO: 3067268 - RNA, 23 nt, Human
gaaaagaaaaaugagccuggcaa

SEQ ID NO: 3067269 - RNA, 14 nt, Human
gaaaagacuccaaa

SEQ ID NO: 3067270 - RNA, 17 nt, Human
gaaaagacuccaaagaa

SEQ ID NO: 3067271 - RNA, 16 nt, Human
gaaaagacuccaaaga

SEQ ID NO: 3067272 - RNA, 20 nt, Human
gaaaauuauuuuguucauac

SEQ ID NO: 3067273 - RNA, 21 nt, Human
gaaaauuauuuuguucauaca

SEQ ID NO: 3067274 - RNA, 22 nt, Human
gaaaauuauuuuguucauacau

SEQ ID NO: 3067275 - RNA, 21 nt, Human
gaaagaaaauaccaaggaaca

SEQ ID NO: 3067276 - RNA, 18 nt, Human
gaaagaaaaucaggcugg

SEQ ID NO: 3067277 - RNA, 17 nt, Human
gaaacuggauuaaacuu

SEQ ID NO: 3067278 - RNA, 13 nt, Human
gaaacuggauuaa

SEQ ID NO: 3067279 - RNA, 14 nt, Human
gaaaggcuccagga

SEQ ID NO: 3067280 - RNA, 15 nt, Human
gaaaggcuccaggag

SEQ ID NO: 3067281 - RNA, 13 nt, Human
gaaaggcuccagg

SEQ ID NO: 3067282 - RNA, 12 nt, Human
gaaaggcuccag

SEQ ID NO: 3067283 - RNA, 13 nt, Human
gaaagggcccaga

SEQ ID NO: 3067284 - RNA, 20 nt, Human
gaaagggauuuucagcccuc

SEQ ID NO: 3067285 - RNA, 12 nt, Human
gaaagggauuuu

SEQ ID NO: 3067286 - RNA, 11 nt, Human
gaaaugaaaaa

SEQ ID NO: 3067287 - RNA, 16 nt, Human
gaaagggcccagagag

SEQ ID NO: 3067288 - RNA, 15 nt, Human
gaaagggcccagaga

SEQ ID NO: 3067289 - RNA, 22 nt, Human
gaaccaccacacccagcccacu

SEQ ID NO: 3067290 - RNA, 21 nt, Human
gaaccaccacacccagcccac

SEQ ID NO: 3067291 - RNA, 20 nt, Human
gaaccaccacacccagccca

SEQ ID NO: 3067292 - RNA, 18 nt, Human
gaaccaccacacccagcc

SEQ ID NO: 3067293 - RNA, 17 nt, Human
gaacugauguaaguaaa

SEQ ID NO: 3067294 - RNA, 13 nt, Human
gaacuccuggccu

SEQ ID NO: 3067295 - RNA, 17 nt, Human
gaacccgggaggcagag

SEQ ID NO: 3067296 - RNA, 14 nt, Human
gaacuccuggccuc

SEQ ID NO: 3067297 - RNA, 17 nt, Human
gaacccaaguccaagca

SEQ ID NO: 3067298 - RNA, 16 nt, Human
gaacccaaguccaagc

SEQ ID NO: 3067299 - RNA, 22 nt, Human
gaaccauggucggaaaacaugc

SEQ ID NO: 3067300 - RNA, 23 nt, Human
gaaccaccacacccagcccacuu

SEQ ID NO: 3067301 - RNA, 16 nt, Human
gaagacucauucuucu

SEQ ID NO: 3067302 - RNA, 18 nt, Human
gaagacucauucuucugu

SEQ ID NO: 3067303 - RNA, 17 nt, Human
gaagacucauucuucug

SEQ ID NO: 3067304 - RNA, 22 nt, Human
gaagcacaugccucucucaggc

SEQ ID NO: 3067305 - RNA, 17 nt, Human
gaagcacagugaucaag

SEQ ID NO: 3067306 - RNA, 14 nt, Human
gaagcacagcuuca

SEQ ID NO: 3067307 - RNA, 13 nt, Human
gaagcacagcuuc

SEQ ID NO: 3067308 - RNA, 16 nt, Human
gaagcaccauaacuuu

SEQ ID NO: 3067309 - RNA, 21 nt, Human
gaagcacaugccucucucagg

SEQ ID NO: 3067310 - RNA, 12 nt, Human
gaagcagcucuu

SEQ ID NO: 3067311 - RNA, 14 nt, Human
gaagacagcucuua

SEQ ID NO: 3067312 - RNA, 15 nt, Human
gaagacagcucuuau

SEQ ID NO: 3067313 - RNA, 13 nt, Human
gaagacagagcua

SEQ ID NO: 3067314 - RNA, 15 nt, Human
gaagacagagcuaca

SEQ ID NO: 3067315 - RNA, 12 nt, Human
gaagacagcucu

SEQ ID NO: 3067316 - RNA, 13 nt, Human
gaagacagcucuu

SEQ ID NO: 3067317 - RNA, 21 nt, Human
gaagacacugaugggcaaccc

SEQ ID NO: 3067318 - RNA, 16 nt, Human
gaagacacugaugggc

SEQ ID NO: 3067319 - RNA, 16 nt, Human
cugucgcccagucugg

SEQ ID NO: 3067320 - RNA, 15 nt, Human
cugucgcccagucug

SEQ ID NO: 3067321 - RNA, 17 nt, Human
cugucggagcccugucu

SEQ ID NO: 3067322 - RNA, 23 nt, Human
cugucaauuacaggaaguacugg

SEQ ID NO: 3067323 - RNA, 19 nt, Human
cugucaauuacaggaagua

SEQ ID NO: 3067324 - RNA, 20 nt, Human
cugucaauuacaggaaguac

SEQ ID NO: 3067325 - RNA, 21 nt, Human
cuguccugggagugagcuggu

SEQ ID NO: 3067326 - RNA, 13 nt, Human
cuguagaguggga

SEQ ID NO: 3067327 - RNA, 18 nt, Human
cugugccucugggacugg

SEQ ID NO: 3067328 - RNA, 13 nt, Human
cugugcugcccug

SEQ ID NO: 3067329 - RNA, 14 nt, Human
cugugcugcccugc

SEQ ID NO: 3067330 - RNA, 12 nt, Human
cugugcugcccu

SEQ ID NO: 3067331 - RNA, 15 nt, Human
cugugcugcccugcc

SEQ ID NO: 3067332 - RNA, 17 nt, Human
cugugcugcccugccca

SEQ ID NO: 3067333 - RNA, 18 nt, Human
cugugcugcccugcccac

SEQ ID NO: 3067334 - RNA, 19 nt, Human
cugugcugcccugcccacc

SEQ ID NO: 3067335 - RNA, 17 nt, Human
cugugucagcauagaag

SEQ ID NO: 3067336 - RNA, 19 nt, Human
cugugucagcauagaagua

SEQ ID NO: 3067337 - RNA, 13 nt, Human
cuguuauaaucuu

SEQ ID NO: 3067338 - RNA, 19 nt, Human
cuuagggaaggauacaaaa

SEQ ID NO: 3067339 - RNA, 21 nt, Human
cuuagggaaggauacaaaagc

SEQ ID NO: 3067340 - RNA, 23 nt, Human
cuuagcucauucuccuuguguua

SEQ ID NO: 3067341 - RNA, 22 nt, Human
cuuagcucauucuccuuguguu

SEQ ID NO: 3067342 - RNA, 16 nt, Human
cuuaccagcagagcac

SEQ ID NO: 3067343 - RNA, 21 nt, Human
cuuagcagggaaacagcuaau

SEQ ID NO: 3067344 - RNA, 14 nt, Human
cuguuggcuggggg

SEQ ID NO: 3067345 - RNA, 22 nt, Human
cuguuggcugggggccucagug

SEQ ID NO: 3067346 - RNA, 19 nt, Human
cuguuggcugggggccuca

SEQ ID NO: 3067347 - RNA, 15 nt, Human
cuguuggccagugug

SEQ ID NO: 3067348 - RNA, 12 nt, Human
cuguuuaagaga

SEQ ID NO: 3067349 - RNA, 14 nt, Human
cuguuuaagagaca

SEQ ID NO: 3067350 - RNA, 21 nt, Human
cuuaaaaaugguuuaaauggu

SEQ ID NO: 3067351 - RNA, 14 nt, Human
cuuaaaacaacacu

SEQ ID NO: 3067352 - RNA, 15 nt, Human
cuuaccagcagagca

SEQ ID NO: 3067353 - RNA, 14 nt, Human
cugcuucaaauauu

SEQ ID NO: 3067354 - RNA, 19 nt, Human
cugcuucaaauauuucccu

SEQ ID NO: 3067355 - RNA, 12 nt, Human
cugcuucaagga

SEQ ID NO: 3067356 - RNA, 21 nt, Human
cugcuucaaggauccugagcc

SEQ ID NO: 3067357 - RNA, 22 nt, Human
cugcuucaaggauccugagcca

SEQ ID NO: 3067358 - RNA, 23 nt, Human
cugcuucaaggauccugagccag

SEQ ID NO: 3067359 - RNA, 20 nt, Human
cugcuuuugucuaugggacu

SEQ ID NO: 3067360 - RNA, 20 nt, Human
cugcuucaaggauccugagc

SEQ ID NO: 3067361 - RNA, 20 nt, Human
cugcuuauccguuagccgug

SEQ ID NO: 3067362 - RNA, 19 nt, Human
cuggauaguccgucucugc

SEQ ID NO: 3067363 - RNA, 18 nt, Human
cuggauaguccgucucug

SEQ ID NO: 3067364 - RNA, 23 nt, Human
cuggacugagggggccuggaugc

SEQ ID NO: 3067365 - RNA, 20 nt, Human
cuggacugagggggccugga

SEQ ID NO: 3067366 - RNA, 21 nt, Human
cuggacugagggggccuggau

SEQ ID NO: 3067367 - RNA, 22 nt, Human
cuggacugagggggccuggaug

SEQ ID NO: 3067368 - RNA, 18 nt, Human
cuggacugagggggccug

SEQ ID NO: 3067369 - RNA, 14 nt, Human
cuggagaaaaugga

SEQ ID NO: 3067370 - RNA, 19 nt, Human
cugcuuuuuaaagaaugcu

SEQ ID NO: 3067371 - RNA, 21 nt, Human
cugcuuuugucuaugggacuc

SEQ ID NO: 3067372 - RNA, 19 nt, Human
cugcuuuugucuaugggac

SEQ ID NO: 3067373 - RNA, 21 nt, Human
cugccuguugggccaggagcc

SEQ ID NO: 3067374 - RNA, 22 nt, Human
cugccuguugggccaggagccu

SEQ ID NO: 3067375 - RNA, 15 nt, Human
cugccuguucagcuc

SEQ ID NO: 3067376 - RNA, 18 nt, Human
cugcugacuguuuucucu

SEQ ID NO: 3067377 - RNA, 21 nt, Human
cugcugacuguuuucucuuga

SEQ ID NO: 3067378 - RNA, 20 nt, Human
cugccuguugggccaggagc

SEQ ID NO: 3067379 - RNA, 19 nt, Human
cugccuguucagcuccagc

SEQ ID NO: 3067380 - RNA, 18 nt, Human
cugccuguucagcuccag

SEQ ID NO: 3067381 - RNA, 17 nt, Human
cugccuguucagcucca

SEQ ID NO: 3067382 - RNA, 23 nt, Human
cugccucucccaucacuucccua

SEQ ID NO: 3067383 - RNA, 22 nt, Human
cugccucucccaucacuucccu

SEQ ID NO: 3067384 - RNA, 15 nt, Human
cugccucucccauca

SEQ ID NO: 3067385 - RNA, 11 nt, Human
cuggcagccca

SEQ ID NO: 3067386 - RNA, 12 nt, Human
cuggcagccccu

SEQ ID NO: 3067387 - RNA, 17 nt, Human
cuggcagaguugaagac

SEQ ID NO: 3067388 - RNA, 18 nt, Human
cuggcagaguugaagaca

SEQ ID NO: 3067389 - RNA, 11 nt, Human
cugggacacag

SEQ ID NO: 3067390 - RNA, 22 nt, Human
cuggccccucagggucccuggu

SEQ ID NO: 3067391 - RNA, 22 nt, Human
cuggccgggaccccgagccugg

SEQ ID NO: 3067392 - RNA, 12 nt, Human
cugggcagaagg

SEQ ID NO: 3067393 - RNA, 15 nt, Human
cugggcagaaggaag

SEQ ID NO: 3067394 - RNA, 14 nt, Human
cuggggagaaagua

SEQ ID NO: 3067395 - RNA, 15 nt, Human
cuggggccaggcugg

SEQ ID NO: 3067396 - RNA, 15 nt, Human
cuggguucacugcaa

SEQ ID NO: 3067397 - RNA, 20 nt, Human
cuggguucacugcaaccucc

SEQ ID NO: 3067398 - RNA, 18 nt, Human
cuggguucacugcaaccu

SEQ ID NO: 3067399 - RNA, 14 nt, Human
uuucaaacuuugga

SEQ ID NO: 3067400 - RNA, 17 nt, Human
uuuccaugaguccccug

SEQ ID NO: 3067401 - RNA, 18 nt, Human
uuuccaugaguccccugu

SEQ ID NO: 3067402 - RNA, 11 nt, Human
auggacuuugu

SEQ ID NO: 3067403 - RNA, 12 nt, Human
auggacuuuguu

SEQ ID NO: 3067404 - RNA, 22 nt, Human
auggacuuugcacacuuuggcc

SEQ ID NO: 3067405 - RNA, 19 nt, Human
auggacuaacuugucuuug

SEQ ID NO: 3067406 - RNA, 20 nt, Human
auggcauauuuuucacauau

SEQ ID NO: 3067407 - RNA, 21 nt, Human
auggcauauuuuucacauauc

SEQ ID NO: 3067408 - RNA, 22 nt, Human
auggcauauuuuucacauaucu

SEQ ID NO: 3067409 - RNA, 23 nt, Human
auggcauauuuuucacauaucua

SEQ ID NO: 3067410 - RNA, 18 nt, Human
auggcauauuuuucacau

SEQ ID NO: 3067411 - RNA, 14 nt, Human
auggcacuaguauu

SEQ ID NO: 3067412 - RNA, 16 nt, Human
auggcacuaguauuuc

SEQ ID NO: 3067413 - RNA, 23 nt, Human
auggcuauaggugcuacaaaaac

SEQ ID NO: 3067414 - RNA, 19 nt, Human
auggcuaagcaaaauguga

SEQ ID NO: 3067415 - RNA, 19 nt, Human
augggagagaagagaaugc

SEQ ID NO: 3067416 - RNA, 15 nt, Human
augggagagaagaga

SEQ ID NO: 3067417 - RNA, 21 nt, Human
uuuaucaaagggugaaaauua

SEQ ID NO: 3067418 - RNA, 18 nt, Human
uuuaucaugugaaaucau

SEQ ID NO: 3067419 - RNA, 17 nt, Human
uuuaucaugugaaauca

SEQ ID NO: 3067420 - RNA, 18 nt, Human
augcuagguuaauuccaa

SEQ ID NO: 3067421 - RNA, 19 nt, Human
augcuagaacucccuuuca

SEQ ID NO: 3067422 - RNA, 22 nt, Human
augcuagaacucccuuucaaca

SEQ ID NO: 3067423 - RNA, 20 nt, Human
augcuagaacucccuuucaa

SEQ ID NO: 3067424 - RNA, 21 nt, Human
augcuagaacucccuuucaac

SEQ ID NO: 3067425 - RNA, 20 nt, Human
uuuauuuuguguuuaggaac

SEQ ID NO: 3067426 - RNA, 16 nt, Human
uuuauuuuguguuuag

SEQ ID NO: 3067427 - RNA, 22 nt, Human
uuucaaaauuguuacaaauugu

SEQ ID NO: 3067428 - RNA, 16 nt, Human
uuucaaacauauauaa

SEQ ID NO: 3067429 - RNA, 16 nt, Human
uuucaaacuuuacuau

SEQ ID NO: 3067430 - RNA, 22 nt, Human
uuucaaacuuuacuauggcccu

SEQ ID NO: 3067431 - RNA, 15 nt, Human
uuucaaacuuuacua

SEQ ID NO: 3067432 - RNA, 13 nt, Human
augcuucucacug

SEQ ID NO: 3067433 - RNA, 19 nt, Human
augcuguucaugaaagauu

SEQ ID NO: 3067434 - RNA, 22 nt, Human
augcugugcccuaaaguguauu

SEQ ID NO: 3067435 - RNA, 17 nt, Human
augcuguucaugaaaga

SEQ ID NO: 3067436 - RNA, 13 nt, Human
augcugcugcccc

SEQ ID NO: 3067437 - RNA, 15 nt, Human
augcugcugccccug

SEQ ID NO: 3067438 - RNA, 21 nt, Human
augcugcugccccugcacagc

SEQ ID NO: 3067439 - RNA, 22 nt, Human
augcugcugccccugcacagca

SEQ ID NO: 3067440 - RNA, 23 nt, Human
augcugcugccccugcacagcag

SEQ ID NO: 3067441 - RNA, 17 nt, Human
augauacuugaaaauua

SEQ ID NO: 3067442 - RNA, 21 nt, Human
augauacuugaaaauuaacau

SEQ ID NO: 3067443 - RNA, 17 nt, Human
augaucuaggaagacuu

SEQ ID NO: 3067444 - RNA, 20 nt, Human
augaucuaggaagacuuugg

SEQ ID NO: 3067445 - RNA, 15 nt, Human
augaucuaggaagac

SEQ ID NO: 3067446 - RNA, 18 nt, Human
augauuaaguaaugauaa

SEQ ID NO: 3067447 - RNA, 14 nt, Human
augauuaaguaaug

SEQ ID NO: 3067448 - RNA, 20 nt, Human
uuguguuaaguauguguaaa

SEQ ID NO: 3067449 - RNA, 21 nt, Human
uuguuccacaaguuaaauaaa

SEQ ID NO: 3067450 - RNA, 20 nt, Human
uuguguuacuaaguuuuuau

SEQ ID NO: 3067451 - RNA, 15 nt, Human
uuguguuacuaaguu

SEQ ID NO: 3067452 - RNA, 13 nt, Human
uuguguuacuaag

SEQ ID NO: 3067453 - RNA, 16 nt, Human
uuggugcgggguacac

SEQ ID NO: 3067454 - RNA, 17 nt, Human
augauaaguaaaugcua

SEQ ID NO: 3067455 - RNA, 15 nt, Human
augauaacuggaaac

SEQ ID NO: 3067456 - RNA, 20 nt, Human
uuguucuugguuuguaaauu

SEQ ID NO: 3067457 - RNA, 23 nt, Human
uuuaaaaauacagauagauauau

SEQ ID NO: 3067458 - RNA, 13 nt, Human
uuuaaagaaugcu

SEQ ID NO: 3067459 - RNA, 19 nt, Human
augcacuuuguucuggcuc

SEQ ID NO: 3067460 - RNA, 20 nt, Human
augcacuuuguucuggcucu

SEQ ID NO: 3067461 - RNA, 17 nt, Human
augcacuuuguucuggc

SEQ ID NO: 3067462 - RNA, 16 nt, Human
augcacuuuguucugg

SEQ ID NO: 3067463 - RNA, 14 nt, Human
augcaccagcccuu

SEQ ID NO: 3067464 - RNA, 13 nt, Human
augcaccuggaau

SEQ ID NO: 3067465 - RNA, 22 nt, Human
augcaccagcccuuagcaggga

SEQ ID NO: 3067466 - RNA, 17 nt, Human
augcagccucacagucc

SEQ ID NO: 3067467 - RNA, 18 nt, Human
augcagccucacaguccu

SEQ ID NO: 3067468 - RNA, 19 nt, Human
uuuaauuuuuuugagacag

SEQ ID NO: 3067469 - RNA, 12 nt, Human
augcccagcccc

SEQ ID NO: 3067470 - RNA, 13 nt, Human
augcccagccccu

SEQ ID NO: 3067471 - RNA, 14 nt, Human
augcccagccccuu

SEQ ID NO: 3067472 - RNA, 13 nt, Human
augcagugcuucc

SEQ ID NO: 3067473 - RNA, 23 nt, Human
augcagugguaugaucacggcuc

SEQ ID NO: 3067474 - RNA, 13 nt, Human
augcaguucugaa

SEQ ID NO: 3067475 - RNA, 11 nt, Human
augcccagccc

SEQ ID NO: 3067476 - RNA, 21 nt, Human
augccauuuaaagcuuauuaa

SEQ ID NO: 3067477 - RNA, 17 nt, Human
augccauuuaaagcuua

SEQ ID NO: 3067478 - RNA, 17 nt, Human
auguacauguacugauu

SEQ ID NO: 3067479 - RNA, 13 nt, Human
augguuguacaua

SEQ ID NO: 3067480 - RNA, 21 nt, Human
augguucccuugaugaagaag

SEQ ID NO: 3067481 - RNA, 15 nt, Human
augguuuucaaaaua

SEQ ID NO: 3067482 - RNA, 14 nt, Human
augguuuucaaaau

SEQ ID NO: 3067483 - RNA, 15 nt, Human
augguuuggagcuga

SEQ ID NO: 3067484 - RNA, 14 nt, Human
augguuuggagcug

SEQ ID NO: 3067485 - RNA, 16 nt, Human
augguuuucaaaauaa

SEQ ID NO: 3067486 - RNA, 14 nt, Human
augguuuucuugug

SEQ ID NO: 3067487 - RNA, 17 nt, Human
augguggcuggguugga

SEQ ID NO: 3067488 - RNA, 15 nt, Human
augguggcuggguug

SEQ ID NO: 3067489 - RNA, 13 nt, Human
augguggcugggu

SEQ ID NO: 3067490 - RNA, 12 nt, Human
augguggcuggg

SEQ ID NO: 3067491 - RNA, 19 nt, Human
auggugcaaugaccuuuca

SEQ ID NO: 3067492 - RNA, 16 nt, Human
auggugcaaugaccuu

SEQ ID NO: 3067493 - RNA, 17 nt, Human
auggugcaaugaccuuu

SEQ ID NO: 3067494 - RNA, 12 nt, Human
auggugcaauga

SEQ ID NO: 3067495 - RNA, 13 nt, Human
auggugcaaugac

SEQ ID NO: 3067496 - RNA, 15 nt, Human
auggugcaaugaccu

SEQ ID NO: 3067497 - RNA, 15 nt, Human
augggugcuuggagg

SEQ ID NO: 3067498 - RNA, 20 nt, Human
auggugagggauacccaucc

SEQ ID NO: 3067499 - RNA, 20 nt, Human
augggcuggguucuacccag

SEQ ID NO: 3067500 - RNA, 17 nt, Human
augggccuccugugugu

SEQ ID NO: 3067501 - RNA, 18 nt, Human
augggccuccugugugug

SEQ ID NO: 3067502 - RNA, 15 nt, Human
uuugaaauauugacu

SEQ ID NO: 3067503 - RNA, 12 nt, Human
auggggcugcac

SEQ ID NO: 3067504 - RNA, 24 nt, Human
auggggcugcaccggcuggccugg

SEQ ID NO: 3067505 - RNA, 14 nt, Human
augggggugcauuu

SEQ ID NO: 3067506 - RNA, 15 nt, Human
augggggugcauuug

SEQ ID NO: 3067507 - RNA, 15 nt, Human
augggauccuggagu

SEQ ID NO: 3067508 - RNA, 18 nt, Human
uuucucccagucauuuaa

SEQ ID NO: 3067509 - RNA, 17 nt, Human
uuucucccagucauuua

SEQ ID NO: 3067510 - RNA, 19 nt, Human
uuucuggcuaugcauuuga

SEQ ID NO: 3067511 - RNA, 18 nt, Human
uuucuggcuaugcauuug

SEQ ID NO: 3067512 - RNA, 16 nt, Human
uuucuggcuaugcauu

SEQ ID NO: 3067513 - RNA, 15 nt, Human
uuucuggcuaugcau

SEQ ID NO: 3067514 - RNA, 19 nt, Human
uuucugcagccacuauugu

SEQ ID NO: 3067515 - RNA, 17 nt, Human
auguagaggagaaacug

SEQ ID NO: 3067516 - RNA, 19 nt, Human
auguagaggagaaacugga

SEQ ID NO: 3067517 - RNA, 12 nt, Human
auguagaggaga

SEQ ID NO: 3067518 - RNA, 13 nt, Human
auguagaggagaa

SEQ ID NO: 3067519 - RNA, 16 nt, Human
auguacuucaugcugu

SEQ ID NO: 3067520 - RNA, 19 nt, Human
auguagccccucuccugga

SEQ ID NO: 3067521 - RNA, 22 nt, Human
uuugacagaauauguuucaaac

SEQ ID NO: 3067522 - RNA, 12 nt, Human
uuugaccucugc

SEQ ID NO: 3067523 - RNA, 13 nt, Human
uuugccucugccu

SEQ ID NO: 3067524 - RNA, 13 nt, Human
uuugcucauggaa

SEQ ID NO: 3067525 - RNA, 15 nt, Human
uuugccguuauuaaa

SEQ ID NO: 3067526 - RNA, 14 nt, Human
uuugcaagccagau

SEQ ID NO: 3067527 - RNA, 22 nt, Human
uuugauucagacagcugccugg

SEQ ID NO: 3067528 - RNA, 13 nt, Human
uuugacgccaucc

SEQ ID NO: 3067529 - RNA, 14 nt, Human
uuugacgccauccc

SEQ ID NO: 3067530 - RNA, 16 nt, Human
uuugacgccaucccag

SEQ ID NO: 3067531 - RNA, 19 nt, Human
uuugacgccaucccagccc

SEQ ID NO: 3067532 - RNA, 20 nt, Human
uuugacgccaucccagcccc

SEQ ID NO: 3067533 - RNA, 21 nt, Human
uuugauucagacagcugccug

SEQ ID NO: 3067534 - RNA, 21 nt, Human
uuugauuaaauucuugcaaag

SEQ ID NO: 3067535 - RNA, 18 nt, Human
uuugauuaaauucuugca

SEQ ID NO: 3067536 - RNA, 13 nt, Human
uuugauuaaauuc

SEQ ID NO: 3067537 - RNA, 22 nt, Human
uuugauguucuuucacccuuuu

SEQ ID NO: 3067538 - RNA, 22 nt, Human
auguauuacaguggggaaugaa

SEQ ID NO: 3067539 - RNA, 16 nt, Human
auguauguguaaguau

SEQ ID NO: 3067540 - RNA, 15 nt, Human
auguauguguaagua

SEQ ID NO: 3067541 - RNA, 12 nt, Human
augucaguguga

SEQ ID NO: 3067542 - RNA, 13 nt, Human
augucagugugac

SEQ ID NO: 3067543 - RNA, 16 nt, Human
auguccacugguucuu

SEQ ID NO: 3067544 - RNA, 17 nt, Human
auguccacugguucuuc

SEQ ID NO: 3067545 - RNA, 14 nt, Human
uuuguaaugaaaac

SEQ ID NO: 3067546 - RNA, 13 nt, Human
uuuguaaugaaaa

SEQ ID NO: 3067547 - RNA, 12 nt, Human
uuuguauaaaag

SEQ ID NO: 3067548 - RNA, 17 nt, Human
uuuguaguguuggagaa

SEQ ID NO: 3067549 - RNA, 19 nt, Human
uuuguaguguuggagaaga

SEQ ID NO: 3067550 - RNA, 21 nt, Human
uuuguaguguuggagaagaac

SEQ ID NO: 3067551 - RNA, 20 nt, Human
uuugugaagguggaaauaaa

SEQ ID NO: 3067552 - RNA, 17 nt, Human
uuugugaagcaaaauuu

SEQ ID NO: 3067553 - RNA, 15 nt, Human
augugaugagaggaa

SEQ ID NO: 3067554 - RNA, 16 nt, Human
augugaugagaggaaa

SEQ ID NO: 3067555 - RNA, 17 nt, Human
augugaugagaggaaau

SEQ ID NO: 3067556 - RNA, 19 nt, Human
augugaugagaggaaauca

SEQ ID NO: 3067557 - RNA, 23 nt, Human
augugcacaugcacgugugugca

SEQ ID NO: 3067558 - RNA, 21 nt, Human
uugauuaaauucuugcaaagu

SEQ ID NO: 3067559 - RNA, 14 nt, Human
uugauuaaauucuu

SEQ ID NO: 3067560 - RNA, 22 nt, Human
uugcaagccagauuuuccugaa

SEQ ID NO: 3067561 - RNA, 23 nt, Human
uugauguuuuaaggaugcuugua

SEQ ID NO: 3067562 - RNA, 13 nt, Human
uugauuaaauucu

SEQ ID NO: 3067563 - RNA, 23 nt, Human
aucugaaaauguauguguaagua

SEQ ID NO: 3067564 - RNA, 12 nt, Human
aucugaaaaugu

SEQ ID NO: 3067565 - RNA, 14 nt, Human
uugcaccacugcac

SEQ ID NO: 3067566 - RNA, 15 nt, Human
uugcaccacugcacu

SEQ ID NO: 3067567 - RNA, 16 nt, Human
uugcaccacugcacuc

SEQ ID NO: 3067568 - RNA, 18 nt, Human
uugcaccacugcacucca

SEQ ID NO: 3067569 - RNA, 19 nt, Human
uugcaauggcagccuuggc

SEQ ID NO: 3067570 - RNA, 17 nt, Human
uugcaauggcagccuug

SEQ ID NO: 3067571 - RNA, 16 nt, Human
uugcaauggcagccuu

SEQ ID NO: 3067572 - RNA, 13 nt, Human
uugcaucaauuuu

SEQ ID NO: 3067573 - RNA, 13 nt, Human
aucuccaaaauaa

SEQ ID NO: 3067574 - RNA, 21 nt, Human
aucuccaaaauaaaacuuuuu

SEQ ID NO: 3067575 - RNA, 20 nt, Human
aucuccaaaauaaaacuuuu

SEQ ID NO: 3067576 - RNA, 17 nt, Human
aucuccaaaauaaaacu

SEQ ID NO: 3067577 - RNA, 14 nt, Human
aucuccaaaauaaa

SEQ ID NO: 3067578 - RNA, 14 nt, Human
aucucagggccugg

SEQ ID NO: 3067579 - RNA, 16 nt, Human
aucucagggccugguc

SEQ ID NO: 3067580 - RNA, 16 nt, Human
aucucccccagcccca

SEQ ID NO: 3067581 - RNA, 17 nt, Human
aucucccccagccccau

SEQ ID NO: 3067582 - RNA, 14 nt, Human
aucucccccagccc

SEQ ID NO: 3067583 - RNA, 15 nt, Human
aucucccccagcccc

SEQ ID NO: 3067584 - RNA, 22 nt, Human
aucugaaaauguauguguaagu

SEQ ID NO: 3067585 - RNA, 20 nt, Human
aucugaaaauguauguguaa

SEQ ID NO: 3067586 - RNA, 19 nt, Human
aucugaaaauguaugugua

SEQ ID NO: 3067587 - RNA, 16 nt, Human
aucugaaaauguaugu

SEQ ID NO: 3067588 - RNA, 14 nt, Human
aucugaaaauguau

SEQ ID NO: 3067589 - RNA, 15 nt, Human
aucucuugagccugg

SEQ ID NO: 3067590 - RNA, 17 nt, Human
uugacagaauauguuuc

SEQ ID NO: 3067591 - RNA, 21 nt, Human
uugaaggaugcugucuucgua

SEQ ID NO: 3067592 - RNA, 13 nt, Human
aucuaaauggaac

SEQ ID NO: 3067593 - RNA, 18 nt, Human
aucuaaauggaaccacuc

SEQ ID NO: 3067594 - RNA, 17 nt, Human
aucuaaauggaaccacu

SEQ ID NO: 3067595 - RNA, 16 nt, Human
auccucuguacagagc

SEQ ID NO: 3067596 - RNA, 17 nt, Human
auccucuguacagagcc

SEQ ID NO: 3067597 - RNA, 16 nt, Human
uugagauguguucaca

SEQ ID NO: 3067598 - RNA, 16 nt, Human
uugagaucagccuggg

SEQ ID NO: 3067599 - RNA, 15 nt, Human
uugagaucagccugg

SEQ ID NO: 3067600 - RNA, 20 nt, Human
uugacagaauauguuucaaa

SEQ ID NO: 3067601 - RNA, 12 nt, Human
uugagacagagu

SEQ ID NO: 3067602 - RNA, 18 nt, Human
aucuaauauguaacaagc

SEQ ID NO: 3067603 - RNA, 18 nt, Human
aucuacacuccagugaga

SEQ ID NO: 3067604 - RNA, 19 nt, Human
aucuacacuccagugagac

SEQ ID NO: 3067605 - RNA, 20 nt, Human
uugagugaagcugggagaac

SEQ ID NO: 3067606 - RNA, 20 nt, Human
uugaguugauucagcucugc

SEQ ID NO: 3067607 - RNA, 19 nt, Human
aucuuguagcuuuaucaaa

SEQ ID NO: 3067608 - RNA, 20 nt, Human
aucuuguagcuuuaucaaag

SEQ ID NO: 3067609 - RNA, 18 nt, Human
aucuuguagcuuuaucaa

SEQ ID NO: 3067610 - RNA, 20 nt, Human
aucuuggucagauuugaacu

SEQ ID NO: 3067611 - RNA, 13 nt, Human
aucuugcucugcu

SEQ ID NO: 3067612 - RNA, 18 nt, Human
aucugugaaaggaaagag

SEQ ID NO: 3067613 - RNA, 16 nt, Human
aucuggugacuuuccu

SEQ ID NO: 3067614 - RNA, 17 nt, Human
aucuggugacuuuccuc

SEQ ID NO: 3067615 - RNA, 10 nt, Human
aucuggugac

SEQ ID NO: 3067616 - RNA, 17 nt, Human
aucugugaaaggaaaga

SEQ ID NO: 3067617 - RNA, 22 nt, Human
aucugucauuugagcagggcuc

SEQ ID NO: 3067618 - RNA, 18 nt, Human
aucugcgggggcagugcu

SEQ ID NO: 3067619 - RNA, 19 nt, Human
aucugcgggggcagugcuc

SEQ ID NO: 3067620 - RNA, 20 nt, Human
aucugcgggggcagugcuca

SEQ ID NO: 3067621 - RNA, 21 nt, Human
aucugcgggggcagugcucac

SEQ ID NO: 3067622 - RNA, 23 nt, Human
aucugcgggggcagugcucaccc

SEQ ID NO: 3067623 - RNA, 20 nt, Human
uuggagacacaacuauuuuu

SEQ ID NO: 3067624 - RNA, 14 nt, Human
uugcuugaaagaaa

SEQ ID NO: 3067625 - RNA, 16 nt, Human
uuggagggugucccaa

SEQ ID NO: 3067626 - RNA, 18 nt, Human
uuggccccugcccggcug

SEQ ID NO: 3067627 - RNA, 23 nt, Human
uuggcuauuagagaucaaccccu

SEQ ID NO: 3067628 - RNA, 22 nt, Human
aucuuuucauuuaggugaggaa

SEQ ID NO: 3067629 - RNA, 17 nt, Human
aucuuugcagacaggca

SEQ ID NO: 3067630 - RNA, 18 nt, Human
augaaagggcccagagag

SEQ ID NO: 3067631 - RNA, 15 nt, Human
augaaagggcccaga

SEQ ID NO: 3067632 - RNA, 16 nt, Human
augaauauuuaguguu

SEQ ID NO: 3067633 - RNA, 21 nt, Human
augaaauuauauaaguauucu

SEQ ID NO: 3067634 - RNA, 19 nt, Human
augaaauuauauaaguauu

SEQ ID NO: 3067635 - RNA, 19 nt, Human
augaaagggcccagagagg

SEQ ID NO: 3067636 - RNA, 14 nt, Human
augaaaugagguca

SEQ ID NO: 3067637 - RNA, 21 nt, Human
augaauauuuaguguucauaa

SEQ ID NO: 3067638 - RNA, 23 nt, Human
augaauggcuaagcaaaauguga

SEQ ID NO: 3067639 - RNA, 15 nt, Human
augaauuaaguuuuu

SEQ ID NO: 3067640 - RNA, 15 nt, Human
augaauuacauuugu

SEQ ID NO: 3067641 - RNA, 18 nt, Human
uuggggaccagagcugcc

SEQ ID NO: 3067642 - RNA, 16 nt, Human
augaauuacauuugua

SEQ ID NO: 3067643 - RNA, 14 nt, Human
uucuaaauuuuaua

SEQ ID NO: 3067644 - RNA, 23 nt, Human
uucuaagaagugaaaaucuacac

SEQ ID NO: 3067645 - RNA, 13 nt, Human
uucuaagaaguga

SEQ ID NO: 3067646 - RNA, 15 nt, Human
uucuaaguaaaacca

SEQ ID NO: 3067647 - RNA, 16 nt, Human
uucuaaguaaaaccac

SEQ ID NO: 3067648 - RNA, 15 nt, Human
uucuagcauggcaua

SEQ ID NO: 3067649 - RNA, 18 nt, Human
uucuagcauggcauauuu

SEQ ID NO: 3067650 - RNA, 20 nt, Human
uucuagcauggcauauuuuu

SEQ ID NO: 3067651 - RNA, 21 nt, Human
uucuagcauggcauauuuuuc

SEQ ID NO: 3067652 - RNA, 14 nt, Human
uucuagcauggcau

SEQ ID NO: 3067653 - RNA, 19 nt, Human
uucuagcaugaagacagag

SEQ ID NO: 3067654 - RNA, 17 nt, Human
uucuagcuaauguaaua

SEQ ID NO: 3067655 - RNA, 22 nt, Human
uucuagcauggcauauuuuuca

SEQ ID NO: 3067656 - RNA, 16 nt, Human
uucuagcauggcugcc

SEQ ID NO: 3067657 - RNA, 21 nt, Human
uucuaaaggcuaccuuuguau

SEQ ID NO: 3067658 - RNA, 20 nt, Human
uucuaaaggcuaccuuugua

SEQ ID NO: 3067659 - RNA, 19 nt, Human
uucuaaaggcuaccuuugu

SEQ ID NO: 3067660 - RNA, 15 nt, Human
uucggccuccauccu

SEQ ID NO: 3067661 - RNA, 19 nt, Human
uucuaaaucuccaaaauaa

SEQ ID NO: 3067662 - RNA, 21 nt, Human
uucuaaaucuccaaaauaaaa

SEQ ID NO: 3067663 - RNA, 19 nt, Human
uucgcuccugugucuugca

SEQ ID NO: 3067664 - RNA, 15 nt, Human
uucgcuccugugucu

SEQ ID NO: 3067665 - RNA, 14 nt, Human
uucggccuccaucc

SEQ ID NO: 3067666 - RNA, 14 nt, Human
aucaggccaggccc

SEQ ID NO: 3067667 - RNA, 17 nt, Human
aucaggguuaguauugu

SEQ ID NO: 3067668 - RNA, 13 nt, Human
aucagcacgauuu

SEQ ID NO: 3067669 - RNA, 15 nt, Human
aucaggccaggcccu

SEQ ID NO: 3067670 - RNA, 16 nt, Human
aucaggccaggcccuc

SEQ ID NO: 3067671 - RNA, 18 nt, Human
aucaggccaggcccucug

SEQ ID NO: 3067672 - RNA, 12 nt, Human
aucagaauucuc

SEQ ID NO: 3067673 - RNA, 11 nt, Human
aucagaauucu

SEQ ID NO: 3067674 - RNA, 22 nt, Human
aucacuugucaauaaaauccau

SEQ ID NO: 3067675 - RNA, 13 nt, Human
uucuaggacugaa

SEQ ID NO: 3067676 - RNA, 14 nt, Human
uucuaggacugaau

SEQ ID NO: 3067677 - RNA, 20 nt, Human
uucucacagcuccaagaauu

SEQ ID NO: 3067678 - RNA, 16 nt, Human
uucuaggacugaauua

SEQ ID NO: 3067679 - RNA, 19 nt, Human
uuccguagguuauuuucag

SEQ ID NO: 3067680 - RNA, 16 nt, Human
uuccguuaaaauacca

SEQ ID NO: 3067681 - RNA, 14 nt, Human
uuccguuaaaauac

SEQ ID NO: 3067682 - RNA, 15 nt, Human
uucccuauuagagaa

SEQ ID NO: 3067683 - RNA, 20 nt, Human
uucccucaccuuucccaucu

SEQ ID NO: 3067684 - RNA, 13 nt, Human
uuccucuuuccau

SEQ ID NO: 3067685 - RNA, 22 nt, Human
uuccucuuuccaucuacccucc

SEQ ID NO: 3067686 - RNA, 17 nt, Human
uuccucuuuccaucuac

SEQ ID NO: 3067687 - RNA, 14 nt, Human
uuccugaaccgaug

SEQ ID NO: 3067688 - RNA, 14 nt, Human
uuccugaacaggau

SEQ ID NO: 3067689 - RNA, 15 nt, Human
uuccugaacaggaua

SEQ ID NO: 3067690 - RNA, 17 nt, Human
uuccuaauccucuagga

SEQ ID NO: 3067691 - RNA, 12 nt, Human
auauuuuucaca

SEQ ID NO: 3067692 - RNA, 13 nt, Human
auauuuuucacau

SEQ ID NO: 3067693 - RNA, 14 nt, Human
auauuuuucacaua

SEQ ID NO: 3067694 - RNA, 15 nt, Human
auauuuuucacauau

SEQ ID NO: 3067695 - RNA, 17 nt, Human
auauuuuucacauaucu

SEQ ID NO: 3067696 - RNA, 11 nt, Human
uuccugugucu

SEQ ID NO: 3067697 - RNA, 21 nt, Human
aucaagaugugacauguuuua

SEQ ID NO: 3067698 - RNA, 14 nt, Human
aucaacagauaaau

SEQ ID NO: 3067699 - RNA, 18 nt, Human
auauuuuuuguuaaauga

SEQ ID NO: 3067700 - RNA, 20 nt, Human
auauuuuuuguuaaaugauu

SEQ ID NO: 3067701 - RNA, 14 nt, Human
aucaaugaguaaca

SEQ ID NO: 3067702 - RNA, 15 nt, Human
aucacggcucacugc

SEQ ID NO: 3067703 - RNA, 13 nt, Human
aucacgccacugc

SEQ ID NO: 3067704 - RNA, 19 nt, Human
aucacggcucacugcagcc

SEQ ID NO: 3067705 - RNA, 18 nt, Human
aucacggcucacugcagc

SEQ ID NO: 3067706 - RNA, 20 nt, Human
aucauuuuaccuuugacaaa

SEQ ID NO: 3067707 - RNA, 18 nt, Human
auccaagcaaaugugaau

SEQ ID NO: 3067708 - RNA, 15 nt, Human
auccaguaucuugaa

SEQ ID NO: 3067709 - RNA, 16 nt, Human
auccaguaucuugaag

SEQ ID NO: 3067710 - RNA, 15 nt, Human
auccacccaccucag

SEQ ID NO: 3067711 - RNA, 13 nt, Human
auccacccaccuc

SEQ ID NO: 3067712 - RNA, 18 nt, Human
auccaagcuggucccacu

SEQ ID NO: 3067713 - RNA, 14 nt, Human
auccauacauuugu

SEQ ID NO: 3067714 - RNA, 21 nt, Human
auccaguaucuugaagacuuu

SEQ ID NO: 3067715 - RNA, 19 nt, Human
aucccaaacccuucagugc

SEQ ID NO: 3067716 - RNA, 20 nt, Human
aucccaaacccuucagugcc

SEQ ID NO: 3067717 - RNA, 12 nt, Human
aucccagcccca

SEQ ID NO: 3067718 - RNA, 18 nt, Human
aucccauaugccugggca

SEQ ID NO: 3067719 - RNA, 15 nt, Human
uucugccauauucug

SEQ ID NO: 3067720 - RNA, 19 nt, Human
uucugaacuuggcgcugcc

SEQ ID NO: 3067721 - RNA, 22 nt, Human
uucugaacuuggcgcugccccu

SEQ ID NO: 3067722 - RNA, 18 nt, Human
uucugccugcccaggccc

SEQ ID NO: 3067723 - RNA, 17 nt, Human
uucugccugcccaggcc

SEQ ID NO: 3067724 - RNA, 15 nt, Human
uucuggcucuuccag

SEQ ID NO: 3067725 - RNA, 21 nt, Human
uucugccugcccaggccccug

SEQ ID NO: 3067726 - RNA, 16 nt, Human
uucuggcucuuccagg

SEQ ID NO: 3067727 - RNA, 17 nt, Human
uucuggcucuuccaggc

SEQ ID NO: 3067728 - RNA, 17 nt, Human
uucucuaguuugauuaa

SEQ ID NO: 3067729 - RNA, 15 nt, Human
uucucuaguuugauu

SEQ ID NO: 3067730 - RNA, 12 nt, Human
uucucuaggaaa

SEQ ID NO: 3067731 - RNA, 21 nt, Human
uucuccuuguguuacuaaguu

SEQ ID NO: 3067732 - RNA, 15 nt, Human
uucuuuguaaugaaa

SEQ ID NO: 3067733 - RNA, 20 nt, Human
uucuucugcuucagccuccc

SEQ ID NO: 3067734 - RNA, 23 nt, Human
uucuuaaccagaucauugugaaa

SEQ ID NO: 3067735 - RNA, 13 nt, Human
aucccucauccuc

SEQ ID NO: 3067736 - RNA, 21 nt, Human
aucccucauccucauacccac

SEQ ID NO: 3067737 - RNA, 23 nt, Human
aucccucauccucauacccaccc

SEQ ID NO: 3067738 - RNA, 14 nt, Human
aucccucauccuca

SEQ ID NO: 3067739 - RNA, 24 nt, Human
aucccauaugccugggcagaagga

SEQ ID NO: 3067740 - RNA, 13 nt, Human
uucuucucccuca

SEQ ID NO: 3067741 - RNA, 11 nt, Human
uucuucucccu

SEQ ID NO: 3067742 - RNA, 14 nt, Human
uucuucucccucag

SEQ ID NO: 3067743 - RNA, 15 nt, Human
uucuucugcuucagc

SEQ ID NO: 3067744 - RNA, 13 nt, Human
uucuucugcuuca

SEQ ID NO: 3067745 - RNA, 17 nt, Human
uugaaauuguauuacaa

SEQ ID NO: 3067746 - RNA, 18 nt, Human
uugaacccgggaggcaga

SEQ ID NO: 3067747 - RNA, 19 nt, Human
uugaacccgggaggcagag

SEQ ID NO: 3067748 - RNA, 16 nt, Human
auccuaggcauuugcu

SEQ ID NO: 3067749 - RNA, 16 nt, Human
auccuccucagaucuu

SEQ ID NO: 3067750 - RNA, 14 nt, Human
auccuccucagauc

SEQ ID NO: 3067751 - RNA, 12 nt, Human
auccuaagcuau

SEQ ID NO: 3067752 - RNA, 15 nt, Human
auuauuuuguucaua

SEQ ID NO: 3067753 - RNA, 16 nt, Human
auuauuuuguucauac

SEQ ID NO: 3067754 - RNA, 17 nt, Human
auuauuuuguucauaca

SEQ ID NO: 3067755 - RNA, 18 nt, Human
auuauuuuguucauacau

SEQ ID NO: 3067756 - RNA, 19 nt, Human
auuauuuuguucauacaua

SEQ ID NO: 3067757 - RNA, 21 nt, Human
auuauuuuguucauacauauu

SEQ ID NO: 3067758 - RNA, 18 nt, Human
auucaaacagucucagga

SEQ ID NO: 3067759 - RNA, 16 nt, Human
auucaaacagucucag

SEQ ID NO: 3067760 - RNA, 20 nt, Human
auucaaacagucucaggaaa

SEQ ID NO: 3067761 - RNA, 19 nt, Human
auucaaacagucucaggaa

SEQ ID NO: 3067762 - RNA, 15 nt, Human
auuauuauuuggccc

SEQ ID NO: 3067763 - RNA, 20 nt, Human
auuauuaccuuacagaaguu

SEQ ID NO: 3067764 - RNA, 18 nt, Human
auuaucuagauacuguau

SEQ ID NO: 3067765 - RNA, 14 nt, Human
auuaucuagauacu

SEQ ID NO: 3067766 - RNA, 21 nt, Human
auuauguuaaaacugggacag

SEQ ID NO: 3067767 - RNA, 15 nt, Human
auuauauuuauuacu

SEQ ID NO: 3067768 - RNA, 18 nt, Human
auuauauuuauuacugua

SEQ ID NO: 3067769 - RNA, 20 nt, Human
auucacauuguauucagagu

SEQ ID NO: 3067770 - RNA, 13 nt, Human
auucacauuguau

SEQ ID NO: 3067771 - RNA, 18 nt, Human
auucagaaggaucuucau

SEQ ID NO: 3067772 - RNA, 24 nt, Human
auucagaaggaucuucaucugacu

SEQ ID NO: 3067773 - RNA, 11 nt, Human
auucagacagc

SEQ ID NO: 3067774 - RNA, 12 nt, Human
auucagacagcu

SEQ ID NO: 3067775 - RNA, 13 nt, Human
auucagacagcug

SEQ ID NO: 3067776 - RNA, 14 nt, Human
auucagacagcugc

SEQ ID NO: 3067777 - RNA, 15 nt, Human
auucagacagcugcc

SEQ ID NO: 3067778 - RNA, 16 nt, Human
auucagacagcugccu

SEQ ID NO: 3067779 - RNA, 17 nt, Human
auucagacagcugccug

SEQ ID NO: 3067780 - RNA, 18 nt, Human
auucagacagcugccugg

SEQ ID NO: 3067781 - RNA, 12 nt, Human
auucaggaagcu

SEQ ID NO: 3067782 - RNA, 14 nt, Human
auucuaaauuuuau

SEQ ID NO: 3067783 - RNA, 13 nt, Human
auucaggaagcuc

SEQ ID NO: 3067784 - RNA, 17 nt, Human
auuauauuuacaaaugg

SEQ ID NO: 3067785 - RNA, 14 nt, Human
auuauauuaugaag

SEQ ID NO: 3067786 - RNA, 18 nt, Human
auucuagcuaauguaaua

SEQ ID NO: 3067787 - RNA, 15 nt, Human
auucuagcuaaugua

SEQ ID NO: 3067788 - RNA, 17 nt, Human
auucucauuugucacac

SEQ ID NO: 3067789 - RNA, 19 nt, Human
auucugccugcccaggccc

SEQ ID NO: 3067790 - RNA, 18 nt, Human
auucugccugcccaggcc

SEQ ID NO: 3067791 - RNA, 17 nt, Human
auucugccugcccaggc

SEQ ID NO: 3067792 - RNA, 16 nt, Human
auucugccugcccagg

SEQ ID NO: 3067793 - RNA, 15 nt, Human
auucugccugcccag

SEQ ID NO: 3067794 - RNA, 14 nt, Human
auucugccugccca

SEQ ID NO: 3067795 - RNA, 13 nt, Human
auucugccugccc

SEQ ID NO: 3067796 - RNA, 11 nt, Human
auucugccugc

SEQ ID NO: 3067797 - RNA, 14 nt, Human
auucuguuggccag

SEQ ID NO: 3067798 - RNA, 21 nt, Human
auucuguuggccagugugaca

SEQ ID NO: 3067799 - RNA, 19 nt, Human
auucuguuggccaguguga

SEQ ID NO: 3067800 - RNA, 22 nt, Human
auucugcucacauaucugucau

SEQ ID NO: 3067801 - RNA, 21 nt, Human
auucugcucacauaucuguca

SEQ ID NO: 3067802 - RNA, 20 nt, Human
auucugcucacauaucuguc

SEQ ID NO: 3067803 - RNA, 19 nt, Human
auucugcucacauaucugu

SEQ ID NO: 3067804 - RNA, 21 nt, Human
auucugccugcccaggccccu

SEQ ID NO: 3067805 - RNA, 20 nt, Human
auucugccugcccaggcccc

SEQ ID NO: 3067806 - RNA, 18 nt, Human
auucugcucacauaucug

SEQ ID NO: 3067807 - RNA, 17 nt, Human
auugaaaucuuuuugcu

SEQ ID NO: 3067808 - RNA, 18 nt, Human
auugaaaucuuuuugcuu

SEQ ID NO: 3067809 - RNA, 20 nt, Human
auugaaaucuuuuugcuuug

SEQ ID NO: 3067810 - RNA, 12 nt, Human
auugaaaucuuu

SEQ ID NO: 3067811 - RNA, 14 nt, Human
auucuuaaauaugu

SEQ ID NO: 3067812 - RNA, 17 nt, Human
auugaccugaggcccuu

SEQ ID NO: 3067813 - RNA, 19 nt, Human
auugacacuuaaaaauggu

SEQ ID NO: 3067814 - RNA, 15 nt, Human
auugacacuuaaaaa

SEQ ID NO: 3067815 - RNA, 17 nt, Human
auugacacuuaaaaaug

SEQ ID NO: 3067816 - RNA, 22 nt, Human
auuuuugacagaauauguuuca

SEQ ID NO: 3067817 - RNA, 12 nt, Human
auuuuugacaga

SEQ ID NO: 3067818 - RNA, 13 nt, Human
auuuuugacagaa

SEQ ID NO: 3067819 - RNA, 14 nt, Human
auuuuugacagaau

SEQ ID NO: 3067820 - RNA, 15 nt, Human
auuuuugacagaaua

SEQ ID NO: 3067821 - RNA, 22 nt, Human
auuuuucuuagggaaggauaca

SEQ ID NO: 3067822 - RNA, 15 nt, Human
auuuuucuuauuuca

SEQ ID NO: 3067823 - RNA, 20 nt, Human
auuuuucuuauuucauuucu

SEQ ID NO: 3067824 - RNA, 19 nt, Human
auuuuucuuauuucauuuc

SEQ ID NO: 3067825 - RNA, 18 nt, Human
auuuuucacauaucuagu

SEQ ID NO: 3067826 - RNA, 21 nt, Human
auuuuucacauaucuaguaug

SEQ ID NO: 3067827 - RNA, 15 nt, Human
auuuuucacauaucu

SEQ ID NO: 3067828 - RNA, 15 nt, Human
auuuuuccaaaauaa

SEQ ID NO: 3067829 - RNA, 21 nt, Human
auuuuucuuagggaaggauac

SEQ ID NO: 3067830 - RNA, 22 nt, Human
auuuuugugauuuugugauuga

SEQ ID NO: 3067831 - RNA, 20 nt, Human
auuuuuguagcacugacaga

SEQ ID NO: 3067832 - RNA, 21 nt, Human
auuuuuguagcacugacagau

SEQ ID NO: 3067833 - RNA, 12 nt, Human
auuuuuguaauu

SEQ ID NO: 3067834 - RNA, 19 nt, Human
auuuuuguagagccagggu

SEQ ID NO: 3067835 - RNA, 14 nt, Human
auuuuuuaaaugca

SEQ ID NO: 3067836 - RNA, 13 nt, Human
auuuuuuaaaugc

SEQ ID NO: 3067837 - RNA, 21 nt, Human
auuuuuguuuucauuaucuca

SEQ ID NO: 3067838 - RNA, 20 nt, Human
auuuuuucucuaggaaauau

SEQ ID NO: 3067839 - RNA, 23 nt, Human
auuuuuucucuaggaaauauuua

SEQ ID NO: 3067840 - RNA, 18 nt, Human
auuuuuuguuaaaugauu

SEQ ID NO: 3067841 - RNA, 17 nt, Human
auuuuguguuuaggaac

SEQ ID NO: 3067842 - RNA, 12 nt, Human
auuuuguucaua

SEQ ID NO: 3067843 - RNA, 14 nt, Human
auuuuguucauaca

SEQ ID NO: 3067844 - RNA, 15 nt, Human
auuuuguucauacau

SEQ ID NO: 3067845 - RNA, 16 nt, Human
auuuuguucauacaua

SEQ ID NO: 3067846 - RNA, 18 nt, Human
auuuuguucauacauauu

SEQ ID NO: 3067847 - RNA, 16 nt, Human
auuuuguuucagugca

SEQ ID NO: 3067848 - RNA, 23 nt, Human
auuuugucauauaagauucauau

SEQ ID NO: 3067849 - RNA, 19 nt, Human
auuuugugcccccauguaa

SEQ ID NO: 3067850 - RNA, 12 nt, Human
auuuugcuuugu

SEQ ID NO: 3067851 - RNA, 20 nt, Human
auuuugcuuugugauuuuug

SEQ ID NO: 3067852 - RNA, 18 nt, Human
auuuugcuuugugauuuu

SEQ ID NO: 3067853 - RNA, 19 nt, Human
auuuuggaaaauaaauuau

SEQ ID NO: 3067854 - RNA, 14 nt, Human
auuuuggaaaauaa

SEQ ID NO: 3067855 - RNA, 20 nt, Human
auuuuggaaaauaaauuauu

SEQ ID NO: 3067856 - RNA, 21 nt, Human
auuuugcugucccuuuuccuu

SEQ ID NO: 3067857 - RNA, 20 nt, Human
auuuugcuaaaugugaauga

SEQ ID NO: 3067858 - RNA, 17 nt, Human
auuuugauguuuuaagg

SEQ ID NO: 3067859 - RNA, 15 nt, Human
auuuugauguuuuaa

SEQ ID NO: 3067860 - RNA, 19 nt, Human
auuuugauccaagcugguc

SEQ ID NO: 3067861 - RNA, 18 nt, Human
auuuugauccaagcuggu

SEQ ID NO: 3067862 - RNA, 17 nt, Human
auuuuaauaaacacucu

SEQ ID NO: 3067863 - RNA, 16 nt, Human
auuuuaauaaacacuc

SEQ ID NO: 3067864 - RNA, 15 nt, Human
auuuuaauaaacacu

SEQ ID NO: 3067865 - RNA, 14 nt, Human
auuuucuauaauuu

SEQ ID NO: 3067866 - RNA, 15 nt, Human
auuuucuauaauuua

SEQ ID NO: 3067867 - RNA, 19 nt, Human
auuuucccuauuagagaag

SEQ ID NO: 3067868 - RNA, 14 nt, Human
auuuuccugaaaac

SEQ ID NO: 3067869 - RNA, 16 nt, Human
auuuuccugccaggca

SEQ ID NO: 3067870 - RNA, 19 nt, Human
auuggacaguaaaauccac

SEQ ID NO: 3067871 - RNA, 19 nt, Human
auuggagcucgugggacag

SEQ ID NO: 3067872 - RNA, 18 nt, Human
auugcuuuggucauauga

SEQ ID NO: 3067873 - RNA, 14 nt, Human
auugcuuuggucau

SEQ ID NO: 3067874 - RNA, 21 nt, Human
auugauuuccguuaaaauacc

SEQ ID NO: 3067875 - RNA, 13 nt, Human
auugacuuuuuau

SEQ ID NO: 3067876 - RNA, 16 nt, Human
auuguacgaagaguau

SEQ ID NO: 3067877 - RNA, 23 nt, Human
auugucaaaguggugagaggcau

SEQ ID NO: 3067878 - RNA, 16 nt, Human
auugucaaagugguga

SEQ ID NO: 3067879 - RNA, 14 nt, Human
auugugggaagggg

SEQ ID NO: 3067880 - RNA, 13 nt, Human
auugugggaaggg

SEQ ID NO: 3067881 - RNA, 13 nt, Human
auugucuagugaa

SEQ ID NO: 3067882 - RNA, 21 nt, Human
auuguuuggggaugagaaagg

SEQ ID NO: 3067883 - RNA, 13 nt, Human
auuuaaaagauac

SEQ ID NO: 3067884 - RNA, 16 nt, Human
auuuaaaagauacagu

SEQ ID NO: 3067885 - RNA, 14 nt, Human
auuuaaaagauaca

SEQ ID NO: 3067886 - RNA, 17 nt, Human
auuuaaaagauacaguu

SEQ ID NO: 3067887 - RNA, 19 nt, Human
auuuguaguguuggagaag

SEQ ID NO: 3067888 - RNA, 22 nt, Human
auuuguaguguuggagaagaac

SEQ ID NO: 3067889 - RNA, 14 nt, Human
auuuguauaaaaua

SEQ ID NO: 3067890 - RNA, 23 nt, Human
auuuuaaaagaaugauuaugaau

SEQ ID NO: 3067891 - RNA, 21 nt, Human
auuugugaagguggaaauaaa

SEQ ID NO: 3067892 - RNA, 18 nt, Human
auuugugaagguggaaau

SEQ ID NO: 3067893 - RNA, 18 nt, Human
auuugucccaagugccaa

SEQ ID NO: 3067894 - RNA, 13 nt, Human
auuugucccaagu

SEQ ID NO: 3067895 - RNA, 14 nt, Human
auuugucccaagug

SEQ ID NO: 3067896 - RNA, 22 nt, Human
auuuuaaaaauacagauagaua

SEQ ID NO: 3067897 - RNA, 16 nt, Human
auuuuaaaagaaugau

SEQ ID NO: 3067898 - RNA, 18 nt, Human
auuugaaacacuuugcau

SEQ ID NO: 3067899 - RNA, 16 nt, Human
auuucuuccacaagag

SEQ ID NO: 3067900 - RNA, 15 nt, Human
auuugaaaauuuuga

SEQ ID NO: 3067901 - RNA, 16 nt, Human
auuugaaaauuuugau

SEQ ID NO: 3067902 - RNA, 17 nt, Human
auuucuaggacugaauu

SEQ ID NO: 3067903 - RNA, 18 nt, Human
auuucuaggacugaauua

SEQ ID NO: 3067904 - RNA, 20 nt, Human
auuucuuccacaagagccca

SEQ ID NO: 3067905 - RNA, 23 nt, Human
auuucuuccacaagagcccaggc

SEQ ID NO: 3067906 - RNA, 20 nt, Human
auuucuaggacugaauuaug

SEQ ID NO: 3067907 - RNA, 23 nt, Human
auuucuaggacugaauuaugaaa

SEQ ID NO: 3067908 - RNA, 19 nt, Human
auuucccaaagcagugcau

SEQ ID NO: 3067909 - RNA, 14 nt, Human
auuuauuuaaauuu

SEQ ID NO: 3067910 - RNA, 12 nt, Human
auuuauuuaaau

SEQ ID NO: 3067911 - RNA, 14 nt, Human
auuuauuuuaauaa

SEQ ID NO: 3067912 - RNA, 23 nt, Human
uuacuguacagacagaaaaaacu

SEQ ID NO: 3067913 - RNA, 12 nt, Human
uuacuguacaug

SEQ ID NO: 3067914 - RNA, 23 nt, Human
uuacuguacaugaaaacacauuu

SEQ ID NO: 3067915 - RNA, 22 nt, Human
uuacuguacaugaaaacacauu

SEQ ID NO: 3067916 - RNA, 14 nt, Human
uuacuguacaugaa

SEQ ID NO: 3067917 - RNA, 13 nt, Human
uuacuguacauga

SEQ ID NO: 3067918 - RNA, 15 nt, Human
uuacugcagcuuugu

SEQ ID NO: 3067919 - RNA, 16 nt, Human
uuagaagucacacagu

SEQ ID NO: 3067920 - RNA, 14 nt, Human
auaagauucauauu

SEQ ID NO: 3067921 - RNA, 17 nt, Human
uuacaguggggaaugaa

SEQ ID NO: 3067922 - RNA, 14 nt, Human
uuaccagcagagca

SEQ ID NO: 3067923 - RNA, 19 nt, Human
uuaccagcagagcaccuua

SEQ ID NO: 3067924 - RNA, 14 nt, Human
uuacaggugugaac

SEQ ID NO: 3067925 - RNA, 22 nt, Human
uuauaaaaauaaaaaacacugg

SEQ ID NO: 3067926 - RNA, 21 nt, Human
uuauaaaaauaaaaaacacug

SEQ ID NO: 3067927 - RNA, 13 nt, Human
uuauaaacuuuac

SEQ ID NO: 3067928 - RNA, 15 nt, Human
uuauaaaaauaaaaa

SEQ ID NO: 3067929 - RNA, 14 nt, Human
uuaguagagacagg

SEQ ID NO: 3067930 - RNA, 19 nt, Human
uuaguacuccccuccuuga

SEQ ID NO: 3067931 - RNA, 13 nt, Human
uuaguagagacag

SEQ ID NO: 3067932 - RNA, 13 nt, Human
uuaguaaucauau

SEQ ID NO: 3067933 - RNA, 14 nt, Human
uuaguaaucauauu

SEQ ID NO: 3067934 - RNA, 19 nt, Human
uuaggugugggggaagcac

SEQ ID NO: 3067935 - RNA, 21 nt, Human
uuaggugugacugaauuucuu

SEQ ID NO: 3067936 - RNA, 15 nt, Human
uuagggagagaagau

SEQ ID NO: 3067937 - RNA, 14 nt, Human
uuagggagagaaga

SEQ ID NO: 3067938 - RNA, 14 nt, Human
uuaggguuaugauu

SEQ ID NO: 3067939 - RNA, 16 nt, Human
uuaggguuaugauuaa

SEQ ID NO: 3067940 - RNA, 21 nt, Human
auaagauucauauuuacuucu

SEQ ID NO: 3067941 - RNA, 22 nt, Human
auaagccaaaaaaugcuugcuu

SEQ ID NO: 3067942 - RNA, 13 nt, Human
auaauuuuaaaug

SEQ ID NO: 3067943 - RNA, 12 nt, Human
auaauuuuaaau

SEQ ID NO: 3067944 - RNA, 14 nt, Human
auaauuuuaaaugu

SEQ ID NO: 3067945 - RNA, 23 nt, Human
auaauucacauuguauucagagu

SEQ ID NO: 3067946 - RNA, 14 nt, Human
auaaucuuucacag

SEQ ID NO: 3067947 - RNA, 19 nt, Human
auaauuuauacaggucaua

SEQ ID NO: 3067948 - RNA, 21 nt, Human
auaauuuauacaggucauauu

SEQ ID NO: 3067949 - RNA, 17 nt, Human
auaauucagaaggaucu

SEQ ID NO: 3067950 - RNA, 18 nt, Human
auaauuuaccugaagucu

SEQ ID NO: 3067951 - RNA, 15 nt, Human
aguuuguugaaacac

SEQ ID NO: 3067952 - RNA, 19 nt, Human
aguuucugccgcagcccug

SEQ ID NO: 3067953 - RNA, 22 nt, Human
aguuuguuaguaugaggcauuu

SEQ ID NO: 3067954 - RNA, 15 nt, Human
aguuucugccgcagc

SEQ ID NO: 3067955 - RNA, 14 nt, Human
aguuucucuuuuca

SEQ ID NO: 3067956 - RNA, 20 nt, Human
uuaaauuuugaguucuacau

SEQ ID NO: 3067957 - RNA, 15 nt, Human
uuaaauuuugaguuc

SEQ ID NO: 3067958 - RNA, 14 nt, Human
uuaacagaaaugua

SEQ ID NO: 3067959 - RNA, 13 nt, Human
uuaacagaaaugu

SEQ ID NO: 3067960 - RNA, 12 nt, Human
uuaacagaaaug

SEQ ID NO: 3067961 - RNA, 13 nt, Human
aguuuacauugua

SEQ ID NO: 3067962 - RNA, 17 nt, Human
aguuuacauuguaaaua

SEQ ID NO: 3067963 - RNA, 15 nt, Human
aguuuacauuguaaa

SEQ ID NO: 3067964 - RNA, 17 nt, Human
aguuuaaauuguaauag

SEQ ID NO: 3067965 - RNA, 20 nt, Human
aguuuaaauuguaauaggcg

SEQ ID NO: 3067966 - RNA, 19 nt, Human
uuaaaaaagaaacauuugg

SEQ ID NO: 3067967 - RNA, 15 nt, Human
aguuuagcuggaaaa

SEQ ID NO: 3067968 - RNA, 19 nt, Human
uuaaaaugagaaaucuaaa

SEQ ID NO: 3067969 - RNA, 12 nt, Human
uuaaaaugagaa

SEQ ID NO: 3067970 - RNA, 19 nt, Human
uuaaaaaucucaaauuucu

SEQ ID NO: 3067971 - RNA, 16 nt, Human
uuaaaaaauggaacau

SEQ ID NO: 3067972 - RNA, 20 nt, Human
uuaaaaaucucaaauuucua

SEQ ID NO: 3067973 - RNA, 17 nt, Human
uuaaaaaucucaaauuu

SEQ ID NO: 3067974 - RNA, 14 nt, Human
uuaaaaucauuucu

SEQ ID NO: 3067975 - RNA, 22 nt, Human
uuaaaaucauuucugcaucagc

SEQ ID NO: 3067976 - RNA, 13 nt, Human
uuaaucuuuaauu

SEQ ID NO: 3067977 - RNA, 17 nt, Human
uuaaucuuuaauuuuac

SEQ ID NO: 3067978 - RNA, 16 nt, Human
uuaauuuauccucugu

SEQ ID NO: 3067979 - RNA, 16 nt, Human
uuaauuugguuuucac

SEQ ID NO: 3067980 - RNA, 22 nt, Human
uuaagacgaaacauuuguucua

SEQ ID NO: 3067981 - RNA, 22 nt, Human
uuaagagagucuauuuacggaa

SEQ ID NO: 3067982 - RNA, 15 nt, Human
uuaaucuaaauggaa

SEQ ID NO: 3067983 - RNA, 15 nt, Human
aguuuuuuuuauaca

SEQ ID NO: 3067984 - RNA, 16 nt, Human
aguuuuauaugcuucu

SEQ ID NO: 3067985 - RNA, 19 nt, Human
uuaagacgaaacauuuguu

SEQ ID NO: 3067986 - RNA, 20 nt, Human
auaaaagccuguuuaagaga

SEQ ID NO: 3067987 - RNA, 19 nt, Human
auaaaagccuguuuaagag

SEQ ID NO: 3067988 - RNA, 18 nt, Human
uuaacuuuuauaaacuuu

SEQ ID NO: 3067989 - RNA, 22 nt, Human
uuaacuuuuauaaacuuuaccu

SEQ ID NO: 3067990 - RNA, 23 nt, Human
uuaacuuuuauaaacuuuaccuu

SEQ ID NO: 3067991 - RNA, 23 nt, Human
auacgcaacauaauuaaauuuug

SEQ ID NO: 3067992 - RNA, 13 nt, Human
auacguacacauu

SEQ ID NO: 3067993 - RNA, 16 nt, Human
auacguacacauuuua

SEQ ID NO: 3067994 - RNA, 18 nt, Human
auacgugggcauucaaau

SEQ ID NO: 3067995 - RNA, 19 nt, Human
auacgugggcauucaaaug

SEQ ID NO: 3067996 - RNA, 15 nt, Human
auacguacacauuuu

SEQ ID NO: 3067997 - RNA, 14 nt, Human
auacguacacauuu

SEQ ID NO: 3067998 - RNA, 18 nt, Human
auaccacuuuuguucuug

SEQ ID NO: 3067999 - RNA, 17 nt, Human
auaccacuuuuguucuu

SEQ ID NO: 3068000 - RNA, 22 nt, Human
auaccacaggaaccacaagacu

SEQ ID NO: 3068001 - RNA, 14 nt, Human
auaccuuuuuuaga

SEQ ID NO: 3068002 - RNA, 15 nt, Human
uuauauuugaaauau

SEQ ID NO: 3068003 - RNA, 19 nt, Human
uuauauuugaaauauugac

SEQ ID NO: 3068004 - RNA, 20 nt, Human
auacuaaccagcagaaaugc

SEQ ID NO: 3068005 - RNA, 19 nt, Human
auacuaaccagcagaaaug

SEQ ID NO: 3068006 - RNA, 13 nt, Human
auacuaaccagca

SEQ ID NO: 3068007 - RNA, 17 nt, Human
auacuauggaauuucuc

SEQ ID NO: 3068008 - RNA, 21 nt, Human
auacaggaugaugacuaugga

SEQ ID NO: 3068009 - RNA, 18 nt, Human
auacaguuacucagaauu

SEQ ID NO: 3068010 - RNA, 23 nt, Human
auacaggaaaagcugcugacagu

SEQ ID NO: 3068011 - RNA, 22 nt, Human
auacaggaaaagcugcugacag

SEQ ID NO: 3068012 - RNA, 23 nt, Human
auacagauagauauaugcucugc

SEQ ID NO: 3068013 - RNA, 20 nt, Human
auacaguuacucagaauucu

SEQ ID NO: 3068014 - RNA, 20 nt, Human
auacauaaacaagaccacgu

SEQ ID NO: 3068015 - RNA, 22 nt, Human
uuauaaacuuuuuucuuacugu

SEQ ID NO: 3068016 - RNA, 16 nt, Human
uuauaaacuuuuuucu

SEQ ID NO: 3068017 - RNA, 12 nt, Human
uuauaaacuuuu

SEQ ID NO: 3068018 - RNA, 18 nt, Human
uuauaaacuuuaccuuuu

SEQ ID NO: 3068019 - RNA, 17 nt, Human
uuauaaacuuuaccuuu

SEQ ID NO: 3068020 - RNA, 16 nt, Human
auacagaggcaacugc

SEQ ID NO: 3068021 - RNA, 17 nt, Human
auacagaggcaacugca

SEQ ID NO: 3068022 - RNA, 13 nt, Human
uuaugugaaacau

SEQ ID NO: 3068023 - RNA, 22 nt, Human
uuaugugccagauuuaugcaua

SEQ ID NO: 3068024 - RNA, 15 nt, Human
uuaugugaaacaugu

SEQ ID NO: 3068025 - RNA, 18 nt, Human
uuauggcuuuugugcauu

SEQ ID NO: 3068026 - RNA, 19 nt, Human
uuauggcuuuugugcauua

SEQ ID NO: 3068027 - RNA, 13 nt, Human
uuaugggcugggu

SEQ ID NO: 3068028 - RNA, 19 nt, Human
uuaugauuaaguaaugaua

SEQ ID NO: 3068029 - RNA, 22 nt, Human
uuaugggcuggguucuacccag

SEQ ID NO: 3068030 - RNA, 20 nt, Human
uuaugaagcuuuuaugugaa

SEQ ID NO: 3068031 - RNA, 19 nt, Human
uuaugaaacuuuuggaagg

SEQ ID NO: 3068032 - RNA, 14 nt, Human
uuaugaaacuuuug

SEQ ID NO: 3068033 - RNA, 17 nt, Human
uuaugaaacuuuuggaa

SEQ ID NO: 3068034 - RNA, 18 nt, Human
uuaugaaacuuuuggaag

SEQ ID NO: 3068035 - RNA, 21 nt, Human
uuaucacccagaagaaaauag

SEQ ID NO: 3068036 - RNA, 19 nt, Human
uuaucacccagaagaaaau

SEQ ID NO: 3068037 - RNA, 18 nt, Human
uuaucacccagaagaaaa

SEQ ID NO: 3068038 - RNA, 17 nt, Human
uuaucacccagaagaaa

SEQ ID NO: 3068039 - RNA, 20 nt, Human
uuaugauacuugaaaauuaa

SEQ ID NO: 3068040 - RNA, 11 nt, Human
uuaugacucca

SEQ ID NO: 3068041 - RNA, 21 nt, Human
uuaugaauuacauuuguauaa

SEQ ID NO: 3068042 - RNA, 14 nt, Human
uuaugaauuacauu

SEQ ID NO: 3068043 - RNA, 16 nt, Human
uuaugaauuacauuug

SEQ ID NO: 3068044 - RNA, 17 nt, Human
uuaugaauuacauuugu

SEQ ID NO: 3068045 - RNA, 18 nt, Human
auagauaggucagugcaa

SEQ ID NO: 3068046 - RNA, 19 nt, Human
auagaguguacuuaacuau

SEQ ID NO: 3068047 - RNA, 14 nt, Human
auagaguguacuua

SEQ ID NO: 3068048 - RNA, 21 nt, Human
auagaguguacuuaacuauuc

SEQ ID NO: 3068049 - RNA, 22 nt, Human
auagagcaaaauugauguguuu

SEQ ID NO: 3068050 - RNA, 21 nt, Human
auagagcaaaauugauguguu

SEQ ID NO: 3068051 - RNA, 17 nt, Human
auagagcaaaauugaug

SEQ ID NO: 3068052 - RNA, 15 nt, Human
auagagcaaaauuga

SEQ ID NO: 3068053 - RNA, 14 nt, Human
auagagagagacca

SEQ ID NO: 3068054 - RNA, 19 nt, Human
auagaauaaaauuuuuaau

SEQ ID NO: 3068055 - RNA, 14 nt, Human
auagaauaaaauuu

SEQ ID NO: 3068056 - RNA, 22 nt, Human
auagaauaaaauuuuuaaucuu

SEQ ID NO: 3068057 - RNA, 17 nt, Human
auagaauuaacacauga

SEQ ID NO: 3068058 - RNA, 22 nt, Human
auagacaauuuauuauggcaca

SEQ ID NO: 3068059 - RNA, 16 nt, Human
auagacaauuuauuau

SEQ ID NO: 3068060 - RNA, 23 nt, Human
auagacaauuuauuauggcacau

SEQ ID NO: 3068061 - RNA, 13 nt, Human
auagaaguaaaaa

SEQ ID NO: 3068062 - RNA, 14 nt, Human
uuauuauauuuaca

SEQ ID NO: 3068063 - RNA, 19 nt, Human
uuauguuaaaacugggaca

SEQ ID NO: 3068064 - RNA, 15 nt, Human
uuauuauauuuacaa

SEQ ID NO: 3068065 - RNA, 12 nt, Human
uuauuaugcaug

SEQ ID NO: 3068066 - RNA, 12 nt, Human
uuauucauaauu

SEQ ID NO: 3068067 - RNA, 13 nt, Human
uuauuaugcauga

SEQ ID NO: 3068068 - RNA, 16 nt, Human
auacucugcuuagaau

SEQ ID NO: 3068069 - RNA, 14 nt, Human
auacucuuauaucu

SEQ ID NO: 3068070 - RNA, 18 nt, Human
auacucuuauaucuauau

SEQ ID NO: 3068071 - RNA, 17 nt, Human
auacuccuccaagguua

SEQ ID NO: 3068072 - RNA, 14 nt, Human
auacucccaucugu

SEQ ID NO: 3068073 - RNA, 11 nt, Human
auacucccauc

SEQ ID NO: 3068074 - RNA, 16 nt, Human
auacucauuaggaugg

SEQ ID NO: 3068075 - RNA, 19 nt, Human
aguauucuuauuuaaugaa

SEQ ID NO: 3068076 - RNA, 17 nt, Human
agucaccccggccaccu

SEQ ID NO: 3068077 - RNA, 15 nt, Human
agucaccaagcccag

SEQ ID NO: 3068078 - RNA, 14 nt, Human
agucaccaagccca

SEQ ID NO: 3068079 - RNA, 22 nt, Human
ugucauuugagcagggcucagc

SEQ ID NO: 3068080 - RNA, 21 nt, Human
ugucauuugagcagggcucag

SEQ ID NO: 3068081 - RNA, 20 nt, Human
ugucauuugagcagggcuca

SEQ ID NO: 3068082 - RNA, 20 nt, Human
ugucagguggggcagcuuga

SEQ ID NO: 3068083 - RNA, 18 nt, Human
ugucagguggggcagcuu

SEQ ID NO: 3068084 - RNA, 17 nt, Human
ugucagguggggcagcu

SEQ ID NO: 3068085 - RNA, 14 nt, Human
uguccaagaagccc

SEQ ID NO: 3068086 - RNA, 15 nt, Human
uguccaagaagccca

SEQ ID NO: 3068087 - RNA, 16 nt, Human
ugucagguggggcagc

SEQ ID NO: 3068088 - RNA, 23 nt, Human
ugucccugcacuugcagacucua

SEQ ID NO: 3068089 - RNA, 22 nt, Human
ugucccugcacuugcagacucu

SEQ ID NO: 3068090 - RNA, 20 nt, Human
ugucccugcacuugcagacu

SEQ ID NO: 3068091 - RNA, 16 nt, Human
uguccaagaagcccag

SEQ ID NO: 3068092 - RNA, 17 nt, Human
uguccaagaagcccagg

SEQ ID NO: 3068093 - RNA, 18 nt, Human
uguccaagaagcccagga

SEQ ID NO: 3068094 - RNA, 22 nt, Human
uguccaagaagcccaggaaagg

SEQ ID NO: 3068095 - RNA, 20 nt, Human
uguccagccccguagacgug

SEQ ID NO: 3068096 - RNA, 14 nt, Human
aguccucccaucuc

SEQ ID NO: 3068097 - RNA, 16 nt, Human
aguccucccaucucac

SEQ ID NO: 3068098 - RNA, 21 nt, Human
agucucacuguugcccaggcu

SEQ ID NO: 3068099 - RNA, 13 nt, Human
agucucaggaaau

SEQ ID NO: 3068100 - RNA, 22 nt, Human
ugucucaguccaugaagaugua

SEQ ID NO: 3068101 - RNA, 23 nt, Human
agucucacuguugcccaggcugg

SEQ ID NO: 3068102 - RNA, 15 nt, Human
agucuauuuacggaa

SEQ ID NO: 3068103 - RNA, 20 nt, Human
agucuauuuacggaacucaa

SEQ ID NO: 3068104 - RNA, 16 nt, Human
agucccaccuuggcug

SEQ ID NO: 3068105 - RNA, 15 nt, Human
agucccaccuuggcu

SEQ ID NO: 3068106 - RNA, 19 nt, Human
agucccaccuuggcugcag

SEQ ID NO: 3068107 - RNA, 18 nt, Human
agucccaccuuggcugca

SEQ ID NO: 3068108 - RNA, 19 nt, Human
ugucccuuacgugaguccu

SEQ ID NO: 3068109 - RNA, 23 nt, Human
ugucccuuacgugaguccuggca

SEQ ID NO: 3068110 - RNA, 14 nt, Human
ugucccugcacuug

SEQ ID NO: 3068111 - RNA, 20 nt, Human
ugucggccccaccagugccu

SEQ ID NO: 3068112 - RNA, 21 nt, Human
ugucggccccaccagugccuc

SEQ ID NO: 3068113 - RNA, 22 nt, Human
ugucggccccaccagugccucu

SEQ ID NO: 3068114 - RNA, 23 nt, Human
ugucggccccaccagugccucuc

SEQ ID NO: 3068115 - RNA, 14 nt, Human
agucaggaaagaga

SEQ ID NO: 3068116 - RNA, 14 nt, Human
agguugaagcacca

SEQ ID NO: 3068117 - RNA, 14 nt, Human
agguugcagugagc

SEQ ID NO: 3068118 - RNA, 22 nt, Human
aggugugagucaccaagcccag

SEQ ID NO: 3068119 - RNA, 21 nt, Human
aggugugagucaccaagccca

SEQ ID NO: 3068120 - RNA, 16 nt, Human
aggugucccugcacuu

SEQ ID NO: 3068121 - RNA, 20 nt, Human
aggugugagucaccaagccc

SEQ ID NO: 3068122 - RNA, 12 nt, Human
aggugggaggau

SEQ ID NO: 3068123 - RNA, 16 nt, Human
aggugcuacaaaaaca

SEQ ID NO: 3068124 - RNA, 21 nt, Human
uguaauuaaguacuauguauc

SEQ ID NO: 3068125 - RNA, 19 nt, Human
uguaauuaaguacuaugua

SEQ ID NO: 3068126 - RNA, 18 nt, Human
uguaauuaaguacuaugu

SEQ ID NO: 3068127 - RNA, 19 nt, Human
uguaagggaaacugccagc

SEQ ID NO: 3068128 - RNA, 17 nt, Human
uguaauuaaguacuaug

SEQ ID NO: 3068129 - RNA, 20 nt, Human
agguuggcaaaaaggcagga

SEQ ID NO: 3068130 - RNA, 18 nt, Human
uguaagggaaacugccag

SEQ ID NO: 3068131 - RNA, 13 nt, Human
uguaagggaaacu

SEQ ID NO: 3068132 - RNA, 20 nt, Human
uguacauaaugcgugcauac

SEQ ID NO: 3068133 - RNA, 19 nt, Human
uguacauaaugcgugcaua

SEQ ID NO: 3068134 - RNA, 20 nt, Human
uguaauuuuuuuaucgucac

SEQ ID NO: 3068135 - RNA, 14 nt, Human
uguacaugaaaaca

SEQ ID NO: 3068136 - RNA, 16 nt, Human
uguacaugaaaacaca

SEQ ID NO: 3068137 - RNA, 20 nt, Human
uguacaugaaaacacauuuu

SEQ ID NO: 3068138 - RNA, 13 nt, Human
aguaauagagcaa

SEQ ID NO: 3068139 - RNA, 19 nt, Human
aguaaaaccacagcaguug

SEQ ID NO: 3068140 - RNA, 17 nt, Human
aguaaaaccacagcagu

SEQ ID NO: 3068141 - RNA, 16 nt, Human
aguaaaaccacagcag

SEQ ID NO: 3068142 - RNA, 23 nt, Human
aguaaaaacaaagaaauuaugug

SEQ ID NO: 3068143 - RNA, 16 nt, Human
aguaaaaacaaagaaa

SEQ ID NO: 3068144 - RNA, 21 nt, Human
uguacauggaauaacauguaa

SEQ ID NO: 3068145 - RNA, 19 nt, Human
aguaauucaagaaaacaac

SEQ ID NO: 3068146 - RNA, 12 nt, Human
aguaauuggaaa

SEQ ID NO: 3068147 - RNA, 13 nt, Human
aguaauuggaaag

SEQ ID NO: 3068148 - RNA, 19 nt, Human
aguacauuuggagacacaa

SEQ ID NO: 3068149 - RNA, 23 nt, Human
aguacacuguuucaaacuuuacu

SEQ ID NO: 3068150 - RNA, 20 nt, Human
aguacacuguuucaaacuuu

SEQ ID NO: 3068151 - RNA, 21 nt, Human
aguacacuguuucaaacuuua

SEQ ID NO: 3068152 - RNA, 18 nt, Human
uguauauccuuucuaaca

SEQ ID NO: 3068153 - RNA, 22 nt, Human
uguauauauuuccuauauuguu

SEQ ID NO: 3068154 - RNA, 18 nt, Human
uguauauauuuccuauau

SEQ ID NO: 3068155 - RNA, 17 nt, Human
uguaguguuggagaaga

SEQ ID NO: 3068156 - RNA, 18 nt, Human
uguaguguuggagaagaa

SEQ ID NO: 3068157 - RNA, 16 nt, Human
uguaguguuggagaag

SEQ ID NO: 3068158 - RNA, 17 nt, Human
uguaggguuauaauaau

SEQ ID NO: 3068159 - RNA, 16 nt, Human
uguaggguuauaauaa

SEQ ID NO: 3068160 - RNA, 14 nt, Human
uguguaaaauguga

SEQ ID NO: 3068161 - RNA, 20 nt, Human
ugugucagguggggcagcuu

SEQ ID NO: 3068162 - RNA, 22 nt, Human
ugugucuaaauuugaauguuaa

SEQ ID NO: 3068163 - RNA, 19 nt, Human
ugugucuaaauuugaaugu

SEQ ID NO: 3068164 - RNA, 22 nt, Human
ugugucucuugguccugcugca

SEQ ID NO: 3068165 - RNA, 18 nt, Human
agugggggaucacagccu

SEQ ID NO: 3068166 - RNA, 22 nt, Human
agugggcccaaugcacuuuguu

SEQ ID NO: 3068167 - RNA, 16 nt, Human
aguggggaaugaagau

SEQ ID NO: 3068168 - RNA, 23 nt, Human
uguuaagcagauggaaugcugug

SEQ ID NO: 3068169 - RNA, 22 nt, Human
uguguuaaguauguguaaaaug

SEQ ID NO: 3068170 - RNA, 22 nt, Human
uguguuaucacccagaagaaaa

SEQ ID NO: 3068171 - RNA, 14 nt, Human
uguuacaaauugua

SEQ ID NO: 3068172 - RNA, 18 nt, Human
uguuacaaauuguagaag

SEQ ID NO: 3068173 - RNA, 17 nt, Human
uguuacaaauuguagaa

SEQ ID NO: 3068174 - RNA, 19 nt, Human
uguuacauaagauaaaugu

SEQ ID NO: 3068175 - RNA, 15 nt, Human
uguugcauagaauaa

SEQ ID NO: 3068176 - RNA, 15 nt, Human
uguucuaagaaguga

SEQ ID NO: 3068177 - RNA, 20 nt, Human
uguugcccaggcuggcgugc

SEQ ID NO: 3068178 - RNA, 23 nt, Human
uguugcccaggcuggcgugcagu

SEQ ID NO: 3068179 - RNA, 22 nt, Human
uguugcccacagcuguaugauu

SEQ ID NO: 3068180 - RNA, 21 nt, Human
aguguucauaaauaaaguuug

SEQ ID NO: 3068181 - RNA, 18 nt, Human
aguguguguuuuucauaa

SEQ ID NO: 3068182 - RNA, 16 nt, Human
aguguuguggauuuaa

SEQ ID NO: 3068183 - RNA, 23 nt, Human
aguguuggagaagaacugaaauc

SEQ ID NO: 3068184 - RNA, 20 nt, Human
aguguuguggauuuaacaga

SEQ ID NO: 3068185 - RNA, 19 nt, Human
aguguuguggauuuaacag

SEQ ID NO: 3068186 - RNA, 13 nt, Human
aguuacucagaau

SEQ ID NO: 3068187 - RNA, 22 nt, Human
agugugguguuuccuggcacug

SEQ ID NO: 3068188 - RNA, 17 nt, Human
uguuaugacuccagaau

SEQ ID NO: 3068189 - RNA, 13 nt, Human
uguuaugacucca

SEQ ID NO: 3068190 - RNA, 20 nt, Human
agugugguguuuccuggcac

SEQ ID NO: 3068191 - RNA, 21 nt, Human
agugugccugaagucccagau

SEQ ID NO: 3068192 - RNA, 20 nt, Human
agugugccugaagucccaga

SEQ ID NO: 3068193 - RNA, 20 nt, Human
agugugacugaucucucgug

SEQ ID NO: 3068194 - RNA, 16 nt, Human
agucuuucacauuuaa

SEQ ID NO: 3068195 - RNA, 20 nt, Human
agugaacaaauuuacagaga

SEQ ID NO: 3068196 - RNA, 21 nt, Human
agugaacaaauuuacagagac

SEQ ID NO: 3068197 - RNA, 16 nt, Human
agugaacuugggccac

SEQ ID NO: 3068198 - RNA, 22 nt, Human
agugaacaaauuuacagagaca

SEQ ID NO: 3068199 - RNA, 23 nt, Human
agugaacaaauuuacagagacag

SEQ ID NO: 3068200 - RNA, 21 nt, Human
agugacugauggcuaauguac

SEQ ID NO: 3068201 - RNA, 14 nt, Human
agugagcacuaagg

SEQ ID NO: 3068202 - RNA, 12 nt, Human
agugagcugguu

SEQ ID NO: 3068203 - RNA, 22 nt, Human
ugugaugaugaaaugaggucag

SEQ ID NO: 3068204 - RNA, 19 nt, Human
ugugaugagaggaaaucac

SEQ ID NO: 3068205 - RNA, 18 nt, Human
ugugaugagaggaaauca

SEQ ID NO: 3068206 - RNA, 13 nt, Human
agucuuagaugua

SEQ ID NO: 3068207 - RNA, 16 nt, Human
agucuuagauguauau

SEQ ID NO: 3068208 - RNA, 14 nt, Human
agucuuagauguau

SEQ ID NO: 3068209 - RNA, 16 nt, Human
agucucuugauucaua

SEQ ID NO: 3068210 - RNA, 17 nt, Human
agucucuugauucauaa

SEQ ID NO: 3068211 - RNA, 16 nt, Human
ugugacugaucucucg

SEQ ID NO: 3068212 - RNA, 11 nt, Human
ugugaggaagc

SEQ ID NO: 3068213 - RNA, 20 nt, Human
ugugcucaggagcccuggga

SEQ ID NO: 3068214 - RNA, 21 nt, Human
ugugcucaggagcccugggag

SEQ ID NO: 3068215 - RNA, 18 nt, Human
ugugcugagucugaaggc

SEQ ID NO: 3068216 - RNA, 19 nt, Human
ugugcugagucugaaggcu

SEQ ID NO: 3068217 - RNA, 21 nt, Human
uguggaucaaauccagccugc

SEQ ID NO: 3068218 - RNA, 14 nt, Human
uguggaugauaaaa

SEQ ID NO: 3068219 - RNA, 20 nt, Human
uguggauuuaacagaaaugu

SEQ ID NO: 3068220 - RNA, 19 nt, Human
uguggauuuaacagaaaug

SEQ ID NO: 3068221 - RNA, 22 nt, Human
uguggauuuaacagaaauguac

SEQ ID NO: 3068222 - RNA, 23 nt, Human
agugagcugguuuuuagcggaga

SEQ ID NO: 3068223 - RNA, 18 nt, Human
ugugcugcccugcccacc

SEQ ID NO: 3068224 - RNA, 19 nt, Human
ugugcugcccugcccaccu

SEQ ID NO: 3068225 - RNA, 20 nt, Human
ugugcugcccugcccaccug

SEQ ID NO: 3068226 - RNA, 14 nt, Human
agugcaugcugucc

SEQ ID NO: 3068227 - RNA, 16 nt, Human
agugcaugcugucccu

SEQ ID NO: 3068228 - RNA, 17 nt, Human
agugcagugagccgaga

SEQ ID NO: 3068229 - RNA, 14 nt, Human
agugcacuaaugug

SEQ ID NO: 3068230 - RNA, 17 nt, Human
agugcacuaauguguaa

SEQ ID NO: 3068231 - RNA, 21 nt, Human
agugcacuaauguguaagaca

SEQ ID NO: 3068232 - RNA, 12 nt, Human
agugaggcucug

SEQ ID NO: 3068233 - RNA, 13 nt, Human
agugaggcucugc

SEQ ID NO: 3068234 - RNA, 16 nt, Human
agugaggaugaaaaaa

SEQ ID NO: 3068235 - RNA, 22 nt, Human
agugcaaauugucacaggacag

SEQ ID NO: 3068236 - RNA, 19 nt, Human
aggaguuucguuuucaaaa

SEQ ID NO: 3068237 - RNA, 21 nt, Human
aggaguuugagaccaaccugg

SEQ ID NO: 3068238 - RNA, 14 nt, Human
uggaagugcuaauu

SEQ ID NO: 3068239 - RNA, 15 nt, Human
aggaggccagccuug

SEQ ID NO: 3068240 - RNA, 21 nt, Human
uggaacaagaugguucuagca

SEQ ID NO: 3068241 - RNA, 10 nt, Human
ugcugcccug

SEQ ID NO: 3068242 - RNA, 22 nt, Human
ugcugccccugcacagcaggcu

SEQ ID NO: 3068243 - RNA, 21 nt, Human
ugcugccccugcacagcaggc

SEQ ID NO: 3068244 - RNA, 20 nt, Human
ugcugccccugcacagcagg

SEQ ID NO: 3068245 - RNA, 12 nt, Human
uggaacacucug

SEQ ID NO: 3068246 - RNA, 13 nt, Human
uggaagcuccgcu

SEQ ID NO: 3068247 - RNA, 20 nt, Human
uggaaguacuauaauuuacc

SEQ ID NO: 3068248 - RNA, 18 nt, Human
uggaaguacuauaauuua

SEQ ID NO: 3068249 - RNA, 14 nt, Human
uggaauuugaaaca

SEQ ID NO: 3068250 - RNA, 22 nt, Human
uggaauuucucccagucauuua

SEQ ID NO: 3068251 - RNA, 19 nt, Human
aggcaacugcauuggcuuu

SEQ ID NO: 3068252 - RNA, 14 nt, Human
aggcaagcaccucc

SEQ ID NO: 3068253 - RNA, 15 nt, Human
uggacaccggaaaca

SEQ ID NO: 3068254 - RNA, 14 nt, Human
uggacaaaauggaa

SEQ ID NO: 3068255 - RNA, 17 nt, Human
uggacaaaauggaauac

SEQ ID NO: 3068256 - RNA, 16 nt, Human
aggaugcuuguacaua

SEQ ID NO: 3068257 - RNA, 15 nt, Human
aggaugcuuguacau

SEQ ID NO: 3068258 - RNA, 21 nt, Human
aggauccugagccagauuuca

SEQ ID NO: 3068259 - RNA, 12 nt, Human
aggaucagucug

SEQ ID NO: 3068260 - RNA, 18 nt, Human
aggaugcuuguacauaau

SEQ ID NO: 3068261 - RNA, 22 nt, Human
aggauugcuacuguccuaccca

SEQ ID NO: 3068262 - RNA, 21 nt, Human
uggagcucgugggacagucac

SEQ ID NO: 3068263 - RNA, 16 nt, Human
aggcaaugcuggcugu

SEQ ID NO: 3068264 - RNA, 15 nt, Human
aggcaaugcuggcug

SEQ ID NO: 3068265 - RNA, 23 nt, Human
uggagcccacuguacuugcucuu

SEQ ID NO: 3068266 - RNA, 19 nt, Human
uggagcccacuguacuugc

SEQ ID NO: 3068267 - RNA, 16 nt, Human
uggagcccacuguacu

SEQ ID NO: 3068268 - RNA, 24 nt, Human
uggacuuuguuaguuucuccaagc

SEQ ID NO: 3068269 - RNA, 14 nt, Human
uggagaagaacuga

SEQ ID NO: 3068270 - RNA, 16 nt, Human
uggagaagaacugaaa

SEQ ID NO: 3068271 - RNA, 11 nt, Human
uggacuuuguu

SEQ ID NO: 3068272 - RNA, 22 nt, Human
uggacuuuguuaguuucuccaa

SEQ ID NO: 3068273 - RNA, 20 nt, Human
aggcaggaguuucguuuuca

SEQ ID NO: 3068274 - RNA, 12 nt, Human
aggcaggauggc

SEQ ID NO: 3068275 - RNA, 21 nt, Human
aggcagccccauucugccugc

SEQ ID NO: 3068276 - RNA, 20 nt, Human
aggcagccccauucugccug

SEQ ID NO: 3068277 - RNA, 19 nt, Human
aggcagccccauucugccu

SEQ ID NO: 3068278 - RNA, 22 nt, Human
aggcagccccauucugccugcc

SEQ ID NO: 3068279 - RNA, 21 nt, Human
aggcaggucuugaacuccugg

SEQ ID NO: 3068280 - RNA, 14 nt, Human
aggcagguccaggg

SEQ ID NO: 3068281 - RNA, 22 nt, Human
aggcagggucucacucugucgc

SEQ ID NO: 3068282 - RNA, 21 nt, Human
aggcagggucucacucugucg

SEQ ID NO: 3068283 - RNA, 20 nt, Human
aggcagggucucacucuguc

SEQ ID NO: 3068284 - RNA, 18 nt, Human
aggcagggucucacucug

SEQ ID NO: 3068285 - RNA, 19 nt, Human
aggcagggucucacucugu

SEQ ID NO: 3068286 - RNA, 12 nt, Human
aggccuggccag

SEQ ID NO: 3068287 - RNA, 13 nt, Human
aggccuggccaga

SEQ ID NO: 3068288 - RNA, 16 nt, Human
aggcccggcuccaggc

SEQ ID NO: 3068289 - RNA, 15 nt, Human
aggcccggcuccagg

SEQ ID NO: 3068290 - RNA, 14 nt, Human
aggcccggcuccag

SEQ ID NO: 3068291 - RNA, 21 nt, Human
aggccccugccacccugggga

SEQ ID NO: 3068292 - RNA, 12 nt, Human
aggccccugcca

SEQ ID NO: 3068293 - RNA, 18 nt, Human
aggccccugccacccugg

SEQ ID NO: 3068294 - RNA, 17 nt, Human
aggccccugccacccug

SEQ ID NO: 3068295 - RNA, 19 nt, Human
aggcccagagggccugcaa

SEQ ID NO: 3068296 - RNA, 20 nt, Human
aggcccagagggccugcaag

SEQ ID NO: 3068297 - RNA, 15 nt, Human
aggccccugccaccc

SEQ ID NO: 3068298 - RNA, 13 nt, Human
aggccccugccac

SEQ ID NO: 3068299 - RNA, 16 nt, Human
uggcaccagcagccug

SEQ ID NO: 3068300 - RNA, 17 nt, Human
uggcaccagcagccugg

SEQ ID NO: 3068301 - RNA, 15 nt, Human
aggcccagagggccu

SEQ ID NO: 3068302 - RNA, 16 nt, Human
aggcccagagggccug

SEQ ID NO: 3068303 - RNA, 13 nt, Human
uggcagcucagag

SEQ ID NO: 3068304 - RNA, 23 nt, Human
aggccagagacacaagccuucgg

SEQ ID NO: 3068305 - RNA, 18 nt, Human
aggccaugggccuccugu

SEQ ID NO: 3068306 - RNA, 17 nt, Human
aggccaugggccuccug

SEQ ID NO: 3068307 - RNA, 12 nt, Human
aggccagagaca

SEQ ID NO: 3068308 - RNA, 16 nt, Human
uggcagcucagagagg

SEQ ID NO: 3068309 - RNA, 13 nt, Human
aggccagagacac

SEQ ID NO: 3068310 - RNA, 18 nt, Human
aggccagagacacaagcc

SEQ ID NO: 3068311 - RNA, 14 nt, Human
uggcagcucagaga

SEQ ID NO: 3068312 - RNA, 15 nt, Human
uggcagcucagagag

SEQ ID NO: 3068313 - RNA, 14 nt, Human
aggcuccaggagca

SEQ ID NO: 3068314 - RNA, 16 nt, Human
aggcuccaggagcagc

SEQ ID NO: 3068315 - RNA, 13 nt, Human
aggcuccaggagc

SEQ ID NO: 3068316 - RNA, 11 nt, Human
aggcuccacuu

SEQ ID NO: 3068317 - RNA, 17 nt, Human
aggcuccacuuggucug

SEQ ID NO: 3068318 - RNA, 21 nt, Human
aggcuccacuuggucugugag

SEQ ID NO: 3068319 - RNA, 22 nt, Human
aggcuccacuuggucugugaga

SEQ ID NO: 3068320 - RNA, 18 nt, Human
aggccuucucugaaggac

SEQ ID NO: 3068321 - RNA, 17 nt, Human
aggccuucucugaagga

SEQ ID NO: 3068322 - RNA, 19 nt, Human
uggccucugcacuccccug

SEQ ID NO: 3068323 - RNA, 18 nt, Human
uggccucugcacuccccu

SEQ ID NO: 3068324 - RNA, 20 nt, Human
uggccucugcacuccccugc

SEQ ID NO: 3068325 - RNA, 18 nt, Human
uggccugagcugggauga

SEQ ID NO: 3068326 - RNA, 13 nt, Human
uggcccacugcau

SEQ ID NO: 3068327 - RNA, 14 nt, Human
uggcccacugcauc

SEQ ID NO: 3068328 - RNA, 13 nt, Human
uggcccacgcacu

SEQ ID NO: 3068329 - RNA, 19 nt, Human
uggcccacgcacuucggga

SEQ ID NO: 3068330 - RNA, 22 nt, Human
uggcaugggaaugaaugucagu

SEQ ID NO: 3068331 - RNA, 15 nt, Human
ugggagaaaugaaaa

SEQ ID NO: 3068332 - RNA, 16 nt, Human
ugggacuacaggugug

SEQ ID NO: 3068333 - RNA, 18 nt, Human
ugggacuacaggcaccca

SEQ ID NO: 3068334 - RNA, 20 nt, Human
agggacuuggaagcuccgcu

SEQ ID NO: 3068335 - RNA, 14 nt, Human
agggagagaagaua

SEQ ID NO: 3068336 - RNA, 13 nt, Human
agggagagaagau

SEQ ID NO: 3068337 - RNA, 15 nt, Human
agggacuuggaagcu

SEQ ID NO: 3068338 - RNA, 23 nt, Human
agggacuucugucuucacaacag

SEQ ID NO: 3068339 - RNA, 19 nt, Human
agggacuuggaagcuccgc

SEQ ID NO: 3068340 - RNA, 18 nt, Human
agggacuuggaagcuccg

SEQ ID NO: 3068341 - RNA, 16 nt, Human
ugggauuuggucaaca

SEQ ID NO: 3068342 - RNA, 21 nt, Human
ugggcaacccccagccugcua

SEQ ID NO: 3068343 - RNA, 14 nt, Human
ugggcauucaaaug

SEQ ID NO: 3068344 - RNA, 13 nt, Human
ugggcauucaaau

SEQ ID NO: 3068345 - RNA, 16 nt, Human
ugggcagaaggaagac

SEQ ID NO: 3068346 - RNA, 20 nt, Human
ugggcagaaggaagacuuca

SEQ ID NO: 3068347 - RNA, 13 nt, Human
ugggcagaaggaa

SEQ ID NO: 3068348 - RNA, 23 nt, Human
ugggaggcucuggagcccacugu

SEQ ID NO: 3068349 - RNA, 17 nt, Human
ugggaggcucuggagcc

SEQ ID NO: 3068350 - RNA, 14 nt, Human
ugggaggcucugga

SEQ ID NO: 3068351 - RNA, 19 nt, Human
ugggaggcugagaugggag

SEQ ID NO: 3068352 - RNA, 16 nt, Human
ugggagaaaugaaaaa

SEQ ID NO: 3068353 - RNA, 21 nt, Human
ugggagaaccaaaaagaggcu

SEQ ID NO: 3068354 - RNA, 22 nt, Human
ugggaggaucucuugagccugg

SEQ ID NO: 3068355 - RNA, 22 nt, Human
ugggaggauugcuugagcucag

SEQ ID NO: 3068356 - RNA, 18 nt, Human
ugggaggauugcuugagc

SEQ ID NO: 3068357 - RNA, 21 nt, Human
ugggaggauugcuugagcuca

SEQ ID NO: 3068358 - RNA, 14 nt, Human
ugggcucccuuccc

SEQ ID NO: 3068359 - RNA, 21 nt, Human
ugggcucccuucccaccucuc

SEQ ID NO: 3068360 - RNA, 22 nt, Human
agggcuguuauaaucuuucaca

SEQ ID NO: 3068361 - RNA, 20 nt, Human
agggcuccagacacaugucc

SEQ ID NO: 3068362 - RNA, 15 nt, Human
agggcuccagacaca

SEQ ID NO: 3068363 - RNA, 14 nt, Human
agggcccagagagg

SEQ ID NO: 3068364 - RNA, 17 nt, Human
agggagggcuccagaca

SEQ ID NO: 3068365 - RNA, 19 nt, Human
agggagggcuccagacaca

SEQ ID NO: 3068366 - RNA, 12 nt, Human
agggagggcucc

SEQ ID NO: 3068367 - RNA, 17 nt, Human
agggagggagggcucca

SEQ ID NO: 3068368 - RNA, 22 nt, Human
agggagggcuccagacacaugu

SEQ ID NO: 3068369 - RNA, 20 nt, Human
agggaguccgaaagggacuu

SEQ ID NO: 3068370 - RNA, 20 nt, Human
agggagugaguugauagcac

SEQ ID NO: 3068371 - RNA, 20 nt, Human
agggagugacagaggcagcc

SEQ ID NO: 3068372 - RNA, 23 nt, Human
agggaguccgaaagggacuugga

SEQ ID NO: 3068373 - RNA, 13 nt, Human
agggcccagagag

SEQ ID NO: 3068374 - RNA, 12 nt, Human
agggcccagaga

SEQ ID NO: 3068375 - RNA, 21 nt, Human
aggcuuuuuuaucaugugaaa

SEQ ID NO: 3068376 - RNA, 18 nt, Human
aggcuuuuuuaucaugug

SEQ ID NO: 3068377 - RNA, 15 nt, Human
aggcuuuuuuaucau

SEQ ID NO: 3068378 - RNA, 15 nt, Human
agggaaacugccagc

SEQ ID NO: 3068379 - RNA, 14 nt, Human
agggaaacugccag

SEQ ID NO: 3068380 - RNA, 23 nt, Human
agggaaacugccagcaacgcagg

SEQ ID NO: 3068381 - RNA, 21 nt, Human
agggaaacugccagcaacgca

SEQ ID NO: 3068382 - RNA, 19 nt, Human
agggaaacugccagcaacg

SEQ ID NO: 3068383 - RNA, 16 nt, Human
agggaaacugccagca

SEQ ID NO: 3068384 - RNA, 21 nt, Human
aggcuuagucacugagacagc

SEQ ID NO: 3068385 - RNA, 22 nt, Human
aggcuuagucacugagacagcc

SEQ ID NO: 3068386 - RNA, 23 nt, Human
aggcuuagucacugagacagccc

SEQ ID NO: 3068387 - RNA, 21 nt, Human
aggcugggucgcccuggacug

SEQ ID NO: 3068388 - RNA, 20 nt, Human
aggcugggucgcccuggacu

SEQ ID NO: 3068389 - RNA, 14 nt, Human
aggcuggguucuga

SEQ ID NO: 3068390 - RNA, 17 nt, Human
aggcuggguucugaucc

SEQ ID NO: 3068391 - RNA, 18 nt, Human
aggcugggucgcccugga

SEQ ID NO: 3068392 - RNA, 15 nt, Human
aggcugggucgcccu

SEQ ID NO: 3068393 - RNA, 10 nt, Human
aggcuggguc

SEQ ID NO: 3068394 - RNA, 22 nt, Human
aggcugggggaagaagcucucu

SEQ ID NO: 3068395 - RNA, 21 nt, Human
aggcugggcuucaguggcagc

SEQ ID NO: 3068396 - RNA, 20 nt, Human
aggcugggcuucaguggcag

SEQ ID NO: 3068397 - RNA, 19 nt, Human
aggcugggcuucaguggca

SEQ ID NO: 3068398 - RNA, 18 nt, Human
aggcugggcuucaguggc

SEQ ID NO: 3068399 - RNA, 23 nt, Human
aggcugggcuucaguggcagcug

SEQ ID NO: 3068400 - RNA, 22 nt, Human
aggcugggcuucaguggcagcu

SEQ ID NO: 3068401 - RNA, 17 nt, Human
aggcugggggaagaagc

SEQ ID NO: 3068402 - RNA, 19 nt, Human
aggcugggagagccuucca

SEQ ID NO: 3068403 - RNA, 16 nt, Human
aggcugggagagccuu

SEQ ID NO: 3068404 - RNA, 20 nt, Human
ugggaacccaaguccaagca

SEQ ID NO: 3068405 - RNA, 20 nt, Human
aggcugggagagccuuccag

SEQ ID NO: 3068406 - RNA, 21 nt, Human
aggcugggagagccuuccagg

SEQ ID NO: 3068407 - RNA, 22 nt, Human
aggcugggagagccuuccaggg

SEQ ID NO: 3068408 - RNA, 21 nt, Human
aggcugggcucccuucccacc

SEQ ID NO: 3068409 - RNA, 23 nt, Human
aggcugggcucccuucccaccuc

SEQ ID NO: 3068410 - RNA, 14 nt, Human
aggcugggcuucag

SEQ ID NO: 3068411 - RNA, 14 nt, Human
aggcugggcucccu

SEQ ID NO: 3068412 - RNA, 18 nt, Human
aggcugggcucccuuccc

SEQ ID NO: 3068413 - RNA, 13 nt, Human
aggcugggcuccc

SEQ ID NO: 3068414 - RNA, 18 nt, Human
ugggaaacaaaaggauaa

SEQ ID NO: 3068415 - RNA, 21 nt, Human
uggcuuuugugcauuaucuag

SEQ ID NO: 3068416 - RNA, 17 nt, Human
uggcuucacggaagagc

SEQ ID NO: 3068417 - RNA, 20 nt, Human
uggcuucacggaagagccuu

SEQ ID NO: 3068418 - RNA, 16 nt, Human
uggcuuuugugcauua

SEQ ID NO: 3068419 - RNA, 15 nt, Human
uggcuuuugugcauu

SEQ ID NO: 3068420 - RNA, 16 nt, Human
ugggaaagcauuguaa

SEQ ID NO: 3068421 - RNA, 14 nt, Human
ugggaaagcauugu

SEQ ID NO: 3068422 - RNA, 18 nt, Human
ugggaaagcauuguaaau

SEQ ID NO: 3068423 - RNA, 17 nt, Human
ugggaaagcauuguaaa

SEQ ID NO: 3068424 - RNA, 23 nt, Human
uggcugcaaaggguaucaggugc

SEQ ID NO: 3068425 - RNA, 18 nt, Human
uggcuguuggcugggggc

SEQ ID NO: 3068426 - RNA, 16 nt, Human
uggcuguuggcugggg

SEQ ID NO: 3068427 - RNA, 14 nt, Human
uggcuucacggaag

SEQ ID NO: 3068428 - RNA, 23 nt, Human
uggcuguuggcugggggccucag

SEQ ID NO: 3068429 - RNA, 13 nt, Human
uggcucacgccug

SEQ ID NO: 3068430 - RNA, 13 nt, Human
uggcucacccagu

SEQ ID NO: 3068431 - RNA, 16 nt, Human
uggcucacccaguccu

SEQ ID NO: 3068432 - RNA, 23 nt, Human
uggcuauaggugcuacaaaaaca

SEQ ID NO: 3068433 - RNA, 17 nt, Human
aggcuccaggagcagcc

SEQ ID NO: 3068434 - RNA, 18 nt, Human
aggcuccaggagcagcca

SEQ ID NO: 3068435 - RNA, 19 nt, Human
aggcuccaggagcagccac

SEQ ID NO: 3068436 - RNA, 23 nt, Human
aggcuccaggagcagccacauuc

SEQ ID NO: 3068437 - RNA, 14 nt, Human
uggcuaaauucaug

SEQ ID NO: 3068438 - RNA, 18 nt, Human
uggcuaagcaaaauguga

SEQ ID NO: 3068439 - RNA, 19 nt, Human
uggcuaauguacugcauau

SEQ ID NO: 3068440 - RNA, 17 nt, Human
uggcuaauguacugcau

SEQ ID NO: 3068441 - RNA, 19 nt, Human
uggcuauaggugcuacaaa

SEQ ID NO: 3068442 - RNA, 15 nt, Human
uggcuauaggugcua

SEQ ID NO: 3068443 - RNA, 23 nt, Human
ugcauuugaaaauuuugauguuu

SEQ ID NO: 3068444 - RNA, 19 nt, Human
ugcauuugaaaauuuugau

SEQ ID NO: 3068445 - RNA, 22 nt, Human
agcgcccaguuggguggaugcc

SEQ ID NO: 3068446 - RNA, 14 nt, Human
agcgcccaguuggg

SEQ ID NO: 3068447 - RNA, 19 nt, Human
agcuacuaauuuuaaaaug

SEQ ID NO: 3068448 - RNA, 23 nt, Human
agcgugguggacaugcacagcua

SEQ ID NO: 3068449 - RNA, 20 nt, Human
agcgugguggacaugcacag

SEQ ID NO: 3068450 - RNA, 17 nt, Human
agcgugagccacugcac

SEQ ID NO: 3068451 - RNA, 16 nt, Human
agcgugagccacugca

SEQ ID NO: 3068452 - RNA, 21 nt, Human
ugccauauucuguuggccagu

SEQ ID NO: 3068453 - RNA, 20 nt, Human
ugccauauucuguuggccag

SEQ ID NO: 3068454 - RNA, 15 nt, Human
agcggggacagcucc

SEQ ID NO: 3068455 - RNA, 17 nt, Human
agcggggacagcuccuu

SEQ ID NO: 3068456 - RNA, 16 nt, Human
agcggggacagcuccu

SEQ ID NO: 3068457 - RNA, 15 nt, Human
agcgugagccacugc

SEQ ID NO: 3068458 - RNA, 13 nt, Human
agcgugagccacu

SEQ ID NO: 3068459 - RNA, 15 nt, Human
ugccagucaccccgg

SEQ ID NO: 3068460 - RNA, 16 nt, Human
ugccagucaccccggc

SEQ ID NO: 3068461 - RNA, 18 nt, Human
ugccagucaccccggcca

SEQ ID NO: 3068462 - RNA, 20 nt, Human
ugccagucaccccggccacc

SEQ ID NO: 3068463 - RNA, 15 nt, Human
ugccauauucuguug

SEQ ID NO: 3068464 - RNA, 17 nt, Human
ugccauauucuguuggc

SEQ ID NO: 3068465 - RNA, 16 nt, Human
ugccauauucuguugg

SEQ ID NO: 3068466 - RNA, 22 nt, Human
ugccagucaccccggccaccug

SEQ ID NO: 3068467 - RNA, 23 nt, Human
ugccagucaccccggccaccugc

SEQ ID NO: 3068468 - RNA, 15 nt, Human
ugcccaggcaggucu

SEQ ID NO: 3068469 - RNA, 14 nt, Human
ugcccacaggauca

SEQ ID NO: 3068470 - RNA, 11 nt, Human
ugcccaggccc

SEQ ID NO: 3068471 - RNA, 20 nt, Human
ugcccaggcaggucuugaac

SEQ ID NO: 3068472 - RNA, 17 nt, Human
ugcccaggcaggucuug

SEQ ID NO: 3068473 - RNA, 16 nt, Human
ugcccaggcaggucuu

SEQ ID NO: 3068474 - RNA, 22 nt, Human
ugcccaggccccugccacccug

SEQ ID NO: 3068475 - RNA, 20 nt, Human
ugcccaggccccugccaccc

SEQ ID NO: 3068476 - RNA, 12 nt, Human
ugcccaggcccc

SEQ ID NO: 3068477 - RNA, 13 nt, Human
ugcccccugugga

SEQ ID NO: 3068478 - RNA, 19 nt, Human
ugcccccuguggaugcugc

SEQ ID NO: 3068479 - RNA, 21 nt, Human
ugcccccuguggaugcugcug

SEQ ID NO: 3068480 - RNA, 14 nt, Human
agcucagggccugg

SEQ ID NO: 3068481 - RNA, 15 nt, Human
agcucagggccuggc

SEQ ID NO: 3068482 - RNA, 16 nt, Human
agcucagggccuggcu

SEQ ID NO: 3068483 - RNA, 19 nt, Human
ugccauguuggccaggcug

SEQ ID NO: 3068484 - RNA, 18 nt, Human
ugccauguuggccaggcu

SEQ ID NO: 3068485 - RNA, 17 nt, Human
agcucagggccuggcuc

SEQ ID NO: 3068486 - RNA, 17 nt, Human
ugccauguuggccaggc

SEQ ID NO: 3068487 - RNA, 20 nt, Human
ugccauguuggccaggcugg

SEQ ID NO: 3068488 - RNA, 21 nt, Human
ugccauguuggccaggcuggu

SEQ ID NO: 3068489 - RNA, 12 nt, Human
agcuacugccau

SEQ ID NO: 3068490 - RNA, 13 nt, Human
agcuacugccauc

SEQ ID NO: 3068491 - RNA, 14 nt, Human
agcuacugccaucc

SEQ ID NO: 3068492 - RNA, 16 nt, Human
agcuacugccauccug

SEQ ID NO: 3068493 - RNA, 18 nt, Human
agcuacugccauccuggc

SEQ ID NO: 3068494 - RNA, 22 nt, Human
agcuacugccauccuggcccag

SEQ ID NO: 3068495 - RNA, 16 nt, Human
agccugccucuucucu

SEQ ID NO: 3068496 - RNA, 19 nt, Human
agccugccucuucucuacu

SEQ ID NO: 3068497 - RNA, 23 nt, Human
agccugcaguuauuaacacuaac

SEQ ID NO: 3068498 - RNA, 21 nt, Human
agccugcaauuucauaugcug

SEQ ID NO: 3068499 - RNA, 19 nt, Human
agccugcaauuucauaugc

SEQ ID NO: 3068500 - RNA, 16 nt, Human
ugcaugcugucccuua

SEQ ID NO: 3068501 - RNA, 22 nt, Human
ugcauaccacuuuuguucuugg

SEQ ID NO: 3068502 - RNA, 21 nt, Human
ugcauaccacuuuuguucuug

SEQ ID NO: 3068503 - RNA, 20 nt, Human
ugcaugaaguaauaugcaca

SEQ ID NO: 3068504 - RNA, 22 nt, Human
ugcaugaaguaauaugcacaca

SEQ ID NO: 3068505 - RNA, 21 nt, Human
ugcaugaggcuaguguggugu

SEQ ID NO: 3068506 - RNA, 14 nt, Human
ugcaugcugucccu

SEQ ID NO: 3068507 - RNA, 15 nt, Human
ugcaugcugucccuu

SEQ ID NO: 3068508 - RNA, 13 nt, Human
ugcaugcuguccc

SEQ ID NO: 3068509 - RNA, 15 nt, Human
ugcauaauggucaga

SEQ ID NO: 3068510 - RNA, 20 nt, Human
ugcaggucccuaauaaagcu

SEQ ID NO: 3068511 - RNA, 19 nt, Human
ugcaggucccuaauaaagc

SEQ ID NO: 3068512 - RNA, 18 nt, Human
ugcaggucccuaauaaag

SEQ ID NO: 3068513 - RNA, 17 nt, Human
ugcaggucccuaauaaa

SEQ ID NO: 3068514 - RNA, 14 nt, Human
ugcagugagccgag

SEQ ID NO: 3068515 - RNA, 15 nt, Human
agccucagcauccug

SEQ ID NO: 3068516 - RNA, 18 nt, Human
agccugagcgacagugag

SEQ ID NO: 3068517 - RNA, 14 nt, Human
agccucagcauccu

SEQ ID NO: 3068518 - RNA, 13 nt, Human
agccucagcaucc

SEQ ID NO: 3068519 - RNA, 18 nt, Human
agccucaaccuccugggc

SEQ ID NO: 3068520 - RNA, 17 nt, Human
agccucaaccuccuggg

SEQ ID NO: 3068521 - RNA, 19 nt, Human
ugcagccucaaccuccugg

SEQ ID NO: 3068522 - RNA, 18 nt, Human
ugcagccucaaccuccug

SEQ ID NO: 3068523 - RNA, 19 nt, Human
ugcacguacacacacauac

SEQ ID NO: 3068524 - RNA, 14 nt, Human
ugcaccacugcacu

SEQ ID NO: 3068525 - RNA, 12 nt, Human
ugcacuccccug

SEQ ID NO: 3068526 - RNA, 13 nt, Human
ugcacuccccugc

SEQ ID NO: 3068527 - RNA, 18 nt, Human
ugcacaagcuccaagcuc

SEQ ID NO: 3068528 - RNA, 20 nt, Human
ugcacaagcuccaagcuccc

SEQ ID NO: 3068529 - RNA, 22 nt, Human
ugcacaagcuccaagcucccag

SEQ ID NO: 3068530 - RNA, 23 nt, Human
ugcacaagcuccaagcucccagg

SEQ ID NO: 3068531 - RNA, 15 nt, Human
ugcacaagcuccaag

SEQ ID NO: 3068532 - RNA, 16 nt, Human
ugcacaagcuccaagc

SEQ ID NO: 3068533 - RNA, 15 nt, Human
ugcacacaccagagc

SEQ ID NO: 3068534 - RNA, 22 nt, Human
ugcagacucuacagaggccaug

SEQ ID NO: 3068535 - RNA, 17 nt, Human
agcccuucuuuccacag

SEQ ID NO: 3068536 - RNA, 15 nt, Human
ugcacuccccugcug

SEQ ID NO: 3068537 - RNA, 20 nt, Human
ugcacuuuguucuggcucuu

SEQ ID NO: 3068538 - RNA, 18 nt, Human
ugcagacucuacagaggc

SEQ ID NO: 3068539 - RNA, 20 nt, Human
ugcagacucuacagaggcca

SEQ ID NO: 3068540 - RNA, 19 nt, Human
ugcagacucuacagaggcc

SEQ ID NO: 3068541 - RNA, 17 nt, Human
agccuaggugacagagu

SEQ ID NO: 3068542 - RNA, 15 nt, Human
agccuaggugacaga

SEQ ID NO: 3068543 - RNA, 15 nt, Human
agccucaaccuccug

SEQ ID NO: 3068544 - RNA, 18 nt, Human
agcccuucuuuccacaga

SEQ ID NO: 3068545 - RNA, 19 nt, Human
agcccuucuuuccacagaa

SEQ ID NO: 3068546 - RNA, 22 nt, Human
aggaauuuuauuuuuuucugaa

SEQ ID NO: 3068547 - RNA, 11 nt, Human
ugcugccaucc

SEQ ID NO: 3068548 - RNA, 15 nt, Human
ugcugccauccaggu

SEQ ID NO: 3068549 - RNA, 14 nt, Human
ugcugccauccagg

SEQ ID NO: 3068550 - RNA, 13 nt, Human
ugcugccauccag

SEQ ID NO: 3068551 - RNA, 12 nt, Human
ugcugccaucca

SEQ ID NO: 3068552 - RNA, 22 nt, Human
ugcugccauccagguucagcuu

SEQ ID NO: 3068553 - RNA, 21 nt, Human
ugcugccauccagguucagcu

SEQ ID NO: 3068554 - RNA, 20 nt, Human
aggaauuuuauuuuuuucug

SEQ ID NO: 3068555 - RNA, 19 nt, Human
aggaauugacccacaagaa

SEQ ID NO: 3068556 - RNA, 16 nt, Human
aggaagcucagggccu

SEQ ID NO: 3068557 - RNA, 20 nt, Human
aggaauccagacccggcugc

SEQ ID NO: 3068558 - RNA, 23 nt, Human
aggaauccagacccggcugcgug

SEQ ID NO: 3068559 - RNA, 15 nt, Human
aggaagacuuuggaa

SEQ ID NO: 3068560 - RNA, 14 nt, Human
aggaagagaaaaaa

SEQ ID NO: 3068561 - RNA, 18 nt, Human
aggaagcucagggccugg

SEQ ID NO: 3068562 - RNA, 22 nt, Human
aggaagcucagggccuggcuca

SEQ ID NO: 3068563 - RNA, 17 nt, Human
aggaagcucagggccug

SEQ ID NO: 3068564 - RNA, 17 nt, Human
ugcugacuguuuucucu

SEQ ID NO: 3068565 - RNA, 18 nt, Human
ugcucugcauguuacaua

SEQ ID NO: 3068566 - RNA, 15 nt, Human
ugcucugcauguuac

SEQ ID NO: 3068567 - RNA, 17 nt, Human
ugcucuggacaggcaug

SEQ ID NO: 3068568 - RNA, 22 nt, Human
ugcucugaucauccacugugcc

SEQ ID NO: 3068569 - RNA, 19 nt, Human
ugcucugaucauccacugu

SEQ ID NO: 3068570 - RNA, 22 nt, Human
aggaaaggcuccaggagcagcc

SEQ ID NO: 3068571 - RNA, 13 nt, Human
aggaaauauuuau

SEQ ID NO: 3068572 - RNA, 14 nt, Human
aggaaauauuuauu

SEQ ID NO: 3068573 - RNA, 18 nt, Human
aggaaauauuuauuuuaa

SEQ ID NO: 3068574 - RNA, 16 nt, Human
aggaaaggcuccagga

SEQ ID NO: 3068575 - RNA, 18 nt, Human
aggaaaggcuccaggagc

SEQ ID NO: 3068576 - RNA, 20 nt, Human
aggaaaggcuccaggagcag

SEQ ID NO: 3068577 - RNA, 21 nt, Human
ugcugacuguuuucucuugag

SEQ ID NO: 3068578 - RNA, 24 nt, Human
ugcugacuguuuucucuugagagg

SEQ ID NO: 3068579 - RNA, 16 nt, Human
ugcugacuguuuucuc

SEQ ID NO: 3068580 - RNA, 19 nt, Human
aggaaagcaaaggagauug

SEQ ID NO: 3068581 - RNA, 23 nt, Human
aggaaaccaguuaggucucaaua

SEQ ID NO: 3068582 - RNA, 21 nt, Human
aggaaacccagcucuggucca

SEQ ID NO: 3068583 - RNA, 18 nt, Human
aggaaacccagcucuggu

SEQ ID NO: 3068584 - RNA, 20 nt, Human
aggaaacccagcucuggucc

SEQ ID NO: 3068585 - RNA, 16 nt, Human
aggaaacccagcucug

SEQ ID NO: 3068586 - RNA, 17 nt, Human
aggaaacccagcucugg

SEQ ID NO: 3068587 - RNA, 15 nt, Human
aggaaacccagcucu

SEQ ID NO: 3068588 - RNA, 12 nt, Human
agcuuugaaaau

SEQ ID NO: 3068589 - RNA, 16 nt, Human
agcuuugaaaauucag

SEQ ID NO: 3068590 - RNA, 18 nt, Human
agcuuugaaaauucagug

SEQ ID NO: 3068591 - RNA, 19 nt, Human
agcuuugaaaauucagugg

SEQ ID NO: 3068592 - RNA, 16 nt, Human
aggaaagaggcucugg

SEQ ID NO: 3068593 - RNA, 17 nt, Human
aggaaagcaaaggagau

SEQ ID NO: 3068594 - RNA, 14 nt, Human
ugcuaguaauugga

SEQ ID NO: 3068595 - RNA, 16 nt, Human
ugcuaguaauuggaaa

SEQ ID NO: 3068596 - RNA, 12 nt, Human
aggaaagaggcu

SEQ ID NO: 3068597 - RNA, 13 nt, Human
aggaaagaggcuc

SEQ ID NO: 3068598 - RNA, 13 nt, Human
aggaaagagaacu

SEQ ID NO: 3068599 - RNA, 19 nt, Human
aggaaagagaacuuccaga

SEQ ID NO: 3068600 - RNA, 21 nt, Human
agcuuguaaauagcucaggug

SEQ ID NO: 3068601 - RNA, 20 nt, Human
agcuuguaaauagcucaggu

SEQ ID NO: 3068602 - RNA, 19 nt, Human
agcuuguaaauagcucagg

SEQ ID NO: 3068603 - RNA, 18 nt, Human
agcuuguaaauagcucag

SEQ ID NO: 3068604 - RNA, 21 nt, Human
agcuuauugucuagugaaacu

SEQ ID NO: 3068605 - RNA, 15 nt, Human
agcuuauuaaaacuc

SEQ ID NO: 3068606 - RNA, 20 nt, Human
agcuuauuaaaacucauuuu

SEQ ID NO: 3068607 - RNA, 20 nt, Human
ugcggacagccacggccagg

SEQ ID NO: 3068608 - RNA, 12 nt, Human
agcuuaucucag

SEQ ID NO: 3068609 - RNA, 14 nt, Human
agcuuaucucaggg

SEQ ID NO: 3068610 - RNA, 15 nt, Human
agcuuaucucagggg

SEQ ID NO: 3068611 - RNA, 20 nt, Human
ugccucucugcaggucccua

SEQ ID NO: 3068612 - RNA, 19 nt, Human
ugccucucugcaggucccu

SEQ ID NO: 3068613 - RNA, 21 nt, Human
ugccucugacacacagcucug

SEQ ID NO: 3068614 - RNA, 20 nt, Human
ugccucugacacacagcucu

SEQ ID NO: 3068615 - RNA, 18 nt, Human
ugccucucugcagguccc

SEQ ID NO: 3068616 - RNA, 16 nt, Human
ugccucucugcagguc

SEQ ID NO: 3068617 - RNA, 15 nt, Human
ugccucucucaggcc

SEQ ID NO: 3068618 - RNA, 13 nt, Human
ugccucccaucac

SEQ ID NO: 3068619 - RNA, 14 nt, Human
ugccucccaucacc

SEQ ID NO: 3068620 - RNA, 19 nt, Human
ugccucccaucacccgcua

SEQ ID NO: 3068621 - RNA, 13 nt, Human
ugccucucucagg

SEQ ID NO: 3068622 - RNA, 14 nt, Human
ugccucucucaggc

SEQ ID NO: 3068623 - RNA, 13 nt, Human
agcugccaccugc

SEQ ID NO: 3068624 - RNA, 18 nt, Human
agcugcauacaguuugca

SEQ ID NO: 3068625 - RNA, 19 nt, Human
ugcccuccaagaccuucuc

SEQ ID NO: 3068626 - RNA, 20 nt, Human
ugcccuccaagaccuucucc

SEQ ID NO: 3068627 - RNA, 22 nt, Human
ugcccuccaagaccuucuccuu

SEQ ID NO: 3068628 - RNA, 20 nt, Human
agcucugguccauagagagc

SEQ ID NO: 3068629 - RNA, 22 nt, Human
agcucugcuccucuccccagca

SEQ ID NO: 3068630 - RNA, 12 nt, Human
agcucugcuccu

SEQ ID NO: 3068631 - RNA, 12 nt, Human
agcucuguccug

SEQ ID NO: 3068632 - RNA, 17 nt, Human
agcucuucuccaggcug

SEQ ID NO: 3068633 - RNA, 18 nt, Human
agcucuucuccaggcugu

SEQ ID NO: 3068634 - RNA, 20 nt, Human
agcugaucgcuucuccccca

SEQ ID NO: 3068635 - RNA, 18 nt, Human
agcugcacccucaggcag

SEQ ID NO: 3068636 - RNA, 19 nt, Human
agcugcacccucaggcagg

SEQ ID NO: 3068637 - RNA, 20 nt, Human
agcugcacccucaggcaggu

SEQ ID NO: 3068638 - RNA, 22 nt, Human
agcugcacccucaggcaggugg

SEQ ID NO: 3068639 - RNA, 13 nt, Human
agcugcacccuca

SEQ ID NO: 3068640 - RNA, 17 nt, Human
agcugcacccucaggca

SEQ ID NO: 3068641 - RNA, 17 nt, Human
agcuggggccaggcugg

SEQ ID NO: 3068642 - RNA, 14 nt, Human
agcugggcagguug

SEQ ID NO: 3068643 - RNA, 19 nt, Human
agcugggacuacaggugug

SEQ ID NO: 3068644 - RNA, 17 nt, Human
agcugggacuacaggug

SEQ ID NO: 3068645 - RNA, 23 nt, Human
agcugggaugauuggagggggga

SEQ ID NO: 3068646 - RNA, 21 nt, Human
agcugccugggaucccucauc

SEQ ID NO: 3068647 - RNA, 13 nt, Human
agcugccugggau

SEQ ID NO: 3068648 - RNA, 19 nt, Human
agcugccugggaucccuca

SEQ ID NO: 3068649 - RNA, 13 nt, Human
agcuggaaaagua

SEQ ID NO: 3068650 - RNA, 22 nt, Human
ugccucugacacacagcucugu

SEQ ID NO: 3068651 - RNA, 20 nt, Human
agcuggggccaggcuggguc

SEQ ID NO: 3068652 - RNA, 16 nt, Human
ugccuguucagcucca

SEQ ID NO: 3068653 - RNA, 15 nt, Human
ugccuguucagcucc

SEQ ID NO: 3068654 - RNA, 17 nt, Human
ugcggacagccacggcc

SEQ ID NO: 3068655 - RNA, 18 nt, Human
ugcggacagccacggcca

SEQ ID NO: 3068656 - RNA, 19 nt, Human
ugcgaaaggaugaaaguga

SEQ ID NO: 3068657 - RNA, 13 nt, Human
ugcgaaaggauga

SEQ ID NO: 3068658 - RNA, 13 nt, Human
ugagcuacaaaug

SEQ ID NO: 3068659 - RNA, 14 nt, Human
ugagcuacaaaugc

SEQ ID NO: 3068660 - RNA, 14 nt, Human
ugagcuaggaauug

SEQ ID NO: 3068661 - RNA, 16 nt, Human
ugagcuacaaaugcau

SEQ ID NO: 3068662 - RNA, 19 nt, Human
ugaggaagccgcuggggcc

SEQ ID NO: 3068663 - RNA, 21 nt, Human
ugaggaagccgcuggggccag

SEQ ID NO: 3068664 - RNA, 22 nt, Human
ugaggaagcaaaagcaucuaug

SEQ ID NO: 3068665 - RNA, 14 nt, Human
ugaggaagccgcug

SEQ ID NO: 3068666 - RNA, 17 nt, Human
ugaggaagccgcugggg

SEQ ID NO: 3068667 - RNA, 18 nt, Human
ugaggaagccgcuggggc

SEQ ID NO: 3068668 - RNA, 15 nt, Human
ugaggaagcaaaagc

SEQ ID NO: 3068669 - RNA, 21 nt, Human
ugaggacacuaaccacgcugg

SEQ ID NO: 3068670 - RNA, 15 nt, Human
ugaggacacugauau

SEQ ID NO: 3068671 - RNA, 23 nt, Human
ugaggcauuuguuugaacugaua

SEQ ID NO: 3068672 - RNA, 12 nt, Human
ugaggccagaga

SEQ ID NO: 3068673 - RNA, 22 nt, Human
ugaggaauccagacccggcugc

SEQ ID NO: 3068674 - RNA, 21 nt, Human
ugaggaauccagacccggcug

SEQ ID NO: 3068675 - RNA, 23 nt, Human
ugaggcccagagggccugcaagg

SEQ ID NO: 3068676 - RNA, 21 nt, Human
ugaggcccagagggccugcaa

SEQ ID NO: 3068677 - RNA, 22 nt, Human
ugaggcccagagggccugcaag

SEQ ID NO: 3068678 - RNA, 15 nt, Human
ugaggcccagagggc

SEQ ID NO: 3068679 - RNA, 17 nt, Human
ugaggcccagagggccu

SEQ ID NO: 3068680 - RNA, 18 nt, Human
ugaggcccagagggccug

SEQ ID NO: 3068681 - RNA, 20 nt, Human
ugaggcccagagggccugca

SEQ ID NO: 3068682 - RNA, 20 nt, Human
ugaggccagagacacaagcc

SEQ ID NO: 3068683 - RNA, 14 nt, Human
ugaggccagagaca

SEQ ID NO: 3068684 - RNA, 16 nt, Human
ugaggccagagacaca

SEQ ID NO: 3068685 - RNA, 12 nt, Human
ugaggcccagag

SEQ ID NO: 3068686 - RNA, 13 nt, Human
ugaggcccagagg

SEQ ID NO: 3068687 - RNA, 20 nt, Human
ugaggguugggcugguguca

SEQ ID NO: 3068688 - RNA, 17 nt, Human
ugagguacugagaguga

SEQ ID NO: 3068689 - RNA, 13 nt, Human
ugaggucagagcc

SEQ ID NO: 3068690 - RNA, 22 nt, Human
ugagguacugagagugaacaaa

SEQ ID NO: 3068691 - RNA, 16 nt, Human
ugaggucagagccugc

SEQ ID NO: 3068692 - RNA, 14 nt, Human
ugaggucagagccu

SEQ ID NO: 3068693 - RNA, 18 nt, Human
agcagagaccaucccuga

SEQ ID NO: 3068694 - RNA, 19 nt, Human
agcagagaccaucccugaa

SEQ ID NO: 3068695 - RNA, 17 nt, Human
agcagagaccaucccug

SEQ ID NO: 3068696 - RNA, 17 nt, Human
ugaggucagagccugca

SEQ ID NO: 3068697 - RNA, 20 nt, Human
agcagagcaccuuagacagu

SEQ ID NO: 3068698 - RNA, 20 nt, Human
agcagagaccaucccugaag

SEQ ID NO: 3068699 - RNA, 21 nt, Human
agcagauggaaugcuguguua

SEQ ID NO: 3068700 - RNA, 19 nt, Human
agcagauggagaccccuug

SEQ ID NO: 3068701 - RNA, 17 nt, Human
agcagaggaaggagagg

SEQ ID NO: 3068702 - RNA, 13 nt, Human
ugaggggccucuu

SEQ ID NO: 3068703 - RNA, 12 nt, Human
ugaggggccucu

SEQ ID NO: 3068704 - RNA, 20 nt, Human
ugaggcccuucucuccagcc

SEQ ID NO: 3068705 - RNA, 22 nt, Human
ugaggcccuucucuccagcccc

SEQ ID NO: 3068706 - RNA, 23 nt, Human
ugaggcccuucucuccagccccu

SEQ ID NO: 3068707 - RNA, 24 nt, Human
ugaggcccuucucuccagccccug

SEQ ID NO: 3068708 - RNA, 18 nt, Human
ugaggcccuucucuccag

SEQ ID NO: 3068709 - RNA, 19 nt, Human
ugaggcccuucucuccagc

SEQ ID NO: 3068710 - RNA, 16 nt, Human
ugaggcccuucucucc

SEQ ID NO: 3068711 - RNA, 19 nt, Human
ugagggauacccaucccau

SEQ ID NO: 3068712 - RNA, 19 nt, Human
agcagaaaugccuuacccu

SEQ ID NO: 3068713 - RNA, 13 nt, Human
agcagaaaugccu

SEQ ID NO: 3068714 - RNA, 12 nt, Human
agcagaaaugcc

SEQ ID NO: 3068715 - RNA, 14 nt, Human
agcagaacagugau

SEQ ID NO: 3068716 - RNA, 23 nt, Human
agcacuuugggaggccaaggugg

SEQ ID NO: 3068717 - RNA, 22 nt, Human
agcacuuugggaggccaaggug

SEQ ID NO: 3068718 - RNA, 15 nt, Human
agcacgauuucuguu

SEQ ID NO: 3068719 - RNA, 14 nt, Human
agcacgauuucugu

SEQ ID NO: 3068720 - RNA, 16 nt, Human
agcacgauuucuguuu

SEQ ID NO: 3068721 - RNA, 23 nt, Human
agcaccuuagacagucccugcca

SEQ ID NO: 3068722 - RNA, 13 nt, Human
agcacgauuucug

SEQ ID NO: 3068723 - RNA, 19 nt, Human
agcaccuuagacagucccu

SEQ ID NO: 3068724 - RNA, 20 nt, Human
agcaccuuagacagucccug

SEQ ID NO: 3068725 - RNA, 21 nt, Human
agcaccuuagacagucccugc

SEQ ID NO: 3068726 - RNA, 22 nt, Human
agcaccuuagacagucccugcc

SEQ ID NO: 3068727 - RNA, 19 nt, Human
ugagccuugaacuuugacc

SEQ ID NO: 3068728 - RNA, 18 nt, Human
ugagccuugaacuuugac

SEQ ID NO: 3068729 - RNA, 17 nt, Human
ugagccuugaacuuuga

SEQ ID NO: 3068730 - RNA, 15 nt, Human
ugagccuugaacuuu

SEQ ID NO: 3068731 - RNA, 13 nt, Human
ugagcgacaguga

SEQ ID NO: 3068732 - RNA, 14 nt, Human
ugagcgacagugag

SEQ ID NO: 3068733 - RNA, 16 nt, Human
ugagcgacagugagac

SEQ ID NO: 3068734 - RNA, 20 nt, Human
ugagcgacagugagacucug

SEQ ID NO: 3068735 - RNA, 19 nt, Human
ugagccugggaggucaagg

SEQ ID NO: 3068736 - RNA, 22 nt, Human
ugagccugggaggucaaggcug

SEQ ID NO: 3068737 - RNA, 14 nt, Human
ugagccuugaacuu

SEQ ID NO: 3068738 - RNA, 11 nt, Human
ugagccuggca

SEQ ID NO: 3068739 - RNA, 16 nt, Human
ugagccuggcaagaau

SEQ ID NO: 3068740 - RNA, 14 nt, Human
ugagccugggaggu

SEQ ID NO: 3068741 - RNA, 21 nt, Human
agcagagaaugaaagggccca

SEQ ID NO: 3068742 - RNA, 22 nt, Human
agcagaccauuggggcucccag

SEQ ID NO: 3068743 - RNA, 23 nt, Human
agcagaccauuggggcucccagc

SEQ ID NO: 3068744 - RNA, 21 nt, Human
agcagagaauucucuuaucca

SEQ ID NO: 3068745 - RNA, 14 nt, Human
agcagagaauucuc

SEQ ID NO: 3068746 - RNA, 23 nt, Human
agcagagaaugaaagggcccaga

SEQ ID NO: 3068747 - RNA, 22 nt, Human
agcagagaaugaaagggcccag

SEQ ID NO: 3068748 - RNA, 15 nt, Human
agcagagaccauccc

SEQ ID NO: 3068749 - RNA, 16 nt, Human
agcagagaccaucccu

SEQ ID NO: 3068750 - RNA, 10 nt, Human
ugagccuggc

SEQ ID NO: 3068751 - RNA, 17 nt, Human
ugagccagauuucacuc

SEQ ID NO: 3068752 - RNA, 22 nt, Human
ugagccagauuucacucuccuu

SEQ ID NO: 3068753 - RNA, 21 nt, Human
ugagccagauuucacucuccu

SEQ ID NO: 3068754 - RNA, 13 nt, Human
agcaagugagagc

SEQ ID NO: 3068755 - RNA, 20 nt, Human
agcaagugagacccugucuc

SEQ ID NO: 3068756 - RNA, 14 nt, Human
agcaagugagagcu

SEQ ID NO: 3068757 - RNA, 18 nt, Human
agcaagugagagcugggu

SEQ ID NO: 3068758 - RNA, 22 nt, Human
agcaagugagagcuggguguca

SEQ ID NO: 3068759 - RNA, 13 nt, Human
agcacaugccucu

SEQ ID NO: 3068760 - RNA, 14 nt, Human
agcacaugccucuc

SEQ ID NO: 3068761 - RNA, 22 nt, Human
agcaccaaaagcuuaccaaggg

SEQ ID NO: 3068762 - RNA, 16 nt, Human
agcaccaaucaugaau

SEQ ID NO: 3068763 - RNA, 16 nt, Human
agcacagcuucauuuc

SEQ ID NO: 3068764 - RNA, 22 nt, Human
agcacagccucuuagaugcagu

SEQ ID NO: 3068765 - RNA, 15 nt, Human
agcacagugaucaag

SEQ ID NO: 3068766 - RNA, 15 nt, Human
ugagcaauccugcaa

SEQ ID NO: 3068767 - RNA, 14 nt, Human
agcaacgcaggccc

SEQ ID NO: 3068768 - RNA, 23 nt, Human
ugagcacuaaggugugcucugau

SEQ ID NO: 3068769 - RNA, 22 nt, Human
ugagcacuaaggugugcucuga

SEQ ID NO: 3068770 - RNA, 21 nt, Human
ugagcacuaaggugugcucug

SEQ ID NO: 3068771 - RNA, 20 nt, Human
ugagcacuaaggugugcucu

SEQ ID NO: 3068772 - RNA, 14 nt, Human
ugagccagauuuca

SEQ ID NO: 3068773 - RNA, 16 nt, Human
ugagccagauuucacu

SEQ ID NO: 3068774 - RNA, 13 nt, Human
ugagccagauuuc

SEQ ID NO: 3068775 - RNA, 23 nt, Human
ugagccacugcaccgggccacag

SEQ ID NO: 3068776 - RNA, 18 nt, Human
ugagccacugcaccgggc

SEQ ID NO: 3068777 - RNA, 21 nt, Human
ugagccacugcaccgggccac

SEQ ID NO: 3068778 - RNA, 21 nt, Human
ugagcaucaggccaggcccuc

SEQ ID NO: 3068779 - RNA, 22 nt, Human
ugagcaucaggccaggcccucu

SEQ ID NO: 3068780 - RNA, 24 nt, Human
ugagcaucaggccaggcccucugc

SEQ ID NO: 3068781 - RNA, 17 nt, Human
agauuuucagaaaauau

SEQ ID NO: 3068782 - RNA, 12 nt, Human
agauuuucagaa

SEQ ID NO: 3068783 - RNA, 14 nt, Human
agauuuaugcauau

SEQ ID NO: 3068784 - RNA, 16 nt, Human
agauuuaccacuugug

SEQ ID NO: 3068785 - RNA, 16 nt, Human
agauugugccccugca

SEQ ID NO: 3068786 - RNA, 13 nt, Human
agauuucacucuc

SEQ ID NO: 3068787 - RNA, 14 nt, Human
agauuucacucucc

SEQ ID NO: 3068788 - RNA, 20 nt, Human
ugacuccagaauuucccaaa

SEQ ID NO: 3068789 - RNA, 23 nt, Human
ugacuccagaauuucccaaagca

SEQ ID NO: 3068790 - RNA, 15 nt, Human
ugacuguuuccauca

SEQ ID NO: 3068791 - RNA, 17 nt, Human
ugacuccagaauuuccc

SEQ ID NO: 3068792 - RNA, 19 nt, Human
ugacuccagaauuucccaa

SEQ ID NO: 3068793 - RNA, 14 nt, Human
ugaccugaggcccu

SEQ ID NO: 3068794 - RNA, 15 nt, Human
ugaccugaggcccuu

SEQ ID NO: 3068795 - RNA, 24 nt, Human
ugacuucuaaguaaaaccacagca

SEQ ID NO: 3068796 - RNA, 23 nt, Human
agauuauauauauuuuuuucuga

SEQ ID NO: 3068797 - RNA, 22 nt, Human
agauucaaugccccugaauuua

SEQ ID NO: 3068798 - RNA, 21 nt, Human
agauucaaugccccugaauuu

SEQ ID NO: 3068799 - RNA, 21 nt, Human
agaucauugugaaauuauuca

SEQ ID NO: 3068800 - RNA, 12 nt, Human
agaucauuguga

SEQ ID NO: 3068801 - RNA, 14 nt, Human
agauccuggaaauc

SEQ ID NO: 3068802 - RNA, 19 nt, Human
agaugaugaugaucuuuaa

SEQ ID NO: 3068803 - RNA, 18 nt, Human
agauguguucacaaugga

SEQ ID NO: 3068804 - RNA, 15 nt, Human
agauguguucacaau

SEQ ID NO: 3068805 - RNA, 13 nt, Human
ugaccucugccug

SEQ ID NO: 3068806 - RNA, 14 nt, Human
ugaccucugccuga

SEQ ID NO: 3068807 - RNA, 12 nt, Human
ugaccugaggcc

SEQ ID NO: 3068808 - RNA, 18 nt, Human
agaugcuucucacugcca

SEQ ID NO: 3068809 - RNA, 16 nt, Human
agaugcuucucacugc

SEQ ID NO: 3068810 - RNA, 23 nt, Human
agaugcuagaacucccuuucaac

SEQ ID NO: 3068811 - RNA, 22 nt, Human
agaugcuagaacucccuuucaa

SEQ ID NO: 3068812 - RNA, 21 nt, Human
agaggcgcaugaauuugugaa

SEQ ID NO: 3068813 - RNA, 22 nt, Human
agagggagggagggcuccagac

SEQ ID NO: 3068814 - RNA, 21 nt, Human
agagggagggagggcuccaga

SEQ ID NO: 3068815 - RNA, 20 nt, Human
agagggagggagggcuccag

SEQ ID NO: 3068816 - RNA, 18 nt, Human
ugaagauguagaggagaa

SEQ ID NO: 3068817 - RNA, 17 nt, Human
ugaagauguagaggaga

SEQ ID NO: 3068818 - RNA, 12 nt, Human
ucuuuguaauga

SEQ ID NO: 3068819 - RNA, 14 nt, Human
ucuuuggucuacac

SEQ ID NO: 3068820 - RNA, 21 nt, Human
ucuuuggucuacacugugcug

SEQ ID NO: 3068821 - RNA, 15 nt, Human
ucuuuguaaugaaaa

SEQ ID NO: 3068822 - RNA, 13 nt, Human
ucuuuguaaugaa

SEQ ID NO: 3068823 - RNA, 22 nt, Human
ugaacuuguaaaggaauuuaaa

SEQ ID NO: 3068824 - RNA, 11 nt, Human
ugaacuuugac

SEQ ID NO: 3068825 - RNA, 11 nt, Human
ugaagacaaug

SEQ ID NO: 3068826 - RNA, 17 nt, Human
ugaagacaaugacuuac

SEQ ID NO: 3068827 - RNA, 13 nt, Human
ugaagacaaugac

SEQ ID NO: 3068828 - RNA, 16 nt, Human
ugaacuuugaccucug

SEQ ID NO: 3068829 - RNA, 14 nt, Human
ugaagaagauggua

SEQ ID NO: 3068830 - RNA, 20 nt, Human
ugaagaagcaccaaucauga

SEQ ID NO: 3068831 - RNA, 18 nt, Human
agaggcaacugcauuggc

SEQ ID NO: 3068832 - RNA, 11 nt, Human
agaggaaauca

SEQ ID NO: 3068833 - RNA, 12 nt, Human
agaggaaaucac

SEQ ID NO: 3068834 - RNA, 12 nt, Human
agaggaaagcaa

SEQ ID NO: 3068835 - RNA, 16 nt, Human
agaggaaagcaaagga

SEQ ID NO: 3068836 - RNA, 18 nt, Human
agaggaaagcaaaggaga

SEQ ID NO: 3068837 - RNA, 19 nt, Human
agaggaaagcaaaggagau

SEQ ID NO: 3068838 - RNA, 19 nt, Human
agagcugggugucaagagg

SEQ ID NO: 3068839 - RNA, 18 nt, Human
ugaagguggaaauaaacu

SEQ ID NO: 3068840 - RNA, 19 nt, Human
ugaauggacuuugcacacu

SEQ ID NO: 3068841 - RNA, 16 nt, Human
agagugagacucuguc

SEQ ID NO: 3068842 - RNA, 15 nt, Human
agagugagacucugu

SEQ ID NO: 3068843 - RNA, 18 nt, Human
agagucuauuuacggaac

SEQ ID NO: 3068844 - RNA, 22 nt, Human
agagugaacaaauuuacagaga

SEQ ID NO: 3068845 - RNA, 22 nt, Human
agagucucacuguugcccaggc

SEQ ID NO: 3068846 - RNA, 14 nt, Human
agagugaacaaauu

SEQ ID NO: 3068847 - RNA, 20 nt, Human
agagucucacuguugcccag

SEQ ID NO: 3068848 - RNA, 15 nt, Human
ugaaugucaguguga

SEQ ID NO: 3068849 - RNA, 18 nt, Human
ugaaugucagugugacug

SEQ ID NO: 3068850 - RNA, 14 nt, Human
ugaaugucagugug

SEQ ID NO: 3068851 - RNA, 19 nt, Human
agauaaucagugugucuaa

SEQ ID NO: 3068852 - RNA, 19 nt, Human
agagugagacucugucuca

SEQ ID NO: 3068853 - RNA, 19 nt, Human
agauaaggguaucugguga

SEQ ID NO: 3068854 - RNA, 17 nt, Human
agauaaggguaucuggu

SEQ ID NO: 3068855 - RNA, 21 nt, Human
agaucaaccccuucgcuccug

SEQ ID NO: 3068856 - RNA, 19 nt, Human
agaucaaccccuucgcucc

SEQ ID NO: 3068857 - RNA, 14 nt, Human
agaucaaccccuuc

SEQ ID NO: 3068858 - RNA, 19 nt, Human
agauacaggaaaagcugcu

SEQ ID NO: 3068859 - RNA, 22 nt, Human
agauauuuugcuuugugauuuu

SEQ ID NO: 3068860 - RNA, 18 nt, Human
ucuggauuauauuaugaa

SEQ ID NO: 3068861 - RNA, 12 nt, Human
ucuggauuauau

SEQ ID NO: 3068862 - RNA, 14 nt, Human
ucuggcagcucaga

SEQ ID NO: 3068863 - RNA, 15 nt, Human
ucuggcagcucagag

SEQ ID NO: 3068864 - RNA, 23 nt, Human
ucugcuuuuuaaagaaugcucuu

SEQ ID NO: 3068865 - RNA, 18 nt, Human
ucuggagguacgaaaaga

SEQ ID NO: 3068866 - RNA, 15 nt, Human
agaagcggcuggcag

SEQ ID NO: 3068867 - RNA, 16 nt, Human
agaagcggcuggcagc

SEQ ID NO: 3068868 - RNA, 16 nt, Human
ucugcucacauaucug

SEQ ID NO: 3068869 - RNA, 14 nt, Human
ucugcccuccaaga

SEQ ID NO: 3068870 - RNA, 23 nt, Human
ucugccgcagcccugcagagggc

SEQ ID NO: 3068871 - RNA, 21 nt, Human
agaagaacugaaaucauacuu

SEQ ID NO: 3068872 - RNA, 22 nt, Human
ucugcacuccccugcugggugu

SEQ ID NO: 3068873 - RNA, 21 nt, Human
ucugauucccaagcucugcuc

SEQ ID NO: 3068874 - RNA, 20 nt, Human
ucugauucccaagcucugcu

SEQ ID NO: 3068875 - RNA, 19 nt, Human
ucugauucccaagcucugc

SEQ ID NO: 3068876 - RNA, 18 nt, Human
ucugauucccaagcucug

SEQ ID NO: 3068877 - RNA, 13 nt, Human
ucugauacagaaa

SEQ ID NO: 3068878 - RNA, 16 nt, Human
ucugauacagaaaagu

SEQ ID NO: 3068879 - RNA, 17 nt, Human
ucugauacagaaaaguu

SEQ ID NO: 3068880 - RNA, 23 nt, Human
ucugagaaagacuauucaaacag

SEQ ID NO: 3068881 - RNA, 22 nt, Human
ucugagaaagacuauucaaaca

SEQ ID NO: 3068882 - RNA, 21 nt, Human
ucugagaaagacuauucaaac

SEQ ID NO: 3068883 - RNA, 19 nt, Human
ucugacccugcuucaaaua

SEQ ID NO: 3068884 - RNA, 23 nt, Human
agaaagacuauucaaacagucuc

SEQ ID NO: 3068885 - RNA, 20 nt, Human
agaaagacuauucaaacagu

SEQ ID NO: 3068886 - RNA, 18 nt, Human
agaaagacuauucaaaca

SEQ ID NO: 3068887 - RNA, 19 nt, Human
agaaagacuauucaaacag

SEQ ID NO: 3068888 - RNA, 21 nt, Human
ucugacuguuuccaucaaggg

SEQ ID NO: 3068889 - RNA, 20 nt, Human
ucugagaaagacuauucaaa

SEQ ID NO: 3068890 - RNA, 19 nt, Human
ucugagaaagacuauucaa

SEQ ID NO: 3068891 - RNA, 15 nt, Human
ucugagaaagacuau

SEQ ID NO: 3068892 - RNA, 14 nt, Human
ucugagaaagacua

SEQ ID NO: 3068893 - RNA, 16 nt, Human
agaaauguacagcaag

SEQ ID NO: 3068894 - RNA, 17 nt, Human
agaaauguacagcaagg

SEQ ID NO: 3068895 - RNA, 11 nt, Human
agaaauguguu

SEQ ID NO: 3068896 - RNA, 14 nt, Human
agaacucccuuuca

SEQ ID NO: 3068897 - RNA, 22 nt, Human
acuuuuuuuuuuuaagaguaaa

SEQ ID NO: 3068898 - RNA, 14 nt, Human
acuuuuggcauuuu

SEQ ID NO: 3068899 - RNA, 14 nt, Human
acuuuuggaaggua

SEQ ID NO: 3068900 - RNA, 22 nt, Human
acuuuuuauggcacuaguauuu

SEQ ID NO: 3068901 - RNA, 17 nt, Human
acuuuggaaagacuuuu

SEQ ID NO: 3068902 - RNA, 13 nt, Human
acuuuggaaagac

SEQ ID NO: 3068903 - RNA, 14 nt, Human
acuuuggaaagacu

SEQ ID NO: 3068904 - RNA, 12 nt, Human
acuuuggaaaga

SEQ ID NO: 3068905 - RNA, 18 nt, Human
acuuuaccuuuuuuauac

SEQ ID NO: 3068906 - RNA, 22 nt, Human
acuuuaccuuuuuuauacauaa

SEQ ID NO: 3068907 - RNA, 19 nt, Human
acuuuaccuuuuuuauaca

SEQ ID NO: 3068908 - RNA, 19 nt, Human
acuuugaccucugcagcaa

SEQ ID NO: 3068909 - RNA, 23 nt, Human
acuuugaccucugcagcaauaaa

SEQ ID NO: 3068910 - RNA, 11 nt, Human
ucucccuugga

SEQ ID NO: 3068911 - RNA, 18 nt, Human
ucucccuuggauuguccc

SEQ ID NO: 3068912 - RNA, 15 nt, Human
ucucccagucauuua

SEQ ID NO: 3068913 - RNA, 13 nt, Human
ucuccucugcugc

SEQ ID NO: 3068914 - RNA, 14 nt, Human
ucuccucugcugcu

SEQ ID NO: 3068915 - RNA, 19 nt, Human
ucucccuuggauugucccc

SEQ ID NO: 3068916 - RNA, 12 nt, Human
ucuccucugcug

SEQ ID NO: 3068917 - RNA, 15 nt, Human
ucuccucucucugua

SEQ ID NO: 3068918 - RNA, 15 nt, Human
agaaacauuugguaa

SEQ ID NO: 3068919 - RNA, 14 nt, Human
agaaagaaaaucag

SEQ ID NO: 3068920 - RNA, 13 nt, Human
agaaacuggaacu

SEQ ID NO: 3068921 - RNA, 18 nt, Human
agaaaaaggaugcacaga

SEQ ID NO: 3068922 - RNA, 16 nt, Human
agaaaacaaggaugaa

SEQ ID NO: 3068923 - RNA, 19 nt, Human
agaaaacaaggaugaauua

SEQ ID NO: 3068924 - RNA, 22 nt, Human
ucucuuuaaugucacaggcagg

SEQ ID NO: 3068925 - RNA, 13 nt, Human
ucucuugagccug

SEQ ID NO: 3068926 - RNA, 14 nt, Human
ucucuugagccugg

SEQ ID NO: 3068927 - RNA, 15 nt, Human
ucucuugagccuggg

SEQ ID NO: 3068928 - RNA, 14 nt, Human
ucucuugagagggu

SEQ ID NO: 3068929 - RNA, 13 nt, Human
ucucuucuuuaaa

SEQ ID NO: 3068930 - RNA, 12 nt, Human
ucucuucuuuaa

SEQ ID NO: 3068931 - RNA, 13 nt, Human
ucucuggccuucg

SEQ ID NO: 3068932 - RNA, 16 nt, Human
ucucuggccuucggcc

SEQ ID NO: 3068933 - RNA, 17 nt, Human
ucucuggccuucggccu

SEQ ID NO: 3068934 - RNA, 13 nt, Human
ucucuccagcccc

SEQ ID NO: 3068935 - RNA, 14 nt, Human
ucucuccagccccu

SEQ ID NO: 3068936 - RNA, 20 nt, Human
ucuccuucaccuuugucccc

SEQ ID NO: 3068937 - RNA, 18 nt, Human
ucuccuucaccuuugucc

SEQ ID NO: 3068938 - RNA, 22 nt, Human
ucucuccuguaccucuugagcc

SEQ ID NO: 3068939 - RNA, 20 nt, Human
ucucuccuguaccucuugag

SEQ ID NO: 3068940 - RNA, 15 nt, Human
ucucuccagccccug

SEQ ID NO: 3068941 - RNA, 17 nt, Human
ucucuccuguaccucuu

SEQ ID NO: 3068942 - RNA, 17 nt, Human
ucuuuaaaauacacacu

SEQ ID NO: 3068943 - RNA, 21 nt, Human
ucuuuaaagggauggcaagau

SEQ ID NO: 3068944 - RNA, 15 nt, Human
ucuuuacuucaugga

SEQ ID NO: 3068945 - RNA, 13 nt, Human
ucuuuccugaggc

SEQ ID NO: 3068946 - RNA, 14 nt, Human
ucuuuccugaggcu

SEQ ID NO: 3068947 - RNA, 15 nt, Human
ucuuuccugaggcug

SEQ ID NO: 3068948 - RNA, 12 nt, Human
ucuuuccugagg

SEQ ID NO: 3068949 - RNA, 14 nt, Human
agacuccugcaggc

SEQ ID NO: 3068950 - RNA, 15 nt, Human
agacuccugcaggca

SEQ ID NO: 3068951 - RNA, 16 nt, Human
agacuccugcaggcag

SEQ ID NO: 3068952 - RNA, 17 nt, Human
agacuccugcaggcagc

SEQ ID NO: 3068953 - RNA, 18 nt, Human
agacuccugcaggcagcc

SEQ ID NO: 3068954 - RNA, 19 nt, Human
agacuccugcaggcagcca

SEQ ID NO: 3068955 - RNA, 20 nt, Human
agacuccugcaggcagccag

SEQ ID NO: 3068956 - RNA, 21 nt, Human
agacucgcgacaaugcaaacc

SEQ ID NO: 3068957 - RNA, 17 nt, Human
agacucuacagaggcca

SEQ ID NO: 3068958 - RNA, 19 nt, Human
agacucuacagaggccaug

SEQ ID NO: 3068959 - RNA, 20 nt, Human
agacuggauaguccgucucu

SEQ ID NO: 3068960 - RNA, 21 nt, Human
agacuggauaguccgucucug

SEQ ID NO: 3068961 - RNA, 15 nt, Human
agacuggcacaguuu

SEQ ID NO: 3068962 - RNA, 14 nt, Human
agacuggcacaguu

SEQ ID NO: 3068963 - RNA, 14 nt, Human
agacuucaucccuc

SEQ ID NO: 3068964 - RNA, 17 nt, Human
agacuucaucccucugg

SEQ ID NO: 3068965 - RNA, 13 nt, Human
agagaccaucccu

SEQ ID NO: 3068966 - RNA, 14 nt, Human
agagaccaucccug

SEQ ID NO: 3068967 - RNA, 18 nt, Human
agagacacacugaagaag

SEQ ID NO: 3068968 - RNA, 20 nt, Human
agagacacacugaagaagca

SEQ ID NO: 3068969 - RNA, 15 nt, Human
agagaccaucccuga

SEQ ID NO: 3068970 - RNA, 12 nt, Human
agacuuuggaaa

SEQ ID NO: 3068971 - RNA, 14 nt, Human
agacuuuggaaaga

SEQ ID NO: 3068972 - RNA, 18 nt, Human
agagaaugaaagggccca

SEQ ID NO: 3068973 - RNA, 17 nt, Human
agagacacacugaagaa

SEQ ID NO: 3068974 - RNA, 15 nt, Human
agagaaugagagaca

SEQ ID NO: 3068975 - RNA, 16 nt, Human
ucuugcaauggcagcc

SEQ ID NO: 3068976 - RNA, 13 nt, Human
ucuugcaauggca

SEQ ID NO: 3068977 - RNA, 17 nt, Human
ucuugcaauggcagccu

SEQ ID NO: 3068978 - RNA, 20 nt, Human
ucuugaugccuggcggggug

SEQ ID NO: 3068979 - RNA, 14 nt, Human
ucuugaugccuggc

SEQ ID NO: 3068980 - RNA, 15 nt, Human
agacucauucuucug

SEQ ID NO: 3068981 - RNA, 19 nt, Human
agacuccaaagaaauguaa

SEQ ID NO: 3068982 - RNA, 16 nt, Human
agacuccaaagaaaug

SEQ ID NO: 3068983 - RNA, 17 nt, Human
agacucauucuucugua

SEQ ID NO: 3068984 - RNA, 21 nt, Human
agacuauucaaacagucucag

SEQ ID NO: 3068985 - RNA, 20 nt, Human
agacuauucaaacagucuca

SEQ ID NO: 3068986 - RNA, 18 nt, Human
agacuauucaaacagucu

SEQ ID NO: 3068987 - RNA, 18 nt, Human
agacucauucuucuguac

SEQ ID NO: 3068988 - RNA, 12 nt, Human
agacuccaaaga

SEQ ID NO: 3068989 - RNA, 14 nt, Human
agacuccaaagaaa

SEQ ID NO: 3068990 - RNA, 13 nt, Human
agacuccaaagaa

SEQ ID NO: 3068991 - RNA, 18 nt, Human
agacuaucuaaauguuga

SEQ ID NO: 3068992 - RNA, 17 nt, Human
agacuaucuaaauguug

SEQ ID NO: 3068993 - RNA, 19 nt, Human
agacuaucuaaauguugaa

SEQ ID NO: 3068994 - RNA, 16 nt, Human
agacuauucaaacagu

SEQ ID NO: 3068995 - RNA, 15 nt, Human
agacuaucuaaaugu

SEQ ID NO: 3068996 - RNA, 19 nt, Human
agacccuuguggucccacc

SEQ ID NO: 3068997 - RNA, 20 nt, Human
agacccuuguggucccaccc

SEQ ID NO: 3068998 - RNA, 22 nt, Human
agacccuuguggucccacccca

SEQ ID NO: 3068999 - RNA, 23 nt, Human
agacccuuguggucccaccccac

SEQ ID NO: 3069000 - RNA, 16 nt, Human
agacccugcccugugg

SEQ ID NO: 3069001 - RNA, 19 nt, Human
agacccugcccugugggcc

SEQ ID NO: 3069002 - RNA, 21 nt, Human
agacccugcccugugggcccc

SEQ ID NO: 3069003 - RNA, 23 nt, Human
agacccugcccugugggccccca

SEQ ID NO: 3069004 - RNA, 13 nt, Human
agacccuuguggu

SEQ ID NO: 3069005 - RNA, 15 nt, Human
agacccuuguggucc

SEQ ID NO: 3069006 - RNA, 13 nt, Human
agacccugcccug

SEQ ID NO: 3069007 - RNA, 14 nt, Human
agacccugcccugu

SEQ ID NO: 3069008 - RNA, 12 nt, Human
agacccugcccu

SEQ ID NO: 3069009 - RNA, 18 nt, Human
ucuguuuuauaauuuugu

SEQ ID NO: 3069010 - RNA, 23 nt, Human
agaauuucccaaagcagugcaug

SEQ ID NO: 3069011 - RNA, 13 nt, Human
agaauuucuagga

SEQ ID NO: 3069012 - RNA, 21 nt, Human
agaauuucuaggacugaauua

SEQ ID NO: 3069013 - RNA, 17 nt, Human
agaauuucccaaagcag

SEQ ID NO: 3069014 - RNA, 18 nt, Human
agaauuucccaaagcagu

SEQ ID NO: 3069015 - RNA, 20 nt, Human
ucuguuggccagugugacaa

SEQ ID NO: 3069016 - RNA, 19 nt, Human
ucuguuggccagugugaca

SEQ ID NO: 3069017 - RNA, 18 nt, Human
ucuguuggccagugugac

SEQ ID NO: 3069018 - RNA, 15 nt, Human
ucugugaaaggaaag

SEQ ID NO: 3069019 - RNA, 21 nt, Human
ucugugaaaggaaagagggag

SEQ ID NO: 3069020 - RNA, 15 nt, Human
ucugucauuugagca

SEQ ID NO: 3069021 - RNA, 23 nt, Human
ucugucauuugagcagggcucag

SEQ ID NO: 3069022 - RNA, 20 nt, Human
ucugucauuugagcagggcu

SEQ ID NO: 3069023 - RNA, 18 nt, Human
ucugguccauagagagca

SEQ ID NO: 3069024 - RNA, 16 nt, Human
ucuggguucacugcaa

SEQ ID NO: 3069025 - RNA, 14 nt, Human
ucuggguucacugc

SEQ ID NO: 3069026 - RNA, 11 nt, Human
ucuggggcugu

SEQ ID NO: 3069027 - RNA, 14 nt, Human
agacagucccugcc

SEQ ID NO: 3069028 - RNA, 16 nt, Human
agacagucccugccaa

SEQ ID NO: 3069029 - RNA, 17 nt, Human
agacagucccugccaau

SEQ ID NO: 3069030 - RNA, 15 nt, Human
agacagucccugcca

SEQ ID NO: 3069031 - RNA, 21 nt, Human
agacaggguuuugccauguug

SEQ ID NO: 3069032 - RNA, 15 nt, Human
agacaggaccaggga

SEQ ID NO: 3069033 - RNA, 22 nt, Human
agacaggcaagcaccuccugcc

SEQ ID NO: 3069034 - RNA, 23 nt, Human
agacaggcaagcaccuccugccu

SEQ ID NO: 3069035 - RNA, 20 nt, Human
agaauuugauaugugaacag

SEQ ID NO: 3069036 - RNA, 18 nt, Human
agaauuugauaugugaac

SEQ ID NO: 3069037 - RNA, 19 nt, Human
agaauuugauaugugaaca

SEQ ID NO: 3069038 - RNA, 17 nt, Human
agaauuugauaugugaa

SEQ ID NO: 3069039 - RNA, 15 nt, Human
ucuuaugggcugggu

SEQ ID NO: 3069040 - RNA, 16 nt, Human
ucuuaugggcuggguu

SEQ ID NO: 3069041 - RNA, 13 nt, Human
ucuuaugggcugg

SEQ ID NO: 3069042 - RNA, 14 nt, Human
ucuuaugggcuggg

SEQ ID NO: 3069043 - RNA, 22 nt, Human
ucuuauugcccacgcuggagug

SEQ ID NO: 3069044 - RNA, 18 nt, Human
ucuuauugcccacgcugg

SEQ ID NO: 3069045 - RNA, 14 nt, Human
ucuuauugcccacg

SEQ ID NO: 3069046 - RNA, 14 nt, Human
ucuuaauuaaaaga

SEQ ID NO: 3069047 - RNA, 21 nt, Human
ucuuaauuaaaagaauauuuu

SEQ ID NO: 3069048 - RNA, 18 nt, Human
ucuuaauuaaaagaauau

SEQ ID NO: 3069049 - RNA, 22 nt, Human
ucuuccaggcugggagagccuu

SEQ ID NO: 3069050 - RNA, 21 nt, Human
ucuuccaggcugggagagccu

SEQ ID NO: 3069051 - RNA, 22 nt, Human
ucuucccuacaguugaaaaaca

SEQ ID NO: 3069052 - RNA, 15 nt, Human
ucuucacaacagauu

SEQ ID NO: 3069053 - RNA, 22 nt, Human
accugaagcuaucguaaaauua

SEQ ID NO: 3069054 - RNA, 12 nt, Human
accucugcacaa

SEQ ID NO: 3069055 - RNA, 23 nt, Human
accucucccuuggauuguccccg

SEQ ID NO: 3069056 - RNA, 14 nt, Human
accucucucacucc

SEQ ID NO: 3069057 - RNA, 19 nt, Human
accucucucacuccuugaa

SEQ ID NO: 3069058 - RNA, 13 nt, Human
accucucccuugg

SEQ ID NO: 3069059 - RNA, 14 nt, Human
accucucccuugga

SEQ ID NO: 3069060 - RNA, 15 nt, Human
accucucccuuggau

SEQ ID NO: 3069061 - RNA, 14 nt, Human
accucuaaauucuu

SEQ ID NO: 3069062 - RNA, 21 nt, Human
accucuaaauucuuucauuuu

SEQ ID NO: 3069063 - RNA, 17 nt, Human
accucggugccuuccuc

SEQ ID NO: 3069064 - RNA, 18 nt, Human
accucuaaauucuuucau

SEQ ID NO: 3069065 - RNA, 22 nt, Human
ucauugaccugaggcccuucuc

SEQ ID NO: 3069066 - RNA, 21 nt, Human
ucauucuccuuguguuacuaa

SEQ ID NO: 3069067 - RNA, 19 nt, Human
ucauugaccugaggcccuu

SEQ ID NO: 3069068 - RNA, 14 nt, Human
ucaugugaaaucau

SEQ ID NO: 3069069 - RNA, 13 nt, Human
ucaugucuggcua

SEQ ID NO: 3069070 - RNA, 17 nt, Human
ucauguucuuaauucuu

SEQ ID NO: 3069071 - RNA, 11 nt, Human
ucauguucuua

SEQ ID NO: 3069072 - RNA, 23 nt, Human
ucauccacugugccaugugccag

SEQ ID NO: 3069073 - RNA, 22 nt, Human
ucaugaauuaguuuuauaugcu

SEQ ID NO: 3069074 - RNA, 21 nt, Human
ucauccacugugccaugugcc

SEQ ID NO: 3069075 - RNA, 19 nt, Human
ucauccacugugccaugug

SEQ ID NO: 3069076 - RNA, 19 nt, Human
ucaugacaaagacugagua

SEQ ID NO: 3069077 - RNA, 21 nt, Human
ucaugaauuaguuuuauaugc

SEQ ID NO: 3069078 - RNA, 19 nt, Human
ucauauuaauauauuucca

SEQ ID NO: 3069079 - RNA, 10 nt, Human
acccuuuucu

SEQ ID NO: 3069080 - RNA, 16 nt, Human
ucauauuuacuucuua

SEQ ID NO: 3069081 - RNA, 21 nt, Human
accgaacugauguaaguaaac

SEQ ID NO: 3069082 - RNA, 22 nt, Human
ucauauuuacuucuuauacauu

SEQ ID NO: 3069083 - RNA, 21 nt, Human
ucauauuuacuucuuauacau

SEQ ID NO: 3069084 - RNA, 20 nt, Human
ucauauuuacuucuuauaca

SEQ ID NO: 3069085 - RNA, 20 nt, Human
accgcagacaggaccaggga

SEQ ID NO: 3069086 - RNA, 17 nt, Human
accgccaaggcuggggg

SEQ ID NO: 3069087 - RNA, 17 nt, Human
accgcagacaggaccag

SEQ ID NO: 3069088 - RNA, 20 nt, Human
accuccgccucuuggguuca

SEQ ID NO: 3069089 - RNA, 18 nt, Human
ucauccacugugccaugu

SEQ ID NO: 3069090 - RNA, 13 nt, Human
accuagccuuaga

SEQ ID NO: 3069091 - RNA, 12 nt, Human
accuucuccuuc

SEQ ID NO: 3069092 - RNA, 13 nt, Human
accuucuccuuca

SEQ ID NO: 3069093 - RNA, 15 nt, Human
accuugaaugaugcc

SEQ ID NO: 3069094 - RNA, 14 nt, Human
accuugacagggca

SEQ ID NO: 3069095 - RNA, 15 nt, Human
accuugacagggcac

SEQ ID NO: 3069096 - RNA, 15 nt, Human
uccaccaucaagcca

SEQ ID NO: 3069097 - RNA, 17 nt, Human
accuuagacagucccug

SEQ ID NO: 3069098 - RNA, 19 nt, Human
accuuuguauucucuccug

SEQ ID NO: 3069099 - RNA, 15 nt, Human
accuuuguauucucu

SEQ ID NO: 3069100 - RNA, 23 nt, Human
accuuuguauucucuccuguacc

SEQ ID NO: 3069101 - RNA, 22 nt, Human
uccagaaguuugagaucagccu

SEQ ID NO: 3069102 - RNA, 22 nt, Human
uccagccccuggaugcagccuc

SEQ ID NO: 3069103 - RNA, 20 nt, Human
uccagccugagcgacaguga

SEQ ID NO: 3069104 - RNA, 11 nt, Human
uccagccuggg

SEQ ID NO: 3069105 - RNA, 21 nt, Human
uccagccugagcgacagugag

SEQ ID NO: 3069106 - RNA, 16 nt, Human
uccagccccuggaugc

SEQ ID NO: 3069107 - RNA, 17 nt, Human
uccagccccuggaugca

SEQ ID NO: 3069108 - RNA, 19 nt, Human
uccagccccuggaugcagc

SEQ ID NO: 3069109 - RNA, 21 nt, Human
uccagccccuggaugcagccu

SEQ ID NO: 3069110 - RNA, 15 nt, Human
uccagccccuggaug

SEQ ID NO: 3069111 - RNA, 14 nt, Human
uccagccccuggau

SEQ ID NO: 3069112 - RNA, 11 nt, Human
uccaagcuggu

SEQ ID NO: 3069113 - RNA, 12 nt, Human
uccaagcuccca

SEQ ID NO: 3069114 - RNA, 13 nt, Human
uccaagcucccag

SEQ ID NO: 3069115 - RNA, 14 nt, Human
uccaagcucccagg

SEQ ID NO: 3069116 - RNA, 15 nt, Human
uccaagcucccaggc

SEQ ID NO: 3069117 - RNA, 16 nt, Human
uccaagcucccaggca

SEQ ID NO: 3069118 - RNA, 23 nt, Human
uccaaagucucuggaauuugaaa

SEQ ID NO: 3069119 - RNA, 13 nt, Human
ucauuuuuuuuaa

SEQ ID NO: 3069120 - RNA, 21 nt, Human
ucauuugagcagggcucagcg

SEQ ID NO: 3069121 - RNA, 20 nt, Human
ucauuuuagggguagcauuu

SEQ ID NO: 3069122 - RNA, 18 nt, Human
accugcggugcuaucucc

SEQ ID NO: 3069123 - RNA, 15 nt, Human
accugaagucuuugu

SEQ ID NO: 3069124 - RNA, 22 nt, Human
accugaagucuuuguacagaca

SEQ ID NO: 3069125 - RNA, 19 nt, Human
accugcggugcuaucuccc

SEQ ID NO: 3069126 - RNA, 22 nt, Human
accugcggugcuaucuccccca

SEQ ID NO: 3069127 - RNA, 23 nt, Human
accugcggugcuaucucccccag

SEQ ID NO: 3069128 - RNA, 17 nt, Human
accuggaauauauaacc

SEQ ID NO: 3069129 - RNA, 14 nt, Human
accuggaauauaua

SEQ ID NO: 3069130 - RNA, 19 nt, Human
ucauuugagcagggcucag

SEQ ID NO: 3069131 - RNA, 19 nt, Human
acccacuugcuuuuaaaau

SEQ ID NO: 3069132 - RNA, 16 nt, Human
acccagaagaaaauag

SEQ ID NO: 3069133 - RNA, 18 nt, Human
acccaaaaggcagaagca

SEQ ID NO: 3069134 - RNA, 21 nt, Human
acccaaauguucaucaaugaa

SEQ ID NO: 3069135 - RNA, 18 nt, Human
acccagcccacuucugcc

SEQ ID NO: 3069136 - RNA, 15 nt, Human
acccagcccacuucu

SEQ ID NO: 3069137 - RNA, 17 nt, Human
acccagcccacuucugc

SEQ ID NO: 3069138 - RNA, 16 nt, Human
acccagcccacuucug

SEQ ID NO: 3069139 - RNA, 23 nt, Human
accauuuugggguacccacugcu

SEQ ID NO: 3069140 - RNA, 13 nt, Human
acccaaaaggcag

SEQ ID NO: 3069141 - RNA, 15 nt, Human
acccaaaaggcagaa

SEQ ID NO: 3069142 - RNA, 22 nt, Human
accauuuugggguacccacugc

SEQ ID NO: 3069143 - RNA, 13 nt, Human
accauucuccacc

SEQ ID NO: 3069144 - RNA, 16 nt, Human
accauucuccaccugc

SEQ ID NO: 3069145 - RNA, 18 nt, Human
accauucuccaccugcca

SEQ ID NO: 3069146 - RNA, 22 nt, Human
accaugauuaaccacuucagcu

SEQ ID NO: 3069147 - RNA, 23 nt, Human
accaugauuaaccacuucagcug

SEQ ID NO: 3069148 - RNA, 18 nt, Human
accaguguuguggauuua

SEQ ID NO: 3069149 - RNA, 21 nt, Human
accaguguuguggauuuaaca

SEQ ID NO: 3069150 - RNA, 13 nt, Human
accagugccucuc

SEQ ID NO: 3069151 - RNA, 10 nt, Human
accagugccu

SEQ ID NO: 3069152 - RNA, 18 nt, Human
accagugccucucccugc

SEQ ID NO: 3069153 - RNA, 21 nt, Human
accagugccucucccugcugc

SEQ ID NO: 3069154 - RNA, 22 nt, Human
accagugccucucccugcugcu

SEQ ID NO: 3069155 - RNA, 23 nt, Human
accagugccucucccugcugcuc

SEQ ID NO: 3069156 - RNA, 18 nt, Human
ucacuguugcccaggcug

SEQ ID NO: 3069157 - RNA, 17 nt, Human
ucacuguugcccaggcu

SEQ ID NO: 3069158 - RNA, 14 nt, Human
accagggacugagg

SEQ ID NO: 3069159 - RNA, 16 nt, Human
ucaccugccccucaac

SEQ ID NO: 3069160 - RNA, 14 nt, Human
ucacugagacagcc

SEQ ID NO: 3069161 - RNA, 15 nt, Human
ucacugagacagccc

SEQ ID NO: 3069162 - RNA, 13 nt, Human
ucacugagacagc

SEQ ID NO: 3069163 - RNA, 16 nt, Human
ucacuguugcccaggc

SEQ ID NO: 3069164 - RNA, 12 nt, Human
ucacugcagccu

SEQ ID NO: 3069165 - RNA, 23 nt, Human
accagacaccuugacagggcaca

SEQ ID NO: 3069166 - RNA, 22 nt, Human
accagacaccuugacagggcac

SEQ ID NO: 3069167 - RNA, 12 nt, Human
accacuuuuguu

SEQ ID NO: 3069168 - RNA, 17 nt, Human
accagacaccuugacag

SEQ ID NO: 3069169 - RNA, 19 nt, Human
accacuuguguuuugcaag

SEQ ID NO: 3069170 - RNA, 23 nt, Human
accacuuguguuuugcaagccag

SEQ ID NO: 3069171 - RNA, 17 nt, Human
accagagcccaccuugg

SEQ ID NO: 3069172 - RNA, 22 nt, Human
accagagcccaccuuggcucaa

SEQ ID NO: 3069173 - RNA, 19 nt, Human
accagagcccaccuuggcu

SEQ ID NO: 3069174 - RNA, 19 nt, Human
ucaccugaagacucauucu

SEQ ID NO: 3069175 - RNA, 16 nt, Human
ucaccugaagacucau

SEQ ID NO: 3069176 - RNA, 23 nt, Human
ucaccugaagacucauucuucug

SEQ ID NO: 3069177 - RNA, 14 nt, Human
accacaucuugcuc

SEQ ID NO: 3069178 - RNA, 11 nt, Human
accacagcagu

SEQ ID NO: 3069179 - RNA, 22 nt, Human
accacagacauacuaaccagca

SEQ ID NO: 3069180 - RNA, 21 nt, Human
accacagacauacuaaccagc

SEQ ID NO: 3069181 - RNA, 12 nt, Human
uauuucauuucu

SEQ ID NO: 3069182 - RNA, 13 nt, Human
accacuucagcug

SEQ ID NO: 3069183 - RNA, 14 nt, Human
accacuucagcuga

SEQ ID NO: 3069184 - RNA, 15 nt, Human
accacuucagcugac

SEQ ID NO: 3069185 - RNA, 13 nt, Human
accacugcagaag

SEQ ID NO: 3069186 - RNA, 14 nt, Human
accacugcagaaga

SEQ ID NO: 3069187 - RNA, 19 nt, Human
accacugcagaagacagua

SEQ ID NO: 3069188 - RNA, 24 nt, Human
accacaucuugcucugcugacaga

SEQ ID NO: 3069189 - RNA, 21 nt, Human
accacaucuugcucugcugac

SEQ ID NO: 3069190 - RNA, 20 nt, Human
accacaucuugcucugcuga

SEQ ID NO: 3069191 - RNA, 20 nt, Human
accacucuaucaaguauuau

SEQ ID NO: 3069192 - RNA, 20 nt, Human
accccuucgcuccugugucu

SEQ ID NO: 3069193 - RNA, 23 nt, Human
ucaggguuggccccugcccggcu

SEQ ID NO: 3069194 - RNA, 16 nt, Human
acccuuguggucccac

SEQ ID NO: 3069195 - RNA, 17 nt, Human
acccuuguggucccacc

SEQ ID NO: 3069196 - RNA, 19 nt, Human
acccuuguggucccacccc

SEQ ID NO: 3069197 - RNA, 15 nt, Human
acccuugugguccca

SEQ ID NO: 3069198 - RNA, 11 nt, Human
acccugcccug

SEQ ID NO: 3069199 - RNA, 12 nt, Human
acccugcccugu

SEQ ID NO: 3069200 - RNA, 13 nt, Human
acccugcccugug

SEQ ID NO: 3069201 - RNA, 14 nt, Human
acccucuuagaaaa

SEQ ID NO: 3069202 - RNA, 15 nt, Human
ucaggccagcugcuu

SEQ ID NO: 3069203 - RNA, 20 nt, Human
ucaggccagcugcuugggcu

SEQ ID NO: 3069204 - RNA, 11 nt, Human
ucaggccaggc

SEQ ID NO: 3069205 - RNA, 14 nt, Human
ucaggccagcugcu

SEQ ID NO: 3069206 - RNA, 19 nt, Human
accccuucgcuccuguguc

SEQ ID NO: 3069207 - RNA, 16 nt, Human
ucagguaacaggcaga

SEQ ID NO: 3069208 - RNA, 15 nt, Human
ucagguaacaggcag

SEQ ID NO: 3069209 - RNA, 13 nt, Human
ucagguaacaggc

SEQ ID NO: 3069210 - RNA, 14 nt, Human
ucagggucccuggu

SEQ ID NO: 3069211 - RNA, 18 nt, Human
ucagggucccugguggca

SEQ ID NO: 3069212 - RNA, 23 nt, Human
ucaggggugugcggccuuuggcu

SEQ ID NO: 3069213 - RNA, 13 nt, Human
ucagggucccugg

SEQ ID NO: 3069214 - RNA, 17 nt, Human
ucagcggggacagcucc

SEQ ID NO: 3069215 - RNA, 16 nt, Human
ucagcggggacagcuc

SEQ ID NO: 3069216 - RNA, 15 nt, Human
ucagcggggacagcu

SEQ ID NO: 3069217 - RNA, 20 nt, Human
ucaggccaaacucaccugcc

SEQ ID NO: 3069218 - RNA, 23 nt, Human
ucaggccaaacucaccugccccu

SEQ ID NO: 3069219 - RNA, 16 nt, Human
ucaggaagcucagggc

SEQ ID NO: 3069220 - RNA, 17 nt, Human
ucaggaagcucagggcc

SEQ ID NO: 3069221 - RNA, 19 nt, Human
ucaggaagcucagggccug

SEQ ID NO: 3069222 - RNA, 20 nt, Human
ucaggaagcucagggccugg

SEQ ID NO: 3069223 - RNA, 14 nt, Human
acccccagccugcu

SEQ ID NO: 3069224 - RNA, 15 nt, Human
acccccagccugcua

SEQ ID NO: 3069225 - RNA, 19 nt, Human
ucagccuggcuucaaauug

SEQ ID NO: 3069226 - RNA, 10 nt, Human
ucagccuggg

SEQ ID NO: 3069227 - RNA, 12 nt, Human
ucagccugggca

SEQ ID NO: 3069228 - RNA, 18 nt, Human
ucagaugcacaugagcug

SEQ ID NO: 3069229 - RNA, 13 nt, Human
ucagaagacacug

SEQ ID NO: 3069230 - RNA, 13 nt, Human
ucagaucuucugu

SEQ ID NO: 3069231 - RNA, 13 nt, Human
acccagcucuggu

SEQ ID NO: 3069232 - RNA, 15 nt, Human
acccagcucuggucc

SEQ ID NO: 3069233 - RNA, 16 nt, Human
acccaguccugcccgc

SEQ ID NO: 3069234 - RNA, 15 nt, Human
ucccagugaauucuu

SEQ ID NO: 3069235 - RNA, 19 nt, Human
ucccagugccgagaaggaa

SEQ ID NO: 3069236 - RNA, 22 nt, Human
ucccagugccgagaaggaagcc

SEQ ID NO: 3069237 - RNA, 16 nt, Human
acuacaguccucccau

SEQ ID NO: 3069238 - RNA, 14 nt, Human
ucccaucucacaca

SEQ ID NO: 3069239 - RNA, 19 nt, Human
ucccaucucacacaugagc

SEQ ID NO: 3069240 - RNA, 13 nt, Human
ucccaucucacac

SEQ ID NO: 3069241 - RNA, 15 nt, Human
ucccauaugccuggg

SEQ ID NO: 3069242 - RNA, 22 nt, Human
uccccaccgcagacaggaccag

SEQ ID NO: 3069243 - RNA, 14 nt, Human
acguuucuaaaggc

SEQ ID NO: 3069244 - RNA, 13 nt, Human
acuaaaaauacaa

SEQ ID NO: 3069245 - RNA, 12 nt, Human
acguuucuaaag

SEQ ID NO: 3069246 - RNA, 14 nt, Human
uccagcucaccagc

SEQ ID NO: 3069247 - RNA, 24 nt, Human
uccagccugggugacagagcaagu

SEQ ID NO: 3069248 - RNA, 13 nt, Human
uccagccugggug

SEQ ID NO: 3069249 - RNA, 12 nt, Human
acuaaccacgcu

SEQ ID NO: 3069250 - RNA, 16 nt, Human
acuaaccagcagaaau

SEQ ID NO: 3069251 - RNA, 13 nt, Human
acuaaccacgcug

SEQ ID NO: 3069252 - RNA, 17 nt, Human
acuaaccagcagaaaug

SEQ ID NO: 3069253 - RNA, 23 nt, Human
acuacaggugugagucaccaagc

SEQ ID NO: 3069254 - RNA, 15 nt, Human
acuacaguccuccca

SEQ ID NO: 3069255 - RNA, 22 nt, Human
acuaugaaguuuuuuuuauaca

SEQ ID NO: 3069256 - RNA, 18 nt, Human
acuauguugcccaggcag

SEQ ID NO: 3069257 - RNA, 17 nt, Human
acuauguugcccaggca

SEQ ID NO: 3069258 - RNA, 20 nt, Human
acuauguugcccaggcaggu

SEQ ID NO: 3069259 - RNA, 19 nt, Human
acuauguugcccaggcagg

SEQ ID NO: 3069260 - RNA, 23 nt, Human
acuauguugcccaggcaggucuu

SEQ ID NO: 3069261 - RNA, 23 nt, Human
uccccaggaggccagccuugacc

SEQ ID NO: 3069262 - RNA, 24 nt, Human
uccccaccgcagacaggaccaggg

SEQ ID NO: 3069263 - RNA, 23 nt, Human
acuauaauuuaccugaagucuuu

SEQ ID NO: 3069264 - RNA, 21 nt, Human
acuauaauguaagcucuacug

SEQ ID NO: 3069265 - RNA, 17 nt, Human
acuauagccuaggugac

SEQ ID NO: 3069266 - RNA, 16 nt, Human
ucccgaauagcuggga

SEQ ID NO: 3069267 - RNA, 15 nt, Human
ucccgaauagcuggg

SEQ ID NO: 3069268 - RNA, 18 nt, Human
ucccgaauagcugggacu

SEQ ID NO: 3069269 - RNA, 20 nt, Human
ucccgaguagcugggacuac

SEQ ID NO: 3069270 - RNA, 18 nt, Human
ucccuauuagagaagaga

SEQ ID NO: 3069271 - RNA, 16 nt, Human
ucccuauuagagaaga

SEQ ID NO: 3069272 - RNA, 18 nt, Human
acucaucuagguaaauua

SEQ ID NO: 3069273 - RNA, 16 nt, Human
acucaucuagguaaau

SEQ ID NO: 3069274 - RNA, 22 nt, Human
ucccucauccucauacccaccc

SEQ ID NO: 3069275 - RNA, 21 nt, Human
ucccucagucuggcccuuccu

SEQ ID NO: 3069276 - RNA, 20 nt, Human
ucccucagucuggcccuucc

SEQ ID NO: 3069277 - RNA, 22 nt, Human
acucauugaccugaggcccuuc

SEQ ID NO: 3069278 - RNA, 21 nt, Human
acuccaaagaaauguaaggga

SEQ ID NO: 3069279 - RNA, 22 nt, Human
ucccuuuccaaaugcccagcuu

SEQ ID NO: 3069280 - RNA, 18 nt, Human
ucccuuacgugaguccug

SEQ ID NO: 3069281 - RNA, 22 nt, Human
ucccuuacgugaguccuggcau

SEQ ID NO: 3069282 - RNA, 23 nt, Human
ucccugguggcagcucaccucuc

SEQ ID NO: 3069283 - RNA, 22 nt, Human
ucccuuugacgccaucccagcc

SEQ ID NO: 3069284 - RNA, 23 nt, Human
ucccuuugacgccaucccagccc

SEQ ID NO: 3069285 - RNA, 21 nt, Human
ucccuuugacgccaucccagc

SEQ ID NO: 3069286 - RNA, 14 nt, Human
uccuaggcauuugc

SEQ ID NO: 3069287 - RNA, 22 nt, Human
acucuuauaucuauauuuuaca

SEQ ID NO: 3069288 - RNA, 23 nt, Human
acucuuauaucuauauuuuacau

SEQ ID NO: 3069289 - RNA, 18 nt, Human
acucuccucugcugcugg

SEQ ID NO: 3069290 - RNA, 19 nt, Human
acucuccucugcugcuggc

SEQ ID NO: 3069291 - RNA, 16 nt, Human
acucuccucugcugcu

SEQ ID NO: 3069292 - RNA, 17 nt, Human
acucuccucugcugcug

SEQ ID NO: 3069293 - RNA, 18 nt, Human
acucgcgacaaugcaaac

SEQ ID NO: 3069294 - RNA, 19 nt, Human
uccuaggcauuugcugaau

SEQ ID NO: 3069295 - RNA, 20 nt, Human
acucgcgacaaugcaaacca

SEQ ID NO: 3069296 - RNA, 23 nt, Human
acucgcgacaaugcaaaccauca

SEQ ID NO: 3069297 - RNA, 17 nt, Human
acucgcgacaaugcaaa

SEQ ID NO: 3069298 - RNA, 20 nt, Human
uccucagaucuucugugggu

SEQ ID NO: 3069299 - RNA, 19 nt, Human
acucuuauugcccacgcug

SEQ ID NO: 3069300 - RNA, 16 nt, Human
acucuuauugcccacg

SEQ ID NO: 3069301 - RNA, 20 nt, Human
uccucaaaacuucagacaua

SEQ ID NO: 3069302 - RNA, 15 nt, Human
uccucccucccucuu

SEQ ID NO: 3069303 - RNA, 17 nt, Human
uccucccucccucuuuc

SEQ ID NO: 3069304 - RNA, 19 nt, Human
uccucccucccucuuuccc

SEQ ID NO: 3069305 - RNA, 12 nt, Human
uccucuccccag

SEQ ID NO: 3069306 - RNA, 14 nt, Human
uccucauacccacc

SEQ ID NO: 3069307 - RNA, 18 nt, Human
uccucauacccaccccca

SEQ ID NO: 3069308 - RNA, 20 nt, Human
acuguacagacagaaaaaac

SEQ ID NO: 3069309 - RNA, 15 nt, Human
acuguacaaaguaga

SEQ ID NO: 3069310 - RNA, 14 nt, Human
acuguacaaaguag

SEQ ID NO: 3069311 - RNA, 13 nt, Human
acuguacaaagua

SEQ ID NO: 3069312 - RNA, 19 nt, Human
acuguaauuugugauacaa

SEQ ID NO: 3069313 - RNA, 14 nt, Human
acuguacaugaaaa

SEQ ID NO: 3069314 - RNA, 13 nt, Human
acuguacaugaaa

SEQ ID NO: 3069315 - RNA, 23 nt, Human
acuguacaugaaaacacauuuuu

SEQ ID NO: 3069316 - RNA, 17 nt, Human
acugggagaaaugaaaa

SEQ ID NO: 3069317 - RNA, 13 nt, Human
ucgcuccuguguc

SEQ ID NO: 3069318 - RNA, 12 nt, Human
ucgcuccugugu

SEQ ID NO: 3069319 - RNA, 22 nt, Human
acugggcuuggggaccagagcu

SEQ ID NO: 3069320 - RNA, 16 nt, Human
acuguaaggcaaucau

SEQ ID NO: 3069321 - RNA, 18 nt, Human
acuggguacuuguggaca

SEQ ID NO: 3069322 - RNA, 23 nt, Human
acuggguacuuguggacacagcu

SEQ ID NO: 3069323 - RNA, 20 nt, Human
acuggguacuuguggacaca

SEQ ID NO: 3069324 - RNA, 19 nt, Human
acuggguacuuguggacac

SEQ ID NO: 3069325 - RNA, 14 nt, Human
ucgagcaugccugg

SEQ ID NO: 3069326 - RNA, 13 nt, Human
ucgaggacaggga

SEQ ID NO: 3069327 - RNA, 13 nt, Human
ucgcgacaaugca

SEQ ID NO: 3069328 - RNA, 17 nt, Human
ucgaggacagggaggug

SEQ ID NO: 3069329 - RNA, 14 nt, Human
ucgaggacagggag

SEQ ID NO: 3069330 - RNA, 13 nt, Human
ucgaacuggcugc

SEQ ID NO: 3069331 - RNA, 14 nt, Human
ucgaacuggcugca

SEQ ID NO: 3069332 - RNA, 15 nt, Human
ucgaacuggcugcaa

SEQ ID NO: 3069333 - RNA, 23 nt, Human
uccuuuagcgcccaguugggugg

SEQ ID NO: 3069334 - RNA, 15 nt, Human
uccuuucaccacaug

SEQ ID NO: 3069335 - RNA, 22 nt, Human
acuggauuaaacuuaaucuaaa

SEQ ID NO: 3069336 - RNA, 21 nt, Human
acuggcaaacagggccucugc

SEQ ID NO: 3069337 - RNA, 17 nt, Human
acuggcaaacagggccu

SEQ ID NO: 3069338 - RNA, 19 nt, Human
acuggcaaacagggccucu

SEQ ID NO: 3069339 - RNA, 20 nt, Human
acuggcaaacagggccucug

SEQ ID NO: 3069340 - RNA, 18 nt, Human
acugcuuccagugaggcu

SEQ ID NO: 3069341 - RNA, 21 nt, Human
acugcuuccagugaggcucug

SEQ ID NO: 3069342 - RNA, 22 nt, Human
acugcuuccagugaggcucugc

SEQ ID NO: 3069343 - RNA, 23 nt, Human
acugcuuccagugaggcucugcc

SEQ ID NO: 3069344 - RNA, 20 nt, Human
acugccuucucaacuccaaa

SEQ ID NO: 3069345 - RNA, 22 nt, Human
acugccuucucaacuccaaacu

SEQ ID NO: 3069346 - RNA, 22 nt, Human
acuggcugcaaaggguaucagg

SEQ ID NO: 3069347 - RNA, 18 nt, Human
acuggcucacccaguccu

SEQ ID NO: 3069348 - RNA, 22 nt, Human
acuggcacaguuuucugagaaa

SEQ ID NO: 3069349 - RNA, 21 nt, Human
acuggcacaguuuucugagaa

SEQ ID NO: 3069350 - RNA, 15 nt, Human
acuggcucacccagu

SEQ ID NO: 3069351 - RNA, 12 nt, Human
acuggcucaccc

SEQ ID NO: 3069352 - RNA, 13 nt, Human
uccuucagugccu

SEQ ID NO: 3069353 - RNA, 20 nt, Human
uccuucagugccuuauggaa

SEQ ID NO: 3069354 - RNA, 22 nt, Human
uccuucagugccuuauggaaca

SEQ ID NO: 3069355 - RNA, 11 nt, Human
uccuucagugc

SEQ ID NO: 3069356 - RNA, 13 nt, Human
uccuucagccuga

SEQ ID NO: 3069357 - RNA, 12 nt, Human
uccuucagugcc

SEQ ID NO: 3069358 - RNA, 14 nt, Human
acugaggaucagag

SEQ ID NO: 3069359 - RNA, 17 nt, Human
acugaggggaggggagc

SEQ ID NO: 3069360 - RNA, 22 nt, Human
acugaggggaggggagcauggg

SEQ ID NO: 3069361 - RNA, 15 nt, Human
uccucuccccagcaa

SEQ ID NO: 3069362 - RNA, 22 nt, Human
acugcaaccuccgccucuuggg

SEQ ID NO: 3069363 - RNA, 16 nt, Human
acugcaaccuccgccu

SEQ ID NO: 3069364 - RNA, 14 nt, Human
acugcaaccuccgc

SEQ ID NO: 3069365 - RNA, 13 nt, Human
acugcaaccuccg

SEQ ID NO: 3069366 - RNA, 21 nt, Human
acugaguacguugugcauuug

SEQ ID NO: 3069367 - RNA, 19 nt, Human
acugaguacguugugcauu

SEQ ID NO: 3069368 - RNA, 18 nt, Human
acugaguacguugugcau

SEQ ID NO: 3069369 - RNA, 16 nt, Human
acugagggggccugga

SEQ ID NO: 3069370 - RNA, 17 nt, Human
acugagggggccuggau

SEQ ID NO: 3069371 - RNA, 18 nt, Human
acugagggggccuggaug

SEQ ID NO: 3069372 - RNA, 23 nt, Human
acugaguacguugugcauuuggu

SEQ ID NO: 3069373 - RNA, 22 nt, Human
acugaguacguugugcauuugg

SEQ ID NO: 3069374 - RNA, 19 nt, Human
acugagggggccuggaugc

SEQ ID NO: 3069375 - RNA, 15 nt, Human
uccugcaggcagcca

SEQ ID NO: 3069376 - RNA, 16 nt, Human
uccugcaggcagccag

SEQ ID NO: 3069377 - RNA, 17 nt, Human
uccugcaggcagccagg

SEQ ID NO: 3069378 - RNA, 19 nt, Human
uccugcaggcagccaggcc

SEQ ID NO: 3069379 - RNA, 20 nt, Human
uccugcaggcagccaggcca

SEQ ID NO: 3069380 - RNA, 19 nt, Human
uccugccucagccucccaa

SEQ ID NO: 3069381 - RNA, 22 nt, Human
uccugcaggcagccaggccaca

SEQ ID NO: 3069382 - RNA, 20 nt, Human
uccugccucgaacuggcugc

SEQ ID NO: 3069383 - RNA, 17 nt, Human
uccugccucagccuccc

SEQ ID NO: 3069384 - RNA, 13 nt, Human
uccugcugcaguu

SEQ ID NO: 3069385 - RNA, 23 nt, Human
acugcagccucaaccuccugggc

SEQ ID NO: 3069386 - RNA, 13 nt, Human
acugcacuguuuu

SEQ ID NO: 3069387 - RNA, 22 nt, Human
acugcagccucaaccuccuggg

SEQ ID NO: 3069388 - RNA, 21 nt, Human
acugcagccucaaccuccugg

SEQ ID NO: 3069389 - RNA, 19 nt, Human
acugcagccucaaccuccu

SEQ ID NO: 3069390 - RNA, 24 nt, Human
uccugugucuugcaauggcagccu

SEQ ID NO: 3069391 - RNA, 23 nt, Human
uccugugucuugcaauggcagcc

SEQ ID NO: 3069392 - RNA, 14 nt, Human
uccugugugugcgc

SEQ ID NO: 3069393 - RNA, 13 nt, Human
uccugugugugcg

SEQ ID NO: 3069394 - RNA, 18 nt, Human
uccugugugugcgccuac

SEQ ID NO: 3069395 - RNA, 19 nt, Human
uccuguucccaugagauga

SEQ ID NO: 3069396 - RNA, 22 nt, Human
aaugugaaacuggauuaaacuu

SEQ ID NO: 3069397 - RNA, 14 nt, Human
aaugucacaggcag

SEQ ID NO: 3069398 - RNA, 13 nt, Human
aaugucacaggca

SEQ ID NO: 3069399 - RNA, 14 nt, Human
aauguauuuuuccu

SEQ ID NO: 3069400 - RNA, 19 nt, Human
uacauaaguaauucaagaa

SEQ ID NO: 3069401 - RNA, 17 nt, Human
uacauaaguaauucaag

SEQ ID NO: 3069402 - RNA, 16 nt, Human
uacauaaguaauucaa

SEQ ID NO: 3069403 - RNA, 15 nt, Human
uacauaaguaauuca

SEQ ID NO: 3069404 - RNA, 20 nt, Human
uacaguggggaaugaagaua

SEQ ID NO: 3069405 - RNA, 18 nt, Human
uacaguaucucagggccu

SEQ ID NO: 3069406 - RNA, 12 nt, Human
uacaguccuccc

SEQ ID NO: 3069407 - RNA, 15 nt, Human
uacaguccucccauc

SEQ ID NO: 3069408 - RNA, 17 nt, Human
uacaguccucccaucuc

SEQ ID NO: 3069409 - RNA, 18 nt, Human
uacaguccucccaucuca

SEQ ID NO: 3069410 - RNA, 13 nt, Human
aauguaagacaaa

SEQ ID NO: 3069411 - RNA, 15 nt, Human
aauguaagcucuacu

SEQ ID NO: 3069412 - RNA, 13 nt, Human
aauguaagcucua

SEQ ID NO: 3069413 - RNA, 17 nt, Human
aaugguuuucuugugug

SEQ ID NO: 3069414 - RNA, 18 nt, Human
aaugguuuucuugugugu

SEQ ID NO: 3069415 - RNA, 22 nt, Human
aaugguuuucuuguguguuuau

SEQ ID NO: 3069416 - RNA, 16 nt, Human
aaugguuuucuugugu

SEQ ID NO: 3069417 - RNA, 16 nt, Human
aaugguuuaaaugguc

SEQ ID NO: 3069418 - RNA, 22 nt, Human
uacagcaaggagauuuacaacu

SEQ ID NO: 3069419 - RNA, 23 nt, Human
aauguacagcaaggagauuuaca

SEQ ID NO: 3069420 - RNA, 21 nt, Human
aauguacagcaaggagauuua

SEQ ID NO: 3069421 - RNA, 18 nt, Human
aauguugacaugggacau

SEQ ID NO: 3069422 - RNA, 19 nt, Human
aauuaacaugaauauuuag

SEQ ID NO: 3069423 - RNA, 22 nt, Human
aauuaaauuuugaguucuacau

SEQ ID NO: 3069424 - RNA, 22 nt, Human
aauuaacuuuuauaaacuuuac

SEQ ID NO: 3069425 - RNA, 15 nt, Human
aauuaagagagucua

SEQ ID NO: 3069426 - RNA, 20 nt, Human
aauuaacuuuuauaaacuuu

SEQ ID NO: 3069427 - RNA, 18 nt, Human
aauuaacuuuuauaaacu

SEQ ID NO: 3069428 - RNA, 20 nt, Human
uacauuguacgaagaguauu

SEQ ID NO: 3069429 - RNA, 22 nt, Human
uacauuguacgaagaguauuuu

SEQ ID NO: 3069430 - RNA, 23 nt, Human
uacauuguacgaagaguauuuuu

SEQ ID NO: 3069431 - RNA, 17 nt, Human
uacauguacugauuacu

SEQ ID NO: 3069432 - RNA, 23 nt, Human
uacauggcuggagcuagaauuug

SEQ ID NO: 3069433 - RNA, 16 nt, Human
aauuaacuuuuauaaa

SEQ ID NO: 3069434 - RNA, 13 nt, Human
aauuaaguacuau

SEQ ID NO: 3069435 - RNA, 17 nt, Human
uaccauccccuguagag

SEQ ID NO: 3069436 - RNA, 19 nt, Human
uaccccaagacucccauga

SEQ ID NO: 3069437 - RNA, 17 nt, Human
uaccacuuuuguucuug

SEQ ID NO: 3069438 - RNA, 22 nt, Human
uacccuggcacuauaauguaag

SEQ ID NO: 3069439 - RNA, 20 nt, Human
uacccuggcacuauaaugua

SEQ ID NO: 3069440 - RNA, 16 nt, Human
uacccucauguucuua

SEQ ID NO: 3069441 - RNA, 15 nt, Human
uacccucauguucuu

SEQ ID NO: 3069442 - RNA, 20 nt, Human
uacccgggaagggggcuggg

SEQ ID NO: 3069443 - RNA, 13 nt, Human
uaauucauguugc

SEQ ID NO: 3069444 - RNA, 17 nt, Human
uaauuuaccugaagucu

SEQ ID NO: 3069445 - RNA, 18 nt, Human
uaauuuaccugaagucuu

SEQ ID NO: 3069446 - RNA, 16 nt, Human
uacaaaaacauggccu

SEQ ID NO: 3069447 - RNA, 16 nt, Human
uacaaaaacacagcaa

SEQ ID NO: 3069448 - RNA, 18 nt, Human
uacaaaaacacagcaagg

SEQ ID NO: 3069449 - RNA, 17 nt, Human
uacaaaaacacagcaag

SEQ ID NO: 3069450 - RNA, 20 nt, Human
uacaagcgugagccacugca

SEQ ID NO: 3069451 - RNA, 19 nt, Human
uacaagcgugagccacugc

SEQ ID NO: 3069452 - RNA, 18 nt, Human
uacaagcgugagccacug

SEQ ID NO: 3069453 - RNA, 16 nt, Human
uacaagcgugagccac

SEQ ID NO: 3069454 - RNA, 13 nt, Human
aaugaccuuucaa

SEQ ID NO: 3069455 - RNA, 14 nt, Human
aaugaccuuucaau

SEQ ID NO: 3069456 - RNA, 14 nt, Human
aaugcaaaccauca

SEQ ID NO: 3069457 - RNA, 16 nt, Human
aaugcaaaccaucauu

SEQ ID NO: 3069458 - RNA, 20 nt, Human
aaugaaugucagugugacug

SEQ ID NO: 3069459 - RNA, 21 nt, Human
aaugaaugucagugugacuga

SEQ ID NO: 3069460 - RNA, 18 nt, Human
aaugcacaaacagaggcc

SEQ ID NO: 3069461 - RNA, 22 nt, Human
aaugcaaaccaucauugaaauc

SEQ ID NO: 3069462 - RNA, 23 nt, Human
aaugcaaaccaucauugaaaucu

SEQ ID NO: 3069463 - RNA, 19 nt, Human
aaugcacaaacagaggccg

SEQ ID NO: 3069464 - RNA, 20 nt, Human
aaugcacaaacagaggccgc

SEQ ID NO: 3069465 - RNA, 13 nt, Human
aaugcacuuuguu

SEQ ID NO: 3069466 - RNA, 16 nt, Human
aaugcacuuuguucug

SEQ ID NO: 3069467 - RNA, 19 nt, Human
aaugcacuuuguucuggcu

SEQ ID NO: 3069468 - RNA, 20 nt, Human
aaugcacuuuguucuggcuc

SEQ ID NO: 3069469 - RNA, 23 nt, Human
uaauuaguuccucauuagcauuu

SEQ ID NO: 3069470 - RNA, 15 nt, Human
uaauguaagacaaau

SEQ ID NO: 3069471 - RNA, 17 nt, Human
uaauguaagcucuacug

SEQ ID NO: 3069472 - RNA, 16 nt, Human
uaauguaagcucuacu

SEQ ID NO: 3069473 - RNA, 17 nt, Human
uaauguaauaacuguga

SEQ ID NO: 3069474 - RNA, 15 nt, Human
uaaugucacaggcag

SEQ ID NO: 3069475 - RNA, 17 nt, Human
uaaugucacaggcaggu

SEQ ID NO: 3069476 - RNA, 16 nt, Human
uaaugucacaggcagg

SEQ ID NO: 3069477 - RNA, 23 nt, Human
uaaugugaaacuggauuaaacuu

SEQ ID NO: 3069478 - RNA, 22 nt, Human
uaaugugaaacuggauuaaacu

SEQ ID NO: 3069479 - RNA, 20 nt, Human
uaaugugaaacuggauuaaa

SEQ ID NO: 3069480 - RNA, 12 nt, Human
uaaugugaaacu

SEQ ID NO: 3069481 - RNA, 15 nt, Human
aaugaaugucagugu

SEQ ID NO: 3069482 - RNA, 14 nt, Human
aaugaaugucagug

SEQ ID NO: 3069483 - RNA, 14 nt, Human
aaugaaugaaacau

SEQ ID NO: 3069484 - RNA, 15 nt, Human
aaugaaugaaugaau

SEQ ID NO: 3069485 - RNA, 23 nt, Human
aaucuucugaacuuggcgcugcc

SEQ ID NO: 3069486 - RNA, 17 nt, Human
uaaucuuuaauuuuaca

SEQ ID NO: 3069487 - RNA, 22 nt, Human
uaauccaagcaaaugugaauca

SEQ ID NO: 3069488 - RNA, 18 nt, Human
uaaucagugugucuaaau

SEQ ID NO: 3069489 - RNA, 17 nt, Human
uaaucagugugucuaaa

SEQ ID NO: 3069490 - RNA, 21 nt, Human
uaauauugauaugcuuauaca

SEQ ID NO: 3069491 - RNA, 18 nt, Human
uaauacuugcuuuggaaa

SEQ ID NO: 3069492 - RNA, 21 nt, Human
uaauacaccacuacauucugu

SEQ ID NO: 3069493 - RNA, 22 nt, Human
uaauacaccacuacauucuguu

SEQ ID NO: 3069494 - RNA, 23 nt, Human
uaauacaccacuacauucuguua

SEQ ID NO: 3069495 - RNA, 20 nt, Human
aauacaguaucucagggccu

SEQ ID NO: 3069496 - RNA, 17 nt, Human
acaaaaaaauauauuua

SEQ ID NO: 3069497 - RNA, 13 nt, Human
acaaaaaaauaua

SEQ ID NO: 3069498 - RNA, 17 nt, Human
aauuuuuuugagacaga

SEQ ID NO: 3069499 - RNA, 20 nt, Human
acaaaaaaauauauuuaaug

SEQ ID NO: 3069500 - RNA, 16 nt, Human
acaaaaacacagcaag

SEQ ID NO: 3069501 - RNA, 13 nt, Human
acaaaaacauggc

SEQ ID NO: 3069502 - RNA, 22 nt, Human
aauuuuuuuaucgucacugcuu

SEQ ID NO: 3069503 - RNA, 19 nt, Human
aauuuuuucucuaggaaau

SEQ ID NO: 3069504 - RNA, 18 nt, Human
aauuuuuauuaaauuaug

SEQ ID NO: 3069505 - RNA, 17 nt, Human
aauuuuuauuaaauuau

SEQ ID NO: 3069506 - RNA, 19 nt, Human
aauuuuuauauuugaaaua

SEQ ID NO: 3069507 - RNA, 12 nt, Human
uagacagucccu

SEQ ID NO: 3069508 - RNA, 14 nt, Human
uagacagucccugc

SEQ ID NO: 3069509 - RNA, 15 nt, Human
uagaagucacacagu

SEQ ID NO: 3069510 - RNA, 18 nt, Human
uagaacucccuuucaaca

SEQ ID NO: 3069511 - RNA, 21 nt, Human
uacuucaaauccuugaagauu

SEQ ID NO: 3069512 - RNA, 19 nt, Human
uagaagucuuagauguaua

SEQ ID NO: 3069513 - RNA, 18 nt, Human
uagaagucuuagauguau

SEQ ID NO: 3069514 - RNA, 17 nt, Human
uagaagucuuagaugua

SEQ ID NO: 3069515 - RNA, 16 nt, Human
uagaagucuuagaugu

SEQ ID NO: 3069516 - RNA, 16 nt, Human
uagaagucacacagua

SEQ ID NO: 3069517 - RNA, 23 nt, Human
uagaagucacauuccugaacagg

SEQ ID NO: 3069518 - RNA, 16 nt, Human
uagacaauuuauuaug

SEQ ID NO: 3069519 - RNA, 21 nt, Human
uagacagagucucacuguugc

SEQ ID NO: 3069520 - RNA, 18 nt, Human
acaagcacuaaacaaaga

SEQ ID NO: 3069521 - RNA, 17 nt, Human
acaagagcccaggccuc

SEQ ID NO: 3069522 - RNA, 12 nt, Human
acaagccacccc

SEQ ID NO: 3069523 - RNA, 21 nt, Human
acaagcgugagccacugcacc

SEQ ID NO: 3069524 - RNA, 20 nt, Human
acaagcgugagccacugcac

SEQ ID NO: 3069525 - RNA, 13 nt, Human
acaagcugcaccc

SEQ ID NO: 3069526 - RNA, 18 nt, Human
acaagcgugagccacugc

SEQ ID NO: 3069527 - RNA, 15 nt, Human
acaacaacaaaauga

SEQ ID NO: 3069528 - RNA, 12 nt, Human
acaacacucaca

SEQ ID NO: 3069529 - RNA, 22 nt, Human
acaagaaaugaaagcagggacu

SEQ ID NO: 3069530 - RNA, 21 nt, Human
uagcaugucgucaaagcugaa

SEQ ID NO: 3069531 - RNA, 18 nt, Human
uagcaugucgucaaagcu

SEQ ID NO: 3069532 - RNA, 24 nt, Human
uagcacagacccugcccugugggc

SEQ ID NO: 3069533 - RNA, 16 nt, Human
uagcacagacccugcc

SEQ ID NO: 3069534 - RNA, 17 nt, Human
uagcacagacccugccc

SEQ ID NO: 3069535 - RNA, 18 nt, Human
uagcacagacccugcccu

SEQ ID NO: 3069536 - RNA, 19 nt, Human
uagcacagacccugcccug

SEQ ID NO: 3069537 - RNA, 22 nt, Human
uagauuuuagacccuauugcug

SEQ ID NO: 3069538 - RNA, 16 nt, Human
uagaugcaguucugaa

SEQ ID NO: 3069539 - RNA, 17 nt, Human
uagaugcaguucugaag

SEQ ID NO: 3069540 - RNA, 19 nt, Human
uagaugcaguucugaagaa

SEQ ID NO: 3069541 - RNA, 20 nt, Human
aauuugaaacacuuugcaua

SEQ ID NO: 3069542 - RNA, 15 nt, Human
aauuugaaacacuuu

SEQ ID NO: 3069543 - RNA, 16 nt, Human
aauuugauaugugaac

SEQ ID NO: 3069544 - RNA, 18 nt, Human
aauuugauaugugaacag

SEQ ID NO: 3069545 - RNA, 15 nt, Human
aauuugauaugugaa

SEQ ID NO: 3069546 - RNA, 19 nt, Human
aauuugauaugugaacagu

SEQ ID NO: 3069547 - RNA, 14 nt, Human
uacuucaaauccuu

SEQ ID NO: 3069548 - RNA, 19 nt, Human
uacuucaaauccuugaaga

SEQ ID NO: 3069549 - RNA, 21 nt, Human
aauuucuaaaucuccaaaaua

SEQ ID NO: 3069550 - RNA, 13 nt, Human
aauuucuaaaucu

SEQ ID NO: 3069551 - RNA, 19 nt, Human
aauuucucccagucauuua

SEQ ID NO: 3069552 - RNA, 20 nt, Human
aauuucucccagucauuuaa

SEQ ID NO: 3069553 - RNA, 17 nt, Human
aauuuagaaauauaauu

SEQ ID NO: 3069554 - RNA, 23 nt, Human
aauugugugaaagguacuucaaa

SEQ ID NO: 3069555 - RNA, 22 nt, Human
aauuguuuggggaugagaaagg

SEQ ID NO: 3069556 - RNA, 13 nt, Human
aauuuaaaagucu

SEQ ID NO: 3069557 - RNA, 19 nt, Human
aauuuacauacucugcuua

SEQ ID NO: 3069558 - RNA, 15 nt, Human
aauuuacauacucug

SEQ ID NO: 3069559 - RNA, 16 nt, Human
aauuuaaauagcuuuu

SEQ ID NO: 3069560 - RNA, 15 nt, Human
aauuuaaauagcuuu

SEQ ID NO: 3069561 - RNA, 14 nt, Human
aauucuuucauuuu

SEQ ID NO: 3069562 - RNA, 14 nt, Human
uacguacacauuuu

SEQ ID NO: 3069563 - RNA, 15 nt, Human
uacguacacauuuua

SEQ ID NO: 3069564 - RNA, 16 nt, Human
aauugacccacaagaa

SEQ ID NO: 3069565 - RNA, 19 nt, Human
aauugacccacaagaaaug

SEQ ID NO: 3069566 - RNA, 13 nt, Human
aauugacccacaa

SEQ ID NO: 3069567 - RNA, 21 nt, Human
aauucuugaaggaaaaugaua

SEQ ID NO: 3069568 - RNA, 16 nt, Human
aauucuugaaggaaaa

SEQ ID NO: 3069569 - RNA, 15 nt, Human
aauucuugaaggaaa

SEQ ID NO: 3069570 - RNA, 22 nt, Human
aauucuucuccacuuucuagcc

SEQ ID NO: 3069571 - RNA, 21 nt, Human
aauucuugccaaauauaaaua

SEQ ID NO: 3069572 - RNA, 20 nt, Human
aauucuugcaaaguaucccu

SEQ ID NO: 3069573 - RNA, 14 nt, Human
aauucuugcaaagu

SEQ ID NO: 3069574 - RNA, 13 nt, Human
aauucuuaaauau

SEQ ID NO: 3069575 - RNA, 21 nt, Human
uacucugugucagguggggca

SEQ ID NO: 3069576 - RNA, 20 nt, Human
uacucuuauaucuauauuuu

SEQ ID NO: 3069577 - RNA, 22 nt, Human
uacucuuauaucuauauuuuac

SEQ ID NO: 3069578 - RNA, 14 nt, Human
uacgucugacaggc

SEQ ID NO: 3069579 - RNA, 13 nt, Human
uacguugugcauu

SEQ ID NO: 3069580 - RNA, 16 nt, Human
uacuauaauuuaccug

SEQ ID NO: 3069581 - RNA, 16 nt, Human
uacuauguaucaauga

SEQ ID NO: 3069582 - RNA, 19 nt, Human
acaguucggugagcuacaa

SEQ ID NO: 3069583 - RNA, 22 nt, Human
acaguucggugagcuacaaaug

SEQ ID NO: 3069584 - RNA, 23 nt, Human
acaguucggugagcuacaaaugc

SEQ ID NO: 3069585 - RNA, 16 nt, Human
acaguucucuccuucu

SEQ ID NO: 3069586 - RNA, 20 nt, Human
acaguucaauucucauuugu

SEQ ID NO: 3069587 - RNA, 20 nt, Human
acaguuacucagaauucucu

SEQ ID NO: 3069588 - RNA, 13 nt, Human
acaguuacucaga

SEQ ID NO: 3069589 - RNA, 24 nt, Human
uauucucuccuguaccucuugagc

SEQ ID NO: 3069590 - RNA, 20 nt, Human
uauucucuccuguaccucuu

SEQ ID NO: 3069591 - RNA, 18 nt, Human
uauucucuccuguaccuc

SEQ ID NO: 3069592 - RNA, 17 nt, Human
acaguucucuccuucuu

SEQ ID NO: 3069593 - RNA, 16 nt, Human
uauucuguuggccagu

SEQ ID NO: 3069594 - RNA, 15 nt, Human
uauucuuauuuaaug

SEQ ID NO: 3069595 - RNA, 19 nt, Human
uauuuaaugauaaguaaau

SEQ ID NO: 3069596 - RNA, 14 nt, Human
uauuuaauucaugu

SEQ ID NO: 3069597 - RNA, 23 nt, Human
uauuuaauuuuuuugagacagag

SEQ ID NO: 3069598 - RNA, 18 nt, Human
uauuuacuucuuauacau

SEQ ID NO: 3069599 - RNA, 19 nt, Human
uauuuaguguucauaaaua

SEQ ID NO: 3069600 - RNA, 13 nt, Human
uauuuauuuaaau

SEQ ID NO: 3069601 - RNA, 14 nt, Human
uauuuauuuaaauu

SEQ ID NO: 3069602 - RNA, 18 nt, Human
uauuuauuuuaauaaugu

SEQ ID NO: 3069603 - RNA, 14 nt, Human
uauuuauuuuaaua

SEQ ID NO: 3069604 - RNA, 16 nt, Human
uauuuauuuuaauaau

SEQ ID NO: 3069605 - RNA, 13 nt, Human
uauugucaaagug

SEQ ID NO: 3069606 - RNA, 17 nt, Human
uauugucaaagugguga

SEQ ID NO: 3069607 - RNA, 17 nt, Human
uauuguagcauccugga

SEQ ID NO: 3069608 - RNA, 18 nt, Human
uauuguagcauccuggaa

SEQ ID NO: 3069609 - RNA, 20 nt, Human
uauuguagcauccuggaaua

SEQ ID NO: 3069610 - RNA, 21 nt, Human
uauuguagcauccuggaauau

SEQ ID NO: 3069611 - RNA, 21 nt, Human
uauuuaaugaaagacuguaca

SEQ ID NO: 3069612 - RNA, 15 nt, Human
uauuuaaugaaagac

SEQ ID NO: 3069613 - RNA, 14 nt, Human
uauuuaauagguuu

SEQ ID NO: 3069614 - RNA, 17 nt, Human
uauuuaaccucuaaauu

SEQ ID NO: 3069615 - RNA, 18 nt, Human
uauuuaaccucuaaauuc

SEQ ID NO: 3069616 - RNA, 17 nt, Human
uauugucuagugaaacu

SEQ ID NO: 3069617 - RNA, 19 nt, Human
uauguuuuaagaggcaggg

SEQ ID NO: 3069618 - RNA, 17 nt, Human
uauguuuuaagaggcag

SEQ ID NO: 3069619 - RNA, 22 nt, Human
uauuaaaaaucucaaauuucua

SEQ ID NO: 3069620 - RNA, 20 nt, Human
uauuaaaaaucucaaauuuc

SEQ ID NO: 3069621 - RNA, 18 nt, Human
uauuaaaaaucucaaauu

SEQ ID NO: 3069622 - RNA, 16 nt, Human
uauuaaaaaucucaaa

SEQ ID NO: 3069623 - RNA, 23 nt, Human
uauuaaaaaucucaaauuucuaa

SEQ ID NO: 3069624 - RNA, 12 nt, Human
uauuaaaacuca

SEQ ID NO: 3069625 - RNA, 23 nt, Human
uauuacaguggggaaugaagaua

SEQ ID NO: 3069626 - RNA, 14 nt, Human
uauucauaauuauu

SEQ ID NO: 3069627 - RNA, 23 nt, Human
uauucauagcagcuuauucacaa

SEQ ID NO: 3069628 - RNA, 16 nt, Human
uauucaggagaguaga

SEQ ID NO: 3069629 - RNA, 18 nt, Human
uauucaggaagcucaggg

SEQ ID NO: 3069630 - RNA, 22 nt, Human
uauucaggaagcucagggccug

SEQ ID NO: 3069631 - RNA, 16 nt, Human
uauucaggaagcucag

SEQ ID NO: 3069632 - RNA, 16 nt, Human
uauuaccacagacaua

SEQ ID NO: 3069633 - RNA, 15 nt, Human
uauuagaauaccaca

SEQ ID NO: 3069634 - RNA, 12 nt, Human
uauuagagaaga

SEQ ID NO: 3069635 - RNA, 20 nt, Human
acagugaaagaaaauaacaa

SEQ ID NO: 3069636 - RNA, 17 nt, Human
acagucucaggaaauca

SEQ ID NO: 3069637 - RNA, 21 nt, Human
acaguccuuaccagcagagca

SEQ ID NO: 3069638 - RNA, 22 nt, Human
acaguccuuaccagcagagcac

SEQ ID NO: 3069639 - RNA, 16 nt, Human
acagucucaggaaauc

SEQ ID NO: 3069640 - RNA, 15 nt, Human
acagucucaggaaau

SEQ ID NO: 3069641 - RNA, 14 nt, Human
acagucucaggaaa

SEQ ID NO: 3069642 - RNA, 13 nt, Human
acagucucaggaa

SEQ ID NO: 3069643 - RNA, 21 nt, Human
acaguuaccucugccucagaa

SEQ ID NO: 3069644 - RNA, 15 nt, Human
acaguuaagagaaau

SEQ ID NO: 3069645 - RNA, 14 nt, Human
acagugagacucug

SEQ ID NO: 3069646 - RNA, 18 nt, Human
acagugagacucugucuc

SEQ ID NO: 3069647 - RNA, 12 nt, Human
acagucccugcc

SEQ ID NO: 3069648 - RNA, 13 nt, Human
acagucccugcca

SEQ ID NO: 3069649 - RNA, 19 nt, Human
acaguauuacuucugcuac

SEQ ID NO: 3069650 - RNA, 17 nt, Human
acaguauuacuucugcu

SEQ ID NO: 3069651 - RNA, 16 nt, Human
acaguauuacuucugc

SEQ ID NO: 3069652 - RNA, 15 nt, Human
acaguauuacuucug

SEQ ID NO: 3069653 - RNA, 15 nt, Human
acagucccugccaau

SEQ ID NO: 3069654 - RNA, 13 nt, Human
acaguccucccau

SEQ ID NO: 3069655 - RNA, 14 nt, Human
acaguccucccauc

SEQ ID NO: 3069656 - RNA, 15 nt, Human
acaguccucccaucu

SEQ ID NO: 3069657 - RNA, 18 nt, Human
acaguccuuaccagcaga

SEQ ID NO: 3069658 - RNA, 20 nt, Human
acaguccuuaccagcagagc

SEQ ID NO: 3069659 - RNA, 17 nt, Human
acaguccucccaucuca

SEQ ID NO: 3069660 - RNA, 17 nt, Human
acaggcugggcuucagu

SEQ ID NO: 3069661 - RNA, 14 nt, Human
acaggcugggcuuc

SEQ ID NO: 3069662 - RNA, 21 nt, Human
acaggcugggcuucaguggca

SEQ ID NO: 3069663 - RNA, 20 nt, Human
acagggcacaccgggcacuc

SEQ ID NO: 3069664 - RNA, 12 nt, Human
acaggcugggcu

SEQ ID NO: 3069665 - RNA, 22 nt, Human
acagguuuuccugaagaauuga

SEQ ID NO: 3069666 - RNA, 22 nt, Human
acagggcacaccgggcacucag

SEQ ID NO: 3069667 - RNA, 21 nt, Human
acaguauggcagcuuuccuca

SEQ ID NO: 3069668 - RNA, 16 nt, Human
uauauugauccagaaa

SEQ ID NO: 3069669 - RNA, 14 nt, Human
acagacuggaagca

SEQ ID NO: 3069670 - RNA, 18 nt, Human
acagacccugcccugugg

SEQ ID NO: 3069671 - RNA, 20 nt, Human
acagacccugcccugugggc

SEQ ID NO: 3069672 - RNA, 17 nt, Human
acagacccugcccugug

SEQ ID NO: 3069673 - RNA, 16 nt, Human
acagacccugcccugu

SEQ ID NO: 3069674 - RNA, 11 nt, Human
acacuccuuca

SEQ ID NO: 3069675 - RNA, 23 nt, Human
acagacacaggcccggcuccagg

SEQ ID NO: 3069676 - RNA, 14 nt, Human
uauauuuacaaaug

SEQ ID NO: 3069677 - RNA, 15 nt, Human
uauauuuacaaaugg

SEQ ID NO: 3069678 - RNA, 18 nt, Human
uaucaaguauuauaccuu

SEQ ID NO: 3069679 - RNA, 21 nt, Human
uaucaaguauuauaccuuuuu

SEQ ID NO: 3069680 - RNA, 18 nt, Human
uaucacccagaagaaaau

SEQ ID NO: 3069681 - RNA, 14 nt, Human
uaucuaguaugaaa

SEQ ID NO: 3069682 - RNA, 16 nt, Human
uaucuaguaugaaauu

SEQ ID NO: 3069683 - RNA, 17 nt, Human
uaucuaguaugaaauua

SEQ ID NO: 3069684 - RNA, 19 nt, Human
uaucuagauacuguaucau

SEQ ID NO: 3069685 - RNA, 16 nt, Human
uaucucccccagcccc

SEQ ID NO: 3069686 - RNA, 18 nt, Human
uaucucccccagccccau

SEQ ID NO: 3069687 - RNA, 17 nt, Human
uaucucccccagcccca

SEQ ID NO: 3069688 - RNA, 16 nt, Human
uaucuagauacuguau

SEQ ID NO: 3069689 - RNA, 15 nt, Human
uaucuagauacugua

SEQ ID NO: 3069690 - RNA, 21 nt, Human
acagagugagacucugucuca

SEQ ID NO: 3069691 - RNA, 16 nt, Human
acagagcuacacaggg

SEQ ID NO: 3069692 - RNA, 20 nt, Human
acagagcccacgcccccacu

SEQ ID NO: 3069693 - RNA, 22 nt, Human
acagacuggaagcacagcuuca

SEQ ID NO: 3069694 - RNA, 14 nt, Human
uaucuugaagacuu

SEQ ID NO: 3069695 - RNA, 18 nt, Human
acagaguuuucacucuua

SEQ ID NO: 3069696 - RNA, 20 nt, Human
acagaguuuucacucuuauu

SEQ ID NO: 3069697 - RNA, 14 nt, Human
acagcaggcugcca

SEQ ID NO: 3069698 - RNA, 21 nt, Human
uaugagcuuccuucugugaaa

SEQ ID NO: 3069699 - RNA, 13 nt, Human
uaugaggcauuug

SEQ ID NO: 3069700 - RNA, 23 nt, Human
uaugaggcauuuguuugaacuga

SEQ ID NO: 3069701 - RNA, 18 nt, Human
uaugagcuuccuucugug

SEQ ID NO: 3069702 - RNA, 15 nt, Human
uaucuugaauaaugu

SEQ ID NO: 3069703 - RNA, 15 nt, Human
uaucuugaagacuuu

SEQ ID NO: 3069704 - RNA, 23 nt, Human
uaugaucacggcucacugcagcc

SEQ ID NO: 3069705 - RNA, 21 nt, Human
uaugaucacggcucacugcag

SEQ ID NO: 3069706 - RNA, 14 nt, Human
uaugaucacggcuc

SEQ ID NO: 3069707 - RNA, 14 nt, Human
uauggccuguggau

SEQ ID NO: 3069708 - RNA, 22 nt, Human
uauggccugugagcuaggaauu

SEQ ID NO: 3069709 - RNA, 16 nt, Human
uauggcuauaggugcu

SEQ ID NO: 3069710 - RNA, 22 nt, Human
uauggcccuggccuagcauacg

SEQ ID NO: 3069711 - RNA, 19 nt, Human
uaugcucugcauguuacau

SEQ ID NO: 3069712 - RNA, 14 nt, Human
uaugcucugcaugu

SEQ ID NO: 3069713 - RNA, 18 nt, Human
uaugcucugcauguuaca

SEQ ID NO: 3069714 - RNA, 16 nt, Human
uauggcuuuugugcau

SEQ ID NO: 3069715 - RNA, 10 nt, Human
uaugggagag

SEQ ID NO: 3069716 - RNA, 17 nt, Human
uauggcuauaggugcua

SEQ ID NO: 3069717 - RNA, 14 nt, Human
acagcuaacaugga

SEQ ID NO: 3069718 - RNA, 15 nt, Human
acagcuaacauggaa

SEQ ID NO: 3069719 - RNA, 17 nt, Human
acagcuaacauggaagu

SEQ ID NO: 3069720 - RNA, 15 nt, Human
acagcuccaagaauu

SEQ ID NO: 3069721 - RNA, 13 nt, Human
uauauaucaaaua

SEQ ID NO: 3069722 - RNA, 23 nt, Human
uauauauuuuuuucugaaauuuc

SEQ ID NO: 3069723 - RNA, 20 nt, Human
uauauauuuuuuucugaaau

SEQ ID NO: 3069724 - RNA, 21 nt, Human
uauauauuuuuuucugaaauu

SEQ ID NO: 3069725 - RNA, 22 nt, Human
uauauauuuuuuucugaaauuu

SEQ ID NO: 3069726 - RNA, 16 nt, Human
uauauccuuucuaaca

SEQ ID NO: 3069727 - RNA, 19 nt, Human
acacucauugaccugaggc

SEQ ID NO: 3069728 - RNA, 21 nt, Human
acacucauugaccugaggccc

SEQ ID NO: 3069729 - RNA, 23 nt, Human
acacucauugaccugaggcccuu

SEQ ID NO: 3069730 - RNA, 20 nt, Human
uauagccuaggugacagagu

SEQ ID NO: 3069731 - RNA, 18 nt, Human
uauagccuaggugacaga

SEQ ID NO: 3069732 - RNA, 14 nt, Human
uauaggaauugacc

SEQ ID NO: 3069733 - RNA, 13 nt, Human
uauaggaauugac

SEQ ID NO: 3069734 - RNA, 12 nt, Human
uauaggaauuga

SEQ ID NO: 3069735 - RNA, 23 nt, Human
uauaggugcuacaaaaacacagc

SEQ ID NO: 3069736 - RNA, 20 nt, Human
uauaggugcuacaaaaacac

SEQ ID NO: 3069737 - RNA, 21 nt, Human
uauaggugcuacaaaaacaca

SEQ ID NO: 3069738 - RNA, 18 nt, Human
uauaacaaugcuguauuu

SEQ ID NO: 3069739 - RNA, 21 nt, Human
uauaauuuaccugaagucuuu

SEQ ID NO: 3069740 - RNA, 14 nt, Human
uauaauuuugugaa

SEQ ID NO: 3069741 - RNA, 20 nt, Human
uauaaccaguguuguggauu

SEQ ID NO: 3069742 - RNA, 14 nt, Human
uauacauuugauaa

SEQ ID NO: 3069743 - RNA, 14 nt, Human
uauacauaaacaag

SEQ ID NO: 3069744 - RNA, 13 nt, Human
uauacauaaacaa

SEQ ID NO: 3069745 - RNA, 12 nt, Human
uauaaaagccug

SEQ ID NO: 3069746 - RNA, 17 nt, Human
uauaaaagccuguuuaa

SEQ ID NO: 3069747 - RNA, 14 nt, Human
uauaaaagccuguu

SEQ ID NO: 3069748 - RNA, 21 nt, Human
uauaaaauaauuuuuauauuu

SEQ ID NO: 3069749 - RNA, 22 nt, Human
uauaaaauaauuuuuauauuug

SEQ ID NO: 3069750 - RNA, 20 nt, Human
acacaugcaaggucauuuuu

SEQ ID NO: 3069751 - RNA, 19 nt, Human
acacaugcaaggucauuuu

SEQ ID NO: 3069752 - RNA, 18 nt, Human
acacaugcaaggucauuu

SEQ ID NO: 3069753 - RNA, 22 nt, Human
acacaucagcuugcccuguuaa

SEQ ID NO: 3069754 - RNA, 21 nt, Human
acacaugcaaggucauuuuuu

SEQ ID NO: 3069755 - RNA, 21 nt, Human
acacccagcccacuucugcca

SEQ ID NO: 3069756 - RNA, 20 nt, Human
acacccagcccacuucugcc

SEQ ID NO: 3069757 - RNA, 19 nt, Human
acacccagcccacuucugc

SEQ ID NO: 3069758 - RNA, 12 nt, Human
acacccugugau

SEQ ID NO: 3069759 - RNA, 18 nt, Human
acacccugugauggggcc

SEQ ID NO: 3069760 - RNA, 11 nt, Human
acacccuguga

SEQ ID NO: 3069761 - RNA, 19 nt, Human
acaccauaagcuacugcca

SEQ ID NO: 3069762 - RNA, 15 nt, Human
uaguuuuauaugcuu

SEQ ID NO: 3069763 - RNA, 16 nt, Human
uaguuuuauaugcuuc

SEQ ID NO: 3069764 - RNA, 20 nt, Human
uaguuccucauuagcauuuu

SEQ ID NO: 3069765 - RNA, 19 nt, Human
acaagcugcacccucaggc

SEQ ID NO: 3069766 - RNA, 21 nt, Human
acaagcugcacccucaggcag

SEQ ID NO: 3069767 - RNA, 22 nt, Human
acaagcugcacccucaggcagg

SEQ ID NO: 3069768 - RNA, 23 nt, Human
acaagcugcacccucaggcaggu

SEQ ID NO: 3069769 - RNA, 21 nt, Human
uagucaggugccucaagagaa

SEQ ID NO: 3069770 - RNA, 22 nt, Human
uagugagcagucaggaaagaga

SEQ ID NO: 3069771 - RNA, 22 nt, Human
aaguaaaaacaaagaaauuaug

SEQ ID NO: 3069772 - RNA, 18 nt, Human
aaguaaaaccacagcagu

SEQ ID NO: 3069773 - RNA, 17 nt, Human
aaguaaaaccacagcag

SEQ ID NO: 3069774 - RNA, 21 nt, Human
guuucuagcaugaagacagag

SEQ ID NO: 3069775 - RNA, 14 nt, Human
aaguaaaaccacag

SEQ ID NO: 3069776 - RNA, 16 nt, Human
aaguaaaaccacagca

SEQ ID NO: 3069777 - RNA, 15 nt, Human
aaguaaaaccacagc

SEQ ID NO: 3069778 - RNA, 21 nt, Human
aagggugaugggaaagcauug

SEQ ID NO: 3069779 - RNA, 13 nt, Human
aagggcccagaga

SEQ ID NO: 3069780 - RNA, 15 nt, Human
aagggcccagagagg

SEQ ID NO: 3069781 - RNA, 16 nt, Human
aaggguaucuggugac

SEQ ID NO: 3069782 - RNA, 19 nt, Human
aaggguaucaggugcugcc

SEQ ID NO: 3069783 - RNA, 14 nt, Human
aaggggcaguggug

SEQ ID NO: 3069784 - RNA, 17 nt, Human
aaggguaucaggugcug

SEQ ID NO: 3069785 - RNA, 13 nt, Human
guuugcuaaguga

SEQ ID NO: 3069786 - RNA, 17 nt, Human
guuugccucugccucug

SEQ ID NO: 3069787 - RNA, 18 nt, Human
guuucugccgcagcccug

SEQ ID NO: 3069788 - RNA, 22 nt, Human
guuucugccgcagcccugcaga

SEQ ID NO: 3069789 - RNA, 16 nt, Human
guuuuacugcagcuuu

SEQ ID NO: 3069790 - RNA, 18 nt, Human
guuuuacugcagcuuugu

SEQ ID NO: 3069791 - RNA, 15 nt, Human
guuuuacugcagcuu

SEQ ID NO: 3069792 - RNA, 15 nt, Human
guuuuauaauuuugu

SEQ ID NO: 3069793 - RNA, 22 nt, Human
guuuuauaauuuugugaagcaa

SEQ ID NO: 3069794 - RNA, 15 nt, Human
guuuucugagaaaga

SEQ ID NO: 3069795 - RNA, 16 nt, Human
guuuuaagaggcaggg

SEQ ID NO: 3069796 - RNA, 14 nt, Human
guuuuaagaggcag

SEQ ID NO: 3069797 - RNA, 13 nt, Human
aaguauucuaaau

SEQ ID NO: 3069798 - RNA, 15 nt, Human
aaguauucuaaauuu

SEQ ID NO: 3069799 - RNA, 20 nt, Human
aaguacuucuccacccugcu

SEQ ID NO: 3069800 - RNA, 23 nt, Human
aaguacuucuccacccugcucuc

SEQ ID NO: 3069801 - RNA, 22 nt, Human
aaguacuucuccacccugcucu

SEQ ID NO: 3069802 - RNA, 23 nt, Human
aaguauguuagugcaaauuguca

SEQ ID NO: 3069803 - RNA, 21 nt, Human
aaguauguuagugcaaauugu

SEQ ID NO: 3069804 - RNA, 15 nt, Human
aaguacuauguauca

SEQ ID NO: 3069805 - RNA, 22 nt, Human
guuuucugagaaagacuauuca

SEQ ID NO: 3069806 - RNA, 17 nt, Human
guuuucugagaaagacu

SEQ ID NO: 3069807 - RNA, 16 nt, Human
guuuucugagaaagac

SEQ ID NO: 3069808 - RNA, 16 nt, Human
aaguacuauguaucaa

SEQ ID NO: 3069809 - RNA, 15 nt, Human
aaguacuggagaaaa

SEQ ID NO: 3069810 - RNA, 21 nt, Human
aaguacuucuccacccugcuc

SEQ ID NO: 3069811 - RNA, 13 nt, Human
aagucacacagug

SEQ ID NO: 3069812 - RNA, 20 nt, Human
aagucacauuccugaacagg

SEQ ID NO: 3069813 - RNA, 18 nt, Human
aaguauucuuauuuaaug

SEQ ID NO: 3069814 - RNA, 24 nt, Human
aagucacacaguauuacuucugcu

SEQ ID NO: 3069815 - RNA, 21 nt, Human
aagucaagugaaaaaggagga

SEQ ID NO: 3069816 - RNA, 15 nt, Human
guuuuuuuuuaaaga

SEQ ID NO: 3069817 - RNA, 23 nt, Human
guuuuuuuuuaaaaaagaaacau

SEQ ID NO: 3069818 - RNA, 16 nt, Human
guuuuugucuuaaaaa

SEQ ID NO: 3069819 - RNA, 17 nt, Human
aagucuuagauguauau

SEQ ID NO: 3069820 - RNA, 19 nt, Human
aagucuuagauguauauau

SEQ ID NO: 3069821 - RNA, 18 nt, Human
aagucuuagauguauaua

SEQ ID NO: 3069822 - RNA, 18 nt, Human
guuuuucuaggccugggg

SEQ ID NO: 3069823 - RNA, 17 nt, Human
guugggcuggugucacc

SEQ ID NO: 3069824 - RNA, 15 nt, Human
guugggcugguguca

SEQ ID NO: 3069825 - RNA, 23 nt, Human
guuggcugggggccucagugcca

SEQ ID NO: 3069826 - RNA, 15 nt, Human
guugcccaggcuggc

SEQ ID NO: 3069827 - RNA, 16 nt, Human
guugcccaggcuggcg

SEQ ID NO: 3069828 - RNA, 14 nt, Human
aaggaugcccaaag

SEQ ID NO: 3069829 - RNA, 22 nt, Human
aaggaugcacagaguuguuaca

SEQ ID NO: 3069830 - RNA, 24 nt, Human
aaggaugcacagaguuguuacauu

SEQ ID NO: 3069831 - RNA, 14 nt, Human
aaggccccgcccag

SEQ ID NO: 3069832 - RNA, 16 nt, Human
aaggccccgcccaggc

SEQ ID NO: 3069833 - RNA, 19 nt, Human
aaggccccgcccaggcuua

SEQ ID NO: 3069834 - RNA, 15 nt, Human
aaggcuaccuuugua

SEQ ID NO: 3069835 - RNA, 14 nt, Human
guugcccaggcugg

SEQ ID NO: 3069836 - RNA, 13 nt, Human
aaggcuaccuuug

SEQ ID NO: 3069837 - RNA, 12 nt, Human
aaggaaaaugau

SEQ ID NO: 3069838 - RNA, 14 nt, Human
aaggaaaaugauac

SEQ ID NO: 3069839 - RNA, 15 nt, Human
aaggaaacccagcuc

SEQ ID NO: 3069840 - RNA, 22 nt, Human
aaggagcaagucagaauagaaa

SEQ ID NO: 3069841 - RNA, 17 nt, Human
aaggagauuuacaacug

SEQ ID NO: 3069842 - RNA, 18 nt, Human
aaggagauuuacaacugg

SEQ ID NO: 3069843 - RNA, 11 nt, Human
aaggauaaagu

SEQ ID NO: 3069844 - RNA, 11 nt, Human
aaggauccuga

SEQ ID NO: 3069845 - RNA, 12 nt, Human
aaggauccugag

SEQ ID NO: 3069846 - RNA, 14 nt, Human
aaggaucuucaucu

SEQ ID NO: 3069847 - RNA, 20 nt, Human
aaggauccugagccagauuu

SEQ ID NO: 3069848 - RNA, 22 nt, Human
aaggauccugagccagauuuca

SEQ ID NO: 3069849 - RNA, 23 nt, Human
aaggauaaaguugguaaaccuuu

SEQ ID NO: 3069850 - RNA, 21 nt, Human
aaggauaaaguugguaaaccu

SEQ ID NO: 3069851 - RNA, 20 nt, Human
aaggaggaagagaaaaaaua

SEQ ID NO: 3069852 - RNA, 13 nt, Human
guguuuauuuaua

SEQ ID NO: 3069853 - RNA, 13 nt, Human
guguuuauuguca

SEQ ID NO: 3069854 - RNA, 11 nt, Human
aagcucccagg

SEQ ID NO: 3069855 - RNA, 12 nt, Human
aagcucccaggc

SEQ ID NO: 3069856 - RNA, 22 nt, Human
aagcucccaggcauuccccagg

SEQ ID NO: 3069857 - RNA, 23 nt, Human
aagcucccaggcauuccccagga

SEQ ID NO: 3069858 - RNA, 21 nt, Human
aagcucuacugaggugcuaug

SEQ ID NO: 3069859 - RNA, 16 nt, Human
aagcuuuuaugugaaa

SEQ ID NO: 3069860 - RNA, 16 nt, Human
aaggaaaaaauaacaa

SEQ ID NO: 3069861 - RNA, 18 nt, Human
aagcuguuacugucuuca

SEQ ID NO: 3069862 - RNA, 13 nt, Human
aagcucugcuccu

SEQ ID NO: 3069863 - RNA, 23 nt, Human
guugauagcacagacccugcccu

SEQ ID NO: 3069864 - RNA, 22 nt, Human
guugauagcacagacccugccc

SEQ ID NO: 3069865 - RNA, 13 nt, Human
guugaauuuuaca

SEQ ID NO: 3069866 - RNA, 12 nt, Human
guucucugcccu

SEQ ID NO: 3069867 - RNA, 11 nt, Human
guucucugccc

SEQ ID NO: 3069868 - RNA, 16 nt, Human
guucucugaggacacu

SEQ ID NO: 3069869 - RNA, 14 nt, Human
guucucugaggaca

SEQ ID NO: 3069870 - RNA, 20 nt, Human
uaaauguuuuuuuuuaaaga

SEQ ID NO: 3069871 - RNA, 22 nt, Human
uaaauuaacuuuuauaaacuuu

SEQ ID NO: 3069872 - RNA, 21 nt, Human
uaaaucuccaaaauaaaacuu

SEQ ID NO: 3069873 - RNA, 20 nt, Human
uaaaucuccaaaauaaaacu

SEQ ID NO: 3069874 - RNA, 18 nt, Human
uaaaucuccaaaauaaaa

SEQ ID NO: 3069875 - RNA, 15 nt, Human
uaaauguugacaugg

SEQ ID NO: 3069876 - RNA, 17 nt, Human
uaaaugauuucauucaa

SEQ ID NO: 3069877 - RNA, 23 nt, Human
uaacaaaaaaauauauuuaauga

SEQ ID NO: 3069878 - RNA, 20 nt, Human
uaacaaaaaaauauauuuaa

SEQ ID NO: 3069879 - RNA, 16 nt, Human
uaaauuuugaguucua

SEQ ID NO: 3069880 - RNA, 14 nt, Human
uaaauuuuauaucu

SEQ ID NO: 3069881 - RNA, 13 nt, Human
uaacaagccaccc

SEQ ID NO: 3069882 - RNA, 13 nt, Human
uaacaaugcugua

SEQ ID NO: 3069883 - RNA, 15 nt, Human
uaacaaugcuguauu

SEQ ID NO: 3069884 - RNA, 17 nt, Human
uaacaaugcuguauuuu

SEQ ID NO: 3069885 - RNA, 18 nt, Human
uaaauaguauuugagagu

SEQ ID NO: 3069886 - RNA, 19 nt, Human
uaaaucuccaaaauaaaac

SEQ ID NO: 3069887 - RNA, 12 nt, Human
uaaauagcuuuu

SEQ ID NO: 3069888 - RNA, 15 nt, Human
aauacaccacuacau

SEQ ID NO: 3069889 - RNA, 14 nt, Human
aauacacacucaaa

SEQ ID NO: 3069890 - RNA, 20 nt, Human
aauacaccacuacauucugu

SEQ ID NO: 3069891 - RNA, 18 nt, Human
aauacaccacuacauucu

SEQ ID NO: 3069892 - RNA, 16 nt, Human
aauacaccacuacauu

SEQ ID NO: 3069893 - RNA, 15 nt, Human
aauaacaauaaaaga

SEQ ID NO: 3069894 - RNA, 15 nt, Human
aauaacgauaaaaga

SEQ ID NO: 3069895 - RNA, 19 nt, Human
aauaacauguaauuaagua

SEQ ID NO: 3069896 - RNA, 12 nt, Human
aauaacauguaa

SEQ ID NO: 3069897 - RNA, 12 nt, Human
aauaaauuauuu

SEQ ID NO: 3069898 - RNA, 21 nt, Human
aauaaaugugccuucauuuuu

SEQ ID NO: 3069899 - RNA, 12 nt, Human
aauaaaugugcc

SEQ ID NO: 3069900 - RNA, 15 nt, Human
aauaacuaaaaggua

SEQ ID NO: 3069901 - RNA, 19 nt, Human
aauaauguuucaaacauau

SEQ ID NO: 3069902 - RNA, 12 nt, Human
aauaaaaauaau

SEQ ID NO: 3069903 - RNA, 22 nt, Human
aauaaaaauauuguguugugaa

SEQ ID NO: 3069904 - RNA, 14 nt, Human
aauaaaguaauuau

SEQ ID NO: 3069905 - RNA, 22 nt, Human
aauaaaauccauacauuugugu

SEQ ID NO: 3069906 - RNA, 19 nt, Human
uaaaguguauuuuuuuacu

SEQ ID NO: 3069907 - RNA, 15 nt, Human
uaaaguguauuuuuu

SEQ ID NO: 3069908 - RNA, 14 nt, Human
uaaaguguauuuuu

SEQ ID NO: 3069909 - RNA, 13 nt, Human
uaaagucaggggu

SEQ ID NO: 3069910 - RNA, 19 nt, Human
uaaaauuuuuaaucuuuaa

SEQ ID NO: 3069911 - RNA, 19 nt, Human
uaaaccaaggcuagaacca

SEQ ID NO: 3069912 - RNA, 17 nt, Human
uaaaauuuuuaaucuuu

SEQ ID NO: 3069913 - RNA, 19 nt, Human
aaguuuacauuguaaauag

SEQ ID NO: 3069914 - RNA, 18 nt, Human
aaguuuacauuguaaaua

SEQ ID NO: 3069915 - RNA, 22 nt, Human
aaguuauugauaaguucauaca

SEQ ID NO: 3069916 - RNA, 23 nt, Human
aaguuauugauaaguucauacau

SEQ ID NO: 3069917 - RNA, 12 nt, Human
aaguucauacau

SEQ ID NO: 3069918 - RNA, 13 nt, Human
aaguucauacauu

SEQ ID NO: 3069919 - RNA, 15 nt, Human
aaguucauacauugu

SEQ ID NO: 3069920 - RNA, 19 nt, Human
aaguuauugauaaguucau

SEQ ID NO: 3069921 - RNA, 20 nt, Human
aaguuauugauaaguucaua

SEQ ID NO: 3069922 - RNA, 14 nt, Human
aaguuaaauaaauc

SEQ ID NO: 3069923 - RNA, 12 nt, Human
aaguuaaauaaa

SEQ ID NO: 3069924 - RNA, 17 nt, Human
guuuuuuuuuaaagacu

SEQ ID NO: 3069925 - RNA, 16 nt, Human
uaaagacuuuuaugau

SEQ ID NO: 3069926 - RNA, 21 nt, Human
uaaaggcuaccuuuguauucu

SEQ ID NO: 3069927 - RNA, 19 nt, Human
uaaaggcuaccuuuguauu

SEQ ID NO: 3069928 - RNA, 19 nt, Human
uaaaccucaaaaugucuaa

SEQ ID NO: 3069929 - RNA, 18 nt, Human
uaaaccucaaaaugucua

SEQ ID NO: 3069930 - RNA, 16 nt, Human
uaaaccgccaaggcug

SEQ ID NO: 3069931 - RNA, 18 nt, Human
uaaaccgccaaggcuggg

SEQ ID NO: 3069932 - RNA, 13 nt, Human
uaaacgucuuaaa

SEQ ID NO: 3069933 - RNA, 17 nt, Human
uaaacgucuuaaauauu

SEQ ID NO: 3069934 - RNA, 17 nt, Human
uaaacucauuucuagca

SEQ ID NO: 3069935 - RNA, 12 nt, Human
uaaacucauuuc

SEQ ID NO: 3069936 - RNA, 17 nt, Human
gugaguacuacaguccu

SEQ ID NO: 3069937 - RNA, 21 nt, Human
gugagcacuaaggugugcucu

SEQ ID NO: 3069938 - RNA, 16 nt, Human
gugagaggggaacaga

SEQ ID NO: 3069939 - RNA, 13 nt, Human
gugagagcugggu

SEQ ID NO: 3069940 - RNA, 15 nt, Human
gugagcaauccugca

SEQ ID NO: 3069941 - RNA, 12 nt, Human
gugaccccaggu

SEQ ID NO: 3069942 - RNA, 12 nt, Human
gugagagcuggg

SEQ ID NO: 3069943 - RNA, 19 nt, Human
gugaguacuacaguccucc

SEQ ID NO: 3069944 - RNA, 17 nt, Human
gugaguccuggcauggg

SEQ ID NO: 3069945 - RNA, 20 nt, Human
gugaguccuggcaugggaau

SEQ ID NO: 3069946 - RNA, 13 nt, Human
aacugaaaucaua

SEQ ID NO: 3069947 - RNA, 20 nt, Human
aacugaaaucauacuucuua

SEQ ID NO: 3069948 - RNA, 16 nt, Human
gugaagugaaugaaac

SEQ ID NO: 3069949 - RNA, 14 nt, Human
gugaagugaagaca

SEQ ID NO: 3069950 - RNA, 23 nt, Human
gugaagacaaugacuuacuguac

SEQ ID NO: 3069951 - RNA, 13 nt, Human
aacuauauuguuu

SEQ ID NO: 3069952 - RNA, 20 nt, Human
aacuaucucauuuccaagca

SEQ ID NO: 3069953 - RNA, 19 nt, Human
gugacagaggcagccccau

SEQ ID NO: 3069954 - RNA, 18 nt, Human
gugacagaggcagcccca

SEQ ID NO: 3069955 - RNA, 16 nt, Human
gugacagaggcagccc

SEQ ID NO: 3069956 - RNA, 17 nt, Human
gugaccaaugaugguca

SEQ ID NO: 3069957 - RNA, 18 nt, Human
gugaccagcaccaucucu

SEQ ID NO: 3069958 - RNA, 21 nt, Human
gugaccagcaccaucucuccu

SEQ ID NO: 3069959 - RNA, 18 nt, Human
gugaccauguuuuguuua

SEQ ID NO: 3069960 - RNA, 23 nt, Human
aacguggcugcuucaaggauccu

SEQ ID NO: 3069961 - RNA, 16 nt, Human
gucuucaguaagccgu

SEQ ID NO: 3069962 - RNA, 15 nt, Human
gucuuuguacagaca

SEQ ID NO: 3069963 - RNA, 16 nt, Human
gucuuuguacagacaa

SEQ ID NO: 3069964 - RNA, 12 nt, Human
aaccugugucuc

SEQ ID NO: 3069965 - RNA, 19 nt, Human
aaccugauugugucucuug

SEQ ID NO: 3069966 - RNA, 18 nt, Human
aaccugauugugucucuu

SEQ ID NO: 3069967 - RNA, 23 nt, Human
gucugacaggcaaugcuggcugu

SEQ ID NO: 3069968 - RNA, 22 nt, Human
gucugacaggcaaugcuggcug

SEQ ID NO: 3069969 - RNA, 21 nt, Human
gucugacaggcaaugcuggcu

SEQ ID NO: 3069970 - RNA, 18 nt, Human
gucuggaaugcaguggua

SEQ ID NO: 3069971 - RNA, 13 nt, Human
gucuucacaacag

SEQ ID NO: 3069972 - RNA, 13 nt, Human
gucucuugguccu

SEQ ID NO: 3069973 - RNA, 20 nt, Human
gucucuugguccugcugcag

SEQ ID NO: 3069974 - RNA, 18 nt, Human
gucucuugguccugcugc

SEQ ID NO: 3069975 - RNA, 19 nt, Human
gucucuugguccugcugca

SEQ ID NO: 3069976 - RNA, 17 nt, Human
gucucuugguccugcug

SEQ ID NO: 3069977 - RNA, 22 nt, Human
gucucuuuaaugucacaggcag

SEQ ID NO: 3069978 - RNA, 19 nt, Human
gucugaaggcuggguucug

SEQ ID NO: 3069979 - RNA, 14 nt, Human
gucugaaggcuggg

SEQ ID NO: 3069980 - RNA, 20 nt, Human
gucucuuuaaugucacaggc

SEQ ID NO: 3069981 - RNA, 19 nt, Human
gucucuuuaaugucacagg

SEQ ID NO: 3069982 - RNA, 18 nt, Human
gucucuuuaaugucacag

SEQ ID NO: 3069983 - RNA, 12 nt, Human
aacauaauuaaa

SEQ ID NO: 3069984 - RNA, 20 nt, Human
aacauacucccaucugugaa

SEQ ID NO: 3069985 - RNA, 18 nt, Human
aacauacucccaucugug

SEQ ID NO: 3069986 - RNA, 16 nt, Human
aacauacucccaucug

SEQ ID NO: 3069987 - RNA, 22 nt, Human
aacauguuuuucuucucccuca

SEQ ID NO: 3069988 - RNA, 14 nt, Human
aacaucaacaucuu

SEQ ID NO: 3069989 - RNA, 16 nt, Human
aacauauauaacaaug

SEQ ID NO: 3069990 - RNA, 20 nt, Human
aacagacuggaagcacagcu

SEQ ID NO: 3069991 - RNA, 13 nt, Human
guccuacccaccc

SEQ ID NO: 3069992 - RNA, 19 nt, Human
aacagauuauuaccuuaca

SEQ ID NO: 3069993 - RNA, 17 nt, Human
aacagucucaggaaauc

SEQ ID NO: 3069994 - RNA, 19 nt, Human
aacagucucaggaaaucaa

SEQ ID NO: 3069995 - RNA, 23 nt, Human
guccaugaagauguagaggagaa

SEQ ID NO: 3069996 - RNA, 18 nt, Human
gucccaccuuggcugcag

SEQ ID NO: 3069997 - RNA, 17 nt, Human
gucccaccuuggcugca

SEQ ID NO: 3069998 - RNA, 19 nt, Human
gucccaccuuggcugcagg

SEQ ID NO: 3069999 - RNA, 13 nt, Human
gucccuuuuccuu

SEQ ID NO: 3070000 - RNA, 21 nt, Human
guccgaaagggacuuggaagc

SEQ ID NO: 3070001 - RNA, 22 nt, Human
guccgaaagggacuuggaagcu

SEQ ID NO: 3070002 - RNA, 13 nt, Human
gucccccugacaa

SEQ ID NO: 3070003 - RNA, 15 nt, Human
guccccgcacugggc

SEQ ID NO: 3070004 - RNA, 16 nt, Human
guccccgcacugggcu

SEQ ID NO: 3070005 - RNA, 23 nt, Human
guccccuguuuguuucugaaagg

SEQ ID NO: 3070006 - RNA, 22 nt, Human
aacauuuguucuauagcuuuuc

SEQ ID NO: 3070007 - RNA, 14 nt, Human
gucuccagcugcug

SEQ ID NO: 3070008 - RNA, 13 nt, Human
gucuccagcugcu

SEQ ID NO: 3070009 - RNA, 13 nt, Human
aaccacaucuugc

SEQ ID NO: 3070010 - RNA, 23 nt, Human
aaccaucauugaaaucuuuuugc

SEQ ID NO: 3070011 - RNA, 14 nt, Human
gucuaugggacuca

SEQ ID NO: 3070012 - RNA, 22 nt, Human
gucucaaacucuugaccucagg

SEQ ID NO: 3070013 - RNA, 19 nt, Human
gucucaaaaaaagaaaaag

SEQ ID NO: 3070014 - RNA, 23 nt, Human
gucucaguccaugaagauguaga

SEQ ID NO: 3070015 - RNA, 14 nt, Human
gucgcccuggacug

SEQ ID NO: 3070016 - RNA, 23 nt, Human
gucgcccagucuggaaugcagug

SEQ ID NO: 3070017 - RNA, 20 nt, Human
gucuaccugaggggccucuu

SEQ ID NO: 3070018 - RNA, 14 nt, Human
gucgcccagucugg

SEQ ID NO: 3070019 - RNA, 13 nt, Human
gucgcccagucug

SEQ ID NO: 3070020 - RNA, 14 nt, Human
gucgaggacaggga

SEQ ID NO: 3070021 - RNA, 13 nt, Human
guccugcugcagu

SEQ ID NO: 3070022 - RNA, 16 nt, Human
guccugcugcaguugc

SEQ ID NO: 3070023 - RNA, 13 nt, Human
guguucugugaua

SEQ ID NO: 3070024 - RNA, 19 nt, Human
gugugguguuuccuggcac

SEQ ID NO: 3070025 - RNA, 20 nt, Human
gugucccaaaaagaaaggag

SEQ ID NO: 3070026 - RNA, 19 nt, Human
gugucuugcaauggcagcc

SEQ ID NO: 3070027 - RNA, 16 nt, Human
aagcaaguauuagaau

SEQ ID NO: 3070028 - RNA, 15 nt, Human
gugugguguuuccug

SEQ ID NO: 3070029 - RNA, 18 nt, Human
gugugagucaccaagccc

SEQ ID NO: 3070030 - RNA, 13 nt, Human
gugugagucacca

SEQ ID NO: 3070031 - RNA, 21 nt, Human
gugucuugcaauggcagccuu

SEQ ID NO: 3070032 - RNA, 22 nt, Human
aagauguagaggagaaacugga

SEQ ID NO: 3070033 - RNA, 13 nt, Human
aagcaaaauguga

SEQ ID NO: 3070034 - RNA, 19 nt, Human
aagauguagaggagaaacu

SEQ ID NO: 3070035 - RNA, 14 nt, Human
aagcaaaugugaau

SEQ ID NO: 3070036 - RNA, 13 nt, Human
aagcaaaugugaa

SEQ ID NO: 3070037 - RNA, 19 nt, Human
aagcaaaauuuuuucucua

SEQ ID NO: 3070038 - RNA, 14 nt, Human
aagaguaggaagac

SEQ ID NO: 3070039 - RNA, 18 nt, Human
gugguuauggagagggug

SEQ ID NO: 3070040 - RNA, 19 nt, Human
gugguguuuccuggcacug

SEQ ID NO: 3070041 - RNA, 16 nt, Human
aagaguaggaagacuu

SEQ ID NO: 3070042 - RNA, 18 nt, Human
aagaguaggaagacuuug

SEQ ID NO: 3070043 - RNA, 19 nt, Human
aagaguaggaagacuuugg

SEQ ID NO: 3070044 - RNA, 15 nt, Human
aagauauuuugcuuu

SEQ ID NO: 3070045 - RNA, 20 nt, Human
aagauauuuugcuuugugau

SEQ ID NO: 3070046 - RNA, 17 nt, Human
aagauauuuugcuuugu

SEQ ID NO: 3070047 - RNA, 22 nt, Human
aagauauuuugcuuugugauuu

SEQ ID NO: 3070048 - RNA, 18 nt, Human
guggggggggugcugggc

SEQ ID NO: 3070049 - RNA, 14 nt, Human
guggguagacacac

SEQ ID NO: 3070050 - RNA, 15 nt, Human
gugguguuuccuggc

SEQ ID NO: 3070051 - RNA, 16 nt, Human
gugguguuuccuggca

SEQ ID NO: 3070052 - RNA, 20 nt, Human
guggugguuuucuguucuuu

SEQ ID NO: 3070053 - RNA, 13 nt, Human
guggccucccaac

SEQ ID NO: 3070054 - RNA, 14 nt, Human
guggccucccaacu

SEQ ID NO: 3070055 - RNA, 15 nt, Human
gugggauccuccagg

SEQ ID NO: 3070056 - RNA, 18 nt, Human
gugggauccuccaggugc

SEQ ID NO: 3070057 - RNA, 12 nt, Human
gugggagcugag

SEQ ID NO: 3070058 - RNA, 16 nt, Human
aagagauugugguuuc

SEQ ID NO: 3070059 - RNA, 19 nt, Human
aagagauugugguuucauu

SEQ ID NO: 3070060 - RNA, 12 nt, Human
aagagcccaggc

SEQ ID NO: 3070061 - RNA, 14 nt, Human
aagagcccaggccu

SEQ ID NO: 3070062 - RNA, 16 nt, Human
aagagcccaggccucc

SEQ ID NO: 3070063 - RNA, 18 nt, Human
aagagcuguucacagcca

SEQ ID NO: 3070064 - RNA, 23 nt, Human
aagacgcugugcugcccugccca

SEQ ID NO: 3070065 - RNA, 20 nt, Human
aagacgcugugcugcccugc

SEQ ID NO: 3070066 - RNA, 13 nt, Human
aagacuauucaaa

SEQ ID NO: 3070067 - RNA, 14 nt, Human
aagacuauucaaac

SEQ ID NO: 3070068 - RNA, 21 nt, Human
aagacgcugugcugcccugcc

SEQ ID NO: 3070069 - RNA, 22 nt, Human
aagacgcugugcugcccugccc

SEQ ID NO: 3070070 - RNA, 17 nt, Human
aagacucauucuucugu

SEQ ID NO: 3070071 - RNA, 14 nt, Human
aagacuccaaagaa

SEQ ID NO: 3070072 - RNA, 17 nt, Human
aagacuccaaagaaaug

SEQ ID NO: 3070073 - RNA, 16 nt, Human
aagacuccaaagaaau

SEQ ID NO: 3070074 - RNA, 17 nt, Human
aagacugcauuauauuu

SEQ ID NO: 3070075 - RNA, 22 nt, Human
aagacucccaugagggagaugc

SEQ ID NO: 3070076 - RNA, 24 nt, Human
guggacacagcucuucuccaggcu

SEQ ID NO: 3070077 - RNA, 15 nt, Human
guggacacagcucuu

SEQ ID NO: 3070078 - RNA, 14 nt, Human
guggacacagcucu

SEQ ID NO: 3070079 - RNA, 19 nt, Human
gugcugggccccugccucu

SEQ ID NO: 3070080 - RNA, 16 nt, Human
gugcugggccccugcc

SEQ ID NO: 3070081 - RNA, 21 nt, Human
gugcugcccugcccaccuggc

SEQ ID NO: 3070082 - RNA, 19 nt, Human
gugcugcccugcccaccug

SEQ ID NO: 3070083 - RNA, 20 nt, Human
gugcugcccugcccaccugg

SEQ ID NO: 3070084 - RNA, 18 nt, Human
gugcugcccugcccaccu

SEQ ID NO: 3070085 - RNA, 13 nt, Human
aagaauauuuuaa

SEQ ID NO: 3070086 - RNA, 17 nt, Human
guggcagcugcggucca

SEQ ID NO: 3070087 - RNA, 24 nt, Human
aagaauuucuaggacugaauuaug

SEQ ID NO: 3070088 - RNA, 13 nt, Human
aagacccaaaagg

SEQ ID NO: 3070089 - RNA, 13 nt, Human
guggcaccagcag

SEQ ID NO: 3070090 - RNA, 14 nt, Human
guggcaccagcagc

SEQ ID NO: 3070091 - RNA, 22 nt, Human
guggcagcucaccucucccuug

SEQ ID NO: 3070092 - RNA, 14 nt, Human
guggcagcugcggu

SEQ ID NO: 3070093 - RNA, 23 nt, Human
guggauuuaacagaaauguacag

SEQ ID NO: 3070094 - RNA, 20 nt, Human
guggauuuaacagaaaugua

SEQ ID NO: 3070095 - RNA, 21 nt, Human
guggauuuaacagaaauguac

SEQ ID NO: 3070096 - RNA, 16 nt, Human
aagaagcccaggaaag

SEQ ID NO: 3070097 - RNA, 17 nt, Human
aagaagcccaggaaagg

SEQ ID NO: 3070098 - RNA, 22 nt, Human
aagaagcaccaaucaugaauua

SEQ ID NO: 3070099 - RNA, 14 nt, Human
aagaagcucucucc

SEQ ID NO: 3070100 - RNA, 15 nt, Human
aagaagcucucuccu

SEQ ID NO: 3070101 - RNA, 13 nt, Human
aagaaaauaucac

SEQ ID NO: 3070102 - RNA, 20 nt, Human
aagaaaaaggaugcacagag

SEQ ID NO: 3070103 - RNA, 19 nt, Human
aagaaaaaggaugcacaga

SEQ ID NO: 3070104 - RNA, 22 nt, Human
aagaaaaaggaugcacagaguu

SEQ ID NO: 3070105 - RNA, 23 nt, Human
aacuugguucccauuugcuccuu

SEQ ID NO: 3070106 - RNA, 22 nt, Human
aacuugucuuuggacccugagg

SEQ ID NO: 3070107 - RNA, 14 nt, Human
aacuuggcgcugcc

SEQ ID NO: 3070108 - RNA, 21 nt, Human
gugccuggguggaugggccac

SEQ ID NO: 3070109 - RNA, 15 nt, Human
gugccucugggacug

SEQ ID NO: 3070110 - RNA, 14 nt, Human
gugccucugggacu

SEQ ID NO: 3070111 - RNA, 22 nt, Human
gugcauuugaggucuguucuuu

SEQ ID NO: 3070112 - RNA, 21 nt, Human
gugcauuugaggucuguucuu

SEQ ID NO: 3070113 - RNA, 20 nt, Human
gugcauuugaggucuguucu

SEQ ID NO: 3070114 - RNA, 20 nt, Human
gugcacuaauguguaagaca

SEQ ID NO: 3070115 - RNA, 15 nt, Human
gugcauuuggugguu

SEQ ID NO: 3070116 - RNA, 14 nt, Human
gugccaagcagagg

SEQ ID NO: 3070117 - RNA, 14 nt, Human
gugcacacaccaga

SEQ ID NO: 3070118 - RNA, 12 nt, Human
gugcacacacca

SEQ ID NO: 3070119 - RNA, 18 nt, Human
gugcacguacacacacau

SEQ ID NO: 3070120 - RNA, 17 nt, Human
gugcacacaccagagcc

SEQ ID NO: 3070121 - RNA, 23 nt, Human
gugcacaagcuccaagcucccag

SEQ ID NO: 3070122 - RNA, 18 nt, Human
gugcacgcacacugucug

SEQ ID NO: 3070123 - RNA, 15 nt, Human
aaaaaauauuuuccu

SEQ ID NO: 3070124 - RNA, 12 nt, Human
aaaaacacagca

SEQ ID NO: 3070125 - RNA, 18 nt, Human
aaaaacacagcaagggug

SEQ ID NO: 3070126 - RNA, 13 nt, Human
aaaaacacagcaa

SEQ ID NO: 3070127 - RNA, 12 nt, Human
aguccuguaaug

SEQ ID NO: 3070128 - RNA, 12 nt, Human
agucugaaggcu

SEQ ID NO: 3070129 - RNA, 16 nt, Human
agucugaaggcugggu

SEQ ID NO: 3070130 - RNA, 13 nt, Human
agucugaaggcug

SEQ ID NO: 3070131 - RNA, 15 nt, Human
agucugaaggcuggg

SEQ ID NO: 3070132 - RNA, 20 nt, Human
aguccuggcaugggaaugaa

SEQ ID NO: 3070133 - RNA, 21 nt, Human
aguccuggcaugggaaugaau

SEQ ID NO: 3070134 - RNA, 22 nt, Human
aguccuggcaugggaaugaaug

SEQ ID NO: 3070135 - RNA, 20 nt, Human
agugaacuugggccacugug

SEQ ID NO: 3070136 - RNA, 17 nt, Human
agucuggaaugcagugg

SEQ ID NO: 3070137 - RNA, 18 nt, Human
agucugauucccaagcuc

SEQ ID NO: 3070138 - RNA, 16 nt, Human
agucugauucccaagc

SEQ ID NO: 3070139 - RNA, 16 nt, Human
agugaagacaaugacu

SEQ ID NO: 3070140 - RNA, 14 nt, Human
agugaagacaauga

SEQ ID NO: 3070141 - RNA, 16 nt, Human
aguaucuuuuuauuca

SEQ ID NO: 3070142 - RNA, 14 nt, Human
aguaugaaauuaua

SEQ ID NO: 3070143 - RNA, 16 nt, Human
aguaugaaauuauaua

SEQ ID NO: 3070144 - RNA, 16 nt, Human
aguaugaggcauuugu

SEQ ID NO: 3070145 - RNA, 15 nt, Human
aguaugaggcauuug

SEQ ID NO: 3070146 - RNA, 11 nt, Human
aguaucuugaa

SEQ ID NO: 3070147 - RNA, 12 nt, Human
aguaucuugaag

SEQ ID NO: 3070148 - RNA, 15 nt, Human
aguaucuugaagacu

SEQ ID NO: 3070149 - RNA, 15 nt, Human
aguaucucagggccu

SEQ ID NO: 3070150 - RNA, 23 nt, Human
agucaaauugugugaaagguacu

SEQ ID NO: 3070151 - RNA, 19 nt, Human
agucaaauugugugaaagg

SEQ ID NO: 3070152 - RNA, 23 nt, Human
aguugaaaaucuuauaauuuaaa

SEQ ID NO: 3070153 - RNA, 22 nt, Human
aguugaaaagacuccaaagaaa

SEQ ID NO: 3070154 - RNA, 14 nt, Human
aguugaagacagag

SEQ ID NO: 3070155 - RNA, 21 nt, Human
aguugugugaauaccccaaga

SEQ ID NO: 3070156 - RNA, 16 nt, Human
aguuguguuugaagca

SEQ ID NO: 3070157 - RNA, 20 nt, Human
aguuguuugauucagacagc

SEQ ID NO: 3070158 - RNA, 10 nt, Human
aguucauaca

SEQ ID NO: 3070159 - RNA, 11 nt, Human
aguucauacau

SEQ ID NO: 3070160 - RNA, 19 nt, Human
aguucagguaacaggcaga

SEQ ID NO: 3070161 - RNA, 18 nt, Human
aguucagguaacaggcag

SEQ ID NO: 3070162 - RNA, 20 nt, Human
aguucagguaacaggcagau

SEQ ID NO: 3070163 - RNA, 22 nt, Human
aguugaaaaucuuauaauuuaa

SEQ ID NO: 3070164 - RNA, 21 nt, Human
aguugaaaagacuccaaagaa

SEQ ID NO: 3070165 - RNA, 15 nt, Human
aguucauacauugua

SEQ ID NO: 3070166 - RNA, 22 nt, Human
aguucaucuugaauuguaagga

SEQ ID NO: 3070167 - RNA, 14 nt, Human
aguuacagacaaag

SEQ ID NO: 3070168 - RNA, 16 nt, Human
aguuacagacaaagcg

SEQ ID NO: 3070169 - RNA, 18 nt, Human
aguuacacuaaaagguga

SEQ ID NO: 3070170 - RNA, 12 nt, Human
aguuaaauaaau

SEQ ID NO: 3070171 - RNA, 23 nt, Human
aguggcuuaaaacaacacucaca

SEQ ID NO: 3070172 - RNA, 18 nt, Human
aguguauuuuuuuacuaa

SEQ ID NO: 3070173 - RNA, 17 nt, Human
aguguauuuuuuuacua

SEQ ID NO: 3070174 - RNA, 15 nt, Human
agugucuuaauuaaa

SEQ ID NO: 3070175 - RNA, 14 nt, Human
agugggagcugccu

SEQ ID NO: 3070176 - RNA, 15 nt, Human
agugggagcugccug

SEQ ID NO: 3070177 - RNA, 18 nt, Human
agugucuuaauuaaaaga

SEQ ID NO: 3070178 - RNA, 17 nt, Human
agugucuuaauuaaaag

SEQ ID NO: 3070179 - RNA, 16 nt, Human
auaucaaauauauuca

SEQ ID NO: 3070180 - RNA, 19 nt, Human
auauauuuuuuucugaaau

SEQ ID NO: 3070181 - RNA, 23 nt, Human
auauuaugaagcuuuuaugugaa

SEQ ID NO: 3070182 - RNA, 16 nt, Human
auauuauguuaaaacu

SEQ ID NO: 3070183 - RNA, 19 nt, Human
auauuuacuucuuauacau

SEQ ID NO: 3070184 - RNA, 22 nt, Human
auauuuauuacuguaagaaaau

SEQ ID NO: 3070185 - RNA, 13 nt, Human
auauuuauuuuaa

SEQ ID NO: 3070186 - RNA, 21 nt, Human
auaugcuuauacacuuacacu

SEQ ID NO: 3070187 - RNA, 20 nt, Human
auaugcuucuguuuuauaau

SEQ ID NO: 3070188 - RNA, 22 nt, Human
auaugcuucuguuuuauaauuu

SEQ ID NO: 3070189 - RNA, 22 nt, Human
auauuaccacagacauacuaac

SEQ ID NO: 3070190 - RNA, 19 nt, Human
auauuaccacagacauacu

SEQ ID NO: 3070191 - RNA, 15 nt, Human
auagguuuaauaauu

SEQ ID NO: 3070192 - RNA, 14 nt, Human
auagguuuggacaa

SEQ ID NO: 3070193 - RNA, 21 nt, Human
auaguauuugagaguucuaaa

SEQ ID NO: 3070194 - RNA, 20 nt, Human
auaguauuugagaguucuaa

SEQ ID NO: 3070195 - RNA, 18 nt, Human
auaguaugguggcugggu

SEQ ID NO: 3070196 - RNA, 17 nt, Human
auaguaugguggcuggg

SEQ ID NO: 3070197 - RNA, 23 nt, Human
auaggugcuacaaaaacacagca

SEQ ID NO: 3070198 - RNA, 21 nt, Human
auaggugcuacaaaaacacag

SEQ ID NO: 3070199 - RNA, 15 nt, Human
auaggugcuacaaaa

SEQ ID NO: 3070200 - RNA, 14 nt, Human
auaggugcuacaaa

SEQ ID NO: 3070201 - RNA, 15 nt, Human
auagccaaggccaaa

SEQ ID NO: 3070202 - RNA, 21 nt, Human
auagccaaggccaaaggaagc

SEQ ID NO: 3070203 - RNA, 18 nt, Human
auagcagcuuauucacaa

SEQ ID NO: 3070204 - RNA, 23 nt, Human
auaguauuugagaguucuaaauu

SEQ ID NO: 3070205 - RNA, 14 nt, Human
auagucaaauugug

SEQ ID NO: 3070206 - RNA, 20 nt, Human
auaauuaaauuuugaguucu

SEQ ID NO: 3070207 - RNA, 15 nt, Human
auaauguaagcucua

SEQ ID NO: 3070208 - RNA, 15 nt, Human
auaaugucccuucac

SEQ ID NO: 3070209 - RNA, 23 nt, Human
auaauguuucaaacauauauaac

SEQ ID NO: 3070210 - RNA, 18 nt, Human
auacaccacuacauucug

SEQ ID NO: 3070211 - RNA, 18 nt, Human
auacacacucaaaucaag

SEQ ID NO: 3070212 - RNA, 17 nt, Human
auacacacucaaaucaa

SEQ ID NO: 3070213 - RNA, 20 nt, Human
auacaccacuacauucuguu

SEQ ID NO: 3070214 - RNA, 19 nt, Human
auacaccacuacauucugu

SEQ ID NO: 3070215 - RNA, 21 nt, Human
auacaccacuacauucuguua

SEQ ID NO: 3070216 - RNA, 20 nt, Human
auaaugcgugcauaccacuu

SEQ ID NO: 3070217 - RNA, 21 nt, Human
auaaugcgugcauaccacuuu

SEQ ID NO: 3070218 - RNA, 14 nt, Human
auaauguaagcucu

SEQ ID NO: 3070219 - RNA, 12 nt, Human
auacccaccccc

SEQ ID NO: 3070220 - RNA, 11 nt, Human
auacccacccc

SEQ ID NO: 3070221 - RNA, 18 nt, Human
auaccugucccccugaca

SEQ ID NO: 3070222 - RNA, 17 nt, Human
auaccugucccccugac

SEQ ID NO: 3070223 - RNA, 18 nt, Human
auaaaggauuaaugucaa

SEQ ID NO: 3070224 - RNA, 18 nt, Human
auaaagcuguguggcagu

SEQ ID NO: 3070225 - RNA, 15 nt, Human
auaaagcaggcagaa

SEQ ID NO: 3070226 - RNA, 20 nt, Human
auaaagcagcguuucuauga

SEQ ID NO: 3070227 - RNA, 19 nt, Human
auaaagcagcguuucuaug

SEQ ID NO: 3070228 - RNA, 18 nt, Human
auaaagcagcguuucuau

SEQ ID NO: 3070229 - RNA, 14 nt, Human
auaaagcagcguuu

SEQ ID NO: 3070230 - RNA, 13 nt, Human
auaaagcagcguu

SEQ ID NO: 3070231 - RNA, 20 nt, Human
auaaacuuuuuucuuacugu

SEQ ID NO: 3070232 - RNA, 24 nt, Human
auaaacuuuaccuuuuuuauacau

SEQ ID NO: 3070233 - RNA, 16 nt, Human
auaaacuuuaccuuuu

SEQ ID NO: 3070234 - RNA, 21 nt, Human
auaaacuuuaccuuuuuuaua

SEQ ID NO: 3070235 - RNA, 17 nt, Human
auaaaacuuuuuaaaau

SEQ ID NO: 3070236 - RNA, 14 nt, Human
auaaaaauauugug

SEQ ID NO: 3070237 - RNA, 11 nt, Human
auaaaacuuuu

SEQ ID NO: 3070238 - RNA, 15 nt, Human
auaaaacuuuuuaaa

SEQ ID NO: 3070239 - RNA, 14 nt, Human
auguuucaaacuuu

SEQ ID NO: 3070240 - RNA, 17 nt, Human
auguuucaaacuuugga

SEQ ID NO: 3070241 - RNA, 21 nt, Human
auguuucaaacauauauaaca

SEQ ID NO: 3070242 - RNA, 12 nt, Human
auguuucaaacu

SEQ ID NO: 3070243 - RNA, 13 nt, Human
auguuucaaacuu

SEQ ID NO: 3070244 - RNA, 13 nt, Human
auguucugggaca

SEQ ID NO: 3070245 - RNA, 18 nt, Human
auguuugccucugccucu

SEQ ID NO: 3070246 - RNA, 22 nt, Human
auguuugccucugccucugaca

SEQ ID NO: 3070247 - RNA, 19 nt, Human
auguuugccucugccucug

SEQ ID NO: 3070248 - RNA, 12 nt, Human
auguucugggac

SEQ ID NO: 3070249 - RNA, 11 nt, Human
auguucuggga

SEQ ID NO: 3070250 - RNA, 18 nt, Human
augugggcagugauguca

SEQ ID NO: 3070251 - RNA, 17 nt, Human
auguucuaagaagugaa

SEQ ID NO: 3070252 - RNA, 15 nt, Human
augugaaacauguuu

SEQ ID NO: 3070253 - RNA, 22 nt, Human
augugaaacuggauuaaacuua

SEQ ID NO: 3070254 - RNA, 23 nt, Human
augugaacaguuguguuugaagc

SEQ ID NO: 3070255 - RNA, 11 nt, Human
augugaacagu

SEQ ID NO: 3070256 - RNA, 21 nt, Human
augugaacaguuguguuugaa

SEQ ID NO: 3070257 - RNA, 14 nt, Human
augucuuuucuugc

SEQ ID NO: 3070258 - RNA, 20 nt, Human
auguauucuagcuaauguaa

SEQ ID NO: 3070259 - RNA, 19 nt, Human
auguauucuagcuaaugua

SEQ ID NO: 3070260 - RNA, 17 nt, Human
auguaauuaaguacuau

SEQ ID NO: 3070261 - RNA, 15 nt, Human
auguaauuaaguacu

SEQ ID NO: 3070262 - RNA, 19 nt, Human
auguaagggaaacugccag

SEQ ID NO: 3070263 - RNA, 16 nt, Human
auguaagggaaacugc

SEQ ID NO: 3070264 - RNA, 14 nt, Human
auguaagggaaacu

SEQ ID NO: 3070265 - RNA, 19 nt, Human
auggucaccaaaucagcug

SEQ ID NO: 3070266 - RNA, 16 nt, Human
augcauauuauuuuau

SEQ ID NO: 3070267 - RNA, 17 nt, Human
augccucucucaggcca

SEQ ID NO: 3070268 - RNA, 16 nt, Human
augcaugaaguaauau

SEQ ID NO: 3070269 - RNA, 19 nt, Human
augccucucucaggccaaa

SEQ ID NO: 3070270 - RNA, 21 nt, Human
augcauagguuuagcaguaua

SEQ ID NO: 3070271 - RNA, 17 nt, Human
augcauagguuuagcag

SEQ ID NO: 3070272 - RNA, 18 nt, Human
augcacagaguuguuaca

SEQ ID NO: 3070273 - RNA, 17 nt, Human
augcacagaguuguuac

SEQ ID NO: 3070274 - RNA, 16 nt, Human
augcacaaacagaggc

SEQ ID NO: 3070275 - RNA, 17 nt, Human
augcacaaacagaggcc

SEQ ID NO: 3070276 - RNA, 16 nt, Human
augcacagaguuguua

SEQ ID NO: 3070277 - RNA, 23 nt, Human
augcacacauuuuuuaaaugcac

SEQ ID NO: 3070278 - RNA, 16 nt, Human
augaugccaugaggaa

SEQ ID NO: 3070279 - RNA, 17 nt, Human
augaugccaugaggaac

SEQ ID NO: 3070280 - RNA, 24 nt, Human
augauguuuuccaugaguccccug

SEQ ID NO: 3070281 - RNA, 15 nt, Human
augcacaaacagagg

SEQ ID NO: 3070282 - RNA, 15 nt, Human
auggauuuccagcca

SEQ ID NO: 3070283 - RNA, 14 nt, Human
augcuuguacauaa

SEQ ID NO: 3070284 - RNA, 13 nt, Human
augcuuguacaua

SEQ ID NO: 3070285 - RNA, 12 nt, Human
augcuuguacau

SEQ ID NO: 3070286 - RNA, 16 nt, Human
augcucuuuacuucau

SEQ ID NO: 3070287 - RNA, 11 nt, Human
augcugcccug

SEQ ID NO: 3070288 - RNA, 16 nt, Human
aucaugugaaaucauu

SEQ ID NO: 3070289 - RNA, 14 nt, Human
aucaugugaaauca

SEQ ID NO: 3070290 - RNA, 15 nt, Human
aucaugugaaaucau

SEQ ID NO: 3070291 - RNA, 17 nt, Human
aucagcugcugaaacaa

SEQ ID NO: 3070292 - RNA, 23 nt, Human
aucagcugcugaaacaacaaaua

SEQ ID NO: 3070293 - RNA, 22 nt, Human
aucagcugcugaaacaacaaau

SEQ ID NO: 3070294 - RNA, 21 nt, Human
aucagcugcugaaacaacaaa

SEQ ID NO: 3070295 - RNA, 19 nt, Human
aucagccugcuccagcugu

SEQ ID NO: 3070296 - RNA, 17 nt, Human
aucagccugcuccagcu

SEQ ID NO: 3070297 - RNA, 18 nt, Human
aucagccugcuccagcug

SEQ ID NO: 3070298 - RNA, 19 nt, Human
aucaccgaaaacguggcug

SEQ ID NO: 3070299 - RNA, 21 nt, Human
aucaccgaaaacguggcugcu

SEQ ID NO: 3070300 - RNA, 14 nt, Human
aucaccgaaaacgu

SEQ ID NO: 3070301 - RNA, 20 nt, Human
aucagcacgauuucuguuua

SEQ ID NO: 3070302 - RNA, 19 nt, Human
aucagcacgauuucuguuu

SEQ ID NO: 3070303 - RNA, 23 nt, Human
aucagcacgauuucuguuuagau

SEQ ID NO: 3070304 - RNA, 19 nt, Human
aucaccaacgucugugcca

SEQ ID NO: 3070305 - RNA, 23 nt, Human
aucacccgcuaagagggagggag

SEQ ID NO: 3070306 - RNA, 18 nt, Human
aucaccaacgucugugcc

SEQ ID NO: 3070307 - RNA, 21 nt, Human
aucacagccucugaaaaccaa

SEQ ID NO: 3070308 - RNA, 13 nt, Human
aucacagccucug

SEQ ID NO: 3070309 - RNA, 17 nt, Human
auauuuauuuuaauaau

SEQ ID NO: 3070310 - RNA, 14 nt, Human
auauuuauuuuaau

SEQ ID NO: 3070311 - RNA, 15 nt, Human
auauuuauuuuaaua

SEQ ID NO: 3070312 - RNA, 16 nt, Human
auccagaaagaaaacu

SEQ ID NO: 3070313 - RNA, 18 nt, Human
auccagaaagaaaacuug

SEQ ID NO: 3070314 - RNA, 15 nt, Human
auccagacccggcug

SEQ ID NO: 3070315 - RNA, 14 nt, Human
aucccauuuaaaaa

SEQ ID NO: 3070316 - RNA, 15 nt, Human
aucccauuuaaaaaa

SEQ ID NO: 3070317 - RNA, 11 nt, Human
auccuccaggu

SEQ ID NO: 3070318 - RNA, 23 nt, Human
auccucauacccacccccaccca

SEQ ID NO: 3070319 - RNA, 23 nt, Human
auccuccaggugcacaagcucca

SEQ ID NO: 3070320 - RNA, 15 nt, Human
auccucccaccucag

SEQ ID NO: 3070321 - RNA, 15 nt, Human
auccccuguagagug

SEQ ID NO: 3070322 - RNA, 19 nt, Human
auccucccaccucagccuc

SEQ ID NO: 3070323 - RNA, 18 nt, Human
auccucccaccucagccu

SEQ ID NO: 3070324 - RNA, 20 nt, Human
auccucccaccucagccucc

SEQ ID NO: 3070325 - RNA, 18 nt, Human
aucuugaauaauguaaga

SEQ ID NO: 3070326 - RNA, 22 nt, Human
aucuucugaacuuggcgcugcc

SEQ ID NO: 3070327 - RNA, 18 nt, Human
aucuugaagacuuuucuu

SEQ ID NO: 3070328 - RNA, 14 nt, Human
aucuucuuuauaau

SEQ ID NO: 3070329 - RNA, 21 nt, Human
aucucccccagccccauccuc

SEQ ID NO: 3070330 - RNA, 14 nt, Human
aucuauauuuuaca

SEQ ID NO: 3070331 - RNA, 17 nt, Human
aucuauauuuuacauaa

SEQ ID NO: 3070332 - RNA, 21 nt, Human
aucuauauuuuacauaaauuu

SEQ ID NO: 3070333 - RNA, 22 nt, Human
aucugcuuuuuaaagaaugcuc

SEQ ID NO: 3070334 - RNA, 22 nt, Human
augaagcuuuuaugugaaacau

SEQ ID NO: 3070335 - RNA, 19 nt, Human
augaaguuuuuuuuauaca

SEQ ID NO: 3070336 - RNA, 23 nt, Human
augaaaaaauauauaucaaauau

SEQ ID NO: 3070337 - RNA, 17 nt, Human
augaaagacuguacaaa

SEQ ID NO: 3070338 - RNA, 16 nt, Human
augaaagacuguacaa

SEQ ID NO: 3070339 - RNA, 13 nt, Human
augaaagacugua

SEQ ID NO: 3070340 - RNA, 21 nt, Human
augaccuuucaauaggaaaaa

SEQ ID NO: 3070341 - RNA, 18 nt, Human
augaccuuucaauaggaa

SEQ ID NO: 3070342 - RNA, 22 nt, Human
augaccuuucaauaggaaaaac

SEQ ID NO: 3070343 - RNA, 23 nt, Human
augaccuuucaauaggaaaaacu

SEQ ID NO: 3070344 - RNA, 12 nt, Human
agagggcacaga

SEQ ID NO: 3070345 - RNA, 22 nt, Human
agaggguggugaccucugccug

SEQ ID NO: 3070346 - RNA, 20 nt, Human
agaggguggugaccucugcc

SEQ ID NO: 3070347 - RNA, 19 nt, Human
agaggguggugaccucugc

SEQ ID NO: 3070348 - RNA, 14 nt, Human
agagugugccugaa

SEQ ID NO: 3070349 - RNA, 19 nt, Human
agaguggggauaugauuua

SEQ ID NO: 3070350 - RNA, 11 nt, Human
agagugggagc

SEQ ID NO: 3070351 - RNA, 15 nt, Human
agaggagagaggacc

SEQ ID NO: 3070352 - RNA, 16 nt, Human
agaggagagaggaccc

SEQ ID NO: 3070353 - RNA, 23 nt, Human
agaggacuuuucuuuguggcuuc

SEQ ID NO: 3070354 - RNA, 21 nt, Human
agaggaaaucaccgaaaacgu

SEQ ID NO: 3070355 - RNA, 16 nt, Human
agaggaaggagaggag

SEQ ID NO: 3070356 - RNA, 15 nt, Human
agagcccaggccucc

SEQ ID NO: 3070357 - RNA, 13 nt, Human
agagcccaggccu

SEQ ID NO: 3070358 - RNA, 14 nt, Human
agagcccaggccuc

SEQ ID NO: 3070359 - RNA, 14 nt, Human
agaucuucuguggg

SEQ ID NO: 3070360 - RNA, 19 nt, Human
agauauaugcucugcaugu

SEQ ID NO: 3070361 - RNA, 22 nt, Human
agacgugcacgcacacugucug

SEQ ID NO: 3070362 - RNA, 21 nt, Human
agacgugcacgcacacugucu

SEQ ID NO: 3070363 - RNA, 20 nt, Human
agacgcugugcugcccugcc

SEQ ID NO: 3070364 - RNA, 22 nt, Human
agacgcugugcugcccugccca

SEQ ID NO: 3070365 - RNA, 18 nt, Human
agacggagucccaccuug

SEQ ID NO: 3070366 - RNA, 21 nt, Human
agacgcugugcugcccugccc

SEQ ID NO: 3070367 - RNA, 11 nt, Human
agacagcucuu

SEQ ID NO: 3070368 - RNA, 12 nt, Human
agacagcucuua

SEQ ID NO: 3070369 - RNA, 12 nt, Human
agacagcugccu

SEQ ID NO: 3070370 - RNA, 14 nt, Human
agacagcccgggcu

SEQ ID NO: 3070371 - RNA, 15 nt, Human
agacagcccgggcuc

SEQ ID NO: 3070372 - RNA, 15 nt, Human
agacagauacuccuc

SEQ ID NO: 3070373 - RNA, 21 nt, Human
agacagauacuccuccaaggu

SEQ ID NO: 3070374 - RNA, 23 nt, Human
agacagagucucacuguugccca

SEQ ID NO: 3070375 - RNA, 17 nt, Human
agagaacuuccagaucc

SEQ ID NO: 3070376 - RNA, 23 nt, Human
agagagcaagacgcugugcugcc

SEQ ID NO: 3070377 - RNA, 21 nt, Human
agagaggguggugaccucugc

SEQ ID NO: 3070378 - RNA, 20 nt, Human
agagaggguggugaccucug

SEQ ID NO: 3070379 - RNA, 22 nt, Human
agagaggguggugaccucugcc

SEQ ID NO: 3070380 - RNA, 13 nt, Human
agagcccaccuug

SEQ ID NO: 3070381 - RNA, 16 nt, Human
agagcccacgccccca

SEQ ID NO: 3070382 - RNA, 13 nt, Human
agagcccacgccc

SEQ ID NO: 3070383 - RNA, 19 nt, Human
agagcccaccuuggcucaa

SEQ ID NO: 3070384 - RNA, 16 nt, Human
agacuggaagcacagc

SEQ ID NO: 3070385 - RNA, 17 nt, Human
agacuggaagcacagcu

SEQ ID NO: 3070386 - RNA, 19 nt, Human
agacuggaagcacagcuuc

SEQ ID NO: 3070387 - RNA, 21 nt, Human
agacugcauuauauuuauuac

SEQ ID NO: 3070388 - RNA, 16 nt, Human
agcaguugaaaagacu

SEQ ID NO: 3070389 - RNA, 13 nt, Human
agcaguugaaaag

SEQ ID NO: 3070390 - RNA, 23 nt, Human
agccaagugugguagagugugcc

SEQ ID NO: 3070391 - RNA, 20 nt, Human
agcaugccuggauggggcug

SEQ ID NO: 3070392 - RNA, 23 nt, Human
agcaugccuggauggggcugcac

SEQ ID NO: 3070393 - RNA, 23 nt, Human
agcauccuggcacccggccccug

SEQ ID NO: 3070394 - RNA, 22 nt, Human
agcauccuggcacccggccccu

SEQ ID NO: 3070395 - RNA, 18 nt, Human
agcauccuggcacccggc

SEQ ID NO: 3070396 - RNA, 15 nt, Human
agcaugaagacagag

SEQ ID NO: 3070397 - RNA, 18 nt, Human
agcacugacagauuucca

SEQ ID NO: 3070398 - RNA, 13 nt, Human
agcacugacagau

SEQ ID NO: 3070399 - RNA, 14 nt, Human
agcacugacagauu

SEQ ID NO: 3070400 - RNA, 16 nt, Human
agcacugacuucuaag

SEQ ID NO: 3070401 - RNA, 18 nt, Human
agcacagacccugcccug

SEQ ID NO: 3070402 - RNA, 19 nt, Human
agcacagacccugcccugu

SEQ ID NO: 3070403 - RNA, 20 nt, Human
agcacagacccugcccugug

SEQ ID NO: 3070404 - RNA, 17 nt, Human
agcacagacccugcccu

SEQ ID NO: 3070405 - RNA, 20 nt, Human
agcacacuggcucacccagu

SEQ ID NO: 3070406 - RNA, 23 nt, Human
agcacacuugacaucaacugcau

SEQ ID NO: 3070407 - RNA, 12 nt, Human
agcacacuggcu

SEQ ID NO: 3070408 - RNA, 19 nt, Human
agcacacuggcucacccag

SEQ ID NO: 3070409 - RNA, 18 nt, Human
agcagugcaugcuguccc

SEQ ID NO: 3070410 - RNA, 19 nt, Human
agcagugcaugcugucccu

SEQ ID NO: 3070411 - RNA, 20 nt, Human
agcagugcaugcugucccuu

SEQ ID NO: 3070412 - RNA, 13 nt, Human
agcagcguuucua

SEQ ID NO: 3070413 - RNA, 13 nt, Human
agccgcuggggcc

SEQ ID NO: 3070414 - RNA, 12 nt, Human
agccgcccaagg

SEQ ID NO: 3070415 - RNA, 13 nt, Human
agccgcccaaggc

SEQ ID NO: 3070416 - RNA, 15 nt, Human
agccgcccaaggccu

SEQ ID NO: 3070417 - RNA, 16 nt, Human
agccgcccaaggccuu

SEQ ID NO: 3070418 - RNA, 21 nt, Human
agccgccaugcuccuggccca

SEQ ID NO: 3070419 - RNA, 19 nt, Human
agccucccgaguagcuggg

SEQ ID NO: 3070420 - RNA, 18 nt, Human
agccucccgaguagcugg

SEQ ID NO: 3070421 - RNA, 20 nt, Human
agccucccgaguagcuggga

SEQ ID NO: 3070422 - RNA, 14 nt, Human
agccuccuccagcc

SEQ ID NO: 3070423 - RNA, 20 nt, Human
agccucccaaagugcuggga

SEQ ID NO: 3070424 - RNA, 21 nt, Human
agccucccaaagugcugggau

SEQ ID NO: 3070425 - RNA, 22 nt, Human
agccucccacgacugcccggca

SEQ ID NO: 3070426 - RNA, 18 nt, Human
agccagcaggcucucagg

SEQ ID NO: 3070427 - RNA, 19 nt, Human
agccagcaggcucucaggc

SEQ ID NO: 3070428 - RNA, 17 nt, Human
agccagcaggcucucag

SEQ ID NO: 3070429 - RNA, 20 nt, Human
agccagcaggcucucaggcc

SEQ ID NO: 3070430 - RNA, 15 nt, Human
agccccagugcccac

SEQ ID NO: 3070431 - RNA, 14 nt, Human
agccccagugccca

SEQ ID NO: 3070432 - RNA, 13 nt, Human
agccccagugccc

SEQ ID NO: 3070433 - RNA, 16 nt, Human
agccccauucugccug

SEQ ID NO: 3070434 - RNA, 13 nt, Human
agccccauucugc

SEQ ID NO: 3070435 - RNA, 23 nt, Human
agguaaaucagacuaugaaguuu

SEQ ID NO: 3070436 - RNA, 11 nt, Human
aggucccuaau

SEQ ID NO: 3070437 - RNA, 12 nt, Human
aggucccuaaua

SEQ ID NO: 3070438 - RNA, 18 nt, Human
agguaaaucagacuauga

SEQ ID NO: 3070439 - RNA, 20 nt, Human
agguaaaagcaucacaugaa

SEQ ID NO: 3070440 - RNA, 15 nt, Human
aggucccuaauaaag

SEQ ID NO: 3070441 - RNA, 13 nt, Human
aggucccuaauaa

SEQ ID NO: 3070442 - RNA, 18 nt, Human
aggucuguucuuuccaaa

SEQ ID NO: 3070443 - RNA, 23 nt, Human
aggucuguucuuuccaaaguaca

SEQ ID NO: 3070444 - RNA, 22 nt, Human
aggucuguucuuuccaaaguac

SEQ ID NO: 3070445 - RNA, 18 nt, Human
aggugcuacaaaaacaca

SEQ ID NO: 3070446 - RNA, 22 nt, Human
aggugcuacaaaaacacagcaa

SEQ ID NO: 3070447 - RNA, 21 nt, Human
aggugcuacaaaaacacagca

SEQ ID NO: 3070448 - RNA, 20 nt, Human
aggugcuacaaaaacacagc

SEQ ID NO: 3070449 - RNA, 19 nt, Human
aggugcuacaaaaacacag

SEQ ID NO: 3070450 - RNA, 23 nt, Human
aggugcuaggaacacuccuucac

SEQ ID NO: 3070451 - RNA, 19 nt, Human
aggugcuaggaacacuccu

SEQ ID NO: 3070452 - RNA, 22 nt, Human
aggugcuaggaacacuccuuca

SEQ ID NO: 3070453 - RNA, 24 nt, Human
aggugcuacaaaaacacagcaagg

SEQ ID NO: 3070454 - RNA, 23 nt, Human
aggugcuacaaaaacacagcaag

SEQ ID NO: 3070455 - RNA, 22 nt, Human
agguucccuuugacgccauccc

SEQ ID NO: 3070456 - RNA, 13 nt, Human
agguucccuuuga

SEQ ID NO: 3070457 - RNA, 14 nt, Human
agguucaaagauau

SEQ ID NO: 3070458 - RNA, 23 nt, Human
agguucccuuugacgccauccca

SEQ ID NO: 3070459 - RNA, 19 nt, Human
aggggccucuuaugggcug

SEQ ID NO: 3070460 - RNA, 20 nt, Human
aggggccucuuaugggcugg

SEQ ID NO: 3070461 - RNA, 21 nt, Human
aggggccucuuaugggcuggg

SEQ ID NO: 3070462 - RNA, 21 nt, Human
aggguaucaggugcugccauc

SEQ ID NO: 3070463 - RNA, 18 nt, Human
aggguaucaggugcugcc

SEQ ID NO: 3070464 - RNA, 19 nt, Human
aggguaucaggugcugcca

SEQ ID NO: 3070465 - RNA, 11 nt, Human
agggucccugg

SEQ ID NO: 3070466 - RNA, 23 nt, Human
aggcuacuguaaggcaaucaugg

SEQ ID NO: 3070467 - RNA, 17 nt, Human
aggcuacugucagcucc

SEQ ID NO: 3070468 - RNA, 21 nt, Human
aggcuagaaccaccugccuau

SEQ ID NO: 3070469 - RNA, 20 nt, Human
aggcccuucucuccagcccc

SEQ ID NO: 3070470 - RNA, 21 nt, Human
aggcccuucucuccagccccu

SEQ ID NO: 3070471 - RNA, 22 nt, Human
aggcccuucucuccagccccug

SEQ ID NO: 3070472 - RNA, 23 nt, Human
aggcccuucucuccagccccugg

SEQ ID NO: 3070473 - RNA, 22 nt, Human
aggcccuugucggccccaccag

SEQ ID NO: 3070474 - RNA, 20 nt, Human
aggcugucaauuacaggaag

SEQ ID NO: 3070475 - RNA, 19 nt, Human
aggcugucaauuacaggaa

SEQ ID NO: 3070476 - RNA, 18 nt, Human
aggcuguaucccaugagc

SEQ ID NO: 3070477 - RNA, 13 nt, Human
aggcuguauccca

SEQ ID NO: 3070478 - RNA, 15 nt, Human
aggcuagauguaugu

SEQ ID NO: 3070479 - RNA, 16 nt, Human
aggcuagauguaugua

SEQ ID NO: 3070480 - RNA, 22 nt, Human
agggacagaggggguggccucc

SEQ ID NO: 3070481 - RNA, 21 nt, Human
aggcugucaauuacaggaagu

SEQ ID NO: 3070482 - RNA, 23 nt, Human
agggacagaggggguggccuccc

SEQ ID NO: 3070483 - RNA, 23 nt, Human
aggaugcuuguacauaaugcgug

SEQ ID NO: 3070484 - RNA, 21 nt, Human
aggaugcuuguacauaaugcg

SEQ ID NO: 3070485 - RNA, 13 nt, Human
aggaccucaggug

SEQ ID NO: 3070486 - RNA, 22 nt, Human
aggauguucuagcauggcugcc

SEQ ID NO: 3070487 - RNA, 16 nt, Human
aggauguucugggaca

SEQ ID NO: 3070488 - RNA, 15 nt, Human
aggauguucugggac

SEQ ID NO: 3070489 - RNA, 23 nt, Human
aggaugguucccuugaugaagaa

SEQ ID NO: 3070490 - RNA, 14 nt, Human
aggauuauuggaaa

SEQ ID NO: 3070491 - RNA, 17 nt, Human
aggauguugaaaaaguu

SEQ ID NO: 3070492 - RNA, 21 nt, Human
agcuuuucccuuuuuuuaagu

SEQ ID NO: 3070493 - RNA, 21 nt, Human
aggaaucaugugccaagcaga

SEQ ID NO: 3070494 - RNA, 17 nt, Human
aggaauccagacccggc

SEQ ID NO: 3070495 - RNA, 21 nt, Human
agcugcgguccacccaggagc

SEQ ID NO: 3070496 - RNA, 23 nt, Human
agcuccgcuuucuacccagcgag

SEQ ID NO: 3070497 - RNA, 21 nt, Human
agcuccgcuuucuacccagcg

SEQ ID NO: 3070498 - RNA, 20 nt, Human
agcuccgcuuucuacccagc

SEQ ID NO: 3070499 - RNA, 12 nt, Human
agcuccuucugu

SEQ ID NO: 3070500 - RNA, 13 nt, Human
agcuccuucuguc

SEQ ID NO: 3070501 - RNA, 22 nt, Human
agcuccccucggagaagagcug

SEQ ID NO: 3070502 - RNA, 23 nt, Human
agcugcgguccacccaggagccc

SEQ ID NO: 3070503 - RNA, 13 nt, Human
aaccacgcuggac

SEQ ID NO: 3070504 - RNA, 22 nt, Human
aaccacuggaaaguuuaugguu

SEQ ID NO: 3070505 - RNA, 15 nt, Human
aaccacuucagcuga

SEQ ID NO: 3070506 - RNA, 21 nt, Human
aaccgaacugauguaaguaaa

SEQ ID NO: 3070507 - RNA, 16 nt, Human
aacccgggaggcagag

SEQ ID NO: 3070508 - RNA, 15 nt, Human
aaaugccuuuguacu

SEQ ID NO: 3070509 - RNA, 17 nt, Human
aaaucuuauaauuuaaa

SEQ ID NO: 3070510 - RNA, 23 nt, Human
aaaugccuuacccucauguucuu

SEQ ID NO: 3070511 - RNA, 22 nt, Human
aaauguuguucucuucuuuaaa

SEQ ID NO: 3070512 - RNA, 18 nt, Human
aaauucuugcaaaguauc

SEQ ID NO: 3070513 - RNA, 21 nt, Human
aaauucuugcaaaguaucccu

SEQ ID NO: 3070514 - RNA, 13 nt, Human
aaauucuuucauu

SEQ ID NO: 3070515 - RNA, 19 nt, Human
aaauugacacuuaaaaaug

SEQ ID NO: 3070516 - RNA, 16 nt, Human
aacacaucagcuugcc

SEQ ID NO: 3070517 - RNA, 12 nt, Human
aacacaucagcu

SEQ ID NO: 3070518 - RNA, 18 nt, Human
aacaaauuuacagagaca

SEQ ID NO: 3070519 - RNA, 22 nt, Human
aacuuuauacccagaaaguuau

SEQ ID NO: 3070520 - RNA, 23 nt, Human
aacuuuauacccagaaaguuauu

SEQ ID NO: 3070521 - RNA, 20 nt, Human
aacuuuaugcuaagugaaau

SEQ ID NO: 3070522 - RNA, 21 nt, Human
aacuuuaugcuaagugaaaua

SEQ ID NO: 3070523 - RNA, 16 nt, Human
aacuuaaucuaaaugg

SEQ ID NO: 3070524 - RNA, 15 nt, Human
aacuuaaucuaaaug

SEQ ID NO: 3070525 - RNA, 18 nt, Human
aacuuaaucuaaauggaa

SEQ ID NO: 3070526 - RNA, 19 nt, Human
aacuuaaauaaugugaaac

SEQ ID NO: 3070527 - RNA, 14 nt, Human
aacugauaaagaug

SEQ ID NO: 3070528 - RNA, 15 nt, Human
aacugacucuuaaga

SEQ ID NO: 3070529 - RNA, 18 nt, Human
aacugacucuuaagaaga

SEQ ID NO: 3070530 - RNA, 20 nt, Human
aacugagaugugaacacauc

SEQ ID NO: 3070531 - RNA, 19 nt, Human
aacugacucuuaagaagac

SEQ ID NO: 3070532 - RNA, 20 nt, Human
aacugacucuuaagaagacu

SEQ ID NO: 3070533 - RNA, 15 nt, Human
aaaggcuccaggagc

SEQ ID NO: 3070534 - RNA, 16 nt, Human
aaaggcuccaggagca

SEQ ID NO: 3070535 - RNA, 14 nt, Human
aaaggcagaagcaa

SEQ ID NO: 3070536 - RNA, 19 nt, Human
aaauaaaacuuuuuaaaau

SEQ ID NO: 3070537 - RNA, 16 nt, Human
aaauaaaacuuuuuaa

SEQ ID NO: 3070538 - RNA, 13 nt, Human
aaauaaaacuuuu

SEQ ID NO: 3070539 - RNA, 13 nt, Human
aaaguggaaaaau

SEQ ID NO: 3070540 - RNA, 19 nt, Human
aaaggcuccaggagcagcc

SEQ ID NO: 3070541 - RNA, 20 nt, Human
aaaggcuccaggagcagcca

SEQ ID NO: 3070542 - RNA, 18 nt, Human
aaaucugcuuuuuaaaga

SEQ ID NO: 3070543 - RNA, 20 nt, Human
aaauauuuauuuuaauaaug

SEQ ID NO: 3070544 - RNA, 13 nt, Human
aaauauuuauuuu

SEQ ID NO: 3070545 - RNA, 15 nt, Human
aaauauuuauuuuaa

SEQ ID NO: 3070546 - RNA, 14 nt, Human
aaaucaaauaugca

SEQ ID NO: 3070547 - RNA, 12 nt, Human
aaaucaaauaug

SEQ ID NO: 3070548 - RNA, 15 nt, Human
aaaucaaauaugcaa

SEQ ID NO: 3070549 - RNA, 24 nt, Human
aaauagcucaggugucccugcacu

SEQ ID NO: 3070550 - RNA, 19 nt, Human
aaauaguggugugauuugg

SEQ ID NO: 3070551 - RNA, 20 nt, Human
aaauagcuuuuuucucugau

SEQ ID NO: 3070552 - RNA, 17 nt, Human
aaauagcuuuuuucucu

SEQ ID NO: 3070553 - RNA, 17 nt, Human
aaagaaauauaccuaaa

SEQ ID NO: 3070554 - RNA, 15 nt, Human
aaagaaauauaccua

SEQ ID NO: 3070555 - RNA, 23 nt, Human
aaacugagaugugaacacaucag

SEQ ID NO: 3070556 - RNA, 21 nt, Human
aaacugagaugugaacacauc

SEQ ID NO: 3070557 - RNA, 14 nt, Human
aaagaguaggaaga

SEQ ID NO: 3070558 - RNA, 15 nt, Human
aaagaaauguaaggg

SEQ ID NO: 3070559 - RNA, 13 nt, Human
aaagaagcagacc

SEQ ID NO: 3070560 - RNA, 16 nt, Human
aaagaagcagaccauu

SEQ ID NO: 3070561 - RNA, 17 nt, Human
aaagauauuuugcuuug

SEQ ID NO: 3070562 - RNA, 16 nt, Human
aaagauauuuugcuuu

SEQ ID NO: 3070563 - RNA, 12 nt, Human
aaagauauuuug

SEQ ID NO: 3070564 - RNA, 18 nt, Human
aaaccaucauugaaaucu

SEQ ID NO: 3070565 - RNA, 18 nt, Human
aaacucuccucugcugcu

SEQ ID NO: 3070566 - RNA, 13 nt, Human
aaacucuccucug

SEQ ID NO: 3070567 - RNA, 24 nt, Human
aaacccucgaggcggaucuuugga

SEQ ID NO: 3070568 - RNA, 13 nt, Human
aaacccucgaggc

SEQ ID NO: 3070569 - RNA, 21 nt, Human
aaacacugggagaaaugaaaa

SEQ ID NO: 3070570 - RNA, 24 nt, Human
aaacacucaguuguucaauaauaa

SEQ ID NO: 3070571 - RNA, 22 nt, Human
aaacacugggagaaaugaaaaa

SEQ ID NO: 3070572 - RNA, 16 nt, Human
aaacacuguucucugc

SEQ ID NO: 3070573 - RNA, 21 nt, Human
aaaauugaugggauuugguca

SEQ ID NO: 3070574 - RNA, 14 nt, Human
aaaauugauguguu

SEQ ID NO: 3070575 - RNA, 12 nt, Human
aaaauugaugug

SEQ ID NO: 3070576 - RNA, 21 nt, Human
aaaauugauguguuuauuuau

SEQ ID NO: 3070577 - RNA, 22 nt, Human
aaaaucucaaauuucuaaaucu

SEQ ID NO: 3070578 - RNA, 19 nt, Human
aaaaucucaaauuucuaaa

SEQ ID NO: 3070579 - RNA, 16 nt, Human
aaaaucucaauauuuc

SEQ ID NO: 3070580 - RNA, 17 nt, Human
aaaaucaguuguacagu

SEQ ID NO: 3070581 - RNA, 22 nt, Human
aaaaucccuuaccucggugccu

SEQ ID NO: 3070582 - RNA, 21 nt, Human
aaaaucuacacuccagugaga

SEQ ID NO: 3070583 - RNA, 18 nt, Human
aaaaguucugcagauaaa

SEQ ID NO: 3070584 - RNA, 17 nt, Human
aaaauaaaacuuuuuaa

SEQ ID NO: 3070585 - RNA, 16 nt, Human
aaaauaaaacuuuuua

SEQ ID NO: 3070586 - RNA, 15 nt, Human
aaaaagaaaggaggg

SEQ ID NO: 3070587 - RNA, 16 nt, Human
aaaaagaaacauuugg

SEQ ID NO: 3070588 - RNA, 20 nt, Human
aagcagauggaaugcugugu

SEQ ID NO: 3070589 - RNA, 19 nt, Human
aagcagauggaaugcugug

SEQ ID NO: 3070590 - RNA, 17 nt, Human
aagcagauggaaugcug

SEQ ID NO: 3070591 - RNA, 14 nt, Human
aagcagcguuucua

SEQ ID NO: 3070592 - RNA, 20 nt, Human
aagcagcguuucuaugacac

SEQ ID NO: 3070593 - RNA, 17 nt, Human
aagcagcguuucuauga

SEQ ID NO: 3070594 - RNA, 19 nt, Human
aagccagcaggcucucagg

SEQ ID NO: 3070595 - RNA, 22 nt, Human
aagcagcguuucuaugacacau

SEQ ID NO: 3070596 - RNA, 21 nt, Human
aagcagcguuucuaugacaca

SEQ ID NO: 3070597 - RNA, 20 nt, Human
aagccagcaggcucucaggc

SEQ ID NO: 3070598 - RNA, 23 nt, Human
aagccagcaggcucucaggccag

SEQ ID NO: 3070599 - RNA, 13 nt, Human
aagauaaaugugc

SEQ ID NO: 3070600 - RNA, 23 nt, Human
aagauacaguuacucagaauucu

SEQ ID NO: 3070601 - RNA, 12 nt, Human
aagauaaaugug

SEQ ID NO: 3070602 - RNA, 13 nt, Human
aagauacugaaau

SEQ ID NO: 3070603 - RNA, 18 nt, Human
aagcuguguggcagucug

SEQ ID NO: 3070604 - RNA, 21 nt, Human
aagcuggucccacucagucca

SEQ ID NO: 3070605 - RNA, 18 nt, Human
aagcuggucccacucagu

SEQ ID NO: 3070606 - RNA, 15 nt, Human
aagcugggcagguug

SEQ ID NO: 3070607 - RNA, 22 nt, Human
aagcuacugccauccuggccca

SEQ ID NO: 3070608 - RNA, 17 nt, Human
aagcuacugccauccug

SEQ ID NO: 3070609 - RNA, 13 nt, Human
aaggacacuagaa

SEQ ID NO: 3070610 - RNA, 15 nt, Human
aaggauugcuacugu

SEQ ID NO: 3070611 - RNA, 15 nt, Human
aaggauguucuagca

SEQ ID NO: 3070612 - RNA, 20 nt, Human
aaggcagcucuaaaugucaa

SEQ ID NO: 3070613 - RNA, 17 nt, Human
aagcgauucuucugcuu

SEQ ID NO: 3070614 - RNA, 21 nt, Human
aagcgauucuucugcuucagc

SEQ ID NO: 3070615 - RNA, 20 nt, Human
aaggugaggagcuugaaacc

SEQ ID NO: 3070616 - RNA, 20 nt, Human
aaguagaagucuuagaugua

SEQ ID NO: 3070617 - RNA, 19 nt, Human
aaguagaagucuuagaugu

SEQ ID NO: 3070618 - RNA, 21 nt, Human
aaguagaagucuuagauguau

SEQ ID NO: 3070619 - RNA, 21 nt, Human
aaguagggacuucugucuuca

SEQ ID NO: 3070620 - RNA, 23 nt, Human
aaguaucccuacuguaauuugug

SEQ ID NO: 3070621 - RNA, 18 nt, Human
aaguaucccuacuguaau

SEQ ID NO: 3070622 - RNA, 17 nt, Human
aaguaucccuacuguaa

SEQ ID NO: 3070623 - RNA, 14 nt, Human
aagucuccaaaguc

SEQ ID NO: 3070624 - RNA, 22 nt, Human
aaguccucuuuucugagaggac

SEQ ID NO: 3070625 - RNA, 18 nt, Human
aaguccucuuuucugaga

SEQ ID NO: 3070626 - RNA, 18 nt, Human
aaguccaagcauuuagau

SEQ ID NO: 3070627 - RNA, 17 nt, Human
aaguccaagcauaccaa

SEQ ID NO: 3070628 - RNA, 19 nt, Human
aaggucauuuuuuuuaaga

SEQ ID NO: 3070629 - RNA, 18 nt, Human
aaggucauuuuuuuuaag

SEQ ID NO: 3070630 - RNA, 23 nt, Human
aagggaaacugccagcaacgcag

SEQ ID NO: 3070631 - RNA, 17 nt, Human
aagggaaacugccagca

SEQ ID NO: 3070632 - RNA, 16 nt, Human
aagggaaacugccagc

SEQ ID NO: 3070633 - RNA, 15 nt, Human
aagucuccaaagucu

SEQ ID NO: 3070634 - RNA, 19 nt, Human
aaguggaaaaauagccugc

SEQ ID NO: 3070635 - RNA, 21 nt, Human
aaguggaaaaauagccugccu

SEQ ID NO: 3070636 - RNA, 12 nt, Human
aaguugaauuuu

SEQ ID NO: 3070637 - RNA, 20 nt, Human
aauguuuuuuuuuaaagacu

SEQ ID NO: 3070638 - RNA, 15 nt, Human
aauguuuuuuuuuaa

SEQ ID NO: 3070639 - RNA, 22 nt, Human
aauguuuuuuuuuaaagacuuu

SEQ ID NO: 3070640 - RNA, 21 nt, Human
aaugcuagguuaauuccaauu

SEQ ID NO: 3070641 - RNA, 16 nt, Human
aauguuugccucugcc

SEQ ID NO: 3070642 - RNA, 15 nt, Human
aauguuugccucugc

SEQ ID NO: 3070643 - RNA, 23 nt, Human
aauguuucaaacauauauaacaa

SEQ ID NO: 3070644 - RNA, 15 nt, Human
aaugugaaaagaaaa

SEQ ID NO: 3070645 - RNA, 19 nt, Human
aaugcuagguuaauuccaa

SEQ ID NO: 3070646 - RNA, 18 nt, Human
aaugcuagguuaauucca

SEQ ID NO: 3070647 - RNA, 19 nt, Human
aaugcgugcauaccacuuu

SEQ ID NO: 3070648 - RNA, 18 nt, Human
aaugcgugcauaccacuu

SEQ ID NO: 3070649 - RNA, 23 nt, Human
aaugccuuacccucauguucuua

SEQ ID NO: 3070650 - RNA, 18 nt, Human
aauccaagcaaaugugaa

SEQ ID NO: 3070651 - RNA, 17 nt, Human
aauccaagcaaauguga

SEQ ID NO: 3070652 - RNA, 13 nt, Human
aauccagccugcu

SEQ ID NO: 3070653 - RNA, 15 nt, Human
aaucucaaauuucua

SEQ ID NO: 3070654 - RNA, 16 nt, Human
aaucucaaauuucuaa

SEQ ID NO: 3070655 - RNA, 17 nt, Human
aauccagacccggcugc

SEQ ID NO: 3070656 - RNA, 19 nt, Human
aauccagacccggcugcgu

SEQ ID NO: 3070657 - RNA, 18 nt, Human
aaucucaaauuucuaaau

SEQ ID NO: 3070658 - RNA, 17 nt, Human
aaucucaaauuucuaaa

SEQ ID NO: 3070659 - RNA, 16 nt, Human
aaugauuaauuaaaac

SEQ ID NO: 3070660 - RNA, 21 nt, Human
aaugauuaugaauuacauuug

SEQ ID NO: 3070661 - RNA, 15 nt, Human
aaugauuaugaauua

SEQ ID NO: 3070662 - RNA, 15 nt, Human
aaucaccaaaggcuc

SEQ ID NO: 3070663 - RNA, 14 nt, Human
aaucaccgaaaacg

SEQ ID NO: 3070664 - RNA, 15 nt, Human
aaucaccgaaaacgu

SEQ ID NO: 3070665 - RNA, 16 nt, Human
aauauauaucaaauau

SEQ ID NO: 3070666 - RNA, 13 nt, Human
aauauguuucaaa

SEQ ID NO: 3070667 - RNA, 15 nt, Human
aauauguuucaaacu

SEQ ID NO: 3070668 - RNA, 16 nt, Human
aauauguuucaaacuu

SEQ ID NO: 3070669 - RNA, 17 nt, Human
aauauguuucaaacuuu

SEQ ID NO: 3070670 - RNA, 13 nt, Human
aauagacaauuua

SEQ ID NO: 3070671 - RNA, 20 nt, Human
aauacucuacccucuuagaa

SEQ ID NO: 3070672 - RNA, 22 nt, Human
aauacucuacccucuuagaaaa

SEQ ID NO: 3070673 - RNA, 13 nt, Human
aauacucuuauau

SEQ ID NO: 3070674 - RNA, 13 nt, Human
accagaucauugu

SEQ ID NO: 3070675 - RNA, 19 nt, Human
accagagcugccaccugcc

SEQ ID NO: 3070676 - RNA, 17 nt, Human
accagccaguaaauggg

SEQ ID NO: 3070677 - RNA, 13 nt, Human
accagcagaaaug

SEQ ID NO: 3070678 - RNA, 19 nt, Human
acauuuguucuauagcuuu

SEQ ID NO: 3070679 - RNA, 15 nt, Human
acauuuauucugcuc

SEQ ID NO: 3070680 - RNA, 21 nt, Human
acauuuguauaaaauaauuuu

SEQ ID NO: 3070681 - RNA, 14 nt, Human
acauuuauucugcu

SEQ ID NO: 3070682 - RNA, 22 nt, Human
acauguuucuuuguaaugaaaa

SEQ ID NO: 3070683 - RNA, 19 nt, Human
acauguuucuuuguaauga

SEQ ID NO: 3070684 - RNA, 18 nt, Human
acaugugcacaugcacgu

SEQ ID NO: 3070685 - RNA, 16 nt, Human
acaugugcacaugcac

SEQ ID NO: 3070686 - RNA, 17 nt, Human
acaucagcacgauuucu

SEQ ID NO: 3070687 - RNA, 15 nt, Human
acaucagcacgauuu

SEQ ID NO: 3070688 - RNA, 18 nt, Human
acaucagcacgauuucug

SEQ ID NO: 3070689 - RNA, 19 nt, Human
acaugaucuucuuuauaau

SEQ ID NO: 3070690 - RNA, 23 nt, Human
acaggcaaugcuggcuguuggcu

SEQ ID NO: 3070691 - RNA, 19 nt, Human
acaggcaaugcuggcuguu

SEQ ID NO: 3070692 - RNA, 19 nt, Human
acaggguuuugccauguug

SEQ ID NO: 3070693 - RNA, 21 nt, Human
acauaaugcgugcauaccacu

SEQ ID NO: 3070694 - RNA, 22 nt, Human
acauaaugcgugcauaccacuu

SEQ ID NO: 3070695 - RNA, 23 nt, Human
acauaaugcgugcauaccacuuu

SEQ ID NO: 3070696 - RNA, 20 nt, Human
accccucaacaccucugcac

SEQ ID NO: 3070697 - RNA, 19 nt, Human
accccuccaugugggcuag

SEQ ID NO: 3070698 - RNA, 16 nt, Human
accccuccaugugggc

SEQ ID NO: 3070699 - RNA, 16 nt, Human
accauauuaccacaga

SEQ ID NO: 3070700 - RNA, 14 nt, Human
accauauuaccaca

SEQ ID NO: 3070701 - RNA, 23 nt, Human
acccaagggccuggccugagcug

SEQ ID NO: 3070702 - RNA, 15 nt, Human
acccacaagaaauga

SEQ ID NO: 3070703 - RNA, 17 nt, Human
acccacaagaaaugaaa

SEQ ID NO: 3070704 - RNA, 21 nt, Human
acccacaagaaaugaaagcag

SEQ ID NO: 3070705 - RNA, 15 nt, Human
acccaccucagccuc

SEQ ID NO: 3070706 - RNA, 14 nt, Human
acccaccucagccu

SEQ ID NO: 3070707 - RNA, 13 nt, Human
acccaccucagcc

SEQ ID NO: 3070708 - RNA, 19 nt, Human
acccaagggccuggccuga

SEQ ID NO: 3070709 - RNA, 22 nt, Human
acccaagggccuggccugagcu

SEQ ID NO: 3070710 - RNA, 18 nt, Human
acccaagggccuggccug

SEQ ID NO: 3070711 - RNA, 20 nt, Human
accauauuaccacagacaua

SEQ ID NO: 3070712 - RNA, 11 nt, Human
acccccugaau

SEQ ID NO: 3070713 - RNA, 16 nt, Human
acccaccucagccucc

SEQ ID NO: 3070714 - RNA, 19 nt, Human
acccaguguuuuaggagca

SEQ ID NO: 3070715 - RNA, 22 nt, Human
acccaguguuuuaggagcauga

SEQ ID NO: 3070716 - RNA, 21 nt, Human
acaggaugaugacuauggaaa

SEQ ID NO: 3070717 - RNA, 14 nt, Human
acaggauuauugga

SEQ ID NO: 3070718 - RNA, 12 nt, Human
acaggcaagcac

SEQ ID NO: 3070719 - RNA, 18 nt, Human
acaggcaaugcuggcugu

SEQ ID NO: 3070720 - RNA, 15 nt, Human
acaggaucagucuga

SEQ ID NO: 3070721 - RNA, 17 nt, Human
acagcucuucuccaggc

SEQ ID NO: 3070722 - RNA, 16 nt, Human
acagcucuucuccagg

SEQ ID NO: 3070723 - RNA, 17 nt, Human
acagcucuguccuggga

SEQ ID NO: 3070724 - RNA, 15 nt, Human
acagccacggccagg

SEQ ID NO: 3070725 - RNA, 17 nt, Human
acagccacggccaggcc

SEQ ID NO: 3070726 - RNA, 16 nt, Human
acagccacggccaggc

SEQ ID NO: 3070727 - RNA, 18 nt, Human
acagccacggccaggcca

SEQ ID NO: 3070728 - RNA, 17 nt, Human
acagccaacuauggccu

SEQ ID NO: 3070729 - RNA, 18 nt, Human
acagcaguugaaaagacu

SEQ ID NO: 3070730 - RNA, 19 nt, Human
acagccaacuauggccugu

SEQ ID NO: 3070731 - RNA, 19 nt, Human
acagagugagacucugucu

SEQ ID NO: 3070732 - RNA, 21 nt, Human
acagcaguugaaaagacucca

SEQ ID NO: 3070733 - RNA, 23 nt, Human
acagcaguugaaaagacuccaaa

SEQ ID NO: 3070734 - RNA, 22 nt, Human
acagcaguugaaaagacuccaa

SEQ ID NO: 3070735 - RNA, 15 nt, Human
acagagugagacucu

SEQ ID NO: 3070736 - RNA, 23 nt, Human
acagagucucacuguugcccagg

SEQ ID NO: 3070737 - RNA, 11 nt, Human
acagacacagg

SEQ ID NO: 3070738 - RNA, 15 nt, Human
acacuguacugcaau

SEQ ID NO: 3070739 - RNA, 15 nt, Human
acagaggcagcccca

SEQ ID NO: 3070740 - RNA, 14 nt, Human
acagaggcagcccc

SEQ ID NO: 3070741 - RNA, 14 nt, Human
acagacacaggccc

SEQ ID NO: 3070742 - RNA, 13 nt, Human
acagacacaggcc

SEQ ID NO: 3070743 - RNA, 23 nt, Human
acagaggccaugggccuccugug

SEQ ID NO: 3070744 - RNA, 19 nt, Human
acagaggcagccccauucu

SEQ ID NO: 3070745 - RNA, 15 nt, Human
acacugcauguuugu

SEQ ID NO: 3070746 - RNA, 14 nt, Human
acacugcauguuug

SEQ ID NO: 3070747 - RNA, 21 nt, Human
acacuggcucacccaguccug

SEQ ID NO: 3070748 - RNA, 20 nt, Human
acacuggcucacccaguccu

SEQ ID NO: 3070749 - RNA, 22 nt, Human
acaaaauguaggguuauaauaa

SEQ ID NO: 3070750 - RNA, 12 nt, Human
acaaggcaaggc

SEQ ID NO: 3070751 - RNA, 14 nt, Human
acaaggcaaggcug

SEQ ID NO: 3070752 - RNA, 17 nt, Human
acaaggauugcuacugu

SEQ ID NO: 3070753 - RNA, 20 nt, Human
acaaggcaaggcugucaauu

SEQ ID NO: 3070754 - RNA, 17 nt, Human
acacgcgugcacacacc

SEQ ID NO: 3070755 - RNA, 15 nt, Human
acacgcgugcacaca

SEQ ID NO: 3070756 - RNA, 21 nt, Human
acacgagcaggcuacugucag

SEQ ID NO: 3070757 - RNA, 19 nt, Human
acacauuuuuuaaaugcac

SEQ ID NO: 3070758 - RNA, 19 nt, Human
acacgagcaggcuacuguc

SEQ ID NO: 3070759 - RNA, 14 nt, Human
acacgagcaggcua

SEQ ID NO: 3070760 - RNA, 12 nt, Human
acacauuuuucu

SEQ ID NO: 3070761 - RNA, 22 nt, Human
acacauuuuuuaaaugcaccug

SEQ ID NO: 3070762 - RNA, 20 nt, Human
acacauuuuuuaaaugcacc

SEQ ID NO: 3070763 - RNA, 13 nt, Human
acacagcucuucu

SEQ ID NO: 3070764 - RNA, 11 nt, Human
acacagcucuu

SEQ ID NO: 3070765 - RNA, 22 nt, Human
acacauuuuauuuuauuaugca

SEQ ID NO: 3070766 - RNA, 21 nt, Human
acacauuuuauuuuauuaugc

SEQ ID NO: 3070767 - RNA, 19 nt, Human
acacagaggcugccucucc

SEQ ID NO: 3070768 - RNA, 14 nt, Human
acacagcucugucc

SEQ ID NO: 3070769 - RNA, 20 nt, Human
acacagcucuguccugggag

SEQ ID NO: 3070770 - RNA, 11 nt, Human
agaaaguuauu

SEQ ID NO: 3070771 - RNA, 23 nt, Human
agaaaguuauugauaaguucaua

SEQ ID NO: 3070772 - RNA, 16 nt, Human
agaaaggauaaaguug

SEQ ID NO: 3070773 - RNA, 23 nt, Human
agaaaguacuucuccacccugcu

SEQ ID NO: 3070774 - RNA, 22 nt, Human
agaaaguacuucuccacccugc

SEQ ID NO: 3070775 - RNA, 20 nt, Human
acuuuauacccagaaaguua

SEQ ID NO: 3070776 - RNA, 22 nt, Human
acuuuauacccagaaaguuauu

SEQ ID NO: 3070777 - RNA, 22 nt, Human
acuuuaucuugaauaauguaag

SEQ ID NO: 3070778 - RNA, 22 nt, Human
acuuuauuuucuauaauuuaaa

SEQ ID NO: 3070779 - RNA, 16 nt, Human
acuuuguucuggcucu

SEQ ID NO: 3070780 - RNA, 17 nt, Human
acuuuguucuggcucuu

SEQ ID NO: 3070781 - RNA, 16 nt, Human
acuuuuaugauacuug

SEQ ID NO: 3070782 - RNA, 12 nt, Human
acuuuuaugaua

SEQ ID NO: 3070783 - RNA, 13 nt, Human
acuuuuauaaacu

SEQ ID NO: 3070784 - RNA, 19 nt, Human
acuuuguucuggcucuucc

SEQ ID NO: 3070785 - RNA, 23 nt, Human
acuuuuaugauacuugaaaauua

SEQ ID NO: 3070786 - RNA, 20 nt, Human
acuuuucauaaccuagccuu

SEQ ID NO: 3070787 - RNA, 16 nt, Human
acuuuucuuucagcca

SEQ ID NO: 3070788 - RNA, 14 nt, Human
agaaaauaacaaua

SEQ ID NO: 3070789 - RNA, 14 nt, Human
acuuuucuuugugg

SEQ ID NO: 3070790 - RNA, 16 nt, Human
agaaaaucaggcuggc

SEQ ID NO: 3070791 - RNA, 15 nt, Human
agaaaauaccaagga

SEQ ID NO: 3070792 - RNA, 19 nt, Human
agaaaauaguggugugauu

SEQ ID NO: 3070793 - RNA, 22 nt, Human
acugugaaguuuacauuguaaa

SEQ ID NO: 3070794 - RNA, 16 nt, Human
acugugaagagaacca

SEQ ID NO: 3070795 - RNA, 18 nt, Human
acugguuccauggccucu

SEQ ID NO: 3070796 - RNA, 22 nt, Human
acuguaagaaaauaucacuugu

SEQ ID NO: 3070797 - RNA, 19 nt, Human
acuguaagaaaauaucacu

SEQ ID NO: 3070798 - RNA, 13 nt, Human
acuguaagaaaau

SEQ ID NO: 3070799 - RNA, 18 nt, Human
acugguaggaaacuaggu

SEQ ID NO: 3070800 - RNA, 15 nt, Human
acuggagaaaaugga

SEQ ID NO: 3070801 - RNA, 17 nt, Human
acuggaagcacagcuuc

SEQ ID NO: 3070802 - RNA, 19 nt, Human
acuggaagcacagcuucau

SEQ ID NO: 3070803 - RNA, 16 nt, Human
acuggaagcacagcuu

SEQ ID NO: 3070804 - RNA, 13 nt, Human
acugccagcaacg

SEQ ID NO: 3070805 - RNA, 20 nt, Human
acucugucucaguccaugaa

SEQ ID NO: 3070806 - RNA, 18 nt, Human
acucugucucaguccaug

SEQ ID NO: 3070807 - RNA, 20 nt, Human
acugugcugagucugaaggc

SEQ ID NO: 3070808 - RNA, 14 nt, Human
acuugggccacugu

SEQ ID NO: 3070809 - RNA, 15 nt, Human
acuugggccacugug

SEQ ID NO: 3070810 - RNA, 22 nt, Human
acuucugucuucacaacagauu

SEQ ID NO: 3070811 - RNA, 18 nt, Human
acuucuuauacauuugau

SEQ ID NO: 3070812 - RNA, 16 nt, Human
acuugguuuuuaaaaa

SEQ ID NO: 3070813 - RNA, 21 nt, Human
acuuggucugugagaugcuag

SEQ ID NO: 3070814 - RNA, 23 nt, Human
acuucacauauugauuuccguua

SEQ ID NO: 3070815 - RNA, 21 nt, Human
acuucugucuucacaacagau

SEQ ID NO: 3070816 - RNA, 19 nt, Human
acucaguccauagcagaga

SEQ ID NO: 3070817 - RNA, 22 nt, Human
acuauucaggagaguagaacag

SEQ ID NO: 3070818 - RNA, 18 nt, Human
acuauucaaacagucuca

SEQ ID NO: 3070819 - RNA, 21 nt, Human
acuauucaaacagucucagga

SEQ ID NO: 3070820 - RNA, 20 nt, Human
acuaguauuucuaugaaaua

SEQ ID NO: 3070821 - RNA, 19 nt, Human
acuaguauuucuaugaaau

SEQ ID NO: 3070822 - RNA, 13 nt, Human
acucaaaagcugg

SEQ ID NO: 3070823 - RNA, 14 nt, Human
acucaaaucaagaa

SEQ ID NO: 3070824 - RNA, 15 nt, Human
acucuagggaaaaac

SEQ ID NO: 3070825 - RNA, 17 nt, Human
acucuagggaaaaacca

SEQ ID NO: 3070826 - RNA, 23 nt, Human
acucuaucaaguauuauaccuuu

SEQ ID NO: 3070827 - RNA, 21 nt, Human
acucuaucaaguauuauaccu

SEQ ID NO: 3070828 - RNA, 17 nt, Human
acucuauguucuaagaa

SEQ ID NO: 3070829 - RNA, 19 nt, Human
acucugucgcccagucugg

SEQ ID NO: 3070830 - RNA, 15 nt, Human
acucauauuuucaug

SEQ ID NO: 3070831 - RNA, 12 nt, Human
accugucccccu

SEQ ID NO: 3070832 - RNA, 15 nt, Human
accugucccccugac

SEQ ID NO: 3070833 - RNA, 16 nt, Human
accugucccccugaca

SEQ ID NO: 3070834 - RNA, 15 nt, Human
accuuuaagagaaau

SEQ ID NO: 3070835 - RNA, 18 nt, Human
accuuucccaucuuccaa

SEQ ID NO: 3070836 - RNA, 13 nt, Human
accuuucccaucu

SEQ ID NO: 3070837 - RNA, 17 nt, Human
accuuggcugcagggag

SEQ ID NO: 3070838 - RNA, 18 nt, Human
accuuggcugcagggagu

SEQ ID NO: 3070839 - RNA, 15 nt, Human
accucugcagcaaua

SEQ ID NO: 3070840 - RNA, 20 nt, Human
accucugcagcaauaaagca

SEQ ID NO: 3070841 - RNA, 18 nt, Human
accucugcagcaauaaag

SEQ ID NO: 3070842 - RNA, 23 nt, Human
accucugccugaagucacacagu

SEQ ID NO: 3070843 - RNA, 21 nt, Human
accucugcagcaauaaagcag

SEQ ID NO: 3070844 - RNA, 12 nt, Human
acgcugugcugc

SEQ ID NO: 3070845 - RNA, 14 nt, Human
acgcugugcugccc

SEQ ID NO: 3070846 - RNA, 11 nt, Human
acgcugugcug

SEQ ID NO: 3070847 - RNA, 22 nt, Human
acgcaggcccccaggugccagu

SEQ ID NO: 3070848 - RNA, 19 nt, Human
acgcaggcccccaggugcc

SEQ ID NO: 3070849 - RNA, 14 nt, Human
acgucugacaggca

SEQ ID NO: 3070850 - RNA, 13 nt, Human
acgucugacaggc

SEQ ID NO: 3070851 - RNA, 14 nt, Human
acggaacucaaaua

SEQ ID NO: 3070852 - RNA, 11 nt, Human
acgugaguccu

SEQ ID NO: 3070853 - RNA, 13 nt, Human
acuaagagagaau

SEQ ID NO: 3070854 - RNA, 15 nt, Human
caaauucugucucug

SEQ ID NO: 3070855 - RNA, 15 nt, Human
caaauugugugaaag

SEQ ID NO: 3070856 - RNA, 14 nt, Human
caaauuuacagaga

SEQ ID NO: 3070857 - RNA, 23 nt, Human
caacaggcugggcuucaguggca

SEQ ID NO: 3070858 - RNA, 15 nt, Human
caaauuuacagagac

SEQ ID NO: 3070859 - RNA, 24 nt, Human
caacaggcugggcuucaguggcag

SEQ ID NO: 3070860 - RNA, 19 nt, Human
caacagguuuuccugaaga

SEQ ID NO: 3070861 - RNA, 18 nt, Human
caacaggguuuuuuucca

SEQ ID NO: 3070862 - RNA, 15 nt, Human
caacagguuuuccug

SEQ ID NO: 3070863 - RNA, 22 nt, Human
caacaucuuggucagauuugaa

SEQ ID NO: 3070864 - RNA, 19 nt, Human
caaccccuucgcuccugug

SEQ ID NO: 3070865 - RNA, 18 nt, Human
caaccccuucgcuccugu

SEQ ID NO: 3070866 - RNA, 21 nt, Human
caaccccuucgcuccuguguc

SEQ ID NO: 3070867 - RNA, 12 nt, Human
caacuuuauacc

SEQ ID NO: 3070868 - RNA, 12 nt, Human
caacuuuguaua

SEQ ID NO: 3070869 - RNA, 18 nt, Human
caagaaaacaacuucaau

SEQ ID NO: 3070870 - RNA, 11 nt, Human
caacuuuguau

SEQ ID NO: 3070871 - RNA, 20 nt, Human
caacucuccuccagagucag

SEQ ID NO: 3070872 - RNA, 21 nt, Human
caacucugaaggguaauuaua

SEQ ID NO: 3070873 - RNA, 16 nt, Human
caacugcauuggcuuu

SEQ ID NO: 3070874 - RNA, 12 nt, Human
caacccucauca

SEQ ID NO: 3070875 - RNA, 15 nt, Human
caacccucaucacca

SEQ ID NO: 3070876 - RNA, 16 nt, Human
caaccugauugugucu

SEQ ID NO: 3070877 - RNA, 19 nt, Human
caacucuccuccagaguca

SEQ ID NO: 3070878 - RNA, 17 nt, Human
caagcacuaaacaaaga

SEQ ID NO: 3070879 - RNA, 18 nt, Human
caagcaccuccugccucg

SEQ ID NO: 3070880 - RNA, 21 nt, Human
caagccaccaacauacuccca

SEQ ID NO: 3070881 - RNA, 16 nt, Human
caagcgugagccacug

SEQ ID NO: 3070882 - RNA, 13 nt, Human
caaggauccugag

SEQ ID NO: 3070883 - RNA, 21 nt, Human
caaggaugaucuaggaagacu

SEQ ID NO: 3070884 - RNA, 22 nt, Human
caaggauccugagccagauuuc

SEQ ID NO: 3070885 - RNA, 17 nt, Human
caagcgugagccacugc

SEQ ID NO: 3070886 - RNA, 17 nt, Human
caagugauucuccugcc

SEQ ID NO: 3070887 - RNA, 16 nt, Human
caagugauucuccugc

SEQ ID NO: 3070888 - RNA, 19 nt, Human
caagugaaaaaggaggaag

SEQ ID NO: 3070889 - RNA, 21 nt, Human
caagugauucuccugccucag

SEQ ID NO: 3070890 - RNA, 22 nt, Human
caagugauucuccugccucagc

SEQ ID NO: 3070891 - RNA, 22 nt, Human
caagugugguagagugugccug

SEQ ID NO: 3070892 - RNA, 23 nt, Human
caaggugggaggauugcuugagc

SEQ ID NO: 3070893 - RNA, 12 nt, Human
caaggugggagg

SEQ ID NO: 3070894 - RNA, 19 nt, Human
caagggccuggccugagcu

SEQ ID NO: 3070895 - RNA, 16 nt, Human
caagggccuggccuga

SEQ ID NO: 3070896 - RNA, 15 nt, Human
caaggauugcuacug

SEQ ID NO: 3070897 - RNA, 23 nt, Human
caaaaaaauauauuuaaugauaa

SEQ ID NO: 3070898 - RNA, 18 nt, Human
auuuuuuuacuaauagac

SEQ ID NO: 3070899 - RNA, 15 nt, Human
caaagcuaggccugg

SEQ ID NO: 3070900 - RNA, 21 nt, Human
caaagccaaagcuaggccugg

SEQ ID NO: 3070901 - RNA, 20 nt, Human
caaagccaaagcuaggccug

SEQ ID NO: 3070902 - RNA, 17 nt, Human
caaagcuaggccuggcc

SEQ ID NO: 3070903 - RNA, 16 nt, Human
caaagcuaggccuggc

SEQ ID NO: 3070904 - RNA, 16 nt, Human
caaagcuuguuaagau

SEQ ID NO: 3070905 - RNA, 12 nt, Human
caaauauauuca

SEQ ID NO: 3070906 - RNA, 14 nt, Human
caaauaugcaaagc

SEQ ID NO: 3070907 - RNA, 21 nt, Human
caaaggaugcccaaagaugca

SEQ ID NO: 3070908 - RNA, 13 nt, Human
caaaucagcugcu

SEQ ID NO: 3070909 - RNA, 16 nt, Human
caaaucagcugcuacu

SEQ ID NO: 3070910 - RNA, 18 nt, Human
caaauaugcaaagcacug

SEQ ID NO: 3070911 - RNA, 17 nt, Human
caaauaugcaaagcacu

SEQ ID NO: 3070912 - RNA, 16 nt, Human
caaauaugcaaagcac

SEQ ID NO: 3070913 - RNA, 22 nt, Human
caaauucugcuugcuugcuuuu

SEQ ID NO: 3070914 - RNA, 21 nt, Human
caaauguucaucaaugaauga

SEQ ID NO: 3070915 - RNA, 20 nt, Human
caaauguucaucaaugaaug

SEQ ID NO: 3070916 - RNA, 23 nt, Human
cacauguccaagaagcccaggaa

SEQ ID NO: 3070917 - RNA, 19 nt, Human
cacaugccucucucaggcc

SEQ ID NO: 3070918 - RNA, 13 nt, Human
cacaugccucucu

SEQ ID NO: 3070919 - RNA, 17 nt, Human
cacaugccucucucagg

SEQ ID NO: 3070920 - RNA, 18 nt, Human
cacaugccucucucaggc

SEQ ID NO: 3070921 - RNA, 18 nt, Human
cacaucagcacgauuucu

SEQ ID NO: 3070922 - RNA, 12 nt, Human
cacauaucuguc

SEQ ID NO: 3070923 - RNA, 20 nt, Human
cacauauugauuuccguuaa

SEQ ID NO: 3070924 - RNA, 15 nt, Human
cacaugugcacaugc

SEQ ID NO: 3070925 - RNA, 14 nt, Human
cacaugugcacaug

SEQ ID NO: 3070926 - RNA, 17 nt, Human
cacaugugcacaugcac

SEQ ID NO: 3070927 - RNA, 16 nt, Human
cacauuccugaugcuu

SEQ ID NO: 3070928 - RNA, 16 nt, Human
cacauuccugaacagg

SEQ ID NO: 3070929 - RNA, 15 nt, Human
caccacacccagccc

SEQ ID NO: 3070930 - RNA, 13 nt, Human
caccacacccagc

SEQ ID NO: 3070931 - RNA, 18 nt, Human
cacauuggagauguuuag

SEQ ID NO: 3070932 - RNA, 17 nt, Human
cacauuggaaacaaguc

SEQ ID NO: 3070933 - RNA, 15 nt, Human
caccaagcccaguua

SEQ ID NO: 3070934 - RNA, 18 nt, Human
caccacuacauucuguua

SEQ ID NO: 3070935 - RNA, 17 nt, Human
caccacuacauucuguu

SEQ ID NO: 3070936 - RNA, 16 nt, Human
caccacuacauucugu

SEQ ID NO: 3070937 - RNA, 14 nt, Human
caccaccucuuugg

SEQ ID NO: 3070938 - RNA, 20 nt, Human
caccacuacauucuguuaau

SEQ ID NO: 3070939 - RNA, 19 nt, Human
caccacuacauucuguuaa

SEQ ID NO: 3070940 - RNA, 18 nt, Human
caccacaugugcacaugc

SEQ ID NO: 3070941 - RNA, 15 nt, Human
caccacaugugcaca

SEQ ID NO: 3070942 - RNA, 19 nt, Human
caccacaugugcacaugca

SEQ ID NO: 3070943 - RNA, 23 nt, Human
cacauaucuaguaugaaauuaua

SEQ ID NO: 3070944 - RNA, 17 nt, Human
cacauacacacacacgc

SEQ ID NO: 3070945 - RNA, 14 nt, Human
cacaguuuucugag

SEQ ID NO: 3070946 - RNA, 23 nt, Human
cacaggcccggcuccaggcuccu

SEQ ID NO: 3070947 - RNA, 20 nt, Human
cacaggcccggcuccaggcu

SEQ ID NO: 3070948 - RNA, 18 nt, Human
cacagugagucgaggaca

SEQ ID NO: 3070949 - RNA, 20 nt, Human
cacagugagucgaggacagg

SEQ ID NO: 3070950 - RNA, 19 nt, Human
cacagugagucgaggacag

SEQ ID NO: 3070951 - RNA, 16 nt, Human
cacaggaucagucuga

SEQ ID NO: 3070952 - RNA, 15 nt, Human
cacaggaucagucug

SEQ ID NO: 3070953 - RNA, 12 nt, Human
cacaggaucagu

SEQ ID NO: 3070954 - RNA, 19 nt, Human
cacaggaaccacaagacug

SEQ ID NO: 3070955 - RNA, 15 nt, Human
cacaggaaguagagg

SEQ ID NO: 3070956 - RNA, 20 nt, Human
cacaggaaccacaagacugc

SEQ ID NO: 3070957 - RNA, 10 nt, Human
cacaggcagg

SEQ ID NO: 3070958 - RNA, 19 nt, Human
cacaggcccggcuccaggc

SEQ ID NO: 3070959 - RNA, 18 nt, Human
cacaggcccggcuccagg

SEQ ID NO: 3070960 - RNA, 17 nt, Human
cacaggcccggcuccag

SEQ ID NO: 3070961 - RNA, 16 nt, Human
cacaggcccggcucca

SEQ ID NO: 3070962 - RNA, 22 nt, Human
cacagcaguugaaaagacucca

SEQ ID NO: 3070963 - RNA, 20 nt, Human
cacagaugggugcuuggagg

SEQ ID NO: 3070964 - RNA, 14 nt, Human
cacagaugggugcu

SEQ ID NO: 3070965 - RNA, 18 nt, Human
cacagaugggugcuugga

SEQ ID NO: 3070966 - RNA, 20 nt, Human
cacagaguuguuacauuuuu

SEQ ID NO: 3070967 - RNA, 21 nt, Human
cacaaauucugucucuggauu

SEQ ID NO: 3070968 - RNA, 11 nt, Human
cacaacagauu

SEQ ID NO: 3070969 - RNA, 18 nt, Human
cacaaaaguuucucuuuu

SEQ ID NO: 3070970 - RNA, 16 nt, Human
cacaaaaguuucucuu

SEQ ID NO: 3070971 - RNA, 19 nt, Human
caaugcaaaccaucauuga

SEQ ID NO: 3070972 - RNA, 22 nt, Human
caaugcacuuuguucuggcucu

SEQ ID NO: 3070973 - RNA, 23 nt, Human
caaugcacuuuguucuggcucuu

SEQ ID NO: 3070974 - RNA, 14 nt, Human
caaugcaaaccauc

SEQ ID NO: 3070975 - RNA, 17 nt, Human
caaugcaaaccaucauu

SEQ ID NO: 3070976 - RNA, 18 nt, Human
caaugcaaaccaucauug

SEQ ID NO: 3070977 - RNA, 22 nt, Human
caaugaaugaaugaauggcuaa

SEQ ID NO: 3070978 - RNA, 21 nt, Human
caauaggaaaaacugauuuuu

SEQ ID NO: 3070979 - RNA, 21 nt, Human
caauaucuuuuuuuuaauaaa

SEQ ID NO: 3070980 - RNA, 20 nt, Human
caauaggaaaaacugauuuu

SEQ ID NO: 3070981 - RNA, 18 nt, Human
caauaggaaaaacugauu

SEQ ID NO: 3070982 - RNA, 19 nt, Human
cacaacuauuuuuccaaaa

SEQ ID NO: 3070983 - RNA, 14 nt, Human
cacaacuauuuuuc

SEQ ID NO: 3070984 - RNA, 13 nt, Human
cacaacuauauug

SEQ ID NO: 3070985 - RNA, 14 nt, Human
cacacaccagagcc

SEQ ID NO: 3070986 - RNA, 12 nt, Human
cacacagcucug

SEQ ID NO: 3070987 - RNA, 19 nt, Human
cacacagaggcugccucuc

SEQ ID NO: 3070988 - RNA, 13 nt, Human
cacaccagagccc

SEQ ID NO: 3070989 - RNA, 12 nt, Human
cacaccagagcc

SEQ ID NO: 3070990 - RNA, 15 nt, Human
cacaccagagcccac

SEQ ID NO: 3070991 - RNA, 15 nt, Human
cacaccauaagcuac

SEQ ID NO: 3070992 - RNA, 21 nt, Human
cacaccauaagcuacugccau

SEQ ID NO: 3070993 - RNA, 23 nt, Human
cacaccauaagcuacugccaucc

SEQ ID NO: 3070994 - RNA, 21 nt, Human
cacagagaaaguacuucucca

SEQ ID NO: 3070995 - RNA, 17 nt, Human
cacagaguuguuacauu

SEQ ID NO: 3070996 - RNA, 16 nt, Human
cacagaguuguuacau

SEQ ID NO: 3070997 - RNA, 22 nt, Human
cacagacccugcccugugggcc

SEQ ID NO: 3070998 - RNA, 21 nt, Human
cacacuugacaucaacugcau

SEQ ID NO: 3070999 - RNA, 15 nt, Human
cacacuggcucaccc

SEQ ID NO: 3071000 - RNA, 16 nt, Human
cacacuggcucaccca

SEQ ID NO: 3071001 - RNA, 19 nt, Human
cacacuggcucacccaguc

SEQ ID NO: 3071002 - RNA, 12 nt, Human
cacacuggcuca

SEQ ID NO: 3071003 - RNA, 14 nt, Human
cacacugaagaagc

SEQ ID NO: 3071004 - RNA, 19 nt, Human
cacacucaaaucaagaaac

SEQ ID NO: 3071005 - RNA, 16 nt, Human
cacccaagggccuggc

SEQ ID NO: 3071006 - RNA, 17 nt, Human
cacccaagggccuggcc

SEQ ID NO: 3071007 - RNA, 18 nt, Human
cacccaagggccuggccu

SEQ ID NO: 3071008 - RNA, 19 nt, Human
cacccaagggccuggccug

SEQ ID NO: 3071009 - RNA, 20 nt, Human
cacccaagggccuggccuga

SEQ ID NO: 3071010 - RNA, 21 nt, Human
cacccaagggccuggccugag

SEQ ID NO: 3071011 - RNA, 23 nt, Human
cacccaagggccuggccugagcu

SEQ ID NO: 3071012 - RNA, 15 nt, Human
cacccacaccauaag

SEQ ID NO: 3071013 - RNA, 22 nt, Human
cacccaccaucaugucuggcua

SEQ ID NO: 3071014 - RNA, 20 nt, Human
cacccaccaucaugucuggc

SEQ ID NO: 3071015 - RNA, 16 nt, Human
cacccaccucagccuc

SEQ ID NO: 3071016 - RNA, 14 nt, Human
cacccaccucagcc

SEQ ID NO: 3071017 - RNA, 13 nt, Human
cacccaccucagc

SEQ ID NO: 3071018 - RNA, 12 nt, Human
cacccaccucag

SEQ ID NO: 3071019 - RNA, 12 nt, Human
caccccagcccc

SEQ ID NO: 3071020 - RNA, 13 nt, Human
caccccagcccca

SEQ ID NO: 3071021 - RNA, 22 nt, Human
cacccccacccaagggccuggc

SEQ ID NO: 3071022 - RNA, 14 nt, Human
caccccggccaccu

SEQ ID NO: 3071023 - RNA, 15 nt, Human
caccccggccaccug

SEQ ID NO: 3071024 - RNA, 16 nt, Human
caccccggccaccugc

SEQ ID NO: 3071025 - RNA, 17 nt, Human
caccccggccaccugcg

SEQ ID NO: 3071026 - RNA, 15 nt, Human
uuggauuguccccga

SEQ ID NO: 3071027 - RNA, 15 nt, Human
uuggacccugaggcc

SEQ ID NO: 3071028 - RNA, 18 nt, Human
uuggacccugaggcccag

SEQ ID NO: 3071029 - RNA, 19 nt, Human
uuggacccugaggcccaga

SEQ ID NO: 3071030 - RNA, 21 nt, Human
uuggacccugaggcccagagg

SEQ ID NO: 3071031 - RNA, 19 nt, Human
uuggaagcuccgcuuucua

SEQ ID NO: 3071032 - RNA, 18 nt, Human
uuggacaaaauggaauac

SEQ ID NO: 3071033 - RNA, 19 nt, Human
uuggacagaagcagcucuu

SEQ ID NO: 3071034 - RNA, 16 nt, Human
uuggacagaagcagcu

SEQ ID NO: 3071035 - RNA, 21 nt, Human
uugccauguuggccaggcugg

SEQ ID NO: 3071036 - RNA, 20 nt, Human
uugccauguuggccaggcug

SEQ ID NO: 3071037 - RNA, 18 nt, Human
uugcugucccuuuuccuu

SEQ ID NO: 3071038 - RNA, 16 nt, Human
uugcugucccuuuucc

SEQ ID NO: 3071039 - RNA, 14 nt, Human
uugcugcuugaggc

SEQ ID NO: 3071040 - RNA, 16 nt, Human
uugcugcuugaggcaa

SEQ ID NO: 3071041 - RNA, 18 nt, Human
uugcuaagcauuccaacu

SEQ ID NO: 3071042 - RNA, 16 nt, Human
uugcuaagcauuccaa

SEQ ID NO: 3071043 - RNA, 23 nt, Human
uuggcuucacggaagagccuugc

SEQ ID NO: 3071044 - RNA, 20 nt, Human
uuggucugacccacugcuuu

SEQ ID NO: 3071045 - RNA, 13 nt, Human
uugguccugcugc

SEQ ID NO: 3071046 - RNA, 12 nt, Human
uuguaaaauggu

SEQ ID NO: 3071047 - RNA, 13 nt, Human
uuguaaaauggug

SEQ ID NO: 3071048 - RNA, 20 nt, Human
uugguaaggggaauugagga

SEQ ID NO: 3071049 - RNA, 16 nt, Human
uuguacgaagaguauu

SEQ ID NO: 3071050 - RNA, 19 nt, Human
uuguacgaagaguauuuuu

SEQ ID NO: 3071051 - RNA, 16 nt, Human
uuguaccgcaauguga

SEQ ID NO: 3071052 - RNA, 20 nt, Human
uuguaaaauggugugaccac

SEQ ID NO: 3071053 - RNA, 18 nt, Human
uuguacuuuagggaagua

SEQ ID NO: 3071054 - RNA, 22 nt, Human
uuguagaagucacauuccugaa

SEQ ID NO: 3071055 - RNA, 17 nt, Human
uuguagaagucacauuc

SEQ ID NO: 3071056 - RNA, 14 nt, Human
uuguagcacugaca

SEQ ID NO: 3071057 - RNA, 16 nt, Human
uuguagcacugacaga

SEQ ID NO: 3071058 - RNA, 17 nt, Human
uuguagcacugacagau

SEQ ID NO: 3071059 - RNA, 18 nt, Human
uuguagcacugacagauu

SEQ ID NO: 3071060 - RNA, 22 nt, Human
uuguagcacugacagauuucca

SEQ ID NO: 3071061 - RNA, 15 nt, Human
uuguagcauccugga

SEQ ID NO: 3071062 - RNA, 20 nt, Human
uugucuaugggacucaaugc

SEQ ID NO: 3071063 - RNA, 22 nt, Human
uugucuuaaaaaguggaaaaau

SEQ ID NO: 3071064 - RNA, 22 nt, Human
uugucaaaguggugagaggcau

SEQ ID NO: 3071065 - RNA, 14 nt, Human
uugucuaugggacu

SEQ ID NO: 3071066 - RNA, 20 nt, Human
uuguauuuuacuaauaaaau

SEQ ID NO: 3071067 - RNA, 16 nt, Human
uugcauaacguauaaa

SEQ ID NO: 3071068 - RNA, 19 nt, Human
uugccauguuggccaggcu

SEQ ID NO: 3071069 - RNA, 18 nt, Human
uugccauguuggccaggc

SEQ ID NO: 3071070 - RNA, 17 nt, Human
uugccauguuggccagg

SEQ ID NO: 3071071 - RNA, 16 nt, Human
uugccauguuggccag

SEQ ID NO: 3071072 - RNA, 13 nt, Human
uugauucauaaug

SEQ ID NO: 3071073 - RNA, 17 nt, Human
uugauucauaaugacuu

SEQ ID NO: 3071074 - RNA, 22 nt, Human
uugcagacaggcaagcaccucc

SEQ ID NO: 3071075 - RNA, 23 nt, Human
uugcagacaggcaagcaccuccu

SEQ ID NO: 3071076 - RNA, 23 nt, Human
uugcagcucuccccuucucugua

SEQ ID NO: 3071077 - RNA, 17 nt, Human
uugauccagaaagaaaa

SEQ ID NO: 3071078 - RNA, 16 nt, Human
uugauucagcucugca

SEQ ID NO: 3071079 - RNA, 23 nt, Human
uugauucagacagcugccuggga

SEQ ID NO: 3071080 - RNA, 17 nt, Human
uugauucagacagcugc

SEQ ID NO: 3071081 - RNA, 21 nt, Human
uugauucagacagcugccugg

SEQ ID NO: 3071082 - RNA, 16 nt, Human
uugauaugcuuauaca

SEQ ID NO: 3071083 - RNA, 16 nt, Human
uugauaugugaacagu

SEQ ID NO: 3071084 - RNA, 20 nt, Human
uugauaugccuuuucccaac

SEQ ID NO: 3071085 - RNA, 14 nt, Human
uugagccugggagg

SEQ ID NO: 3071086 - RNA, 14 nt, Human
uugagccuugaacu

SEQ ID NO: 3071087 - RNA, 16 nt, Human
uugagccuugaacuuu

SEQ ID NO: 3071088 - RNA, 15 nt, Human
uugagccuugaacuu

SEQ ID NO: 3071089 - RNA, 19 nt, Human
uugagccuugaacuuugac

SEQ ID NO: 3071090 - RNA, 18 nt, Human
uugaaaauuaacaugaau

SEQ ID NO: 3071091 - RNA, 15 nt, Human
uugaacuuugaccuc

SEQ ID NO: 3071092 - RNA, 21 nt, Human
uugaaaaucuuauaauuuaaa

SEQ ID NO: 3071093 - RNA, 21 nt, Human
uucuuuccugaggcugggcuc

SEQ ID NO: 3071094 - RNA, 18 nt, Human
uucuuuccacagaagcuc

SEQ ID NO: 3071095 - RNA, 17 nt, Human
uugaauguuaagcagau

SEQ ID NO: 3071096 - RNA, 14 nt, Human
uugaauguuaagca

SEQ ID NO: 3071097 - RNA, 12 nt, Human
uugaaugaugcc

SEQ ID NO: 3071098 - RNA, 16 nt, Human
uugaaugaugccauga

SEQ ID NO: 3071099 - RNA, 18 nt, Human
uugaacuuugaccucugc

SEQ ID NO: 3071100 - RNA, 17 nt, Human
uugaacuuugaccucug

SEQ ID NO: 3071101 - RNA, 16 nt, Human
uugaagagguuuuaaa

SEQ ID NO: 3071102 - RNA, 13 nt, Human
uugaacuuugacc

SEQ ID NO: 3071103 - RNA, 20 nt, Human
uugaagcacagugaucaagu

SEQ ID NO: 3071104 - RNA, 21 nt, Human
uugaagagguuuuaaagcuuc

SEQ ID NO: 3071105 - RNA, 20 nt, Human
uucuggcagaguugaagaca

SEQ ID NO: 3071106 - RNA, 24 nt, Human
uucuaaguaaaaccacagcaguug

SEQ ID NO: 3071107 - RNA, 17 nt, Human
uucuuagggaaggauac

SEQ ID NO: 3071108 - RNA, 19 nt, Human
uucuuaggguuaugauuaa

SEQ ID NO: 3071109 - RNA, 13 nt, Human
uucuucagagacu

SEQ ID NO: 3071110 - RNA, 16 nt, Human
uuuaaaaugagaaauc

SEQ ID NO: 3071111 - RNA, 12 nt, Human
uuuaaaaugucu

SEQ ID NO: 3071112 - RNA, 13 nt, Human
uuuaacagaaaug

SEQ ID NO: 3071113 - RNA, 13 nt, Human
uuuaaaagauaca

SEQ ID NO: 3071114 - RNA, 17 nt, Human
uuuaaaagaaugauuau

SEQ ID NO: 3071115 - RNA, 14 nt, Human
uuuaaaagaaugau

SEQ ID NO: 3071116 - RNA, 16 nt, Human
uuuaaaaucauuucug

SEQ ID NO: 3071117 - RNA, 19 nt, Human
uuuaaaauacacacucaaa

SEQ ID NO: 3071118 - RNA, 19 nt, Human
uuguucaauaauaaauauu

SEQ ID NO: 3071119 - RNA, 17 nt, Human
uuguuuaaaaucauuuc

SEQ ID NO: 3071120 - RNA, 18 nt, Human
uuguuuaaaaucauuucu

SEQ ID NO: 3071121 - RNA, 15 nt, Human
uugucuuuggacccu

SEQ ID NO: 3071122 - RNA, 20 nt, Human
uugucuuuggacccugaggc

SEQ ID NO: 3071123 - RNA, 24 nt, Human
uugucuuuggacccugaggcccag

SEQ ID NO: 3071124 - RNA, 20 nt, Human
uuguuuggggaugagaaagg

SEQ ID NO: 3071125 - RNA, 15 nt, Human
uuuauacaggucaua

SEQ ID NO: 3071126 - RNA, 20 nt, Human
uuuauacauaaacaagacca

SEQ ID NO: 3071127 - RNA, 12 nt, Human
uuuauacauaaa

SEQ ID NO: 3071128 - RNA, 18 nt, Human
uuuaguugcaacuuugua

SEQ ID NO: 3071129 - RNA, 17 nt, Human
uuuaguugcaacuuugu

SEQ ID NO: 3071130 - RNA, 22 nt, Human
uuuagacccuauugcugcuuga

SEQ ID NO: 3071131 - RNA, 19 nt, Human
uuuagacccuauugcugcu

SEQ ID NO: 3071132 - RNA, 18 nt, Human
uuuauaaacuuuaccuuu

SEQ ID NO: 3071133 - RNA, 13 nt, Human
uuuacagagacag

SEQ ID NO: 3071134 - RNA, 22 nt, Human
uuuaauaaacacucuugaaaaa

SEQ ID NO: 3071135 - RNA, 13 nt, Human
uuuaauaaaccau

SEQ ID NO: 3071136 - RNA, 14 nt, Human
uuuaauaauguuuc

SEQ ID NO: 3071137 - RNA, 15 nt, Human
uuuaauaauguuuca

SEQ ID NO: 3071138 - RNA, 19 nt, Human
uuuaauaauguuucaaaca

SEQ ID NO: 3071139 - RNA, 15 nt, Human
uuuaauaaacacucu

SEQ ID NO: 3071140 - RNA, 14 nt, Human
uuuaauaaacacuc

SEQ ID NO: 3071141 - RNA, 14 nt, Human
uuuaaccucuaaau

SEQ ID NO: 3071142 - RNA, 15 nt, Human
uuuaacagaaaugua

SEQ ID NO: 3071143 - RNA, 14 nt, Human
uuuaacagaaaugu

SEQ ID NO: 3071144 - RNA, 13 nt, Human
uuugaguucuaca

SEQ ID NO: 3071145 - RNA, 16 nt, Human
uuugagaguucuaaau

SEQ ID NO: 3071146 - RNA, 14 nt, Human
uuugagaguucuaa

SEQ ID NO: 3071147 - RNA, 16 nt, Human
uuugagaucagccugg

SEQ ID NO: 3071148 - RNA, 17 nt, Human
uuugagaucagccuggg

SEQ ID NO: 3071149 - RNA, 21 nt, Human
uuugaaauuguauuacaaauc

SEQ ID NO: 3071150 - RNA, 18 nt, Human
uuugaagcacagugauca

SEQ ID NO: 3071151 - RNA, 18 nt, Human
uuucuuaaccagaucauu

SEQ ID NO: 3071152 - RNA, 19 nt, Human
uuucuuguguguuuauugu

SEQ ID NO: 3071153 - RNA, 15 nt, Human
uuuggacccugaggc

SEQ ID NO: 3071154 - RNA, 19 nt, Human
uuuggacccugaggcccag

SEQ ID NO: 3071155 - RNA, 23 nt, Human
uuugcuuuauggguuuggcuugu

SEQ ID NO: 3071156 - RNA, 14 nt, Human
uuugcuugaaagaa

SEQ ID NO: 3071157 - RNA, 16 nt, Human
uuugcuugaaagaaaa

SEQ ID NO: 3071158 - RNA, 14 nt, Human
uuugauaugugaac

SEQ ID NO: 3071159 - RNA, 15 nt, Human
uuugauaugugaaca

SEQ ID NO: 3071160 - RNA, 17 nt, Human
uuugauaugugaacagu

SEQ ID NO: 3071161 - RNA, 18 nt, Human
uuugguaaggggaauuga

SEQ ID NO: 3071162 - RNA, 21 nt, Human
uuucuaacaaaaaaauauauu

SEQ ID NO: 3071163 - RNA, 14 nt, Human
uuucuaaaguaaaa

SEQ ID NO: 3071164 - RNA, 17 nt, Human
uuucuaaaguaaaaaca

SEQ ID NO: 3071165 - RNA, 22 nt, Human
uuucuaaaguaaaaacaaagaa

SEQ ID NO: 3071166 - RNA, 19 nt, Human
uuucuaaaucuccaaaaua

SEQ ID NO: 3071167 - RNA, 19 nt, Human
uuuccuggcacugcuucca

SEQ ID NO: 3071168 - RNA, 23 nt, Human
uuuccuggcacugcuuccaguga

SEQ ID NO: 3071169 - RNA, 18 nt, Human
uuucuacccagcgagccc

SEQ ID NO: 3071170 - RNA, 15 nt, Human
uuucuacccagcgag

SEQ ID NO: 3071171 - RNA, 22 nt, Human
uuucuacccagcgagcccuggu

SEQ ID NO: 3071172 - RNA, 12 nt, Human
uuucucuaggaa

SEQ ID NO: 3071173 - RNA, 14 nt, Human
uuucugaaauaaca

SEQ ID NO: 3071174 - RNA, 12 nt, Human
uuucugaaauuu

SEQ ID NO: 3071175 - RNA, 20 nt, Human
uuuccuaaauauauuuuaag

SEQ ID NO: 3071176 - RNA, 15 nt, Human
uuucacauaucuagu

SEQ ID NO: 3071177 - RNA, 21 nt, Human
uuucacauaucuaguaugaaa

SEQ ID NO: 3071178 - RNA, 16 nt, Human
uuucagccaagaauuc

SEQ ID NO: 3071179 - RNA, 17 nt, Human
uuucagccaagaauucu

SEQ ID NO: 3071180 - RNA, 18 nt, Human
uuaaaagaugaaaauauu

SEQ ID NO: 3071181 - RNA, 15 nt, Human
uuaaaagaugaaaau

SEQ ID NO: 3071182 - RNA, 21 nt, Human
uuaaaauaccagccaguaaau

SEQ ID NO: 3071183 - RNA, 19 nt, Human
uuaaaauacacacucaaau

SEQ ID NO: 3071184 - RNA, 18 nt, Human
uguuuuuuuuuaaagacu

SEQ ID NO: 3071185 - RNA, 17 nt, Human
uuaaaagauacaguuac

SEQ ID NO: 3071186 - RNA, 14 nt, Human
uuaaaagauacagu

SEQ ID NO: 3071187 - RNA, 22 nt, Human
uuaaaagaauauuuuaacuucc

SEQ ID NO: 3071188 - RNA, 21 nt, Human
uuaaaagaauauuuuaacuuc

SEQ ID NO: 3071189 - RNA, 18 nt, Human
uguuuuaaggaugcuugu

SEQ ID NO: 3071190 - RNA, 22 nt, Human
uguuuuaagaggcagggucuca

SEQ ID NO: 3071191 - RNA, 16 nt, Human
uguuuagauaauacac

SEQ ID NO: 3071192 - RNA, 19 nt, Human
uguuucaaacauauauaac

SEQ ID NO: 3071193 - RNA, 15 nt, Human
uguuucaaacuuuac

SEQ ID NO: 3071194 - RNA, 21 nt, Human
uguuucaaacauauauaacaa

SEQ ID NO: 3071195 - RNA, 22 nt, Human
uguuucaaacauauauaacaau

SEQ ID NO: 3071196 - RNA, 20 nt, Human
uguuuuaagaggcagggucu

SEQ ID NO: 3071197 - RNA, 13 nt, Human
uguuugugauuga

SEQ ID NO: 3071198 - RNA, 23 nt, Human
uguuuccuggcacugcuuccagu

SEQ ID NO: 3071199 - RNA, 19 nt, Human
uguuuggggaugagaaagg

SEQ ID NO: 3071200 - RNA, 23 nt, Human
uuaaauguuuuuuuuuaaagacu

SEQ ID NO: 3071201 - RNA, 21 nt, Human
uuaaauguuuuuuuuuaaaga

SEQ ID NO: 3071202 - RNA, 17 nt, Human
uuaaccacuucagcuga

SEQ ID NO: 3071203 - RNA, 21 nt, Human
uuaagcagauggaaugcugug

SEQ ID NO: 3071204 - RNA, 14 nt, Human
uuaacuuuuauaaa

SEQ ID NO: 3071205 - RNA, 17 nt, Human
uuaacuuuuauaaacuu

SEQ ID NO: 3071206 - RNA, 16 nt, Human
uuaacuuuuauaaacu

SEQ ID NO: 3071207 - RNA, 16 nt, Human
uuaacuucacauauug

SEQ ID NO: 3071208 - RNA, 15 nt, Human
uuaacuuuuauaaac

SEQ ID NO: 3071209 - RNA, 21 nt, Human
uuaaugauaaguaaaugcuag

SEQ ID NO: 3071210 - RNA, 17 nt, Human
uuaaugauaaguaaaug

SEQ ID NO: 3071211 - RNA, 22 nt, Human
uuaauauugauaugcuuauaca

SEQ ID NO: 3071212 - RNA, 18 nt, Human
uuaauauugauaugcuua

SEQ ID NO: 3071213 - RNA, 13 nt, Human
uuaauauauuucc

SEQ ID NO: 3071214 - RNA, 14 nt, Human
uuaauauauuucca

SEQ ID NO: 3071215 - RNA, 17 nt, Human
uuaagcuguuacugucu

SEQ ID NO: 3071216 - RNA, 20 nt, Human
uuacaagcgugagccacugc

SEQ ID NO: 3071217 - RNA, 21 nt, Human
uuacaagcgugagccacugca

SEQ ID NO: 3071218 - RNA, 14 nt, Human
uuaguguucauaaa

SEQ ID NO: 3071219 - RNA, 16 nt, Human
uuaguaugaggcauuu

SEQ ID NO: 3071220 - RNA, 18 nt, Human
uuaguaugaggcauuugu

SEQ ID NO: 3071221 - RNA, 17 nt, Human
uuaguagagacaggguu

SEQ ID NO: 3071222 - RNA, 18 nt, Human
uuaggauguugaaaaagu

SEQ ID NO: 3071223 - RNA, 14 nt, Human
uuagaguugauacu

SEQ ID NO: 3071224 - RNA, 14 nt, Human
uuagcggagacgga

SEQ ID NO: 3071225 - RNA, 20 nt, Human
uuagaugcaguucugaagaa

SEQ ID NO: 3071226 - RNA, 21 nt, Human
uuagaugcaguucugaagaag

SEQ ID NO: 3071227 - RNA, 22 nt, Human
uuagauaauacaccacuacauu

SEQ ID NO: 3071228 - RNA, 12 nt, Human
uuagcuggaaaa

SEQ ID NO: 3071229 - RNA, 13 nt, Human
uuagcuggaaaag

SEQ ID NO: 3071230 - RNA, 17 nt, Human
uuacugucuuuuuucua

SEQ ID NO: 3071231 - RNA, 19 nt, Human
uuacugucuuuuuucuaaa

SEQ ID NO: 3071232 - RNA, 21 nt, Human
uuacuuaaaccgccaaggcug

SEQ ID NO: 3071233 - RNA, 23 nt, Human
uuacuucuuauacauuugauaaa

SEQ ID NO: 3071234 - RNA, 12 nt, Human
uuacuucugcua

SEQ ID NO: 3071235 - RNA, 11 nt, Human
uuacuucugcu

SEQ ID NO: 3071236 - RNA, 18 nt, Human
uuacuuagguguggggga

SEQ ID NO: 3071237 - RNA, 17 nt, Human
uuacuaguuucccuugc

SEQ ID NO: 3071238 - RNA, 16 nt, Human
uuacuaauagacaauu

SEQ ID NO: 3071239 - RNA, 14 nt, Human
uuacuaaguuuuua

SEQ ID NO: 3071240 - RNA, 13 nt, Human
uuacuaaguuuuu

SEQ ID NO: 3071241 - RNA, 16 nt, Human
uuagacagucccugcc

SEQ ID NO: 3071242 - RNA, 17 nt, Human
uuagacagucccugcca

SEQ ID NO: 3071243 - RNA, 18 nt, Human
uuagacagucccugccaa

SEQ ID NO: 3071244 - RNA, 14 nt, Human
uuagacagucccug

SEQ ID NO: 3071245 - RNA, 15 nt, Human
uuagacagucccugc

SEQ ID NO: 3071246 - RNA, 14 nt, Human
uuacuuuguguuca

SEQ ID NO: 3071247 - RNA, 18 nt, Human
uuacuuuaaaaggagcca

SEQ ID NO: 3071248 - RNA, 17 nt, Human
uuacuuuaaaaggagcc

SEQ ID NO: 3071249 - RNA, 17 nt, Human
uucccuugaugaagaag

SEQ ID NO: 3071250 - RNA, 20 nt, Human
uucccuuugacgccauccca

SEQ ID NO: 3071251 - RNA, 21 nt, Human
uucccuuugacgccaucccag

SEQ ID NO: 3071252 - RNA, 22 nt, Human
uucccuuugacgccaucccagc

SEQ ID NO: 3071253 - RNA, 13 nt, Human
uuccucauuagca

SEQ ID NO: 3071254 - RNA, 20 nt, Human
uucgggaggucgaggcagga

SEQ ID NO: 3071255 - RNA, 22 nt, Human
uucggccuccauccugaggcuc

SEQ ID NO: 3071256 - RNA, 17 nt, Human
uuccuuggacucauuuu

SEQ ID NO: 3071257 - RNA, 20 nt, Human
uuccuuggacucauuuuaaa

SEQ ID NO: 3071258 - RNA, 13 nt, Human
uucuaaagcugcc

SEQ ID NO: 3071259 - RNA, 17 nt, Human
uucuaaagcugccagcc

SEQ ID NO: 3071260 - RNA, 18 nt, Human
uuccugaugcuucuucag

SEQ ID NO: 3071261 - RNA, 19 nt, Human
uuccugaugcuucuucaga

SEQ ID NO: 3071262 - RNA, 15 nt, Human
uuccugaugcuucuu

SEQ ID NO: 3071263 - RNA, 17 nt, Human
uuccugccaggcauggu

SEQ ID NO: 3071264 - RNA, 14 nt, Human
uuccuggcacugcu

SEQ ID NO: 3071265 - RNA, 19 nt, Human
uuccagauccuggaaauca

SEQ ID NO: 3071266 - RNA, 21 nt, Human
uuccaaaauaauuuuaagaaa

SEQ ID NO: 3071267 - RNA, 13 nt, Human
uuccaaaauaauu

SEQ ID NO: 3071268 - RNA, 15 nt, Human
uuccaaauucugcuu

SEQ ID NO: 3071269 - RNA, 17 nt, Human
uucaugcaaacuuuauu

SEQ ID NO: 3071270 - RNA, 19 nt, Human
uucaugcauagguuuagca

SEQ ID NO: 3071271 - RNA, 12 nt, Human
uuccaaaauaau

SEQ ID NO: 3071272 - RNA, 16 nt, Human
uucauuuccugugucu

SEQ ID NO: 3071273 - RNA, 15 nt, Human
uucauuuccuguguc

SEQ ID NO: 3071274 - RNA, 11 nt, Human
uucaggaagcu

SEQ ID NO: 3071275 - RNA, 13 nt, Human
uucaggaagcuca

SEQ ID NO: 3071276 - RNA, 17 nt, Human
uucaucuugaauuguaa

SEQ ID NO: 3071277 - RNA, 21 nt, Human
uucaucuugaauuguaaggaa

SEQ ID NO: 3071278 - RNA, 17 nt, Human
uucaugaaagauucaau

SEQ ID NO: 3071279 - RNA, 15 nt, Human
uucaugaaagauuca

SEQ ID NO: 3071280 - RNA, 17 nt, Human
uuccccaggaggccagc

SEQ ID NO: 3071281 - RNA, 18 nt, Human
uuccccaggaggccagcc

SEQ ID NO: 3071282 - RNA, 19 nt, Human
uuccccaggaggccagccu

SEQ ID NO: 3071283 - RNA, 20 nt, Human
uuccccaggaggccagccuu

SEQ ID NO: 3071284 - RNA, 21 nt, Human
uuccccaggaggccagccuug

SEQ ID NO: 3071285 - RNA, 20 nt, Human
uucccucccuuccucuuucc

SEQ ID NO: 3071286 - RNA, 17 nt, Human
uucccucccuuccucuu

SEQ ID NO: 3071287 - RNA, 11 nt, Human
uucccucccuu

SEQ ID NO: 3071288 - RNA, 16 nt, Human
uucccauuugcuccuu

SEQ ID NO: 3071289 - RNA, 15 nt, Human
uuccccaggaggcca

SEQ ID NO: 3071290 - RNA, 16 nt, Human
uuccccaggaggccag

SEQ ID NO: 3071291 - RNA, 20 nt, Human
uuauuuuauguugcauagaa

SEQ ID NO: 3071292 - RNA, 17 nt, Human
uuauuuuaauucaguug

SEQ ID NO: 3071293 - RNA, 18 nt, Human
uuauugucaaagugguga

SEQ ID NO: 3071294 - RNA, 15 nt, Human
uuauugucuagugaa

SEQ ID NO: 3071295 - RNA, 17 nt, Human
uuauugucaaaguggug

SEQ ID NO: 3071296 - RNA, 15 nt, Human
uuauuuuaauaaugu

SEQ ID NO: 3071297 - RNA, 16 nt, Human
uuauuuuaauaauguu

SEQ ID NO: 3071298 - RNA, 22 nt, Human
uucagaguugaugguuguacau

SEQ ID NO: 3071299 - RNA, 21 nt, Human
uucagaguugaugguuguaca

SEQ ID NO: 3071300 - RNA, 21 nt, Human
uucagacagcugccugggauc

SEQ ID NO: 3071301 - RNA, 16 nt, Human
uucagacauagaauua

SEQ ID NO: 3071302 - RNA, 19 nt, Human
uucagagacuccugcaggc

SEQ ID NO: 3071303 - RNA, 20 nt, Human
uucagacauagaauuaacac

SEQ ID NO: 3071304 - RNA, 13 nt, Human
uucacucuccuug

SEQ ID NO: 3071305 - RNA, 15 nt, Human
uucacgugguccuaa

SEQ ID NO: 3071306 - RNA, 18 nt, Human
uucacggaagagccuugc

SEQ ID NO: 3071307 - RNA, 13 nt, Human
uucaauaggaaaa

SEQ ID NO: 3071308 - RNA, 15 nt, Human
uucaauaggaaaaac

SEQ ID NO: 3071309 - RNA, 18 nt, Human
uucaauaggaaaaacuga

SEQ ID NO: 3071310 - RNA, 20 nt, Human
uucaauaggaaaaacugauu

SEQ ID NO: 3071311 - RNA, 15 nt, Human
uuauugauaaguuca

SEQ ID NO: 3071312 - RNA, 19 nt, Human
uuauugauaaguucauaca

SEQ ID NO: 3071313 - RNA, 20 nt, Human
uuauugauaaguucauacau

SEQ ID NO: 3071314 - RNA, 15 nt, Human
uuauugcccacgcug

SEQ ID NO: 3071315 - RNA, 11 nt, Human
uuauucugcuc

SEQ ID NO: 3071316 - RNA, 23 nt, Human
uuauuaaaaaucucaaauuucua

SEQ ID NO: 3071317 - RNA, 17 nt, Human
uuauggcuauaggugcu

SEQ ID NO: 3071318 - RNA, 16 nt, Human
uuauuacuguaagaaa

SEQ ID NO: 3071319 - RNA, 17 nt, Human
uuauuacuguaagaaaa

SEQ ID NO: 3071320 - RNA, 18 nt, Human
uuauuacuguaagaaaau

SEQ ID NO: 3071321 - RNA, 13 nt, Human
uuaguugcaacuu

SEQ ID NO: 3071322 - RNA, 16 nt, Human
uuaguuccucauuagc

SEQ ID NO: 3071323 - RNA, 14 nt, Human
uuaguuccuugagu

SEQ ID NO: 3071324 - RNA, 20 nt, Human
uuaguugcaacuuuguauaa

SEQ ID NO: 3071325 - RNA, 16 nt, Human
uuaucuagauacugua

SEQ ID NO: 3071326 - RNA, 14 nt, Human
uuaucuagauacug

SEQ ID NO: 3071327 - RNA, 20 nt, Human
uuaucuugaauaauguaaga

SEQ ID NO: 3071328 - RNA, 17 nt, Human
uuaucuagauacuguau

SEQ ID NO: 3071329 - RNA, 16 nt, Human
uuauggaacacucuga

SEQ ID NO: 3071330 - RNA, 21 nt, Human
uuauggcacuaguauuucuau

SEQ ID NO: 3071331 - RNA, 22 nt, Human
uuaugcaugaaguaauaugcac

SEQ ID NO: 3071332 - RNA, 16 nt, Human
uuaugcaugaaguaau

SEQ ID NO: 3071333 - RNA, 18 nt, Human
ugcauauuauuuuauguu

SEQ ID NO: 3071334 - RNA, 19 nt, Human
ugcaucaagaugugacaug

SEQ ID NO: 3071335 - RNA, 22 nt, Human
ugcaucaauuuuucuuauuuca

SEQ ID NO: 3071336 - RNA, 16 nt, Human
ugcauagguuuagcag

SEQ ID NO: 3071337 - RNA, 16 nt, Human
ugcaguugccagucac

SEQ ID NO: 3071338 - RNA, 12 nt, Human
ugcaguucugaa

SEQ ID NO: 3071339 - RNA, 15 nt, Human
ugcaguugccaguca

SEQ ID NO: 3071340 - RNA, 21 nt, Human
ugcaguuacacuaaaagguga

SEQ ID NO: 3071341 - RNA, 21 nt, Human
ugcaguggugcgaucuggguu

SEQ ID NO: 3071342 - RNA, 20 nt, Human
ugcaguggugcgaucugggu

SEQ ID NO: 3071343 - RNA, 13 nt, Human
ugcagggaguccg

SEQ ID NO: 3071344 - RNA, 21 nt, Human
ugcauuuggugguuucagaaa

SEQ ID NO: 3071345 - RNA, 13 nt, Human
ugcaucagcugcu

SEQ ID NO: 3071346 - RNA, 23 nt, Human
ugcauuuggugguuucagaaaug

SEQ ID NO: 3071347 - RNA, 17 nt, Human
ugccaaagaagcagacc

SEQ ID NO: 3071348 - RNA, 20 nt, Human
ugccaggaagccagcaggcu

SEQ ID NO: 3071349 - RNA, 22 nt, Human
ugccaggaagccagcaggcucu

SEQ ID NO: 3071350 - RNA, 16 nt, Human
ugccacuaaauugaca

SEQ ID NO: 3071351 - RNA, 10 nt, Human
ugccaggcau

SEQ ID NO: 3071352 - RNA, 14 nt, Human
ugccaggcauggug

SEQ ID NO: 3071353 - RNA, 20 nt, Human
ugccacccuggggagaaagu

SEQ ID NO: 3071354 - RNA, 19 nt, Human
ugcccaggcuggcgugcag

SEQ ID NO: 3071355 - RNA, 18 nt, Human
ugcccaggcuggcgugca

SEQ ID NO: 3071356 - RNA, 20 nt, Human
ugcccaggcuggcgugcagu

SEQ ID NO: 3071357 - RNA, 13 nt, Human
ugcccaggcuggc

SEQ ID NO: 3071358 - RNA, 14 nt, Human
ugcccggcugcgga

SEQ ID NO: 3071359 - RNA, 12 nt, Human
ugcccggcugcg

SEQ ID NO: 3071360 - RNA, 16 nt, Human
ugccccuggcagcccc

SEQ ID NO: 3071361 - RNA, 15 nt, Human
ugccucaagagaagg

SEQ ID NO: 3071362 - RNA, 14 nt, Human
ugccucaagagaag

SEQ ID NO: 3071363 - RNA, 16 nt, Human
ugcccugcccaccugg

SEQ ID NO: 3071364 - RNA, 20 nt, Human
ugcccugcccaccuggccuc

SEQ ID NO: 3071365 - RNA, 15 nt, Human
ugcccugcccaccug

SEQ ID NO: 3071366 - RNA, 14 nt, Human
ugcccugcccaccu

SEQ ID NO: 3071367 - RNA, 17 nt, Human
ugcucuugaugccuggc

SEQ ID NO: 3071368 - RNA, 23 nt, Human
ugcucuccgaccagacaccuuga

SEQ ID NO: 3071369 - RNA, 19 nt, Human
ugcucaggagcccugggag

SEQ ID NO: 3071370 - RNA, 18 nt, Human
ugcucaggagcccuggga

SEQ ID NO: 3071371 - RNA, 20 nt, Human
ugcucaggagcccugggagg

SEQ ID NO: 3071372 - RNA, 15 nt, Human
ugcucaggagcccug

SEQ ID NO: 3071373 - RNA, 17 nt, Human
ugcucacauaucuguca

SEQ ID NO: 3071374 - RNA, 21 nt, Human
ugcuaggaacacuccuucaca

SEQ ID NO: 3071375 - RNA, 20 nt, Human
ugcuaggaacacuccuucac

SEQ ID NO: 3071376 - RNA, 22 nt, Human
ugcuaggaacacuccuucacag

SEQ ID NO: 3071377 - RNA, 13 nt, Human
ugcuagaacuccc

SEQ ID NO: 3071378 - RNA, 14 nt, Human
ugcuagaacucccu

SEQ ID NO: 3071379 - RNA, 15 nt, Human
ugcuagaacucccuu

SEQ ID NO: 3071380 - RNA, 17 nt, Human
ugcuagaacucccuuuc

SEQ ID NO: 3071381 - RNA, 20 nt, Human
ugccuugcauaauggucaga

SEQ ID NO: 3071382 - RNA, 22 nt, Human
ugcuacuguccuacccacccuc

SEQ ID NO: 3071383 - RNA, 21 nt, Human
ugcuacuguccuacccacccu

SEQ ID NO: 3071384 - RNA, 17 nt, Human
ugcugccugcuuuuuau

SEQ ID NO: 3071385 - RNA, 15 nt, Human
ugcugccugcuuuuu

SEQ ID NO: 3071386 - RNA, 19 nt, Human
ugcugcauuuaaaagauac

SEQ ID NO: 3071387 - RNA, 18 nt, Human
ugcugcauuuaaaagaua

SEQ ID NO: 3071388 - RNA, 17 nt, Human
ugcugcauuuaaaagau

SEQ ID NO: 3071389 - RNA, 23 nt, Human
ugcugcauuuaaaagauacaguu

SEQ ID NO: 3071390 - RNA, 14 nt, Human
ugcugcauuuaaaa

SEQ ID NO: 3071391 - RNA, 24 nt, Human
ugcugggccccugccucucugcag

SEQ ID NO: 3071392 - RNA, 23 nt, Human
ugcugggccccugccucucugca

SEQ ID NO: 3071393 - RNA, 22 nt, Human
ugcugggccccugccucucugc

SEQ ID NO: 3071394 - RNA, 21 nt, Human
ugcugggccccugccucucug

SEQ ID NO: 3071395 - RNA, 19 nt, Human
ugcugggccccugccucuc

SEQ ID NO: 3071396 - RNA, 18 nt, Human
ugcugggccccugccucu

SEQ ID NO: 3071397 - RNA, 17 nt, Human
ugcugggccccugccuc

SEQ ID NO: 3071398 - RNA, 16 nt, Human
ugcugggccccugccu

SEQ ID NO: 3071399 - RNA, 14 nt, Human
ugcugggccccugc

SEQ ID NO: 3071400 - RNA, 19 nt, Human
ugcugcuugaggcaacuca

SEQ ID NO: 3071401 - RNA, 20 nt, Human
ugcugggauuacagguguga

SEQ ID NO: 3071402 - RNA, 12 nt, Human
ugcugcuugagg

SEQ ID NO: 3071403 - RNA, 19 nt, Human
ugcugcugccccugcacag

SEQ ID NO: 3071404 - RNA, 12 nt, Human
ugcugcugcccc

SEQ ID NO: 3071405 - RNA, 13 nt, Human
ugcugguuuuagu

SEQ ID NO: 3071406 - RNA, 18 nt, Human
ugcuguguuaaauaaacc

SEQ ID NO: 3071407 - RNA, 11 nt, Human
ugcuguguuaa

SEQ ID NO: 3071408 - RNA, 16 nt, Human
ugcuguucaugaaaga

SEQ ID NO: 3071409 - RNA, 17 nt, Human
ugcuguucaugaaagau

SEQ ID NO: 3071410 - RNA, 13 nt, Human
ugcuggguguggc

SEQ ID NO: 3071411 - RNA, 17 nt, Human
ugcugggcuugucugua

SEQ ID NO: 3071412 - RNA, 20 nt, Human
ugcugggggggauuguaaaa

SEQ ID NO: 3071413 - RNA, 19 nt, Human
uggugacuuuccucuuugg

SEQ ID NO: 3071414 - RNA, 22 nt, Human
uggugaccucugccugaaguca

SEQ ID NO: 3071415 - RNA, 17 nt, Human
uggugaccucugccuga

SEQ ID NO: 3071416 - RNA, 16 nt, Human
uggugaccucugccug

SEQ ID NO: 3071417 - RNA, 15 nt, Human
uggugaccucugccu

SEQ ID NO: 3071418 - RNA, 21 nt, Human
uggugcaaugaccuuucaaua

SEQ ID NO: 3071419 - RNA, 20 nt, Human
uggugcaaugaccuuucaau

SEQ ID NO: 3071420 - RNA, 22 nt, Human
uggugauuuagcaggaagcugu

SEQ ID NO: 3071421 - RNA, 16 nt, Human
uggugauuuagcagga

SEQ ID NO: 3071422 - RNA, 15 nt, Human
uggucuacacugugc

SEQ ID NO: 3071423 - RNA, 16 nt, Human
uggucuacacugugcu

SEQ ID NO: 3071424 - RNA, 17 nt, Human
uggucuacacugugcug

SEQ ID NO: 3071425 - RNA, 18 nt, Human
uggucuacacugugcuga

SEQ ID NO: 3071426 - RNA, 14 nt, Human
uggugaccucugcc

SEQ ID NO: 3071427 - RNA, 13 nt, Human
uggugaccucugc

SEQ ID NO: 3071428 - RNA, 17 nt, Human
uggucggaaaacaugcu

SEQ ID NO: 3071429 - RNA, 14 nt, Human
uggucggaaaacau

SEQ ID NO: 3071430 - RNA, 17 nt, Human
ugguccuaaucuucuga

SEQ ID NO: 3071431 - RNA, 19 nt, Human
ugguccuaaucuucugaac

SEQ ID NO: 3071432 - RNA, 13 nt, Human
ugguccugcugca

SEQ ID NO: 3071433 - RNA, 15 nt, Human
ugguccugcugcagu

SEQ ID NO: 3071434 - RNA, 23 nt, Human
ugguccugcugcaguugccaguc

SEQ ID NO: 3071435 - RNA, 15 nt, Human
uggucccccuuccau

SEQ ID NO: 3071436 - RNA, 16 nt, Human
uggucccccuuccaug

SEQ ID NO: 3071437 - RNA, 18 nt, Human
uggucccccuuccaugga

SEQ ID NO: 3071438 - RNA, 23 nt, Human
uggucccccuuccauggacuuug

SEQ ID NO: 3071439 - RNA, 18 nt, Human
ugguaugaucacggcuca

SEQ ID NO: 3071440 - RNA, 13 nt, Human
ugguauguuuuca

SEQ ID NO: 3071441 - RNA, 14 nt, Human
uggucccccuucca

SEQ ID NO: 3071442 - RNA, 13 nt, Human
uggucccacucag

SEQ ID NO: 3071443 - RNA, 22 nt, Human
uggucacaggaaguagaggagg

SEQ ID NO: 3071444 - RNA, 17 nt, Human
uggucacaggaaguaga

SEQ ID NO: 3071445 - RNA, 14 nt, Human
ugggagugggccca

SEQ ID NO: 3071446 - RNA, 16 nt, Human
ugggagugggcccaau

SEQ ID NO: 3071447 - RNA, 20 nt, Human
uggcugggggccucagugcc

SEQ ID NO: 3071448 - RNA, 17 nt, Human
uggcugggggccucagu

SEQ ID NO: 3071449 - RNA, 16 nt, Human
uggcugggggccucag

SEQ ID NO: 3071450 - RNA, 22 nt, Human
ugggcagagcagagaccauccc

SEQ ID NO: 3071451 - RNA, 18 nt, Human
ugggcagagcagagacca

SEQ ID NO: 3071452 - RNA, 22 nt, Human
ugggauuacaagcgugagccac

SEQ ID NO: 3071453 - RNA, 12 nt, Human
ugggauccucca

SEQ ID NO: 3071454 - RNA, 13 nt, Human
ugggauccuccag

SEQ ID NO: 3071455 - RNA, 23 nt, Human
ugggccccugccucucugcaggu

SEQ ID NO: 3071456 - RNA, 21 nt, Human
ugggccccugccucucugcag

SEQ ID NO: 3071457 - RNA, 20 nt, Human
ugggccccugccucucugca

SEQ ID NO: 3071458 - RNA, 14 nt, Human
ugggccuggcuccc

SEQ ID NO: 3071459 - RNA, 23 nt, Human
ugggcagagcagagaccaucccu

SEQ ID NO: 3071460 - RNA, 13 nt, Human
uggggggggugcu

SEQ ID NO: 3071461 - RNA, 16 nt, Human
ugggggaguggccaca

SEQ ID NO: 3071462 - RNA, 18 nt, Human
uggguacuuguggacaca

SEQ ID NO: 3071463 - RNA, 17 nt, Human
uggguacuuguggacac

SEQ ID NO: 3071464 - RNA, 20 nt, Human
uggggccaggcugggucgcc

SEQ ID NO: 3071465 - RNA, 23 nt, Human
uggggaugagaaagguugaagca

SEQ ID NO: 3071466 - RNA, 15 nt, Human
uggggaugagaaagg

SEQ ID NO: 3071467 - RNA, 22 nt, Human
uggggccaggcugggucgcccu

SEQ ID NO: 3071468 - RNA, 21 nt, Human
uggggccaggcugggucgccc

SEQ ID NO: 3071469 - RNA, 20 nt, Human
uggggccaguuggucccccu

SEQ ID NO: 3071470 - RNA, 22 nt, Human
ugggcuucauccuccucagauc

SEQ ID NO: 3071471 - RNA, 15 nt, Human
uggcgggguggggug

SEQ ID NO: 3071472 - RNA, 15 nt, Human
uggcugcuucaagga

SEQ ID NO: 3071473 - RNA, 15 nt, Human
uggcugggggccuca

SEQ ID NO: 3071474 - RNA, 11 nt, Human
uggcugcuuca

SEQ ID NO: 3071475 - RNA, 15 nt, Human
uggcgcugccccugg

SEQ ID NO: 3071476 - RNA, 23 nt, Human
uggcgcugccccuggcagccccu

SEQ ID NO: 3071477 - RNA, 16 nt, Human
uggcgcugccccuggc

SEQ ID NO: 3071478 - RNA, 22 nt, Human
uggcgcagcauauucaggaagc

SEQ ID NO: 3071479 - RNA, 23 nt, Human
uggcgcagcauauucaggaagcu

SEQ ID NO: 3071480 - RNA, 23 nt, Human
uggcgagccauuugucccaagug

SEQ ID NO: 3071481 - RNA, 22 nt, Human
uggcgagccauuugucccaagu

SEQ ID NO: 3071482 - RNA, 23 nt, Human
uggccucccaacucaccccagcc

SEQ ID NO: 3071483 - RNA, 19 nt, Human
uggccagaugcaccagccc

SEQ ID NO: 3071484 - RNA, 15 nt, Human
uggcagaguugaaga

SEQ ID NO: 3071485 - RNA, 21 nt, Human
uggcagaguggauucuugaac

SEQ ID NO: 3071486 - RNA, 17 nt, Human
uggcagaguugaagaca

SEQ ID NO: 3071487 - RNA, 19 nt, Human
uggcagaguugaagacaga

SEQ ID NO: 3071488 - RNA, 18 nt, Human
uggccagaugcaccagcc

SEQ ID NO: 3071489 - RNA, 17 nt, Human
uggccagaugcaccagc

SEQ ID NO: 3071490 - RNA, 13 nt, Human
uggccaggcuggu

SEQ ID NO: 3071491 - RNA, 16 nt, Human
uggcccaggguggcca

SEQ ID NO: 3071492 - RNA, 17 nt, Human
uggcccaggguggccac

SEQ ID NO: 3071493 - RNA, 18 nt, Human
uggcccaggguggccaca

SEQ ID NO: 3071494 - RNA, 16 nt, Human
uggccccugcccggcu

SEQ ID NO: 3071495 - RNA, 15 nt, Human
uggccccugcccggc

SEQ ID NO: 3071496 - RNA, 14 nt, Human
uggccccugcccgg

SEQ ID NO: 3071497 - RNA, 21 nt, Human
uggaggaaggaaacccagcuc

SEQ ID NO: 3071498 - RNA, 23 nt, Human
uggaggaaggaaacccagcucug

SEQ ID NO: 3071499 - RNA, 20 nt, Human
uggcaaacagggccucugcg

SEQ ID NO: 3071500 - RNA, 24 nt, Human
uggcaaacagggccucugcggagc

SEQ ID NO: 3071501 - RNA, 15 nt, Human
uggcaaacagggccu

SEQ ID NO: 3071502 - RNA, 16 nt, Human
uggcaaacagggccuc

SEQ ID NO: 3071503 - RNA, 18 nt, Human
uggcaaacagggccucug

SEQ ID NO: 3071504 - RNA, 19 nt, Human
uggcaaacagggccucugc

SEQ ID NO: 3071505 - RNA, 12 nt, Human
uggcaaaaaggc

SEQ ID NO: 3071506 - RNA, 16 nt, Human
uggcaaaaaggcagga

SEQ ID NO: 3071507 - RNA, 16 nt, Human
uggcacuauaauguaa

SEQ ID NO: 3071508 - RNA, 15 nt, Human
uggcacuauaaugua

SEQ ID NO: 3071509 - RNA, 20 nt, Human
uggcaauagucaaauugugu

SEQ ID NO: 3071510 - RNA, 15 nt, Human
uggcacuaguauuuc

SEQ ID NO: 3071511 - RNA, 19 nt, Human
uggacugagggggccugga

SEQ ID NO: 3071512 - RNA, 23 nt, Human
uggacugagggggccuggaugcc

SEQ ID NO: 3071513 - RNA, 20 nt, Human
uggacugagggggccuggau

SEQ ID NO: 3071514 - RNA, 22 nt, Human
uggacugagggggccuggaugc

SEQ ID NO: 3071515 - RNA, 23 nt, Human
uggacaggcauguucucugagga

SEQ ID NO: 3071516 - RNA, 23 nt, Human
ugacauaaguauuuaauucaugu

SEQ ID NO: 3071517 - RNA, 19 nt, Human
ugacagagugagacucugu

SEQ ID NO: 3071518 - RNA, 17 nt, Human
ugacagagugagacucu

SEQ ID NO: 3071519 - RNA, 14 nt, Human
ugacagagugagac

SEQ ID NO: 3071520 - RNA, 23 nt, Human
ugacagaggcagccccauucugc

SEQ ID NO: 3071521 - RNA, 18 nt, Human
ugacagaggcagccccau

SEQ ID NO: 3071522 - RNA, 17 nt, Human
ugacagaggcagcccca

SEQ ID NO: 3071523 - RNA, 16 nt, Human
ugacagaggcagcccc

SEQ ID NO: 3071524 - RNA, 15 nt, Human
ugacagaggcagccc

SEQ ID NO: 3071525 - RNA, 14 nt, Human
ugacagaggcagcc

SEQ ID NO: 3071526 - RNA, 23 nt, Human
ugacagacacaggcccggcucca

SEQ ID NO: 3071527 - RNA, 20 nt, Human
ugacagacacaggcccggcu

SEQ ID NO: 3071528 - RNA, 13 nt, Human
ugacagaggcagc

SEQ ID NO: 3071529 - RNA, 16 nt, Human
ugacagaauauguuuc

SEQ ID NO: 3071530 - RNA, 18 nt, Human
ugacaaggauugcuacug

SEQ ID NO: 3071531 - RNA, 15 nt, Human
ugacaagcucacaga

SEQ ID NO: 3071532 - RNA, 20 nt, Human
ugacaagcucacagaccuuu

SEQ ID NO: 3071533 - RNA, 12 nt, Human
ugacaagcucac

SEQ ID NO: 3071534 - RNA, 19 nt, Human
ugaccagcaccaucucucc

SEQ ID NO: 3071535 - RNA, 20 nt, Human
ugaccacugcagaagacagu

SEQ ID NO: 3071536 - RNA, 18 nt, Human
ugaccacugcagaagaca

SEQ ID NO: 3071537 - RNA, 15 nt, Human
ugacaugucuuuucu

SEQ ID NO: 3071538 - RNA, 13 nt, Human
ugacaugucuuuu

SEQ ID NO: 3071539 - RNA, 18 nt, Human
ugacaugggacauuugcu

SEQ ID NO: 3071540 - RNA, 16 nt, Human
ugacaugggacauuug

SEQ ID NO: 3071541 - RNA, 17 nt, Human
ugacaugggacauuugc

SEQ ID NO: 3071542 - RNA, 13 nt, Human
ugaccgugaggcc

SEQ ID NO: 3071543 - RNA, 14 nt, Human
ugaccgugaggcca

SEQ ID NO: 3071544 - RNA, 16 nt, Human
ugaccgugaggccaga

SEQ ID NO: 3071545 - RNA, 20 nt, Human
ugaccgugaggccagagaca

SEQ ID NO: 3071546 - RNA, 17 nt, Human
ugaccauucuccaccug

SEQ ID NO: 3071547 - RNA, 18 nt, Human
ugaccauucuccaccugc

SEQ ID NO: 3071548 - RNA, 16 nt, Human
ugaccauucuccaccu

SEQ ID NO: 3071549 - RNA, 16 nt, Human
ugaauuauuuucucuc

SEQ ID NO: 3071550 - RNA, 15 nt, Human
ugaauuaugaaacuu

SEQ ID NO: 3071551 - RNA, 17 nt, Human
ugaauuaugaaacuuuu

SEQ ID NO: 3071552 - RNA, 13 nt, Human
ugaauuaugaaac

SEQ ID NO: 3071553 - RNA, 14 nt, Human
ugaauuacauuugu

SEQ ID NO: 3071554 - RNA, 15 nt, Human
ugaauuacauuugua

SEQ ID NO: 3071555 - RNA, 16 nt, Human
ugaauuacauuuguau

SEQ ID NO: 3071556 - RNA, 18 nt, Human
ugaauuacauuuguauaa

SEQ ID NO: 3071557 - RNA, 23 nt, Human
ugaaucauuuuaccuuugacaaa

SEQ ID NO: 3071558 - RNA, 22 nt, Human
ugaaucauuuuaccuuugacaa

SEQ ID NO: 3071559 - RNA, 20 nt, Human
ugaaugaauggcuaagcaaa

SEQ ID NO: 3071560 - RNA, 20 nt, Human
ugaaggacauugcggacagc

SEQ ID NO: 3071561 - RNA, 19 nt, Human
ugaaggacauugcggacag

SEQ ID NO: 3071562 - RNA, 22 nt, Human
ugaaggacauugcggacagcca

SEQ ID NO: 3071563 - RNA, 15 nt, Human
ugaaggccccgccca

SEQ ID NO: 3071564 - RNA, 16 nt, Human
ugaaggccccgcccag

SEQ ID NO: 3071565 - RNA, 17 nt, Human
ugaacuccuggccucaa

SEQ ID NO: 3071566 - RNA, 14 nt, Human
ugaagauacugaaa

SEQ ID NO: 3071567 - RNA, 15 nt, Human
ugaagauacugaaau

SEQ ID NO: 3071568 - RNA, 16 nt, Human
ugaagauacugaaaua

SEQ ID NO: 3071569 - RNA, 18 nt, Human
ugaagauacugaaauaaa

SEQ ID NO: 3071570 - RNA, 17 nt, Human
ugaaggccccgcccagg

SEQ ID NO: 3071571 - RNA, 11 nt, Human
ugaaguccaag

SEQ ID NO: 3071572 - RNA, 13 nt, Human
ugaaguccaagca

SEQ ID NO: 3071573 - RNA, 17 nt, Human
ucuuucacauuuaaaua

SEQ ID NO: 3071574 - RNA, 23 nt, Human
ucuuucacccuuuucuguuugcu

SEQ ID NO: 3071575 - RNA, 16 nt, Human
ucuuguguguuuauug

SEQ ID NO: 3071576 - RNA, 21 nt, Human
ucuuguguguuuauugucaaa

SEQ ID NO: 3071577 - RNA, 16 nt, Human
ucucccuucauccuuc

SEQ ID NO: 3071578 - RNA, 20 nt, Human
ucuccucugcugcuggcugg

SEQ ID NO: 3071579 - RNA, 23 nt, Human
ucuugcaauggcagccuuggcaa

SEQ ID NO: 3071580 - RNA, 12 nt, Human
ucuuugccaagu

SEQ ID NO: 3071581 - RNA, 17 nt, Human
ucuuuggacacucacac

SEQ ID NO: 3071582 - RNA, 21 nt, Human
ucuuuggacagaagcagcucu

SEQ ID NO: 3071583 - RNA, 19 nt, Human
ucuuuggacagaagcagcu

SEQ ID NO: 3071584 - RNA, 19 nt, Human
ucuuuccacagaagcucca

SEQ ID NO: 3071585 - RNA, 16 nt, Human
ucuuucagccaagaau

SEQ ID NO: 3071586 - RNA, 19 nt, Human
ucuuucagccaagaauucu

SEQ ID NO: 3071587 - RNA, 20 nt, Human
ucuuucagccaagaauucuu

SEQ ID NO: 3071588 - RNA, 21 nt, Human
ucuuucagccaagaauucuua

SEQ ID NO: 3071589 - RNA, 14 nt, Human
ucuuuccaaaguac

SEQ ID NO: 3071590 - RNA, 13 nt, Human
ucuuuccaaagua

SEQ ID NO: 3071591 - RNA, 19 nt, Human
ugaacaguuguguuugaag

SEQ ID NO: 3071592 - RNA, 16 nt, Human
ugaacuccuggccuca

SEQ ID NO: 3071593 - RNA, 20 nt, Human
ugaaccaccacacccagccc

SEQ ID NO: 3071594 - RNA, 17 nt, Human
ugaaccaccacacccag

SEQ ID NO: 3071595 - RNA, 23 nt, Human
ugaaccacaucuugcucugcuga

SEQ ID NO: 3071596 - RNA, 22 nt, Human
ugaaccaagaacuuuccaggaa

SEQ ID NO: 3071597 - RNA, 12 nt, Human
ugaaauuauuca

SEQ ID NO: 3071598 - RNA, 19 nt, Human
ugaaauggacuuuuguaca

SEQ ID NO: 3071599 - RNA, 18 nt, Human
ugaaauauuauguuaaaa

SEQ ID NO: 3071600 - RNA, 16 nt, Human
ugaaauauugacuuuu

SEQ ID NO: 3071601 - RNA, 14 nt, Human
ugaaacauuuuguc

SEQ ID NO: 3071602 - RNA, 22 nt, Human
ugaaacaacaaauaggaauugu

SEQ ID NO: 3071603 - RNA, 13 nt, Human
ugaaaauuuugau

SEQ ID NO: 3071604 - RNA, 12 nt, Human
ugaaaauuuuga

SEQ ID NO: 3071605 - RNA, 21 nt, Human
ugaaaauuuugauguuuuaag

SEQ ID NO: 3071606 - RNA, 19 nt, Human
ugaaaauuuugauguuuua

SEQ ID NO: 3071607 - RNA, 18 nt, Human
ugaaagcccugagcuuuc

SEQ ID NO: 3071608 - RNA, 23 nt, Human
ugaaagcagggacuugaacccau

SEQ ID NO: 3071609 - RNA, 18 nt, Human
ugaaagaggcagcuugaa

SEQ ID NO: 3071610 - RNA, 18 nt, Human
ugaaagggcccagagagg

SEQ ID NO: 3071611 - RNA, 15 nt, Human
ugaaagguacuucaa

SEQ ID NO: 3071612 - RNA, 16 nt, Human
ugaaagguacuucaaa

SEQ ID NO: 3071613 - RNA, 23 nt, Human
ugaaagggaguauuacaaaaaca

SEQ ID NO: 3071614 - RNA, 13 nt, Human
ugaaagggcccag

SEQ ID NO: 3071615 - RNA, 13 nt, Human
ugauuauauguca

SEQ ID NO: 3071616 - RNA, 17 nt, Human
ugauuaugaauuacauu

SEQ ID NO: 3071617 - RNA, 19 nt, Human
ugauuaugaauuacauuug

SEQ ID NO: 3071618 - RNA, 20 nt, Human
ugauguucuuucacccuuuu

SEQ ID NO: 3071619 - RNA, 16 nt, Human
ugauuaccagggacug

SEQ ID NO: 3071620 - RNA, 20 nt, Human
ugauucaacagguuuuccug

SEQ ID NO: 3071621 - RNA, 21 nt, Human
ugauuaugaauuacauuugua

SEQ ID NO: 3071622 - RNA, 22 nt, Human
ugauuaugaauuacauuuguau

SEQ ID NO: 3071623 - RNA, 13 nt, Human
ugauucagacagc

SEQ ID NO: 3071624 - RNA, 14 nt, Human
ugauucagacagcu

SEQ ID NO: 3071625 - RNA, 15 nt, Human
ugauucagacagcug

SEQ ID NO: 3071626 - RNA, 16 nt, Human
ugauucagacagcugc

SEQ ID NO: 3071627 - RNA, 18 nt, Human
ugauucagacagcugccu

SEQ ID NO: 3071628 - RNA, 19 nt, Human
ugauucagacagcugccug

SEQ ID NO: 3071629 - RNA, 20 nt, Human
ugauucagacagcugccugg

SEQ ID NO: 3071630 - RNA, 21 nt, Human
ugauucagacagcugccuggg

SEQ ID NO: 3071631 - RNA, 23 nt, Human
ugauucagacagcugccugggau

SEQ ID NO: 3071632 - RNA, 21 nt, Human
ugauucuccugccucagccuc

SEQ ID NO: 3071633 - RNA, 16 nt, Human
ugauugugucucuugg

SEQ ID NO: 3071634 - RNA, 13 nt, Human
ugauuggaggggg

SEQ ID NO: 3071635 - RNA, 21 nt, Human
ugauuggaggggggagguggg

SEQ ID NO: 3071636 - RNA, 11 nt, Human
ugaugccuggc

SEQ ID NO: 3071637 - RNA, 20 nt, Human
ugaugcuacaggauuugaaa

SEQ ID NO: 3071638 - RNA, 23 nt, Human
ugaugcuacaggauuugaaauug

SEQ ID NO: 3071639 - RNA, 16 nt, Human
ugaucuuugcagacag

SEQ ID NO: 3071640 - RNA, 17 nt, Human
ugaucuuuaaaauacac

SEQ ID NO: 3071641 - RNA, 18 nt, Human
ugauguguuuauuuauag

SEQ ID NO: 3071642 - RNA, 14 nt, Human
ugauguguuuauuu

SEQ ID NO: 3071643 - RNA, 16 nt, Human
ugauguguuaucucuu

SEQ ID NO: 3071644 - RNA, 14 nt, Human
ugaugguuguacau

SEQ ID NO: 3071645 - RNA, 13 nt, Human
ugaugguuguaca

SEQ ID NO: 3071646 - RNA, 16 nt, Human
ugaugcuucuucagag

SEQ ID NO: 3071647 - RNA, 17 nt, Human
ugaugcuucuucagaga

SEQ ID NO: 3071648 - RNA, 15 nt, Human
ugauggugguauguu

SEQ ID NO: 3071649 - RNA, 20 nt, Human
ugaucuucuuuauaauucua

SEQ ID NO: 3071650 - RNA, 14 nt, Human
ugaucuuuaaaaua

SEQ ID NO: 3071651 - RNA, 19 nt, Human
ugauccacccaccucagcc

SEQ ID NO: 3071652 - RNA, 18 nt, Human
ugauccacccaccucagc

SEQ ID NO: 3071653 - RNA, 17 nt, Human
ugauccacccaccucag

SEQ ID NO: 3071654 - RNA, 16 nt, Human
ugauccacccaccuca

SEQ ID NO: 3071655 - RNA, 15 nt, Human
ugauccaagcugguc

SEQ ID NO: 3071656 - RNA, 14 nt, Human
ugauccaagcuggu

SEQ ID NO: 3071657 - RNA, 13 nt, Human
ugauccaagcugg

SEQ ID NO: 3071658 - RNA, 13 nt, Human
ugauagcacagac

SEQ ID NO: 3071659 - RNA, 14 nt, Human
ugauagcacagacc

SEQ ID NO: 3071660 - RNA, 17 nt, Human
ugaucagcuuauugucu

SEQ ID NO: 3071661 - RNA, 24 nt, Human
ugaucagcuuauugucuagugaaa

SEQ ID NO: 3071662 - RNA, 22 nt, Human
ugaguucuacauaaguaauuca

SEQ ID NO: 3071663 - RNA, 14 nt, Human
ugagugagcaugcc

SEQ ID NO: 3071664 - RNA, 16 nt, Human
ugaguugauagcacag

SEQ ID NO: 3071665 - RNA, 20 nt, Human
ugaguugauagcacagaccc

SEQ ID NO: 3071666 - RNA, 16 nt, Human
ugauaacuggaaacuu

SEQ ID NO: 3071667 - RNA, 13 nt, Human
ugagucugaaggc

SEQ ID NO: 3071668 - RNA, 15 nt, Human
ugagucugaaggcug

SEQ ID NO: 3071669 - RNA, 17 nt, Human
ugagucugaaggcuggg

SEQ ID NO: 3071670 - RNA, 18 nt, Human
ugagucugaaggcugggu

SEQ ID NO: 3071671 - RNA, 19 nt, Human
ugagucgaggacagggagg

SEQ ID NO: 3071672 - RNA, 18 nt, Human
ugagucgaggacagggag

SEQ ID NO: 3071673 - RNA, 13 nt, Human
ugaguccagaagu

SEQ ID NO: 3071674 - RNA, 19 nt, Human
ugaguccagaaguuugaga

SEQ ID NO: 3071675 - RNA, 16 nt, Human
ugaggagcuugaaacc

SEQ ID NO: 3071676 - RNA, 13 nt, Human
ugagcugggauga

SEQ ID NO: 3071677 - RNA, 21 nt, Human
ugaggcauuuguuugaacuga

SEQ ID NO: 3071678 - RNA, 17 nt, Human
ugaggcuaguguggugu

SEQ ID NO: 3071679 - RNA, 23 nt, Human
ugaggcuagugugguguuuccug

SEQ ID NO: 3071680 - RNA, 20 nt, Human
ugaggcauuuguuugaacug

SEQ ID NO: 3071681 - RNA, 19 nt, Human
ugaggcauuuguuugaacu

SEQ ID NO: 3071682 - RNA, 12 nt, Human
ugaggcauuugu

SEQ ID NO: 3071683 - RNA, 12 nt, Human
ugaggugggagg

SEQ ID NO: 3071684 - RNA, 13 nt, Human
ugaggugggagga

SEQ ID NO: 3071685 - RNA, 13 nt, Human
ugaggcucugccc

SEQ ID NO: 3071686 - RNA, 14 nt, Human
ugaggcucugcccu

SEQ ID NO: 3071687 - RNA, 18 nt, Human
ugaggcuccacuuggucu

SEQ ID NO: 3071688 - RNA, 20 nt, Human
ugaggcuccacuuggucugu

SEQ ID NO: 3071689 - RNA, 17 nt, Human
ugagggaacagagaggu

SEQ ID NO: 3071690 - RNA, 16 nt, Human
ugagggagaugccaug

SEQ ID NO: 3071691 - RNA, 23 nt, Human
ugagacguuuuuggaagaguagu

SEQ ID NO: 3071692 - RNA, 19 nt, Human
ugagacucgcgacaaugca

SEQ ID NO: 3071693 - RNA, 17 nt, Human
ugagaaauuuauaaacu

SEQ ID NO: 3071694 - RNA, 21 nt, Human
ugaccucaggugauccaccca

SEQ ID NO: 3071695 - RNA, 20 nt, Human
ugaccucaggugauccaccc

SEQ ID NO: 3071696 - RNA, 20 nt, Human
ugagacucgcgacaaugcaa

SEQ ID NO: 3071697 - RNA, 21 nt, Human
ugagacucgcgacaaugcaaa

SEQ ID NO: 3071698 - RNA, 22 nt, Human
ugagacucgcgacaaugcaaac

SEQ ID NO: 3071699 - RNA, 23 nt, Human
ugagacucgcgacaaugcaaacc

SEQ ID NO: 3071700 - RNA, 16 nt, Human
ugagagugaacaaauu

SEQ ID NO: 3071701 - RNA, 15 nt, Human
ugagaucaaaacggu

SEQ ID NO: 3071702 - RNA, 14 nt, Human
ugagaucagccugg

SEQ ID NO: 3071703 - RNA, 15 nt, Human
ugagcagggcucagc

SEQ ID NO: 3071704 - RNA, 14 nt, Human
ugagcagggcucag

SEQ ID NO: 3071705 - RNA, 13 nt, Human
ugagcagggcuca

SEQ ID NO: 3071706 - RNA, 12 nt, Human
ugagcagggcuc

SEQ ID NO: 3071707 - RNA, 15 nt, Human
ugagccucagcaucc

SEQ ID NO: 3071708 - RNA, 17 nt, Human
ugagccucagcauccug

SEQ ID NO: 3071709 - RNA, 21 nt, Human
ugagccgagaucacgccacug

SEQ ID NO: 3071710 - RNA, 19 nt, Human
ugagccgagaucacgccac

SEQ ID NO: 3071711 - RNA, 21 nt, Human
ugagccucagcauccuggcac

SEQ ID NO: 3071712 - RNA, 18 nt, Human
ugagccucagcauccugg

SEQ ID NO: 3071713 - RNA, 22 nt, Human
ugagccucagcauccuggcacc

SEQ ID NO: 3071714 - RNA, 18 nt, Human
ugagcaucaggccaggcc

SEQ ID NO: 3071715 - RNA, 19 nt, Human
ugagcaucaggccaggccc

SEQ ID NO: 3071716 - RNA, 20 nt, Human
ugagcaucaggccaggcccu

SEQ ID NO: 3071717 - RNA, 13 nt, Human
ugagccccaaaag

SEQ ID NO: 3071718 - RNA, 16 nt, Human
ugagcaucaggccagg

SEQ ID NO: 3071719 - RNA, 17 nt, Human
ugagcagggcucagcgg

SEQ ID NO: 3071720 - RNA, 16 nt, Human
ugagcagggcucagcg

SEQ ID NO: 3071721 - RNA, 19 nt, Human
ugagcagggcucagcgggg

SEQ ID NO: 3071722 - RNA, 14 nt, Human
uauggaggcaggag

SEQ ID NO: 3071723 - RNA, 13 nt, Human
uauguguguuuua

SEQ ID NO: 3071724 - RNA, 19 nt, Human
uauggaggcuuugcauaga

SEQ ID NO: 3071725 - RNA, 12 nt, Human
uauguuaaaacu

SEQ ID NO: 3071726 - RNA, 19 nt, Human
uauguuagugcaaauuguc

SEQ ID NO: 3071727 - RNA, 22 nt, Human
uauguucuuaguggauguucug

SEQ ID NO: 3071728 - RNA, 17 nt, Human
uauguucuaagaaguga

SEQ ID NO: 3071729 - RNA, 21 nt, Human
uauguugcccaggcaggucuu

SEQ ID NO: 3071730 - RNA, 16 nt, Human
uauuaagaaagacuau

SEQ ID NO: 3071731 - RNA, 17 nt, Human
uauuaaaugcccagccc

SEQ ID NO: 3071732 - RNA, 19 nt, Human
uauuaaaugcccagccccu

SEQ ID NO: 3071733 - RNA, 15 nt, Human
uauuaaaugcccagc

SEQ ID NO: 3071734 - RNA, 20 nt, Human
uauuauggaggcaggaguuu

SEQ ID NO: 3071735 - RNA, 16 nt, Human
uauuauguuaaaacug

SEQ ID NO: 3071736 - RNA, 12 nt, Human
uauuauguguuu

SEQ ID NO: 3071737 - RNA, 17 nt, Human
uauuauauuuacaaaug

SEQ ID NO: 3071738 - RNA, 14 nt, Human
uauuauaccuuuuu

SEQ ID NO: 3071739 - RNA, 14 nt, Human
uauuaaggaagaca

SEQ ID NO: 3071740 - RNA, 13 nt, Human
uauuauaccuuuu

SEQ ID NO: 3071741 - RNA, 12 nt, Human
uauuauaccuuu

SEQ ID NO: 3071742 - RNA, 14 nt, Human
uauugauaaguuca

SEQ ID NO: 3071743 - RNA, 16 nt, Human
uauugauaaguucaua

SEQ ID NO: 3071744 - RNA, 23 nt, Human
uauugauaaguucauacauugua

SEQ ID NO: 3071745 - RNA, 20 nt, Human
uauugauaugcuuauacacu

SEQ ID NO: 3071746 - RNA, 15 nt, Human
uauugcccacgcugg

SEQ ID NO: 3071747 - RNA, 14 nt, Human
uauugcccacgcug

SEQ ID NO: 3071748 - RNA, 13 nt, Human
uauugcccacgcu

SEQ ID NO: 3071749 - RNA, 23 nt, Human
uauugcugauggugcaaugaccu

SEQ ID NO: 3071750 - RNA, 22 nt, Human
uauugcugauggugcaaugacc

SEQ ID NO: 3071751 - RNA, 15 nt, Human
uauuguuuaaaauca

SEQ ID NO: 3071752 - RNA, 17 nt, Human
uauuguuuaaaaucauu

SEQ ID NO: 3071753 - RNA, 16 nt, Human
uauuguuuaaaaucau

SEQ ID NO: 3071754 - RNA, 14 nt, Human
uauuucuaugaaau

SEQ ID NO: 3071755 - RNA, 15 nt, Human
uauuucuaugaaaua

SEQ ID NO: 3071756 - RNA, 22 nt, Human
uauuuauuaaaugcccagcccc

SEQ ID NO: 3071757 - RNA, 14 nt, Human
uauuuauuacugua

SEQ ID NO: 3071758 - RNA, 13 nt, Human
uauuuauuacugu

SEQ ID NO: 3071759 - RNA, 13 nt, Human
uauuucuaugaaa

SEQ ID NO: 3071760 - RNA, 17 nt, Human
uauuuaugggauccugg

SEQ ID NO: 3071761 - RNA, 20 nt, Human
uauuguuuaaaaucauuucu

SEQ ID NO: 3071762 - RNA, 17 nt, Human
ucaaacauauauaacaa

SEQ ID NO: 3071763 - RNA, 22 nt, Human
ucaaacagucucaggaaaucaa

SEQ ID NO: 3071764 - RNA, 15 nt, Human
ucaaagagagaaaau

SEQ ID NO: 3071765 - RNA, 20 nt, Human
ucaaagagagaaaauaaaga

SEQ ID NO: 3071766 - RNA, 12 nt, Human
ucaaagagguuu

SEQ ID NO: 3071767 - RNA, 23 nt, Human
ucaaagagguuuuaaaaaaaucc

SEQ ID NO: 3071768 - RNA, 17 nt, Human
ucaaauaugcaaagcac

SEQ ID NO: 3071769 - RNA, 16 nt, Human
ucaaauaugcaaagca

SEQ ID NO: 3071770 - RNA, 16 nt, Human
ucaaauccuugaagau

SEQ ID NO: 3071771 - RNA, 15 nt, Human
ucaaauccuugaaga

SEQ ID NO: 3071772 - RNA, 19 nt, Human
ucaaauaugcaaagcacug

SEQ ID NO: 3071773 - RNA, 18 nt, Human
ucaaauaugcaaagcacu

SEQ ID NO: 3071774 - RNA, 20 nt, Human
ucaacucuccuccagaguca

SEQ ID NO: 3071775 - RNA, 19 nt, Human
ucaacuccaaacugacucu

SEQ ID NO: 3071776 - RNA, 22 nt, Human
ucaacuccaaacugacucuuaa

SEQ ID NO: 3071777 - RNA, 19 nt, Human
ucaaccccuucgcuccugu

SEQ ID NO: 3071778 - RNA, 18 nt, Human
ucaaccccuucgcuccug

SEQ ID NO: 3071779 - RNA, 15 nt, Human
ucaaccuccugggcu

SEQ ID NO: 3071780 - RNA, 20 nt, Human
ucaaccccuucgcuccugug

SEQ ID NO: 3071781 - RNA, 16 nt, Human
ucaaccuccugggcua

SEQ ID NO: 3071782 - RNA, 15 nt, Human
ucaaggauccugagc

SEQ ID NO: 3071783 - RNA, 16 nt, Human
ucaaggauccugagcc

SEQ ID NO: 3071784 - RNA, 13 nt, Human
ucaaggauccuga

SEQ ID NO: 3071785 - RNA, 14 nt, Human
ucaaggauccugag

SEQ ID NO: 3071786 - RNA, 19 nt, Human
ucaagcgauucuucugcuu

SEQ ID NO: 3071787 - RNA, 18 nt, Human
ucaagcgauucuucugcu

SEQ ID NO: 3071788 - RNA, 21 nt, Human
ucaagcgauucuucugcuuca

SEQ ID NO: 3071789 - RNA, 12 nt, Human
ucaagccaccaa

SEQ ID NO: 3071790 - RNA, 20 nt, Human
ucaagccaccaacauacucc

SEQ ID NO: 3071791 - RNA, 17 nt, Human
ucaagcgauucuucugc

SEQ ID NO: 3071792 - RNA, 22 nt, Human
ucacauuguauucagaguugau

SEQ ID NO: 3071793 - RNA, 17 nt, Human
ucacauuggaaacaagu

SEQ ID NO: 3071794 - RNA, 12 nt, Human
ucacauuuaaau

SEQ ID NO: 3071795 - RNA, 17 nt, Human
ucaccaacgucugugcc

SEQ ID NO: 3071796 - RNA, 18 nt, Human
ucaccaacgucugugcca

SEQ ID NO: 3071797 - RNA, 21 nt, Human
ucaccaaaucagcugcuacua

SEQ ID NO: 3071798 - RNA, 14 nt, Human
ucacauuuauucug

SEQ ID NO: 3071799 - RNA, 13 nt, Human
ucaccaagcccag

SEQ ID NO: 3071800 - RNA, 16 nt, Human
ucaccacaugugcaca

SEQ ID NO: 3071801 - RNA, 18 nt, Human
ucacccgcuaagagggag

SEQ ID NO: 3071802 - RNA, 12 nt, Human
ucacccuuuucu

SEQ ID NO: 3071803 - RNA, 14 nt, Human
ucaccgaaaacgug

SEQ ID NO: 3071804 - RNA, 19 nt, Human
ucacccgcuaagagggagg

SEQ ID NO: 3071805 - RNA, 15 nt, Human
ucaccgaaaacgugg

SEQ ID NO: 3071806 - RNA, 19 nt, Human
ucaccgaaaacguggcugc

SEQ ID NO: 3071807 - RNA, 20 nt, Human
ucaccgaaaacguggcugcu

SEQ ID NO: 3071808 - RNA, 21 nt, Human
ucaccgaaaacguggcugcuu

SEQ ID NO: 3071809 - RNA, 22 nt, Human
ucaccgaaaacguggcugcuuc

SEQ ID NO: 3071810 - RNA, 23 nt, Human
ucaccgaaaacguggcugcuuca

SEQ ID NO: 3071811 - RNA, 22 nt, Human
ucacacaugagcaucaggccag

SEQ ID NO: 3071812 - RNA, 23 nt, Human
ucacacaugagcaucaggccagg

SEQ ID NO: 3071813 - RNA, 15 nt, Human
ucacacacuuuggcu

SEQ ID NO: 3071814 - RNA, 14 nt, Human
ucacauuggaaaca

SEQ ID NO: 3071815 - RNA, 20 nt, Human
ucacauuccugaacaggaua

SEQ ID NO: 3071816 - RNA, 18 nt, Human
ucacaagacccaaaaggc

SEQ ID NO: 3071817 - RNA, 22 nt, Human
ucacaagacccaaaaggcagaa

SEQ ID NO: 3071818 - RNA, 16 nt, Human
uaugauucccagccag

SEQ ID NO: 3071819 - RNA, 16 nt, Human
uaugauucaaaugucu

SEQ ID NO: 3071820 - RNA, 21 nt, Human
uaugauucaaaugucuauaaa

SEQ ID NO: 3071821 - RNA, 16 nt, Human
uaugacuccagaauuu

SEQ ID NO: 3071822 - RNA, 17 nt, Human
uaugacuccagaauuuc

SEQ ID NO: 3071823 - RNA, 23 nt, Human
uaugacuccagaauuucccaaag

SEQ ID NO: 3071824 - RNA, 18 nt, Human
uaugcaaucaaaucugcu

SEQ ID NO: 3071825 - RNA, 15 nt, Human
uaugcaaagcacuga

SEQ ID NO: 3071826 - RNA, 14 nt, Human
uaugcacacauuuu

SEQ ID NO: 3071827 - RNA, 13 nt, Human
uaugcacacauuu

SEQ ID NO: 3071828 - RNA, 12 nt, Human
uaugcaaagcac

SEQ ID NO: 3071829 - RNA, 14 nt, Human
uaugcaaagcacug

SEQ ID NO: 3071830 - RNA, 13 nt, Human
uaugcaaagcacu

SEQ ID NO: 3071831 - RNA, 20 nt, Human
uaugcauauuauuuuauguu

SEQ ID NO: 3071832 - RNA, 15 nt, Human
uaugcuucuguuuua

SEQ ID NO: 3071833 - RNA, 16 nt, Human
uaugcuucuguuuuau

SEQ ID NO: 3071834 - RNA, 22 nt, Human
uaugcuuauacacuuacacuuu

SEQ ID NO: 3071835 - RNA, 13 nt, Human
uaugcaugaagua

SEQ ID NO: 3071836 - RNA, 13 nt, Human
uauggaacacucu

SEQ ID NO: 3071837 - RNA, 16 nt, Human
uauggaacacucugag

SEQ ID NO: 3071838 - RNA, 17 nt, Human
uauggaacacucugaga

SEQ ID NO: 3071839 - RNA, 18 nt, Human
uauggaacacucugagac

SEQ ID NO: 3071840 - RNA, 19 nt, Human
uauggaacacucugagacu

SEQ ID NO: 3071841 - RNA, 17 nt, Human
uauggacaaugacccag

SEQ ID NO: 3071842 - RNA, 20 nt, Human
uaugaaguuuuuuuuauaca

SEQ ID NO: 3071843 - RNA, 23 nt, Human
uaucugucauuugagcagggcuc

SEQ ID NO: 3071844 - RNA, 21 nt, Human
uaucugucauuugagcagggc

SEQ ID NO: 3071845 - RNA, 20 nt, Human
uaucugucauuugagcaggg

SEQ ID NO: 3071846 - RNA, 19 nt, Human
uaugacauaaaaacaacuu

SEQ ID NO: 3071847 - RNA, 22 nt, Human
uaugacauaaaaacaacuuuau

SEQ ID NO: 3071848 - RNA, 23 nt, Human
uaugacauaaaaacaacuuuaua

SEQ ID NO: 3071849 - RNA, 22 nt, Human
uaugacacaugcaaggucauuu

SEQ ID NO: 3071850 - RNA, 12 nt, Human
uaugacacaugc

SEQ ID NO: 3071851 - RNA, 17 nt, Human
uaugaauuacauuugua

SEQ ID NO: 3071852 - RNA, 23 nt, Human
uaugaauuacauuuguauaaaau

SEQ ID NO: 3071853 - RNA, 17 nt, Human
uauccuuucuaacaaaa

SEQ ID NO: 3071854 - RNA, 15 nt, Human
uauccuucagccuga

SEQ ID NO: 3071855 - RNA, 14 nt, Human
uauccuucagccug

SEQ ID NO: 3071856 - RNA, 18 nt, Human
uaucguaaaauuaagaaa

SEQ ID NO: 3071857 - RNA, 15 nt, Human
uaucguaaaauuaag

SEQ ID NO: 3071858 - RNA, 16 nt, Human
uaucuaaauguugaaa

SEQ ID NO: 3071859 - RNA, 19 nt, Human
uauauguuuuaagaggcag

SEQ ID NO: 3071860 - RNA, 14 nt, Human
uauccucuguugau

SEQ ID NO: 3071861 - RNA, 21 nt, Human
uaucuaauauguaacaagcca

SEQ ID NO: 3071862 - RNA, 15 nt, Human
uauaauucacauugu

SEQ ID NO: 3071863 - RNA, 18 nt, Human
uauaaacuuuaccuuuuu

SEQ ID NO: 3071864 - RNA, 21 nt, Human
uauaugcucugcauguuacau

SEQ ID NO: 3071865 - RNA, 20 nt, Human
uauaugcucugcauguuaca

SEQ ID NO: 3071866 - RNA, 13 nt, Human
uauaugcuucugu

SEQ ID NO: 3071867 - RNA, 21 nt, Human
uauaucuauauuuuacauaaa

SEQ ID NO: 3071868 - RNA, 20 nt, Human
uaguugcaacuuuguauaaa

SEQ ID NO: 3071869 - RNA, 13 nt, Human
uagucaaauugug

SEQ ID NO: 3071870 - RNA, 14 nt, Human
uagugcaaauuguc

SEQ ID NO: 3071871 - RNA, 15 nt, Human
uagugcaaauuguca

SEQ ID NO: 3071872 - RNA, 13 nt, Human
uaguaugaaauua

SEQ ID NO: 3071873 - RNA, 15 nt, Human
uaguaugaaauuaua

SEQ ID NO: 3071874 - RNA, 23 nt, Human
uaguaugaaauuauauaaguauu

SEQ ID NO: 3071875 - RNA, 16 nt, Human
uaguauuucuaugaaa

SEQ ID NO: 3071876 - RNA, 18 nt, Human
uaguauuucuaugaaaua

SEQ ID NO: 3071877 - RNA, 19 nt, Human
uaguauuucuaugaaauau

SEQ ID NO: 3071878 - RNA, 23 nt, Human
uaggugacagagugagacucugu

SEQ ID NO: 3071879 - RNA, 13 nt, Human
uaguaucaaaaga

SEQ ID NO: 3071880 - RNA, 16 nt, Human
uaggaauuguguuuau

SEQ ID NO: 3071881 - RNA, 12 nt, Human
uaggaauugacc

SEQ ID NO: 3071882 - RNA, 15 nt, Human
uaggccuggccagau

SEQ ID NO: 3071883 - RNA, 18 nt, Human
uaggccuggccagaugca

SEQ ID NO: 3071884 - RNA, 19 nt, Human
uaggacccgucuccagcug

SEQ ID NO: 3071885 - RNA, 18 nt, Human
uaggccaugggacaggga

SEQ ID NO: 3071886 - RNA, 16 nt, Human
uaggccaugggacagg

SEQ ID NO: 3071887 - RNA, 16 nt, Human
uagguaaauuacaguu

SEQ ID NO: 3071888 - RNA, 16 nt, Human
uaggucagugcaaaua

SEQ ID NO: 3071889 - RNA, 20 nt, Human
uagggaaaaaccagcgugug

SEQ ID NO: 3071890 - RNA, 21 nt, Human
uagggaaaaaccagcguguga

SEQ ID NO: 3071891 - RNA, 19 nt, Human
uagggaaaaaccagcgugu

SEQ ID NO: 3071892 - RNA, 11 nt, Human
uagggaaaaac

SEQ ID NO: 3071893 - RNA, 14 nt, Human
uccauagagagcaa

SEQ ID NO: 3071894 - RNA, 15 nt, Human
uccauagagagcaag

SEQ ID NO: 3071895 - RNA, 15 nt, Human
uccauacauuugugu

SEQ ID NO: 3071896 - RNA, 20 nt, Human
uccagguuuaagcuguuacu

SEQ ID NO: 3071897 - RNA, 18 nt, Human
uccagguuuaagcuguua

SEQ ID NO: 3071898 - RNA, 19 nt, Human
uccagguagagggugugua

SEQ ID NO: 3071899 - RNA, 12 nt, Human
uccauacauuug

SEQ ID NO: 3071900 - RNA, 12 nt, Human
uccaggagcagc

SEQ ID NO: 3071901 - RNA, 13 nt, Human
uccaggagcagcc

SEQ ID NO: 3071902 - RNA, 14 nt, Human
uccaggagcagcca

SEQ ID NO: 3071903 - RNA, 15 nt, Human
uccaggagcagccac

SEQ ID NO: 3071904 - RNA, 19 nt, Human
uccaggggugggacacccu

SEQ ID NO: 3071905 - RNA, 20 nt, Human
uccaggggugggacacccug

SEQ ID NO: 3071906 - RNA, 23 nt, Human
uccagaaagaaaacuuguauuau

SEQ ID NO: 3071907 - RNA, 16 nt, Human
uccaaaguacacuguu

SEQ ID NO: 3071908 - RNA, 14 nt, Human
uccaaaguacacug

SEQ ID NO: 3071909 - RNA, 21 nt, Human
uccacuuggucugugagaugc

SEQ ID NO: 3071910 - RNA, 17 nt, Human
uccacuuggucugugag

SEQ ID NO: 3071911 - RNA, 20 nt, Human
uccacuuucuagccagagga

SEQ ID NO: 3071912 - RNA, 21 nt, Human
uccacuuucuagccagaggag

SEQ ID NO: 3071913 - RNA, 19 nt, Human
uccacuuucuagccagagg

SEQ ID NO: 3071914 - RNA, 23 nt, Human
uccacuuggucugugagaugcua

SEQ ID NO: 3071915 - RNA, 18 nt, Human
uccccagauugcaacagg

SEQ ID NO: 3071916 - RNA, 13 nt, Human
uccccagauugca

SEQ ID NO: 3071917 - RNA, 20 nt, Human
ucccaugagccucagcaucc

SEQ ID NO: 3071918 - RNA, 17 nt, Human
ucccaugagccucagca

SEQ ID NO: 3071919 - RNA, 22 nt, Human
uccccagcaagugagagcuggg

SEQ ID NO: 3071920 - RNA, 21 nt, Human
uccccagcaagugagagcugg

SEQ ID NO: 3071921 - RNA, 20 nt, Human
uccccagcaagugagagcug

SEQ ID NO: 3071922 - RNA, 23 nt, Human
uccccagauugcaacaggcuggg

SEQ ID NO: 3071923 - RNA, 22 nt, Human
uccccagauugcaacaggcugg

SEQ ID NO: 3071924 - RNA, 20 nt, Human
uccccagauugcaacaggcu

SEQ ID NO: 3071925 - RNA, 19 nt, Human
uccccagauugcaacaggc

SEQ ID NO: 3071926 - RNA, 13 nt, Human
uccccaggaggcc

SEQ ID NO: 3071927 - RNA, 17 nt, Human
ucccccagccccauccu

SEQ ID NO: 3071928 - RNA, 15 nt, Human
uccccaggaggccag

SEQ ID NO: 3071929 - RNA, 16 nt, Human
uccccaggaggccagc

SEQ ID NO: 3071930 - RNA, 20 nt, Human
ucccccagccccauccucug

SEQ ID NO: 3071931 - RNA, 21 nt, Human
ucccccagccccauccucugu

SEQ ID NO: 3071932 - RNA, 14 nt, Human
uccccaggaggcca

SEQ ID NO: 3071933 - RNA, 19 nt, Human
ucccaugagccucagcauc

SEQ ID NO: 3071934 - RNA, 18 nt, Human
ucccaugagccucagcau

SEQ ID NO: 3071935 - RNA, 21 nt, Human
ucccaucugugaaaggaaaga

SEQ ID NO: 3071936 - RNA, 15 nt, Human
ucccaucuuccaagg

SEQ ID NO: 3071937 - RNA, 22 nt, Human
ucccagcugugcucuggacagg

SEQ ID NO: 3071938 - RNA, 21 nt, Human
ucccagcugugcucuggacag

SEQ ID NO: 3071939 - RNA, 23 nt, Human
ucccagcugugcucuggacaggc

SEQ ID NO: 3071940 - RNA, 20 nt, Human
ucccaccuggcucuguggcg

SEQ ID NO: 3071941 - RNA, 23 nt, Human
ucccaggcauuccccaggaggcc

SEQ ID NO: 3071942 - RNA, 24 nt, Human
ucccaggcauuccccaggaggcca

SEQ ID NO: 3071943 - RNA, 20 nt, Human
uccaugugggcuaguugggc

SEQ ID NO: 3071944 - RNA, 22 nt, Human
ucccaccucucucacuccuuga

SEQ ID NO: 3071945 - RNA, 20 nt, Human
ucccagcugugcucuggaca

SEQ ID NO: 3071946 - RNA, 17 nt, Human
ucccaccuuggcugcag

SEQ ID NO: 3071947 - RNA, 16 nt, Human
ucccaccuuggcugca

SEQ ID NO: 3071948 - RNA, 13 nt, Human
ucccaccuuggcu

SEQ ID NO: 3071949 - RNA, 14 nt, Human
ucccaccuggcucu

SEQ ID NO: 3071950 - RNA, 15 nt, Human
ucccaccuggcucug

SEQ ID NO: 3071951 - RNA, 16 nt, Human
ucccaccuggcucugu

SEQ ID NO: 3071952 - RNA, 19 nt, Human
ucccaccuggcucuguggc

SEQ ID NO: 3071953 - RNA, 23 nt, Human
ucagucugauucccaagcucugc

SEQ ID NO: 3071954 - RNA, 22 nt, Human
ucagucugauucccaagcucug

SEQ ID NO: 3071955 - RNA, 21 nt, Human
ucagucugauucccaagcucu

SEQ ID NO: 3071956 - RNA, 19 nt, Human
ucagucugauucccaagcu

SEQ ID NO: 3071957 - RNA, 20 nt, Human
ucagguggggcagcuugagg

SEQ ID NO: 3071958 - RNA, 19 nt, Human
ucagguggggcagcuugag

SEQ ID NO: 3071959 - RNA, 18 nt, Human
ucagguggggcagcuuga

SEQ ID NO: 3071960 - RNA, 23 nt, Human
ucaggugauccacccaccucagc

SEQ ID NO: 3071961 - RNA, 23 nt, Human
ucaggugagaagcagaggaagga

SEQ ID NO: 3071962 - RNA, 16 nt, Human
ucaggugauccaccca

SEQ ID NO: 3071963 - RNA, 15 nt, Human
ucaggagcccuggga

SEQ ID NO: 3071964 - RNA, 14 nt, Human
ucaggagcccuggg

SEQ ID NO: 3071965 - RNA, 12 nt, Human
ucaggagcccug

SEQ ID NO: 3071966 - RNA, 11 nt, Human
ucaggagcccu

SEQ ID NO: 3071967 - RNA, 21 nt, Human
ucaggccugggggcugggcag

SEQ ID NO: 3071968 - RNA, 23 nt, Human
ucaggaagcucagggccuggcuc

SEQ ID NO: 3071969 - RNA, 23 nt, Human
ucagcucugcaagaauugaagca

SEQ ID NO: 3071970 - RNA, 24 nt, Human
ucagcuccagcucaccagccccag

SEQ ID NO: 3071971 - RNA, 23 nt, Human
ucagcuccagcucaccagcccca

SEQ ID NO: 3071972 - RNA, 14 nt, Human
ucauggugcucaga

SEQ ID NO: 3071973 - RNA, 16 nt, Human
ucauuaggauggcuag

SEQ ID NO: 3071974 - RNA, 22 nt, Human
uccaaaaagauuuucagaaaau

SEQ ID NO: 3071975 - RNA, 16 nt, Human
uccaaaccaaauaaaa

SEQ ID NO: 3071976 - RNA, 13 nt, Human
uccaaaguacacu

SEQ ID NO: 3071977 - RNA, 17 nt, Human
uccaaagaaauguaagg

SEQ ID NO: 3071978 - RNA, 14 nt, Human
uccaaagaaaugua

SEQ ID NO: 3071979 - RNA, 16 nt, Human
ucaucuccccaucauu

SEQ ID NO: 3071980 - RNA, 19 nt, Human
ucaucuugaauuguaagga

SEQ ID NO: 3071981 - RNA, 17 nt, Human
ucauccacugugccaug

SEQ ID NO: 3071982 - RNA, 14 nt, Human
ucauccacugugcc

SEQ ID NO: 3071983 - RNA, 17 nt, Human
ucaugcuguucaugaaa

SEQ ID NO: 3071984 - RNA, 20 nt, Human
ucaguguacauggaauaaca

SEQ ID NO: 3071985 - RNA, 12 nt, Human
ucauagcagcuu

SEQ ID NO: 3071986 - RNA, 11 nt, Human
ucauagcagcu

SEQ ID NO: 3071987 - RNA, 14 nt, Human
ucaucauccuaagc

SEQ ID NO: 3071988 - RNA, 17 nt, Human
ucaucaaugaaugaaug

SEQ ID NO: 3071989 - RNA, 14 nt, Human
ucuaccuuccugca

SEQ ID NO: 3071990 - RNA, 15 nt, Human
ucuacagaggccaug

SEQ ID NO: 3071991 - RNA, 21 nt, Human
ucuacacugugcugagucuga

SEQ ID NO: 3071992 - RNA, 17 nt, Human
ucuaugacacaugcaag

SEQ ID NO: 3071993 - RNA, 14 nt, Human
ucuaugacacaugc

SEQ ID NO: 3071994 - RNA, 18 nt, Human
ucuaugaaauauuauguu

SEQ ID NO: 3071995 - RNA, 19 nt, Human
ucuaggaagacuuuggaaa

SEQ ID NO: 3071996 - RNA, 15 nt, Human
ucuaggaagacuuug

SEQ ID NO: 3071997 - RNA, 16 nt, Human
ucuaggaagacuuugg

SEQ ID NO: 3071998 - RNA, 20 nt, Human
ucuaaaggcuaccuuuguau

SEQ ID NO: 3071999 - RNA, 19 nt, Human
ucuaaaggcuaccuuugua

SEQ ID NO: 3072000 - RNA, 17 nt, Human
ucuaaaggcuaccuuug

SEQ ID NO: 3072001 - RNA, 18 nt, Human
ucuaaaggcuaccuuugu

SEQ ID NO: 3072002 - RNA, 13 nt, Human
ucgugacaacacu

SEQ ID NO: 3072003 - RNA, 12 nt, Human
ucggagaagagc

SEQ ID NO: 3072004 - RNA, 16 nt, Human
ucggagaagagcuguu

SEQ ID NO: 3072005 - RNA, 14 nt, Human
ucggagaagagcug

SEQ ID NO: 3072006 - RNA, 18 nt, Human
ucucccugcugcuccuag

SEQ ID NO: 3072007 - RNA, 20 nt, Human
ucucccugcugcuccuagga

SEQ ID NO: 3072008 - RNA, 23 nt, Human
ucucccucagucuggcccuuccu

SEQ ID NO: 3072009 - RNA, 18 nt, Human
ucucccucagucuggccc

SEQ ID NO: 3072010 - RNA, 12 nt, Human
ucucccccagcc

SEQ ID NO: 3072011 - RNA, 22 nt, Human
ucuccagccccuggaugcagcc

SEQ ID NO: 3072012 - RNA, 16 nt, Human
ucuccagccccuggau

SEQ ID NO: 3072013 - RNA, 18 nt, Human
ucuccagccccuggaugc

SEQ ID NO: 3072014 - RNA, 13 nt, Human
ucuccagcugcug

SEQ ID NO: 3072015 - RNA, 15 nt, Human
ucuccagcugcugag

SEQ ID NO: 3072016 - RNA, 12 nt, Human
ucuccagccccu

SEQ ID NO: 3072017 - RNA, 13 nt, Human
ucuccagccccug

SEQ ID NO: 3072018 - RNA, 14 nt, Human
ucuccagccccugg

SEQ ID NO: 3072019 - RNA, 15 nt, Human
ucuccagccccugga

SEQ ID NO: 3072020 - RNA, 14 nt, Human
ucuccaccugccag

SEQ ID NO: 3072021 - RNA, 15 nt, Human
ucuccaccugccagg

SEQ ID NO: 3072022 - RNA, 16 nt, Human
ucuccaccugccaggg

SEQ ID NO: 3072023 - RNA, 17 nt, Human
ucuccaccugccaggga

SEQ ID NO: 3072024 - RNA, 19 nt, Human
ucuccaccugccagggaca

SEQ ID NO: 3072025 - RNA, 22 nt, Human
ucuccaccugccagggacagag

SEQ ID NO: 3072026 - RNA, 16 nt, Human
ucuccacccugcucuc

SEQ ID NO: 3072027 - RNA, 14 nt, Human
ucuccacccugcuc

SEQ ID NO: 3072028 - RNA, 17 nt, Human
ucuccacccugcucucc

SEQ ID NO: 3072029 - RNA, 12 nt, Human
ucuccacccugc

SEQ ID NO: 3072030 - RNA, 13 nt, Human
ucuccacccugcu

SEQ ID NO: 3072031 - RNA, 13 nt, Human
ucuaugggacuca

SEQ ID NO: 3072032 - RNA, 12 nt, Human
ucuaugggacuc

SEQ ID NO: 3072033 - RNA, 19 nt, Human
ucuaugggacucaaugcac

SEQ ID NO: 3072034 - RNA, 23 nt, Human
ucucaguccaugaagauguagag

SEQ ID NO: 3072035 - RNA, 23 nt, Human
ucucauaauuuauacaggucaua

SEQ ID NO: 3072036 - RNA, 18 nt, Human
ucucauacucaccucacc

SEQ ID NO: 3072037 - RNA, 16 nt, Human
ucucauacucaccuca

SEQ ID NO: 3072038 - RNA, 21 nt, Human
uccuauauuguuuucagugua

SEQ ID NO: 3072039 - RNA, 23 nt, Human
uccuauauuguuuucaguguaca

SEQ ID NO: 3072040 - RNA, 23 nt, Human
uccuagugaaagaggcagcuuga

SEQ ID NO: 3072041 - RNA, 14 nt, Human
uccuagugaaagag

SEQ ID NO: 3072042 - RNA, 10 nt, Human
uccuccaggu

SEQ ID NO: 3072043 - RNA, 12 nt, Human
uccucccaccuc

SEQ ID NO: 3072044 - RNA, 18 nt, Human
uccucauuagcauuuugc

SEQ ID NO: 3072045 - RNA, 17 nt, Human
uccucauuagcauuuug

SEQ ID NO: 3072046 - RNA, 22 nt, Human
uccucauuuuuauaaugucccu

SEQ ID NO: 3072047 - RNA, 21 nt, Human
uccuaagcuauucaguaauaa

SEQ ID NO: 3072048 - RNA, 20 nt, Human
uccuaagcuauucaguaaua

SEQ ID NO: 3072049 - RNA, 20 nt, Human
uccgcuuucuacccagcgag

SEQ ID NO: 3072050 - RNA, 18 nt, Human
uccgcuuucuacccagcg

SEQ ID NO: 3072051 - RNA, 16 nt, Human
uccgcuuucuacccag

SEQ ID NO: 3072052 - RNA, 14 nt, Human
uccgccucuugggu

SEQ ID NO: 3072053 - RNA, 16 nt, Human
ucccuuccucuuucca

SEQ ID NO: 3072054 - RNA, 15 nt, Human
ucccuuccucuuucc

SEQ ID NO: 3072055 - RNA, 15 nt, Human
ucccccuuccaugga

SEQ ID NO: 3072056 - RNA, 20 nt, Human
ucccuucacaaacccagugu

SEQ ID NO: 3072057 - RNA, 22 nt, Human
uccugucggagcccugucuccu

SEQ ID NO: 3072058 - RNA, 13 nt, Human
uccuguagcccua

SEQ ID NO: 3072059 - RNA, 11 nt, Human
uccuguagccc

SEQ ID NO: 3072060 - RNA, 22 nt, Human
uccuguaccucuugagccuuga

SEQ ID NO: 3072061 - RNA, 12 nt, Human
uccuggccucaa

SEQ ID NO: 3072062 - RNA, 13 nt, Human
uccuggcccaggg

SEQ ID NO: 3072063 - RNA, 22 nt, Human
uccuggcccagggcaucuggga

SEQ ID NO: 3072064 - RNA, 15 nt, Human
uccuggcccagggca

SEQ ID NO: 3072065 - RNA, 16 nt, Human
uccuggcccagggcau

SEQ ID NO: 3072066 - RNA, 19 nt, Human
uccuggcccagggcaucug

SEQ ID NO: 3072067 - RNA, 13 nt, Human
uccuggcacugcu

SEQ ID NO: 3072068 - RNA, 16 nt, Human
uccuggcacugcuucc

SEQ ID NO: 3072069 - RNA, 22 nt, Human
uccuggcacccggccccugcug

SEQ ID NO: 3072070 - RNA, 23 nt, Human
uccuggcacccggccccugcugg

SEQ ID NO: 3072071 - RNA, 14 nt, Human
uccuggaguucugg

SEQ ID NO: 3072072 - RNA, 22 nt, Human
uccuggacugagggggccugga

SEQ ID NO: 3072073 - RNA, 20 nt, Human
uccuggacugagggggccug

SEQ ID NO: 3072074 - RNA, 14 nt, Human
uccuggacugaggg

SEQ ID NO: 3072075 - RNA, 17 nt, Human
uccugcccuuaccugcc

SEQ ID NO: 3072076 - RNA, 20 nt, Human
uccugcccuuaccugccagg

SEQ ID NO: 3072077 - RNA, 13 nt, Human
uccugccaggcau

SEQ ID NO: 3072078 - RNA, 14 nt, Human
uccugccaggcaug

SEQ ID NO: 3072079 - RNA, 17 nt, Human
uccugaggcuccacuug

SEQ ID NO: 3072080 - RNA, 19 nt, Human
uccugaggcuccacuuggu

SEQ ID NO: 3072081 - RNA, 20 nt, Human
uccugaggcuccacuugguc

SEQ ID NO: 3072082 - RNA, 18 nt, Human
uccugccccugagcccau

SEQ ID NO: 3072083 - RNA, 17 nt, Human
uccugccccugagccca

SEQ ID NO: 3072084 - RNA, 21 nt, Human
uccugagccagauuucacucu

SEQ ID NO: 3072085 - RNA, 11 nt, Human
gugaggccaga

SEQ ID NO: 3072086 - RNA, 20 nt, Human
gugauccacccaccucagcc

SEQ ID NO: 3072087 - RNA, 18 nt, Human
gugauccacccaccucag

SEQ ID NO: 3072088 - RNA, 15 nt, Human
gugauccacccaccu

SEQ ID NO: 3072089 - RNA, 18 nt, Human
gugauccucccaccucag

SEQ ID NO: 3072090 - RNA, 15 nt, Human
gugauccucccaccu

SEQ ID NO: 3072091 - RNA, 14 nt, Human
gugauccucccacc

SEQ ID NO: 3072092 - RNA, 22 nt, Human
gugauccucccaccucagccuc

SEQ ID NO: 3072093 - RNA, 20 nt, Human
gugauccucccaccucagcc

SEQ ID NO: 3072094 - RNA, 12 nt, Human
gugauuuucauu

SEQ ID NO: 3072095 - RNA, 23 nt, Human
gugauucuccugccucagccucc

SEQ ID NO: 3072096 - RNA, 22 nt, Human
gugauucuccugccucagccuc

SEQ ID NO: 3072097 - RNA, 20 nt, Human
gugauucuccugccucagcc

SEQ ID NO: 3072098 - RNA, 19 nt, Human
gugauucuccugccucagc

SEQ ID NO: 3072099 - RNA, 18 nt, Human
gugauucuccugccucag

SEQ ID NO: 3072100 - RNA, 17 nt, Human
gugauucuccugccuca

SEQ ID NO: 3072101 - RNA, 16 nt, Human
gugauucuccugccuc

SEQ ID NO: 3072102 - RNA, 14 nt, Human
gugauucuccugcc

SEQ ID NO: 3072103 - RNA, 20 nt, Human
gugcccacaggaucagucug

SEQ ID NO: 3072104 - RNA, 19 nt, Human
gugcauaaguuaacuucca

SEQ ID NO: 3072105 - RNA, 18 nt, Human
gugcaaauugucacagga

SEQ ID NO: 3072106 - RNA, 14 nt, Human
gugcauaccacuuu

SEQ ID NO: 3072107 - RNA, 13 nt, Human
gugcauaccacuu

SEQ ID NO: 3072108 - RNA, 22 nt, Human
gugccagguuuuuggucugacc

SEQ ID NO: 3072109 - RNA, 20 nt, Human
gugccagguuuuuggucuga

SEQ ID NO: 3072110 - RNA, 20 nt, Human
gugaaauuauucauaauuau

SEQ ID NO: 3072111 - RNA, 18 nt, Human
gugaaauuauucauaauu

SEQ ID NO: 3072112 - RNA, 14 nt, Human
gugaauaccccaag

SEQ ID NO: 3072113 - RNA, 23 nt, Human
gugaauaccccaagacucccaug

SEQ ID NO: 3072114 - RNA, 13 nt, Human
gugaaaucauuca

SEQ ID NO: 3072115 - RNA, 17 nt, Human
gugaaaguacauuugga

SEQ ID NO: 3072116 - RNA, 19 nt, Human
gugaaaggaaagagggagg

SEQ ID NO: 3072117 - RNA, 12 nt, Human
gugaaaauuauu

SEQ ID NO: 3072118 - RNA, 15 nt, Human
gugaaaauuauuuug

SEQ ID NO: 3072119 - RNA, 14 nt, Human
gugaaaagaaaaau

SEQ ID NO: 3072120 - RNA, 23 nt, Human
gugaaaagaaaaaugagccuggc

SEQ ID NO: 3072121 - RNA, 19 nt, Human
gugaaagaaaauaacaaua

SEQ ID NO: 3072122 - RNA, 12 nt, Human
gugaaacuggau

SEQ ID NO: 3072123 - RNA, 20 nt, Human
gugaaacucguuaauuugua

SEQ ID NO: 3072124 - RNA, 14 nt, Human
gugagcuacaaaug

SEQ ID NO: 3072125 - RNA, 16 nt, Human
gugaggaagccgcugg

SEQ ID NO: 3072126 - RNA, 19 nt, Human
gugaggaagccgcuggggc

SEQ ID NO: 3072127 - RNA, 11 nt, Human
gugaggaagcc

SEQ ID NO: 3072128 - RNA, 17 nt, Human
gugacugaucucucgug

SEQ ID NO: 3072129 - RNA, 16 nt, Human
gugagcagucaggaaa

SEQ ID NO: 3072130 - RNA, 13 nt, Human
gugagccacugca

SEQ ID NO: 3072131 - RNA, 15 nt, Human
gugacugaauuucuu

SEQ ID NO: 3072132 - RNA, 18 nt, Human
gugacugaauuucuuuug

SEQ ID NO: 3072133 - RNA, 16 nt, Human
gugacugaauuucuuu

SEQ ID NO: 3072134 - RNA, 16 nt, Human
gugacaacacuugugu

SEQ ID NO: 3072135 - RNA, 15 nt, Human
gugaccucugccuga

SEQ ID NO: 3072136 - RNA, 11 nt, Human
guggcagucug

SEQ ID NO: 3072137 - RNA, 15 nt, Human
guggcagugggagcu

SEQ ID NO: 3072138 - RNA, 17 nt, Human
guggcagugggagcugc

SEQ ID NO: 3072139 - RNA, 16 nt, Human
guggcagugggagcug

SEQ ID NO: 3072140 - RNA, 19 nt, Human
guggcagcugcuuuugucu

SEQ ID NO: 3072141 - RNA, 13 nt, Human
guggcagcugcuu

SEQ ID NO: 3072142 - RNA, 12 nt, Human
guggcagcugcu

SEQ ID NO: 3072143 - RNA, 23 nt, Human
guggcagcugcgguccacccagg

SEQ ID NO: 3072144 - RNA, 22 nt, Human
guggcagcugcgguccacccag

SEQ ID NO: 3072145 - RNA, 21 nt, Human
guggcagcugcgguccaccca

SEQ ID NO: 3072146 - RNA, 20 nt, Human
guggaugccugguggcagcu

SEQ ID NO: 3072147 - RNA, 19 nt, Human
guggcagcugcgguccacc

SEQ ID NO: 3072148 - RNA, 21 nt, Human
guggcagugggagcugccugu

SEQ ID NO: 3072149 - RNA, 19 nt, Human
guggcagugggagcugccu

SEQ ID NO: 3072150 - RNA, 22 nt, Human
guggccacaccucuaucccggc

SEQ ID NO: 3072151 - RNA, 23 nt, Human
guggccacaccucuaucccggcu

SEQ ID NO: 3072152 - RNA, 17 nt, Human
guggaguucaucuugaa

SEQ ID NO: 3072153 - RNA, 18 nt, Human
guggaugccugguggcag

SEQ ID NO: 3072154 - RNA, 16 nt, Human
guggaugccugguggc

SEQ ID NO: 3072155 - RNA, 20 nt, Human
guggagaagcggcuggcagc

SEQ ID NO: 3072156 - RNA, 16 nt, Human
gugcucuggacaggca

SEQ ID NO: 3072157 - RNA, 15 nt, Human
gugcucuggacaggc

SEQ ID NO: 3072158 - RNA, 21 nt, Human
gugccuuggggacaagagcag

SEQ ID NO: 3072159 - RNA, 23 nt, Human
gugcugaaugguuuucaaaauaa

SEQ ID NO: 3072160 - RNA, 20 nt, Human
gugcugaaugguuuucaaaa

SEQ ID NO: 3072161 - RNA, 19 nt, Human
gugcugaaugguuuucaaa

SEQ ID NO: 3072162 - RNA, 18 nt, Human
gugcucuggacaggcaug

SEQ ID NO: 3072163 - RNA, 17 nt, Human
gugcucuggacaggcau

SEQ ID NO: 3072164 - RNA, 16 nt, Human
gugcugagucugaagg

SEQ ID NO: 3072165 - RNA, 17 nt, Human
gugcugagucugaaggc

SEQ ID NO: 3072166 - RNA, 18 nt, Human
gugcugagucugaaggcu

SEQ ID NO: 3072167 - RNA, 19 nt, Human
gugcugagucugaaggcug

SEQ ID NO: 3072168 - RNA, 12 nt, Human
gugcugagucug

SEQ ID NO: 3072169 - RNA, 19 nt, Human
gugcugccauccagguuca

SEQ ID NO: 3072170 - RNA, 18 nt, Human
gugcugccauccagguuc

SEQ ID NO: 3072171 - RNA, 15 nt, Human
gugcugccauccagg

SEQ ID NO: 3072172 - RNA, 20 nt, Human
gugcugcauuuaaaagauac

SEQ ID NO: 3072173 - RNA, 19 nt, Human
gugcugcauuuaaaagaua

SEQ ID NO: 3072174 - RNA, 12 nt, Human
gugcugcauuua

SEQ ID NO: 3072175 - RNA, 18 nt, Human
guggaaaaauagccugcc

SEQ ID NO: 3072176 - RNA, 13 nt, Human
gugcuuggaggaa

SEQ ID NO: 3072177 - RNA, 15 nt, Human
gugcuuggaggaagg

SEQ ID NO: 3072178 - RNA, 12 nt, Human
gugcuuggagga

SEQ ID NO: 3072179 - RNA, 11 nt, Human
gugcugcccug

SEQ ID NO: 3072180 - RNA, 22 nt, Human
gugcugccauccagguucagcu

SEQ ID NO: 3072181 - RNA, 23 nt, Human
gucuaagauaguaacaaugaaga

SEQ ID NO: 3072182 - RNA, 17 nt, Human
gucuacacuaagagaga

SEQ ID NO: 3072183 - RNA, 15 nt, Human
gucuacacugugcug

SEQ ID NO: 3072184 - RNA, 23 nt, Human
gucuacacuaagagagaaugaga

SEQ ID NO: 3072185 - RNA, 16 nt, Human
guccuuaccagcagag

SEQ ID NO: 3072186 - RNA, 17 nt, Human
guccuuaccagcagagc

SEQ ID NO: 3072187 - RNA, 15 nt, Human
guccuuaccagcaga

SEQ ID NO: 3072188 - RNA, 23 nt, Human
gucucacuguugcccaggcuggc

SEQ ID NO: 3072189 - RNA, 22 nt, Human
gucucacuguugcccaggcugg

SEQ ID NO: 3072190 - RNA, 21 nt, Human
gucucacuguugcccaggcug

SEQ ID NO: 3072191 - RNA, 20 nt, Human
gucucacuguugcccaggcu

SEQ ID NO: 3072192 - RNA, 19 nt, Human
gucucacuguugcccaggc

SEQ ID NO: 3072193 - RNA, 18 nt, Human
gucucacuguugcccagg

SEQ ID NO: 3072194 - RNA, 17 nt, Human
gucucacuguugcccag

SEQ ID NO: 3072195 - RNA, 16 nt, Human
gucucacuguugccca

SEQ ID NO: 3072196 - RNA, 23 nt, Human
gucucacuauguugcccaggcag

SEQ ID NO: 3072197 - RNA, 13 nt, Human
gucucacuguugc

SEQ ID NO: 3072198 - RNA, 21 nt, Human
gucucacuauguugcccaggc

SEQ ID NO: 3072199 - RNA, 20 nt, Human
gucucacuauguugcccagg

SEQ ID NO: 3072200 - RNA, 19 nt, Human
gucugaggaauccagaccc

SEQ ID NO: 3072201 - RNA, 18 nt, Human
gucugaggaauccagacc

SEQ ID NO: 3072202 - RNA, 15 nt, Human
gucugacccacugcu

SEQ ID NO: 3072203 - RNA, 14 nt, Human
gucugacccacugc

SEQ ID NO: 3072204 - RNA, 13 nt, Human
gucugacccacug

SEQ ID NO: 3072205 - RNA, 21 nt, Human
gucugauucccaagcucugcu

SEQ ID NO: 3072206 - RNA, 20 nt, Human
gucugauucccaagcucugc

SEQ ID NO: 3072207 - RNA, 21 nt, Human
gucugaggaauccagacccgg

SEQ ID NO: 3072208 - RNA, 19 nt, Human
gucugauucccaagcucug

SEQ ID NO: 3072209 - RNA, 18 nt, Human
gucugauucccaagcucu

SEQ ID NO: 3072210 - RNA, 17 nt, Human
gucugauucccaagcuc

SEQ ID NO: 3072211 - RNA, 12 nt, Human
gucccagugccg

SEQ ID NO: 3072212 - RNA, 23 nt, Human
guccuagaaauuccccacccuga

SEQ ID NO: 3072213 - RNA, 23 nt, Human
guccuacucugugucaggugggg

SEQ ID NO: 3072214 - RNA, 15 nt, Human
guccuacucuguguc

SEQ ID NO: 3072215 - RNA, 16 nt, Human
gucccugguggcagcu

SEQ ID NO: 3072216 - RNA, 17 nt, Human
gucccugguggcagcuc

SEQ ID NO: 3072217 - RNA, 13 nt, Human
guccuacucugug

SEQ ID NO: 3072218 - RNA, 23 nt, Human
guccucccaucucacacaugagc

SEQ ID NO: 3072219 - RNA, 13 nt, Human
guccucccaucuc

SEQ ID NO: 3072220 - RNA, 14 nt, Human
guccucccaucuca

SEQ ID NO: 3072221 - RNA, 12 nt, Human
guccucccaucu

SEQ ID NO: 3072222 - RNA, 17 nt, Human
guccuggcaugggaaug

SEQ ID NO: 3072223 - RNA, 16 nt, Human
guccugggagugagcu

SEQ ID NO: 3072224 - RNA, 15 nt, Human
guccugggagugagc

SEQ ID NO: 3072225 - RNA, 18 nt, Human
guccugggagugagcugg

SEQ ID NO: 3072226 - RNA, 17 nt, Human
guccugggagugagcug

SEQ ID NO: 3072227 - RNA, 19 nt, Human
guccugggagugagcuggu

SEQ ID NO: 3072228 - RNA, 21 nt, Human
guccugucggagcccugucuc

SEQ ID NO: 3072229 - RNA, 20 nt, Human
guccugucggagcccugucu

SEQ ID NO: 3072230 - RNA, 18 nt, Human
guccugucggagcccugu

SEQ ID NO: 3072231 - RNA, 21 nt, Human
guauuugagaguucuaaauuu

SEQ ID NO: 3072232 - RNA, 19 nt, Human
guauuugagaguucuaaau

SEQ ID NO: 3072233 - RNA, 17 nt, Human
guauuucuaugaaauau

SEQ ID NO: 3072234 - RNA, 22 nt, Human
guauuucuaugaaauauuaugu

SEQ ID NO: 3072235 - RNA, 15 nt, Human
guauuauguguguuu

SEQ ID NO: 3072236 - RNA, 14 nt, Human
guauuauaccuuuu

SEQ ID NO: 3072237 - RNA, 15 nt, Human
guauuacuucugcua

SEQ ID NO: 3072238 - RNA, 14 nt, Human
guauuacuucugcu

SEQ ID NO: 3072239 - RNA, 13 nt, Human
guauuacuucugc

SEQ ID NO: 3072240 - RNA, 22 nt, Human
guauuacaguggggaaugaaga

SEQ ID NO: 3072241 - RNA, 15 nt, Human
guagagugggagcug

SEQ ID NO: 3072242 - RNA, 20 nt, Human
guauuacaguggggaaugaa

SEQ ID NO: 3072243 - RNA, 13 nt, Human
guagagugggagc

SEQ ID NO: 3072244 - RNA, 16 nt, Human
gucaagugaaaaagga

SEQ ID NO: 3072245 - RNA, 18 nt, Human
gucaagugaaaaaggagg

SEQ ID NO: 3072246 - RNA, 19 nt, Human
gucaagugaaaaaggagga

SEQ ID NO: 3072247 - RNA, 19 nt, Human
gucaagagggucugaggaa

SEQ ID NO: 3072248 - RNA, 18 nt, Human
gucaagagggucugagga

SEQ ID NO: 3072249 - RNA, 16 nt, Human
guauuuuaaaagaaug

SEQ ID NO: 3072250 - RNA, 17 nt, Human
guauuuuaaaagaauga

SEQ ID NO: 3072251 - RNA, 20 nt, Human
gucaccugaagacucauucu

SEQ ID NO: 3072252 - RNA, 14 nt, Human
gucaccucauggaa

SEQ ID NO: 3072253 - RNA, 13 nt, Human
gucaccccggcca

SEQ ID NO: 3072254 - RNA, 13 nt, Human
gucaauuacagga

SEQ ID NO: 3072255 - RNA, 15 nt, Human
gucaauuacaggaag

SEQ ID NO: 3072256 - RNA, 16 nt, Human
gucaauuacaggaagu

SEQ ID NO: 3072257 - RNA, 21 nt, Human
gucaauaaaauccauacauuu

SEQ ID NO: 3072258 - RNA, 15 nt, Human
gucaauaaaauccau

SEQ ID NO: 3072259 - RNA, 17 nt, Human
gucccagauacuugggg

SEQ ID NO: 3072260 - RNA, 14 nt, Human
gucccacucagucc

SEQ ID NO: 3072261 - RNA, 15 nt, Human
gucccacucagucca

SEQ ID NO: 3072262 - RNA, 16 nt, Human
guccacccaggagccc

SEQ ID NO: 3072263 - RNA, 15 nt, Human
guccacccaggagcc

SEQ ID NO: 3072264 - RNA, 13 nt, Human
guccacccaggag

SEQ ID NO: 3072265 - RNA, 14 nt, Human
guccacccaggagc

SEQ ID NO: 3072266 - RNA, 21 nt, Human
gucauauaagauucauauuua

SEQ ID NO: 3072267 - RNA, 15 nt, Human
guacagacagaaaaa

SEQ ID NO: 3072268 - RNA, 16 nt, Human
guacagacaacaaacc

SEQ ID NO: 3072269 - RNA, 20 nt, Human
guacacuguuucaaacuuua

SEQ ID NO: 3072270 - RNA, 19 nt, Human
guacacuguuucaaacuuu

SEQ ID NO: 3072271 - RNA, 21 nt, Human
guacacuguuucaaacuuuac

SEQ ID NO: 3072272 - RNA, 23 nt, Human
guacacugccuucucaacuccaa

SEQ ID NO: 3072273 - RNA, 12 nt, Human
guacagagccca

SEQ ID NO: 3072274 - RNA, 18 nt, Human
guacagagcccacgcccc

SEQ ID NO: 3072275 - RNA, 22 nt, Human
guacagagcccacgcccccacu

SEQ ID NO: 3072276 - RNA, 20 nt, Human
guacagcaaggagauuuaca

SEQ ID NO: 3072277 - RNA, 20 nt, Human
guacauaaugcgugcauacc

SEQ ID NO: 3072278 - RNA, 15 nt, Human
guacccacugcucug

SEQ ID NO: 3072279 - RNA, 13 nt, Human
guaaugaaaacca

SEQ ID NO: 3072280 - RNA, 11 nt, Human
guaaugaaaac

SEQ ID NO: 3072281 - RNA, 19 nt, Human
guaaugauaacuggaaacu

SEQ ID NO: 3072282 - RNA, 14 nt, Human
guaauucaagaaaa

SEQ ID NO: 3072283 - RNA, 13 nt, Human
guaauucaagaaa

SEQ ID NO: 3072284 - RNA, 18 nt, Human
guacacuguuucaaacuu

SEQ ID NO: 3072285 - RNA, 15 nt, Human
guaauuggaaaggca

SEQ ID NO: 3072286 - RNA, 21 nt, Human
guaauuaaguacuauguauca

SEQ ID NO: 3072287 - RNA, 20 nt, Human
guaauuaaguacuauguauc

SEQ ID NO: 3072288 - RNA, 17 nt, Human
guaauuaaguacuaugu

SEQ ID NO: 3072289 - RNA, 14 nt, Human
guaauuaaguacua

SEQ ID NO: 3072290 - RNA, 15 nt, Human
guacgaagaguauuu

SEQ ID NO: 3072291 - RNA, 15 nt, Human
guacgucugacaggc

SEQ ID NO: 3072292 - RNA, 14 nt, Human
guacgucugacagg

SEQ ID NO: 3072293 - RNA, 16 nt, Human
guacguugugcauuug

SEQ ID NO: 3072294 - RNA, 15 nt, Human
guacguugugcauuu

SEQ ID NO: 3072295 - RNA, 14 nt, Human
guacguugugcauu

SEQ ID NO: 3072296 - RNA, 17 nt, Human
guacgucugacaggcaa

SEQ ID NO: 3072297 - RNA, 23 nt, Human
guacuaaggaaucuuucugcuuu

SEQ ID NO: 3072298 - RNA, 15 nt, Human
guacuaaggaaucuu

SEQ ID NO: 3072299 - RNA, 17 nt, Human
guacguugugcauuugg

SEQ ID NO: 3072300 - RNA, 15 nt, Human
guacuucuccacccu

SEQ ID NO: 3072301 - RNA, 14 nt, Human
guacuucuccaccc

SEQ ID NO: 3072302 - RNA, 15 nt, Human
guacuucaugcuguc

SEQ ID NO: 3072303 - RNA, 16 nt, Human
guacccacugcucugg

SEQ ID NO: 3072304 - RNA, 15 nt, Human
guaccgcaaugugac

SEQ ID NO: 3072305 - RNA, 22 nt, Human
guaccucuugagccuugaacuu

SEQ ID NO: 3072306 - RNA, 21 nt, Human
guaccucuugagccuugaacu

SEQ ID NO: 3072307 - RNA, 13 nt, Human
guaccucuugagc

SEQ ID NO: 3072308 - RNA, 23 nt, Human
guacuuuauuuucuauaauuuaa

SEQ ID NO: 3072309 - RNA, 21 nt, Human
guacuuguggacacagcucuu

SEQ ID NO: 3072310 - RNA, 18 nt, Human
guagagccagggucucac

SEQ ID NO: 3072311 - RNA, 16 nt, Human
guagagcggagaaagg

SEQ ID NO: 3072312 - RNA, 15 nt, Human
guagaggagaaacug

SEQ ID NO: 3072313 - RNA, 19 nt, Human
guacuugcucuugaugccu

SEQ ID NO: 3072314 - RNA, 18 nt, Human
guacuugcucuugaugcc

SEQ ID NO: 3072315 - RNA, 16 nt, Human
guacuugcucuugaug

SEQ ID NO: 3072316 - RNA, 15 nt, Human
guacuugcucuugau

SEQ ID NO: 3072317 - RNA, 22 nt, Human
guacuugcucuugaugccuggc

SEQ ID NO: 3072318 - RNA, 20 nt, Human
guacuuguggacacagcucu

SEQ ID NO: 3072319 - RNA, 16 nt, Human
guacuuguggacacag

SEQ ID NO: 3072320 - RNA, 14 nt, Human
guacuugcucuuga

SEQ ID NO: 3072321 - RNA, 21 nt, Human
guacuucuccacccugcucuc

SEQ ID NO: 3072322 - RNA, 20 nt, Human
guacuucuccacccugcucu

SEQ ID NO: 3072323 - RNA, 19 nt, Human
guacuucuccacccugcuc

SEQ ID NO: 3072324 - RNA, 18 nt, Human
guacuucuccacccugcu

SEQ ID NO: 3072325 - RNA, 17 nt, Human
guacuucuccacccugc

SEQ ID NO: 3072326 - RNA, 16 nt, Human
guacuucuccacccug

SEQ ID NO: 3072327 - RNA, 18 nt, Human
guaaaaacaaagaaauua

SEQ ID NO: 3072328 - RNA, 20 nt, Human
guaaaaacaaagaaauuaug

SEQ ID NO: 3072329 - RNA, 23 nt, Human
guaaaaccacagcaguugaaaag

SEQ ID NO: 3072330 - RNA, 18 nt, Human
guaaaaccacagcaguug

SEQ ID NO: 3072331 - RNA, 16 nt, Human
guaaaaccacagcagu

SEQ ID NO: 3072332 - RNA, 15 nt, Human
guaaaaccacagcag

SEQ ID NO: 3072333 - RNA, 14 nt, Human
guaaaaccacagca

SEQ ID NO: 3072334 - RNA, 13 nt, Human
gguuuucuguucu

SEQ ID NO: 3072335 - RNA, 12 nt, Human
gguuuucuguuc

SEQ ID NO: 3072336 - RNA, 15 nt, Human
gguuuucuguucuuu

SEQ ID NO: 3072337 - RNA, 20 nt, Human
gguuuucacauuggaaacaa

SEQ ID NO: 3072338 - RNA, 23 nt, Human
gguuuugccauguuggccaggcu

SEQ ID NO: 3072339 - RNA, 14 nt, Human
gguugaagcaccaa

SEQ ID NO: 3072340 - RNA, 23 nt, Human
gguucaagcgauucuucugcuuc

SEQ ID NO: 3072341 - RNA, 22 nt, Human
gguucaagcgauucuucugcuu

SEQ ID NO: 3072342 - RNA, 20 nt, Human
gguucacugcaaccuccgcc

SEQ ID NO: 3072343 - RNA, 17 nt, Human
gguggccucccaacuca

SEQ ID NO: 3072344 - RNA, 21 nt, Human
gguucaagcgauucuucugcu

SEQ ID NO: 3072345 - RNA, 13 nt, Human
gguggccucccaa

SEQ ID NO: 3072346 - RNA, 14 nt, Human
gguugggcuggugu

SEQ ID NO: 3072347 - RNA, 13 nt, Human
gguuuaagcuguu

SEQ ID NO: 3072348 - RNA, 13 nt, Human
gguuggugggggc

SEQ ID NO: 3072349 - RNA, 15 nt, Human
guaaauaguauuuga

SEQ ID NO: 3072350 - RNA, 17 nt, Human
guaaauaguauuugaga

SEQ ID NO: 3072351 - RNA, 16 nt, Human
guaaauaguauuugag

SEQ ID NO: 3072352 - RNA, 20 nt, Human
guaaaugggggugcauuuga

SEQ ID NO: 3072353 - RNA, 19 nt, Human
guaaaugggggugcauuug

SEQ ID NO: 3072354 - RNA, 18 nt, Human
guaaaugggggugcauuu

SEQ ID NO: 3072355 - RNA, 22 nt, Human
guaaauuaacuuuuauaaacuu

SEQ ID NO: 3072356 - RNA, 21 nt, Human
guaaauuaacuuuuauaaacu

SEQ ID NO: 3072357 - RNA, 17 nt, Human
guaaauuaacuuuuaua

SEQ ID NO: 3072358 - RNA, 16 nt, Human
guaaauuaacuuuuau

SEQ ID NO: 3072359 - RNA, 15 nt, Human
guaaauuaacuuuua

SEQ ID NO: 3072360 - RNA, 22 nt, Human
guaaguauucuuauuuaaugaa

SEQ ID NO: 3072361 - RNA, 17 nt, Human
guaagggaaacugccag

SEQ ID NO: 3072362 - RNA, 18 nt, Human
guaagggaaacugccagc

SEQ ID NO: 3072363 - RNA, 20 nt, Human
guaaggaauaccuguccccc

SEQ ID NO: 3072364 - RNA, 21 nt, Human
guaaggaauaccugucccccu

SEQ ID NO: 3072365 - RNA, 23 nt, Human
guaaggaauaccugucccccuga

SEQ ID NO: 3072366 - RNA, 13 nt, Human
guaaggaaugauu

SEQ ID NO: 3072367 - RNA, 18 nt, Human
guaaggaauaccuguccc

SEQ ID NO: 3072368 - RNA, 23 nt, Human
guaaauuaacuuuuauaaacuuu

SEQ ID NO: 3072369 - RNA, 22 nt, Human
ggucccaccccacacacgccag

SEQ ID NO: 3072370 - RNA, 14 nt, Human
ggucccacucaguc

SEQ ID NO: 3072371 - RNA, 12 nt, Human
ggucccacucag

SEQ ID NO: 3072372 - RNA, 22 nt, Human
ggucccacucaguccauagcag

SEQ ID NO: 3072373 - RNA, 18 nt, Human
ggucccccuuccauggac

SEQ ID NO: 3072374 - RNA, 23 nt, Human
ggucccccuuccauggacuuugu

SEQ ID NO: 3072375 - RNA, 13 nt, Human
ggucccccuucca

SEQ ID NO: 3072376 - RNA, 16 nt, Human
ggucagagccugcagu

SEQ ID NO: 3072377 - RNA, 15 nt, Human
ggucagagccugcag

SEQ ID NO: 3072378 - RNA, 14 nt, Human
ggucagagccugca

SEQ ID NO: 3072379 - RNA, 13 nt, Human
ggucagagccugc

SEQ ID NO: 3072380 - RNA, 16 nt, Human
ggucacucuggcagcu

SEQ ID NO: 3072381 - RNA, 20 nt, Human
ggucacucuggcagcucaga

SEQ ID NO: 3072382 - RNA, 22 nt, Human
ggucacucuggcagcucagaga

SEQ ID NO: 3072383 - RNA, 12 nt, Human
ggucagagccug

SEQ ID NO: 3072384 - RNA, 12 nt, Human
ggucacucuggc

SEQ ID NO: 3072385 - RNA, 15 nt, Human
gguagacacacauga

SEQ ID NO: 3072386 - RNA, 22 nt, Human
gguagacacacaugaaguccaa

SEQ ID NO: 3072387 - RNA, 19 nt, Human
gggugcugggccccugccu

SEQ ID NO: 3072388 - RNA, 18 nt, Human
gggugcugggccccugcc

SEQ ID NO: 3072389 - RNA, 21 nt, Human
ggguagccacuggacugacga

SEQ ID NO: 3072390 - RNA, 19 nt, Human
ggguuggccccugcccggc

SEQ ID NO: 3072391 - RNA, 16 nt, Human
ggguuggccccugccc

SEQ ID NO: 3072392 - RNA, 17 nt, Human
ggguucuacccaggugc

SEQ ID NO: 3072393 - RNA, 22 nt, Human
ggguucuacccaggugcuagga

SEQ ID NO: 3072394 - RNA, 23 nt, Human
ggguucccuuuuuuggcugcuga

SEQ ID NO: 3072395 - RNA, 21 nt, Human
gguacuuguggacacagcucu

SEQ ID NO: 3072396 - RNA, 22 nt, Human
gguacuucaaauccuugaagau

SEQ ID NO: 3072397 - RNA, 22 nt, Human
gguacuuguggacacagcucuu

SEQ ID NO: 3072398 - RNA, 20 nt, Human
gguacuuguggacacagcuc

SEQ ID NO: 3072399 - RNA, 15 nt, Human
ggguugggcuggugu

SEQ ID NO: 3072400 - RNA, 16 nt, Human
gguacccacugcucug

SEQ ID NO: 3072401 - RNA, 17 nt, Human
gguacccacugcucugg

SEQ ID NO: 3072402 - RNA, 17 nt, Human
ggucccuaauaaagcug

SEQ ID NO: 3072403 - RNA, 16 nt, Human
ggucccuaauaaagcu

SEQ ID NO: 3072404 - RNA, 13 nt, Human
ggucccuaauaaa

SEQ ID NO: 3072405 - RNA, 12 nt, Human
ggucccuaauaa

SEQ ID NO: 3072406 - RNA, 18 nt, Human
ggucccuaauaaagcugu

SEQ ID NO: 3072407 - RNA, 14 nt, Human
ggucccugguggca

SEQ ID NO: 3072408 - RNA, 22 nt, Human
ggucccugguggcagcucaccu

SEQ ID NO: 3072409 - RNA, 22 nt, Human
ggucucacuauguugcccaggc

SEQ ID NO: 3072410 - RNA, 18 nt, Human
ggugaagugaagacaaug

SEQ ID NO: 3072411 - RNA, 16 nt, Human
ggugaacuugguuccc

SEQ ID NO: 3072412 - RNA, 19 nt, Human
ggucugaggaauccagacc

SEQ ID NO: 3072413 - RNA, 12 nt, Human
ggucucacucug

SEQ ID NO: 3072414 - RNA, 21 nt, Human
ggucucacuauguugcccagg

SEQ ID NO: 3072415 - RNA, 16 nt, Human
ggucugacccacugcu

SEQ ID NO: 3072416 - RNA, 15 nt, Human
ggucugacccacugc

SEQ ID NO: 3072417 - RNA, 14 nt, Human
ggugaccucugccu

SEQ ID NO: 3072418 - RNA, 16 nt, Human
ggugaccucugccuga

SEQ ID NO: 3072419 - RNA, 15 nt, Human
ggugcgaucuggguu

SEQ ID NO: 3072420 - RNA, 19 nt, Human
ggugcuacaaaaacacagc

SEQ ID NO: 3072421 - RNA, 23 nt, Human
ggugcuaucucccccagccccau

SEQ ID NO: 3072422 - RNA, 21 nt, Human
ggugcuaucucccccagcccc

SEQ ID NO: 3072423 - RNA, 22 nt, Human
ggugcuaucucccccagcccca

SEQ ID NO: 3072424 - RNA, 13 nt, Human
gguggcagcugcg

SEQ ID NO: 3072425 - RNA, 12 nt, Human
gguggcagcugc

SEQ ID NO: 3072426 - RNA, 13 nt, Human
gguggcagcucac

SEQ ID NO: 3072427 - RNA, 11 nt, Human
gguggcagcug

SEQ ID NO: 3072428 - RNA, 23 nt, Human
gguggcagcugcgguccacccag

SEQ ID NO: 3072429 - RNA, 15 nt, Human
gguggcagcugcggu

SEQ ID NO: 3072430 - RNA, 20 nt, Human
gggcuucauccuccucagau

SEQ ID NO: 3072431 - RNA, 20 nt, Human
gggcuuggggaccagagcug

SEQ ID NO: 3072432 - RNA, 19 nt, Human
gggcuucauccuccucaga

SEQ ID NO: 3072433 - RNA, 20 nt, Human
gggcuucaguggcagcugcu

SEQ ID NO: 3072434 - RNA, 19 nt, Human
gggcuucaguggcagcugc

SEQ ID NO: 3072435 - RNA, 18 nt, Human
gggcuucaguggcagcug

SEQ ID NO: 3072436 - RNA, 17 nt, Human
gggcuucaguggcagcu

SEQ ID NO: 3072437 - RNA, 16 nt, Human
gggcuucaguggcagc

SEQ ID NO: 3072438 - RNA, 15 nt, Human
gggcuucaguggcag

SEQ ID NO: 3072439 - RNA, 17 nt, Human
ggggaucacagccucug

SEQ ID NO: 3072440 - RNA, 13 nt, Human
ggggaguggccac

SEQ ID NO: 3072441 - RNA, 21 nt, Human
gggcuuggggaccagagcugc

SEQ ID NO: 3072442 - RNA, 11 nt, Human
ggggagaaagu

SEQ ID NO: 3072443 - RNA, 18 nt, Human
ggguacccacugcucugg

SEQ ID NO: 3072444 - RNA, 15 nt, Human
ggguacccacugcuc

SEQ ID NO: 3072445 - RNA, 13 nt, Human
ggguacccacugc

SEQ ID NO: 3072446 - RNA, 23 nt, Human
ggguagagcggagaaaggaaggg

SEQ ID NO: 3072447 - RNA, 23 nt, Human
ggguacuuguggacacagcucuu

SEQ ID NO: 3072448 - RNA, 22 nt, Human
ggguacuuguggacacagcucu

SEQ ID NO: 3072449 - RNA, 19 nt, Human
ggguacuuguggacacagc

SEQ ID NO: 3072450 - RNA, 23 nt, Human
gggguucccuuuuuuggcugcug

SEQ ID NO: 3072451 - RNA, 13 nt, Human
ggggcugggacau

SEQ ID NO: 3072452 - RNA, 16 nt, Human
ggggcugggcagagga

SEQ ID NO: 3072453 - RNA, 17 nt, Human
ggggcugggcagaggaa

SEQ ID NO: 3072454 - RNA, 14 nt, Human
ggggcugcucccac

SEQ ID NO: 3072455 - RNA, 23 nt, Human
ggggcugcaccggcuggccuggc

SEQ ID NO: 3072456 - RNA, 18 nt, Human
ggggcugcucccaccugg

SEQ ID NO: 3072457 - RNA, 16 nt, Human
gggcgcgguggcucac

SEQ ID NO: 3072458 - RNA, 13 nt, Human
gggcucccuuccc

SEQ ID NO: 3072459 - RNA, 14 nt, Human
gggcucccuuccca

SEQ ID NO: 3072460 - RNA, 17 nt, Human
gggcucccuucccaccu

SEQ ID NO: 3072461 - RNA, 18 nt, Human
gggcucccuucccaccuc

SEQ ID NO: 3072462 - RNA, 23 nt, Human
gggcucccuucccaccucucuca

SEQ ID NO: 3072463 - RNA, 18 nt, Human
gggccuggucguuuucaa

SEQ ID NO: 3072464 - RNA, 14 nt, Human
gggccuggcucagg

SEQ ID NO: 3072465 - RNA, 16 nt, Human
gggccuggcucaggug

SEQ ID NO: 3072466 - RNA, 12 nt, Human
gggccuggcuca

SEQ ID NO: 3072467 - RNA, 19 nt, Human
gggccuggccugagcuggg

SEQ ID NO: 3072468 - RNA, 12 nt, Human
gggccuggaugc

SEQ ID NO: 3072469 - RNA, 18 nt, Human
ggcucccagccaggcccu

SEQ ID NO: 3072470 - RNA, 16 nt, Human
ggcucccagccaggcc

SEQ ID NO: 3072471 - RNA, 17 nt, Human
ggcucccagccaggccc

SEQ ID NO: 3072472 - RNA, 14 nt, Human
ggcucccagccagg

SEQ ID NO: 3072473 - RNA, 15 nt, Human
ggcucccagccaggc

SEQ ID NO: 3072474 - RNA, 15 nt, Human
gggcucugccuccca

SEQ ID NO: 3072475 - RNA, 16 nt, Human
gggcucugccucccau

SEQ ID NO: 3072476 - RNA, 17 nt, Human
gggcucugccucccauc

SEQ ID NO: 3072477 - RNA, 20 nt, Human
gggcucugccucccaucacc

SEQ ID NO: 3072478 - RNA, 13 nt, Human
gggcucugccucc

SEQ ID NO: 3072479 - RNA, 16 nt, Human
gggcugaggugggagg

SEQ ID NO: 3072480 - RNA, 14 nt, Human
gggcugcaccggcu

SEQ ID NO: 3072481 - RNA, 14 nt, Human
gggcuucaguggca

SEQ ID NO: 3072482 - RNA, 17 nt, Human
gcucuugaugccuggcg

SEQ ID NO: 3072483 - RNA, 20 nt, Human
gcugacagacacaggcccgg

SEQ ID NO: 3072484 - RNA, 21 nt, Human
gcugacagacacaggcccggc

SEQ ID NO: 3072485 - RNA, 16 nt, Human
gcucuugaugccuggc

SEQ ID NO: 3072486 - RNA, 15 nt, Human
gcucuugaugccugg

SEQ ID NO: 3072487 - RNA, 14 nt, Human
gcucuugaugccug

SEQ ID NO: 3072488 - RNA, 16 nt, Human
gcucuucuccaggcug

SEQ ID NO: 3072489 - RNA, 14 nt, Human
gcucuucuccaggc

SEQ ID NO: 3072490 - RNA, 19 nt, Human
gcucuuccaggcugggaga

SEQ ID NO: 3072491 - RNA, 18 nt, Human
gcucuuccaggcugggag

SEQ ID NO: 3072492 - RNA, 12 nt, Human
gcucuucuccag

SEQ ID NO: 3072493 - RNA, 22 nt, Human
gcucuuccaggcugggagagcc

SEQ ID NO: 3072494 - RNA, 19 nt, Human
gcugagucugaaggcuggg

SEQ ID NO: 3072495 - RNA, 16 nt, Human
gcugagucugaaggcu

SEQ ID NO: 3072496 - RNA, 18 nt, Human
gcugagucugaaggcugg

SEQ ID NO: 3072497 - RNA, 15 nt, Human
gcugagucugaaggc

SEQ ID NO: 3072498 - RNA, 15 nt, Human
gcugauggugcaaug

SEQ ID NO: 3072499 - RNA, 16 nt, Human
gcugauggugcaauga

SEQ ID NO: 3072500 - RNA, 22 nt, Human
gcugagugggggaucacagccu

SEQ ID NO: 3072501 - RNA, 23 nt, Human
gcugagugggggaucacagccuc

SEQ ID NO: 3072502 - RNA, 18 nt, Human
gcugauggugcaaugacc

SEQ ID NO: 3072503 - RNA, 21 nt, Human
gcugauggugcaaugaccuuu

SEQ ID NO: 3072504 - RNA, 18 nt, Human
gcugcaguugccagucac

SEQ ID NO: 3072505 - RNA, 20 nt, Human
gcugcaguugccagucaccc

SEQ ID NO: 3072506 - RNA, 21 nt, Human
gcugcaguugccagucacccc

SEQ ID NO: 3072507 - RNA, 17 nt, Human
gcugcaguugccaguca

SEQ ID NO: 3072508 - RNA, 17 nt, Human
gcucuccgaccagacac

SEQ ID NO: 3072509 - RNA, 13 nt, Human
gcucuccgaccag

SEQ ID NO: 3072510 - RNA, 19 nt, Human
gcucuccgaccagacaccu

SEQ ID NO: 3072511 - RNA, 12 nt, Human
gcucucuggccu

SEQ ID NO: 3072512 - RNA, 13 nt, Human
gcucucuggccuu

SEQ ID NO: 3072513 - RNA, 11 nt, Human
gcucucuggcc

SEQ ID NO: 3072514 - RNA, 21 nt, Human
gcuccuucuguccuacucugu

SEQ ID NO: 3072515 - RNA, 15 nt, Human
gcuccuucuguccua

SEQ ID NO: 3072516 - RNA, 16 nt, Human
gcucccuucccaccuc

SEQ ID NO: 3072517 - RNA, 18 nt, Human
gcucccuucccaccucuc

SEQ ID NO: 3072518 - RNA, 15 nt, Human
gcucccuucccaccu

SEQ ID NO: 3072519 - RNA, 16 nt, Human
gcucgagcaugccugg

SEQ ID NO: 3072520 - RNA, 23 nt, Human
gcucugcccuugguuaggcauug

SEQ ID NO: 3072521 - RNA, 11 nt, Human
gcucugccucc

SEQ ID NO: 3072522 - RNA, 13 nt, Human
gcucugcccuugg

SEQ ID NO: 3072523 - RNA, 14 nt, Human
gcucugcccuuggu

SEQ ID NO: 3072524 - RNA, 14 nt, Human
gcucucuggccuuc

SEQ ID NO: 3072525 - RNA, 15 nt, Human
gcucucuggccuucg

SEQ ID NO: 3072526 - RNA, 19 nt, Human
gcucucuggccuucggccu

SEQ ID NO: 3072527 - RNA, 20 nt, Human
gcucucuggccuucggccuc

SEQ ID NO: 3072528 - RNA, 13 nt, Human
gcucugccuccca

SEQ ID NO: 3072529 - RNA, 14 nt, Human
gcucugccucccau

SEQ ID NO: 3072530 - RNA, 15 nt, Human
gcucugccucccauc

SEQ ID NO: 3072531 - RNA, 22 nt, Human
gcucugccucccaucacccgcu

SEQ ID NO: 3072532 - RNA, 14 nt, Human
gcucugcuccucuc

SEQ ID NO: 3072533 - RNA, 13 nt, Human
gcucugcuccucu

SEQ ID NO: 3072534 - RNA, 23 nt, Human
gcucugcugacagacacaggccc

SEQ ID NO: 3072535 - RNA, 20 nt, Human
gcucugcugacagacacagg

SEQ ID NO: 3072536 - RNA, 19 nt, Human
gcucugcugacagacacag

SEQ ID NO: 3072537 - RNA, 18 nt, Human
gcucugcugacagacaca

SEQ ID NO: 3072538 - RNA, 14 nt, Human
gcucugcugacaga

SEQ ID NO: 3072539 - RNA, 13 nt, Human
gcucugcugacag

SEQ ID NO: 3072540 - RNA, 21 nt, Human
gcucugcuccucuccccagca

SEQ ID NO: 3072541 - RNA, 19 nt, Human
gcucugcuccucuccccag

SEQ ID NO: 3072542 - RNA, 22 nt, Human
gcucuggacaggcauguucucu

SEQ ID NO: 3072543 - RNA, 21 nt, Human
gcucuggacaggcauguucuc

SEQ ID NO: 3072544 - RNA, 16 nt, Human
gcucuggacaggcaug

SEQ ID NO: 3072545 - RNA, 15 nt, Human
gcucuggacaggcau

SEQ ID NO: 3072546 - RNA, 14 nt, Human
gcucuggacaggca

SEQ ID NO: 3072547 - RNA, 23 nt, Human
gccugugagcuaggaauuguguu

SEQ ID NO: 3072548 - RNA, 16 nt, Human
gcgguccacccaggag

SEQ ID NO: 3072549 - RNA, 13 nt, Human
gcggggacagcuc

SEQ ID NO: 3072550 - RNA, 15 nt, Human
gcgggcuuccuccug

SEQ ID NO: 3072551 - RNA, 12 nt, Human
gcggggacagcu

SEQ ID NO: 3072552 - RNA, 19 nt, Human
gcgguccacccaggagccc

SEQ ID NO: 3072553 - RNA, 18 nt, Human
gcgguccacccaggagcc

SEQ ID NO: 3072554 - RNA, 23 nt, Human
gcgugagccacugcaccgggcca

SEQ ID NO: 3072555 - RNA, 18 nt, Human
gcgugagccacugcaccg

SEQ ID NO: 3072556 - RNA, 16 nt, Human
gcgugagccacugcac

SEQ ID NO: 3072557 - RNA, 21 nt, Human
gcuaagagggagggagggcuc

SEQ ID NO: 3072558 - RNA, 22 nt, Human
gcuaagagggagggagggcucc

SEQ ID NO: 3072559 - RNA, 13 nt, Human
gcuaaaugugaau

SEQ ID NO: 3072560 - RNA, 16 nt, Human
gcuaaaugugaaugau

SEQ ID NO: 3072561 - RNA, 23 nt, Human
gcuaagagggagggagggcucca

SEQ ID NO: 3072562 - RNA, 17 nt, Human
gcuaagcaaaaugugau

SEQ ID NO: 3072563 - RNA, 14 nt, Human
gcuaagcauuccaa

SEQ ID NO: 3072564 - RNA, 14 nt, Human
gcuacccgggaagg

SEQ ID NO: 3072565 - RNA, 15 nt, Human
gcuacccgggaaggg

SEQ ID NO: 3072566 - RNA, 18 nt, Human
gcuagagguucaaagaua

SEQ ID NO: 3072567 - RNA, 21 nt, Human
gcuagagguucaaagauauuu

SEQ ID NO: 3072568 - RNA, 19 nt, Human
gcuagagguucaaagauau

SEQ ID NO: 3072569 - RNA, 21 nt, Human
gcuacccgggaagggggcugg

SEQ ID NO: 3072570 - RNA, 20 nt, Human
gcuaccuuuguauucucucc

SEQ ID NO: 3072571 - RNA, 16 nt, Human
gcuaucucccccagcc

SEQ ID NO: 3072572 - RNA, 17 nt, Human
gcuaucucccccagccc

SEQ ID NO: 3072573 - RNA, 18 nt, Human
gcuaucucccccagcccc

SEQ ID NO: 3072574 - RNA, 22 nt, Human
gcuagcagcagggagggcuucu

SEQ ID NO: 3072575 - RNA, 19 nt, Human
gcuaucucccccagcccca

SEQ ID NO: 3072576 - RNA, 20 nt, Human
gcuaucucccccagccccau

SEQ ID NO: 3072577 - RNA, 21 nt, Human
gcuaucucccccagccccauc

SEQ ID NO: 3072578 - RNA, 22 nt, Human
gcuaucucccccagccccaucc

SEQ ID NO: 3072579 - RNA, 23 nt, Human
gcuaucucccccagccccauccu

SEQ ID NO: 3072580 - RNA, 15 nt, Human
gcuaucucccccagc

SEQ ID NO: 3072581 - RNA, 13 nt, Human
gcuccaaacccuc

SEQ ID NO: 3072582 - RNA, 16 nt, Human
gcuccaaacccucgag

SEQ ID NO: 3072583 - RNA, 18 nt, Human
gcuccaaacccucgaggc

SEQ ID NO: 3072584 - RNA, 17 nt, Human
gcuccaaacccucgagg

SEQ ID NO: 3072585 - RNA, 19 nt, Human
gcucaggugucccugcacu

SEQ ID NO: 3072586 - RNA, 15 nt, Human
gcucagcggggacag

SEQ ID NO: 3072587 - RNA, 19 nt, Human
gcucagcggggacagcucc

SEQ ID NO: 3072588 - RNA, 20 nt, Human
gcucagcggggacagcuccu

SEQ ID NO: 3072589 - RNA, 17 nt, Human
gcucaggugucccugca

SEQ ID NO: 3072590 - RNA, 18 nt, Human
gcucaggugucccugcac

SEQ ID NO: 3072591 - RNA, 22 nt, Human
gcucagcggggacagcuccuuc

SEQ ID NO: 3072592 - RNA, 21 nt, Human
gcucagcggggacagcuccuu

SEQ ID NO: 3072593 - RNA, 18 nt, Human
gcucaccagccccagugc

SEQ ID NO: 3072594 - RNA, 19 nt, Human
gcucaccagccccagugcc

SEQ ID NO: 3072595 - RNA, 23 nt, Human
gcucaccagccccagugcccaca

SEQ ID NO: 3072596 - RNA, 20 nt, Human
gcucaccagccccagugccc

SEQ ID NO: 3072597 - RNA, 15 nt, Human
gcucacccaguccug

SEQ ID NO: 3072598 - RNA, 17 nt, Human
gcucagcaaaagaugcu

SEQ ID NO: 3072599 - RNA, 20 nt, Human
gcucagcaaaagaugcuucu

SEQ ID NO: 3072600 - RNA, 22 nt, Human
gcucagcaaaagaugcuucuca

SEQ ID NO: 3072601 - RNA, 23 nt, Human
gcucagcaaaagaugcuucucac

SEQ ID NO: 3072602 - RNA, 23 nt, Human
gcuccaggcuccuuuagcgccca

SEQ ID NO: 3072603 - RNA, 16 nt, Human
gcuccaggcuccuuua

SEQ ID NO: 3072604 - RNA, 11 nt, Human
gcuccagcugu

SEQ ID NO: 3072605 - RNA, 13 nt, Human
gcuccaggcuccu

SEQ ID NO: 3072606 - RNA, 16 nt, Human
gcuccaagcucccagg

SEQ ID NO: 3072607 - RNA, 17 nt, Human
gcuccaagcucccaggc

SEQ ID NO: 3072608 - RNA, 18 nt, Human
gcuccaagcucccaggca

SEQ ID NO: 3072609 - RNA, 19 nt, Human
gcuccaagcucccaggcau

SEQ ID NO: 3072610 - RNA, 21 nt, Human
gcuccaagcucccaggcauuc

SEQ ID NO: 3072611 - RNA, 14 nt, Human
gcuccaagcuccca

SEQ ID NO: 3072612 - RNA, 15 nt, Human
gcuccaagcucccag

SEQ ID NO: 3072613 - RNA, 13 nt, Human
gcuccaagcuccc

SEQ ID NO: 3072614 - RNA, 14 nt, Human
gcuccaagaauuuc

SEQ ID NO: 3072615 - RNA, 19 nt, Human
gcuccaaacccucgaggcg

SEQ ID NO: 3072616 - RNA, 19 nt, Human
gccucucugcaggucccua

SEQ ID NO: 3072617 - RNA, 22 nt, Human
gccucucccugcugcuccuagg

SEQ ID NO: 3072618 - RNA, 18 nt, Human
gccucucccugcugcucc

SEQ ID NO: 3072619 - RNA, 19 nt, Human
gccucucccugcugcuccu

SEQ ID NO: 3072620 - RNA, 20 nt, Human
gccucucccugcugcuccua

SEQ ID NO: 3072621 - RNA, 21 nt, Human
gccucucccugcugcuccuag

SEQ ID NO: 3072622 - RNA, 17 nt, Human
gccucucccugcugcuc

SEQ ID NO: 3072623 - RNA, 15 nt, Human
gccucccgaguagcu

SEQ ID NO: 3072624 - RNA, 23 nt, Human
gccucccgaauagcugggacuac

SEQ ID NO: 3072625 - RNA, 21 nt, Human
gccucccacgacugcccggca

SEQ ID NO: 3072626 - RNA, 14 nt, Human
gccucccacgacug

SEQ ID NO: 3072627 - RNA, 21 nt, Human
gccucccgaauagcugggacu

SEQ ID NO: 3072628 - RNA, 22 nt, Human
gccucccaacucaccccagccc

SEQ ID NO: 3072629 - RNA, 23 nt, Human
gccucccaacucaccccagcccc

SEQ ID NO: 3072630 - RNA, 21 nt, Human
gccucccaacucaccccagcc

SEQ ID NO: 3072631 - RNA, 15 nt, Human
gccucagugccacua

SEQ ID NO: 3072632 - RNA, 21 nt, Human
gccucacaguccuuaccagca

SEQ ID NO: 3072633 - RNA, 23 nt, Human
gccucagccucccaaagugcugg

SEQ ID NO: 3072634 - RNA, 14 nt, Human
gccucagugccacu

SEQ ID NO: 3072635 - RNA, 12 nt, Human
gccucagugcca

SEQ ID NO: 3072636 - RNA, 21 nt, Human
gccucaagugauucuccugcc

SEQ ID NO: 3072637 - RNA, 20 nt, Human
gccucaagugauucuccugc

SEQ ID NO: 3072638 - RNA, 19 nt, Human
gccucaagugauucuccug

SEQ ID NO: 3072639 - RNA, 16 nt, Human
gccucaaccuccuggg

SEQ ID NO: 3072640 - RNA, 14 nt, Human
gccucaaccuccug

SEQ ID NO: 3072641 - RNA, 19 nt, Human
gccgagauagccaaggcca

SEQ ID NO: 3072642 - RNA, 17 nt, Human
gccuaagugcagccccg

SEQ ID NO: 3072643 - RNA, 22 nt, Human
gccuauauuuuuuguuaaauga

SEQ ID NO: 3072644 - RNA, 22 nt, Human
gccuggccagaugcaccagccc

SEQ ID NO: 3072645 - RNA, 15 nt, Human
gccuggccagaugca

SEQ ID NO: 3072646 - RNA, 14 nt, Human
gccuggccagaugc

SEQ ID NO: 3072647 - RNA, 15 nt, Human
gccugggcagaagga

SEQ ID NO: 3072648 - RNA, 15 nt, Human
gccuggauggggcug

SEQ ID NO: 3072649 - RNA, 14 nt, Human
gccuggauggggcu

SEQ ID NO: 3072650 - RNA, 16 nt, Human
gccugggcagaaggaa

SEQ ID NO: 3072651 - RNA, 17 nt, Human
gccugggcagaaggaag

SEQ ID NO: 3072652 - RNA, 20 nt, Human
gccugggggcugggcagagg

SEQ ID NO: 3072653 - RNA, 21 nt, Human
gccucucugcaggucccuaau

SEQ ID NO: 3072654 - RNA, 20 nt, Human
gccucucugcaggucccuaa

SEQ ID NO: 3072655 - RNA, 18 nt, Human
gccucucugcaggucccu

SEQ ID NO: 3072656 - RNA, 18 nt, Human
gccucugccucugacaca

SEQ ID NO: 3072657 - RNA, 22 nt, Human
gccugaagucacacagugaguc

SEQ ID NO: 3072658 - RNA, 19 nt, Human
gccucugcggagcacacug

SEQ ID NO: 3072659 - RNA, 21 nt, Human
gccucugcggagcacacuggc

SEQ ID NO: 3072660 - RNA, 24 nt, Human
gccucugcggagcacacuggcuca

SEQ ID NO: 3072661 - RNA, 22 nt, Human
gccugcuuuuuauggccuguga

SEQ ID NO: 3072662 - RNA, 19 nt, Human
gccugcuuuuuauggccug

SEQ ID NO: 3072663 - RNA, 18 nt, Human
gccugcuuuuuauggccu

SEQ ID NO: 3072664 - RNA, 16 nt, Human
gccugcuccagcuguu

SEQ ID NO: 3072665 - RNA, 18 nt, Human
gccugcuccagcuguuca

SEQ ID NO: 3072666 - RNA, 15 nt, Human
gccugcuccagcugu

SEQ ID NO: 3072667 - RNA, 22 nt, Human
gcccuggacugugugcucagga

SEQ ID NO: 3072668 - RNA, 16 nt, Human
gcccuggacugugugc

SEQ ID NO: 3072669 - RNA, 12 nt, Human
gcccuggacugu

SEQ ID NO: 3072670 - RNA, 12 nt, Human
gcccucugccca

SEQ ID NO: 3072671 - RNA, 16 nt, Human
gcccugagcuuucugc

SEQ ID NO: 3072672 - RNA, 14 nt, Human
gcccugagcuuucu

SEQ ID NO: 3072673 - RNA, 18 nt, Human
gcccggcuccaggcuccu

SEQ ID NO: 3072674 - RNA, 17 nt, Human
gcccggcuccaggcucc

SEQ ID NO: 3072675 - RNA, 15 nt, Human
gcagacucuacagag

SEQ ID NO: 3072676 - RNA, 21 nt, Human
gccccuguucuggcagaguug

SEQ ID NO: 3072677 - RNA, 17 nt, Human
gccccuguucuggcaga

SEQ ID NO: 3072678 - RNA, 15 nt, Human
gccccugccacccug

SEQ ID NO: 3072679 - RNA, 14 nt, Human
gccccugccacccu

SEQ ID NO: 3072680 - RNA, 13 nt, Human
gccccugccaccc

SEQ ID NO: 3072681 - RNA, 16 nt, Human
gcccggcuccaggcuc

SEQ ID NO: 3072682 - RNA, 15 nt, Human
gcccggcuccaggcu

SEQ ID NO: 3072683 - RNA, 21 nt, Human
gcccugggaggcucuggagcc

SEQ ID NO: 3072684 - RNA, 19 nt, Human
gcccugggaggcucuggag

SEQ ID NO: 3072685 - RNA, 18 nt, Human
gcccugggaggcucugga

SEQ ID NO: 3072686 - RNA, 17 nt, Human
gcccugggaggcucugg

SEQ ID NO: 3072687 - RNA, 23 nt, Human
gcccugggaggcucuggagccca

SEQ ID NO: 3072688 - RNA, 16 nt, Human
gcccugggaggcucug

SEQ ID NO: 3072689 - RNA, 15 nt, Human
gcccugggaggcucu

SEQ ID NO: 3072690 - RNA, 14 nt, Human
gcccugggaggcuc

SEQ ID NO: 3072691 - RNA, 13 nt, Human
gcccugggaggcu

SEQ ID NO: 3072692 - RNA, 23 nt, Human
gcccugguggcagugggagcugc

SEQ ID NO: 3072693 - RNA, 22 nt, Human
gcccugguggcagugggagcug

SEQ ID NO: 3072694 - RNA, 21 nt, Human
gcccugguggcagugggagcu

SEQ ID NO: 3072695 - RNA, 20 nt, Human
gcccugguggcagugggagc

SEQ ID NO: 3072696 - RNA, 19 nt, Human
gcccugguggcagugggag

SEQ ID NO: 3072697 - RNA, 18 nt, Human
gcccugguggcaguggga

SEQ ID NO: 3072698 - RNA, 17 nt, Human
gcccugguggcaguggg

SEQ ID NO: 3072699 - RNA, 14 nt, Human
gcccugguggcagu

SEQ ID NO: 3072700 - RNA, 19 nt, Human
gcccuucucuccagccccu

SEQ ID NO: 3072701 - RNA, 21 nt, Human
gcccuucucuccagccccugg

SEQ ID NO: 3072702 - RNA, 22 nt, Human
gcccuucucuccagccccugga

SEQ ID NO: 3072703 - RNA, 18 nt, Human
gccgagauugcaccacug

SEQ ID NO: 3072704 - RNA, 17 nt, Human
gccgagauugcaccacu

SEQ ID NO: 3072705 - RNA, 19 nt, Human
gccgagaucacgccacugc

SEQ ID NO: 3072706 - RNA, 18 nt, Human
gccgagaucacgccacug

SEQ ID NO: 3072707 - RNA, 16 nt, Human
gccgagaucacgccac

SEQ ID NO: 3072708 - RNA, 11 nt, Human
ggccugugagc

SEQ ID NO: 3072709 - RNA, 14 nt, Human
ggccugggggcugg

SEQ ID NO: 3072710 - RNA, 20 nt, Human
ggccugggggcugggcagag

SEQ ID NO: 3072711 - RNA, 22 nt, Human
ggccugggggcugggcagagga

SEQ ID NO: 3072712 - RNA, 19 nt, Human
ggccuggccugagcuggga

SEQ ID NO: 3072713 - RNA, 18 nt, Human
ggcgcugccccuggcagc

SEQ ID NO: 3072714 - RNA, 19 nt, Human
ggcgcugccccuggcagcc

SEQ ID NO: 3072715 - RNA, 21 nt, Human
ggcgcugccccuggcagcccc

SEQ ID NO: 3072716 - RNA, 23 nt, Human
ggcgcugccccuggcagccccug

SEQ ID NO: 3072717 - RNA, 15 nt, Human
ggcuccaggcuccuu

SEQ ID NO: 3072718 - RNA, 11 nt, Human
ggcuccaggcu

SEQ ID NO: 3072719 - RNA, 18 nt, Human
ggcuccaggagcagccac

SEQ ID NO: 3072720 - RNA, 16 nt, Human
ggcuccaggcuccuuu

SEQ ID NO: 3072721 - RNA, 19 nt, Human
ggcuccaggagcagccaca

SEQ ID NO: 3072722 - RNA, 12 nt, Human
ggcuccaggagc

SEQ ID NO: 3072723 - RNA, 21 nt, Human
ggcucaaguccucuuuucuga

SEQ ID NO: 3072724 - RNA, 15 nt, Human
ggcucaaguccucuu

SEQ ID NO: 3072725 - RNA, 15 nt, Human
ggcuaugcauuugaa

SEQ ID NO: 3072726 - RNA, 23 nt, Human
ggcuagugugguguuuccuggca

SEQ ID NO: 3072727 - RNA, 15 nt, Human
ggcuaguugggcuuc

SEQ ID NO: 3072728 - RNA, 16 nt, Human
ggcuaguugggcuucc

SEQ ID NO: 3072729 - RNA, 14 nt, Human
ggcuaugcauuuga

SEQ ID NO: 3072730 - RNA, 22 nt, Human
ggcuaggaccccuccauguggg

SEQ ID NO: 3072731 - RNA, 16 nt, Human
ggcuaggaccccucca

SEQ ID NO: 3072732 - RNA, 16 nt, Human
ggcuagagguucaaag

SEQ ID NO: 3072733 - RNA, 17 nt, Human
ggcuagagguucaaaga

SEQ ID NO: 3072734 - RNA, 22 nt, Human
ggcuagagguucaaagauauuu

SEQ ID NO: 3072735 - RNA, 23 nt, Human
ggccuagcauacguacacauuuu

SEQ ID NO: 3072736 - RNA, 13 nt, Human
ggccucugcacuc

SEQ ID NO: 3072737 - RNA, 14 nt, Human
ggccucugcacucc

SEQ ID NO: 3072738 - RNA, 15 nt, Human
ggccucugcacuccc

SEQ ID NO: 3072739 - RNA, 20 nt, Human
ggccucugcggagcacacug

SEQ ID NO: 3072740 - RNA, 18 nt, Human
ggccucuuaugggcuggg

SEQ ID NO: 3072741 - RNA, 17 nt, Human
ggccucuuaugggcugg

SEQ ID NO: 3072742 - RNA, 13 nt, Human
ggcccugccuccu

SEQ ID NO: 3072743 - RNA, 14 nt, Human
ggcccugccuccuu

SEQ ID NO: 3072744 - RNA, 15 nt, Human
ggcccugccuccuuu

SEQ ID NO: 3072745 - RNA, 21 nt, Human
ggcccucugcccacucccugc

SEQ ID NO: 3072746 - RNA, 19 nt, Human
ggcccucugcccacucccu

SEQ ID NO: 3072747 - RNA, 20 nt, Human
ggcccucugcccacucccug

SEQ ID NO: 3072748 - RNA, 13 nt, Human
ggcccucugccca

SEQ ID NO: 3072749 - RNA, 15 nt, Human
ggcccucugcccacu

SEQ ID NO: 3072750 - RNA, 16 nt, Human
ggcccucugcccacuc

SEQ ID NO: 3072751 - RNA, 17 nt, Human
ggcccucugcccacucc

SEQ ID NO: 3072752 - RNA, 11 nt, Human
ggcccagagag

SEQ ID NO: 3072753 - RNA, 19 nt, Human
ggaugcagccucacagucc

SEQ ID NO: 3072754 - RNA, 19 nt, Human
ggauuacaagcgugagcca

SEQ ID NO: 3072755 - RNA, 15 nt, Human
ggaugcuuguacaua

SEQ ID NO: 3072756 - RNA, 17 nt, Human
ggaugcugcugccccug

SEQ ID NO: 3072757 - RNA, 12 nt, Human
ggauccuccagg

SEQ ID NO: 3072758 - RNA, 13 nt, Human
ggauccuccaggu

SEQ ID NO: 3072759 - RNA, 23 nt, Human
ggaugcacagaguuguuacauuu

SEQ ID NO: 3072760 - RNA, 21 nt, Human
ggaugauuggaggggggaggu

SEQ ID NO: 3072761 - RNA, 16 nt, Human
ggaugcagccucacag

SEQ ID NO: 3072762 - RNA, 17 nt, Human
ggaugcagccucacagu

SEQ ID NO: 3072763 - RNA, 22 nt, Human
ggaucccucauccucauaccca

SEQ ID NO: 3072764 - RNA, 13 nt, Human
ggaucccucaucc

SEQ ID NO: 3072765 - RNA, 17 nt, Human
ggaucccucauccucau

SEQ ID NO: 3072766 - RNA, 23 nt, Human
ggagugaguugauagcacagacc

SEQ ID NO: 3072767 - RNA, 21 nt, Human
ggagaugccaugagccgccca

SEQ ID NO: 3072768 - RNA, 12 nt, Human
ggagugcaguga

SEQ ID NO: 3072769 - RNA, 14 nt, Human
ggagugcagugagc

SEQ ID NO: 3072770 - RNA, 18 nt, Human
ggauacaaaagcauguga

SEQ ID NO: 3072771 - RNA, 17 nt, Human
ggauugcuacuguccua

SEQ ID NO: 3072772 - RNA, 17 nt, Human
ggcaacccccagccugc

SEQ ID NO: 3072773 - RNA, 16 nt, Human
ggcaacccccagccug

SEQ ID NO: 3072774 - RNA, 15 nt, Human
ggauuguaaaauggu

SEQ ID NO: 3072775 - RNA, 23 nt, Human
ggauuacaagcgugagccacugc

SEQ ID NO: 3072776 - RNA, 16 nt, Human
ggauucuuauggacaa

SEQ ID NO: 3072777 - RNA, 19 nt, Human
ggcaaucauggugcucaga

SEQ ID NO: 3072778 - RNA, 18 nt, Human
ggcaacccccagccugcu

SEQ ID NO: 3072779 - RNA, 23 nt, Human
ggcaaugcuggcuguuggcuggg

SEQ ID NO: 3072780 - RNA, 15 nt, Human
ggcaaugcuggcugu

SEQ ID NO: 3072781 - RNA, 14 nt, Human
ggcaaugcuggcug

SEQ ID NO: 3072782 - RNA, 22 nt, Human
ggcacccggccccugcugguuc

SEQ ID NO: 3072783 - RNA, 23 nt, Human
ggcacccaccaucaugucuggcu

SEQ ID NO: 3072784 - RNA, 20 nt, Human
ggcacccaccaucaugucug

SEQ ID NO: 3072785 - RNA, 13 nt, Human
ggcagcucagaga

SEQ ID NO: 3072786 - RNA, 21 nt, Human
ggcagcucagagaggguggga

SEQ ID NO: 3072787 - RNA, 17 nt, Human
ggcagcuugaggguugg

SEQ ID NO: 3072788 - RNA, 22 nt, Human
ggcagcugcuuuugucuauggg

SEQ ID NO: 3072789 - RNA, 12 nt, Human
ggcagcucaccu

SEQ ID NO: 3072790 - RNA, 14 nt, Human
ggcagcucaccucu

SEQ ID NO: 3072791 - RNA, 16 nt, Human
ggcagugggagcugcc

SEQ ID NO: 3072792 - RNA, 14 nt, Human
ggcagugggagcug

SEQ ID NO: 3072793 - RNA, 13 nt, Human
ggcagugggagcu

SEQ ID NO: 3072794 - RNA, 20 nt, Human
ggcagggucucacucugucg

SEQ ID NO: 3072795 - RNA, 19 nt, Human
ggcagggucucacucuguc

SEQ ID NO: 3072796 - RNA, 18 nt, Human
ggcaugacacgaauauug

SEQ ID NO: 3072797 - RNA, 15 nt, Human
ggcaugaagacagau

SEQ ID NO: 3072798 - RNA, 16 nt, Human
ggccaugggccuccug

SEQ ID NO: 3072799 - RNA, 23 nt, Human
ggccagcugcuugggcuucaucc

SEQ ID NO: 3072800 - RNA, 18 nt, Human
ggccaggcccucugccca

SEQ ID NO: 3072801 - RNA, 22 nt, Human
ggccagccuugaccauucucca

SEQ ID NO: 3072802 - RNA, 17 nt, Human
ggccagcugcuugggcu

SEQ ID NO: 3072803 - RNA, 20 nt, Human
ggccagccuugaccauucuc

SEQ ID NO: 3072804 - RNA, 22 nt, Human
ggcaugggaaugaaugucagug

SEQ ID NO: 3072805 - RNA, 17 nt, Human
ggcauuccccaggaggc

SEQ ID NO: 3072806 - RNA, 18 nt, Human
ggcaugggaaugaauguc

SEQ ID NO: 3072807 - RNA, 14 nt, Human
ggcauggcugggaa

SEQ ID NO: 3072808 - RNA, 18 nt, Human
ggcauuccccaggaggcc

SEQ ID NO: 3072809 - RNA, 19 nt, Human
ggcauuccccaggaggcca

SEQ ID NO: 3072810 - RNA, 16 nt, Human
ggcauuccccaggagg

SEQ ID NO: 3072811 - RNA, 16 nt, Human
ggccaccgccuugccc

SEQ ID NO: 3072812 - RNA, 17 nt, Human
ggagaagcggcuggcag

SEQ ID NO: 3072813 - RNA, 18 nt, Human
ggagaagcggcuggcagc

SEQ ID NO: 3072814 - RNA, 15 nt, Human
ggagaaucacuugaa

SEQ ID NO: 3072815 - RNA, 19 nt, Human
ggagaaucacuugaacccg

SEQ ID NO: 3072816 - RNA, 13 nt, Human
ggacgcucucugg

SEQ ID NO: 3072817 - RNA, 14 nt, Human
ggacgcucucuggc

SEQ ID NO: 3072818 - RNA, 20 nt, Human
ggacauugcggacagccacg

SEQ ID NO: 3072819 - RNA, 14 nt, Human
ggacauggacaagg

SEQ ID NO: 3072820 - RNA, 21 nt, Human
ggacagccacggccaggccag

SEQ ID NO: 3072821 - RNA, 20 nt, Human
ggacagccacggccaggcca

SEQ ID NO: 3072822 - RNA, 19 nt, Human
ggacagccacggccaggcc

SEQ ID NO: 3072823 - RNA, 15 nt, Human
ggacagccacggcca

SEQ ID NO: 3072824 - RNA, 17 nt, Human
ggacacucaaaagcugg

SEQ ID NO: 3072825 - RNA, 19 nt, Human
ggacgcuacccgggaaggg

SEQ ID NO: 3072826 - RNA, 20 nt, Human
ggacgcuacccgggaagggg

SEQ ID NO: 3072827 - RNA, 17 nt, Human
ggacgcuacccgggaag

SEQ ID NO: 3072828 - RNA, 17 nt, Human
ggaccuugaacugggua

SEQ ID NO: 3072829 - RNA, 15 nt, Human
ggaccuugaacuggg

SEQ ID NO: 3072830 - RNA, 19 nt, Human
ggaccucaggugagaagca

SEQ ID NO: 3072831 - RNA, 20 nt, Human
ggaccucaggccugggggcu

SEQ ID NO: 3072832 - RNA, 23 nt, Human
ggaccucaggugagaagcagagg

SEQ ID NO: 3072833 - RNA, 13 nt, Human
ggaccagagcugc

SEQ ID NO: 3072834 - RNA, 12 nt, Human
ggaauuguguuu

SEQ ID NO: 3072835 - RNA, 16 nt, Human
ggaauuggagcucgug

SEQ ID NO: 3072836 - RNA, 22 nt, Human
ggaauuggagcucgugggacag

SEQ ID NO: 3072837 - RNA, 23 nt, Human
ggaauuucucccagucauuuaau

SEQ ID NO: 3072838 - RNA, 19 nt, Human
ggaauuuucaucuaggauu

SEQ ID NO: 3072839 - RNA, 16 nt, Human
ggacaaaauggaauac

SEQ ID NO: 3072840 - RNA, 17 nt, Human
ggacaaaauggaauacu

SEQ ID NO: 3072841 - RNA, 14 nt, Human
ggaaugcuguguua

SEQ ID NO: 3072842 - RNA, 24 nt, Human
ggaaugauuaauuaaaacacaaca

SEQ ID NO: 3072843 - RNA, 12 nt, Human
ggaaugcagugg

SEQ ID NO: 3072844 - RNA, 19 nt, Human
ggaauguuugccucugccu

SEQ ID NO: 3072845 - RNA, 18 nt, Human
ggaagugcuaauuuugaa

SEQ ID NO: 3072846 - RNA, 14 nt, Human
ggaaugauuaauua

SEQ ID NO: 3072847 - RNA, 20 nt, Human
ggaagugacgguuuaauggg

SEQ ID NO: 3072848 - RNA, 12 nt, Human
ggaaguacugga

SEQ ID NO: 3072849 - RNA, 16 nt, Human
ggaaguacuggagaaa

SEQ ID NO: 3072850 - RNA, 18 nt, Human
ggaaguacuggagaaaau

SEQ ID NO: 3072851 - RNA, 23 nt, Human
ggaaggggagauaaggguaucug

SEQ ID NO: 3072852 - RNA, 18 nt, Human
gcuucaguggcagcugcu

SEQ ID NO: 3072853 - RNA, 17 nt, Human
gcuucaguggcagcugc

SEQ ID NO: 3072854 - RNA, 12 nt, Human
gcuucauccucc

SEQ ID NO: 3072855 - RNA, 15 nt, Human
gcuucauccuccuca

SEQ ID NO: 3072856 - RNA, 16 nt, Human
gcuucauuuccugugu

SEQ ID NO: 3072857 - RNA, 13 nt, Human
gcuucauuuccug

SEQ ID NO: 3072858 - RNA, 12 nt, Human
gcuuauacacuu

SEQ ID NO: 3072859 - RNA, 13 nt, Human
gcuuaucucaggg

SEQ ID NO: 3072860 - RNA, 19 nt, Human
gcuuaucucaggggugugc

SEQ ID NO: 3072861 - RNA, 15 nt, Human
gcuucaguggcagcu

SEQ ID NO: 3072862 - RNA, 16 nt, Human
gcuucaguggcagcug

SEQ ID NO: 3072863 - RNA, 16 nt, Human
gcuuccagugaggcuc

SEQ ID NO: 3072864 - RNA, 17 nt, Human
gcuucauuuccuguguc

SEQ ID NO: 3072865 - RNA, 15 nt, Human
gcuuccagugaggcu

SEQ ID NO: 3072866 - RNA, 16 nt, Human
gcuugaggguugggcu

SEQ ID NO: 3072867 - RNA, 22 nt, Human
gcuucucccccacccccuaggg

SEQ ID NO: 3072868 - RNA, 21 nt, Human
gcuuagucacugagacagccc

SEQ ID NO: 3072869 - RNA, 19 nt, Human
gcuuagucacugagacagc

SEQ ID NO: 3072870 - RNA, 20 nt, Human
gcuuagucacugagacagcc

SEQ ID NO: 3072871 - RNA, 15 nt, Human
gcuuagucacugaga

SEQ ID NO: 3072872 - RNA, 17 nt, Human
gcuuagucacugagaca

SEQ ID NO: 3072873 - RNA, 14 nt, Human
gcuguucagcuggu

SEQ ID NO: 3072874 - RNA, 13 nt, Human
gcuguucagcugg

SEQ ID NO: 3072875 - RNA, 12 nt, Human
gcuguucaugaa

SEQ ID NO: 3072876 - RNA, 21 nt, Human
gcuguucaugaaagauucaau

SEQ ID NO: 3072877 - RNA, 20 nt, Human
gcugucuacacuaagagaga

SEQ ID NO: 3072878 - RNA, 16 nt, Human
gcugccaaugggagcu

SEQ ID NO: 3072879 - RNA, 19 nt, Human
gcugccaaugggagcucau

SEQ ID NO: 3072880 - RNA, 15 nt, Human
gcugccaaugggagc

SEQ ID NO: 3072881 - RNA, 16 nt, Human
ggaacaggaaacugau

SEQ ID NO: 3072882 - RNA, 14 nt, Human
ggaaaucaccgaaa

SEQ ID NO: 3072883 - RNA, 17 nt, Human
ggaaaucaaauaugcaa

SEQ ID NO: 3072884 - RNA, 21 nt, Human
ggaaaucaccgaaaacguggc

SEQ ID NO: 3072885 - RNA, 16 nt, Human
ggaaaucaaauaugca

SEQ ID NO: 3072886 - RNA, 23 nt, Human
ggaaaaucagccugcuccagcug

SEQ ID NO: 3072887 - RNA, 19 nt, Human
ggaaaaucagccugcucca

SEQ ID NO: 3072888 - RNA, 13 nt, Human
ggaaaggcuccag

SEQ ID NO: 3072889 - RNA, 14 nt, Human
ggaaaggcuccagg

SEQ ID NO: 3072890 - RNA, 12 nt, Human
ggaaaggcucca

SEQ ID NO: 3072891 - RNA, 17 nt, Human
ggaaaggcuccaggagc

SEQ ID NO: 3072892 - RNA, 19 nt, Human
ggaaaggcuccaggagcag

SEQ ID NO: 3072893 - RNA, 20 nt, Human
ggaaaggcuccaggagcagc

SEQ ID NO: 3072894 - RNA, 21 nt, Human
ggaaaggcuccaggagcagcc

SEQ ID NO: 3072895 - RNA, 22 nt, Human
ggaaaggcuccaggagcagcca

SEQ ID NO: 3072896 - RNA, 23 nt, Human
ggaaagggauuuucagcccucag

SEQ ID NO: 3072897 - RNA, 14 nt, Human
ggaaaagcugcuga

SEQ ID NO: 3072898 - RNA, 20 nt, Human
ggaaaagcugcugacagugu

SEQ ID NO: 3072899 - RNA, 18 nt, Human
ggaaaagcugcugacagu

SEQ ID NO: 3072900 - RNA, 18 nt, Human
ggaaaacaugcuacacac

SEQ ID NO: 3072901 - RNA, 21 nt, Human
gcuuuguuuguugucagcuga

SEQ ID NO: 3072902 - RNA, 15 nt, Human
gcuuugugauuuuug

SEQ ID NO: 3072903 - RNA, 20 nt, Human
gcuugaggguugggcuggug

SEQ ID NO: 3072904 - RNA, 18 nt, Human
gcuugaggguugggcugg

SEQ ID NO: 3072905 - RNA, 21 nt, Human
gauucaaugccccugaauuua

SEQ ID NO: 3072906 - RNA, 19 nt, Human
gauucaaugccccugaauu

SEQ ID NO: 3072907 - RNA, 20 nt, Human
gauucaaugccccugaauuu

SEQ ID NO: 3072908 - RNA, 14 nt, Human
gauuuaacagaaau

SEQ ID NO: 3072909 - RNA, 13 nt, Human
gauuuaacagaaa

SEQ ID NO: 3072910 - RNA, 12 nt, Human
gauuuaaaucag

SEQ ID NO: 3072911 - RNA, 22 nt, Human
gauuuccguuaaaauaccagcc

SEQ ID NO: 3072912 - RNA, 15 nt, Human
gauuuaacagaaaug

SEQ ID NO: 3072913 - RNA, 18 nt, Human
gauuuccguuaaaauacc

SEQ ID NO: 3072914 - RNA, 23 nt, Human
gcaaaugugaaucauuuuaccuu

SEQ ID NO: 3072915 - RNA, 16 nt, Human
gcaaauugucacagga

SEQ ID NO: 3072916 - RNA, 21 nt, Human
gcaaagcugaugacaacuucc

SEQ ID NO: 3072917 - RNA, 12 nt, Human
gcaaaccaucau

SEQ ID NO: 3072918 - RNA, 21 nt, Human
gauuuugaaauuuuuauuaaa

SEQ ID NO: 3072919 - RNA, 19 nt, Human
gauuuugauccaagcuggu

SEQ ID NO: 3072920 - RNA, 16 nt, Human
gauguuuaguaaucau

SEQ ID NO: 3072921 - RNA, 19 nt, Human
gauguugaaaaaguucugc

SEQ ID NO: 3072922 - RNA, 23 nt, Human
gauuacaagcgugagccacugca

SEQ ID NO: 3072923 - RNA, 15 nt, Human
gauuaaacuuaaucu

SEQ ID NO: 3072924 - RNA, 22 nt, Human
gauuacaagcgugagccacugc

SEQ ID NO: 3072925 - RNA, 17 nt, Human
gauggugcaaugaccuu

SEQ ID NO: 3072926 - RNA, 15 nt, Human
gauggugcaaugacc

SEQ ID NO: 3072927 - RNA, 16 nt, Human
gauggugcaaugaccu

SEQ ID NO: 3072928 - RNA, 12 nt, Human
gauggugcaaug

SEQ ID NO: 3072929 - RNA, 14 nt, Human
gauggugcaaugac

SEQ ID NO: 3072930 - RNA, 19 nt, Human
gaugggugcuuggaggaag

SEQ ID NO: 3072931 - RNA, 15 nt, Human
gauggggcugcaccg

SEQ ID NO: 3072932 - RNA, 13 nt, Human
gauggggcugcac

SEQ ID NO: 3072933 - RNA, 24 nt, Human
gauggggcccugccuccuuuguga

SEQ ID NO: 3072934 - RNA, 21 nt, Human
gaugggcaacccccagccugc

SEQ ID NO: 3072935 - RNA, 20 nt, Human
gaugggcaacccccagccug

SEQ ID NO: 3072936 - RNA, 22 nt, Human
gauggccgggcgcgguggcuca

SEQ ID NO: 3072937 - RNA, 20 nt, Human
gaugcccaaagaugcagccg

SEQ ID NO: 3072938 - RNA, 22 nt, Human
gaugccaugagccgcccaaggc

SEQ ID NO: 3072939 - RNA, 19 nt, Human
gaugcccaaagaugcagcc

SEQ ID NO: 3072940 - RNA, 18 nt, Human
gaugcuagaacucccuuu

SEQ ID NO: 3072941 - RNA, 20 nt, Human
gaugcuagaacucccuuuca

SEQ ID NO: 3072942 - RNA, 14 nt, Human
gcaaugugauaaaa

SEQ ID NO: 3072943 - RNA, 14 nt, Human
gcaacucaucuuag

SEQ ID NO: 3072944 - RNA, 15 nt, Human
gcaauggcagccuug

SEQ ID NO: 3072945 - RNA, 13 nt, Human
gcaacucugaagg

SEQ ID NO: 3072946 - RNA, 14 nt, Human
gcaauuucauaugc

SEQ ID NO: 3072947 - RNA, 14 nt, Human
gcacaaacagaggc

SEQ ID NO: 3072948 - RNA, 15 nt, Human
gcacaaacagaggcc

SEQ ID NO: 3072949 - RNA, 16 nt, Human
gcacaaacagaggccg

SEQ ID NO: 3072950 - RNA, 23 nt, Human
gcacaaauucugucucuggauua

SEQ ID NO: 3072951 - RNA, 18 nt, Human
gcacaagcuccaagcucc

SEQ ID NO: 3072952 - RNA, 15 nt, Human
gcacaagcuccaagc

SEQ ID NO: 3072953 - RNA, 17 nt, Human
gcacaagcuccaagcuc

SEQ ID NO: 3072954 - RNA, 20 nt, Human
gcacaccgggcacucagaag

SEQ ID NO: 3072955 - RNA, 13 nt, Human
gcacacuggcuca

SEQ ID NO: 3072956 - RNA, 20 nt, Human
gcacagaaaauggaagacag

SEQ ID NO: 3072957 - RNA, 18 nt, Human
gcacacuuuggcccaggg

SEQ ID NO: 3072958 - RNA, 16 nt, Human
gcacacuuuggcccag

SEQ ID NO: 3072959 - RNA, 13 nt, Human
gcacacugucugc

SEQ ID NO: 3072960 - RNA, 19 nt, Human
gcacacuggcucacccagu

SEQ ID NO: 3072961 - RNA, 22 nt, Human
gcacacuggcucacccaguccu

SEQ ID NO: 3072962 - RNA, 22 nt, Human
gcacagacccugcccugugggc

SEQ ID NO: 3072963 - RNA, 15 nt, Human
gcacagaguuguuac

SEQ ID NO: 3072964 - RNA, 18 nt, Human
gcacagacccugcccugu

SEQ ID NO: 3072965 - RNA, 19 nt, Human
gcacagacccugcccugug

SEQ ID NO: 3072966 - RNA, 20 nt, Human
gcacagacccugcccugugg

SEQ ID NO: 3072967 - RNA, 21 nt, Human
gcacagacccugcccuguggg

SEQ ID NO: 3072968 - RNA, 14 nt, Human
gcacagacccugcc

SEQ ID NO: 3072969 - RNA, 15 nt, Human
gcacagacccugccc

SEQ ID NO: 3072970 - RNA, 16 nt, Human
gcacagacccugcccu

SEQ ID NO: 3072971 - RNA, 17 nt, Human
gcacagacccugcccug

SEQ ID NO: 3072972 - RNA, 21 nt, Human
gcacagaaaauggaagacagc

SEQ ID NO: 3072973 - RNA, 22 nt, Human
gcacagaaaauggaagacagcu

SEQ ID NO: 3072974 - RNA, 23 nt, Human
gcacagaaaauggaagacagcuc

SEQ ID NO: 3072975 - RNA, 22 nt, Human
gcaccccagcuggggccaggcu

SEQ ID NO: 3072976 - RNA, 12 nt, Human
gcaccauaacuu

SEQ ID NO: 3072977 - RNA, 20 nt, Human
gcaccuuagacagucccugc

SEQ ID NO: 3072978 - RNA, 21 nt, Human
gcaccuuagacagucccugcc

SEQ ID NO: 3072979 - RNA, 15 nt, Human
gcacgauuucuguuu

SEQ ID NO: 3072980 - RNA, 13 nt, Human
gcacgauuucugu

SEQ ID NO: 3072981 - RNA, 19 nt, Human
gcaccuuagacagucccug

SEQ ID NO: 3072982 - RNA, 21 nt, Human
gcacagaguuguuacauuuuu

SEQ ID NO: 3072983 - RNA, 19 nt, Human
gcacagaguuguuacauuu

SEQ ID NO: 3072984 - RNA, 18 nt, Human
gcacagaguuguuacauu

SEQ ID NO: 3072985 - RNA, 16 nt, Human
gcacagaguuguuaca

SEQ ID NO: 3072986 - RNA, 22 nt, Human
gcacagaguuguuacauuuuua

SEQ ID NO: 3072987 - RNA, 19 nt, Human
gcacuggcaaacagggccu

SEQ ID NO: 3072988 - RNA, 20 nt, Human
gcacuggcaaacagggccuc

SEQ ID NO: 3072989 - RNA, 22 nt, Human
gcacuggcaaacagggccucug

SEQ ID NO: 3072990 - RNA, 23 nt, Human
gcacuggcaaacagggccucugc

SEQ ID NO: 3072991 - RNA, 23 nt, Human
gcacugcuuccagugaggcucug

SEQ ID NO: 3072992 - RNA, 22 nt, Human
gcacugcuuccagugaggcucu

SEQ ID NO: 3072993 - RNA, 17 nt, Human
gcacuggcaaacagggc

SEQ ID NO: 3072994 - RNA, 16 nt, Human
gcacgauuucuguuua

SEQ ID NO: 3072995 - RNA, 15 nt, Human
gcacugacuucuaag

SEQ ID NO: 3072996 - RNA, 18 nt, Human
gcacugacuucuaaguaa

SEQ ID NO: 3072997 - RNA, 18 nt, Human
gcagacaggaccagggau

SEQ ID NO: 3072998 - RNA, 12 nt, Human
gcagacaggcaa

SEQ ID NO: 3072999 - RNA, 14 nt, Human
gcagacaggcaagc

SEQ ID NO: 3073000 - RNA, 13 nt, Human
gcagacaggcaag

SEQ ID NO: 3073001 - RNA, 18 nt, Human
gcagaaggaagacuucau

SEQ ID NO: 3073002 - RNA, 15 nt, Human
gagggggccuggaug

SEQ ID NO: 3073003 - RNA, 15 nt, Human
gagggggcugcuccc

SEQ ID NO: 3073004 - RNA, 17 nt, Human
gaggggguggccuccca

SEQ ID NO: 3073005 - RNA, 13 nt, Human
gaggguaaggcug

SEQ ID NO: 3073006 - RNA, 19 nt, Human
gagggagggcuccagacac

SEQ ID NO: 3073007 - RNA, 20 nt, Human
gaggcugggcucccuuccca

SEQ ID NO: 3073008 - RNA, 20 nt, Human
gagggagggcuccagacaca

SEQ ID NO: 3073009 - RNA, 16 nt, Human
gagggagggcuccaga

SEQ ID NO: 3073010 - RNA, 16 nt, Human
gagggagugacagagg

SEQ ID NO: 3073011 - RNA, 18 nt, Human
gagggagugacagaggca

SEQ ID NO: 3073012 - RNA, 22 nt, Human
gagggagugacagaggcagccc

SEQ ID NO: 3073013 - RNA, 21 nt, Human
gagggagugacagaggcagcc

SEQ ID NO: 3073014 - RNA, 14 nt, Human
gagggucugaggaa

SEQ ID NO: 3073015 - RNA, 13 nt, Human
gagggucugagga

SEQ ID NO: 3073016 - RNA, 22 nt, Human
gagggugucccaaaaagaaagg

SEQ ID NO: 3073017 - RNA, 21 nt, Human
gaggguggugaccucugccug

SEQ ID NO: 3073018 - RNA, 15 nt, Human
gagggugggaguggg

SEQ ID NO: 3073019 - RNA, 14 nt, Human
gaggguggugaccu

SEQ ID NO: 3073020 - RNA, 21 nt, Human
gagggugaagugaagacaaug

SEQ ID NO: 3073021 - RNA, 12 nt, Human
gaggguggaaua

SEQ ID NO: 3073022 - RNA, 17 nt, Human
gaggucaaggcugcagu

SEQ ID NO: 3073023 - RNA, 13 nt, Human
gaggucagagccu

SEQ ID NO: 3073024 - RNA, 12 nt, Human
gaggucagagcc

SEQ ID NO: 3073025 - RNA, 14 nt, Human
gaggguugggcugg

SEQ ID NO: 3073026 - RNA, 15 nt, Human
gaggguugggcuggu

SEQ ID NO: 3073027 - RNA, 21 nt, Human
gagguaaggaauaccuguccc

SEQ ID NO: 3073028 - RNA, 24 nt, Human
gagguaaggaauaccugucccccu

SEQ ID NO: 3073029 - RNA, 16 nt, Human
gaggccuucucugaag

SEQ ID NO: 3073030 - RNA, 19 nt, Human
gaggccuucucugaaggac

SEQ ID NO: 3073031 - RNA, 18 nt, Human
gaggccuucucugaagga

SEQ ID NO: 3073032 - RNA, 21 nt, Human
gaggcgcaugaauuugugaag

SEQ ID NO: 3073033 - RNA, 14 nt, Human
gaggcugccucucc

SEQ ID NO: 3073034 - RNA, 16 nt, Human
gaggcugggcucccuu

SEQ ID NO: 3073035 - RNA, 11 nt, Human
gaggcccagag

SEQ ID NO: 3073036 - RNA, 13 nt, Human
gaggcccagaggg

SEQ ID NO: 3073037 - RNA, 14 nt, Human
gaggcccagagggc

SEQ ID NO: 3073038 - RNA, 19 nt, Human
gaggcccagagggccugca

SEQ ID NO: 3073039 - RNA, 15 nt, Human
gaggcccagagggcc

SEQ ID NO: 3073040 - RNA, 16 nt, Human
gaggcccagagggccu

SEQ ID NO: 3073041 - RNA, 21 nt, Human
gaggcccuucucuccagcccc

SEQ ID NO: 3073042 - RNA, 15 nt, Human
gaggcccuucucucc

SEQ ID NO: 3073043 - RNA, 20 nt, Human
gaggcccuucucuccagccc

SEQ ID NO: 3073044 - RNA, 14 nt, Human
gaggcccuucucuc

SEQ ID NO: 3073045 - RNA, 9 nt, Human
gaggcaggg

SEQ ID NO: 3073046 - RNA, 20 nt, Human
gaggcagccccauucugccu

SEQ ID NO: 3073047 - RNA, 18 nt, Human
gaggcagccccauucugc

SEQ ID NO: 3073048 - RNA, 19 nt, Human
gaggcagccccauucugcc

SEQ ID NO: 3073049 - RNA, 23 nt, Human
gaggccaugggccuccugugugu

SEQ ID NO: 3073050 - RNA, 21 nt, Human
gaggccaugggccuccugugu

SEQ ID NO: 3073051 - RNA, 20 nt, Human
gaggccaugggccuccugug

SEQ ID NO: 3073052 - RNA, 18 nt, Human
gaggccaugggccuccug

SEQ ID NO: 3073053 - RNA, 17 nt, Human
gaggccaugggccuccu

SEQ ID NO: 3073054 - RNA, 14 nt, Human
gaggccaugggccu

SEQ ID NO: 3073055 - RNA, 20 nt, Human
gaggauugcuugagcucagg

SEQ ID NO: 3073056 - RNA, 16 nt, Human
gaggaucucuugagcc

SEQ ID NO: 3073057 - RNA, 19 nt, Human
gaggaucucuugagccugg

SEQ ID NO: 3073058 - RNA, 22 nt, Human
gaggaucucuugagccugggag

SEQ ID NO: 3073059 - RNA, 13 nt, Human
gaggaucucuuga

SEQ ID NO: 3073060 - RNA, 12 nt, Human
gagcccugucuc

SEQ ID NO: 3073061 - RNA, 18 nt, Human
gaguguacuuaacuauuc

SEQ ID NO: 3073062 - RNA, 17 nt, Human
gagugacagaggcagcc

SEQ ID NO: 3073063 - RNA, 23 nt, Human
gagugggggaucacagccucuga

SEQ ID NO: 3073064 - RNA, 13 nt, Human
gagugggugaaua

SEQ ID NO: 3073065 - RNA, 20 nt, Human
gagugugccugaagucccag

SEQ ID NO: 3073066 - RNA, 12 nt, Human
gaguuacagaca

SEQ ID NO: 3073067 - RNA, 13 nt, Human
gaguuacagacaa

SEQ ID NO: 3073068 - RNA, 15 nt, Human
gaguuacagacaaag

SEQ ID NO: 3073069 - RNA, 19 nt, Human
gaguucaucuugaauugua

SEQ ID NO: 3073070 - RNA, 14 nt, Human
gaguucaucuugaa

SEQ ID NO: 3073071 - RNA, 20 nt, Human
gaguucauacccuguuacca

SEQ ID NO: 3073072 - RNA, 15 nt, Human
gaguugaagacagag

SEQ ID NO: 3073073 - RNA, 17 nt, Human
gaguugaagacagagcu

SEQ ID NO: 3073074 - RNA, 21 nt, Human
gaguugaagacagagcuacac

SEQ ID NO: 3073075 - RNA, 14 nt, Human
gaguugaagacaga

SEQ ID NO: 3073076 - RNA, 19 nt, Human
gauacaggaaaagcugcug

SEQ ID NO: 3073077 - RNA, 23 nt, Human
gauacaggaaaagcugcugacag

SEQ ID NO: 3073078 - RNA, 21 nt, Human
gauacaggaaaagcugcugac

SEQ ID NO: 3073079 - RNA, 22 nt, Human
gauaagaaccuuuugagugccu

SEQ ID NO: 3073080 - RNA, 20 nt, Human
gauacaggaaaagcugcuga

SEQ ID NO: 3073081 - RNA, 22 nt, Human
gauagccaaggccaaaggaagc

SEQ ID NO: 3073082 - RNA, 14 nt, Human
gauagccaaggcca

SEQ ID NO: 3073083 - RNA, 15 nt, Human
gauagcacagacccu

SEQ ID NO: 3073084 - RNA, 15 nt, Human
gauauaagugugugu

SEQ ID NO: 3073085 - RNA, 24 nt, Human
gauaugauucaaaugucuauaaac

SEQ ID NO: 3073086 - RNA, 14 nt, Human
gauaugauucaaau

SEQ ID NO: 3073087 - RNA, 22 nt, Human
gauaugauucaaaugucuauaa

SEQ ID NO: 3073088 - RNA, 16 nt, Human
gaucacggcucacugc

SEQ ID NO: 3073089 - RNA, 15 nt, Human
gaucacggcucacug

SEQ ID NO: 3073090 - RNA, 18 nt, Human
gaucacggcucacugcag

SEQ ID NO: 3073091 - RNA, 22 nt, Human
gaguaauccaagcaaaugugaa

SEQ ID NO: 3073092 - RNA, 20 nt, Human
gaguacuacaguccucccau

SEQ ID NO: 3073093 - RNA, 21 nt, Human
gaguacuacaguccucccauc

SEQ ID NO: 3073094 - RNA, 23 nt, Human
gaguacuacaguccucccaucuc

SEQ ID NO: 3073095 - RNA, 13 nt, Human
gaguaggaagacu

SEQ ID NO: 3073096 - RNA, 17 nt, Human
gaguaggaagacuuugg

SEQ ID NO: 3073097 - RNA, 12 nt, Human
gaguaggaagac

SEQ ID NO: 3073098 - RNA, 22 nt, Human
gaguagcugggacuacaggcac

SEQ ID NO: 3073099 - RNA, 19 nt, Human
gaguagcugggacuacagg

SEQ ID NO: 3073100 - RNA, 16 nt, Human
gagguuucaaaccucc

SEQ ID NO: 3073101 - RNA, 15 nt, Human
gagguugggaggcca

SEQ ID NO: 3073102 - RNA, 17 nt, Human
gagguugggaggccauu

SEQ ID NO: 3073103 - RNA, 20 nt, Human
gaggucagagccugcaguua

SEQ ID NO: 3073104 - RNA, 17 nt, Human
gaggucagagccugcag

SEQ ID NO: 3073105 - RNA, 11 nt, Human
gaguauauguc

SEQ ID NO: 3073106 - RNA, 18 nt, Human
gaguaggaagacuuugga

SEQ ID NO: 3073107 - RNA, 19 nt, Human
gaguaggaagacuuuggaa

SEQ ID NO: 3073108 - RNA, 14 nt, Human
gagucgaggacagg

SEQ ID NO: 3073109 - RNA, 19 nt, Human
gaguccgaaagggacuugg

SEQ ID NO: 3073110 - RNA, 15 nt, Human
gagucgaggacaggg

SEQ ID NO: 3073111 - RNA, 17 nt, Human
gagugaagcugggagaa

SEQ ID NO: 3073112 - RNA, 23 nt, Human
gagugaacaaauuuacagagaca

SEQ ID NO: 3073113 - RNA, 16 nt, Human
gagugacagaggcagc

SEQ ID NO: 3073114 - RNA, 15 nt, Human
gagugacagaggcag

SEQ ID NO: 3073115 - RNA, 14 nt, Human
gagugacagaggca

SEQ ID NO: 3073116 - RNA, 12 nt, Human
gagucugaaggc

SEQ ID NO: 3073117 - RNA, 13 nt, Human
gagucugaaggcu

SEQ ID NO: 3073118 - RNA, 21 nt, Human
gagucuauuuacggaacucaa

SEQ ID NO: 3073119 - RNA, 14 nt, Human
gagucugaaggcug

SEQ ID NO: 3073120 - RNA, 14 nt, Human
gaauguuaagcaga

SEQ ID NO: 3073121 - RNA, 13 nt, Human
gaaugucagugug

SEQ ID NO: 3073122 - RNA, 15 nt, Human
gaauguuaagcagau

SEQ ID NO: 3073123 - RNA, 18 nt, Human
gaauucuugaaggaaaau

SEQ ID NO: 3073124 - RNA, 14 nt, Human
gaauugaagcagga

SEQ ID NO: 3073125 - RNA, 16 nt, Human
gaauugacccacaaga

SEQ ID NO: 3073126 - RNA, 21 nt, Human
gaauugacccacaagaaauga

SEQ ID NO: 3073127 - RNA, 16 nt, Human
gaauuggagcucgugg

SEQ ID NO: 3073128 - RNA, 18 nt, Human
gaaucucauaauuuauac

SEQ ID NO: 3073129 - RNA, 20 nt, Human
gaauccagacccggcugcgu

SEQ ID NO: 3073130 - RNA, 18 nt, Human
gaauccagacccggcugc

SEQ ID NO: 3073131 - RNA, 19 nt, Human
gaaucucauaauuuauaca

SEQ ID NO: 3073132 - RNA, 21 nt, Human
gaaugaaagggcccagagagg

SEQ ID NO: 3073133 - RNA, 20 nt, Human
gaaugcacaaacagaggccg

SEQ ID NO: 3073134 - RNA, 14 nt, Human
gaaugcuguguuaa

SEQ ID NO: 3073135 - RNA, 13 nt, Human
gaaugcuguguua

SEQ ID NO: 3073136 - RNA, 21 nt, Human
gaaugcacaaacagaggccgc

SEQ ID NO: 3073137 - RNA, 15 nt, Human
gaauuguaaggaaug

SEQ ID NO: 3073138 - RNA, 19 nt, Human
gaauuucuaggacugaauu

SEQ ID NO: 3073139 - RNA, 20 nt, Human
gaauuucuaggacugaauua

SEQ ID NO: 3073140 - RNA, 22 nt, Human
gaauuucuuuugccguuauuaa

SEQ ID NO: 3073141 - RNA, 20 nt, Human
gaauuugauaugugaacagu

SEQ ID NO: 3073142 - RNA, 22 nt, Human
gacaacacucauugaccugagg

SEQ ID NO: 3073143 - RNA, 23 nt, Human
gacaacacucauugaccugaggc

SEQ ID NO: 3073144 - RNA, 15 nt, Human
gacaagcucacagac

SEQ ID NO: 3073145 - RNA, 16 nt, Human
gacaaggaaaaaauaa

SEQ ID NO: 3073146 - RNA, 19 nt, Human
gacaaggauugcuacuguc

SEQ ID NO: 3073147 - RNA, 21 nt, Human
gacaaggaugaucuaggaaga

SEQ ID NO: 3073148 - RNA, 18 nt, Human
gacaaggauugcuacugu

SEQ ID NO: 3073149 - RNA, 12 nt, Human
gacaaugugaaa

SEQ ID NO: 3073150 - RNA, 18 nt, Human
gacaaugugaaaagaaaa

SEQ ID NO: 3073151 - RNA, 22 nt, Human
gacaaugcaaaccaucauugaa

SEQ ID NO: 3073152 - RNA, 19 nt, Human
gacaaugugaaaagaaaaa

SEQ ID NO: 3073153 - RNA, 20 nt, Human
gacaaugugaaaagaaaaau

SEQ ID NO: 3073154 - RNA, 13 nt, Human
gacacaacuauuu

SEQ ID NO: 3073155 - RNA, 19 nt, Human
gacacaggcccggcuccag

SEQ ID NO: 3073156 - RNA, 16 nt, Human
gacacaagccuucggc

SEQ ID NO: 3073157 - RNA, 21 nt, Human
gacacaggcccggcuccaggc

SEQ ID NO: 3073158 - RNA, 20 nt, Human
gacacaggcccggcuccagg

SEQ ID NO: 3073159 - RNA, 14 nt, Human
gacacaugcaaggu

SEQ ID NO: 3073160 - RNA, 19 nt, Human
gacacaugcaaggucauuu

SEQ ID NO: 3073161 - RNA, 15 nt, Human
gacacauguccaaga

SEQ ID NO: 3073162 - RNA, 20 nt, Human
gacacauguccaagaagccc

SEQ ID NO: 3073163 - RNA, 23 nt, Human
gacacauguccaagaagcccagg

SEQ ID NO: 3073164 - RNA, 19 nt, Human
gaccauucuccaccugcca

SEQ ID NO: 3073165 - RNA, 20 nt, Human
gaccauucuccaccugccag

SEQ ID NO: 3073166 - RNA, 21 nt, Human
gaccauucuccaccugccagg

SEQ ID NO: 3073167 - RNA, 22 nt, Human
gaccauucuccaccugccaggg

SEQ ID NO: 3073168 - RNA, 17 nt, Human
gaccauucuccaccugc

SEQ ID NO: 3073169 - RNA, 17 nt, Human
gaccauuggggcuccca

SEQ ID NO: 3073170 - RNA, 19 nt, Human
gaccauuggggcucccagc

SEQ ID NO: 3073171 - RNA, 20 nt, Human
gaccauuggggcucccagcc

SEQ ID NO: 3073172 - RNA, 21 nt, Human
gaccauuggggcucccagcca

SEQ ID NO: 3073173 - RNA, 13 nt, Human
gaccagagcugcc

SEQ ID NO: 3073174 - RNA, 14 nt, Human
gaccagagcugcca

SEQ ID NO: 3073175 - RNA, 15 nt, Human
gaccagagcugccac

SEQ ID NO: 3073176 - RNA, 17 nt, Human
gaccagagcugccaccu

SEQ ID NO: 3073177 - RNA, 18 nt, Human
gaccagagcugccaccug

SEQ ID NO: 3073178 - RNA, 19 nt, Human
gaccagagcugccaccugc

SEQ ID NO: 3073179 - RNA, 14 nt, Human
gaccacguuucuaa

SEQ ID NO: 3073180 - RNA, 21 nt, Human
gaccacugcagaagacaguau

SEQ ID NO: 3073181 - RNA, 18 nt, Human
gaccacugcagaagacag

SEQ ID NO: 3073182 - RNA, 11 nt, Human
gaccagagcug

SEQ ID NO: 3073183 - RNA, 24 nt, Human
gaccagacaccuugacagggcaca

SEQ ID NO: 3073184 - RNA, 18 nt, Human
gacaugggaaaggggaag

SEQ ID NO: 3073185 - RNA, 16 nt, Human
gacaugggacauuugc

SEQ ID NO: 3073186 - RNA, 22 nt, Human
gacccugaggcccagagggccu

SEQ ID NO: 3073187 - RNA, 21 nt, Human
gaccccuccaugugggcuagu

SEQ ID NO: 3073188 - RNA, 18 nt, Human
gaccccuccaugugggcu

SEQ ID NO: 3073189 - RNA, 14 nt, Human
gaccccuccaugug

SEQ ID NO: 3073190 - RNA, 23 nt, Human
gacccugaggcccagagggccug

SEQ ID NO: 3073191 - RNA, 20 nt, Human
gacccaaaaggcagaagcaa

SEQ ID NO: 3073192 - RNA, 16 nt, Human
gacccaaaaggcagaa

SEQ ID NO: 3073193 - RNA, 15 nt, Human
gacccacaagaaaug

SEQ ID NO: 3073194 - RNA, 15 nt, Human
gaccgugaggccaga

SEQ ID NO: 3073195 - RNA, 18 nt, Human
gaccgugaggccagagac

SEQ ID NO: 3073196 - RNA, 16 nt, Human
gaccgugaggccagag

SEQ ID NO: 3073197 - RNA, 17 nt, Human
gaccgugaggccagaga

SEQ ID NO: 3073198 - RNA, 15 nt, Human
gacccuugugguccc

SEQ ID NO: 3073199 - RNA, 21 nt, Human
gacccuuguggucccacccca

SEQ ID NO: 3073200 - RNA, 19 nt, Human
gacccuuguggucccaccc

SEQ ID NO: 3073201 - RNA, 20 nt, Human
gacccuuguggucccacccc

SEQ ID NO: 3073202 - RNA, 12 nt, Human
gacccugucuca

SEQ ID NO: 3073203 - RNA, 21 nt, Human
gacagagcaagugagacccug

SEQ ID NO: 3073204 - RNA, 16 nt, Human
gacagaggcagcccca

SEQ ID NO: 3073205 - RNA, 14 nt, Human
gacagaggcagccc

SEQ ID NO: 3073206 - RNA, 12 nt, Human
gacagaggcagc

SEQ ID NO: 3073207 - RNA, 19 nt, Human
gacagagccccacccucag

SEQ ID NO: 3073208 - RNA, 21 nt, Human
gacagaggggguggccuccca

SEQ ID NO: 3073209 - RNA, 22 nt, Human
gacagaggggguggccucccaa

SEQ ID NO: 3073210 - RNA, 19 nt, Human
gacagagugagacucuguc

SEQ ID NO: 3073211 - RNA, 23 nt, Human
gacagaggggguggccucccaac

SEQ ID NO: 3073212 - RNA, 18 nt, Human
gacagaggggguggccuc

SEQ ID NO: 3073213 - RNA, 19 nt, Human
gacagaggggguggccucc

SEQ ID NO: 3073214 - RNA, 15 nt, Human
gacagaggggguggc

SEQ ID NO: 3073215 - RNA, 17 nt, Human
gacagaggcagccccau

SEQ ID NO: 3073216 - RNA, 16 nt, Human
gacagcugccugggau

SEQ ID NO: 3073217 - RNA, 17 nt, Human
gacagcugccugggauc

SEQ ID NO: 3073218 - RNA, 21 nt, Human
gacagccacggccaggccaga

SEQ ID NO: 3073219 - RNA, 20 nt, Human
gacagccacggccaggccag

SEQ ID NO: 3073220 - RNA, 18 nt, Human
gacagcugccugggaucc

SEQ ID NO: 3073221 - RNA, 21 nt, Human
gacagcugccugggaucccuc

SEQ ID NO: 3073222 - RNA, 19 nt, Human
gacagccacggccaggcca

SEQ ID NO: 3073223 - RNA, 18 nt, Human
gacagccacggccaggcc

SEQ ID NO: 3073224 - RNA, 17 nt, Human
gacagccacggccaggc

SEQ ID NO: 3073225 - RNA, 14 nt, Human
gacagccacggcca

SEQ ID NO: 3073226 - RNA, 22 nt, Human
gacagagugagacucugucuca

SEQ ID NO: 3073227 - RNA, 20 nt, Human
gacagagugagacucugucu

SEQ ID NO: 3073228 - RNA, 13 nt, Human
gacagagggggug

SEQ ID NO: 3073229 - RNA, 13 nt, Human
gacagccacggcc

SEQ ID NO: 3073230 - RNA, 14 nt, Human
gacaugggaaaggg

SEQ ID NO: 3073231 - RNA, 14 nt, Human
gacaugaucuucuu

SEQ ID NO: 3073232 - RNA, 20 nt, Human
gacauagaauuaacacauga

SEQ ID NO: 3073233 - RNA, 15 nt, Human
gacaggaccagggau

SEQ ID NO: 3073234 - RNA, 23 nt, Human
gacaggaccagggauuuccauga

SEQ ID NO: 3073235 - RNA, 14 nt, Human
gacaggaccaggga

SEQ ID NO: 3073236 - RNA, 17 nt, Human
gacagggaggacgcucu

SEQ ID NO: 3073237 - RNA, 24 nt, Human
gacagggcacaccgggcacucaga

SEQ ID NO: 3073238 - RNA, 14 nt, Human
gacaguuaagagaa

SEQ ID NO: 3073239 - RNA, 16 nt, Human
gacagggaggugaccc

SEQ ID NO: 3073240 - RNA, 18 nt, Human
gacagggaggacgcucuc

SEQ ID NO: 3073241 - RNA, 23 nt, Human
gacagggcacaccgggcacucag

SEQ ID NO: 3073242 - RNA, 12 nt, Human
gagaaaugaaaa

SEQ ID NO: 3073243 - RNA, 21 nt, Human
gagaaaugaaaaaauauauau

SEQ ID NO: 3073244 - RNA, 14 nt, Human
gagaaaugagcuug

SEQ ID NO: 3073245 - RNA, 21 nt, Human
gagaaccuagggugauauuaa

SEQ ID NO: 3073246 - RNA, 22 nt, Human
gagaaccuagggugauauuaac

SEQ ID NO: 3073247 - RNA, 16 nt, Human
gagaaagguugaagca

SEQ ID NO: 3073248 - RNA, 16 nt, Human
gagaagagaaugcaca

SEQ ID NO: 3073249 - RNA, 16 nt, Human
gagaagcagaggaagg

SEQ ID NO: 3073250 - RNA, 17 nt, Human
gagaaugagagacacac

SEQ ID NO: 3073251 - RNA, 14 nt, Human
gagaagagaaugca

SEQ ID NO: 3073252 - RNA, 22 nt, Human
gagaacuuccagauccuggaaa

SEQ ID NO: 3073253 - RNA, 23 nt, Human
gagaacuuccagauccuggaaau

SEQ ID NO: 3073254 - RNA, 19 nt, Human
gacuuaagcacacuugaca

SEQ ID NO: 3073255 - RNA, 16 nt, Human
gacuucuaaguaaaac

SEQ ID NO: 3073256 - RNA, 18 nt, Human
gacuucuaaguaaaacca

SEQ ID NO: 3073257 - RNA, 17 nt, Human
gacuucuaaguaaaacc

SEQ ID NO: 3073258 - RNA, 23 nt, Human
gacuucugucuucacaacagauu

SEQ ID NO: 3073259 - RNA, 20 nt, Human
gacuucugucuucacaacag

SEQ ID NO: 3073260 - RNA, 24 nt, Human
gacuucuaaguaaaaccacagcag

SEQ ID NO: 3073261 - RNA, 23 nt, Human
gacuucuaaguaaaaccacagca

SEQ ID NO: 3073262 - RNA, 19 nt, Human
gacuucuaaguaaaaccac

SEQ ID NO: 3073263 - RNA, 23 nt, Human
gacugaguacguugugcauuugg

SEQ ID NO: 3073264 - RNA, 14 nt, Human
gacugcauuauauu

SEQ ID NO: 3073265 - RNA, 16 nt, Human
gacugcauuauauuua

SEQ ID NO: 3073266 - RNA, 15 nt, Human
gacugcccggcaggg

SEQ ID NO: 3073267 - RNA, 13 nt, Human
gacugcccggcag

SEQ ID NO: 3073268 - RNA, 18 nt, Human
gacugaguacguugugca

SEQ ID NO: 3073269 - RNA, 22 nt, Human
gacugaguacguugugcauuug

SEQ ID NO: 3073270 - RNA, 21 nt, Human
gacugaguacguugugcauuu

SEQ ID NO: 3073271 - RNA, 17 nt, Human
gacucgcgacaaugcaa

SEQ ID NO: 3073272 - RNA, 18 nt, Human
gacuggaagcacagcuuc

SEQ ID NO: 3073273 - RNA, 16 nt, Human
gacuggaagcacagcu

SEQ ID NO: 3073274 - RNA, 15 nt, Human
gacuggaagcacagc

SEQ ID NO: 3073275 - RNA, 14 nt, Human
gacuggaagcacag

SEQ ID NO: 3073276 - RNA, 12 nt, Human
gacuccugcagg

SEQ ID NO: 3073277 - RNA, 13 nt, Human
gacuccugcaggc

SEQ ID NO: 3073278 - RNA, 21 nt, Human
gacuccugcaggcagccaggc

SEQ ID NO: 3073279 - RNA, 13 nt, Human
gacucgcgacaau

SEQ ID NO: 3073280 - RNA, 16 nt, Human
gacuccaaagaaaugu

SEQ ID NO: 3073281 - RNA, 15 nt, Human
gacuccaaagaaaug

SEQ ID NO: 3073282 - RNA, 12 nt, Human
gacuccaaagaa

SEQ ID NO: 3073283 - RNA, 11 nt, Human
gacuccaaaga

SEQ ID NO: 3073284 - RNA, 21 nt, Human
gacucauuuuaaaaaauggaa

SEQ ID NO: 3073285 - RNA, 15 nt, Human
gacucauucuucugu

SEQ ID NO: 3073286 - RNA, 14 nt, Human
gacucauucuucug

SEQ ID NO: 3073287 - RNA, 21 nt, Human
gacuacaggugugagucacca

SEQ ID NO: 3073288 - RNA, 18 nt, Human
gacuacaggugugaguca

SEQ ID NO: 3073289 - RNA, 13 nt, Human
gacuacaggugug

SEQ ID NO: 3073290 - RNA, 20 nt, Human
gagacagcucugcauacuca

SEQ ID NO: 3073291 - RNA, 23 nt, Human
gagaaugcacaaacagaggccgc

SEQ ID NO: 3073292 - RNA, 20 nt, Human
gagaaugagagacacacuga

SEQ ID NO: 3073293 - RNA, 18 nt, Human
gagaccaucccugaaggc

SEQ ID NO: 3073294 - RNA, 21 nt, Human
gagaccaucccugaaggcccc

SEQ ID NO: 3073295 - RNA, 14 nt, Human
gagaccaucccuga

SEQ ID NO: 3073296 - RNA, 12 nt, Human
gagaccaucccu

SEQ ID NO: 3073297 - RNA, 22 nt, Human
gagacaggguuuugccauguug

SEQ ID NO: 3073298 - RNA, 20 nt, Human
gagacucgcgacaaugcaaa

SEQ ID NO: 3073299 - RNA, 21 nt, Human
gagacucgcgacaaugcaaac

SEQ ID NO: 3073300 - RNA, 18 nt, Human
gagacucgcgacaaugca

SEQ ID NO: 3073301 - RNA, 20 nt, Human
gagacuccugcaggcagcca

SEQ ID NO: 3073302 - RNA, 21 nt, Human
gagacuccugcaggcagccag

SEQ ID NO: 3073303 - RNA, 19 nt, Human
gagacuccugcaggcagcc

SEQ ID NO: 3073304 - RNA, 18 nt, Human
gagacuccugcaggcagc

SEQ ID NO: 3073305 - RNA, 15 nt, Human
gagaguagaacagau

SEQ ID NO: 3073306 - RNA, 14 nt, Human
gagagggugggagu

SEQ ID NO: 3073307 - RNA, 16 nt, Human
gagagggugggagugg

SEQ ID NO: 3073308 - RNA, 13 nt, Human
gagaggggcacag

SEQ ID NO: 3073309 - RNA, 19 nt, Human
gagaggggaacagacugga

SEQ ID NO: 3073310 - RNA, 19 nt, Human
gagagacacacugaagaag

SEQ ID NO: 3073311 - RNA, 23 nt, Human
gagcccacuguacuugcucuuga

SEQ ID NO: 3073312 - RNA, 19 nt, Human
gagccagggucucacuaug

SEQ ID NO: 3073313 - RNA, 23 nt, Human
gagccagauuucacucuccuugg

SEQ ID NO: 3073314 - RNA, 14 nt, Human
gagccagggucuca

SEQ ID NO: 3073315 - RNA, 18 nt, Human
gagcccugguggcagugg

SEQ ID NO: 3073316 - RNA, 20 nt, Human
gagccagauuucacucuccu

SEQ ID NO: 3073317 - RNA, 19 nt, Human
gagccaauuuaaagaaaac

SEQ ID NO: 3073318 - RNA, 12 nt, Human
gagcagagacca

SEQ ID NO: 3073319 - RNA, 16 nt, Human
gagcagagaauucucu

SEQ ID NO: 3073320 - RNA, 16 nt, Human
gagauagccaaggcca

SEQ ID NO: 3073321 - RNA, 23 nt, Human
gagaucaaccccuucgcuccugu

SEQ ID NO: 3073322 - RNA, 14 nt, Human
gagauagccaaggc

SEQ ID NO: 3073323 - RNA, 18 nt, Human
gagaucacgccacugcac

SEQ ID NO: 3073324 - RNA, 19 nt, Human
gagaucacgccacugcacu

SEQ ID NO: 3073325 - RNA, 21 nt, Human
gagcaccuuagacagucccug

SEQ ID NO: 3073326 - RNA, 22 nt, Human
gagcaccuuagacagucccugc

SEQ ID NO: 3073327 - RNA, 15 nt, Human
gagcacuaaggugug

SEQ ID NO: 3073328 - RNA, 19 nt, Human
gagcaccuuagacaguccc

SEQ ID NO: 3073329 - RNA, 21 nt, Human
gagcacuaaggugugcucuga

SEQ ID NO: 3073330 - RNA, 20 nt, Human
gagcaccuuagacagucccu

SEQ ID NO: 3073331 - RNA, 23 nt, Human
gagcaagacgcugugcugcccug

SEQ ID NO: 3073332 - RNA, 21 nt, Human
cugugugcucaggagcccugg

SEQ ID NO: 3073333 - RNA, 20 nt, Human
cugugugcucaggagcccug

SEQ ID NO: 3073334 - RNA, 16 nt, Human
cugugugcucaggagc

SEQ ID NO: 3073335 - RNA, 19 nt, Human
cugugugcucaggagcccu

SEQ ID NO: 3073336 - RNA, 23 nt, Human
cugugugcucaggagcccuggga

SEQ ID NO: 3073337 - RNA, 15 nt, Human
cuguguggcagucug

SEQ ID NO: 3073338 - RNA, 22 nt, Human
cugugucuugcaauggcagccu

SEQ ID NO: 3073339 - RNA, 20 nt, Human
cugugucuugcaauggcagc

SEQ ID NO: 3073340 - RNA, 21 nt, Human
cugugucuugcaauggcagcc

SEQ ID NO: 3073341 - RNA, 20 nt, Human
cugugugugcgccuacagga

SEQ ID NO: 3073342 - RNA, 18 nt, Human
cugugugugcgccuacag

SEQ ID NO: 3073343 - RNA, 23 nt, Human
cuguuaaaagaugaaaauauuug

SEQ ID NO: 3073344 - RNA, 21 nt, Human
cuguuaaaagaugaaaauauu

SEQ ID NO: 3073345 - RNA, 20 nt, Human
cuguuaaaagaugaaaauau

SEQ ID NO: 3073346 - RNA, 18 nt, Human
cuguucagcugguugagg

SEQ ID NO: 3073347 - RNA, 19 nt, Human
cuguucagcugguugaggu

SEQ ID NO: 3073348 - RNA, 21 nt, Human
cuguucagcugguugagguuu

SEQ ID NO: 3073349 - RNA, 18 nt, Human
cuguucaugaaagauuca

SEQ ID NO: 3073350 - RNA, 23 nt, Human
cuguucaugaaagauucaaugcc

SEQ ID NO: 3073351 - RNA, 17 nt, Human
cuguucaugaaagauuc

SEQ ID NO: 3073352 - RNA, 14 nt, Human
cuguucucugcccu

SEQ ID NO: 3073353 - RNA, 15 nt, Human
cuguucucugcccuc

SEQ ID NO: 3073354 - RNA, 16 nt, Human
cuguucucugcccucc

SEQ ID NO: 3073355 - RNA, 17 nt, Human
cuguucucugcccucca

SEQ ID NO: 3073356 - RNA, 18 nt, Human
cuguucucugcccuccaa

SEQ ID NO: 3073357 - RNA, 19 nt, Human
cuguucucugcccuccaag

SEQ ID NO: 3073358 - RNA, 20 nt, Human
cuguucucugcccuccaaga

SEQ ID NO: 3073359 - RNA, 13 nt, Human
cuguucucugccc

SEQ ID NO: 3073360 - RNA, 18 nt, Human
cugucuccauguuugaug

SEQ ID NO: 3073361 - RNA, 18 nt, Human
cugugauggggcccugcc

SEQ ID NO: 3073362 - RNA, 17 nt, Human
cugugauggggcccugc

SEQ ID NO: 3073363 - RNA, 20 nt, Human
cugugaguacuacaguccuc

SEQ ID NO: 3073364 - RNA, 21 nt, Human
cugugaguacuacaguccucc

SEQ ID NO: 3073365 - RNA, 23 nt, Human
cugugaguacuacaguccuccca

SEQ ID NO: 3073366 - RNA, 18 nt, Human
cugugccaugugccaggu

SEQ ID NO: 3073367 - RNA, 16 nt, Human
cugugccaugugccag

SEQ ID NO: 3073368 - RNA, 14 nt, Human
cugugccauuuugu

SEQ ID NO: 3073369 - RNA, 19 nt, Human
cugugauggggcccugccu

SEQ ID NO: 3073370 - RNA, 20 nt, Human
cugugauggggcccugccuc

SEQ ID NO: 3073371 - RNA, 16 nt, Human
cugugccucugggacu

SEQ ID NO: 3073372 - RNA, 14 nt, Human
cugugccucuggga

SEQ ID NO: 3073373 - RNA, 21 nt, Human
cugugcugcccugcccaccug

SEQ ID NO: 3073374 - RNA, 17 nt, Human
cugugccucugggacug

SEQ ID NO: 3073375 - RNA, 22 nt, Human
cugugcugcccugcccaccugg

SEQ ID NO: 3073376 - RNA, 14 nt, Human
cugugggcccccaa

SEQ ID NO: 3073377 - RNA, 22 nt, Human
cuguggcgagccauuuguccca

SEQ ID NO: 3073378 - RNA, 23 nt, Human
cuguggcgagccauuugucccaa

SEQ ID NO: 3073379 - RNA, 17 nt, Human
cuguggaugauaaaaca

SEQ ID NO: 3073380 - RNA, 14 nt, Human
cuguggaugcugcu

SEQ ID NO: 3073381 - RNA, 22 nt, Human
cuguggaugcugcugccccugc

SEQ ID NO: 3073382 - RNA, 23 nt, Human
cuguggaugcugcugccccugca

SEQ ID NO: 3073383 - RNA, 16 nt, Human
cuguggaugcugcugc

SEQ ID NO: 3073384 - RNA, 18 nt, Human
cuguggaugcugcugccc

SEQ ID NO: 3073385 - RNA, 19 nt, Human
cuguggaugcugcugcccc

SEQ ID NO: 3073386 - RNA, 21 nt, Human
cuguggaugcugcugccccug

SEQ ID NO: 3073387 - RNA, 16 nt, Human
cugguuccauggccuc

SEQ ID NO: 3073388 - RNA, 22 nt, Human
cuguaauaaacucauuucuagc

SEQ ID NO: 3073389 - RNA, 23 nt, Human
cuguaaucacagcuacuugggag

SEQ ID NO: 3073390 - RNA, 13 nt, Human
cuguacaaaguag

SEQ ID NO: 3073391 - RNA, 22 nt, Human
cuguaauuugugauacaaugcu

SEQ ID NO: 3073392 - RNA, 15 nt, Human
cuguacaaaguagaa

SEQ ID NO: 3073393 - RNA, 20 nt, Human
cuguaauccuagcacuuugg

SEQ ID NO: 3073394 - RNA, 19 nt, Human
cuguaauccuagcacuuug

SEQ ID NO: 3073395 - RNA, 14 nt, Human
cugguggcagcugc

SEQ ID NO: 3073396 - RNA, 13 nt, Human
cugguggcagcug

SEQ ID NO: 3073397 - RNA, 21 nt, Human
cugguggcagcucaccucucc

SEQ ID NO: 3073398 - RNA, 23 nt, Human
cugguggcagcucaccucucccu

SEQ ID NO: 3073399 - RNA, 18 nt, Human
cugggggcugggcagagg

SEQ ID NO: 3073400 - RNA, 19 nt, Human
cugggggcugggcagagga

SEQ ID NO: 3073401 - RNA, 22 nt, Human
cugggggggauuguaaaauggu

SEQ ID NO: 3073402 - RNA, 15 nt, Human
cugggggaagaagcu

SEQ ID NO: 3073403 - RNA, 24 nt, Human
cugggcuucaguggcagcugcuuu

SEQ ID NO: 3073404 - RNA, 23 nt, Human
cugggcuucaguggcagcugcuu

SEQ ID NO: 3073405 - RNA, 13 nt, Human
cugggggaagaag

SEQ ID NO: 3073406 - RNA, 22 nt, Human
cuggguaacuagggaagauaau

SEQ ID NO: 3073407 - RNA, 20 nt, Human
cuggguaacuagggaagaua

SEQ ID NO: 3073408 - RNA, 14 nt, Human
cuggguucuaccca

SEQ ID NO: 3073409 - RNA, 15 nt, Human
cuggguucuacccag

SEQ ID NO: 3073410 - RNA, 16 nt, Human
cuggguucuacccagg

SEQ ID NO: 3073411 - RNA, 17 nt, Human
cuggguucuacccaggu

SEQ ID NO: 3073412 - RNA, 20 nt, Human
cugucuacacuaagagagaa

SEQ ID NO: 3073413 - RNA, 15 nt, Human
cuguccgagcuuuga

SEQ ID NO: 3073414 - RNA, 14 nt, Human
cuguccuacccacc

SEQ ID NO: 3073415 - RNA, 18 nt, Human
cugucucaaaaaaagaaa

SEQ ID NO: 3073416 - RNA, 16 nt, Human
cugucucaaaaaaaga

SEQ ID NO: 3073417 - RNA, 23 nt, Human
cugucucaaaaaaacacaaaagu

SEQ ID NO: 3073418 - RNA, 17 nt, Human
cuguccccgcacugggc

SEQ ID NO: 3073419 - RNA, 18 nt, Human
cuguccccgcacugggcu

SEQ ID NO: 3073420 - RNA, 19 nt, Human
cuguccccgcacugggcuu

SEQ ID NO: 3073421 - RNA, 22 nt, Human
cuguccccgcacugggcuuggg

SEQ ID NO: 3073422 - RNA, 14 nt, Human
cuguccgagcuuug

SEQ ID NO: 3073423 - RNA, 20 nt, Human
cugucccuuacgugaguccu

SEQ ID NO: 3073424 - RNA, 13 nt, Human
cuguacagagccc

SEQ ID NO: 3073425 - RNA, 23 nt, Human
cuguaucccaugagccucagcau

SEQ ID NO: 3073426 - RNA, 22 nt, Human
cuguauuuuaaaagaaugauua

SEQ ID NO: 3073427 - RNA, 20 nt, Human
cuguauuuuaaaagaaugau

SEQ ID NO: 3073428 - RNA, 19 nt, Human
cuguauuuuaaaagaauga

SEQ ID NO: 3073429 - RNA, 23 nt, Human
cugcugguucaggguuggccccu

SEQ ID NO: 3073430 - RNA, 15 nt, Human
cugcugguucagggu

SEQ ID NO: 3073431 - RNA, 13 nt, Human
cugcugguucagg

SEQ ID NO: 3073432 - RNA, 19 nt, Human
cugcuuccagugaggcucu

SEQ ID NO: 3073433 - RNA, 20 nt, Human
cugcuuccagugaggcucug

SEQ ID NO: 3073434 - RNA, 21 nt, Human
cugcuuccagugaggcucugc

SEQ ID NO: 3073435 - RNA, 23 nt, Human
cugcuuccagugaggcucugccc

SEQ ID NO: 3073436 - RNA, 16 nt, Human
cugcuuccagugaggc

SEQ ID NO: 3073437 - RNA, 18 nt, Human
cugcuuccagugaggcuc

SEQ ID NO: 3073438 - RNA, 15 nt, Human
cugcuuccagugagg

SEQ ID NO: 3073439 - RNA, 14 nt, Human
cugcugcuggcugg

SEQ ID NO: 3073440 - RNA, 15 nt, Human
cugcugcuggcuggu

SEQ ID NO: 3073441 - RNA, 15 nt, Human
cugcugcuccuagga

SEQ ID NO: 3073442 - RNA, 18 nt, Human
cugcugcuccuaggaccc

SEQ ID NO: 3073443 - RNA, 11 nt, Human
cugcugaaggc

SEQ ID NO: 3073444 - RNA, 18 nt, Human
cugcugaaacaacaaaua

SEQ ID NO: 3073445 - RNA, 15 nt, Human
cugcugcaguugcca

SEQ ID NO: 3073446 - RNA, 16 nt, Human
cugcugccccugcaca

SEQ ID NO: 3073447 - RNA, 14 nt, Human
cugcugccccugca

SEQ ID NO: 3073448 - RNA, 22 nt, Human
cugcugccccugcacagcaggc

SEQ ID NO: 3073449 - RNA, 23 nt, Human
cugcugccccugcacagcaggcu

SEQ ID NO: 3073450 - RNA, 19 nt, Human
cugcucuccgaccagacac

SEQ ID NO: 3073451 - RNA, 15 nt, Human
cugcucccaccuggc

SEQ ID NO: 3073452 - RNA, 10 nt, Human
cugcucccac

SEQ ID NO: 3073453 - RNA, 19 nt, Human
cugcuccagcuguucagcu

SEQ ID NO: 3073454 - RNA, 20 nt, Human
cugcuccagcuguucagcug

SEQ ID NO: 3073455 - RNA, 15 nt, Human
cugcuccagcuguuc

SEQ ID NO: 3073456 - RNA, 19 nt, Human
cugcgaccacaagaaggau

SEQ ID NO: 3073457 - RNA, 19 nt, Human
cugccucucugcagguccc

SEQ ID NO: 3073458 - RNA, 15 nt, Human
cugccucuucucuac

SEQ ID NO: 3073459 - RNA, 14 nt, Human
cugccucuucucua

SEQ ID NO: 3073460 - RNA, 17 nt, Human
cugccugcccaggcccc

SEQ ID NO: 3073461 - RNA, 16 nt, Human
cugccugcccaggccc

SEQ ID NO: 3073462 - RNA, 15 nt, Human
cugccugcccaggcc

SEQ ID NO: 3073463 - RNA, 15 nt, Human
cugccugaagucaca

SEQ ID NO: 3073464 - RNA, 21 nt, Human
cugccugggaucccucauccu

SEQ ID NO: 3073465 - RNA, 20 nt, Human
cugccugcccaggccccugc

SEQ ID NO: 3073466 - RNA, 21 nt, Human
cugccucucugcaggucccua

SEQ ID NO: 3073467 - RNA, 20 nt, Human
cugccucucugcaggucccu

SEQ ID NO: 3073468 - RNA, 22 nt, Human
cugccucucugcaggucccuaa

SEQ ID NO: 3073469 - RNA, 23 nt, Human
cugccucugacacacagcucugu

SEQ ID NO: 3073470 - RNA, 22 nt, Human
cugccucugacacacagcucug

SEQ ID NO: 3073471 - RNA, 12 nt, Human
cugccucccauc

SEQ ID NO: 3073472 - RNA, 14 nt, Human
cugccucccaucac

SEQ ID NO: 3073473 - RNA, 16 nt, Human
cugccucccaucaccc

SEQ ID NO: 3073474 - RNA, 19 nt, Human
cugccucccaucacccgcu

SEQ ID NO: 3073475 - RNA, 11 nt, Human
cugccucccau

SEQ ID NO: 3073476 - RNA, 14 nt, Human
cugccgcagcccug

SEQ ID NO: 3073477 - RNA, 15 nt, Human
cugccgcagcccugc

SEQ ID NO: 3073478 - RNA, 17 nt, Human
cugccgcagcccugcag

SEQ ID NO: 3073479 - RNA, 18 nt, Human
cugccgcagcccugcaga

SEQ ID NO: 3073480 - RNA, 14 nt, Human
cucccuucccaccu

SEQ ID NO: 3073481 - RNA, 15 nt, Human
cucccuucccaccuc

SEQ ID NO: 3073482 - RNA, 16 nt, Human
cucccuucccaccucu

SEQ ID NO: 3073483 - RNA, 17 nt, Human
cucccuucccaccucuc

SEQ ID NO: 3073484 - RNA, 12 nt, Human
cugcccuccaag

SEQ ID NO: 3073485 - RNA, 15 nt, Human
cuggcccacugcauc

SEQ ID NO: 3073486 - RNA, 14 nt, Human
cuggccagaugcac

SEQ ID NO: 3073487 - RNA, 20 nt, Human
cuggagugcagugagccgag

SEQ ID NO: 3073488 - RNA, 20 nt, Human
cuggcacaguuuucugagaa

SEQ ID NO: 3073489 - RNA, 22 nt, Human
cuggcacaguuuucugagaaag

SEQ ID NO: 3073490 - RNA, 21 nt, Human
cuggcacaguuuucugagaaa

SEQ ID NO: 3073491 - RNA, 19 nt, Human
cuggcacccggccccugcu

SEQ ID NO: 3073492 - RNA, 21 nt, Human
cuggcacccggccccugcugg

SEQ ID NO: 3073493 - RNA, 20 nt, Human
cuggcacccggccccugcug

SEQ ID NO: 3073494 - RNA, 19 nt, Human
cuggcacugcuuccaguga

SEQ ID NO: 3073495 - RNA, 20 nt, Human
cuggcacugcuuccagugag

SEQ ID NO: 3073496 - RNA, 23 nt, Human
cuggcacugcuuccagugaggcu

SEQ ID NO: 3073497 - RNA, 18 nt, Human
cuggcacugcuuccagug

SEQ ID NO: 3073498 - RNA, 22 nt, Human
cuggcacuggcaaacagggccu

SEQ ID NO: 3073499 - RNA, 24 nt, Human
cuggcucuuccaggcugggagagc

SEQ ID NO: 3073500 - RNA, 21 nt, Human
cuggcucuuccaggcugggag

SEQ ID NO: 3073501 - RNA, 22 nt, Human
cuggcucuuccaggcugggaga

SEQ ID NO: 3073502 - RNA, 15 nt, Human
cuggcgugcaguggu

SEQ ID NO: 3073503 - RNA, 14 nt, Human
cuggcgugcagugg

SEQ ID NO: 3073504 - RNA, 23 nt, Human
cuggccuucggccuccauccuga

SEQ ID NO: 3073505 - RNA, 24 nt, Human
cuggccuggccccucagggucccu

SEQ ID NO: 3073506 - RNA, 22 nt, Human
cuggccuucggccuccauccug

SEQ ID NO: 3073507 - RNA, 19 nt, Human
cuggccuggccccucaggg

SEQ ID NO: 3073508 - RNA, 18 nt, Human
cuggccucugcacucccc

SEQ ID NO: 3073509 - RNA, 20 nt, Human
cuggccucugcacuccccug

SEQ ID NO: 3073510 - RNA, 21 nt, Human
cuggccucugcacuccccugc

SEQ ID NO: 3073511 - RNA, 16 nt, Human
cuggccucugcacucc

SEQ ID NO: 3073512 - RNA, 17 nt, Human
cuggagugcagugagcc

SEQ ID NO: 3073513 - RNA, 16 nt, Human
cuggagugcagugagc

SEQ ID NO: 3073514 - RNA, 15 nt, Human
cuggagugcagugag

SEQ ID NO: 3073515 - RNA, 14 nt, Human
cuggagugcaguga

SEQ ID NO: 3073516 - RNA, 17 nt, Human
cuggagguacgaaaaga

SEQ ID NO: 3073517 - RNA, 22 nt, Human
cuggagguacgaaaagagggga

SEQ ID NO: 3073518 - RNA, 12 nt, Human
cuggagcucugc

SEQ ID NO: 3073519 - RNA, 13 nt, Human
cuggagcucugcc

SEQ ID NO: 3073520 - RNA, 16 nt, Human
cuggagcucugcccau

SEQ ID NO: 3073521 - RNA, 13 nt, Human
cuggaauuugaaa

SEQ ID NO: 3073522 - RNA, 17 nt, Human
cuggacaggcauguucu

SEQ ID NO: 3073523 - RNA, 14 nt, Human
cuggacaggcaugu

SEQ ID NO: 3073524 - RNA, 23 nt, Human
cuggacaggcauguucucugagg

SEQ ID NO: 3073525 - RNA, 20 nt, Human
cuggaccuugaacuggguac

SEQ ID NO: 3073526 - RNA, 17 nt, Human
cuggaccuugaacuggg

SEQ ID NO: 3073527 - RNA, 21 nt, Human
cuggaccuugaacuggguacu

SEQ ID NO: 3073528 - RNA, 15 nt, Human
cuggacccuguggau

SEQ ID NO: 3073529 - RNA, 16 nt, Human
cuggaccuugaacugg

SEQ ID NO: 3073530 - RNA, 13 nt, Human
cuuauauuaugga

SEQ ID NO: 3073531 - RNA, 19 nt, Human
cuuauaucuauauuuuaca

SEQ ID NO: 3073532 - RNA, 15 nt, Human
cuuauacauuugaua

SEQ ID NO: 3073533 - RNA, 16 nt, Human
cuguucuggcagaguu

SEQ ID NO: 3073534 - RNA, 20 nt, Human
cuuagaugcaguucugaaga

SEQ ID NO: 3073535 - RNA, 13 nt, Human
cuuagauguauau

SEQ ID NO: 3073536 - RNA, 22 nt, Human
cuuagaugcaguucugaagaag

SEQ ID NO: 3073537 - RNA, 16 nt, Human
cuuagucacugagaca

SEQ ID NO: 3073538 - RNA, 18 nt, Human
cuuagucacugagacagc

SEQ ID NO: 3073539 - RNA, 19 nt, Human
cuuagucacugagacagcc

SEQ ID NO: 3073540 - RNA, 14 nt, Human
cuuagucacugaga

SEQ ID NO: 3073541 - RNA, 13 nt, Human
cuucaaggauccu

SEQ ID NO: 3073542 - RNA, 15 nt, Human
cuucaaggauccuga

SEQ ID NO: 3073543 - RNA, 10 nt, Human
cuucaaggau

SEQ ID NO: 3073544 - RNA, 23 nt, Human
cuucacagaugggugcuuggagg

SEQ ID NO: 3073545 - RNA, 18 nt, Human
cuuauuuaaugaaagacu

SEQ ID NO: 3073546 - RNA, 14 nt, Human
cuuauuucauuucu

SEQ ID NO: 3073547 - RNA, 17 nt, Human
cuuauuuaaugaaagac

SEQ ID NO: 3073548 - RNA, 15 nt, Human
cuuauuuccucauuu

SEQ ID NO: 3073549 - RNA, 15 nt, Human
cuuauuucauuucuu

SEQ ID NO: 3073550 - RNA, 13 nt, Human
cuucccuuucugc

SEQ ID NO: 3073551 - RNA, 15 nt, Human
cuuccaggcugggag

SEQ ID NO: 3073552 - RNA, 16 nt, Human
cuuccaggcugggaga

SEQ ID NO: 3073553 - RNA, 19 nt, Human
cuuccaggcugggagagcc

SEQ ID NO: 3073554 - RNA, 14 nt, Human
cuuccagggguggg

SEQ ID NO: 3073555 - RNA, 15 nt, Human
cuuccagggguggga

SEQ ID NO: 3073556 - RNA, 17 nt, Human
cuuccaggggugggaca

SEQ ID NO: 3073557 - RNA, 17 nt, Human
cuuccccuggcacuggc

SEQ ID NO: 3073558 - RNA, 16 nt, Human
cuucaguaagccguga

SEQ ID NO: 3073559 - RNA, 23 nt, Human
cuucaguaagccgugauuuucau

SEQ ID NO: 3073560 - RNA, 16 nt, Human
cuucaguggcagcugc

SEQ ID NO: 3073561 - RNA, 15 nt, Human
cuucaguggcagcug

SEQ ID NO: 3073562 - RNA, 14 nt, Human
cuucaguggcagcu

SEQ ID NO: 3073563 - RNA, 13 nt, Human
cuucaguggcagc

SEQ ID NO: 3073564 - RNA, 18 nt, Human
cuucagugccuuauggaa

SEQ ID NO: 3073565 - RNA, 22 nt, Human
cuucagugccuuauggaacacu

SEQ ID NO: 3073566 - RNA, 15 nt, Human
cuucaguaagccgug

SEQ ID NO: 3073567 - RNA, 20 nt, Human
cuucauucaacccaccugcg

SEQ ID NO: 3073568 - RNA, 19 nt, Human
cuuccacaagagcccaggc

SEQ ID NO: 3073569 - RNA, 21 nt, Human
cuuccacaagagcccaggccu

SEQ ID NO: 3073570 - RNA, 17 nt, Human
cuuccacaagagcccag

SEQ ID NO: 3073571 - RNA, 16 nt, Human
cuuccacaagagccca

SEQ ID NO: 3073572 - RNA, 12 nt, Human
cuuccaggcugg

SEQ ID NO: 3073573 - RNA, 14 nt, Human
cuuccaggcuggga

SEQ ID NO: 3073574 - RNA, 13 nt, Human
cuugaaaauuaac

SEQ ID NO: 3073575 - RNA, 12 nt, Human
cuugaaaauuaa

SEQ ID NO: 3073576 - RNA, 18 nt, Human
cuugaaaauuaacaugaa

SEQ ID NO: 3073577 - RNA, 18 nt, Human
cuugaaaaaugcauguug

SEQ ID NO: 3073578 - RNA, 12 nt, Human
cuugaaaaaugc

SEQ ID NO: 3073579 - RNA, 14 nt, Human
cuugaaaacacugu

SEQ ID NO: 3073580 - RNA, 23 nt, Human
cuugaaaacacuguucucugccc

SEQ ID NO: 3073581 - RNA, 14 nt, Human
cuucugugaaagua

SEQ ID NO: 3073582 - RNA, 14 nt, Human
cuucuguggguuuc

SEQ ID NO: 3073583 - RNA, 21 nt, Human
cuucuguggguuucuaaagcu

SEQ ID NO: 3073584 - RNA, 13 nt, Human
cuucuguggguuu

SEQ ID NO: 3073585 - RNA, 20 nt, Human
cuugaggguugggcuggugu

SEQ ID NO: 3073586 - RNA, 19 nt, Human
cuugaggguugggcuggug

SEQ ID NO: 3073587 - RNA, 21 nt, Human
cuugaguugauucagcucugc

SEQ ID NO: 3073588 - RNA, 21 nt, Human
cuugaggguugggcugguguc

SEQ ID NO: 3073589 - RNA, 13 nt, Human
cuugagcucagga

SEQ ID NO: 3073590 - RNA, 18 nt, Human
cuugagccuugaacuuug

SEQ ID NO: 3073591 - RNA, 17 nt, Human
cuugagccuugaacuuu

SEQ ID NO: 3073592 - RNA, 15 nt, Human
cuugagccuugaacu

SEQ ID NO: 3073593 - RNA, 16 nt, Human
cuugagccugggaggu

SEQ ID NO: 3073594 - RNA, 17 nt, Human
cuugaccgugaggccag

SEQ ID NO: 3073595 - RNA, 22 nt, Human
cuugaccauucuccaccugcca

SEQ ID NO: 3073596 - RNA, 23 nt, Human
cuugaccauucuccaccugccag

SEQ ID NO: 3073597 - RNA, 18 nt, Human
cuugaccgugaggccaga

SEQ ID NO: 3073598 - RNA, 20 nt, Human
cuugaccgugaggccagaga

SEQ ID NO: 3073599 - RNA, 21 nt, Human
cuugaccgugaggccagagac

SEQ ID NO: 3073600 - RNA, 13 nt, Human
cuugaccucaggu

SEQ ID NO: 3073601 - RNA, 13 nt, Human
cuugaacuccugg

SEQ ID NO: 3073602 - RNA, 21 nt, Human
cuugaacuuugaccucugcag

SEQ ID NO: 3073603 - RNA, 17 nt, Human
cuugaacuuugaccucu

SEQ ID NO: 3073604 - RNA, 21 nt, Human
cuucuguccuacucuguguca

SEQ ID NO: 3073605 - RNA, 18 nt, Human
cuucugucuucacaacag

SEQ ID NO: 3073606 - RNA, 22 nt, Human
cuucugucuucacaacagauua

SEQ ID NO: 3073607 - RNA, 21 nt, Human
cuucugucuucacaacagauu

SEQ ID NO: 3073608 - RNA, 19 nt, Human
cuucuguccuacucugugu

SEQ ID NO: 3073609 - RNA, 18 nt, Human
cuucuguccuacucugug

SEQ ID NO: 3073610 - RNA, 17 nt, Human
cuucuguccuacucugu

SEQ ID NO: 3073611 - RNA, 16 nt, Human
cuucuguccuacucug

SEQ ID NO: 3073612 - RNA, 20 nt, Human
cuucuguacgucugacaggc

SEQ ID NO: 3073613 - RNA, 18 nt, Human
cuucuguacgucugacag

SEQ ID NO: 3073614 - RNA, 15 nt, Human
cuucuguacgucuga

SEQ ID NO: 3073615 - RNA, 14 nt, Human
cuucuguacgucug

SEQ ID NO: 3073616 - RNA, 21 nt, Human
cuucuguacgucugacaggca

SEQ ID NO: 3073617 - RNA, 20 nt, Human
cuucugccauuucugagauc

SEQ ID NO: 3073618 - RNA, 13 nt, Human
cuucucugaagga

SEQ ID NO: 3073619 - RNA, 13 nt, Human
cuucucuccagcc

SEQ ID NO: 3073620 - RNA, 15 nt, Human
cuucucuccagcccc

SEQ ID NO: 3073621 - RNA, 17 nt, Human
cuucucuccagccccug

SEQ ID NO: 3073622 - RNA, 19 nt, Human
cuucucuccagccccugga

SEQ ID NO: 3073623 - RNA, 12 nt, Human
cuucucuccagc

SEQ ID NO: 3073624 - RNA, 11 nt, Human
cuucuccacuu

SEQ ID NO: 3073625 - RNA, 20 nt, Human
cuucuccacuuucuagccag

SEQ ID NO: 3073626 - RNA, 13 nt, Human
cuucuccaggcug

SEQ ID NO: 3073627 - RNA, 12 nt, Human
cuucuccaggcu

SEQ ID NO: 3073628 - RNA, 21 nt, Human
gaaagaguacucuuguuuccu

SEQ ID NO: 3073629 - RNA, 15 nt, Human
gaaagaguaggaaga

SEQ ID NO: 3073630 - RNA, 22 nt, Human
gaaagcagaacagugauuacca

SEQ ID NO: 3073631 - RNA, 14 nt, Human
gaaagcagaacagu

SEQ ID NO: 3073632 - RNA, 17 nt, Human
gaaagcagaacagugau

SEQ ID NO: 3073633 - RNA, 19 nt, Human
gaaagacuuuuccaacccu

SEQ ID NO: 3073634 - RNA, 17 nt, Human
gaaagagaacuuccaga

SEQ ID NO: 3073635 - RNA, 17 nt, Human
gaaagacuguacaaagu

SEQ ID NO: 3073636 - RNA, 21 nt, Human
gaaagaggaaugaaguacuca

SEQ ID NO: 3073637 - RNA, 20 nt, Human
gaaagaggcagcuugaaacu

SEQ ID NO: 3073638 - RNA, 21 nt, Human
gaaagcccugagcuuucugcu

SEQ ID NO: 3073639 - RNA, 22 nt, Human
gaaagcccugagcuuucugcua

SEQ ID NO: 3073640 - RNA, 17 nt, Human
gaaagcccugagcuuuc

SEQ ID NO: 3073641 - RNA, 14 nt, Human
gaaagcagggacuu

SEQ ID NO: 3073642 - RNA, 20 nt, Human
gaaaaugauacgcaacauaa

SEQ ID NO: 3073643 - RNA, 21 nt, Human
gaaacaagucagucauucaga

SEQ ID NO: 3073644 - RNA, 11 nt, Human
gaaacauuugg

SEQ ID NO: 3073645 - RNA, 16 nt, Human
gaaacacaacuauauu

SEQ ID NO: 3073646 - RNA, 15 nt, Human
gaaacccagcucugg

SEQ ID NO: 3073647 - RNA, 16 nt, Human
gaaacccagcucuggu

SEQ ID NO: 3073648 - RNA, 18 nt, Human
gaaacccagcucuggucc

SEQ ID NO: 3073649 - RNA, 19 nt, Human
gaaacccagcucuggucca

SEQ ID NO: 3073650 - RNA, 13 nt, Human
gaaacccagcucu

SEQ ID NO: 3073651 - RNA, 14 nt, Human
gaaacccagcucug

SEQ ID NO: 3073652 - RNA, 23 nt, Human
gaaacccagcucugguccauaga

SEQ ID NO: 3073653 - RNA, 14 nt, Human
gaaacccugucucu

SEQ ID NO: 3073654 - RNA, 23 nt, Human
gaaacucguuaauuuguaguguu

SEQ ID NO: 3073655 - RNA, 18 nt, Human
gaaaaucuuauaauuuaa

SEQ ID NO: 3073656 - RNA, 20 nt, Human
gaaaaucagccugcuccagc

SEQ ID NO: 3073657 - RNA, 22 nt, Human
gaaaaucagccugcuccagcug

SEQ ID NO: 3073658 - RNA, 22 nt, Human
gaaaaucuacacuccagugaga

SEQ ID NO: 3073659 - RNA, 21 nt, Human
gaaaauauuauguguuuccau

SEQ ID NO: 3073660 - RNA, 18 nt, Human
gaaaauauuuguaucaca

SEQ ID NO: 3073661 - RNA, 20 nt, Human
gaaaacguggcugcuucaag

SEQ ID NO: 3073662 - RNA, 22 nt, Human
gaaaacguggcugcuucaagga

SEQ ID NO: 3073663 - RNA, 19 nt, Human
gaaaacguggcugcuucaa

SEQ ID NO: 3073664 - RNA, 19 nt, Human
gaaaagcugcugacagugu

SEQ ID NO: 3073665 - RNA, 22 nt, Human
gaaaacacuguucucugcccuc

SEQ ID NO: 3073666 - RNA, 24 nt, Human
gaaaacacuguucucugcccucca

SEQ ID NO: 3073667 - RNA, 14 nt, Human
gaaaaguugaauuu

SEQ ID NO: 3073668 - RNA, 15 nt, Human
gaaaaguugaauuuu

SEQ ID NO: 3073669 - RNA, 17 nt, Human
cuuuuuauggccuguga

SEQ ID NO: 3073670 - RNA, 18 nt, Human
cuuuguuaguuucuccaa

SEQ ID NO: 3073671 - RNA, 12 nt, Human
cuuuuguucuug

SEQ ID NO: 3073672 - RNA, 11 nt, Human
cuuuuguucuu

SEQ ID NO: 3073673 - RNA, 19 nt, Human
gaaaacacauuuuucuuag

SEQ ID NO: 3073674 - RNA, 18 nt, Human
gaaaacacauuuuucuua

SEQ ID NO: 3073675 - RNA, 14 nt, Human
gaaaacacauuuuu

SEQ ID NO: 3073676 - RNA, 12 nt, Human
gaaaaaggagga

SEQ ID NO: 3073677 - RNA, 15 nt, Human
gaaaaaggaggaaga

SEQ ID NO: 3073678 - RNA, 16 nt, Human
cuuuuuuggcugcuga

SEQ ID NO: 3073679 - RNA, 20 nt, Human
cuuuuuuggcugcugaaggc

SEQ ID NO: 3073680 - RNA, 22 nt, Human
cuuuuuuggcugcugaaggcuc

SEQ ID NO: 3073681 - RNA, 17 nt, Human
cuuuuuuggcugcugaa

SEQ ID NO: 3073682 - RNA, 21 nt, Human
cuuuaucaaagggugaaaauu

SEQ ID NO: 3073683 - RNA, 22 nt, Human
cuuuaucaaagggugaaaauua

SEQ ID NO: 3073684 - RNA, 19 nt, Human
cuuuauaauucuacuuuga

SEQ ID NO: 3073685 - RNA, 13 nt, Human
cuuuauaauucua

SEQ ID NO: 3073686 - RNA, 14 nt, Human
cuuuagcgcccagu

SEQ ID NO: 3073687 - RNA, 21 nt, Human
cuuuaucuugaauaauguaag

SEQ ID NO: 3073688 - RNA, 18 nt, Human
cuuuaucuugaauaaugu

SEQ ID NO: 3073689 - RNA, 23 nt, Human
cuuuaucuugaauaauguaagac

SEQ ID NO: 3073690 - RNA, 15 nt, Human
cuuuaugcacaaaau

SEQ ID NO: 3073691 - RNA, 22 nt, Human
cuuuaccuuuuuuauacauaaa

SEQ ID NO: 3073692 - RNA, 13 nt, Human
cuuuacuauggcc

SEQ ID NO: 3073693 - RNA, 19 nt, Human
cuugaguuuaaauuguaau

SEQ ID NO: 3073694 - RNA, 23 nt, Human
cuuggggggcugaggugggagga

SEQ ID NO: 3073695 - RNA, 22 nt, Human
cuuggggggcugaggugggagg

SEQ ID NO: 3073696 - RNA, 16 nt, Human
cuuguaaauagcucag

SEQ ID NO: 3073697 - RNA, 21 nt, Human
cuuguacauaaugcgugcaua

SEQ ID NO: 3073698 - RNA, 19 nt, Human
cuuguacauaaugcgugca

SEQ ID NO: 3073699 - RNA, 22 nt, Human
cuuguacauaaugcgugcauac

SEQ ID NO: 3073700 - RNA, 12 nt, Human
cuuguacauaau

SEQ ID NO: 3073701 - RNA, 15 nt, Human
cuuguacauaaugcg

SEQ ID NO: 3073702 - RNA, 18 nt, Human
cuuguaaauagcucaggu

SEQ ID NO: 3073703 - RNA, 17 nt, Human
cuuguaaauagcucagg

SEQ ID NO: 3073704 - RNA, 23 nt, Human
cuugucaauaaaauccauacauu

SEQ ID NO: 3073705 - RNA, 16 nt, Human
cuuuggcccagggugg

SEQ ID NO: 3073706 - RNA, 14 nt, Human
cuuuggcccagggu

SEQ ID NO: 3073707 - RNA, 15 nt, Human
cuuuggcccagggug

SEQ ID NO: 3073708 - RNA, 19 nt, Human
cuuuggcuauuagagauca

SEQ ID NO: 3073709 - RNA, 13 nt, Human
cuuuggcccaggg

SEQ ID NO: 3073710 - RNA, 14 nt, Human
cuuuguccccaccg

SEQ ID NO: 3073711 - RNA, 19 nt, Human
cuuugugauuuuuguaauu

SEQ ID NO: 3073712 - RNA, 15 nt, Human
cuuugugaggaagcc

SEQ ID NO: 3073713 - RNA, 15 nt, Human
cuuuguccccaccgc

SEQ ID NO: 3073714 - RNA, 24 nt, Human
cuuugaccucugcagcaauaaagc

SEQ ID NO: 3073715 - RNA, 20 nt, Human
cuuugaccucugcagcaaua

SEQ ID NO: 3073716 - RNA, 18 nt, Human
cuuugaccucugcagcaa

SEQ ID NO: 3073717 - RNA, 17 nt, Human
cuuugaccucugcagca

SEQ ID NO: 3073718 - RNA, 15 nt, Human
cuuugaccucugcag

SEQ ID NO: 3073719 - RNA, 14 nt, Human
cuuugaccucugca

SEQ ID NO: 3073720 - RNA, 13 nt, Human
cuuugaccucugc

SEQ ID NO: 3073721 - RNA, 16 nt, Human
cuuugcagacaggcaa

SEQ ID NO: 3073722 - RNA, 20 nt, Human
cuuugcagacaggcaagcac

SEQ ID NO: 3073723 - RNA, 16 nt, Human
cuuucugcuuguguua

SEQ ID NO: 3073724 - RNA, 13 nt, Human
cuuuccugaggcu

SEQ ID NO: 3073725 - RNA, 15 nt, Human
cuuuccugaggcugg

SEQ ID NO: 3073726 - RNA, 20 nt, Human
cuuucuggcuaugcauuuga

SEQ ID NO: 3073727 - RNA, 19 nt, Human
cuuucuggcuaugcauuug

SEQ ID NO: 3073728 - RNA, 18 nt, Human
cuuucuggcuaugcauuu

SEQ ID NO: 3073729 - RNA, 17 nt, Human
cuuucuggcuaugcauu

SEQ ID NO: 3073730 - RNA, 15 nt, Human
cuuuccaucuacccu

SEQ ID NO: 3073731 - RNA, 15 nt, Human
cuuuccaggaaggcu

SEQ ID NO: 3073732 - RNA, 16 nt, Human
cuuucccucccuuccu

SEQ ID NO: 3073733 - RNA, 14 nt, Human
cuuucccucccuuc

SEQ ID NO: 3073734 - RNA, 13 nt, Human
cuuucccucccuu

SEQ ID NO: 3073735 - RNA, 11 nt, Human
cuuucccuccc

SEQ ID NO: 3073736 - RNA, 12 nt, Human
cuuuccugaggc

SEQ ID NO: 3073737 - RNA, 16 nt, Human
cuuuccucuuuggucu

SEQ ID NO: 3073738 - RNA, 15 nt, Human
cuaaauuuuauaucu

SEQ ID NO: 3073739 - RNA, 16 nt, Human
cuaaauuuuauaucuu

SEQ ID NO: 3073740 - RNA, 13 nt, Human
cuaaauuuuauau

SEQ ID NO: 3073741 - RNA, 20 nt, Human
cuaaauuuuauaucuuguag

SEQ ID NO: 3073742 - RNA, 16 nt, Human
cuaaauucaugcugcu

SEQ ID NO: 3073743 - RNA, 19 nt, Human
cuaaauucuuucauuuuag

SEQ ID NO: 3073744 - RNA, 19 nt, Human
cuaaauugacacuuaaaaa

SEQ ID NO: 3073745 - RNA, 14 nt, Human
cuaaccacgcugga

SEQ ID NO: 3073746 - RNA, 12 nt, Human
cuaaccacgcug

SEQ ID NO: 3073747 - RNA, 16 nt, Human
cuaagauaguaacaau

SEQ ID NO: 3073748 - RNA, 23 nt, Human
cuaagagggagggagggcuccag

SEQ ID NO: 3073749 - RNA, 15 nt, Human
cuaagagggagggag

SEQ ID NO: 3073750 - RNA, 22 nt, Human
cuaagagggagggagggcucca

SEQ ID NO: 3073751 - RNA, 13 nt, Human
cuaagagggaggg

SEQ ID NO: 3073752 - RNA, 14 nt, Human
cuaagagagaauga

SEQ ID NO: 3073753 - RNA, 15 nt, Human
cuaagagagaaugag

SEQ ID NO: 3073754 - RNA, 21 nt, Human
cgggaggauguucugggacac

SEQ ID NO: 3073755 - RNA, 23 nt, Human
cgggaggauguucugggacacag

SEQ ID NO: 3073756 - RNA, 20 nt, Human
cgggaggcagagguugcagu

SEQ ID NO: 3073757 - RNA, 23 nt, Human
cgggaccccgagccuggcuccaa

SEQ ID NO: 3073758 - RNA, 20 nt, Human
cuaaaucuccaaaauaaaac

SEQ ID NO: 3073759 - RNA, 21 nt, Human
cuaaaucuccaaaauaaaacu

SEQ ID NO: 3073760 - RNA, 22 nt, Human
cuaaaugaaaaucgugacaaca

SEQ ID NO: 3073761 - RNA, 21 nt, Human
cuaagcuucacuguaaaauaa

SEQ ID NO: 3073762 - RNA, 22 nt, Human
cuaagcuauucaguaauaacuc

SEQ ID NO: 3073763 - RNA, 14 nt, Human
cuaauaaagcugug

SEQ ID NO: 3073764 - RNA, 19 nt, Human
cuaaguaaaaccacagcag

SEQ ID NO: 3073765 - RNA, 18 nt, Human
cuaaguaaaaccacagca

SEQ ID NO: 3073766 - RNA, 14 nt, Human
cuaaguaaaaccac

SEQ ID NO: 3073767 - RNA, 23 nt, Human
cuaauagacaauuuauuauggca

SEQ ID NO: 3073768 - RNA, 19 nt, Human
cuaauagacaauuuauuau

SEQ ID NO: 3073769 - RNA, 17 nt, Human
cuaauagacaauuuauu

SEQ ID NO: 3073770 - RNA, 23 nt, Human
cuacacgagauacagaauuuuau

SEQ ID NO: 3073771 - RNA, 14 nt, Human
cuacacuaagagag

SEQ ID NO: 3073772 - RNA, 21 nt, Human
cuacacaggggaaaagaggag

SEQ ID NO: 3073773 - RNA, 21 nt, Human
cuacacacugcauguuuguga

SEQ ID NO: 3073774 - RNA, 13 nt, Human
cuaaugggacacu

SEQ ID NO: 3073775 - RNA, 12 nt, Human
cuaaugggacac

SEQ ID NO: 3073776 - RNA, 22 nt, Human
cuacauuauaaaugucucuuua

SEQ ID NO: 3073777 - RNA, 14 nt, Human
cuacauucuguuaa

SEQ ID NO: 3073778 - RNA, 13 nt, Human
cuacauucuguua

SEQ ID NO: 3073779 - RNA, 18 nt, Human
cuaccauccccuguagag

SEQ ID NO: 3073780 - RNA, 17 nt, Human
cuacccagcgagcccug

SEQ ID NO: 3073781 - RNA, 15 nt, Human
cuacccagcgagccc

SEQ ID NO: 3073782 - RNA, 12 nt, Human
cuacccaggugc

SEQ ID NO: 3073783 - RNA, 13 nt, Human
cuacccaggugcu

SEQ ID NO: 3073784 - RNA, 18 nt, Human
cuacccagcgagcccugg

SEQ ID NO: 3073785 - RNA, 17 nt, Human
cuacccucuuagaaaaa

SEQ ID NO: 3073786 - RNA, 13 nt, Human
cuacacugugcug

SEQ ID NO: 3073787 - RNA, 14 nt, Human
cuacacugugcuga

SEQ ID NO: 3073788 - RNA, 17 nt, Human
cuacacugugcugaguc

SEQ ID NO: 3073789 - RNA, 17 nt, Human
cuacagaggccaugggc

SEQ ID NO: 3073790 - RNA, 20 nt, Human
cuacagaggccaugggccuc

SEQ ID NO: 3073791 - RNA, 18 nt, Human
cuacagaggccaugggcc

SEQ ID NO: 3073792 - RNA, 22 nt, Human
cuacagaggccaugggccuccu

SEQ ID NO: 3073793 - RNA, 19 nt, Human
cuacagcuugaccgugagg

SEQ ID NO: 3073794 - RNA, 22 nt, Human
cuacagcuugaccgugaggcca

SEQ ID NO: 3073795 - RNA, 23 nt, Human
cuacagcuugaccgugaggccag

SEQ ID NO: 3073796 - RNA, 16 nt, Human
cuacaggagugagcac

SEQ ID NO: 3073797 - RNA, 15 nt, Human
cuacaggagugagca

SEQ ID NO: 3073798 - RNA, 14 nt, Human
cuacaggagugagc

SEQ ID NO: 3073799 - RNA, 17 nt, Human
cuacaggcacccaccau

SEQ ID NO: 3073800 - RNA, 15 nt, Human
cuacaggcacccacc

SEQ ID NO: 3073801 - RNA, 20 nt, Human
cuacauggaguauaugucaa

SEQ ID NO: 3073802 - RNA, 18 nt, Human
cuacauggaguauauguc

SEQ ID NO: 3073803 - RNA, 13 nt, Human
cuacaguccuccc

SEQ ID NO: 3073804 - RNA, 14 nt, Human
cuacaggugugagu

SEQ ID NO: 3073805 - RNA, 16 nt, Human
cuacaggugugaguca

SEQ ID NO: 3073806 - RNA, 13 nt, Human
cucaaauuucuaa

SEQ ID NO: 3073807 - RNA, 17 nt, Human
cucaaauuucuaaaucu

SEQ ID NO: 3073808 - RNA, 15 nt, Human
cucaaauuucuaaau

SEQ ID NO: 3073809 - RNA, 14 nt, Human
cucaacucuccucc

SEQ ID NO: 3073810 - RNA, 14 nt, Human
cucaaauuucuaaa

SEQ ID NO: 3073811 - RNA, 23 nt, Human
cucacacggacacucaaaagcug

SEQ ID NO: 3073812 - RNA, 16 nt, Human
cucaacucuccuccag

SEQ ID NO: 3073813 - RNA, 18 nt, Human
cucaacucuccuccagag

SEQ ID NO: 3073814 - RNA, 18 nt, Human
cuauuguuagucucuuga

SEQ ID NO: 3073815 - RNA, 16 nt, Human
cuauugcugcuugagg

SEQ ID NO: 3073816 - RNA, 21 nt, Human
cuauucaggagaguagaacag

SEQ ID NO: 3073817 - RNA, 17 nt, Human
cuauucaguaauaacuc

SEQ ID NO: 3073818 - RNA, 13 nt, Human
cuauguaucaaug

SEQ ID NO: 3073819 - RNA, 23 nt, Human
cuauucaguaauaacucuacccu

SEQ ID NO: 3073820 - RNA, 22 nt, Human
cuaugaaguuuuuuuuauacag

SEQ ID NO: 3073821 - RNA, 21 nt, Human
cuaugcauuugaaaauuuuga

SEQ ID NO: 3073822 - RNA, 18 nt, Human
cuaugaaauauuauguua

SEQ ID NO: 3073823 - RNA, 19 nt, Human
cuaugaaauauuauguuaa

SEQ ID NO: 3073824 - RNA, 12 nt, Human
cuauaauuuaaa

SEQ ID NO: 3073825 - RNA, 20 nt, Human
cuaggaacacuccuucacag

SEQ ID NO: 3073826 - RNA, 15 nt, Human
cuaggaagacuuugg

SEQ ID NO: 3073827 - RNA, 17 nt, Human
cuaggaagacuuuggaa

SEQ ID NO: 3073828 - RNA, 21 nt, Human
cuauagccuaggugacagagu

SEQ ID NO: 3073829 - RNA, 20 nt, Human
cuauagccuaggugacagag

SEQ ID NO: 3073830 - RNA, 18 nt, Human
cuauagccuaggugacag

SEQ ID NO: 3073831 - RNA, 19 nt, Human
cuauagccuaggugacaga

SEQ ID NO: 3073832 - RNA, 22 nt, Human
cuagcuaauguaauaacuguga

SEQ ID NO: 3073833 - RNA, 23 nt, Human
cuagccuuagaagucacacagua

SEQ ID NO: 3073834 - RNA, 22 nt, Human
cuagccuuagaagucacacagu

SEQ ID NO: 3073835 - RNA, 19 nt, Human
cuagccugugccucuggga

SEQ ID NO: 3073836 - RNA, 21 nt, Human
cuagccugugccucugggacu

SEQ ID NO: 3073837 - RNA, 22 nt, Human
cuagccugugccucugggacug

SEQ ID NO: 3073838 - RNA, 21 nt, Human
cuagccuuagaagucacacag

SEQ ID NO: 3073839 - RNA, 16 nt, Human
cuagauacuguaucau

SEQ ID NO: 3073840 - RNA, 13 nt, Human
cuagauacuguau

SEQ ID NO: 3073841 - RNA, 24 nt, Human
cuagauacuguaucaugacaaaga

SEQ ID NO: 3073842 - RNA, 14 nt, Human
cuaggaaauauuua

SEQ ID NO: 3073843 - RNA, 15 nt, Human
cuaggaaauauuuau

SEQ ID NO: 3073844 - RNA, 19 nt, Human
cuaggaaauauuuauuuua

SEQ ID NO: 3073845 - RNA, 20 nt, Human
cuaggaaauauuuauuuuaa

SEQ ID NO: 3073846 - RNA, 23 nt, Human
cuacugccauccuggcccagggc

SEQ ID NO: 3073847 - RNA, 14 nt, Human
cuacugccauccug

SEQ ID NO: 3073848 - RNA, 15 nt, Human
cuacugccauccugg

SEQ ID NO: 3073849 - RNA, 16 nt, Human
cuacugccauccuggc

SEQ ID NO: 3073850 - RNA, 17 nt, Human
cuacugccauccuggcc

SEQ ID NO: 3073851 - RNA, 18 nt, Human
cuacugccauccuggccc

SEQ ID NO: 3073852 - RNA, 19 nt, Human
cuacugccauccuggccca

SEQ ID NO: 3073853 - RNA, 20 nt, Human
cuacugccauccuggcccag

SEQ ID NO: 3073854 - RNA, 22 nt, Human
cuacugccauccuggcccaggg

SEQ ID NO: 3073855 - RNA, 21 nt, Human
cuacuguaauuugugauacaa

SEQ ID NO: 3073856 - RNA, 19 nt, Human
cuacuguccuacccacccu

SEQ ID NO: 3073857 - RNA, 12 nt, Human
cuacucuguguc

SEQ ID NO: 3073858 - RNA, 16 nt, Human
cuacucgaguuacaga

SEQ ID NO: 3073859 - RNA, 19 nt, Human
cuacucgaguuacagacaa

SEQ ID NO: 3073860 - RNA, 15 nt, Human
cuacucgaguuacag

SEQ ID NO: 3073861 - RNA, 15 nt, Human
cuagagguucaaaga

SEQ ID NO: 3073862 - RNA, 18 nt, Human
cuagaguuuagcuggaaa

SEQ ID NO: 3073863 - RNA, 19 nt, Human
cuagaguuuagcuggaaaa

SEQ ID NO: 3073864 - RNA, 21 nt, Human
cuagagguucaaagauauuuu

SEQ ID NO: 3073865 - RNA, 18 nt, Human
cuagagguucaaagauau

SEQ ID NO: 3073866 - RNA, 17 nt, Human
cuagagguucaaagaua

SEQ ID NO: 3073867 - RNA, 20 nt, Human
cuacuguccuacccacccuc

SEQ ID NO: 3073868 - RNA, 24 nt, Human
cucaggagcccugggaggcucugg

SEQ ID NO: 3073869 - RNA, 18 nt, Human
cucaggcaggugggaugg

SEQ ID NO: 3073870 - RNA, 15 nt, Human
cucaggcagguggga

SEQ ID NO: 3073871 - RNA, 19 nt, Human
cucagggccuggcucaggu

SEQ ID NO: 3073872 - RNA, 20 nt, Human
cucagggccuggcucaggug

SEQ ID NO: 3073873 - RNA, 18 nt, Human
cucagggccuggcucagg

SEQ ID NO: 3073874 - RNA, 23 nt, Human
cucaggugauccacccaccucag

SEQ ID NO: 3073875 - RNA, 22 nt, Human
cucaggugauccacccaccuca

SEQ ID NO: 3073876 - RNA, 19 nt, Human
cucagguggggucacucug

SEQ ID NO: 3073877 - RNA, 20 nt, Human
cucagguggggucacucugg

SEQ ID NO: 3073878 - RNA, 21 nt, Human
cucagguggggucacucuggc

SEQ ID NO: 3073879 - RNA, 14 nt, Human
cucagggccugguc

SEQ ID NO: 3073880 - RNA, 20 nt, Human
cucagggucccugguggcag

SEQ ID NO: 3073881 - RNA, 21 nt, Human
cucagggucccugguggcagc

SEQ ID NO: 3073882 - RNA, 22 nt, Human
cucagggucccugguggcagcu

SEQ ID NO: 3073883 - RNA, 24 nt, Human
cucagggucccugguggcagcuca

SEQ ID NO: 3073884 - RNA, 18 nt, Human
cucagggucccugguggc

SEQ ID NO: 3073885 - RNA, 23 nt, Human
cucaggagcccugggaggcucug

SEQ ID NO: 3073886 - RNA, 22 nt, Human
cucaggagcccugggaggcucu

SEQ ID NO: 3073887 - RNA, 21 nt, Human
cucaggagcccugggaggcuc

SEQ ID NO: 3073888 - RNA, 20 nt, Human
cucaggagcccugggaggcu

SEQ ID NO: 3073889 - RNA, 17 nt, Human
cucaggagcccugggag

SEQ ID NO: 3073890 - RNA, 16 nt, Human
cucaggagcccuggga

SEQ ID NO: 3073891 - RNA, 15 nt, Human
cucaggagcccuggg

SEQ ID NO: 3073892 - RNA, 14 nt, Human
cucaggagcccugg

SEQ ID NO: 3073893 - RNA, 13 nt, Human
cucaggagcccug

SEQ ID NO: 3073894 - RNA, 12 nt, Human
cucaggagcccu

SEQ ID NO: 3073895 - RNA, 22 nt, Human
cucaggaaaucaaauaugcaaa

SEQ ID NO: 3073896 - RNA, 19 nt, Human
cucagcaaaagaugcuucu

SEQ ID NO: 3073897 - RNA, 20 nt, Human
cucagcaaaagaugcuucuc

SEQ ID NO: 3073898 - RNA, 16 nt, Human
cucagcaggggagggu

SEQ ID NO: 3073899 - RNA, 22 nt, Human
cucagcauccuggcacccggcc

SEQ ID NO: 3073900 - RNA, 21 nt, Human
cucagcauccuggcacccggc

SEQ ID NO: 3073901 - RNA, 13 nt, Human
cucagcauccugg

SEQ ID NO: 3073902 - RNA, 21 nt, Human
cucagcggggacagcuccuuc

SEQ ID NO: 3073903 - RNA, 20 nt, Human
cucagcggggacagcuccuu

SEQ ID NO: 3073904 - RNA, 19 nt, Human
cucagcggggacagcuccu

SEQ ID NO: 3073905 - RNA, 18 nt, Human
cucagcggggacagcucc

SEQ ID NO: 3073906 - RNA, 16 nt, Human
cucagcggggacagcu

SEQ ID NO: 3073907 - RNA, 15 nt, Human
cucagcggggacagc

SEQ ID NO: 3073908 - RNA, 14 nt, Human
cucagcggggacag

SEQ ID NO: 3073909 - RNA, 23 nt, Human
cucagcggggacagcuccuucug

SEQ ID NO: 3073910 - RNA, 13 nt, Human
cucagcggggaca

SEQ ID NO: 3073911 - RNA, 14 nt, Human
cucacugcagccuc

SEQ ID NO: 3073912 - RNA, 16 nt, Human
cucacugcagccucaa

SEQ ID NO: 3073913 - RNA, 15 nt, Human
cucacugcagccuca

SEQ ID NO: 3073914 - RNA, 15 nt, Human
cucacuguugcccag

SEQ ID NO: 3073915 - RNA, 14 nt, Human
cucacuguugccca

SEQ ID NO: 3073916 - RNA, 16 nt, Human
cucagaucuucugugg

SEQ ID NO: 3073917 - RNA, 21 nt, Human
cucagaugcacaugagcuggc

SEQ ID NO: 3073918 - RNA, 19 nt, Human
cucacuguugcccaggcug

SEQ ID NO: 3073919 - RNA, 18 nt, Human
cucacuguugcccaggcu

SEQ ID NO: 3073920 - RNA, 17 nt, Human
cucacuguugcccaggc

SEQ ID NO: 3073921 - RNA, 16 nt, Human
cucacuguugcccagg

SEQ ID NO: 3073922 - RNA, 23 nt, Human
cucagagagggugggagugggcc

SEQ ID NO: 3073923 - RNA, 19 nt, Human
cucagagagggugggagug

SEQ ID NO: 3073924 - RNA, 18 nt, Human
cucagagagggugggagu

SEQ ID NO: 3073925 - RNA, 14 nt, Human
cuccccucggagaa

SEQ ID NO: 3073926 - RNA, 14 nt, Human
cuccccugcugggu

SEQ ID NO: 3073927 - RNA, 21 nt, Human
cuccccugcuggguguggcgc

SEQ ID NO: 3073928 - RNA, 23 nt, Human
cuccccugcuggguguggcgcag

SEQ ID NO: 3073929 - RNA, 15 nt, Human
cucccuucauccuuc

SEQ ID NO: 3073930 - RNA, 14 nt, Human
cucccugcugcucc

SEQ ID NO: 3073931 - RNA, 16 nt, Human
cucccugcugcuccua

SEQ ID NO: 3073932 - RNA, 17 nt, Human
cucccugcugcuccuag

SEQ ID NO: 3073933 - RNA, 19 nt, Human
cucccgaauagcugggacu

SEQ ID NO: 3073934 - RNA, 23 nt, Human
cucccgaauagcugggacuacag

SEQ ID NO: 3073935 - RNA, 20 nt, Human
cucccgaauagcugggacua

SEQ ID NO: 3073936 - RNA, 23 nt, Human
cucccaaagugcugggauuacag

SEQ ID NO: 3073937 - RNA, 16 nt, Human
cucccaaagugcuggg

SEQ ID NO: 3073938 - RNA, 14 nt, Human
cucccaacucaccc

SEQ ID NO: 3073939 - RNA, 15 nt, Human
cucccaacucacccc

SEQ ID NO: 3073940 - RNA, 15 nt, Human
cucccacaaaggaga

SEQ ID NO: 3073941 - RNA, 21 nt, Human
cuccagcugcugagauccugg

SEQ ID NO: 3073942 - RNA, 23 nt, Human
cuccagcugcugagauccuggac

SEQ ID NO: 3073943 - RNA, 20 nt, Human
cuccagcugcugagauccug

SEQ ID NO: 3073944 - RNA, 14 nt, Human
cuccagcugcugag

SEQ ID NO: 3073945 - RNA, 16 nt, Human
cucccaucacuucccu

SEQ ID NO: 3073946 - RNA, 14 nt, Human
cucccaucacccgc

SEQ ID NO: 3073947 - RNA, 24 nt, Human
cucccaugagggagaugccaugag

SEQ ID NO: 3073948 - RNA, 21 nt, Human
cucauaaaaagccugcaauuu

SEQ ID NO: 3073949 - RNA, 17 nt, Human
cucauugaccugaggcc

SEQ ID NO: 3073950 - RNA, 22 nt, Human
cucauucuccuuguguuacuaa

SEQ ID NO: 3073951 - RNA, 18 nt, Human
cucauucuccuuguguua

SEQ ID NO: 3073952 - RNA, 19 nt, Human
cucauugaccugaggcccu

SEQ ID NO: 3073953 - RNA, 21 nt, Human
cucauugaccugaggcccuuc

SEQ ID NO: 3073954 - RNA, 18 nt, Human
cucauuugucacacacuu

SEQ ID NO: 3073955 - RNA, 17 nt, Human
cucauuuccaagcaagu

SEQ ID NO: 3073956 - RNA, 21 nt, Human
cucauuugucacacacuuugg

SEQ ID NO: 3073957 - RNA, 13 nt, Human
cucauuuccaagc

SEQ ID NO: 3073958 - RNA, 14 nt, Human
cucauuuccaagca

SEQ ID NO: 3073959 - RNA, 12 nt, Human
cucauuuccaag

SEQ ID NO: 3073960 - RNA, 17 nt, Human
cuccaagcucccaggca

SEQ ID NO: 3073961 - RNA, 21 nt, Human
cuccaaacccucgaggcggau

SEQ ID NO: 3073962 - RNA, 18 nt, Human
cuccaaaauaaaacuuuu

SEQ ID NO: 3073963 - RNA, 23 nt, Human
cucauuuuuauaaugucccuuca

SEQ ID NO: 3073964 - RNA, 17 nt, Human
cuccaaacccucgaggc

SEQ ID NO: 3073965 - RNA, 15 nt, Human
cuccaaacccucgag

SEQ ID NO: 3073966 - RNA, 16 nt, Human
cuccagagucagaagu

SEQ ID NO: 3073967 - RNA, 18 nt, Human
cuccagagccccacagcc

SEQ ID NO: 3073968 - RNA, 21 nt, Human
cuccagagccccacagcccca

SEQ ID NO: 3073969 - RNA, 16 nt, Human
cuccagagccccacag

SEQ ID NO: 3073970 - RNA, 13 nt, Human
cuccagccccugg

SEQ ID NO: 3073971 - RNA, 14 nt, Human
cuccagccccugga

SEQ ID NO: 3073972 - RNA, 11 nt, Human
cuccagccccu

SEQ ID NO: 3073973 - RNA, 18 nt, Human
cuccagcucaccagcccc

SEQ ID NO: 3073974 - RNA, 16 nt, Human
cuccagcucaccagcc

SEQ ID NO: 3073975 - RNA, 15 nt, Human
cuccagcucaccagc

SEQ ID NO: 3073976 - RNA, 14 nt, Human
cuccagcucaccag

SEQ ID NO: 3073977 - RNA, 20 nt, Human
ccugugccucugggacugga

SEQ ID NO: 3073978 - RNA, 18 nt, Human
ccuguggaucaaauccag

SEQ ID NO: 3073979 - RNA, 20 nt, Human
ccuguggaugauaaaacaca

SEQ ID NO: 3073980 - RNA, 17 nt, Human
ccuguggaugcugcugc

SEQ ID NO: 3073981 - RNA, 19 nt, Human
ccuguggaugcugcugccc

SEQ ID NO: 3073982 - RNA, 20 nt, Human
ccugugggcccccaaaugga

SEQ ID NO: 3073983 - RNA, 17 nt, Human
ccuuccauggacuuugu

SEQ ID NO: 3073984 - RNA, 13 nt, Human
ccuuccaggggug

SEQ ID NO: 3073985 - RNA, 16 nt, Human
ccuucggccuccaucc

SEQ ID NO: 3073986 - RNA, 17 nt, Human
ccuucggccuccauccu

SEQ ID NO: 3073987 - RNA, 18 nt, Human
ccuucggccuccauccug

SEQ ID NO: 3073988 - RNA, 12 nt, Human
ccuucucuccag

SEQ ID NO: 3073989 - RNA, 13 nt, Human
ccuucucuccagc

SEQ ID NO: 3073990 - RNA, 15 nt, Human
ccuucucuccagccc

SEQ ID NO: 3073991 - RNA, 16 nt, Human
ccuucucuccagcccc

SEQ ID NO: 3073992 - RNA, 19 nt, Human
ccuucucuccagccccugg

SEQ ID NO: 3073993 - RNA, 15 nt, Human
ccuuggauugucccc

SEQ ID NO: 3073994 - RNA, 15 nt, Human
ccuuggacucauuuu

SEQ ID NO: 3073995 - RNA, 22 nt, Human
ccuuggcucaaguccucuuuuc

SEQ ID NO: 3073996 - RNA, 17 nt, Human
ccuucucuccagccccu

SEQ ID NO: 3073997 - RNA, 18 nt, Human
ccuucucuccagccccug

SEQ ID NO: 3073998 - RNA, 21 nt, Human
ccuugacagggcacaccgggc

SEQ ID NO: 3073999 - RNA, 18 nt, Human
ccuugacagggcacaccg

SEQ ID NO: 3074000 - RNA, 14 nt, Human
ccuuggggagcagg

SEQ ID NO: 3074001 - RNA, 16 nt, Human
ccuuggcugcagggag

SEQ ID NO: 3074002 - RNA, 14 nt, Human
ccuuggcugcaggg

SEQ ID NO: 3074003 - RNA, 19 nt, Human
ccuuggugucgggcaugac

SEQ ID NO: 3074004 - RNA, 20 nt, Human
ccuuggugucgggcaugaca

SEQ ID NO: 3074005 - RNA, 14 nt, Human
ccuuuguccccacc

SEQ ID NO: 3074006 - RNA, 16 nt, Human
ccuuuguccccaccgc

SEQ ID NO: 3074007 - RNA, 18 nt, Human
ccuuuguccccaccgcag

SEQ ID NO: 3074008 - RNA, 23 nt, Human
ccuuuguauucucuccuguaccu

SEQ ID NO: 3074009 - RNA, 22 nt, Human
ccuuuguauucucuccuguacc

SEQ ID NO: 3074010 - RNA, 24 nt, Human
ccuuuguauucucuccuguaccuc

SEQ ID NO: 3074011 - RNA, 23 nt, Human
ccuugucggccccaccagugccu

SEQ ID NO: 3074012 - RNA, 15 nt, Human
ccuuuuuuggcugcu

SEQ ID NO: 3074013 - RNA, 19 nt, Human
ccuuuuuuauacauaaaca

SEQ ID NO: 3074014 - RNA, 15 nt, Human
ccuuugugaggaagc

SEQ ID NO: 3074015 - RNA, 16 nt, Human
ccuuugugaggaagcc

SEQ ID NO: 3074016 - RNA, 17 nt, Human
ccuuugugaggaagccg

SEQ ID NO: 3074017 - RNA, 23 nt, Human
ccuuugugaggaagccgcugggg

SEQ ID NO: 3074018 - RNA, 22 nt, Human
ccuuuguccccaccgcagacag

SEQ ID NO: 3074019 - RNA, 23 nt, Human
ccuuuguccccaccgcagacagg

SEQ ID NO: 3074020 - RNA, 14 nt, Human
ccuuugugaggaag

SEQ ID NO: 3074021 - RNA, 23 nt, Human
cgaagaguauuuuugacagaaua

SEQ ID NO: 3074022 - RNA, 23 nt, Human
cgaacauguuuuucuucucccuc

SEQ ID NO: 3074023 - RNA, 21 nt, Human
cgaacauguuuuucuucuccc

SEQ ID NO: 3074024 - RNA, 17 nt, Human
ccuuuuuuggcugcuga

SEQ ID NO: 3074025 - RNA, 18 nt, Human
ccuuuuuuggcugcugaa

SEQ ID NO: 3074026 - RNA, 20 nt, Human
ccuuuuuuggcugcugaagg

SEQ ID NO: 3074027 - RNA, 22 nt, Human
ccuuuuuuggcugcugaaggcu

SEQ ID NO: 3074028 - RNA, 23 nt, Human
cgaaagggacuuggaagcuccgc

SEQ ID NO: 3074029 - RNA, 12 nt, Human
cgaauauugcug

SEQ ID NO: 3074030 - RNA, 14 nt, Human
cgaauauugcugau

SEQ ID NO: 3074031 - RNA, 11 nt, Human
cgaauauugcu

SEQ ID NO: 3074032 - RNA, 16 nt, Human
cgaauagcugggacua

SEQ ID NO: 3074033 - RNA, 15 nt, Human
cgaauagcugggacu

SEQ ID NO: 3074034 - RNA, 15 nt, Human
cgaauauugcugaug

SEQ ID NO: 3074035 - RNA, 17 nt, Human
cgaauauugcugauggu

SEQ ID NO: 3074036 - RNA, 19 nt, Human
cgcgguggcucacgccugu

SEQ ID NO: 3074037 - RNA, 14 nt, Human
cgcgacaaugcaaa

SEQ ID NO: 3074038 - RNA, 16 nt, Human
cgccuugcccagccug

SEQ ID NO: 3074039 - RNA, 19 nt, Human
cgccuugcccagccuggau

SEQ ID NO: 3074040 - RNA, 15 nt, Human
cgccuugcccagccu

SEQ ID NO: 3074041 - RNA, 17 nt, Human
cgcuacccgggaagggg

SEQ ID NO: 3074042 - RNA, 18 nt, Human
cgcuacccgggaaggggg

SEQ ID NO: 3074043 - RNA, 21 nt, Human
cgcuacccgggaagggggcug

SEQ ID NO: 3074044 - RNA, 24 nt, Human
cgcuacccgggaagggggcuggga

SEQ ID NO: 3074045 - RNA, 12 nt, Human
cgcccagucugg

SEQ ID NO: 3074046 - RNA, 17 nt, Human
cgcccaaggccuucccc

SEQ ID NO: 3074047 - RNA, 21 nt, Human
cgcccagucuggaaugcagug

SEQ ID NO: 3074048 - RNA, 19 nt, Human
cgcccagucuggaaugcag

SEQ ID NO: 3074049 - RNA, 13 nt, Human
cgcccagucugga

SEQ ID NO: 3074050 - RNA, 12 nt, Human
cgcccaaggccu

SEQ ID NO: 3074051 - RNA, 18 nt, Human
cgcagcccugcagagggc

SEQ ID NO: 3074052 - RNA, 19 nt, Human
cgcagcccugcagagggca

SEQ ID NO: 3074053 - RNA, 20 nt, Human
cggacagccacggccaggcc

SEQ ID NO: 3074054 - RNA, 14 nt, Human
cggaauaguuggcu

SEQ ID NO: 3074055 - RNA, 17 nt, Human
cggaauaguuggcuagg

SEQ ID NO: 3074056 - RNA, 16 nt, Human
cggaauaguuggcuag

SEQ ID NO: 3074057 - RNA, 16 nt, Human
cgcuuucuacccagcg

SEQ ID NO: 3074058 - RNA, 14 nt, Human
cgcuuucuacccag

SEQ ID NO: 3074059 - RNA, 22 nt, Human
cggacagccacggccaggccag

SEQ ID NO: 3074060 - RNA, 21 nt, Human
cggacagccacggccaggcca

SEQ ID NO: 3074061 - RNA, 17 nt, Human
cggagaaaggaagggcu

SEQ ID NO: 3074062 - RNA, 15 nt, Human
cggagaaaggaaggg

SEQ ID NO: 3074063 - RNA, 13 nt, Human
cgcugugcugccc

SEQ ID NO: 3074064 - RNA, 14 nt, Human
cgcugugcugcccu

SEQ ID NO: 3074065 - RNA, 11 nt, Human
cgcugugcugc

SEQ ID NO: 3074066 - RNA, 21 nt, Human
cgcugugcugcccugcccacc

SEQ ID NO: 3074067 - RNA, 23 nt, Human
cgcugugcugcccugcccaccug

SEQ ID NO: 3074068 - RNA, 19 nt, Human
cgcugugcugcccugccca

SEQ ID NO: 3074069 - RNA, 18 nt, Human
cgcugugcugcccugccc

SEQ ID NO: 3074070 - RNA, 18 nt, Human
cgggaauuuucaucuagg

SEQ ID NO: 3074071 - RNA, 20 nt, Human
cgggaauuuucaucuaggau

SEQ ID NO: 3074072 - RNA, 19 nt, Human
cgggaagggggcugggaca

SEQ ID NO: 3074073 - RNA, 20 nt, Human
cgggaagggggcugggacau

SEQ ID NO: 3074074 - RNA, 16 nt, Human
cgggaagggggcuggg

SEQ ID NO: 3074075 - RNA, 23 nt, Human
cggcuggcagcccaccccucaac

SEQ ID NO: 3074076 - RNA, 13 nt, Human
cggcuggccuggc

SEQ ID NO: 3074077 - RNA, 14 nt, Human
cggcuggcagccca

SEQ ID NO: 3074078 - RNA, 16 nt, Human
cggcccuccagagccc

SEQ ID NO: 3074079 - RNA, 20 nt, Human
cggcccuccagagccccaca

SEQ ID NO: 3074080 - RNA, 11 nt, Human
cggccaggcca

SEQ ID NO: 3074081 - RNA, 20 nt, Human
cggccaggccagagggagug

SEQ ID NO: 3074082 - RNA, 12 nt, Human
cggccaggccag

SEQ ID NO: 3074083 - RNA, 13 nt, Human
cggcccuccagag

SEQ ID NO: 3074084 - RNA, 13 nt, Human
cgcacugggcuug

SEQ ID NO: 3074085 - RNA, 19 nt, Human
cgcagcauauucaggaagc

SEQ ID NO: 3074086 - RNA, 20 nt, Human
cgcagcauauucaggaagcu

SEQ ID NO: 3074087 - RNA, 15 nt, Human
cgcagcccugcagag

SEQ ID NO: 3074088 - RNA, 17 nt, Human
cgcagcccugcagaggg

SEQ ID NO: 3074089 - RNA, 17 nt, Human
cgcacugggcuugggga

SEQ ID NO: 3074090 - RNA, 19 nt, Human
cgagcccugguggcagugg

SEQ ID NO: 3074091 - RNA, 14 nt, Human
cgaggacagggagg

SEQ ID NO: 3074092 - RNA, 13 nt, Human
cgagccuggcucc

SEQ ID NO: 3074093 - RNA, 18 nt, Human
cgagcccugguggcagug

SEQ ID NO: 3074094 - RNA, 16 nt, Human
cgaggacagggaggug

SEQ ID NO: 3074095 - RNA, 18 nt, Human
ccugguggcagcugcggu

SEQ ID NO: 3074096 - RNA, 17 nt, Human
ccugguggcagcugcgg

SEQ ID NO: 3074097 - RNA, 16 nt, Human
ccugguggcagcugcg

SEQ ID NO: 3074098 - RNA, 15 nt, Human
ccugguggcagcugc

SEQ ID NO: 3074099 - RNA, 19 nt, Human
ccugguggcagcucaccuc

SEQ ID NO: 3074100 - RNA, 21 nt, Human
ccugguggcagcucaccucuc

SEQ ID NO: 3074101 - RNA, 22 nt, Human
ccugguggcagcucaccucucc

SEQ ID NO: 3074102 - RNA, 14 nt, Human
ccugguggcagcug

SEQ ID NO: 3074103 - RNA, 13 nt, Human
ccugucccccuga

SEQ ID NO: 3074104 - RNA, 14 nt, Human
ccugucccccugac

SEQ ID NO: 3074105 - RNA, 15 nt, Human
ccugucccccugaca

SEQ ID NO: 3074106 - RNA, 12 nt, Human
ccugucccccug

SEQ ID NO: 3074107 - RNA, 13 nt, Human
ccuguagcccuaa

SEQ ID NO: 3074108 - RNA, 15 nt, Human
ccuguagagugggag

SEQ ID NO: 3074109 - RNA, 16 nt, Human
ccuguagagugggagc

SEQ ID NO: 3074110 - RNA, 14 nt, Human
ccugguggcagugg

SEQ ID NO: 3074111 - RNA, 13 nt, Human
ccugguggcagug

SEQ ID NO: 3074112 - RNA, 10 nt, Human
ccuguaccuc

SEQ ID NO: 3074113 - RNA, 20 nt, Human
ccugggggcugggcagagga

SEQ ID NO: 3074114 - RNA, 21 nt, Human
ccugggggcugggcagaggaa

SEQ ID NO: 3074115 - RNA, 19 nt, Human
ccugggggcugggcagagg

SEQ ID NO: 3074116 - RNA, 18 nt, Human
ccugggggcugggcagag

SEQ ID NO: 3074117 - RNA, 15 nt, Human
ccugggcagaaggaa

SEQ ID NO: 3074118 - RNA, 18 nt, Human
ccugggagugagcugguu

SEQ ID NO: 3074119 - RNA, 16 nt, Human
ccugggcagaaggaag

SEQ ID NO: 3074120 - RNA, 22 nt, Human
ccugggaggucaaggcugcagu

SEQ ID NO: 3074121 - RNA, 16 nt, Human
ccugggagugagcugg

SEQ ID NO: 3074122 - RNA, 16 nt, Human
ccuggcccacugcauc

SEQ ID NO: 3074123 - RNA, 16 nt, Human
ccuggcccagggcauc

SEQ ID NO: 3074124 - RNA, 21 nt, Human
ccuggcccagggcaucuggga

SEQ ID NO: 3074125 - RNA, 13 nt, Human
ccuggcccagggc

SEQ ID NO: 3074126 - RNA, 14 nt, Human
ccuggcccagggca

SEQ ID NO: 3074127 - RNA, 15 nt, Human
ccuggcccagggcau

SEQ ID NO: 3074128 - RNA, 12 nt, Human
ccuggcccaggg

SEQ ID NO: 3074129 - RNA, 13 nt, Human
ccuggcacugcuu

SEQ ID NO: 3074130 - RNA, 16 nt, Human
ccuggcacugcuucca

SEQ ID NO: 3074131 - RNA, 13 nt, Human
ccuggcaugggaa

SEQ ID NO: 3074132 - RNA, 23 nt, Human
ccuggcaugggaaugaaugucag

SEQ ID NO: 3074133 - RNA, 20 nt, Human
ccuggccagaugcaccagcc

SEQ ID NO: 3074134 - RNA, 23 nt, Human
ccuggccagaugcaccagcccuu

SEQ ID NO: 3074135 - RNA, 21 nt, Human
ccuggccagaugcaccagccc

SEQ ID NO: 3074136 - RNA, 13 nt, Human
ccuggcccacugc

SEQ ID NO: 3074137 - RNA, 14 nt, Human
ccuggcccacugca

SEQ ID NO: 3074138 - RNA, 12 nt, Human
ccuggcacugcu

SEQ ID NO: 3074139 - RNA, 22 nt, Human
ccuggcacuauaauguaagcuc

SEQ ID NO: 3074140 - RNA, 18 nt, Human
ccuggcacccggccccug

SEQ ID NO: 3074141 - RNA, 21 nt, Human
ccuggcacccggccccugcug

SEQ ID NO: 3074142 - RNA, 20 nt, Human
ccuggcacccggccccugcu

SEQ ID NO: 3074143 - RNA, 19 nt, Human
ccuggcacccggccccugc

SEQ ID NO: 3074144 - RNA, 18 nt, Human
ccugccuguugggccagg

SEQ ID NO: 3074145 - RNA, 19 nt, Human
ccugccuguugggccagga

SEQ ID NO: 3074146 - RNA, 20 nt, Human
ccugccuguugggccaggag

SEQ ID NO: 3074147 - RNA, 21 nt, Human
ccugcuaauuccccagauugc

SEQ ID NO: 3074148 - RNA, 17 nt, Human
ccugcuaauuccccaga

SEQ ID NO: 3074149 - RNA, 15 nt, Human
ccugcccugugggcc

SEQ ID NO: 3074150 - RNA, 19 nt, Human
ccugcccuuaccugccagg

SEQ ID NO: 3074151 - RNA, 21 nt, Human
ccugcccuuaccugccaggaa

SEQ ID NO: 3074152 - RNA, 22 nt, Human
ccugcccuuaccugccaggaag

SEQ ID NO: 3074153 - RNA, 14 nt, Human
ccugccuguugggc

SEQ ID NO: 3074154 - RNA, 11 nt, Human
ccugccucagc

SEQ ID NO: 3074155 - RNA, 12 nt, Human
ccugccucagcc

SEQ ID NO: 3074156 - RNA, 14 nt, Human
ccugccucagccuc

SEQ ID NO: 3074157 - RNA, 13 nt, Human
ccugccucagccu

SEQ ID NO: 3074158 - RNA, 12 nt, Human
ccugcccugugg

SEQ ID NO: 3074159 - RNA, 14 nt, Human
ccugcccugugggc

SEQ ID NO: 3074160 - RNA, 11 nt, Human
ccugcccugug

SEQ ID NO: 3074161 - RNA, 16 nt, Human
ccugcccggcugcgga

SEQ ID NO: 3074162 - RNA, 14 nt, Human
ccugcccggcugcg

SEQ ID NO: 3074163 - RNA, 17 nt, Human
ccugccccugagcccau

SEQ ID NO: 3074164 - RNA, 12 nt, Human
ccugccaggcau

SEQ ID NO: 3074165 - RNA, 22 nt, Human
ccugccagggacagagggggug

SEQ ID NO: 3074166 - RNA, 22 nt, Human
ccugccuguugggccaggagcc

SEQ ID NO: 3074167 - RNA, 21 nt, Human
ccugaagacucauucuucugu

SEQ ID NO: 3074168 - RNA, 18 nt, Human
ccugaaagcccugagcuu

SEQ ID NO: 3074169 - RNA, 13 nt, Human
ccugaaagcccug

SEQ ID NO: 3074170 - RNA, 14 nt, Human
ccugaaagcccuga

SEQ ID NO: 3074171 - RNA, 22 nt, Human
ccugaaggccccgcccaggcuu

SEQ ID NO: 3074172 - RNA, 20 nt, Human
ccugaaggccccgcccaggc

SEQ ID NO: 3074173 - RNA, 21 nt, Human
ccugaaggccccgcccaggcu

SEQ ID NO: 3074174 - RNA, 18 nt, Human
ccugaaggccccgcccag

SEQ ID NO: 3074175 - RNA, 19 nt, Human
ccugaaggccccgcccagg

SEQ ID NO: 3074176 - RNA, 14 nt, Human
ccugaaggccccgc

SEQ ID NO: 3074177 - RNA, 15 nt, Human
ccugagcugggauga

SEQ ID NO: 3074178 - RNA, 23 nt, Human
ccugcacagcaggcugccagugc

SEQ ID NO: 3074179 - RNA, 14 nt, Human
ccugcacagcaggc

SEQ ID NO: 3074180 - RNA, 17 nt, Human
ccugcacagcaggcugc

SEQ ID NO: 3074181 - RNA, 19 nt, Human
ccugcacagcaggcugcca

SEQ ID NO: 3074182 - RNA, 20 nt, Human
ccugcacagcaggcugccag

SEQ ID NO: 3074183 - RNA, 21 nt, Human
ccugcacagcaggcugccagu

SEQ ID NO: 3074184 - RNA, 13 nt, Human
ccugccacccugg

SEQ ID NO: 3074185 - RNA, 12 nt, Human
ccugccacccug

SEQ ID NO: 3074186 - RNA, 14 nt, Human
ccugccacccuggg

SEQ ID NO: 3074187 - RNA, 22 nt, Human
ccugccacccuggggagaaagu

SEQ ID NO: 3074188 - RNA, 16 nt, Human
ccugccacccugggga

SEQ ID NO: 3074189 - RNA, 19 nt, Human
ccugccaauggacuaacuu

SEQ ID NO: 3074190 - RNA, 15 nt, Human
ccugaggcccagagg

SEQ ID NO: 3074191 - RNA, 16 nt, Human
ccugaggcccagaggg

SEQ ID NO: 3074192 - RNA, 17 nt, Human
ccugaggcccagagggc

SEQ ID NO: 3074193 - RNA, 12 nt, Human
ccugagcuggga

SEQ ID NO: 3074194 - RNA, 13 nt, Human
ccugaggcugggc

SEQ ID NO: 3074195 - RNA, 14 nt, Human
ccugaggcugggcu

SEQ ID NO: 3074196 - RNA, 15 nt, Human
ccugaggcugggcuc

SEQ ID NO: 3074197 - RNA, 13 nt, Human
ccugaggcuccac

SEQ ID NO: 3074198 - RNA, 14 nt, Human
ccugaggcuccacu

SEQ ID NO: 3074199 - RNA, 15 nt, Human
ccugagccagauuuc

SEQ ID NO: 3074200 - RNA, 12 nt, Human
ccugagccagau

SEQ ID NO: 3074201 - RNA, 16 nt, Human
ccugagccagauuuca

SEQ ID NO: 3074202 - RNA, 18 nt, Human
ccugagccagauuucacu

SEQ ID NO: 3074203 - RNA, 19 nt, Human
ccugaagucacacagugag

SEQ ID NO: 3074204 - RNA, 20 nt, Human
ccugaagucacacagugagu

SEQ ID NO: 3074205 - RNA, 22 nt, Human
ccugaagucuuuguacagacaa

SEQ ID NO: 3074206 - RNA, 19 nt, Human
ccagccccaaaacucuccu

SEQ ID NO: 3074207 - RNA, 20 nt, Human
ccagccgagauagccaaggc

SEQ ID NO: 3074208 - RNA, 22 nt, Human
ccagccgagauagccaaggcca

SEQ ID NO: 3074209 - RNA, 17 nt, Human
ccagccgagauagccaa

SEQ ID NO: 3074210 - RNA, 19 nt, Human
ccagccgccaugcuccugg

SEQ ID NO: 3074211 - RNA, 19 nt, Human
ccagcaggcucucaggcca

SEQ ID NO: 3074212 - RNA, 20 nt, Human
ccagcaggcucucaggccag

SEQ ID NO: 3074213 - RNA, 21 nt, Human
ccagcaggcucucaggccagc

SEQ ID NO: 3074214 - RNA, 23 nt, Human
ccagcaggcucucaggccagcug

SEQ ID NO: 3074215 - RNA, 17 nt, Human
ccagcccacuucugcca

SEQ ID NO: 3074216 - RNA, 16 nt, Human
ccagcccacuucugcc

SEQ ID NO: 3074217 - RNA, 19 nt, Human
ccagccugagcgacaguga

SEQ ID NO: 3074218 - RNA, 23 nt, Human
ccagccuugaccauucuccaccu

SEQ ID NO: 3074219 - RNA, 22 nt, Human
ccagccuugaccauucuccacc

SEQ ID NO: 3074220 - RNA, 13 nt, Human
ccagccuggguga

SEQ ID NO: 3074221 - RNA, 18 nt, Human
ccagauuucacucuccuu

SEQ ID NO: 3074222 - RNA, 19 nt, Human
ccagauuucacucuccuug

SEQ ID NO: 3074223 - RNA, 15 nt, Human
ccagauuucacucuc

SEQ ID NO: 3074224 - RNA, 22 nt, Human
ccagauugcaacaggcugggcu

SEQ ID NO: 3074225 - RNA, 23 nt, Human
ccagauugcaacaggcugggcuu

SEQ ID NO: 3074226 - RNA, 14 nt, Human
ccagagcccaccuu

SEQ ID NO: 3074227 - RNA, 16 nt, Human
ccagagccccacagcc

SEQ ID NO: 3074228 - RNA, 13 nt, Human
ccagagccccaca

SEQ ID NO: 3074229 - RNA, 16 nt, Human
ccagauugcaacaggc

SEQ ID NO: 3074230 - RNA, 14 nt, Human
ccagauugcaacag

SEQ ID NO: 3074231 - RNA, 17 nt, Human
ccagagccccacagccc

SEQ ID NO: 3074232 - RNA, 23 nt, Human
ccagagccccacagccccaucug

SEQ ID NO: 3074233 - RNA, 17 nt, Human
ccagcaggcucucaggc

SEQ ID NO: 3074234 - RNA, 18 nt, Human
ccagcaggcucucaggcc

SEQ ID NO: 3074235 - RNA, 16 nt, Human
ccagcaggcucucagg

SEQ ID NO: 3074236 - RNA, 17 nt, Human
ccagcaccaucucuccu

SEQ ID NO: 3074237 - RNA, 18 nt, Human
ccagcaccaucucuccuc

SEQ ID NO: 3074238 - RNA, 19 nt, Human
ccagcaagugagagcuggg

SEQ ID NO: 3074239 - RNA, 18 nt, Human
ccagcaagugagagcugg

SEQ ID NO: 3074240 - RNA, 17 nt, Human
ccagcaagugagagcug

SEQ ID NO: 3074241 - RNA, 18 nt, Human
ccagaaaccuuuguuugc

SEQ ID NO: 3074242 - RNA, 22 nt, Human
ccagaagaaaauagugguguga

SEQ ID NO: 3074243 - RNA, 16 nt, Human
ccacugugccaugugc

SEQ ID NO: 3074244 - RNA, 15 nt, Human
ccacugugccaugug

SEQ ID NO: 3074245 - RNA, 19 nt, Human
ccacugugccaugugccag

SEQ ID NO: 3074246 - RNA, 22 nt, Human
ccacuuuuguucuugguuugua

SEQ ID NO: 3074247 - RNA, 21 nt, Human
ccacugcaucguuucaucuuc

SEQ ID NO: 3074248 - RNA, 23 nt, Human
ccacugcaucguuucaucuucca

SEQ ID NO: 3074249 - RNA, 15 nt, Human
ccacugcucugguua

SEQ ID NO: 3074250 - RNA, 13 nt, Human
ccacugcucuggu

SEQ ID NO: 3074251 - RNA, 12 nt, Human
ccacugcucugg

SEQ ID NO: 3074252 - RNA, 11 nt, Human
ccacugcucug

SEQ ID NO: 3074253 - RNA, 20 nt, Human
ccacugcuuuuggucugugu

SEQ ID NO: 3074254 - RNA, 22 nt, Human
ccacugcuuuuggucuguguga

SEQ ID NO: 3074255 - RNA, 23 nt, Human
ccacuggugacaugucuuuucuu

SEQ ID NO: 3074256 - RNA, 15 nt, Human
ccacugguucuucuu

SEQ ID NO: 3074257 - RNA, 14 nt, Human
ccacugugaagaga

SEQ ID NO: 3074258 - RNA, 15 nt, Human
ccacugugaagagaa

SEQ ID NO: 3074259 - RNA, 17 nt, Human
ccagacacauguccaag

SEQ ID NO: 3074260 - RNA, 20 nt, Human
ccagacacauguccaagaag

SEQ ID NO: 3074261 - RNA, 22 nt, Human
ccagacacauguccaagaagcc

SEQ ID NO: 3074262 - RNA, 14 nt, Human
ccagacaucaacag

SEQ ID NO: 3074263 - RNA, 15 nt, Human
ccagacccggcugcg

SEQ ID NO: 3074264 - RNA, 14 nt, Human
ccagacccggcugc

SEQ ID NO: 3074265 - RNA, 19 nt, Human
ccacccccacccaagggcc

SEQ ID NO: 3074266 - RNA, 19 nt, Human
ccaccccucaacaccucug

SEQ ID NO: 3074267 - RNA, 12 nt, Human
ccacccccuagg

SEQ ID NO: 3074268 - RNA, 18 nt, Human
ccacccugaaagcccuga

SEQ ID NO: 3074269 - RNA, 14 nt, Human
ccacccuccuuuca

SEQ ID NO: 3074270 - RNA, 12 nt, Human
ccacccugcucu

SEQ ID NO: 3074271 - RNA, 11 nt, Human
ccacccugcuc

SEQ ID NO: 3074272 - RNA, 14 nt, Human
ccaccucucucacu

SEQ ID NO: 3074273 - RNA, 16 nt, Human
ccaccucucucacucc

SEQ ID NO: 3074274 - RNA, 19 nt, Human
ccaccucucucacuccuug

SEQ ID NO: 3074275 - RNA, 20 nt, Human
ccaccucucucacuccuuga

SEQ ID NO: 3074276 - RNA, 13 nt, Human
ccaccuggccucu

SEQ ID NO: 3074277 - RNA, 18 nt, Human
ccaccuggccucugcacu

SEQ ID NO: 3074278 - RNA, 20 nt, Human
ccaccuggccucugcacucc

SEQ ID NO: 3074279 - RNA, 14 nt, Human
ccaccuggcucugu

SEQ ID NO: 3074280 - RNA, 16 nt, Human
ccaccuggcucugugg

SEQ ID NO: 3074281 - RNA, 13 nt, Human
ccaccuggcucug

SEQ ID NO: 3074282 - RNA, 12 nt, Human
ccaccuggcucu

SEQ ID NO: 3074283 - RNA, 13 nt, Human
ccaccugccaggg

SEQ ID NO: 3074284 - RNA, 14 nt, Human
ccaccugccaggga

SEQ ID NO: 3074285 - RNA, 12 nt, Human
ccaccugccagg

SEQ ID NO: 3074286 - RNA, 15 nt, Human
ccaccugccagggac

SEQ ID NO: 3074287 - RNA, 13 nt, Human
ccaggcccucugc

SEQ ID NO: 3074288 - RNA, 14 nt, Human
ccaggcccucugcc

SEQ ID NO: 3074289 - RNA, 16 nt, Human
ccaggccccugccacc

SEQ ID NO: 3074290 - RNA, 15 nt, Human
ccaggccccugccac

SEQ ID NO: 3074291 - RNA, 14 nt, Human
ccaggccccugcca

SEQ ID NO: 3074292 - RNA, 21 nt, Human
ccaggccacaagacccuugug

SEQ ID NO: 3074293 - RNA, 20 nt, Human
ccaggaggccagccuugacc

SEQ ID NO: 3074294 - RNA, 15 nt, Human
ccaggaggccagccu

SEQ ID NO: 3074295 - RNA, 18 nt, Human
ccaggaggccagccuuga

SEQ ID NO: 3074296 - RNA, 14 nt, Human
ccaggaggccagcc

SEQ ID NO: 3074297 - RNA, 24 nt, Human
ccaggcugggucgcccuggacugu

SEQ ID NO: 3074298 - RNA, 23 nt, Human
ccaggcugggucgcccuggacug

SEQ ID NO: 3074299 - RNA, 22 nt, Human
ccaggcugggucgcccuggacu

SEQ ID NO: 3074300 - RNA, 21 nt, Human
ccaggcugggucgcccuggac

SEQ ID NO: 3074301 - RNA, 16 nt, Human
ccaggcugggucgccc

SEQ ID NO: 3074302 - RNA, 12 nt, Human
ccaggcuggguc

SEQ ID NO: 3074303 - RNA, 15 nt, Human
ccaggcccucugccc

SEQ ID NO: 3074304 - RNA, 23 nt, Human
ccaggcugggagagccuuccagg

SEQ ID NO: 3074305 - RNA, 22 nt, Human
ccaggcuuagucacugagacag

SEQ ID NO: 3074306 - RNA, 23 nt, Human
ccaggcuuagucacugagacagc

SEQ ID NO: 3074307 - RNA, 21 nt, Human
ccaggcuuagucacugagaca

SEQ ID NO: 3074308 - RNA, 18 nt, Human
ccaggguggccacaccuc

SEQ ID NO: 3074309 - RNA, 24 nt, Human
ccaggguggccacaccucuauccc

SEQ ID NO: 3074310 - RNA, 20 nt, Human
ccagguagaggguguguaag

SEQ ID NO: 3074311 - RNA, 23 nt, Human
ccagugaauucuugaaggaaaau

SEQ ID NO: 3074312 - RNA, 21 nt, Human
ccaggugcuaggaacacuccu

SEQ ID NO: 3074313 - RNA, 12 nt, Human
ccaggugccagu

SEQ ID NO: 3074314 - RNA, 22 nt, Human
ccaguaaaugggggugcauuug

SEQ ID NO: 3074315 - RNA, 21 nt, Human
ccaguaaaugggggugcauuu

SEQ ID NO: 3074316 - RNA, 20 nt, Human
ccaguaaaugggggugcauu

SEQ ID NO: 3074317 - RNA, 13 nt, Human
ccagguuuaagcu

SEQ ID NO: 3074318 - RNA, 16 nt, Human
ccagguuucuaugugu

SEQ ID NO: 3074319 - RNA, 14 nt, Human
ccaucauugaaauc

SEQ ID NO: 3074320 - RNA, 16 nt, Human
ccaucauugaaaucuu

SEQ ID NO: 3074321 - RNA, 17 nt, Human
ccaucauugaaaucuuu

SEQ ID NO: 3074322 - RNA, 18 nt, Human
ccauccugaggcuccacu

SEQ ID NO: 3074323 - RNA, 13 nt, Human
ccaucuacccucc

SEQ ID NO: 3074324 - RNA, 16 nt, Human
ccauccugaggcucca

SEQ ID NO: 3074325 - RNA, 20 nt, Human
ccauccugaggcuccacuug

SEQ ID NO: 3074326 - RNA, 14 nt, Human
ccaucucacacaug

SEQ ID NO: 3074327 - RNA, 15 nt, Human
ccaucucacacauga

SEQ ID NO: 3074328 - RNA, 17 nt, Human
ccaucucacacaugagc

SEQ ID NO: 3074329 - RNA, 18 nt, Human
ccaucucacacaugagca

SEQ ID NO: 3074330 - RNA, 20 nt, Human
ccaucucacacaugagcauc

SEQ ID NO: 3074331 - RNA, 21 nt, Human
ccaucucacacaugagcauca

SEQ ID NO: 3074332 - RNA, 15 nt, Human
ccaucucuccuccuu

SEQ ID NO: 3074333 - RNA, 23 nt, Human
ccagugugacaaggauugcuacu

SEQ ID NO: 3074334 - RNA, 14 nt, Human
ccagugugacaagg

SEQ ID NO: 3074335 - RNA, 13 nt, Human
ccauaugccuggg

SEQ ID NO: 3074336 - RNA, 12 nt, Human
ccaucaagccac

SEQ ID NO: 3074337 - RNA, 15 nt, Human
ccauaugccugggca

SEQ ID NO: 3074338 - RNA, 16 nt, Human
ccaucaagccaccaac

SEQ ID NO: 3074339 - RNA, 13 nt, Human
ccaucaagccacc

SEQ ID NO: 3074340 - RNA, 14 nt, Human
ccaucaagccacca

SEQ ID NO: 3074341 - RNA, 12 nt, Human
ccaucauugaaa

SEQ ID NO: 3074342 - RNA, 13 nt, Human
ccaucaugucugg

SEQ ID NO: 3074343 - RNA, 12 nt, Human
ccaucaugucug

SEQ ID NO: 3074344 - RNA, 21 nt, Human
cccacgcuggagugcagugag

SEQ ID NO: 3074345 - RNA, 15 nt, Human
cccaccuuggcugca

SEQ ID NO: 3074346 - RNA, 14 nt, Human
cccaccuuggcugc

SEQ ID NO: 3074347 - RNA, 22 nt, Human
cccaccuuggcucaaguccucu

SEQ ID NO: 3074348 - RNA, 15 nt, Human
cccaccuuggcucaa

SEQ ID NO: 3074349 - RNA, 15 nt, Human
cccacgcccccacug

SEQ ID NO: 3074350 - RNA, 17 nt, Human
cccacgcccccacuggu

SEQ ID NO: 3074351 - RNA, 19 nt, Human
cccacgcccccacugguga

SEQ ID NO: 3074352 - RNA, 14 nt, Human
cccaccucucucac

SEQ ID NO: 3074353 - RNA, 17 nt, Human
cccaccucucucacucc

SEQ ID NO: 3074354 - RNA, 13 nt, Human
cccaccucucuca

SEQ ID NO: 3074355 - RNA, 21 nt, Human
cccaccucagccucccaaagu

SEQ ID NO: 3074356 - RNA, 12 nt, Human
cccaccuuggcu

SEQ ID NO: 3074357 - RNA, 14 nt, Human
cccaccuggcucug

SEQ ID NO: 3074358 - RNA, 15 nt, Human
cccaccucagccucc

SEQ ID NO: 3074359 - RNA, 14 nt, Human
cccaccucagccuc

SEQ ID NO: 3074360 - RNA, 12 nt, Human
cccaccucagcc

SEQ ID NO: 3074361 - RNA, 20 nt, Human
ccauuuugcugucccuuuuc

SEQ ID NO: 3074362 - RNA, 21 nt, Human
ccauuuuguauuuuacuaaua

SEQ ID NO: 3074363 - RNA, 12 nt, Human
cccaagggccug

SEQ ID NO: 3074364 - RNA, 14 nt, Human
cccaagggccuggc

SEQ ID NO: 3074365 - RNA, 13 nt, Human
cccacaggaucag

SEQ ID NO: 3074366 - RNA, 17 nt, Human
cccacaggaucagucug

SEQ ID NO: 3074367 - RNA, 16 nt, Human
cccacagccccaucug

SEQ ID NO: 3074368 - RNA, 16 nt, Human
cccaagggccuggccu

SEQ ID NO: 3074369 - RNA, 13 nt, Human
cccaagugccaaa

SEQ ID NO: 3074370 - RNA, 15 nt, Human
cccaagugccaaaga

SEQ ID NO: 3074371 - RNA, 18 nt, Human
ccauguuuuguuuacggu

SEQ ID NO: 3074372 - RNA, 13 nt, Human
ccauuugcuccuu

SEQ ID NO: 3074373 - RNA, 15 nt, Human
ccauucugccugccc

SEQ ID NO: 3074374 - RNA, 14 nt, Human
cccaguugggugga

SEQ ID NO: 3074375 - RNA, 19 nt, Human
cccaucucuacaaaaagca

SEQ ID NO: 3074376 - RNA, 22 nt, Human
cccaucugcgggggcagugcuc

SEQ ID NO: 3074377 - RNA, 21 nt, Human
cccaucugcgggggcagugcu

SEQ ID NO: 3074378 - RNA, 22 nt, Human
cccaugagccucagcauccugg

SEQ ID NO: 3074379 - RNA, 20 nt, Human
cccaugagggagaugccaug

SEQ ID NO: 3074380 - RNA, 21 nt, Human
cccaugagggagaugccauga

SEQ ID NO: 3074381 - RNA, 14 nt, Human
cccaugagccucag

SEQ ID NO: 3074382 - RNA, 21 nt, Human
ccccacccaagggccuggccu

SEQ ID NO: 3074383 - RNA, 15 nt, Human
ccccaccgcagacag

SEQ ID NO: 3074384 - RNA, 19 nt, Human
ccccaccgcagacaggacc

SEQ ID NO: 3074385 - RNA, 14 nt, Human
ccccacuggugaca

SEQ ID NO: 3074386 - RNA, 16 nt, Human
ccccacuccggcccuc

SEQ ID NO: 3074387 - RNA, 20 nt, Human
ccccacuccggcccuccaga

SEQ ID NO: 3074388 - RNA, 22 nt, Human
ccccucagggucccugguggca

SEQ ID NO: 3074389 - RNA, 16 nt, Human
ccccucagggucccug

SEQ ID NO: 3074390 - RNA, 12 nt, Human
ccccuccaugug

SEQ ID NO: 3074391 - RNA, 15 nt, Human
ccccucggagaagag

SEQ ID NO: 3074392 - RNA, 15 nt, Human
ccccucaacaccucu

SEQ ID NO: 3074393 - RNA, 16 nt, Human
ccccucaacaccucug

SEQ ID NO: 3074394 - RNA, 23 nt, Human
ccccucaacucuccuccagaguc

SEQ ID NO: 3074395 - RNA, 12 nt, Human
cccccagccugc

SEQ ID NO: 3074396 - RNA, 19 nt, Human
cccccugacaacacucauu

SEQ ID NO: 3074397 - RNA, 17 nt, Human
cccccugacaacacuca

SEQ ID NO: 3074398 - RNA, 17 nt, Human
ccccaucauugguaccc

SEQ ID NO: 3074399 - RNA, 14 nt, Human
ccccauccucugua

SEQ ID NO: 3074400 - RNA, 13 nt, Human
cccccacccaagg

SEQ ID NO: 3074401 - RNA, 24 nt, Human
cccccacccaagggccuggccuga

SEQ ID NO: 3074402 - RNA, 15 nt, Human
cccccacuggugaca

SEQ ID NO: 3074403 - RNA, 11 nt, Human
cccccacuggu

SEQ ID NO: 3074404 - RNA, 13 nt, Human
cccccacugguga

SEQ ID NO: 3074405 - RNA, 20 nt, Human
ccccagugcccacaggauca

SEQ ID NO: 3074406 - RNA, 16 nt, Human
ccccagugcccacagg

SEQ ID NO: 3074407 - RNA, 15 nt, Human
ccccagugcccacag

SEQ ID NO: 3074408 - RNA, 14 nt, Human
ccccagugcccaca

SEQ ID NO: 3074409 - RNA, 17 nt, Human
ccccugccucucugcag

SEQ ID NO: 3074410 - RNA, 16 nt, Human
ccccugccucucugca

SEQ ID NO: 3074411 - RNA, 19 nt, Human
ccccugccucucugcaggu

SEQ ID NO: 3074412 - RNA, 15 nt, Human
ccccugccucucugc

SEQ ID NO: 3074413 - RNA, 14 nt, Human
ccccugccucucug

SEQ ID NO: 3074414 - RNA, 19 nt, Human
ccccugcccggcugcggaa

SEQ ID NO: 3074415 - RNA, 17 nt, Human
ccccugcccggcugcgg

SEQ ID NO: 3074416 - RNA, 20 nt, Human
ccccugcugguucaggguug

SEQ ID NO: 3074417 - RNA, 15 nt, Human
ccccugcugguucag

SEQ ID NO: 3074418 - RNA, 13 nt, Human
ccccugcugguuc

SEQ ID NO: 3074419 - RNA, 11 nt, Human
ccccugcuggu

SEQ ID NO: 3074420 - RNA, 14 nt, Human
ccccugcugggugu

SEQ ID NO: 3074421 - RNA, 17 nt, Human
ccccugcuggguguggc

SEQ ID NO: 3074422 - RNA, 18 nt, Human
ccccuggaugcagccuca

SEQ ID NO: 3074423 - RNA, 19 nt, Human
ccccuggaugcagccucac

SEQ ID NO: 3074424 - RNA, 14 nt, Human
ccccuggcacuggc

SEQ ID NO: 3074425 - RNA, 16 nt, Human
ccccuggcacuggcaa

SEQ ID NO: 3074426 - RNA, 15 nt, Human
ccccuggaugcagcc

SEQ ID NO: 3074427 - RNA, 19 nt, Human
ccccuguggaugcugcugc

SEQ ID NO: 3074428 - RNA, 20 nt, Human
ccccuguggaugcugcugcc

SEQ ID NO: 3074429 - RNA, 22 nt, Human
ccccuguggaugcugcugcccc

SEQ ID NO: 3074430 - RNA, 13 nt, Human
ccccuuccaugga

SEQ ID NO: 3074431 - RNA, 20 nt, Human
ccccuuccauggacuuuguu

SEQ ID NO: 3074432 - RNA, 22 nt, Human
cccgaauagcugggacuacagg

SEQ ID NO: 3074433 - RNA, 20 nt, Human
cccgcccaggcuuagucacu

SEQ ID NO: 3074434 - RNA, 22 nt, Human
cccgcccaggcuuagucacuga

SEQ ID NO: 3074435 - RNA, 22 nt, Human
cccgcuaagagggagggagggc

SEQ ID NO: 3074436 - RNA, 23 nt, Human
cccgcuaagagggagggagggcu

SEQ ID NO: 3074437 - RNA, 15 nt, Human
cccgagccuggcucc

SEQ ID NO: 3074438 - RNA, 13 nt, Human
cccgagccuggcu

SEQ ID NO: 3074439 - RNA, 20 nt, Human
cccugcagagggcacagaaa

SEQ ID NO: 3074440 - RNA, 12 nt, Human
cccugaggccca

SEQ ID NO: 3074441 - RNA, 14 nt, Human
cccugccucucugc

SEQ ID NO: 3074442 - RNA, 13 nt, Human
cccugccucucug

SEQ ID NO: 3074443 - RNA, 11 nt, Human
cccugccuccu

SEQ ID NO: 3074444 - RNA, 15 nt, Human
cccugccucucugca

SEQ ID NO: 3074445 - RNA, 21 nt, Human
cccugcucuccgaccagacac

SEQ ID NO: 3074446 - RNA, 22 nt, Human
cccugcucuccgaccagacacc

SEQ ID NO: 3074447 - RNA, 12 nt, Human
cccugcugcucc

SEQ ID NO: 3074448 - RNA, 14 nt, Human
cccugcugcuccua

SEQ ID NO: 3074449 - RNA, 12 nt, Human
cccuuccaugga

SEQ ID NO: 3074450 - RNA, 15 nt, Human
cccuuacgugagucc

SEQ ID NO: 3074451 - RNA, 17 nt, Human
cccuuacgugaguccug

SEQ ID NO: 3074452 - RNA, 14 nt, Human
cccuuagcagggaa

SEQ ID NO: 3074453 - RNA, 23 nt, Human
cccuuagcagggaaacagcuaau

SEQ ID NO: 3074454 - RNA, 20 nt, Human
cccuuaccugccaggaagcc

SEQ ID NO: 3074455 - RNA, 23 nt, Human
cccuuaccugccaggaagccagc

SEQ ID NO: 3074456 - RNA, 17 nt, Human
cccuuaccugccaggaa

SEQ ID NO: 3074457 - RNA, 19 nt, Human
cccuuaccucggugccuuc

SEQ ID NO: 3074458 - RNA, 19 nt, Human
cccuguuuguuucugaaag

SEQ ID NO: 3074459 - RNA, 16 nt, Human
cccuguuuguuucuga

SEQ ID NO: 3074460 - RNA, 13 nt, Human
cccuguucuggca

SEQ ID NO: 3074461 - RNA, 14 nt, Human
cccuguucuggcag

SEQ ID NO: 3074462 - RNA, 21 nt, Human
cccuggugaccagcaccaucu

SEQ ID NO: 3074463 - RNA, 21 nt, Human
cccugguggcagcucaccucu

SEQ ID NO: 3074464 - RNA, 13 nt, Human
cccugguggcagu

SEQ ID NO: 3074465 - RNA, 21 nt, Human
cccuguagagugggagcugag

SEQ ID NO: 3074466 - RNA, 14 nt, Human
cccugguggcagug

SEQ ID NO: 3074467 - RNA, 15 nt, Human
cccucugcccacucc

SEQ ID NO: 3074468 - RNA, 18 nt, Human
cccucugcccacucccug

SEQ ID NO: 3074469 - RNA, 11 nt, Human
cccucugccca

SEQ ID NO: 3074470 - RNA, 19 nt, Human
cccucugcccacucccugc

SEQ ID NO: 3074471 - RNA, 20 nt, Human
cccucuuucccucccuuccu

SEQ ID NO: 3074472 - RNA, 17 nt, Human
cccucuuucccucccuu

SEQ ID NO: 3074473 - RNA, 12 nt, Human
cccucuuucccu

SEQ ID NO: 3074474 - RNA, 23 nt, Human
cccucccucuuucccucccuucc

SEQ ID NO: 3074475 - RNA, 12 nt, Human
cccucccacagc

SEQ ID NO: 3074476 - RNA, 14 nt, Human
cccucccacagcgc

SEQ ID NO: 3074477 - RNA, 18 nt, Human
ccuacaggagugagcacu

SEQ ID NO: 3074478 - RNA, 18 nt, Human
ccuaggugacagagugag

SEQ ID NO: 3074479 - RNA, 23 nt, Human
ccuaggcauuugcugaauacaga

SEQ ID NO: 3074480 - RNA, 14 nt, Human
ccgcuggggccagu

SEQ ID NO: 3074481 - RNA, 11 nt, Human
ccgcuggggcc

SEQ ID NO: 3074482 - RNA, 18 nt, Human
ccgugaggccagagacac

SEQ ID NO: 3074483 - RNA, 18 nt, Human
ccgggcucugccucccau

SEQ ID NO: 3074484 - RNA, 13 nt, Human
ccgggcucugccu

SEQ ID NO: 3074485 - RNA, 14 nt, Human
ccgggcucugccuc

SEQ ID NO: 3074486 - RNA, 15 nt, Human
ccgggcucugccucc

SEQ ID NO: 3074487 - RNA, 13 nt, Human
ccgggccacagag

SEQ ID NO: 3074488 - RNA, 22 nt, Human
ccgggcacucagaagacacuga

SEQ ID NO: 3074489 - RNA, 20 nt, Human
ccgggcacucagaagacacu

SEQ ID NO: 3074490 - RNA, 21 nt, Human
ccggcuccaggcuccuuuagc

SEQ ID NO: 3074491 - RNA, 16 nt, Human
ccggcuccaggcuccu

SEQ ID NO: 3074492 - RNA, 15 nt, Human
ccggcuccaggcucc

SEQ ID NO: 3074493 - RNA, 15 nt, Human
ccgagauugcaccac

SEQ ID NO: 3074494 - RNA, 19 nt, Human
ccgagauugcaccacugca

SEQ ID NO: 3074495 - RNA, 21 nt, Human
ccgagauugcaccacugcacu

SEQ ID NO: 3074496 - RNA, 23 nt, Human
ccgcacugggcuuggggaccaga

SEQ ID NO: 3074497 - RNA, 19 nt, Human
ccgcacugggcuuggggac

SEQ ID NO: 3074498 - RNA, 14 nt, Human
ccgaguagcuggga

SEQ ID NO: 3074499 - RNA, 19 nt, Human
ccgagcuuugaaaauucag

SEQ ID NO: 3074500 - RNA, 22 nt, Human
cugagaggacuuuucuuugugg

SEQ ID NO: 3074501 - RNA, 21 nt, Human
cugagaggacuuuucuuugug

SEQ ID NO: 3074502 - RNA, 17 nt, Human
cugagaguagagucacu

SEQ ID NO: 3074503 - RNA, 22 nt, Human
cugagacucgcgacaaugcaaa

SEQ ID NO: 3074504 - RNA, 23 nt, Human
cugagacagcccgggcucugccu

SEQ ID NO: 3074505 - RNA, 21 nt, Human
cugagacucgcgacaaugcaa

SEQ ID NO: 3074506 - RNA, 20 nt, Human
cugagacucgcgacaaugca

SEQ ID NO: 3074507 - RNA, 21 nt, Human
cugacccaugcugcccuguga

SEQ ID NO: 3074508 - RNA, 22 nt, Human
cugacccaugcugcccugugag

SEQ ID NO: 3074509 - RNA, 21 nt, Human
cugagauccuggacugagggg

SEQ ID NO: 3074510 - RNA, 21 nt, Human
cugagaucaaaacgguuuuac

SEQ ID NO: 3074511 - RNA, 13 nt, Human
cugagauccugga

SEQ ID NO: 3074512 - RNA, 15 nt, Human
cugagauccuggacu

SEQ ID NO: 3074513 - RNA, 17 nt, Human
cugagauccuggacuga

SEQ ID NO: 3074514 - RNA, 14 nt, Human
cugagcuuucugcu

SEQ ID NO: 3074515 - RNA, 15 nt, Human
cugagcuuucugcua

SEQ ID NO: 3074516 - RNA, 14 nt, Human
cugaggaauccaga

SEQ ID NO: 3074517 - RNA, 20 nt, Human
cugaggaauccagacccggc

SEQ ID NO: 3074518 - RNA, 17 nt, Human
cugaggaauccagaccc

SEQ ID NO: 3074519 - RNA, 20 nt, Human
cugaggacacuaaccacgcu

SEQ ID NO: 3074520 - RNA, 23 nt, Human
cugaggacacuaaccacgcugga

SEQ ID NO: 3074521 - RNA, 20 nt, Human
cugaguacguugugcauuug

SEQ ID NO: 3074522 - RNA, 19 nt, Human
cugaguacguugugcauuu

SEQ ID NO: 3074523 - RNA, 17 nt, Human
cugaguacguugugcau

SEQ ID NO: 3074524 - RNA, 18 nt, Human
cugaguacguugugcauu

SEQ ID NO: 3074525 - RNA, 21 nt, Human
cugaguacguugugcauuugg

SEQ ID NO: 3074526 - RNA, 13 nt, Human
cucugcagguccc

SEQ ID NO: 3074527 - RNA, 21 nt, Human
cucugcacuccccugcugggu

SEQ ID NO: 3074528 - RNA, 20 nt, Human
cucugcacuccccugcuggg

SEQ ID NO: 3074529 - RNA, 18 nt, Human
cucugcacuccccugcug

SEQ ID NO: 3074530 - RNA, 16 nt, Human
cucuccccuucucugu

SEQ ID NO: 3074531 - RNA, 17 nt, Human
cucugcaggucccuaau

SEQ ID NO: 3074532 - RNA, 16 nt, Human
cucugcaggucccuaa

SEQ ID NO: 3074533 - RNA, 15 nt, Human
cucugcaggucccua

SEQ ID NO: 3074534 - RNA, 14 nt, Human
cucugcaggucccu

SEQ ID NO: 3074535 - RNA, 18 nt, Human
cucugcuccucuccccag

SEQ ID NO: 3074536 - RNA, 13 nt, Human
cucugcuccucuc

SEQ ID NO: 3074537 - RNA, 14 nt, Human
cucugguccauaga

SEQ ID NO: 3074538 - RNA, 16 nt, Human
cucugcugacagacac

SEQ ID NO: 3074539 - RNA, 14 nt, Human
cucugcugacagac

SEQ ID NO: 3074540 - RNA, 13 nt, Human
cucugcugacaga

SEQ ID NO: 3074541 - RNA, 13 nt, Human
cucuuauugccca

SEQ ID NO: 3074542 - RNA, 22 nt, Human
cucuuagaugcaguucugaaga

SEQ ID NO: 3074543 - RNA, 21 nt, Human
cucuuagaugcaguucugaag

SEQ ID NO: 3074544 - RNA, 20 nt, Human
cucuuauugcccacgcugga

SEQ ID NO: 3074545 - RNA, 19 nt, Human
cucuuauugcccacgcugg

SEQ ID NO: 3074546 - RNA, 15 nt, Human
cucuuauugcccacg

SEQ ID NO: 3074547 - RNA, 14 nt, Human
cucuuauugcccac

SEQ ID NO: 3074548 - RNA, 19 nt, Human
cucuucagaucucuaacuu

SEQ ID NO: 3074549 - RNA, 18 nt, Human
cucuucagaucucuaacu

SEQ ID NO: 3074550 - RNA, 14 nt, Human
cucuucaaucucuu

SEQ ID NO: 3074551 - RNA, 21 nt, Human
cucuugaugccuggcggggug

SEQ ID NO: 3074552 - RNA, 16 nt, Human
cucuugaugccuggcg

SEQ ID NO: 3074553 - RNA, 15 nt, Human
cucuugaugccuggc

SEQ ID NO: 3074554 - RNA, 13 nt, Human
cucuugaugccug

SEQ ID NO: 3074555 - RNA, 13 nt, Human
cugaaacuucccu

SEQ ID NO: 3074556 - RNA, 22 nt, Human
cugaaaauugaugggauuuggu

SEQ ID NO: 3074557 - RNA, 15 nt, Human
cugaaacaacaaaua

SEQ ID NO: 3074558 - RNA, 22 nt, Human
cugaagcuaucguaaaauuaag

SEQ ID NO: 3074559 - RNA, 21 nt, Human
cugaagcuaucguaaaauuaa

SEQ ID NO: 3074560 - RNA, 21 nt, Human
cugaaggacauugcggacagc

SEQ ID NO: 3074561 - RNA, 23 nt, Human
cugaaggacauugcggacagcca

SEQ ID NO: 3074562 - RNA, 18 nt, Human
cugaaggccccgcccagg

SEQ ID NO: 3074563 - RNA, 19 nt, Human
cugaaggccccgcccaggc

SEQ ID NO: 3074564 - RNA, 21 nt, Human
cugaaggccccgcccaggcuu

SEQ ID NO: 3074565 - RNA, 22 nt, Human
cugacaacacucauugaccuga

SEQ ID NO: 3074566 - RNA, 23 nt, Human
cugacaacacucauugaccugag

SEQ ID NO: 3074567 - RNA, 17 nt, Human
cucuugagccuugaacu

SEQ ID NO: 3074568 - RNA, 16 nt, Human
cucuugagccuugaac

SEQ ID NO: 3074569 - RNA, 18 nt, Human
cucuugagccuugaacuu

SEQ ID NO: 3074570 - RNA, 14 nt, Human
cucgaacuggcugc

SEQ ID NO: 3074571 - RNA, 13 nt, Human
cucgaacuggcug

SEQ ID NO: 3074572 - RNA, 15 nt, Human
cucgaacuggcugca

SEQ ID NO: 3074573 - RNA, 14 nt, Human
cucguuaauuugua

SEQ ID NO: 3074574 - RNA, 18 nt, Human
cuccucugcugcuggcug

SEQ ID NO: 3074575 - RNA, 15 nt, Human
cuccucugcugcugg

SEQ ID NO: 3074576 - RNA, 16 nt, Human
cuccucugcugcuggc

SEQ ID NO: 3074577 - RNA, 16 nt, Human
cuccuggcccacugca

SEQ ID NO: 3074578 - RNA, 18 nt, Human
cuccuggcccacugcauc

SEQ ID NO: 3074579 - RNA, 15 nt, Human
cucccccagccccau

SEQ ID NO: 3074580 - RNA, 20 nt, Human
cucccccagccccauccucu

SEQ ID NO: 3074581 - RNA, 22 nt, Human
cucccccagccccauccucugu

SEQ ID NO: 3074582 - RNA, 13 nt, Human
cuccaagcuccca

SEQ ID NO: 3074583 - RNA, 14 nt, Human
cuccaagcucccag

SEQ ID NO: 3074584 - RNA, 15 nt, Human
cuccaagcucccagg

SEQ ID NO: 3074585 - RNA, 16 nt, Human
cuccaagcucccaggc

SEQ ID NO: 3074586 - RNA, 13 nt, Human
cuccacuuggucu

SEQ ID NO: 3074587 - RNA, 15 nt, Human
cuccacuuggucugu

SEQ ID NO: 3074588 - RNA, 16 nt, Human
cuccacuuggucugug

SEQ ID NO: 3074589 - RNA, 17 nt, Human
cuccacuuggucuguga

SEQ ID NO: 3074590 - RNA, 21 nt, Human
cuccacuuggucugugagaug

SEQ ID NO: 3074591 - RNA, 22 nt, Human
cuccacuuggucugugagaugc

SEQ ID NO: 3074592 - RNA, 13 nt, Human
cuccaagaauuuc

SEQ ID NO: 3074593 - RNA, 13 nt, Human
cuccaagcaggac

SEQ ID NO: 3074594 - RNA, 14 nt, Human
cuccaagcaggaca

SEQ ID NO: 3074595 - RNA, 22 nt, Human
cuccaagcaggacauggacaag

SEQ ID NO: 3074596 - RNA, 24 nt, Human
cuccaagcaggacauggacaagga

SEQ ID NO: 3074597 - RNA, 22 nt, Human
cuccaagaccuucuccuucacc

SEQ ID NO: 3074598 - RNA, 21 nt, Human
cuccaagaccuucuccuucac

SEQ ID NO: 3074599 - RNA, 14 nt, Human
cuccaagaauuucu

SEQ ID NO: 3074600 - RNA, 16 nt, Human
cuccacuuucuagcca

SEQ ID NO: 3074601 - RNA, 19 nt, Human
cuccacuuucuagccagag

SEQ ID NO: 3074602 - RNA, 23 nt, Human
cuccacuuggucugugagaugcu

SEQ ID NO: 3074603 - RNA, 15 nt, Human
cucccaccuggcucu

SEQ ID NO: 3074604 - RNA, 22 nt, Human
cucccaccuggcucuguggcga

SEQ ID NO: 3074605 - RNA, 13 nt, Human
cucccaccuggcu

SEQ ID NO: 3074606 - RNA, 14 nt, Human
cucccaccuggcuc

SEQ ID NO: 3074607 - RNA, 19 nt, Human
cuccccaugauguuuagaa

SEQ ID NO: 3074608 - RNA, 12 nt, Human
cuagccagagga

SEQ ID NO: 3074609 - RNA, 13 nt, Human
cuagccagaggag

SEQ ID NO: 3074610 - RNA, 15 nt, Human
cuagccagaggagag

SEQ ID NO: 3074611 - RNA, 13 nt, Human
cuaguuugauuaa

SEQ ID NO: 3074612 - RNA, 22 nt, Human
cuaguuguuugauucagacagc

SEQ ID NO: 3074613 - RNA, 23 nt, Human
cuaguuguuugauucagacagcu

SEQ ID NO: 3074614 - RNA, 22 nt, Human
cuaguuugauuaaauucuugca

SEQ ID NO: 3074615 - RNA, 21 nt, Human
cuaguuugauuaaauucuugc

SEQ ID NO: 3074616 - RNA, 18 nt, Human
cuaucguaaaauuaagaa

SEQ ID NO: 3074617 - RNA, 17 nt, Human
cuaucguaaaauuaaga

SEQ ID NO: 3074618 - RNA, 14 nt, Human
cuaucuaaauguug

SEQ ID NO: 3074619 - RNA, 15 nt, Human
cuaucucccccagcc

SEQ ID NO: 3074620 - RNA, 14 nt, Human
cuaucucccccagc

SEQ ID NO: 3074621 - RNA, 15 nt, Human
cucaaugcacugaca

SEQ ID NO: 3074622 - RNA, 13 nt, Human
cucaaugcacuga

SEQ ID NO: 3074623 - RNA, 20 nt, Human
cucaaacucuugaccucagg

SEQ ID NO: 3074624 - RNA, 18 nt, Human
cucaaaagcugggcaggu

SEQ ID NO: 3074625 - RNA, 23 nt, Human
cucaaaauaccaugccauuuaaa

SEQ ID NO: 3074626 - RNA, 17 nt, Human
cucaaaacugcacuguc

SEQ ID NO: 3074627 - RNA, 16 nt, Human
cuaucucccccagccc

SEQ ID NO: 3074628 - RNA, 17 nt, Human
cuaucucccccagcccc

SEQ ID NO: 3074629 - RNA, 23 nt, Human
cuaaguuuuuauggcuuuugugc

SEQ ID NO: 3074630 - RNA, 20 nt, Human
cuaaguuuuuauggcuuuug

SEQ ID NO: 3074631 - RNA, 21 nt, Human
cuaagugguacuaacuuuccu

SEQ ID NO: 3074632 - RNA, 23 nt, Human
cuaagugauccucccaccucagc

SEQ ID NO: 3074633 - RNA, 23 nt, Human
cuaaguaaaaccacagcaguuga

SEQ ID NO: 3074634 - RNA, 22 nt, Human
cuaaguaaaaccacagcaguug

SEQ ID NO: 3074635 - RNA, 20 nt, Human
cgugugugugcguccugucg

SEQ ID NO: 3074636 - RNA, 20 nt, Human
cuaaguaaaaccacagcagu

SEQ ID NO: 3074637 - RNA, 19 nt, Human
cuacaguccucccaucuca

SEQ ID NO: 3074638 - RNA, 18 nt, Human
cuacaaaaacacagcaag

SEQ ID NO: 3074639 - RNA, 17 nt, Human
cuacaaaaacacagcaa

SEQ ID NO: 3074640 - RNA, 16 nt, Human
cuacaaaaacacagca

SEQ ID NO: 3074641 - RNA, 15 nt, Human
cuacaaaaacacagc

SEQ ID NO: 3074642 - RNA, 22 nt, Human
cuacaguugaaaaacagcugag

SEQ ID NO: 3074643 - RNA, 18 nt, Human
cuacauacaauuccaaac

SEQ ID NO: 3074644 - RNA, 18 nt, Human
cuacauacuauggaauuu

SEQ ID NO: 3074645 - RNA, 19 nt, Human
cuacaguugaaaaacagcu

SEQ ID NO: 3074646 - RNA, 21 nt, Human
cuacaguugaaaaacagcuga

SEQ ID NO: 3074647 - RNA, 20 nt, Human
cuacaguccucccaucucac

SEQ ID NO: 3074648 - RNA, 18 nt, Human
cuacaguccucccaucuc

SEQ ID NO: 3074649 - RNA, 17 nt, Human
cuaccuuuguauucucu

SEQ ID NO: 3074650 - RNA, 20 nt, Human
cuacaugagguacugagagu

SEQ ID NO: 3074651 - RNA, 18 nt, Human
cuacaugagguacugaga

SEQ ID NO: 3074652 - RNA, 22 nt, Human
cuagaagauuuugaaauuuuua

SEQ ID NO: 3074653 - RNA, 12 nt, Human
cuagaacucccu

SEQ ID NO: 3074654 - RNA, 23 nt, Human
cuagcauacguacacauuuuauu

SEQ ID NO: 3074655 - RNA, 21 nt, Human
cuagcauacguacacauuuua

SEQ ID NO: 3074656 - RNA, 20 nt, Human
cuagcauacguacacauuuu

SEQ ID NO: 3074657 - RNA, 23 nt, Human
cuagaauuugauaugugaacagu

SEQ ID NO: 3074658 - RNA, 12 nt, Human
cgacaaugcaaa

SEQ ID NO: 3074659 - RNA, 13 nt, Human
cgacaaugcaaac

SEQ ID NO: 3074660 - RNA, 19 nt, Human
cgacccuugccgucuaccu

SEQ ID NO: 3074661 - RNA, 20 nt, Human
cgacccuugccgucuaccug

SEQ ID NO: 3074662 - RNA, 17 nt, Human
cgacugcccggcagggu

SEQ ID NO: 3074663 - RNA, 14 nt, Human
ccuuuaagagaaau

SEQ ID NO: 3074664 - RNA, 16 nt, Human
ccuugccgucuaccug

SEQ ID NO: 3074665 - RNA, 15 nt, Human
ccuuuugagugccuu

SEQ ID NO: 3074666 - RNA, 17 nt, Human
ccuuuugagugccuuac

SEQ ID NO: 3074667 - RNA, 21 nt, Human
ccuuucaauaggaaaaacuga

SEQ ID NO: 3074668 - RNA, 18 nt, Human
ccuuucaauaggaaaaac

SEQ ID NO: 3074669 - RNA, 23 nt, Human
cgccacuguuuugaaucucauaa

SEQ ID NO: 3074670 - RNA, 14 nt, Human
cgccuacaggagug

SEQ ID NO: 3074671 - RNA, 22 nt, Human
cgcaggauucuuccucccuccc

SEQ ID NO: 3074672 - RNA, 18 nt, Human
cgcaggcccccaggugcc

SEQ ID NO: 3074673 - RNA, 14 nt, Human
cgauagugguggug

SEQ ID NO: 3074674 - RNA, 16 nt, Human
cgaguagcugggacua

SEQ ID NO: 3074675 - RNA, 14 nt, Human
cguaaaauuaagaa

SEQ ID NO: 3074676 - RNA, 16 nt, Human
cgguuuuacugcagcu

SEQ ID NO: 3074677 - RNA, 17 nt, Human
cgugaggccagagacac

SEQ ID NO: 3074678 - RNA, 16 nt, Human
cgugaguccuggcaug

SEQ ID NO: 3074679 - RNA, 17 nt, Human
cgugaguccuggcaugg

SEQ ID NO: 3074680 - RNA, 16 nt, Human
cgugaggccagagaca

SEQ ID NO: 3074681 - RNA, 20 nt, Human
cguguaaccauggacccaau

SEQ ID NO: 3074682 - RNA, 15 nt, Human
cguggugauuuagca

SEQ ID NO: 3074683 - RNA, 22 nt, Human
cguggugauuuagcaggaagcu

SEQ ID NO: 3074684 - RNA, 11 nt, Human
cgggcucagca

SEQ ID NO: 3074685 - RNA, 14 nt, Human
cgggcucugccucc

SEQ ID NO: 3074686 - RNA, 16 nt, Human
cgggcucugccuccca

SEQ ID NO: 3074687 - RNA, 15 nt, Human
cgggcucagcaaaag

SEQ ID NO: 3074688 - RNA, 13 nt, Human
cgggcucugccuc

SEQ ID NO: 3074689 - RNA, 17 nt, Human
cgggcucugccucccau

SEQ ID NO: 3074690 - RNA, 14 nt, Human
cggggacagcuccu

SEQ ID NO: 3074691 - RNA, 18 nt, Human
cgguguggagaagcggcu

SEQ ID NO: 3074692 - RNA, 13 nt, Human
cgguguggagaag

SEQ ID NO: 3074693 - RNA, 15 nt, Human
cggggacagcuccuu

SEQ ID NO: 3074694 - RNA, 14 nt, Human
cggcucacugcagc

SEQ ID NO: 3074695 - RNA, 15 nt, Human
cggcucacugcagcc

SEQ ID NO: 3074696 - RNA, 20 nt, Human
cggagucccaccuuggcugc

SEQ ID NO: 3074697 - RNA, 18 nt, Human
cggagucccaccuuggcu

SEQ ID NO: 3074698 - RNA, 16 nt, Human
cggcucacugcagccu

SEQ ID NO: 3074699 - RNA, 14 nt, Human
cggagucccaccuu

SEQ ID NO: 3074700 - RNA, 12 nt, Human
cggcuccaggcu

SEQ ID NO: 3074701 - RNA, 16 nt, Human
cggcuccaggcuccuu

SEQ ID NO: 3074702 - RNA, 15 nt, Human
cggcuccaggcuccu

SEQ ID NO: 3074703 - RNA, 14 nt, Human
cggcuccaggcucc

SEQ ID NO: 3074704 - RNA, 13 nt, Human
cggcuccaggcuc

SEQ ID NO: 3074705 - RNA, 14 nt, Human
cgggccacagagaa

SEQ ID NO: 3074706 - RNA, 12 nt, Human
cgggccacagag

SEQ ID NO: 3074707 - RNA, 16 nt, Human
cggagucccaccuugg

SEQ ID NO: 3074708 - RNA, 12 nt, Human
ccagucaccccg

SEQ ID NO: 3074709 - RNA, 20 nt, Human
ccagucaccccggccaccug

SEQ ID NO: 3074710 - RNA, 21 nt, Human
ccagucaccccggccaccugc

SEQ ID NO: 3074711 - RNA, 19 nt, Human
ccagucaccccggccaccu

SEQ ID NO: 3074712 - RNA, 19 nt, Human
ccaggcuggcgugcagugg

SEQ ID NO: 3074713 - RNA, 22 nt, Human
ccaggcugggagagccuuccag

SEQ ID NO: 3074714 - RNA, 15 nt, Human
ccaggcugggagagc

SEQ ID NO: 3074715 - RNA, 17 nt, Human
ccaggcugggagagccu

SEQ ID NO: 3074716 - RNA, 18 nt, Human
ccaggcugggagagccuu

SEQ ID NO: 3074717 - RNA, 21 nt, Human
ccaggcugggagagccuucca

SEQ ID NO: 3074718 - RNA, 13 nt, Human
ccaggcugggaga

SEQ ID NO: 3074719 - RNA, 14 nt, Human
ccaggcugggagag

SEQ ID NO: 3074720 - RNA, 19 nt, Human
ccagcagccuggacccugu

SEQ ID NO: 3074721 - RNA, 18 nt, Human
ccagccccuggaugcagc

SEQ ID NO: 3074722 - RNA, 15 nt, Human
ccagcagccuggacc

SEQ ID NO: 3074723 - RNA, 14 nt, Human
ccagcagccuggac

SEQ ID NO: 3074724 - RNA, 10 nt, Human
ccagccccuu

SEQ ID NO: 3074725 - RNA, 21 nt, Human
ccagccccuggaugcagccuc

SEQ ID NO: 3074726 - RNA, 22 nt, Human
ccaggaaaggcuccaggagcag

SEQ ID NO: 3074727 - RNA, 23 nt, Human
ccaggaaaggcuccaggagcagc

SEQ ID NO: 3074728 - RNA, 21 nt, Human
ccaggaaaggcuccaggagca

SEQ ID NO: 3074729 - RNA, 16 nt, Human
ccagcuuaucucaggg

SEQ ID NO: 3074730 - RNA, 23 nt, Human
ccagcagagcaccuuagacaguc

SEQ ID NO: 3074731 - RNA, 19 nt, Human
ccagcagagcaccuuagac

SEQ ID NO: 3074732 - RNA, 13 nt, Human
ccaugagccucag

SEQ ID NO: 3074733 - RNA, 16 nt, Human
ccauccccuguagagu

SEQ ID NO: 3074734 - RNA, 14 nt, Human
ccaugaguccccug

SEQ ID NO: 3074735 - RNA, 15 nt, Human
ccaugaguccccugu

SEQ ID NO: 3074736 - RNA, 16 nt, Human
ccaugaguccccuguu

SEQ ID NO: 3074737 - RNA, 13 nt, Human
ccaugggccuccu

SEQ ID NO: 3074738 - RNA, 13 nt, Human
ccaugaguccccu

SEQ ID NO: 3074739 - RNA, 19 nt, Human
ccaugagccucagcauccu

SEQ ID NO: 3074740 - RNA, 18 nt, Human
ccaugagccucagcaucc

SEQ ID NO: 3074741 - RNA, 14 nt, Human
ccaugagccucagc

SEQ ID NO: 3074742 - RNA, 12 nt, Human
ccaucccagccc

SEQ ID NO: 3074743 - RNA, 23 nt, Human
ccaucccaaacccuucagugcca

SEQ ID NO: 3074744 - RNA, 13 nt, Human
ccauacauuugug

SEQ ID NO: 3074745 - RNA, 20 nt, Human
ccaucccaaacccuucagug

SEQ ID NO: 3074746 - RNA, 15 nt, Human
ccaugggccuccugu

SEQ ID NO: 3074747 - RNA, 14 nt, Human
ccaugggccuccug

SEQ ID NO: 3074748 - RNA, 22 nt, Human
ccauuuaaagcuuauuaaaacu

SEQ ID NO: 3074749 - RNA, 21 nt, Human
cccaggcuggcgugcaguggu

SEQ ID NO: 3074750 - RNA, 15 nt, Human
cccaggcuuagucac

SEQ ID NO: 3074751 - RNA, 19 nt, Human
cccaggaaaggcuccagga

SEQ ID NO: 3074752 - RNA, 23 nt, Human
cccagcugugcucuggacaggca

SEQ ID NO: 3074753 - RNA, 21 nt, Human
cccagcugugcucuggacagg

SEQ ID NO: 3074754 - RNA, 21 nt, Human
cccaggaaaggcuccaggagc

SEQ ID NO: 3074755 - RNA, 22 nt, Human
cccaggaaaggcuccaggagca

SEQ ID NO: 3074756 - RNA, 23 nt, Human
cccaggaaaggcuccaggagcag

SEQ ID NO: 3074757 - RNA, 14 nt, Human
cccagcccacuucu

SEQ ID NO: 3074758 - RNA, 22 nt, Human
cccauucugccugcccaggccc

SEQ ID NO: 3074759 - RNA, 21 nt, Human
cccauucugccugcccaggcc

SEQ ID NO: 3074760 - RNA, 20 nt, Human
cccauucugccugcccaggc

SEQ ID NO: 3074761 - RNA, 19 nt, Human
ccccauccucuguacagag

SEQ ID NO: 3074762 - RNA, 21 nt, Human
ccccauccucuguacagagcc

SEQ ID NO: 3074763 - RNA, 22 nt, Human
ccccauccucuguacagagccc

SEQ ID NO: 3074764 - RNA, 24 nt, Human
ccccaucugcgggggcagugcuca

SEQ ID NO: 3074765 - RNA, 17 nt, Human
ccccauccucuguacag

SEQ ID NO: 3074766 - RNA, 20 nt, Human
ccccagcaagugagagcugg

SEQ ID NO: 3074767 - RNA, 19 nt, Human
ccccagcaagugagagcug

SEQ ID NO: 3074768 - RNA, 17 nt, Human
ccccagcaagugagagc

SEQ ID NO: 3074769 - RNA, 23 nt, Human
ccccagauugcaacaggcugggc

SEQ ID NO: 3074770 - RNA, 22 nt, Human
ccccagauugcaacaggcuggg

SEQ ID NO: 3074771 - RNA, 21 nt, Human
ccccagauugcaacaggcugg

SEQ ID NO: 3074772 - RNA, 17 nt, Human
ccccuucgcuccugugu

SEQ ID NO: 3074773 - RNA, 15 nt, Human
ccccuucgcuccugu

SEQ ID NO: 3074774 - RNA, 14 nt, Human
ccccuucgcuccug

SEQ ID NO: 3074775 - RNA, 19 nt, Human
ccccuucgcuccugugucu

SEQ ID NO: 3074776 - RNA, 18 nt, Human
ccccugcacuccagccug

SEQ ID NO: 3074777 - RNA, 14 nt, Human
ccccauucugccug

SEQ ID NO: 3074778 - RNA, 13 nt, Human
ccccauucugccu

SEQ ID NO: 3074779 - RNA, 15 nt, Human
ccccauucugccugc

SEQ ID NO: 3074780 - RNA, 12 nt, Human
cccggcugcgga

SEQ ID NO: 3074781 - RNA, 18 nt, Human
cccggcuuuggugcgggg

SEQ ID NO: 3074782 - RNA, 16 nt, Human
ccccuucugacccaug

SEQ ID NO: 3074783 - RNA, 17 nt, Human
ccccuucugacccaugc

SEQ ID NO: 3074784 - RNA, 20 nt, Human
cccucaacucuccuccagag

SEQ ID NO: 3074785 - RNA, 16 nt, Human
ccugucggagcccugu

SEQ ID NO: 3074786 - RNA, 21 nt, Human
ccugucggagcccugucuccu

SEQ ID NO: 3074787 - RNA, 17 nt, Human
ccugucggagcccuguc

SEQ ID NO: 3074788 - RNA, 15 nt, Human
ccuguaaucacagcu

SEQ ID NO: 3074789 - RNA, 21 nt, Human
ccugguggcagugggagcugc

SEQ ID NO: 3074790 - RNA, 22 nt, Human
ccugucuaaugaaaccuguguc

SEQ ID NO: 3074791 - RNA, 15 nt, Human
ccugucuaaugaaac

SEQ ID NO: 3074792 - RNA, 22 nt, Human
ccugucggagcccugucuccuc

SEQ ID NO: 3074793 - RNA, 16 nt, Human
ccuggccucugcacuc

SEQ ID NO: 3074794 - RNA, 22 nt, Human
ccuggccuagcauacguacaca

SEQ ID NO: 3074795 - RNA, 20 nt, Human
ccuggccucugcacuccccu

SEQ ID NO: 3074796 - RNA, 21 nt, Human
ccuggccucugcacuccccug

SEQ ID NO: 3074797 - RNA, 22 nt, Human
ccuggccucugcacuccccugc

SEQ ID NO: 3074798 - RNA, 11 nt, Human
ccucuuucccu

SEQ ID NO: 3074799 - RNA, 13 nt, Human
ccucuuucccucc

SEQ ID NO: 3074800 - RNA, 17 nt, Human
ccugcacuugcagacuc

SEQ ID NO: 3074801 - RNA, 16 nt, Human
ccugcacuugcagacu

SEQ ID NO: 3074802 - RNA, 14 nt, Human
ccugcagagggcac

SEQ ID NO: 3074803 - RNA, 18 nt, Human
ccugcacuugcagacucu

SEQ ID NO: 3074804 - RNA, 17 nt, Human
ccugcugcaguugccag

SEQ ID NO: 3074805 - RNA, 19 nt, Human
ccugcugcaguugccaguc

SEQ ID NO: 3074806 - RNA, 23 nt, Human
ccugccucgaacuggcugcaaag

SEQ ID NO: 3074807 - RNA, 21 nt, Human
ccugccucgaacuggcugcaa

SEQ ID NO: 3074808 - RNA, 19 nt, Human
ccugccucgaacuggcugc

SEQ ID NO: 3074809 - RNA, 20 nt, Human
ccugcugcaguugccaguca

SEQ ID NO: 3074810 - RNA, 13 nt, Human
ccugcugcuccua

SEQ ID NO: 3074811 - RNA, 15 nt, Human
ccugcugcuccuagg

SEQ ID NO: 3074812 - RNA, 16 nt, Human
ccugcugcuccuagga

SEQ ID NO: 3074813 - RNA, 17 nt, Human
ccugcugcuccuaggac

SEQ ID NO: 3074814 - RNA, 12 nt, Human
ccugcccaccug

SEQ ID NO: 3074815 - RNA, 14 nt, Human
ccugcccaccuggc

SEQ ID NO: 3074816 - RNA, 20 nt, Human
ccugcccaccuggccucugc

SEQ ID NO: 3074817 - RNA, 13 nt, Human
ccugcccaccugg

SEQ ID NO: 3074818 - RNA, 13 nt, Human
ccugcccaggccc

SEQ ID NO: 3074819 - RNA, 13 nt, Human
ccggccccugcug

SEQ ID NO: 3074820 - RNA, 22 nt, Human
cccuucucuccagccccuggau

SEQ ID NO: 3074821 - RNA, 23 nt, Human
ccgcagcccugcagagggcacag

SEQ ID NO: 3074822 - RNA, 21 nt, Human
cccuucucuccagccccugga

SEQ ID NO: 3074823 - RNA, 15 nt, Human
cccuucgcuccugug

SEQ ID NO: 3074824 - RNA, 14 nt, Human
cccuucgcuccugu

SEQ ID NO: 3074825 - RNA, 20 nt, Human
cccugucucaaaaaaagaaa

SEQ ID NO: 3074826 - RNA, 23 nt, Human
cccugucucaaaaaaagaaaaag

SEQ ID NO: 3074827 - RNA, 16 nt, Human
cccugucuaaugaaac

SEQ ID NO: 3074828 - RNA, 13 nt, Human
cccugucuaauga

SEQ ID NO: 3074829 - RNA, 18 nt, Human
cccugugauggggcccug

SEQ ID NO: 3074830 - RNA, 19 nt, Human
cccugugauggggcccugc

SEQ ID NO: 3074831 - RNA, 20 nt, Human
cccugugauggggcccugcc

SEQ ID NO: 3074832 - RNA, 13 nt, Human
cccuucgcuccug

SEQ ID NO: 3074833 - RNA, 17 nt, Human
cccugugauggggcccu

SEQ ID NO: 3074834 - RNA, 19 nt, Human
cccugucuccucucucugu

SEQ ID NO: 3074835 - RNA, 14 nt, Human
ccggccccugcugg

SEQ ID NO: 3074836 - RNA, 13 nt, Human
ccucccaucucac

SEQ ID NO: 3074837 - RNA, 16 nt, Human
ccucccaucucacaca

SEQ ID NO: 3074838 - RNA, 15 nt, Human
ccucccaccucagcc

SEQ ID NO: 3074839 - RNA, 21 nt, Human
ccucauuuuuauaaugucccu

SEQ ID NO: 3074840 - RNA, 23 nt, Human
ccucauggaauuggagcucgugg

SEQ ID NO: 3074841 - RNA, 14 nt, Human
caugggaaugaaug

SEQ ID NO: 3074842 - RNA, 15 nt, Human
caugggaaugaaugu

SEQ ID NO: 3074843 - RNA, 16 nt, Human
caugggaaugaauguc

SEQ ID NO: 3074844 - RNA, 17 nt, Human
caugggaaugaauguca

SEQ ID NO: 3074845 - RNA, 20 nt, Human
caugcuccuggcccacugca

SEQ ID NO: 3074846 - RNA, 23 nt, Human
caugcuacacacugcauguuugu

SEQ ID NO: 3074847 - RNA, 20 nt, Human
caugcuacacacugcauguu

SEQ ID NO: 3074848 - RNA, 14 nt, Human
caugcuacacacug

SEQ ID NO: 3074849 - RNA, 13 nt, Human
caugauguuuucc

SEQ ID NO: 3074850 - RNA, 14 nt, Human
caugauguuuagaa

SEQ ID NO: 3074851 - RNA, 15 nt, Human
cauguuggccaggcu

SEQ ID NO: 3074852 - RNA, 14 nt, Human
cauguuggccaggc

SEQ ID NO: 3074853 - RNA, 16 nt, Human
cauguuggccaggcug

SEQ ID NO: 3074854 - RNA, 19 nt, Human
cauguuggccaggcugguc

SEQ ID NO: 3074855 - RNA, 14 nt, Human
cauucuccaccugc

SEQ ID NO: 3074856 - RNA, 16 nt, Human
cauucuccaccugcca

SEQ ID NO: 3074857 - RNA, 13 nt, Human
cauucuccaccug

SEQ ID NO: 3074858 - RNA, 23 nt, Human
cauaugcuguauauccuuucuaa

SEQ ID NO: 3074859 - RNA, 22 nt, Human
caguggugguuuucuguucuuu

SEQ ID NO: 3074860 - RNA, 21 nt, Human
caguggugguuuucuguucuu

SEQ ID NO: 3074861 - RNA, 20 nt, Human
caguggugguuuucuguucu

SEQ ID NO: 3074862 - RNA, 19 nt, Human
caguggugguuuucuguuc

SEQ ID NO: 3074863 - RNA, 19 nt, Human
cauauuaauauauuuccau

SEQ ID NO: 3074864 - RNA, 14 nt, Human
cauauuaauauauu

SEQ ID NO: 3074865 - RNA, 15 nt, Human
cauauuaauauauuu

SEQ ID NO: 3074866 - RNA, 17 nt, Human
cauauucuguuggccag

SEQ ID NO: 3074867 - RNA, 22 nt, Human
cauauucaggaagcucagggcc

SEQ ID NO: 3074868 - RNA, 15 nt, Human
cauccuggcacccgg

SEQ ID NO: 3074869 - RNA, 14 nt, Human
caucacuucccuac

SEQ ID NO: 3074870 - RNA, 12 nt, Human
caucacuucccu

SEQ ID NO: 3074871 - RNA, 21 nt, Human
cauccccuguagagugggagc

SEQ ID NO: 3074872 - RNA, 22 nt, Human
cauccuggcacccggccccugc

SEQ ID NO: 3074873 - RNA, 12 nt, Human
cauccuggaaua

SEQ ID NO: 3074874 - RNA, 17 nt, Human
ccaaugggagcucaugg

SEQ ID NO: 3074875 - RNA, 14 nt, Human
ccaaugggagcuca

SEQ ID NO: 3074876 - RNA, 23 nt, Human
ccaaauggaaaugggcagagcag

SEQ ID NO: 3074877 - RNA, 14 nt, Human
ccaacucaccccag

SEQ ID NO: 3074878 - RNA, 17 nt, Human
ccaaauguucaucaaug

SEQ ID NO: 3074879 - RNA, 16 nt, Human
ccaacucaccccagcc

SEQ ID NO: 3074880 - RNA, 17 nt, Human
ccaacucaccccagccc

SEQ ID NO: 3074881 - RNA, 18 nt, Human
ccaacucaccccagcccc

SEQ ID NO: 3074882 - RNA, 13 nt, Human
ccaagcucugcuc

SEQ ID NO: 3074883 - RNA, 17 nt, Human
ccaagcucugcuccucu

SEQ ID NO: 3074884 - RNA, 12 nt, Human
ccaagcucugcu

SEQ ID NO: 3074885 - RNA, 18 nt, Human
ccaagcucugcuccucuc

SEQ ID NO: 3074886 - RNA, 14 nt, Human
ccaaugcacuuugu

SEQ ID NO: 3074887 - RNA, 15 nt, Human
ccaaugauggucacc

SEQ ID NO: 3074888 - RNA, 17 nt, Human
ccaauauuuaccagacc

SEQ ID NO: 3074889 - RNA, 20 nt, Human
ccaaaacucuccucugcugc

SEQ ID NO: 3074890 - RNA, 21 nt, Human
ccaaaacucuccucugcugcu

SEQ ID NO: 3074891 - RNA, 16 nt, Human
cauuuguguugaagag

SEQ ID NO: 3074892 - RNA, 19 nt, Human
cauuuguauaaaauaauuu

SEQ ID NO: 3074893 - RNA, 20 nt, Human
cauuuguauaaaauaauuuu

SEQ ID NO: 3074894 - RNA, 17 nt, Human
cauuuguauaaaauaau

SEQ ID NO: 3074895 - RNA, 22 nt, Human
ccacuccggcccuccagagccc

SEQ ID NO: 3074896 - RNA, 21 nt, Human
ccacuccggcccuccagagcc

SEQ ID NO: 3074897 - RNA, 20 nt, Human
ccacuccggcccuccagagc

SEQ ID NO: 3074898 - RNA, 17 nt, Human
ccacucccugcaaccug

SEQ ID NO: 3074899 - RNA, 21 nt, Human
ccaccuuugaagaaguaagga

SEQ ID NO: 3074900 - RNA, 22 nt, Human
ccaccgcagacaggaccaggga

SEQ ID NO: 3074901 - RNA, 19 nt, Human
ccaccgcagacaggaccag

SEQ ID NO: 3074902 - RNA, 16 nt, Human
ccacgcccccacuggu

SEQ ID NO: 3074903 - RNA, 17 nt, Human
ccacgcccccacuggug

SEQ ID NO: 3074904 - RNA, 18 nt, Human
ccacgcccccacugguga

SEQ ID NO: 3074905 - RNA, 19 nt, Human
ccacgcccccacuggugac

SEQ ID NO: 3074906 - RNA, 13 nt, Human
ccacgcccccacu

SEQ ID NO: 3074907 - RNA, 17 nt, Human
ccaccacacccagccca

SEQ ID NO: 3074908 - RNA, 13 nt, Human
ccaccaucaagcc

SEQ ID NO: 3074909 - RNA, 14 nt, Human
ccaccaucaagcca

SEQ ID NO: 3074910 - RNA, 20 nt, Human
ccaccagugccucucccugc

SEQ ID NO: 3074911 - RNA, 24 nt, Human
ccaccagugccucucccugcugcu

SEQ ID NO: 3074912 - RNA, 23 nt, Human
ccacagcaguugaaaagacucca

SEQ ID NO: 3074913 - RNA, 18 nt, Human
ccacagcaguugaaaaga

SEQ ID NO: 3074914 - RNA, 17 nt, Human
ccacagcaguugaaaag

SEQ ID NO: 3074915 - RNA, 23 nt, Human
ccacagcgcuggccgggaccccg

SEQ ID NO: 3074916 - RNA, 12 nt, Human
ccacagcaguug

SEQ ID NO: 3074917 - RNA, 19 nt, Human
caggggaaaaucagccugc

SEQ ID NO: 3074918 - RNA, 17 nt, Human
caggggaaaaucagccu

SEQ ID NO: 3074919 - RNA, 20 nt, Human
caggggaaaaucagccugcu

SEQ ID NO: 3074920 - RNA, 20 nt, Human
cagggcucagcggggacagc

SEQ ID NO: 3074921 - RNA, 23 nt, Human
cagggcucagcggggacagcucc

SEQ ID NO: 3074922 - RNA, 21 nt, Human
cagggcucagcggggacagcu

SEQ ID NO: 3074923 - RNA, 12 nt, Human
caggcugggaga

SEQ ID NO: 3074924 - RNA, 14 nt, Human
caggcugggagagc

SEQ ID NO: 3074925 - RNA, 20 nt, Human
caggcugggcuucaguggca

SEQ ID NO: 3074926 - RNA, 22 nt, Human
caggcugggcuucaguggcagc

SEQ ID NO: 3074927 - RNA, 21 nt, Human
caggcugggcuucaguggcag

SEQ ID NO: 3074928 - RNA, 19 nt, Human
caggccaggcccucugccc

SEQ ID NO: 3074929 - RNA, 17 nt, Human
caggccaggcccucugc

SEQ ID NO: 3074930 - RNA, 18 nt, Human
caggccaggcccucugcc

SEQ ID NO: 3074931 - RNA, 17 nt, Human
caggccagcugcuuggg

SEQ ID NO: 3074932 - RNA, 19 nt, Human
caggccagcugcuugggcu

SEQ ID NO: 3074933 - RNA, 21 nt, Human
caggccagcugcuugggcuuc

SEQ ID NO: 3074934 - RNA, 23 nt, Human
caggccagcugcuugggcuucau

SEQ ID NO: 3074935 - RNA, 15 nt, Human
caggccagagggagu

SEQ ID NO: 3074936 - RNA, 13 nt, Human
caggccagaggga

SEQ ID NO: 3074937 - RNA, 18 nt, Human
caggcagauacaggaaaa

SEQ ID NO: 3074938 - RNA, 23 nt, Human
caguaaagaacaucccuccuggg

SEQ ID NO: 3074939 - RNA, 16 nt, Human
cagguuuuccugaaga

SEQ ID NO: 3074940 - RNA, 14 nt, Human
cagguuuaagcugu

SEQ ID NO: 3074941 - RNA, 12 nt, Human
cagguuuuccug

SEQ ID NO: 3074942 - RNA, 21 nt, Human
caggugcacaagcuccaagcu

SEQ ID NO: 3074943 - RNA, 19 nt, Human
caggugccaguuauggcua

SEQ ID NO: 3074944 - RNA, 21 nt, Human
cagguuggugggggccucggu

SEQ ID NO: 3074945 - RNA, 20 nt, Human
caggugauccacccaccuca

SEQ ID NO: 3074946 - RNA, 21 nt, Human
caggugauccacccaccucag

SEQ ID NO: 3074947 - RNA, 17 nt, Human
caggugcacaagcucca

SEQ ID NO: 3074948 - RNA, 18 nt, Human
caggugcacaagcuccaa

SEQ ID NO: 3074949 - RNA, 19 nt, Human
caggugcacaagcuccaag

SEQ ID NO: 3074950 - RNA, 20 nt, Human
caggugcacaagcuccaagc

SEQ ID NO: 3074951 - RNA, 23 nt, Human
caggugauccacccaccucagcc

SEQ ID NO: 3074952 - RNA, 22 nt, Human
caggugauccacccaccucagc

SEQ ID NO: 3074953 - RNA, 15 nt, Human
caggugcacaagcuc

SEQ ID NO: 3074954 - RNA, 15 nt, Human
cagucaccucaugga

SEQ ID NO: 3074955 - RNA, 19 nt, Human
cagucaccucauggaauug

SEQ ID NO: 3074956 - RNA, 15 nt, Human
cagucacauuccaag

SEQ ID NO: 3074957 - RNA, 16 nt, Human
cagucaccucauggaa

SEQ ID NO: 3074958 - RNA, 14 nt, Human
caguggggaaugaa

SEQ ID NO: 3074959 - RNA, 18 nt, Human
caguggugguuuucuguu

SEQ ID NO: 3074960 - RNA, 21 nt, Human
caguggugcgaucuggguuca

SEQ ID NO: 3074961 - RNA, 20 nt, Human
caguggugcgaucuggguuc

SEQ ID NO: 3074962 - RNA, 23 nt, Human
cagugggagcugccuguucagcu

SEQ ID NO: 3074963 - RNA, 20 nt, Human
cagugggagcugccuguuca

SEQ ID NO: 3074964 - RNA, 17 nt, Human
cagugcccacaggauca

SEQ ID NO: 3074965 - RNA, 16 nt, Human
cagugcaugcuguccc

SEQ ID NO: 3074966 - RNA, 17 nt, Human
cagugcaugcugucccu

SEQ ID NO: 3074967 - RNA, 15 nt, Human
cagugcccacaggau

SEQ ID NO: 3074968 - RNA, 13 nt, Human
cagugcccacagg

SEQ ID NO: 3074969 - RNA, 20 nt, Human
cagucugacuguuuccauca

SEQ ID NO: 3074970 - RNA, 17 nt, Human
cagucuggaaugcagug

SEQ ID NO: 3074971 - RNA, 15 nt, Human
cagucuggaaugcag

SEQ ID NO: 3074972 - RNA, 13 nt, Human
cagugcaugcugu

SEQ ID NO: 3074973 - RNA, 14 nt, Human
cagugcaugcuguc

SEQ ID NO: 3074974 - RNA, 13 nt, Human
cagcauaauacuu

SEQ ID NO: 3074975 - RNA, 22 nt, Human
cagcaguugaaaagacuccaaa

SEQ ID NO: 3074976 - RNA, 19 nt, Human
cagcacgauuucuguuuag

SEQ ID NO: 3074977 - RNA, 18 nt, Human
cagcacgauuucuguuua

SEQ ID NO: 3074978 - RNA, 16 nt, Human
cagcacgauuucuguu

SEQ ID NO: 3074979 - RNA, 20 nt, Human
cagauucuuuccugaggcug

SEQ ID NO: 3074980 - RNA, 22 nt, Human
cagauucuuuccugaggcuggg

SEQ ID NO: 3074981 - RNA, 17 nt, Human
cagauugcaacaggcug

SEQ ID NO: 3074982 - RNA, 20 nt, Human
cagcaucauggagguuugaa

SEQ ID NO: 3074983 - RNA, 21 nt, Human
cagaguaauccaagcaaaugu

SEQ ID NO: 3074984 - RNA, 17 nt, Human
cagagguugcagugagc

SEQ ID NO: 3074985 - RNA, 16 nt, Human
cagagguugcagugag

SEQ ID NO: 3074986 - RNA, 22 nt, Human
cagaggggguggccucccaacu

SEQ ID NO: 3074987 - RNA, 23 nt, Human
cagaggggguggccucccaacuc

SEQ ID NO: 3074988 - RNA, 12 nt, Human
cagauccuggaa

SEQ ID NO: 3074989 - RNA, 15 nt, Human
cagauucuuuccuga

SEQ ID NO: 3074990 - RNA, 17 nt, Human
cagauucuuuccugagg

SEQ ID NO: 3074991 - RNA, 18 nt, Human
cagauucuuuccugaggc

SEQ ID NO: 3074992 - RNA, 19 nt, Human
cagauucuuuccugaggcu

SEQ ID NO: 3074993 - RNA, 19 nt, Human
cagcuguucagcugguuga

SEQ ID NO: 3074994 - RNA, 24 nt, Human
cagcugugcucuggacaggcaugu

SEQ ID NO: 3074995 - RNA, 20 nt, Human
cagcugugcucuggacaggc

SEQ ID NO: 3074996 - RNA, 19 nt, Human
cagcugugcucuggacagg

SEQ ID NO: 3074997 - RNA, 13 nt, Human
cagcugccuggga

SEQ ID NO: 3074998 - RNA, 14 nt, Human
cagcugccugggau

SEQ ID NO: 3074999 - RNA, 12 nt, Human
cagcugccuggg

SEQ ID NO: 3075000 - RNA, 19 nt, Human
cagcugagggugagugggu

SEQ ID NO: 3075001 - RNA, 20 nt, Human
cagcuccccucggagaagag

SEQ ID NO: 3075002 - RNA, 22 nt, Human
cagcuccccucggagaagagcu

SEQ ID NO: 3075003 - RNA, 21 nt, Human
cagcuccccucggagaagagc

SEQ ID NO: 3075004 - RNA, 16 nt, Human
caggaaaagcugcuga

SEQ ID NO: 3075005 - RNA, 15 nt, Human
caggaaaagcugcug

SEQ ID NO: 3075006 - RNA, 18 nt, Human
caggaaaagcugcugaca

SEQ ID NO: 3075007 - RNA, 17 nt, Human
cagccucugaaaaccaa

SEQ ID NO: 3075008 - RNA, 19 nt, Human
cagccgagauagccaaggc

SEQ ID NO: 3075009 - RNA, 12 nt, Human
cagccugcucca

SEQ ID NO: 3075010 - RNA, 19 nt, Human
cagccugcuaauuccccag

SEQ ID NO: 3075011 - RNA, 21 nt, Human
cagcggggacagcuccuucug

SEQ ID NO: 3075012 - RNA, 19 nt, Human
cagcggggacagcuccuuc

SEQ ID NO: 3075013 - RNA, 18 nt, Human
cagcggggacagcuccuu

SEQ ID NO: 3075014 - RNA, 17 nt, Human
auugauccagaaagaaa

SEQ ID NO: 3075015 - RNA, 16 nt, Human
auugauccagaaagaa

SEQ ID NO: 3075016 - RNA, 18 nt, Human
auugacuuuuuauggcac

SEQ ID NO: 3075017 - RNA, 17 nt, Human
auucuugccaaauauaa

SEQ ID NO: 3075018 - RNA, 16 nt, Human
auucucuccuguaccu

SEQ ID NO: 3075019 - RNA, 21 nt, Human
auucucuccuguaccucuuga

SEQ ID NO: 3075020 - RNA, 19 nt, Human
auucucuccuguaccucuu

SEQ ID NO: 3075021 - RNA, 21 nt, Human
auuccugaugcuucuucagag

SEQ ID NO: 3075022 - RNA, 13 nt, Human
auuccugaacagg

SEQ ID NO: 3075023 - RNA, 13 nt, Human
auucuuuccugag

SEQ ID NO: 3075024 - RNA, 17 nt, Human
auucuuuccugaggcug

SEQ ID NO: 3075025 - RNA, 22 nt, Human
auucuuuccugaggcugggcuc

SEQ ID NO: 3075026 - RNA, 22 nt, Human
auucaagaaaacaacuucaaua

SEQ ID NO: 3075027 - RNA, 18 nt, Human
auucacaagacccaaaag

SEQ ID NO: 3075028 - RNA, 21 nt, Human
auuauguguguuuuaaaauga

SEQ ID NO: 3075029 - RNA, 20 nt, Human
auuauguguguuuuaaaaug

SEQ ID NO: 3075030 - RNA, 15 nt, Human
auuauguguguuuua

SEQ ID NO: 3075031 - RNA, 23 nt, Human
auuaugugccagauuuaugcaua

SEQ ID NO: 3075032 - RNA, 18 nt, Human
auuaaauuuugaguucua

SEQ ID NO: 3075033 - RNA, 20 nt, Human
auuaaauucuugcaaaguau

SEQ ID NO: 3075034 - RNA, 18 nt, Human
auuaaauucuugcaaagu

SEQ ID NO: 3075035 - RNA, 14 nt, Human
auuaaauucuugca

SEQ ID NO: 3075036 - RNA, 19 nt, Human
auucauauuuacuucuuau

SEQ ID NO: 3075037 - RNA, 18 nt, Human
auucauauuuacuucuua

SEQ ID NO: 3075038 - RNA, 20 nt, Human
auucauauuuacuucuuaua

SEQ ID NO: 3075039 - RNA, 19 nt, Human
auuuauacaggucauauua

SEQ ID NO: 3075040 - RNA, 22 nt, Human
auuuaaugauaaguaaaugcua

SEQ ID NO: 3075041 - RNA, 14 nt, Human
auuuaaugaaagac

SEQ ID NO: 3075042 - RNA, 12 nt, Human
auuucuguuuag

SEQ ID NO: 3075043 - RNA, 16 nt, Human
auuucuguuuagauaa

SEQ ID NO: 3075044 - RNA, 14 nt, Human
auuucuguuuagau

SEQ ID NO: 3075045 - RNA, 15 nt, Human
auuucuaugaaauau

SEQ ID NO: 3075046 - RNA, 18 nt, Human
auuucuaugaaauauuau

SEQ ID NO: 3075047 - RNA, 14 nt, Human
auuucuaugaaaua

SEQ ID NO: 3075048 - RNA, 19 nt, Human
auugauccagaaagaaaac

SEQ ID NO: 3075049 - RNA, 18 nt, Human
auugauccagaaagaaaa

SEQ ID NO: 3075050 - RNA, 22 nt, Human
auugauccagaaagaaaacuug

SEQ ID NO: 3075051 - RNA, 18 nt, Human
auuguaagcaugcacaaa

SEQ ID NO: 3075052 - RNA, 15 nt, Human
auuguaaggaaugau

SEQ ID NO: 3075053 - RNA, 16 nt, Human
auuguaaggaaugauu

SEQ ID NO: 3075054 - RNA, 17 nt, Human
auuguaaaugugcuuuu

SEQ ID NO: 3075055 - RNA, 15 nt, Human
auuguaaaugugcuu

SEQ ID NO: 3075056 - RNA, 14 nt, Human
auuguaaaugugcu

SEQ ID NO: 3075057 - RNA, 19 nt, Human
auuguucuuaguuugcagu

SEQ ID NO: 3075058 - RNA, 15 nt, Human
auuguuuaaaaucau

SEQ ID NO: 3075059 - RNA, 19 nt, Human
auuguuuaaaaucauuucu

SEQ ID NO: 3075060 - RNA, 18 nt, Human
caaaaaaauauauuuaau

SEQ ID NO: 3075061 - RNA, 13 nt, Human
auuuuuaagugcu

SEQ ID NO: 3075062 - RNA, 13 nt, Human
auuuuuuuuuccu

SEQ ID NO: 3075063 - RNA, 16 nt, Human
auuuuuuuuuccuuca

SEQ ID NO: 3075064 - RNA, 12 nt, Human
auuuuuuuuucc

SEQ ID NO: 3075065 - RNA, 15 nt, Human
caaaagcugggcagg

SEQ ID NO: 3075066 - RNA, 13 nt, Human
auuuguuugaacu

SEQ ID NO: 3075067 - RNA, 16 nt, Human
auuuguuugaacugau

SEQ ID NO: 3075068 - RNA, 14 nt, Human
auuuguuugaacug

SEQ ID NO: 3075069 - RNA, 20 nt, Human
caacuauuuuuccaaaauaa

SEQ ID NO: 3075070 - RNA, 21 nt, Human
caacuaucucauuuccaagca

SEQ ID NO: 3075071 - RNA, 17 nt, Human
caacccccagccugcua

SEQ ID NO: 3075072 - RNA, 16 nt, Human
caacccccagccugcu

SEQ ID NO: 3075073 - RNA, 15 nt, Human
caacccccagccugc

SEQ ID NO: 3075074 - RNA, 19 nt, Human
caacccaaauguucaucaa

SEQ ID NO: 3075075 - RNA, 18 nt, Human
caagacccuugugguccc

SEQ ID NO: 3075076 - RNA, 19 nt, Human
caagacccuugugguccca

SEQ ID NO: 3075077 - RNA, 22 nt, Human
caagacccuuguggucccaccc

SEQ ID NO: 3075078 - RNA, 23 nt, Human
caagaauuucuaggacugaauua

SEQ ID NO: 3075079 - RNA, 16 nt, Human
caacucaccccagccc

SEQ ID NO: 3075080 - RNA, 13 nt, Human
caacucaccccag

SEQ ID NO: 3075081 - RNA, 15 nt, Human
caacucaccccagcc

SEQ ID NO: 3075082 - RNA, 20 nt, Human
caagaauuucuaggacugaa

SEQ ID NO: 3075083 - RNA, 18 nt, Human
caaccacugcgaccacaa

SEQ ID NO: 3075084 - RNA, 23 nt, Human
caacaaaccuguuucugcagcca

SEQ ID NO: 3075085 - RNA, 15 nt, Human
caaauccuugaagau

SEQ ID NO: 3075086 - RNA, 22 nt, Human
caaauccagccugcugccugcu

SEQ ID NO: 3075087 - RNA, 17 nt, Human
caaaucagcugcuacua

SEQ ID NO: 3075088 - RNA, 20 nt, Human
caaaguacacuguuucaaac

SEQ ID NO: 3075089 - RNA, 16 nt, Human
caaaguacacuguuuc

SEQ ID NO: 3075090 - RNA, 21 nt, Human
caaaguacacuguuucaaacu

SEQ ID NO: 3075091 - RNA, 13 nt, Human
caaagaugcagcc

SEQ ID NO: 3075092 - RNA, 20 nt, Human
caacaccucugcacaagcug

SEQ ID NO: 3075093 - RNA, 22 nt, Human
caacaccucugcacaagcugca

SEQ ID NO: 3075094 - RNA, 20 nt, Human
caacaccuuguuucccucuc

SEQ ID NO: 3075095 - RNA, 17 nt, Human
cacucuugaaaaaugca

SEQ ID NO: 3075096 - RNA, 19 nt, Human
cacucuuauugcccacgcu

SEQ ID NO: 3075097 - RNA, 18 nt, Human
cacucuuauugcccacgc

SEQ ID NO: 3075098 - RNA, 17 nt, Human
cacucuuauugcccacg

SEQ ID NO: 3075099 - RNA, 23 nt, Human
cacuacggaauaguuggcuagga

SEQ ID NO: 3075100 - RNA, 16 nt, Human
cacggccaggccagag

SEQ ID NO: 3075101 - RNA, 15 nt, Human
cacggccaggccaga

SEQ ID NO: 3075102 - RNA, 14 nt, Human
cacggccaggccag

SEQ ID NO: 3075103 - RNA, 20 nt, Human
cacggagggugacgggggug

SEQ ID NO: 3075104 - RNA, 14 nt, Human
caccugccagggac

SEQ ID NO: 3075105 - RNA, 16 nt, Human
caccugccagggacag

SEQ ID NO: 3075106 - RNA, 13 nt, Human
caccugccaggga

SEQ ID NO: 3075107 - RNA, 23 nt, Human
caccucaaaauaccaugccauuu

SEQ ID NO: 3075108 - RNA, 21 nt, Human
caccuacaugagguacugaga

SEQ ID NO: 3075109 - RNA, 16 nt, Human
caccguuaucgguguc

SEQ ID NO: 3075110 - RNA, 14 nt, Human
caccuuugucccca

SEQ ID NO: 3075111 - RNA, 15 nt, Human
caccuuuguccccac

SEQ ID NO: 3075112 - RNA, 17 nt, Human
caccuuuguccccaccg

SEQ ID NO: 3075113 - RNA, 14 nt, Human
caccuuugaagaag

SEQ ID NO: 3075114 - RNA, 13 nt, Human
caccuuggcucaa

SEQ ID NO: 3075115 - RNA, 22 nt, Human
caccuugcagcucuccccuucu

SEQ ID NO: 3075116 - RNA, 17 nt, Human
caccugccagggacaga

SEQ ID NO: 3075117 - RNA, 19 nt, Human
caccuugacagggcacacc

SEQ ID NO: 3075118 - RNA, 18 nt, Human
caccuugacagggcacac

SEQ ID NO: 3075119 - RNA, 15 nt, Human
caccuugcagcucuc

SEQ ID NO: 3075120 - RNA, 13 nt, Human
caccuugcagcuc

SEQ ID NO: 3075121 - RNA, 13 nt, Human
cagaauauguuuc

SEQ ID NO: 3075122 - RNA, 14 nt, Human
cagaauauguuuca

SEQ ID NO: 3075123 - RNA, 15 nt, Human
cagaauauguuucaa

SEQ ID NO: 3075124 - RNA, 17 nt, Human
cagaauauguuucaaac

SEQ ID NO: 3075125 - RNA, 18 nt, Human
cagaauauguuucaaacu

SEQ ID NO: 3075126 - RNA, 20 nt, Human
cagaauauguuucaaacuuu

SEQ ID NO: 3075127 - RNA, 13 nt, Human
cagaauauugcuu

SEQ ID NO: 3075128 - RNA, 12 nt, Human
cagaauauguuu

SEQ ID NO: 3075129 - RNA, 23 nt, Human
cagaaguuugagaucagccuggg

SEQ ID NO: 3075130 - RNA, 22 nt, Human
cagaaguuucugccgcagcccu

SEQ ID NO: 3075131 - RNA, 20 nt, Human
cagaaguuucugccgcagcc

SEQ ID NO: 3075132 - RNA, 21 nt, Human
cagaaguuucugccgcagccc

SEQ ID NO: 3075133 - RNA, 17 nt, Human
cagaaauguguuaucac

SEQ ID NO: 3075134 - RNA, 19 nt, Human
cagaaguuucugccgcagc

SEQ ID NO: 3075135 - RNA, 23 nt, Human
cacugggcuuggggaccagagcu

SEQ ID NO: 3075136 - RNA, 22 nt, Human
cacugggcuuggggaccagagc

SEQ ID NO: 3075137 - RNA, 20 nt, Human
cacugggcuuggggaccaga

SEQ ID NO: 3075138 - RNA, 17 nt, Human
cacuggugacaugucuu

SEQ ID NO: 3075139 - RNA, 16 nt, Human
cacuguugcccaggcu

SEQ ID NO: 3075140 - RNA, 15 nt, Human
cacuguugcccaggc

SEQ ID NO: 3075141 - RNA, 14 nt, Human
cacuguugcccagg

SEQ ID NO: 3075142 - RNA, 19 nt, Human
cacuguuucaaacuuuacu

SEQ ID NO: 3075143 - RNA, 17 nt, Human
cacuuggucugugagau

SEQ ID NO: 3075144 - RNA, 20 nt, Human
cacuuggucugugagaugcu

SEQ ID NO: 3075145 - RNA, 18 nt, Human
cacaguauuacuucugcu

SEQ ID NO: 3075146 - RNA, 16 nt, Human
cacaguauuacuucug

SEQ ID NO: 3075147 - RNA, 20 nt, Human
cacagacccugcccuguggg

SEQ ID NO: 3075148 - RNA, 21 nt, Human
cacagacccugcccugugggc

SEQ ID NO: 3075149 - RNA, 19 nt, Human
cacagacccugcccugugg

SEQ ID NO: 3075150 - RNA, 15 nt, Human
cacagcuaacaugga

SEQ ID NO: 3075151 - RNA, 16 nt, Human
cacagcuaacauggaa

SEQ ID NO: 3075152 - RNA, 18 nt, Human
cacagacccugcccugug

SEQ ID NO: 3075153 - RNA, 19 nt, Human
cacagcucuguccugggag

SEQ ID NO: 3075154 - RNA, 23 nt, Human
cacagcucuguccugggagugag

SEQ ID NO: 3075155 - RNA, 20 nt, Human
cacagcucuguccugggagu

SEQ ID NO: 3075156 - RNA, 22 nt, Human
cacagcuaacauggaaguacua

SEQ ID NO: 3075157 - RNA, 17 nt, Human
cacccagcccacuucug

SEQ ID NO: 3075158 - RNA, 16 nt, Human
cacccagcccacuucu

SEQ ID NO: 3075159 - RNA, 23 nt, Human
caccaacauacucccaucuguga

SEQ ID NO: 3075160 - RNA, 14 nt, Human
caccagcagccugg

SEQ ID NO: 3075161 - RNA, 12 nt, Human
caccagcagccu

SEQ ID NO: 3075162 - RNA, 15 nt, Human
caccagcagccugga

SEQ ID NO: 3075163 - RNA, 21 nt, Human
caccagcccuuagcagggaaa

SEQ ID NO: 3075164 - RNA, 23 nt, Human
cacccaggagccccgaggccuuc

SEQ ID NO: 3075165 - RNA, 20 nt, Human
cacccaggagccccgaggcc

SEQ ID NO: 3075166 - RNA, 19 nt, Human
cacccagcccacuucugcc

SEQ ID NO: 3075167 - RNA, 24 nt, Human
cacccaggagccccgaggccuucu

SEQ ID NO: 3075168 - RNA, 21 nt, Human
cacauuuuuuaaaugcaccug

SEQ ID NO: 3075169 - RNA, 17 nt, Human
cacauuuuuuaaaugca

SEQ ID NO: 3075170 - RNA, 14 nt, Human
cacauuuuucuuag

SEQ ID NO: 3075171 - RNA, 13 nt, Human
cacauuuuucuua

SEQ ID NO: 3075172 - RNA, 20 nt, Human
caccaacauacucccaucug

SEQ ID NO: 3075173 - RNA, 21 nt, Human
caccaacauacucccaucugu

SEQ ID NO: 3075174 - RNA, 17 nt, Human
caccaacauacucccau

SEQ ID NO: 3075175 - RNA, 15 nt, Human
cacauuuuauuuuau

SEQ ID NO: 3075176 - RNA, 18 nt, Human
cacaucuugcucugcuga

SEQ ID NO: 3075177 - RNA, 21 nt, Human
cacaucagcacgauuucuguu

SEQ ID NO: 3075178 - RNA, 20 nt, Human
cacaucagcacgauuucugu

SEQ ID NO: 3075179 - RNA, 19 nt, Human
cacaucagcacgauuucug

SEQ ID NO: 3075180 - RNA, 22 nt, Human
cacaucagcacgauuucuguuu

SEQ ID NO: 3075181 - RNA, 17 nt, Human
cacaucuugcucugcug

SEQ ID NO: 3075182 - RNA, 16 nt, Human
cacaucuugcucugcu

SEQ ID NO: 3075183 - RNA, 23 nt, Human
caaugcuggcuguuggcuggggg

SEQ ID NO: 3075184 - RNA, 22 nt, Human
caaugcuggcuguuggcugggg

SEQ ID NO: 3075185 - RNA, 14 nt, Human
caaugcuguauuuu

SEQ ID NO: 3075186 - RNA, 23 nt, Human
caaugcuguauuuuaaaagaaug

SEQ ID NO: 3075187 - RNA, 12 nt, Human
caauauuucaga

SEQ ID NO: 3075188 - RNA, 20 nt, Human
caauauuucagauaaucaca

SEQ ID NO: 3075189 - RNA, 22 nt, Human
caaugcugugcccuaaagugua

SEQ ID NO: 3075190 - RNA, 14 nt, Human
cacaagacccuugu

SEQ ID NO: 3075191 - RNA, 16 nt, Human
cacaagacccuugugg

SEQ ID NO: 3075192 - RNA, 12 nt, Human
caauuuaaaaaa

SEQ ID NO: 3075193 - RNA, 16 nt, Human
cacaagacugcacauc

SEQ ID NO: 3075194 - RNA, 23 nt, Human
cacaagacccaaaaggcagaagc

SEQ ID NO: 3075195 - RNA, 14 nt, Human
cacaagccuucggc

SEQ ID NO: 3075196 - RNA, 20 nt, Human
caaguauuagaauaccacag

SEQ ID NO: 3075197 - RNA, 14 nt, Human
caaguauuagaaua

SEQ ID NO: 3075198 - RNA, 18 nt, Human
cuucugacccaugcugcc

SEQ ID NO: 3075199 - RNA, 16 nt, Human
cuucugacccaugcug

SEQ ID NO: 3075200 - RNA, 17 nt, Human
cuucugacccaugcugc

SEQ ID NO: 3075201 - RNA, 16 nt, Human
cuucuuauacauuuga

SEQ ID NO: 3075202 - RNA, 13 nt, Human
cuucuuauacauu

SEQ ID NO: 3075203 - RNA, 14 nt, Human
cuuccucccucccu

SEQ ID NO: 3075204 - RNA, 13 nt, Human
cuuccucccuccc

SEQ ID NO: 3075205 - RNA, 12 nt, Human
cuuccucccucc

SEQ ID NO: 3075206 - RNA, 15 nt, Human
cuucugacccaugcu

SEQ ID NO: 3075207 - RNA, 22 nt, Human
cuucugaacuuggcgcugcccc

SEQ ID NO: 3075208 - RNA, 19 nt, Human
cuucugaacuuggcgcugc

SEQ ID NO: 3075209 - RNA, 22 nt, Human
cuucucuguauuccuagaaacu

SEQ ID NO: 3075210 - RNA, 17 nt, Human
cuuucaauaggaaaaac

SEQ ID NO: 3075211 - RNA, 20 nt, Human
cuuuaaugucacaggcaggu

SEQ ID NO: 3075212 - RNA, 19 nt, Human
cuuuaaugucacaggcagg

SEQ ID NO: 3075213 - RNA, 18 nt, Human
cuuuaaugucacaggcag

SEQ ID NO: 3075214 - RNA, 17 nt, Human
cuuuaaugucacaggca

SEQ ID NO: 3075215 - RNA, 14 nt, Human
cuuucaauaggaaa

SEQ ID NO: 3075216 - RNA, 15 nt, Human
cuuucaauaggaaaa

SEQ ID NO: 3075217 - RNA, 22 nt, Human
cuuuaaugucacaggcaggucc

SEQ ID NO: 3075218 - RNA, 21 nt, Human
cuugucuuuggacccugaggc

SEQ ID NO: 3075219 - RNA, 22 nt, Human
cuugucuuuggacccugaggcc

SEQ ID NO: 3075220 - RNA, 16 nt, Human
cuugguucccauuugc

SEQ ID NO: 3075221 - RNA, 20 nt, Human
cuugguucccauuugcuccu

SEQ ID NO: 3075222 - RNA, 22 nt, Human
cuugguccugcugcaguugcca

SEQ ID NO: 3075223 - RNA, 23 nt, Human
cuuggucucagugucaaugcagc

SEQ ID NO: 3075224 - RNA, 20 nt, Human
cuuggugucgggcaugacac

SEQ ID NO: 3075225 - RNA, 19 nt, Human
cuugucuuuggacccugag

SEQ ID NO: 3075226 - RNA, 20 nt, Human
cuugucuuuggacccugagg

SEQ ID NO: 3075227 - RNA, 13 nt, Human
cuugucuguagau

SEQ ID NO: 3075228 - RNA, 16 nt, Human
cuugguccugcugcag

SEQ ID NO: 3075229 - RNA, 17 nt, Human
cuugguccugcugcagu

SEQ ID NO: 3075230 - RNA, 18 nt, Human
cuugguccugcugcaguu

SEQ ID NO: 3075231 - RNA, 20 nt, Human
cuugguccugcugcaguugc

SEQ ID NO: 3075232 - RNA, 15 nt, Human
cuugguccugcugca

SEQ ID NO: 3075233 - RNA, 13 nt, Human
cuugaugccuggc

SEQ ID NO: 3075234 - RNA, 12 nt, Human
cuugauucauaa

SEQ ID NO: 3075235 - RNA, 18 nt, Human
cuugccgucuaccugagg

SEQ ID NO: 3075236 - RNA, 19 nt, Human
cuugccgucuaccugaggg

SEQ ID NO: 3075237 - RNA, 19 nt, Human
cuugauucauaaugacuua

SEQ ID NO: 3075238 - RNA, 15 nt, Human
cuuggauuguccccg

SEQ ID NO: 3075239 - RNA, 18 nt, Human
cuuggauuguccccgacc

SEQ ID NO: 3075240 - RNA, 20 nt, Human
cuuggauuguccccgacccu

SEQ ID NO: 3075241 - RNA, 14 nt, Human
cuuggauugucccc

SEQ ID NO: 3075242 - RNA, 23 nt, Human
cuuggcgcugccccuggcagccc

SEQ ID NO: 3075243 - RNA, 21 nt, Human
cuuggcgcugccccuggcagc

SEQ ID NO: 3075244 - RNA, 22 nt, Human
cuuggcgcugccccuggcagcc

SEQ ID NO: 3075245 - RNA, 14 nt, Human
gaacaaggcaaggc

SEQ ID NO: 3075246 - RNA, 15 nt, Human
gaacaaggcaaggcu

SEQ ID NO: 3075247 - RNA, 17 nt, Human
gaacaaggcaaggcugu

SEQ ID NO: 3075248 - RNA, 18 nt, Human
gaacaaggcaaggcuguc

SEQ ID NO: 3075249 - RNA, 21 nt, Human
gaacaaggcaaggcugucaau

SEQ ID NO: 3075250 - RNA, 23 nt, Human
gaaacuucagcgguuuauauaag

SEQ ID NO: 3075251 - RNA, 16 nt, Human
gaacaagaugguucua

SEQ ID NO: 3075252 - RNA, 23 nt, Human
gaacaaauuuacagagacagaaa

SEQ ID NO: 3075253 - RNA, 19 nt, Human
gaaauuuuuauuaaauuau

SEQ ID NO: 3075254 - RNA, 17 nt, Human
gaacaaauuuacagaga

SEQ ID NO: 3075255 - RNA, 18 nt, Human
gaacaaauuuacagagac

SEQ ID NO: 3075256 - RNA, 17 nt, Human
gaaaucaccgaaaacgu

SEQ ID NO: 3075257 - RNA, 17 nt, Human
gaaaugaaagcagggac

SEQ ID NO: 3075258 - RNA, 23 nt, Human
gaaaucaaauaugcaaagcacug

SEQ ID NO: 3075259 - RNA, 18 nt, Human
gaaauuuuuauuaaauua

SEQ ID NO: 3075260 - RNA, 18 nt, Human
gaaaugaaagcagggacu

SEQ ID NO: 3075261 - RNA, 19 nt, Human
gaaaucaaagagagaaaau

SEQ ID NO: 3075262 - RNA, 16 nt, Human
gaaaucaaauaugcaa

SEQ ID NO: 3075263 - RNA, 21 nt, Human
gaaaucaaauaugcaaagcac

SEQ ID NO: 3075264 - RNA, 21 nt, Human
gaaaguacuucuccacccugc

SEQ ID NO: 3075265 - RNA, 17 nt, Human
gaaaggcuccaggagca

SEQ ID NO: 3075266 - RNA, 18 nt, Human
gaaaggcuccaggagcag

SEQ ID NO: 3075267 - RNA, 19 nt, Human
gaaaggcuccaggagcagc

SEQ ID NO: 3075268 - RNA, 16 nt, Human
gaaaggcuccaggagc

SEQ ID NO: 3075269 - RNA, 18 nt, Human
gaaagacuaucuaaaugu

SEQ ID NO: 3075270 - RNA, 19 nt, Human
cuuuuaugugaaacauguu

SEQ ID NO: 3075271 - RNA, 18 nt, Human
cuuuuaugugaaacaugu

SEQ ID NO: 3075272 - RNA, 17 nt, Human
cuuuugucuaugggacu

SEQ ID NO: 3075273 - RNA, 19 nt, Human
cuuuuguagaagucacauu

SEQ ID NO: 3075274 - RNA, 16 nt, Human
cuuuuggucuguguga

SEQ ID NO: 3075275 - RNA, 15 nt, Human
cuuuuggucugugug

SEQ ID NO: 3075276 - RNA, 16 nt, Human
cuuuugccguuauuaa

SEQ ID NO: 3075277 - RNA, 18 nt, Human
cuuuugccguuauuaaaa

SEQ ID NO: 3075278 - RNA, 14 nt, Human
gaaaaaauauauau

SEQ ID NO: 3075279 - RNA, 19 nt, Human
gaaaaaauauuuuccugcc

SEQ ID NO: 3075280 - RNA, 21 nt, Human
cuuuuuuuuuuuuuuugacaa

SEQ ID NO: 3075281 - RNA, 18 nt, Human
cuuuugugcauuaucuag

SEQ ID NO: 3075282 - RNA, 14 nt, Human
cuuuugugcauuau

SEQ ID NO: 3075283 - RNA, 14 nt, Human
gaaaauuaacauga

SEQ ID NO: 3075284 - RNA, 21 nt, Human
gaaaagacuccaaagaaaugu

SEQ ID NO: 3075285 - RNA, 18 nt, Human
gaaaagacuccaaagaaa

SEQ ID NO: 3075286 - RNA, 20 nt, Human
gaaaagacuccaaagaaaug

SEQ ID NO: 3075287 - RNA, 14 nt, Human
gaaaauuuuaaaaa

SEQ ID NO: 3075288 - RNA, 18 nt, Human
gaaaauuuugauguuuua

SEQ ID NO: 3075289 - RNA, 22 nt, Human
cugucuaaugaaaccugugucu

SEQ ID NO: 3075290 - RNA, 23 nt, Human
cugucggagcccugucuccucuc

SEQ ID NO: 3075291 - RNA, 14 nt, Human
cugucauuugagca

SEQ ID NO: 3075292 - RNA, 14 nt, Human
cuguccugggagug

SEQ ID NO: 3075293 - RNA, 13 nt, Human
cuguccugggagu

SEQ ID NO: 3075294 - RNA, 20 nt, Human
cuguccugggagugagcugg

SEQ ID NO: 3075295 - RNA, 20 nt, Human
cuguacuugcucuugaugcc

SEQ ID NO: 3075296 - RNA, 19 nt, Human
cuguacuugcucuugaugc

SEQ ID NO: 3075297 - RNA, 16 nt, Human
cuguacuugcucuuga

SEQ ID NO: 3075298 - RNA, 15 nt, Human
cuguagagugggagc

SEQ ID NO: 3075299 - RNA, 20 nt, Human
cuguaagaaaauaucacuug

SEQ ID NO: 3075300 - RNA, 18 nt, Human
cuggucuuauuuguaaag

SEQ ID NO: 3075301 - RNA, 22 nt, Human
cuggugacaugucuuuucuugc

SEQ ID NO: 3075302 - RNA, 18 nt, Human
cuguugcccaggcuggcg

SEQ ID NO: 3075303 - RNA, 12 nt, Human
cuguuggccagu

SEQ ID NO: 3075304 - RNA, 19 nt, Human
cuuaaauaaugugaaacug

SEQ ID NO: 3075305 - RNA, 16 nt, Human
cuuaaauaaugugaaa

SEQ ID NO: 3075306 - RNA, 14 nt, Human
cuuaaauaauguga

SEQ ID NO: 3075307 - RNA, 13 nt, Human
cuuaaauaaugug

SEQ ID NO: 3075308 - RNA, 13 nt, Human
cuuaaaaaugguu

SEQ ID NO: 3075309 - RNA, 20 nt, Human
cuuaaaaaugguuuaaaugg

SEQ ID NO: 3075310 - RNA, 12 nt, Human
cuuaaaaauggu

SEQ ID NO: 3075311 - RNA, 23 nt, Human
cugugaaguuuacauuguaaaua

SEQ ID NO: 3075312 - RNA, 18 nt, Human
cugugaaguuuacauugu

SEQ ID NO: 3075313 - RNA, 15 nt, Human
cugugcucuggacag

SEQ ID NO: 3075314 - RNA, 17 nt, Human
cugugcucuggacaggc

SEQ ID NO: 3075315 - RNA, 23 nt, Human
cugugagaugcuagaacucccuu

SEQ ID NO: 3075316 - RNA, 21 nt, Human
cugugagaugcuagaacuccc

SEQ ID NO: 3075317 - RNA, 12 nt, Human
cuguucagcugg

SEQ ID NO: 3075318 - RNA, 22 nt, Human
cuguucagcuccagcucaccag

SEQ ID NO: 3075319 - RNA, 19 nt, Human
cuguucagcuccagcucac

SEQ ID NO: 3075320 - RNA, 18 nt, Human
cuguucagcuccagcuca

SEQ ID NO: 3075321 - RNA, 16 nt, Human
cuguucagcuccagcu

SEQ ID NO: 3075322 - RNA, 19 nt, Human
cuguucacagccagacugg

SEQ ID NO: 3075323 - RNA, 12 nt, Human
cuguucacagcc

SEQ ID NO: 3075324 - RNA, 15 nt, Human
cuguucagcuccagc

SEQ ID NO: 3075325 - RNA, 14 nt, Human
cuguucagcuccag

SEQ ID NO: 3075326 - RNA, 22 nt, Human
cuguucacagccagacuggcac

SEQ ID NO: 3075327 - RNA, 13 nt, Human
cuguuacugucuu

SEQ ID NO: 3075328 - RNA, 19 nt, Human
cuguuauaaucuuucacag

SEQ ID NO: 3075329 - RNA, 17 nt, Human
cuguuacugucuucagu

SEQ ID NO: 3075330 - RNA, 22 nt, Human
cugugucagguggggcagcuug

SEQ ID NO: 3075331 - RNA, 18 nt, Human
cugugcucuggacaggca

SEQ ID NO: 3075332 - RNA, 16 nt, Human
cugcugagauccugga

SEQ ID NO: 3075333 - RNA, 17 nt, Human
cugcugagauccuggac

SEQ ID NO: 3075334 - RNA, 18 nt, Human
cugcugagauccuggacu

SEQ ID NO: 3075335 - RNA, 19 nt, Human
cugcugagauccuggacug

SEQ ID NO: 3075336 - RNA, 23 nt, Human
cugcugagauccuggacugaggg

SEQ ID NO: 3075337 - RNA, 24 nt, Human
cugcugaaggcucgagcaugccug

SEQ ID NO: 3075338 - RNA, 23 nt, Human
cugcugaaggcucgagcaugccu

SEQ ID NO: 3075339 - RNA, 18 nt, Human
cugcugaaggcucgagca

SEQ ID NO: 3075340 - RNA, 17 nt, Human
cugcuaucaaagagguu

SEQ ID NO: 3075341 - RNA, 23 nt, Human
cugccuguucagcuccagcucac

SEQ ID NO: 3075342 - RNA, 20 nt, Human
cugccuguucagcuccagcu

SEQ ID NO: 3075343 - RNA, 14 nt, Human
cugccuccuuugug

SEQ ID NO: 3075344 - RNA, 17 nt, Human
cugccuccuuugugagg

SEQ ID NO: 3075345 - RNA, 21 nt, Human
cugccuccuuugugaggaagc

SEQ ID NO: 3075346 - RNA, 23 nt, Human
cugccuccuuugugaggaagccg

SEQ ID NO: 3075347 - RNA, 14 nt, Human
cugccucgaacugg

SEQ ID NO: 3075348 - RNA, 20 nt, Human
cugccucgaacuggcugcaa

SEQ ID NO: 3075349 - RNA, 19 nt, Human
cugccucgaacuggcugca

SEQ ID NO: 3075350 - RNA, 19 nt, Human
cugcccuuaccugccagga

SEQ ID NO: 3075351 - RNA, 12 nt, Human
cugcccuguggg

SEQ ID NO: 3075352 - RNA, 11 nt, Human
cugcccugugg

SEQ ID NO: 3075353 - RNA, 22 nt, Human
cugcccuuaccugccaggaagc

SEQ ID NO: 3075354 - RNA, 23 nt, Human
cugcccuuaccugccaggaagcc

SEQ ID NO: 3075355 - RNA, 24 nt, Human
cugcccugugaguacuacaguccu

SEQ ID NO: 3075356 - RNA, 13 nt, Human
cugcccugugagu

SEQ ID NO: 3075357 - RNA, 18 nt, Human
cuggaugcagccucacag

SEQ ID NO: 3075358 - RNA, 15 nt, Human
cuggaugcagccuca

SEQ ID NO: 3075359 - RNA, 16 nt, Human
cuggaugcagccucac

SEQ ID NO: 3075360 - RNA, 17 nt, Human
cuggaugcagccucaca

SEQ ID NO: 3075361 - RNA, 14 nt, Human
cugcuuccagugag

SEQ ID NO: 3075362 - RNA, 23 nt, Human
cugcuucagccucccgaguagcu

SEQ ID NO: 3075363 - RNA, 23 nt, Human
cuggaaaaguauguuagugcaaa

SEQ ID NO: 3075364 - RNA, 19 nt, Human
cugcuucaaggauccugag

SEQ ID NO: 3075365 - RNA, 13 nt, Human
cugcuucaaggau

SEQ ID NO: 3075366 - RNA, 14 nt, Human
cugcuucaaggauc

SEQ ID NO: 3075367 - RNA, 16 nt, Human
cugcuucaaggauccu

SEQ ID NO: 3075368 - RNA, 21 nt, Human
cuggagaaaauggacguguua

SEQ ID NO: 3075369 - RNA, 13 nt, Human
cuggcagccccug

SEQ ID NO: 3075370 - RNA, 22 nt, Human
cuggcagaguugaagacagagc

SEQ ID NO: 3075371 - RNA, 23 nt, Human
cuggcagccccuguucuggcaga

SEQ ID NO: 3075372 - RNA, 20 nt, Human
cuggcagaguugaagacaga

SEQ ID NO: 3075373 - RNA, 21 nt, Human
cuggcagaguugaagacagag

SEQ ID NO: 3075374 - RNA, 19 nt, Human
cuggcagaguugaagacag

SEQ ID NO: 3075375 - RNA, 17 nt, Human
cugggacuacaggugug

SEQ ID NO: 3075376 - RNA, 21 nt, Human
cugggacuacaggcacccacc

SEQ ID NO: 3075377 - RNA, 17 nt, Human
cugggacuacaggcacc

SEQ ID NO: 3075378 - RNA, 16 nt, Human
cugggacuacaggcac

SEQ ID NO: 3075379 - RNA, 13 nt, Human
cuggcucuguggc

SEQ ID NO: 3075380 - RNA, 14 nt, Human
cuggcucuguggcg

SEQ ID NO: 3075381 - RNA, 23 nt, Human
cuggcucuguggcgagccauuug

SEQ ID NO: 3075382 - RNA, 14 nt, Human
cuggcucuuccagg

SEQ ID NO: 3075383 - RNA, 15 nt, Human
cuggcucuuccaggc

SEQ ID NO: 3075384 - RNA, 13 nt, Human
cuggcucuuccag

SEQ ID NO: 3075385 - RNA, 12 nt, Human
cuggcucugugg

SEQ ID NO: 3075386 - RNA, 15 nt, Human
cuggcagcucagaga

SEQ ID NO: 3075387 - RNA, 17 nt, Human
cuggcagcucagagagg

SEQ ID NO: 3075388 - RNA, 19 nt, Human
cuggcagcucagagagggu

SEQ ID NO: 3075389 - RNA, 16 nt, Human
cuggcagcucagagag

SEQ ID NO: 3075390 - RNA, 17 nt, Human
gaugcuucuucagagac

SEQ ID NO: 3075391 - RNA, 20 nt, Human
gaugcuucuucagagacucc

SEQ ID NO: 3075392 - RNA, 21 nt, Human
gaugcuucuucagagacuccu

SEQ ID NO: 3075393 - RNA, 23 nt, Human
gaugcuucucacugccaugccag

SEQ ID NO: 3075394 - RNA, 22 nt, Human
gaugauuggaggggggaggugg

SEQ ID NO: 3075395 - RNA, 13 nt, Human
gaugauccuaggc

SEQ ID NO: 3075396 - RNA, 18 nt, Human
gaucucuugagccuggga

SEQ ID NO: 3075397 - RNA, 19 nt, Human
gaucucuugagccugggag

SEQ ID NO: 3075398 - RNA, 15 nt, Human
gaucucuaacuucac

SEQ ID NO: 3075399 - RNA, 21 nt, Human
gauacuguaucaugacaaaga

SEQ ID NO: 3075400 - RNA, 17 nt, Human
gauacuguaucaugaca

SEQ ID NO: 3075401 - RNA, 12 nt, Human
gauacugaaaua

SEQ ID NO: 3075402 - RNA, 23 nt, Human
gauacaguuacucagaauucucu

SEQ ID NO: 3075403 - RNA, 19 nt, Human
gauacaguuacucagaauu

SEQ ID NO: 3075404 - RNA, 16 nt, Human
gauacaguuacucaga

SEQ ID NO: 3075405 - RNA, 17 nt, Human
gauacuugaaaauuaac

SEQ ID NO: 3075406 - RNA, 20 nt, Human
gaucaaaagguuaauaaagu

SEQ ID NO: 3075407 - RNA, 17 nt, Human
gauauuuuuuucuuuuc

SEQ ID NO: 3075408 - RNA, 23 nt, Human
gaucaaaagguuaauaaaguaau

SEQ ID NO: 3075409 - RNA, 19 nt, Human
gauccacccaccucagccu

SEQ ID NO: 3075410 - RNA, 18 nt, Human
gauccacccaccucagcc

SEQ ID NO: 3075411 - RNA, 21 nt, Human
gauccaagcuggucccacuca

SEQ ID NO: 3075412 - RNA, 21 nt, Human
gauccacccaccucagccucc

SEQ ID NO: 3075413 - RNA, 20 nt, Human
gauccacccaccucagccuc

SEQ ID NO: 3075414 - RNA, 22 nt, Human
gauccacccaccucagccuccc

SEQ ID NO: 3075415 - RNA, 19 nt, Human
gauccaagcuggucccacu

SEQ ID NO: 3075416 - RNA, 17 nt, Human
gauccaagcugguccca

SEQ ID NO: 3075417 - RNA, 16 nt, Human
gauccaagcugguccc

SEQ ID NO: 3075418 - RNA, 12 nt, Human
gauccaagcugg

SEQ ID NO: 3075419 - RNA, 15 nt, Human
gcaagugagagcugg

SEQ ID NO: 3075420 - RNA, 16 nt, Human
gcaagugagagcuggg

SEQ ID NO: 3075421 - RNA, 20 nt, Human
gcaaccuccgccucuugggu

SEQ ID NO: 3075422 - RNA, 19 nt, Human
gcaaccuccgccucuuggg

SEQ ID NO: 3075423 - RNA, 16 nt, Human
gcaacccccagccugc

SEQ ID NO: 3075424 - RNA, 15 nt, Human
gcaacccccagccug

SEQ ID NO: 3075425 - RNA, 14 nt, Human
gcaacccccagccu

SEQ ID NO: 3075426 - RNA, 13 nt, Human
gcaacaggcuggg

SEQ ID NO: 3075427 - RNA, 15 nt, Human
gcaacaggcugggcu

SEQ ID NO: 3075428 - RNA, 14 nt, Human
gcaacaggcugggc

SEQ ID NO: 3075429 - RNA, 19 nt, Human
gcaacaggcugggcuucag

SEQ ID NO: 3075430 - RNA, 16 nt, Human
gcaacaggcugggcuu

SEQ ID NO: 3075431 - RNA, 16 nt, Human
gcaaccaccaccaacc

SEQ ID NO: 3075432 - RNA, 18 nt, Human
gcaaccaccaccaaccac

SEQ ID NO: 3075433 - RNA, 13 nt, Human
gcaaccaccacca

SEQ ID NO: 3075434 - RNA, 19 nt, Human
gauuuaacagaaauguaca

SEQ ID NO: 3075435 - RNA, 18 nt, Human
gauuuaacagaaauguac

SEQ ID NO: 3075436 - RNA, 17 nt, Human
gauuuaacagaaaugua

SEQ ID NO: 3075437 - RNA, 16 nt, Human
gauuuaacagaaaugu

SEQ ID NO: 3075438 - RNA, 15 nt, Human
gauucuucugcuuca

SEQ ID NO: 3075439 - RNA, 13 nt, Human
gauucuucugcuu

SEQ ID NO: 3075440 - RNA, 12 nt, Human
gauucuucugcu

SEQ ID NO: 3075441 - RNA, 21 nt, Human
gauuuuuuuuuccuucagugc

SEQ ID NO: 3075442 - RNA, 14 nt, Human
gcaaaaaggcagga

SEQ ID NO: 3075443 - RNA, 22 nt, Human
gcaaaagaugcuucucacugcc

SEQ ID NO: 3075444 - RNA, 17 nt, Human
gcaaaagaugcuucuca

SEQ ID NO: 3075445 - RNA, 16 nt, Human
gauuuuuuuuuccuuc

SEQ ID NO: 3075446 - RNA, 12 nt, Human
gauuucacucuc

SEQ ID NO: 3075447 - RNA, 17 nt, Human
gauuuuuuuuuccuuca

SEQ ID NO: 3075448 - RNA, 18 nt, Human
gauuuuuuuuuccuucag

SEQ ID NO: 3075449 - RNA, 11 nt, Human
gauuucacucu

SEQ ID NO: 3075450 - RNA, 14 nt, Human
gcauacguacacau

SEQ ID NO: 3075451 - RNA, 17 nt, Human
gcauacguacacauuuu

SEQ ID NO: 3075452 - RNA, 16 nt, Human
gcauacguacacauuu

SEQ ID NO: 3075453 - RNA, 15 nt, Human
gcauacguacacauu

SEQ ID NO: 3075454 - RNA, 13 nt, Human
gcagugaugucac

SEQ ID NO: 3075455 - RNA, 22 nt, Human
gcaguuguugcccacagcugua

SEQ ID NO: 3075456 - RNA, 14 nt, Human
gcauccaguaucuu

SEQ ID NO: 3075457 - RNA, 17 nt, Human
gcauccaguaucuugaa

SEQ ID NO: 3075458 - RNA, 18 nt, Human
gcauccaguaucuugaag

SEQ ID NO: 3075459 - RNA, 13 nt, Human
gcauccuggcacc

SEQ ID NO: 3075460 - RNA, 21 nt, Human
gcauggcugccaaugggagcu

SEQ ID NO: 3075461 - RNA, 17 nt, Human
gcauuuaaaagauacag

SEQ ID NO: 3075462 - RNA, 16 nt, Human
gcauuuaaaagauaca

SEQ ID NO: 3075463 - RNA, 16 nt, Human
gcauugugggaagggg

SEQ ID NO: 3075464 - RNA, 18 nt, Human
gcauugugggaaggggag

SEQ ID NO: 3075465 - RNA, 22 nt, Human
gcauuuaaaagauacaguuacu

SEQ ID NO: 3075466 - RNA, 18 nt, Human
gcauuuaaaagauacagu

SEQ ID NO: 3075467 - RNA, 15 nt, Human
gcauuuacuuugugu

SEQ ID NO: 3075468 - RNA, 13 nt, Human
gcauugugggaag

SEQ ID NO: 3075469 - RNA, 15 nt, Human
gcauugugggaaggg

SEQ ID NO: 3075470 - RNA, 21 nt, Human
gcaugugaugagaggaaauca

SEQ ID NO: 3075471 - RNA, 18 nt, Human
gcaugugaugagaggaaa

SEQ ID NO: 3075472 - RNA, 19 nt, Human
gcaugugaugagaggaaau

SEQ ID NO: 3075473 - RNA, 16 nt, Human
gcaugguuuggagcug

SEQ ID NO: 3075474 - RNA, 18 nt, Human
gcaagugagagcugggug

SEQ ID NO: 3075475 - RNA, 17 nt, Human
gcacucagaagacacug

SEQ ID NO: 3075476 - RNA, 20 nt, Human
gcacucagaagacacugaug

SEQ ID NO: 3075477 - RNA, 22 nt, Human
gcacuuuguucuggcucuucca

SEQ ID NO: 3075478 - RNA, 12 nt, Human
gcagaacaguga

SEQ ID NO: 3075479 - RNA, 13 nt, Human
gcagaacagugau

SEQ ID NO: 3075480 - RNA, 12 nt, Human
gcacuccccugc

SEQ ID NO: 3075481 - RNA, 15 nt, Human
gcacuccccugcugg

SEQ ID NO: 3075482 - RNA, 18 nt, Human
gcacuuuguucuggcucu

SEQ ID NO: 3075483 - RNA, 19 nt, Human
gcacuuuguucuggcucuu

SEQ ID NO: 3075484 - RNA, 13 nt, Human
gcacuccccugcu

SEQ ID NO: 3075485 - RNA, 14 nt, Human
gcacuccccugcug

SEQ ID NO: 3075486 - RNA, 14 nt, Human
gcacuccagccugg

SEQ ID NO: 3075487 - RNA, 18 nt, Human
gcagaacagugauuacca

SEQ ID NO: 3075488 - RNA, 22 nt, Human
gcagaacagugauuaccaggga

SEQ ID NO: 3075489 - RNA, 13 nt, Human
gcagaggaaagca

SEQ ID NO: 3075490 - RNA, 14 nt, Human
gcagaggaaagcaa

SEQ ID NO: 3075491 - RNA, 18 nt, Human
gcagaggaaagcaaagga

SEQ ID NO: 3075492 - RNA, 20 nt, Human
gcagaggaaagcaaaggaga

SEQ ID NO: 3075493 - RNA, 21 nt, Human
gcagaggaaagcaaaggagau

SEQ ID NO: 3075494 - RNA, 14 nt, Human
gcagagggcacaga

SEQ ID NO: 3075495 - RNA, 17 nt, Human
gcagcauauucaggaag

SEQ ID NO: 3075496 - RNA, 18 nt, Human
gcagcauauucaggaagc

SEQ ID NO: 3075497 - RNA, 19 nt, Human
gcagcauauucaggaagcu

SEQ ID NO: 3075498 - RNA, 23 nt, Human
gcagcauauucaggaagcucagg

SEQ ID NO: 3075499 - RNA, 15 nt, Human
gcagcucuccccuuc

SEQ ID NO: 3075500 - RNA, 16 nt, Human
gcagccaggccacaag

SEQ ID NO: 3075501 - RNA, 15 nt, Human
gcagccacauuccug

SEQ ID NO: 3075502 - RNA, 19 nt, Human
gacuuuuccaacccucauc

SEQ ID NO: 3075503 - RNA, 22 nt, Human
gacuuuuuauggcacuaguauu

SEQ ID NO: 3075504 - RNA, 14 nt, Human
gacuuuuccaaccc

SEQ ID NO: 3075505 - RNA, 14 nt, Human
gagacggaguccca

SEQ ID NO: 3075506 - RNA, 19 nt, Human
gagacggagucccaccuug

SEQ ID NO: 3075507 - RNA, 16 nt, Human
gagacggagucccacc

SEQ ID NO: 3075508 - RNA, 18 nt, Human
gagacgggggcagagagg

SEQ ID NO: 3075509 - RNA, 21 nt, Human
gagacccugucucaaaaaaag

SEQ ID NO: 3075510 - RNA, 23 nt, Human
gagaaugaaagggcccagagagg

SEQ ID NO: 3075511 - RNA, 15 nt, Human
gagaaugaaagggcc

SEQ ID NO: 3075512 - RNA, 14 nt, Human
gagauuggaaggaa

SEQ ID NO: 3075513 - RNA, 21 nt, Human
gagauugugccccugcacucc

SEQ ID NO: 3075514 - RNA, 21 nt, Human
gagauugcaccacugcacucc

SEQ ID NO: 3075515 - RNA, 20 nt, Human
gagaugcuagaacucccuuu

SEQ ID NO: 3075516 - RNA, 16 nt, Human
gagaugcuagaacucc

SEQ ID NO: 3075517 - RNA, 13 nt, Human
gagacuccugcag

SEQ ID NO: 3075518 - RNA, 14 nt, Human
gagagccuuccagg

SEQ ID NO: 3075519 - RNA, 15 nt, Human
gagagccuuccaggg

SEQ ID NO: 3075520 - RNA, 16 nt, Human
gagagccuuccagggg

SEQ ID NO: 3075521 - RNA, 18 nt, Human
gagagccuuccaggggug

SEQ ID NO: 3075522 - RNA, 20 nt, Human
gagagccuuccagggguggg

SEQ ID NO: 3075523 - RNA, 15 nt, Human
gagagcuagcagcag

SEQ ID NO: 3075524 - RNA, 21 nt, Human
gagagcuagcagcagggaggg

SEQ ID NO: 3075525 - RNA, 13 nt, Human
gagagcugggugu

SEQ ID NO: 3075526 - RNA, 15 nt, Human
gagaggacccccuga

SEQ ID NO: 3075527 - RNA, 20 nt, Human
gagagcugggugucaagagg

SEQ ID NO: 3075528 - RNA, 12 nt, Human
gagaggaaauca

SEQ ID NO: 3075529 - RNA, 17 nt, Human
gagggccugcaagggag

SEQ ID NO: 3075530 - RNA, 21 nt, Human
gagggccugcaagggagugag

SEQ ID NO: 3075531 - RNA, 14 nt, Human
gagggccugcaagg

SEQ ID NO: 3075532 - RNA, 20 nt, Human
gaggcucuggagcccacugu

SEQ ID NO: 3075533 - RNA, 18 nt, Human
gaggcugagaugggagaa

SEQ ID NO: 3075534 - RNA, 17 nt, Human
gaggcuccacuuggucu

SEQ ID NO: 3075535 - RNA, 19 nt, Human
gaggcauuuguuugaacug

SEQ ID NO: 3075536 - RNA, 22 nt, Human
gaggcaugugaugagaggaaau

SEQ ID NO: 3075537 - RNA, 20 nt, Human
gaggcaugugaugagaggaa

SEQ ID NO: 3075538 - RNA, 21 nt, Human
gaggcaugugaugagaggaaa

SEQ ID NO: 3075539 - RNA, 21 nt, Human
gaggcauuuguuugaacugau

SEQ ID NO: 3075540 - RNA, 15 nt, Human
gaggcuccacuuggu

SEQ ID NO: 3075541 - RNA, 12 nt, Human
gaggcuccacuu

SEQ ID NO: 3075542 - RNA, 21 nt, Human
gaggacgcucucuggccuucg

SEQ ID NO: 3075543 - RNA, 20 nt, Human
gaggacgcucucuggccuuc

SEQ ID NO: 3075544 - RNA, 16 nt, Human
gaggacuuuucuuugu

SEQ ID NO: 3075545 - RNA, 23 nt, Human
gaggacuuuucuuuguggcuucc

SEQ ID NO: 3075546 - RNA, 20 nt, Human
gaggacuuuucuuuguggcu

SEQ ID NO: 3075547 - RNA, 14 nt, Human
gaggagagaggacc

SEQ ID NO: 3075548 - RNA, 15 nt, Human
gaggagagaggaccc

SEQ ID NO: 3075549 - RNA, 12 nt, Human
gaggagagagga

SEQ ID NO: 3075550 - RNA, 12 nt, Human
gaggagaaacug

SEQ ID NO: 3075551 - RNA, 14 nt, Human
gaggagaaacugga

SEQ ID NO: 3075552 - RNA, 20 nt, Human
gaggcagggucucacucugu

SEQ ID NO: 3075553 - RNA, 19 nt, Human
gaggcagggucucacucug

SEQ ID NO: 3075554 - RNA, 18 nt, Human
gaggcagggucucacucu

SEQ ID NO: 3075555 - RNA, 22 nt, Human
gagcuguucacagccagacugg

SEQ ID NO: 3075556 - RNA, 14 nt, Human
gagcccugguggca

SEQ ID NO: 3075557 - RNA, 13 nt, Human
gagcccugguggc

SEQ ID NO: 3075558 - RNA, 20 nt, Human
gagcuguucacagccagacu

SEQ ID NO: 3075559 - RNA, 17 nt, Human
gagcuguucacagccag

SEQ ID NO: 3075560 - RNA, 21 nt, Human
gagcagggcucagcggggaca

SEQ ID NO: 3075561 - RNA, 14 nt, Human
gagcaucaggccag

SEQ ID NO: 3075562 - RNA, 14 nt, Human
gagcagucaggaaa

SEQ ID NO: 3075563 - RNA, 13 nt, Human
gagcaugccugga

SEQ ID NO: 3075564 - RNA, 15 nt, Human
gagcaucaggccagg

SEQ ID NO: 3075565 - RNA, 16 nt, Human
gagcaucaggccaggc

SEQ ID NO: 3075566 - RNA, 13 nt, Human
gagcaucaggcca

SEQ ID NO: 3075567 - RNA, 20 nt, Human
gagcccugggaggcucugga

SEQ ID NO: 3075568 - RNA, 19 nt, Human
gagcccugggaggcucugg

SEQ ID NO: 3075569 - RNA, 18 nt, Human
gagcccugggaggcucug

SEQ ID NO: 3075570 - RNA, 16 nt, Human
gagcccugggaggcuc

SEQ ID NO: 3075571 - RNA, 12 nt, Human
gagcccugggag

SEQ ID NO: 3075572 - RNA, 17 nt, Human
gagccccgaggccuucu

SEQ ID NO: 3075573 - RNA, 20 nt, Human
gagccccacagccccaucug

SEQ ID NO: 3075574 - RNA, 14 nt, Human
gagccccgaggccu

SEQ ID NO: 3075575 - RNA, 13 nt, Human
gagccccgaggcc

SEQ ID NO: 3075576 - RNA, 16 nt, Human
gagccccacccucaga

SEQ ID NO: 3075577 - RNA, 12 nt, Human
gagccccacagc

SEQ ID NO: 3075578 - RNA, 13 nt, Human
gagccccacagcc

SEQ ID NO: 3075579 - RNA, 14 nt, Human
gagccccacagccc

SEQ ID NO: 3075580 - RNA, 23 nt, Human
gacauugcggacagccacggcca

SEQ ID NO: 3075581 - RNA, 17 nt, Human
gacauugcggacagcca

SEQ ID NO: 3075582 - RNA, 17 nt, Human
gacauuugcucauggaa

SEQ ID NO: 3075583 - RNA, 19 nt, Human
gacagcuccuucuguccua

SEQ ID NO: 3075584 - RNA, 12 nt, Human
gacagcucugca

SEQ ID NO: 3075585 - RNA, 10 nt, Human
gacagcucuu

SEQ ID NO: 3075586 - RNA, 11 nt, Human
gacagcucuua

SEQ ID NO: 3075587 - RNA, 18 nt, Human
gacagucaccucauggaa

SEQ ID NO: 3075588 - RNA, 12 nt, Human
gacagucccugc

SEQ ID NO: 3075589 - RNA, 14 nt, Human
gacagucccugcca

SEQ ID NO: 3075590 - RNA, 15 nt, Human
gacagucccugccaa

SEQ ID NO: 3075591 - RNA, 16 nt, Human
gacagucccugccaau

SEQ ID NO: 3075592 - RNA, 20 nt, Human
gacagucccugccaauggac

SEQ ID NO: 3075593 - RNA, 14 nt, Human
gacagcccgggcuc

SEQ ID NO: 3075594 - RNA, 18 nt, Human
gacagcuccuucuguccu

SEQ ID NO: 3075595 - RNA, 17 nt, Human
gacagcuccuucugucc

SEQ ID NO: 3075596 - RNA, 16 nt, Human
gacagcccgggcucug

SEQ ID NO: 3075597 - RNA, 16 nt, Human
gacagcuccuucuguc

SEQ ID NO: 3075598 - RNA, 22 nt, Human
gacgcuacccgggaagggggcu

SEQ ID NO: 3075599 - RNA, 23 nt, Human
gacgcuacccgggaagggggcug

SEQ ID NO: 3075600 - RNA, 14 nt, Human
gacgcucucuggcc

SEQ ID NO: 3075601 - RNA, 16 nt, Human
gacgcugugcugcccu

SEQ ID NO: 3075602 - RNA, 17 nt, Human
gacgcugugcugcccug

SEQ ID NO: 3075603 - RNA, 18 nt, Human
gacgcugugcugcccugc

SEQ ID NO: 3075604 - RNA, 15 nt, Human
gacgcugugcugccc

SEQ ID NO: 3075605 - RNA, 22 nt, Human
gaccucugcagcaauaaagcag

SEQ ID NO: 3075606 - RNA, 18 nt, Human
gaccucugcagcaauaaa

SEQ ID NO: 3075607 - RNA, 16 nt, Human
gaccucugcagcaaua

SEQ ID NO: 3075608 - RNA, 12 nt, Human
gacgccauccca

SEQ ID NO: 3075609 - RNA, 13 nt, Human
gacgccaucccag

SEQ ID NO: 3075610 - RNA, 19 nt, Human
gacgccaucccagccccaa

SEQ ID NO: 3075611 - RNA, 21 nt, Human
gacgccaucccagccccaaug

SEQ ID NO: 3075612 - RNA, 18 nt, Human
gaccucaggugagaagca

SEQ ID NO: 3075613 - RNA, 19 nt, Human
gaccucaggugagaagcag

SEQ ID NO: 3075614 - RNA, 19 nt, Human
gaccucaggccugggggcu

SEQ ID NO: 3075615 - RNA, 21 nt, Human
gaccucaggugauccacccac

SEQ ID NO: 3075616 - RNA, 20 nt, Human
gaccucaggugauccaccca

SEQ ID NO: 3075617 - RNA, 21 nt, Human
gaccucaggugagaagcagag

SEQ ID NO: 3075618 - RNA, 19 nt, Human
gaccucaggugauccaccc

SEQ ID NO: 3075619 - RNA, 14 nt, Human
gaccucaggccugg

SEQ ID NO: 3075620 - RNA, 13 nt, Human
gaccucaggccug

SEQ ID NO: 3075621 - RNA, 14 nt, Human
gaaugaauggcuaa

SEQ ID NO: 3075622 - RNA, 15 nt, Human
gaauauauaaccagu

SEQ ID NO: 3075623 - RNA, 12 nt, Human
gaauauugcuga

SEQ ID NO: 3075624 - RNA, 13 nt, Human
gaauauugcugau

SEQ ID NO: 3075625 - RNA, 11 nt, Human
gaauauugcug

SEQ ID NO: 3075626 - RNA, 22 nt, Human
gaauaucuccgucaacucauau

SEQ ID NO: 3075627 - RNA, 24 nt, Human
gaauauugcugauggugcaaugac

SEQ ID NO: 3075628 - RNA, 22 nt, Human
gaauauugcugauggugcaaug

SEQ ID NO: 3075629 - RNA, 23 nt, Human
gaauauugcugauggugcaauga

SEQ ID NO: 3075630 - RNA, 21 nt, Human
gacacagcucuucuccaggcu

SEQ ID NO: 3075631 - RNA, 17 nt, Human
gacacagcucuucucca

SEQ ID NO: 3075632 - RNA, 20 nt, Human
gacacagcucuucuccaggc

SEQ ID NO: 3075633 - RNA, 19 nt, Human
gacacagcucuucuccagg

SEQ ID NO: 3075634 - RNA, 12 nt, Human
gacacagcucuu

SEQ ID NO: 3075635 - RNA, 14 nt, Human
gaauuaugaaacuu

SEQ ID NO: 3075636 - RNA, 18 nt, Human
gaaugcacaaacagaggc

SEQ ID NO: 3075637 - RNA, 22 nt, Human
gaaugauuaugaauuacauuug

SEQ ID NO: 3075638 - RNA, 17 nt, Human
gaauguuugccucugcc

SEQ ID NO: 3075639 - RNA, 16 nt, Human
gaauguuugccucugc

SEQ ID NO: 3075640 - RNA, 19 nt, Human
gaaugcacaaacagaggcc

SEQ ID NO: 3075641 - RNA, 15 nt, Human
gaauguuugccucug

SEQ ID NO: 3075642 - RNA, 20 nt, Human
gaaugaugauccuaggcauu

SEQ ID NO: 3075643 - RNA, 14 nt, Human
gaaugaugccauga

SEQ ID NO: 3075644 - RNA, 14 nt, Human
gaaugauuaauuaa

SEQ ID NO: 3075645 - RNA, 14 nt, Human
gaaugauuaugaau

SEQ ID NO: 3075646 - RNA, 15 nt, Human
gaaugaauggcuaag

SEQ ID NO: 3075647 - RNA, 19 nt, Human
gaauguuugccucugccuc

SEQ ID NO: 3075648 - RNA, 18 nt, Human
gaauguuugccucugccu

SEQ ID NO: 3075649 - RNA, 14 nt, Human
gaauuaacacauga

SEQ ID NO: 3075650 - RNA, 15 nt, Human
gaauuaacacaugau

SEQ ID NO: 3075651 - RNA, 20 nt, Human
gaauuacauuuguauaaaau

SEQ ID NO: 3075652 - RNA, 15 nt, Human
gaauuacauuuguau

SEQ ID NO: 3075653 - RNA, 18 nt, Human
gaauuacauuuguauaaa

SEQ ID NO: 3075654 - RNA, 13 nt, Human
gaauuacauuugu

SEQ ID NO: 3075655 - RNA, 21 nt, Human
ggaagccagcaggcucucagg

SEQ ID NO: 3075656 - RNA, 18 nt, Human
ggaagccgcuggggccag

SEQ ID NO: 3075657 - RNA, 22 nt, Human
ggaagccagcaggcucucaggc

SEQ ID NO: 3075658 - RNA, 23 nt, Human
ggaagccagcaggcucucaggcc

SEQ ID NO: 3075659 - RNA, 23 nt, Human
ggaaaucaccgaaaacguggcug

SEQ ID NO: 3075660 - RNA, 19 nt, Human
ggaaaucaggguuaguauu

SEQ ID NO: 3075661 - RNA, 21 nt, Human
ggacagucaccucauggaauu

SEQ ID NO: 3075662 - RNA, 17 nt, Human
ggacagucaccucaugg

SEQ ID NO: 3075663 - RNA, 18 nt, Human
ggacagucaccucaugga

SEQ ID NO: 3075664 - RNA, 13 nt, Human
ggacacccuguga

SEQ ID NO: 3075665 - RNA, 23 nt, Human
ggacacccugugauggggcccug

SEQ ID NO: 3075666 - RNA, 17 nt, Human
ggacagggaggugaccc

SEQ ID NO: 3075667 - RNA, 23 nt, Human
ggacaggcauguucucugaggac

SEQ ID NO: 3075668 - RNA, 13 nt, Human
ggacauggacaag

SEQ ID NO: 3075669 - RNA, 18 nt, Human
ggaaugaagcaaugcuuc

SEQ ID NO: 3075670 - RNA, 19 nt, Human
ggaaugaaugucaguguga

SEQ ID NO: 3075671 - RNA, 12 nt, Human
ggacacagcucu

SEQ ID NO: 3075672 - RNA, 12 nt, Human
ggacacccugug

SEQ ID NO: 3075673 - RNA, 21 nt, Human
ggacacagcucuucuccaggc

SEQ ID NO: 3075674 - RNA, 13 nt, Human
ggacacagcucuu

SEQ ID NO: 3075675 - RNA, 16 nt, Human
ggaagcucagggccug

SEQ ID NO: 3075676 - RNA, 17 nt, Human
ggaagcucagggccugg

SEQ ID NO: 3075677 - RNA, 21 nt, Human
ggaagcucagggccuggcuca

SEQ ID NO: 3075678 - RNA, 15 nt, Human
ggaauaccugucccc

SEQ ID NO: 3075679 - RNA, 16 nt, Human
ggaauaccuguccccc

SEQ ID NO: 3075680 - RNA, 19 nt, Human
ggaauaccugucccccuga

SEQ ID NO: 3075681 - RNA, 19 nt, Human
ggaauacucuuauaucuau

SEQ ID NO: 3075682 - RNA, 16 nt, Human
ggaauauauaaccagu

SEQ ID NO: 3075683 - RNA, 19 nt, Human
gcuucuucagagacuccug

SEQ ID NO: 3075684 - RNA, 21 nt, Human
gcuucuucagagacuccugca

SEQ ID NO: 3075685 - RNA, 16 nt, Human
gcuugaccgugaggcc

SEQ ID NO: 3075686 - RNA, 17 nt, Human
gcuugaccgugaggcca

SEQ ID NO: 3075687 - RNA, 18 nt, Human
gcuugaccgugaggccag

SEQ ID NO: 3075688 - RNA, 19 nt, Human
gcuugaccgugaggccaga

SEQ ID NO: 3075689 - RNA, 23 nt, Human
gcuugggcuucauccuccucaga

SEQ ID NO: 3075690 - RNA, 16 nt, Human
gcuuggggaccagagc

SEQ ID NO: 3075691 - RNA, 16 nt, Human
gcuuaacuucacauau

SEQ ID NO: 3075692 - RNA, 16 nt, Human
gcuucuucagagacuc

SEQ ID NO: 3075693 - RNA, 17 nt, Human
gcuuaacuucacauauu

SEQ ID NO: 3075694 - RNA, 14 nt, Human
gcuuaacuucacau

SEQ ID NO: 3075695 - RNA, 22 nt, Human
gcuuucuacccagcgagcccug

SEQ ID NO: 3075696 - RNA, 19 nt, Human
gcuuucuacccagcgagcc

SEQ ID NO: 3075697 - RNA, 13 nt, Human
gcuuucuacccag

SEQ ID NO: 3075698 - RNA, 17 nt, Human
gcuuggggaccagagcu

SEQ ID NO: 3075699 - RNA, 18 nt, Human
gcuuggggaccagagcug

SEQ ID NO: 3075700 - RNA, 20 nt, Human
gcuuggggaccagagcugcc

SEQ ID NO: 3075701 - RNA, 21 nt, Human
gcuuggggaccagagcugcca

SEQ ID NO: 3075702 - RNA, 22 nt, Human
gcuuggggaccagagcugccac

SEQ ID NO: 3075703 - RNA, 19 nt, Human
gcuugggcuucauccuccu

SEQ ID NO: 3075704 - RNA, 20 nt, Human
gcuuuucccuuuuuuuaagu

SEQ ID NO: 3075705 - RNA, 21 nt, Human
gcuuuucccuuuuuuuaagua

SEQ ID NO: 3075706 - RNA, 21 nt, Human
ggaaacuaggugcauauuuau

SEQ ID NO: 3075707 - RNA, 13 nt, Human
ggaaacugccagc

SEQ ID NO: 3075708 - RNA, 15 nt, Human
ggaaacccagcucug

SEQ ID NO: 3075709 - RNA, 20 nt, Human
ggaaacagcuaaugggacac

SEQ ID NO: 3075710 - RNA, 16 nt, Human
ggaaaaaauaacaaug

SEQ ID NO: 3075711 - RNA, 19 nt, Human
gcuuuugugcauuaucuag

SEQ ID NO: 3075712 - RNA, 13 nt, Human
gcuuuugugcauu

SEQ ID NO: 3075713 - RNA, 15 nt, Human
gcuuuuuaauauuga

SEQ ID NO: 3075714 - RNA, 19 nt, Human
ggaaagcaaaggagauugg

SEQ ID NO: 3075715 - RNA, 16 nt, Human
ggaaagaguaggaaga

SEQ ID NO: 3075716 - RNA, 17 nt, Human
ggaaagaguaggaagac

SEQ ID NO: 3075717 - RNA, 20 nt, Human
ggaaagacuuuuccaacccu

SEQ ID NO: 3075718 - RNA, 14 nt, Human
ggaaagaggcucug

SEQ ID NO: 3075719 - RNA, 18 nt, Human
gcugagggugagugggug

SEQ ID NO: 3075720 - RNA, 23 nt, Human
gcugagggugagugggugaauaa

SEQ ID NO: 3075721 - RNA, 14 nt, Human
gcugaggugggagg

SEQ ID NO: 3075722 - RNA, 16 nt, Human
gcugagauccuggacu

SEQ ID NO: 3075723 - RNA, 14 nt, Human
gcugagauccugga

SEQ ID NO: 3075724 - RNA, 22 nt, Human
gcugagauccuggacugagggg

SEQ ID NO: 3075725 - RNA, 23 nt, Human
gcugcaaaggguaucaggugcug

SEQ ID NO: 3075726 - RNA, 18 nt, Human
gcugcacccucaggcagg

SEQ ID NO: 3075727 - RNA, 19 nt, Human
gcugcacccucaggcaggu

SEQ ID NO: 3075728 - RNA, 13 nt, Human
gcugcaccggcug

SEQ ID NO: 3075729 - RNA, 16 nt, Human
gcugcacccucaggca

SEQ ID NO: 3075730 - RNA, 17 nt, Human
gcugccccuggcagccc

SEQ ID NO: 3075731 - RNA, 20 nt, Human
gcugccccuggcagccccug

SEQ ID NO: 3075732 - RNA, 18 nt, Human
gcugccccuggcagcccc

SEQ ID NO: 3075733 - RNA, 19 nt, Human
gcugccccuggcagccccu

SEQ ID NO: 3075734 - RNA, 16 nt, Human
gcugccucucccauca

SEQ ID NO: 3075735 - RNA, 20 nt, Human
gcugccugggaucccucauc

SEQ ID NO: 3075736 - RNA, 13 nt, Human
gcugccuguucag

SEQ ID NO: 3075737 - RNA, 12 nt, Human
gcugccuguuca

SEQ ID NO: 3075738 - RNA, 17 nt, Human
gcugccuguucagcucc

SEQ ID NO: 3075739 - RNA, 21 nt, Human
gcugccugggaucccucaucc

SEQ ID NO: 3075740 - RNA, 17 nt, Human
gcuguaucccaugagcc

SEQ ID NO: 3075741 - RNA, 21 nt, Human
gcuguauuuuaaaagaaugau

SEQ ID NO: 3075742 - RNA, 20 nt, Human
gcuguauuuuaaaagaauga

SEQ ID NO: 3075743 - RNA, 18 nt, Human
gcuguauuuuaaaagaau

SEQ ID NO: 3075744 - RNA, 15 nt, Human
gcugugcugcccugc

SEQ ID NO: 3075745 - RNA, 16 nt, Human
gcugugcugcccugcc

SEQ ID NO: 3075746 - RNA, 17 nt, Human
gcugugcugcccugccc

SEQ ID NO: 3075747 - RNA, 15 nt, Human
gcuguuggcuggggg

SEQ ID NO: 3075748 - RNA, 20 nt, Human
gcuguuggcugggggccuca

SEQ ID NO: 3075749 - RNA, 16 nt, Human
gcuguuggcugggggc

SEQ ID NO: 3075750 - RNA, 14 nt, Human
gcuguuggcugggg

SEQ ID NO: 3075751 - RNA, 16 nt, Human
gcugugcucuggacag

SEQ ID NO: 3075752 - RNA, 15 nt, Human
gcugugcucuggaca

SEQ ID NO: 3075753 - RNA, 14 nt, Human
gcugugcugcccug

SEQ ID NO: 3075754 - RNA, 13 nt, Human
gcugugcucugga

SEQ ID NO: 3075755 - RNA, 12 nt, Human
gcugcugaaggc

SEQ ID NO: 3075756 - RNA, 13 nt, Human
gcugcugaaacaa

SEQ ID NO: 3075757 - RNA, 14 nt, Human
gcuggcgugcagug

SEQ ID NO: 3075758 - RNA, 19 nt, Human
gcuggcuguuggcuggggg

SEQ ID NO: 3075759 - RNA, 18 nt, Human
gcuggcuguuggcugggg

SEQ ID NO: 3075760 - RNA, 18 nt, Human
gcuggcgugcaguggugc

SEQ ID NO: 3075761 - RNA, 15 nt, Human
gcuggcgugcagugg

SEQ ID NO: 3075762 - RNA, 14 nt, Human
gcugggcagguugg

SEQ ID NO: 3075763 - RNA, 23 nt, Human
gcuggcuguuggcugggggccuc

SEQ ID NO: 3075764 - RNA, 20 nt, Human
gcuggcuguuggcugggggc

SEQ ID NO: 3075765 - RNA, 17 nt, Human
gcuggcuguuggcuggg

SEQ ID NO: 3075766 - RNA, 14 nt, Human
gcugggccccugcc

SEQ ID NO: 3075767 - RNA, 13 nt, Human
gcugggccccugc

SEQ ID NO: 3075768 - RNA, 12 nt, Human
gcugggccccug

SEQ ID NO: 3075769 - RNA, 18 nt, Human
gcugggccccugccucuc

SEQ ID NO: 3075770 - RNA, 17 nt, Human
gcugggguggggaccuc

SEQ ID NO: 3075771 - RNA, 19 nt, Human
gcugggguggggaccucag

SEQ ID NO: 3075772 - RNA, 22 nt, Human
gcugggguggggaccucaggcc

SEQ ID NO: 3075773 - RNA, 18 nt, Human
gcuggguucuacccaggu

SEQ ID NO: 3075774 - RNA, 17 nt, Human
gcuggguucuacccagg

SEQ ID NO: 3075775 - RNA, 20 nt, Human
gcuggguucuacccaggugc

SEQ ID NO: 3075776 - RNA, 21 nt, Human
gcuggguucuacccaggugcu

SEQ ID NO: 3075777 - RNA, 16 nt, Human
gccccuggcagccccu

SEQ ID NO: 3075778 - RNA, 17 nt, Human
gccccuggcagccccug

SEQ ID NO: 3075779 - RNA, 16 nt, Human
gccuacaggagugagc

SEQ ID NO: 3075780 - RNA, 16 nt, Human
gcccugugggccccca

SEQ ID NO: 3075781 - RNA, 17 nt, Human
gcccugugggcccccaa

SEQ ID NO: 3075782 - RNA, 21 nt, Human
gcccuuaccugccaggaagcc

SEQ ID NO: 3075783 - RNA, 22 nt, Human
gcccuuaccugccaggaagcca

SEQ ID NO: 3075784 - RNA, 23 nt, Human
gcccuuaccugccaggaagccag

SEQ ID NO: 3075785 - RNA, 14 nt, Human
gcccugcccaccug

SEQ ID NO: 3075786 - RNA, 17 nt, Human
gccuacaggagugagca

SEQ ID NO: 3075787 - RNA, 12 nt, Human
gccuagcauacg

SEQ ID NO: 3075788 - RNA, 22 nt, Human
gccucauguccacugguucuuc

SEQ ID NO: 3075789 - RNA, 22 nt, Human
gccuccuuugugaggaagccgc

SEQ ID NO: 3075790 - RNA, 13 nt, Human
gccucgaacuggc

SEQ ID NO: 3075791 - RNA, 16 nt, Human
gccucgaacuggcugc

SEQ ID NO: 3075792 - RNA, 14 nt, Human
gccucugggacugg

SEQ ID NO: 3075793 - RNA, 12 nt, Human
gccuccauccug

SEQ ID NO: 3075794 - RNA, 13 nt, Human
gccuccauccuga

SEQ ID NO: 3075795 - RNA, 14 nt, Human
gccuccauccugag

SEQ ID NO: 3075796 - RNA, 16 nt, Human
gccccaccagugccuc

SEQ ID NO: 3075797 - RNA, 17 nt, Human
gccccaccagugccucu

SEQ ID NO: 3075798 - RNA, 18 nt, Human
gccccaccagugccucuc

SEQ ID NO: 3075799 - RNA, 22 nt, Human
gccccaccagugccucucccug

SEQ ID NO: 3075800 - RNA, 13 nt, Human
gccccaccagugc

SEQ ID NO: 3075801 - RNA, 14 nt, Human
gccccaccagugcc

SEQ ID NO: 3075802 - RNA, 15 nt, Human
gccccaccagugccu

SEQ ID NO: 3075803 - RNA, 18 nt, Human
gccccacagccccaucug

SEQ ID NO: 3075804 - RNA, 20 nt, Human
gccccaaaacucuccucugc

SEQ ID NO: 3075805 - RNA, 21 nt, Human
gccccaaaacucuccucugcu

SEQ ID NO: 3075806 - RNA, 11 nt, Human
gccccaaaagg

SEQ ID NO: 3075807 - RNA, 19 nt, Human
gccccaaaacucuccucug

SEQ ID NO: 3075808 - RNA, 12 nt, Human
gccccuggcagc

SEQ ID NO: 3075809 - RNA, 15 nt, Human
gccccuggcagcccc

SEQ ID NO: 3075810 - RNA, 16 nt, Human
gccccugcugguucag

SEQ ID NO: 3075811 - RNA, 15 nt, Human
gccccugcugguuca

SEQ ID NO: 3075812 - RNA, 12 nt, Human
gccccugcuggu

SEQ ID NO: 3075813 - RNA, 12 nt, Human
gcccaggccccu

SEQ ID NO: 3075814 - RNA, 11 nt, Human
gcccaggcccc

SEQ ID NO: 3075815 - RNA, 21 nt, Human
gcccaggccccugccacccug

SEQ ID NO: 3075816 - RNA, 20 nt, Human
gcccaggccccugccacccu

SEQ ID NO: 3075817 - RNA, 18 nt, Human
gcccaggccccugccacc

SEQ ID NO: 3075818 - RNA, 11 nt, Human
gcccaggcagg

SEQ ID NO: 3075819 - RNA, 16 nt, Human
gcccaggcaggucuug

SEQ ID NO: 3075820 - RNA, 20 nt, Human
gcccacuguacuugcucuug

SEQ ID NO: 3075821 - RNA, 15 nt, Human
gcccacuguacuugc

SEQ ID NO: 3075822 - RNA, 22 nt, Human
gcccacuguacuugcucuugau

SEQ ID NO: 3075823 - RNA, 21 nt, Human
gcccacgcuggagugcaguga

SEQ ID NO: 3075824 - RNA, 19 nt, Human
gcccacgcuggagugcagu

SEQ ID NO: 3075825 - RNA, 23 nt, Human
gcccacgcuggagugcagugagc

SEQ ID NO: 3075826 - RNA, 24 nt, Human
gcccaggaaaggcuccaggagcag

SEQ ID NO: 3075827 - RNA, 21 nt, Human
gcccaggaaaggcuccaggag

SEQ ID NO: 3075828 - RNA, 22 nt, Human
gcccaggaaaggcuccaggagc

SEQ ID NO: 3075829 - RNA, 23 nt, Human
gcccaggaaaggcuccaggagca

SEQ ID NO: 3075830 - RNA, 13 nt, Human
gcccacuucugcc

SEQ ID NO: 3075831 - RNA, 15 nt, Human
gcccacgcccccacu

SEQ ID NO: 3075832 - RNA, 16 nt, Human
gcccacgcccccacug

SEQ ID NO: 3075833 - RNA, 17 nt, Human
gcccacgcccccacugg

SEQ ID NO: 3075834 - RNA, 21 nt, Human
gcccacgcccccacuggugac

SEQ ID NO: 3075835 - RNA, 18 nt, Human
gcauuuacuuuguguuca

SEQ ID NO: 3075836 - RNA, 12 nt, Human
gcauuuagaugu

SEQ ID NO: 3075837 - RNA, 19 nt, Human
gcauuuaggccaugggaca

SEQ ID NO: 3075838 - RNA, 13 nt, Human
gcauuuagaugua

SEQ ID NO: 3075839 - RNA, 22 nt, Human
gcuaagugauccucccaccuca

SEQ ID NO: 3075840 - RNA, 18 nt, Human
gcuaagugauccucccac

SEQ ID NO: 3075841 - RNA, 21 nt, Human
gcuaggaauuguguuuauaau

SEQ ID NO: 3075842 - RNA, 20 nt, Human
gcuaggaccccuccaugugg

SEQ ID NO: 3075843 - RNA, 16 nt, Human
gcuaguugggcuuccu

SEQ ID NO: 3075844 - RNA, 14 nt, Human
gcuaguugggcuuc

SEQ ID NO: 3075845 - RNA, 20 nt, Human
gcucagggccuggcucaggu

SEQ ID NO: 3075846 - RNA, 16 nt, Human
gcucagagcaguguuu

SEQ ID NO: 3075847 - RNA, 22 nt, Human
gcucagagagggugggaguggg

SEQ ID NO: 3075848 - RNA, 23 nt, Human
gcucaggagcccugggaggcucu

SEQ ID NO: 3075849 - RNA, 21 nt, Human
gcucaggagcccugggaggcu

SEQ ID NO: 3075850 - RNA, 22 nt, Human
gcucaggagcccugggaggcuc

SEQ ID NO: 3075851 - RNA, 18 nt, Human
gcucagggccuggcucag

SEQ ID NO: 3075852 - RNA, 19 nt, Human
gcucagggccuggcucagg

SEQ ID NO: 3075853 - RNA, 13 nt, Human
gcucaggaguuug

SEQ ID NO: 3075854 - RNA, 17 nt, Human
gcucagggccuggcuca

SEQ ID NO: 3075855 - RNA, 21 nt, Human
gccuugaccauucuccaccug

SEQ ID NO: 3075856 - RNA, 22 nt, Human
gccuugaccauucuccaccugc

SEQ ID NO: 3075857 - RNA, 23 nt, Human
gccuugaacuuugaccucugcag

SEQ ID NO: 3075858 - RNA, 17 nt, Human
gcgauucuucugcuuca

SEQ ID NO: 3075859 - RNA, 22 nt, Human
gcgauucuucugcuucagccuc

SEQ ID NO: 3075860 - RNA, 23 nt, Human
gccuugaccauucuccaccugcc

SEQ ID NO: 3075861 - RNA, 23 nt, Human
gcgauucuucugcuucagccucc

SEQ ID NO: 3075862 - RNA, 20 nt, Human
gcgcagcauauucaggaagc

SEQ ID NO: 3075863 - RNA, 21 nt, Human
gcgcagcauauucaggaagcu

SEQ ID NO: 3075864 - RNA, 16 nt, Human
gccuucucugaaggac

SEQ ID NO: 3075865 - RNA, 15 nt, Human
gccuucucugaagga

SEQ ID NO: 3075866 - RNA, 23 nt, Human
gccuucggccuccauccugaggc

SEQ ID NO: 3075867 - RNA, 17 nt, Human
gccuguucagcuccagc

SEQ ID NO: 3075868 - RNA, 16 nt, Human
gccuguucagcuccag

SEQ ID NO: 3075869 - RNA, 14 nt, Human
gccuguucagcucc

SEQ ID NO: 3075870 - RNA, 15 nt, Human
gccuguucagcucca

SEQ ID NO: 3075871 - RNA, 14 nt, Human
gccuugaacuuuga

SEQ ID NO: 3075872 - RNA, 19 nt, Human
gccugugccucugggacug

SEQ ID NO: 3075873 - RNA, 23 nt, Human
gccugggaucccucauccucaua

SEQ ID NO: 3075874 - RNA, 21 nt, Human
gccugggaucccucauccuca

SEQ ID NO: 3075875 - RNA, 11 nt, Human
gccugggcaga

SEQ ID NO: 3075876 - RNA, 23 nt, Human
gccuggcuccaaacccucgaggc

SEQ ID NO: 3075877 - RNA, 16 nt, Human
gcggccuuuggcuuca

SEQ ID NO: 3075878 - RNA, 15 nt, Human
gcggcuggcagccca

SEQ ID NO: 3075879 - RNA, 22 nt, Human
ggaggugggauccuccaggugc

SEQ ID NO: 3075880 - RNA, 23 nt, Human
ggaggugggauccuccaggugca

SEQ ID NO: 3075881 - RNA, 21 nt, Human
ggagggugacgggggugaacu

SEQ ID NO: 3075882 - RNA, 22 nt, Human
ggagguaaggaauaccuguccc

SEQ ID NO: 3075883 - RNA, 13 nt, Human
ggaggggggaggu

SEQ ID NO: 3075884 - RNA, 14 nt, Human
ggaggggggaggug

SEQ ID NO: 3075885 - RNA, 16 nt, Human
ggaguggccacagaaa

SEQ ID NO: 3075886 - RNA, 12 nt, Human
ggagugggccca

SEQ ID NO: 3075887 - RNA, 22 nt, Human
ggagugggcccaaugcacuuug

SEQ ID NO: 3075888 - RNA, 15 nt, Human
ggaguggccacagaa

SEQ ID NO: 3075889 - RNA, 14 nt, Human
ggauuguaguccca

SEQ ID NO: 3075890 - RNA, 13 nt, Human
ggauuguccccga

SEQ ID NO: 3075891 - RNA, 14 nt, Human
ggaugaaaaaauaa

SEQ ID NO: 3075892 - RNA, 22 nt, Human
ggaucuuuggacagaagcagcu

SEQ ID NO: 3075893 - RNA, 17 nt, Human
ggauuuaacagaaaugu

SEQ ID NO: 3075894 - RNA, 16 nt, Human
ggauuuaacagaaaug

SEQ ID NO: 3075895 - RNA, 22 nt, Human
ggauuuaacagaaauguacagc

SEQ ID NO: 3075896 - RNA, 16 nt, Human
ggauuguccccgaccc

SEQ ID NO: 3075897 - RNA, 20 nt, Human
ggauuguccccgacccuugc

SEQ ID NO: 3075898 - RNA, 12 nt, Human
ggauuuaacaga

SEQ ID NO: 3075899 - RNA, 23 nt, Human
ggaucuucaucugacuaugacau

SEQ ID NO: 3075900 - RNA, 21 nt, Human
ggaucuuuggacagaagcagc

SEQ ID NO: 3075901 - RNA, 16 nt, Human
ggaguucaucuugaau

SEQ ID NO: 3075902 - RNA, 15 nt, Human
ggauccugagccaga

SEQ ID NO: 3075903 - RNA, 16 nt, Human
ggauccugagccagau

SEQ ID NO: 3075904 - RNA, 18 nt, Human
ggauccugagccagauuu

SEQ ID NO: 3075905 - RNA, 19 nt, Human
ggauccugagccagauuuc

SEQ ID NO: 3075906 - RNA, 20 nt, Human
ggauccugagccagauuuca

SEQ ID NO: 3075907 - RNA, 23 nt, Human
ggauccugagccagauuucacuc

SEQ ID NO: 3075908 - RNA, 14 nt, Human
ggcauuugcugaau

SEQ ID NO: 3075909 - RNA, 17 nt, Human
ggccagagacacaagcc

SEQ ID NO: 3075910 - RNA, 18 nt, Human
ggccagagacacaagccu

SEQ ID NO: 3075911 - RNA, 19 nt, Human
ggccagagggagugacaga

SEQ ID NO: 3075912 - RNA, 17 nt, Human
ggccagagggagugaca

SEQ ID NO: 3075913 - RNA, 13 nt, Human
ggccaaaggaagc

SEQ ID NO: 3075914 - RNA, 17 nt, Human
ggcauuuguuugaacug

SEQ ID NO: 3075915 - RNA, 14 nt, Human
ggccaaaggaagca

SEQ ID NO: 3075916 - RNA, 16 nt, Human
ggccaaaggaagcaca

SEQ ID NO: 3075917 - RNA, 19 nt, Human
ggccaaaggaagcacaugc

SEQ ID NO: 3075918 - RNA, 18 nt, Human
ggcacaccgggcacucag

SEQ ID NO: 3075919 - RNA, 16 nt, Human
ggcacugcuuccagug

SEQ ID NO: 3075920 - RNA, 18 nt, Human
ggcacaucagcacgauuu

SEQ ID NO: 3075921 - RNA, 15 nt, Human
ggcaaaaaggcagga

SEQ ID NO: 3075922 - RNA, 18 nt, Human
ggcaggaggaucacuuga

SEQ ID NO: 3075923 - RNA, 20 nt, Human
ggcacugcuuccagugaggc

SEQ ID NO: 3075924 - RNA, 13 nt, Human
ggcagccaggcca

SEQ ID NO: 3075925 - RNA, 22 nt, Human
ggcagccccauucugccugccc

SEQ ID NO: 3075926 - RNA, 21 nt, Human
ggcagccccauucugccugcc

SEQ ID NO: 3075927 - RNA, 20 nt, Human
ggcagccccauucugccugc

SEQ ID NO: 3075928 - RNA, 16 nt, Human
ggcagccccauucugc

SEQ ID NO: 3075929 - RNA, 14 nt, Human
ggcuggccuggccc

SEQ ID NO: 3075930 - RNA, 15 nt, Human
ggcuggccuggcccc

SEQ ID NO: 3075931 - RNA, 13 nt, Human
ggcuggccuggcc

SEQ ID NO: 3075932 - RNA, 23 nt, Human
aaaaagauuuucagaaaauauua

SEQ ID NO: 3075933 - RNA, 22 nt, Human
aaaaaacugcugacuguuuucu

SEQ ID NO: 3075934 - RNA, 14 nt, Human
aaaaauaaaaaaca

SEQ ID NO: 3075935 - RNA, 20 nt, Human
aaaaagccugcaauuucaua

SEQ ID NO: 3075936 - RNA, 14 nt, Human
aaaaaggaggaaga

SEQ ID NO: 3075937 - RNA, 12 nt, Human
aaaaaggcagga

SEQ ID NO: 3075938 - RNA, 21 nt, Human
aaaaaggaugcacagaguugu

SEQ ID NO: 3075939 - RNA, 22 nt, Human
ggcuggguucuacccaggugcu

SEQ ID NO: 3075940 - RNA, 14 nt, Human
ggcuggguuggagg

SEQ ID NO: 3075941 - RNA, 13 nt, Human
aaaaauacaaaaa

SEQ ID NO: 3075942 - RNA, 15 nt, Human
ggcucacugcagccu

SEQ ID NO: 3075943 - RNA, 14 nt, Human
ggcucacugcagcc

SEQ ID NO: 3075944 - RNA, 13 nt, Human
ggcucacugcagc

SEQ ID NO: 3075945 - RNA, 17 nt, Human
ggcucuuccaggcuggg

SEQ ID NO: 3075946 - RNA, 18 nt, Human
ggcucuuccaggcuggga

SEQ ID NO: 3075947 - RNA, 15 nt, Human
ggcucuuccaggcug

SEQ ID NO: 3075948 - RNA, 14 nt, Human
ggcucuuccaggcu

SEQ ID NO: 3075949 - RNA, 13 nt, Human
ggcucccuuccca

SEQ ID NO: 3075950 - RNA, 19 nt, Human
ggccccugccucucugcag

SEQ ID NO: 3075951 - RNA, 18 nt, Human
ggccccugccucucugca

SEQ ID NO: 3075952 - RNA, 17 nt, Human
ggccccugccucucugc

SEQ ID NO: 3075953 - RNA, 13 nt, Human
ggccccugccucu

SEQ ID NO: 3075954 - RNA, 16 nt, Human
ggccagaugcaccagc

SEQ ID NO: 3075955 - RNA, 15 nt, Human
ggccagaugcaccag

SEQ ID NO: 3075956 - RNA, 18 nt, Human
ggccucccaacucacccc

SEQ ID NO: 3075957 - RNA, 19 nt, Human
ggccucccaacucacccca

SEQ ID NO: 3075958 - RNA, 17 nt, Human
ggccucccaacucaccc

SEQ ID NO: 3075959 - RNA, 13 nt, Human
ggccucagugcca

SEQ ID NO: 3075960 - RNA, 20 nt, Human
ggccucccaacucaccccag

SEQ ID NO: 3075961 - RNA, 22 nt, Human
ggccucccaacucaccccagcc

SEQ ID NO: 3075962 - RNA, 23 nt, Human
ggccucccaacucaccccagccc

SEQ ID NO: 3075963 - RNA, 20 nt, Human
ggcuaagcuucacuguaaaa

SEQ ID NO: 3075964 - RNA, 21 nt, Human
ggcgagccauuugucccaagu

SEQ ID NO: 3075965 - RNA, 20 nt, Human
ggccuuccccuggcacuggc

SEQ ID NO: 3075966 - RNA, 18 nt, Human
ggccuucggccuccaucc

SEQ ID NO: 3075967 - RNA, 16 nt, Human
ggccuucggccuccau

SEQ ID NO: 3075968 - RNA, 14 nt, Human
ggccuuccccuggc

SEQ ID NO: 3075969 - RNA, 14 nt, Human
ggcuaccuuuguau

SEQ ID NO: 3075970 - RNA, 13 nt, Human
ggcuaccuuugua

SEQ ID NO: 3075971 - RNA, 16 nt, Human
ggcuaauguacugcau

SEQ ID NO: 3075972 - RNA, 20 nt, Human
ggcuaagugauccucccacc

SEQ ID NO: 3075973 - RNA, 15 nt, Human
ggccuggccagaugc

SEQ ID NO: 3075974 - RNA, 12 nt, Human
ggccuggccaga

SEQ ID NO: 3075975 - RNA, 11 nt, Human
ggccuggaugc

SEQ ID NO: 3075976 - RNA, 20 nt, Human
ggccuggaugcccccugugg

SEQ ID NO: 3075977 - RNA, 16 nt, Human
ggccugcaagggagug

SEQ ID NO: 3075978 - RNA, 12 nt, Human
aaaaugagaaau

SEQ ID NO: 3075979 - RNA, 11 nt, Human
aaaaugagaaa

SEQ ID NO: 3075980 - RNA, 16 nt, Human
aaaauauauuuaauga

SEQ ID NO: 3075981 - RNA, 15 nt, Human
aaaauauauuuaaug

SEQ ID NO: 3075982 - RNA, 16 nt, Human
aaaauauuuuccugcc

SEQ ID NO: 3075983 - RNA, 17 nt, Human
aaaaucucaauauuuca

SEQ ID NO: 3075984 - RNA, 16 nt, Human
aaaagguuaauaaagu

SEQ ID NO: 3075985 - RNA, 17 nt, Human
aaaagguuaauaaagua

SEQ ID NO: 3075986 - RNA, 11 nt, Human
aaaaggcagga

SEQ ID NO: 3075987 - RNA, 19 nt, Human
aaaagguaugcaaucaaau

SEQ ID NO: 3075988 - RNA, 22 nt, Human
aaaaggaugcacagaguuguua

SEQ ID NO: 3075989 - RNA, 19 nt, Human
aaaaggaugcacagaguug

SEQ ID NO: 3075990 - RNA, 15 nt, Human
aaaaggaugcacaga

SEQ ID NO: 3075991 - RNA, 14 nt, Human
aaaaggaugcacag

SEQ ID NO: 3075992 - RNA, 13 nt, Human
aaaaggaugcaca

SEQ ID NO: 3075993 - RNA, 22 nt, Human
aaaaggagccaauuuaaagaaa

SEQ ID NO: 3075994 - RNA, 13 nt, Human
aaaauaccaagga

SEQ ID NO: 3075995 - RNA, 14 nt, Human
aaaauacacacuca

SEQ ID NO: 3075996 - RNA, 16 nt, Human
aaaauaauuuuuauau

SEQ ID NO: 3075997 - RNA, 17 nt, Human
aaaauaauuuuuauauu

SEQ ID NO: 3075998 - RNA, 11 nt, Human
aaaauaauuuu

SEQ ID NO: 3075999 - RNA, 22 nt, Human
gggcugggccucggaccccacu

SEQ ID NO: 3076000 - RNA, 17 nt, Human
gggcuggguucuaccca

SEQ ID NO: 3076001 - RNA, 16 nt, Human
aaaaugguuuaaaugg

SEQ ID NO: 3076002 - RNA, 18 nt, Human
aaaaugguuuaaaugguc

SEQ ID NO: 3076003 - RNA, 12 nt, Human
gggcugggcaga

SEQ ID NO: 3076004 - RNA, 15 nt, Human
gggcugggcagagga

SEQ ID NO: 3076005 - RNA, 18 nt, Human
gggcugcucccaccuggc

SEQ ID NO: 3076006 - RNA, 21 nt, Human
gggcugcucccaccuggcucu

SEQ ID NO: 3076007 - RNA, 22 nt, Human
gggcugcucccaccuggcucug

SEQ ID NO: 3076008 - RNA, 23 nt, Human
gggcugcucccaccuggcucugu

SEQ ID NO: 3076009 - RNA, 20 nt, Human
gggcugcaccggcuggccug

SEQ ID NO: 3076010 - RNA, 21 nt, Human
gggcugcaccggcuggccugg

SEQ ID NO: 3076011 - RNA, 13 nt, Human
gggcugcucccac

SEQ ID NO: 3076012 - RNA, 19 nt, Human
gggcucagcggggacagcu

SEQ ID NO: 3076013 - RNA, 17 nt, Human
gggcucagcggggacag

SEQ ID NO: 3076014 - RNA, 15 nt, Human
gggcuaguugggcuu

SEQ ID NO: 3076015 - RNA, 18 nt, Human
gggcucagcaaaagaugc

SEQ ID NO: 3076016 - RNA, 22 nt, Human
gggcucagcaaaagaugcuucu

SEQ ID NO: 3076017 - RNA, 10 nt, Human
gggcuccaga

SEQ ID NO: 3076018 - RNA, 13 nt, Human
gggcuccagacac

SEQ ID NO: 3076019 - RNA, 21 nt, Human
gggcucagcggggacagcucc

SEQ ID NO: 3076020 - RNA, 17 nt, Human
gggcugcaccggcuggc

SEQ ID NO: 3076021 - RNA, 19 nt, Human
gggcugcaccggcuggccu

SEQ ID NO: 3076022 - RNA, 15 nt, Human
gggcucccagccagg

SEQ ID NO: 3076023 - RNA, 17 nt, Human
gggcucccagccaggcc

SEQ ID NO: 3076024 - RNA, 19 nt, Human
gggcucccagccaggcccu

SEQ ID NO: 3076025 - RNA, 22 nt, Human
gggccucgguguggagaagcgg

SEQ ID NO: 3076026 - RNA, 21 nt, Human
gggccucugcggagcacacug

SEQ ID NO: 3076027 - RNA, 23 nt, Human
gggccucugcggagcacacuggc

SEQ ID NO: 3076028 - RNA, 18 nt, Human
gggccucuuaugggcugg

SEQ ID NO: 3076029 - RNA, 15 nt, Human
gggccucagugccac

SEQ ID NO: 3076030 - RNA, 14 nt, Human
gggccucagugcca

SEQ ID NO: 3076031 - RNA, 13 nt, Human
gggccucagugcc

SEQ ID NO: 3076032 - RNA, 21 nt, Human
gggcggugagaggggaacaga

SEQ ID NO: 3076033 - RNA, 12 nt, Human
gggccaggagcc

SEQ ID NO: 3076034 - RNA, 13 nt, Human
gggccaggagccu

SEQ ID NO: 3076035 - RNA, 14 nt, Human
gggccaggagccuc

SEQ ID NO: 3076036 - RNA, 14 nt, Human
gggucacucuggca

SEQ ID NO: 3076037 - RNA, 20 nt, Human
gggucacucuggcagcucag

SEQ ID NO: 3076038 - RNA, 19 nt, Human
aaacauuuugucauauaag

SEQ ID NO: 3076039 - RNA, 22 nt, Human
aaaccugugucucugagaguag

SEQ ID NO: 3076040 - RNA, 15 nt, Human
gggggcugggcagag

SEQ ID NO: 3076041 - RNA, 13 nt, Human
ggggguggccucc

SEQ ID NO: 3076042 - RNA, 21 nt, Human
ggggucacucuggcagcucag

SEQ ID NO: 3076043 - RNA, 21 nt, Human
gggggcagugcucacccacac

SEQ ID NO: 3076044 - RNA, 11 nt, Human
gggggcuggga

SEQ ID NO: 3076045 - RNA, 14 nt, Human
gggggcugcuccca

SEQ ID NO: 3076046 - RNA, 17 nt, Human
gggggaucacagccucu

SEQ ID NO: 3076047 - RNA, 19 nt, Human
ggggccaguuggucccccu

SEQ ID NO: 3076048 - RNA, 14 nt, Human
ggggaccagagcug

SEQ ID NO: 3076049 - RNA, 18 nt, Human
aaaauguauguguaagua

SEQ ID NO: 3076050 - RNA, 12 nt, Human
ggggaccagagc

SEQ ID NO: 3076051 - RNA, 13 nt, Human
ggggaccagagcu

SEQ ID NO: 3076052 - RNA, 20 nt, Human
gguaaggaauaccugucccc

SEQ ID NO: 3076053 - RNA, 14 nt, Human
gguaucaggugcug

SEQ ID NO: 3076054 - RNA, 20 nt, Human
gguaggguaagugagagagg

SEQ ID NO: 3076055 - RNA, 21 nt, Human
aaacuucccuuucugcuugug

SEQ ID NO: 3076056 - RNA, 22 nt, Human
aaacuugauguguuaucucuua

SEQ ID NO: 3076057 - RNA, 18 nt, Human
aaacuuuacuauggcccu

SEQ ID NO: 3076058 - RNA, 14 nt, Human
ggucagugcaaaua

SEQ ID NO: 3076059 - RNA, 19 nt, Human
gguaucaggugcugccauc

SEQ ID NO: 3076060 - RNA, 22 nt, Human
gguaaaucagacuaugaaguuu

SEQ ID NO: 3076061 - RNA, 18 nt, Human
gguaacuagggaagauaa

SEQ ID NO: 3076062 - RNA, 12 nt, Human
ggguggugaccu

SEQ ID NO: 3076063 - RNA, 20 nt, Human
ggguuuugccauguuggcca

SEQ ID NO: 3076064 - RNA, 20 nt, Human
ggguuuuauuguuuaaaauc

SEQ ID NO: 3076065 - RNA, 23 nt, Human
ggguuuugccauguuggccaggc

SEQ ID NO: 3076066 - RNA, 19 nt, Human
aaacuuaaucuaaauggaa

SEQ ID NO: 3076067 - RNA, 15 nt, Human
gggugggacacccug

SEQ ID NO: 3076068 - RNA, 18 nt, Human
gggugggacacccuguga

SEQ ID NO: 3076069 - RNA, 14 nt, Human
ggguggccucccaa

SEQ ID NO: 3076070 - RNA, 19 nt, Human
aaacuguuaauaguucagg

SEQ ID NO: 3076071 - RNA, 20 nt, Human
aaacguggcugcuucaagga

SEQ ID NO: 3076072 - RNA, 21 nt, Human
aaacguggcugcuucaaggau

SEQ ID NO: 3076073 - RNA, 14 nt, Human
aaauauauuuaaug

SEQ ID NO: 3076074 - RNA, 14 nt, Human
aaauauauaucaaa

SEQ ID NO: 3076075 - RNA, 18 nt, Human
aaauauaugcuaagucuu

SEQ ID NO: 3076076 - RNA, 22 nt, Human
aaauauauuuuaagacgaaaca

SEQ ID NO: 3076077 - RNA, 16 nt, Human
aaauauauuuuaagac

SEQ ID NO: 3076078 - RNA, 15 nt, Human
aaauauauuuaauga

SEQ ID NO: 3076079 - RNA, 22 nt, Human
aaauaucacuugucaauaaaau

SEQ ID NO: 3076080 - RNA, 21 nt, Human
aaauaccagccaguaaauggg

SEQ ID NO: 3076081 - RNA, 20 nt, Human
aaauaccagccaguaaaugg

SEQ ID NO: 3076082 - RNA, 21 nt, Human
aaauaccaugccauuuaaagc

SEQ ID NO: 3076083 - RNA, 19 nt, Human
aaauaccagccaguaaaug

SEQ ID NO: 3076084 - RNA, 16 nt, Human
guacacacacauacac

SEQ ID NO: 3076085 - RNA, 15 nt, Human
aaauauaggaacuua

SEQ ID NO: 3076086 - RNA, 20 nt, Human
aaauacgugggcauucaaau

SEQ ID NO: 3076087 - RNA, 21 nt, Human
aaauacgugggcauucaaaug

SEQ ID NO: 3076088 - RNA, 20 nt, Human
aaauauuguguugugaaugu

SEQ ID NO: 3076089 - RNA, 23 nt, Human
aaaucagccugcuccagcuguuc

SEQ ID NO: 3076090 - RNA, 19 nt, Human
aaaucagccugcuccagcu

SEQ ID NO: 3076091 - RNA, 21 nt, Human
aaaucagccugcuccagcugu

SEQ ID NO: 3076092 - RNA, 23 nt, Human
aaauaucugaaaauguaugugua

SEQ ID NO: 3076093 - RNA, 22 nt, Human
aaauaucugaaaauguaugugu

SEQ ID NO: 3076094 - RNA, 21 nt, Human
aaauaucugaaaauguaugug

SEQ ID NO: 3076095 - RNA, 19 nt, Human
aaauaucugaaaauguaug

SEQ ID NO: 3076096 - RNA, 18 nt, Human
aaauaucugaaaauguau

SEQ ID NO: 3076097 - RNA, 17 nt, Human
aaauaucugaaaaugua

SEQ ID NO: 3076098 - RNA, 14 nt, Human
aaauaucugaaaau

SEQ ID NO: 3076099 - RNA, 12 nt, Human
aaauaucugaaa

SEQ ID NO: 3076100 - RNA, 17 nt, Human
aaauaugcaaagcacug

SEQ ID NO: 3076101 - RNA, 16 nt, Human
aaauaugcaaagcacu

SEQ ID NO: 3076102 - RNA, 15 nt, Human
aaauaugcaaagcac

SEQ ID NO: 3076103 - RNA, 13 nt, Human
aaauaugcaaagc

SEQ ID NO: 3076104 - RNA, 13 nt, Human
guaaaccuuuuau

SEQ ID NO: 3076105 - RNA, 22 nt, Human
aaaguguauuuuuuuacuaaua

SEQ ID NO: 3076106 - RNA, 22 nt, Human
aaauaaugugaaacuggauuaa

SEQ ID NO: 3076107 - RNA, 14 nt, Human
aaauaaugugaaac

SEQ ID NO: 3076108 - RNA, 16 nt, Human
guaacaagccacccca

SEQ ID NO: 3076109 - RNA, 19 nt, Human
guaacaggaaaauuuuaaa

SEQ ID NO: 3076110 - RNA, 15 nt, Human
guaauagagcaaaau

SEQ ID NO: 3076111 - RNA, 13 nt, Human
guaauaaacucau

SEQ ID NO: 3076112 - RNA, 21 nt, Human
guaauuuuuuuaucgucacug

SEQ ID NO: 3076113 - RNA, 20 nt, Human
guaauuugugauacaaugcu

SEQ ID NO: 3076114 - RNA, 17 nt, Human
guaauuugugauacaau

SEQ ID NO: 3076115 - RNA, 15 nt, Human
guaauuugugauaca

SEQ ID NO: 3076116 - RNA, 23 nt, Human
guaauccuagcacuuugggaggc

SEQ ID NO: 3076117 - RNA, 18 nt, Human
aaagguucaugcaaacuu

SEQ ID NO: 3076118 - RNA, 20 nt, Human
aaagggcccagagagggugg

SEQ ID NO: 3076119 - RNA, 20 nt, Human
aaagggauggcaagaugugg

SEQ ID NO: 3076120 - RNA, 20 nt, Human
aaagggcuguuauaaucuuu

SEQ ID NO: 3076121 - RNA, 22 nt, Human
aaagggcuguuauaaucuuuca

SEQ ID NO: 3076122 - RNA, 21 nt, Human
aaaguaaaaacaaagaaauua

SEQ ID NO: 3076123 - RNA, 12 nt, Human
gguggcuggguu

SEQ ID NO: 3076124 - RNA, 18 nt, Human
gguggcuggguuggaggg

SEQ ID NO: 3076125 - RNA, 17 nt, Human
ggugggacacccuguga

SEQ ID NO: 3076126 - RNA, 13 nt, Human
ggugggacacccu

SEQ ID NO: 3076127 - RNA, 16 nt, Human
ggugggacacccugug

SEQ ID NO: 3076128 - RNA, 19 nt, Human
gguggggaccucaggccug

SEQ ID NO: 3076129 - RNA, 14 nt, Human
aaagcuguguggca

SEQ ID NO: 3076130 - RNA, 22 nt, Human
aaagcugccagccgagauagcc

SEQ ID NO: 3076131 - RNA, 12 nt, Human
aaagcugccagc

SEQ ID NO: 3076132 - RNA, 13 nt, Human
aaagcugccagcc

SEQ ID NO: 3076133 - RNA, 13 nt, Human
aaagcagugcaug

SEQ ID NO: 3076134 - RNA, 16 nt, Human
aaagcuaggccuggcc

SEQ ID NO: 3076135 - RNA, 14 nt, Human
aaagcuaggccugg

SEQ ID NO: 3076136 - RNA, 21 nt, Human
ggugcugccauccagguucag

SEQ ID NO: 3076137 - RNA, 12 nt, Human
aaacuuuaugcu

SEQ ID NO: 3076138 - RNA, 19 nt, Human
aaacuuuaugcuaagugaa

SEQ ID NO: 3076139 - RNA, 14 nt, Human
gguggcaccagcag

SEQ ID NO: 3076140 - RNA, 20 nt, Human
gguggcaccagcagccugga

SEQ ID NO: 3076141 - RNA, 16 nt, Human
aaagcagaacagugau

SEQ ID NO: 3076142 - RNA, 20 nt, Human
gguuuguaaauuaacuuuua

SEQ ID NO: 3076143 - RNA, 17 nt, Human
gguuuucacauuggaaa

SEQ ID NO: 3076144 - RNA, 19 nt, Human
gguuuuauuguuuaaaauc

SEQ ID NO: 3076145 - RNA, 22 nt, Human
gguuucuaaagcugccagccga

SEQ ID NO: 3076146 - RNA, 16 nt, Human
gguuucuaaagcugcc

SEQ ID NO: 3076147 - RNA, 15 nt, Human
gguuucagaaaugug

SEQ ID NO: 3076148 - RNA, 19 nt, Human
aaaguacacuguuucaaac

SEQ ID NO: 3076149 - RNA, 18 nt, Human
aaaguacacuguuucaaa

SEQ ID NO: 3076150 - RNA, 22 nt, Human
aaaguagaagucuuagauguau

SEQ ID NO: 3076151 - RNA, 20 nt, Human
aaaguagaagucuuagaugu

SEQ ID NO: 3076152 - RNA, 21 nt, Human
aaaguaucccuacuguaauuu

SEQ ID NO: 3076153 - RNA, 21 nt, Human
aaaguguauuuuuuuacuaau

SEQ ID NO: 3076154 - RNA, 14 nt, Human
aaaguguauuuuuu

SEQ ID NO: 3076155 - RNA, 17 nt, Human
gguguuuuaaaaaaucu

SEQ ID NO: 3076156 - RNA, 17 nt, Human
gguucccauuugcuccu

SEQ ID NO: 3076157 - RNA, 17 nt, Human
gguguuuccuggcacug

SEQ ID NO: 3076158 - RNA, 19 nt, Human
gguguuuccuggcacugcu

SEQ ID NO: 3076159 - RNA, 20 nt, Human
gguucuagcauggcauauuu

SEQ ID NO: 3076160 - RNA, 22 nt, Human
gguucccuuuuuuggcugcuga

SEQ ID NO: 3076161 - RNA, 23 nt, Human
gguucccuuugacgccaucccag

SEQ ID NO: 3076162 - RNA, 22 nt, Human
gguucccuuugacgccauccca

SEQ ID NO: 3076163 - RNA, 12 nt, Human
gguguggagaag

SEQ ID NO: 3076164 - RNA, 14 nt, Human
gguguggagaagcg

SEQ ID NO: 3076165 - RNA, 23 nt, Human
gguguggagaagcggcuggcagc

SEQ ID NO: 3076166 - RNA, 13 nt, Human
ggugggggccucg

SEQ ID NO: 3076167 - RNA, 11 nt, Human
gguguggggga

SEQ ID NO: 3076168 - RNA, 13 nt, Human
ggugugggggaag

SEQ ID NO: 3076169 - RNA, 17 nt, Human
auucagaguugaugguu

SEQ ID NO: 3076170 - RNA, 14 nt, Human
auucaggaagcuca

SEQ ID NO: 3076171 - RNA, 19 nt, Human
auucagacagcugccuggg

SEQ ID NO: 3076172 - RNA, 17 nt, Human
auucaggaagcucaggg

SEQ ID NO: 3076173 - RNA, 19 nt, Human
auucaggaagcucagggcc

SEQ ID NO: 3076174 - RNA, 18 nt, Human
auucagauaugauucaaa

SEQ ID NO: 3076175 - RNA, 19 nt, Human
auucaguaauaacucuacc

SEQ ID NO: 3076176 - RNA, 15 nt, Human
auucaguaauaacuc

SEQ ID NO: 3076177 - RNA, 15 nt, Human
auucccaagcucugc

SEQ ID NO: 3076178 - RNA, 14 nt, Human
auucccaagcucug

SEQ ID NO: 3076179 - RNA, 16 nt, Human
auucccaagcucugcu

SEQ ID NO: 3076180 - RNA, 18 nt, Human
auucuccaccugccaggg

SEQ ID NO: 3076181 - RNA, 21 nt, Human
auucuccaccugccagggaca

SEQ ID NO: 3076182 - RNA, 13 nt, Human
auucuccugccuc

SEQ ID NO: 3076183 - RNA, 14 nt, Human
auucuccugccuca

SEQ ID NO: 3076184 - RNA, 11 nt, Human
auucuccugcc

SEQ ID NO: 3076185 - RNA, 17 nt, Human
auucuccugccucagcc

SEQ ID NO: 3076186 - RNA, 15 nt, Human
auucuccugccucag

SEQ ID NO: 3076187 - RNA, 19 nt, Human
auucuccugccucagccuc

SEQ ID NO: 3076188 - RNA, 20 nt, Human
auucuccugccucagccucc

SEQ ID NO: 3076189 - RNA, 16 nt, Human
auucuccuuguguuac

SEQ ID NO: 3076190 - RNA, 19 nt, Human
auucuccaccugccaggga

SEQ ID NO: 3076191 - RNA, 20 nt, Human
auucuccaccugccagggac

SEQ ID NO: 3076192 - RNA, 17 nt, Human
auguuuaguaaucauau

SEQ ID NO: 3076193 - RNA, 15 nt, Human
auguuuucaggcuag

SEQ ID NO: 3076194 - RNA, 17 nt, Human
auguuuucaggcuagau

SEQ ID NO: 3076195 - RNA, 21 nt, Human
auguuuucaggcuagauguau

SEQ ID NO: 3076196 - RNA, 20 nt, Human
auuaaaaaucucaaauuucu

SEQ ID NO: 3076197 - RNA, 23 nt, Human
auuaaaacacaacaucuuuuucu

SEQ ID NO: 3076198 - RNA, 19 nt, Human
auuaaaaaucucaaauuuc

SEQ ID NO: 3076199 - RNA, 15 nt, Human
auuaaaaaucucaaa

SEQ ID NO: 3076200 - RNA, 15 nt, Human
uuuuccaaaauaauu

SEQ ID NO: 3076201 - RNA, 20 nt, Human
uuuucauuuaggugaggaag

SEQ ID NO: 3076202 - RNA, 14 nt, Human
uuuucucuaggaaa

SEQ ID NO: 3076203 - RNA, 18 nt, Human
uuuucugagaaagacuau

SEQ ID NO: 3076204 - RNA, 15 nt, Human
uuuucugagaaagac

SEQ ID NO: 3076205 - RNA, 13 nt, Human
uuuuauuaugcau

SEQ ID NO: 3076206 - RNA, 11 nt, Human
uuuuauuuuau

SEQ ID NO: 3076207 - RNA, 14 nt, Human
uuuucaguguacau

SEQ ID NO: 3076208 - RNA, 20 nt, Human
auguugcccuguugcugccu

SEQ ID NO: 3076209 - RNA, 20 nt, Human
auguugcccaggcaggucuu

SEQ ID NO: 3076210 - RNA, 18 nt, Human
auguugcauagaauaaaa

SEQ ID NO: 3076211 - RNA, 17 nt, Human
auguugcauagaauaaa

SEQ ID NO: 3076212 - RNA, 18 nt, Human
auguucaucaaugaauga

SEQ ID NO: 3076213 - RNA, 15 nt, Human
auguugcauagaaua

SEQ ID NO: 3076214 - RNA, 12 nt, Human
auguugcccagg

SEQ ID NO: 3076215 - RNA, 17 nt, Human
auguugcccaggcaggu

SEQ ID NO: 3076216 - RNA, 16 nt, Human
auguugcccaggcagg

SEQ ID NO: 3076217 - RNA, 13 nt, Human
auguuaagcagau

SEQ ID NO: 3076218 - RNA, 23 nt, Human
auguguguuuuaaaaugagaaau

SEQ ID NO: 3076219 - RNA, 15 nt, Human
auguguguuuuaaaa

SEQ ID NO: 3076220 - RNA, 20 nt, Human
auguggaguucaucuugaau

SEQ ID NO: 3076221 - RNA, 24 nt, Human
auguggaguucaucuugaauugua

SEQ ID NO: 3076222 - RNA, 14 nt, Human
uuuuaauaaacacu

SEQ ID NO: 3076223 - RNA, 20 nt, Human
auggggcccugccuccuuug

SEQ ID NO: 3076224 - RNA, 12 nt, Human
uuuuaauaaugu

SEQ ID NO: 3076225 - RNA, 13 nt, Human
uuuuaauaauguu

SEQ ID NO: 3076226 - RNA, 14 nt, Human
uuuuaauaauguuu

SEQ ID NO: 3076227 - RNA, 21 nt, Human
augugccagguuuuuggucug

SEQ ID NO: 3076228 - RNA, 22 nt, Human
augugccagguuuuuggucuga

SEQ ID NO: 3076229 - RNA, 16 nt, Human
uuuuaauaauguuuca

SEQ ID NO: 3076230 - RNA, 19 nt, Human
augugcuaguaauuggaaa

SEQ ID NO: 3076231 - RNA, 20 nt, Human
auuauauaaguauucuaaau

SEQ ID NO: 3076232 - RNA, 14 nt, Human
auuauauaaguauu

SEQ ID NO: 3076233 - RNA, 17 nt, Human
auuauauaaguauucua

SEQ ID NO: 3076234 - RNA, 19 nt, Human
uuuuugugaaaagcuccau

SEQ ID NO: 3076235 - RNA, 20 nt, Human
uuuuuguagagccagggucu

SEQ ID NO: 3076236 - RNA, 19 nt, Human
uuuuuguagagccaggguc

SEQ ID NO: 3076237 - RNA, 21 nt, Human
auuaaguaaugauaacuggaa

SEQ ID NO: 3076238 - RNA, 23 nt, Human
auuaaguaaugauaacuggaaac

SEQ ID NO: 3076239 - RNA, 21 nt, Human
uuuuuauggcuuuugugcauu

SEQ ID NO: 3076240 - RNA, 20 nt, Human
uuuuuauggcuuuugugcau

SEQ ID NO: 3076241 - RNA, 22 nt, Human
uuuuuauggcuuuugugcauua

SEQ ID NO: 3076242 - RNA, 14 nt, Human
auuaaguacuaugu

SEQ ID NO: 3076243 - RNA, 21 nt, Human
auuacaguggggaaugaagau

SEQ ID NO: 3076244 - RNA, 16 nt, Human
auuacauuuguauaaa

SEQ ID NO: 3076245 - RNA, 12 nt, Human
auuaccagggac

SEQ ID NO: 3076246 - RNA, 17 nt, Human
auuacauuuguauaaaa

SEQ ID NO: 3076247 - RNA, 18 nt, Human
auuacauuuguauaaaau

SEQ ID NO: 3076248 - RNA, 14 nt, Human
uuuugaguucuaca

SEQ ID NO: 3076249 - RNA, 17 nt, Human
uuuugauccaagcuggu

SEQ ID NO: 3076250 - RNA, 17 nt, Human
uuuugagugccuuacac

SEQ ID NO: 3076251 - RNA, 23 nt, Human
uuuugccauguuggccaggcugg

SEQ ID NO: 3076252 - RNA, 12 nt, Human
uuuuuaucaugu

SEQ ID NO: 3076253 - RNA, 20 nt, Human
uuuuuaucgucacugcuuaa

SEQ ID NO: 3076254 - RNA, 12 nt, Human
uuuuuauggcuu

SEQ ID NO: 3076255 - RNA, 19 nt, Human
uuuuuauauuugaaauauu

SEQ ID NO: 3076256 - RNA, 17 nt, Human
uuuuuauauuugaaaua

SEQ ID NO: 3076257 - RNA, 11 nt, Human
uuuuuacuaau

SEQ ID NO: 3076258 - RNA, 22 nt, Human
uuuuuagacagagucucacugu

SEQ ID NO: 3076259 - RNA, 14 nt, Human
uuuuguucauacau

SEQ ID NO: 3076260 - RNA, 20 nt, Human
uuuugugcauuaucuagaua

SEQ ID NO: 3076261 - RNA, 17 nt, Human
uuuugugcauuaucuag

SEQ ID NO: 3076262 - RNA, 17 nt, Human
uuuuguucauacauauu

SEQ ID NO: 3076263 - RNA, 15 nt, Human
uuuuguuccacaagu

SEQ ID NO: 3076264 - RNA, 21 nt, Human
uuuuguuccacaaguuaaaua

SEQ ID NO: 3076265 - RNA, 21 nt, Human
auuuuauuuuuuucugaauua

SEQ ID NO: 3076266 - RNA, 17 nt, Human
auuuucagaaaauauua

SEQ ID NO: 3076267 - RNA, 14 nt, Human
auuuucagaaaaua

SEQ ID NO: 3076268 - RNA, 22 nt, Human
auuuucaguuauuauauuuaca

SEQ ID NO: 3076269 - RNA, 23 nt, Human
auuugugaagguggaaauaaacu

SEQ ID NO: 3076270 - RNA, 19 nt, Human
auuuguauaaaauaauuuu

SEQ ID NO: 3076271 - RNA, 15 nt, Human
auuuguauaaaauaa

SEQ ID NO: 3076272 - RNA, 18 nt, Human
auuuguauaaaauaauuu

SEQ ID NO: 3076273 - RNA, 14 nt, Human
auuugugauacaau

SEQ ID NO: 3076274 - RNA, 17 nt, Human
auuuuaaaagaaugauu

SEQ ID NO: 3076275 - RNA, 15 nt, Human
auuuuaauucaguug

SEQ ID NO: 3076276 - RNA, 13 nt, Human
auuuuacauaaau

SEQ ID NO: 3076277 - RNA, 16 nt, Human
auuuuacauaaauuua

SEQ ID NO: 3076278 - RNA, 17 nt, Human
auuuuacauaaauuuag

SEQ ID NO: 3076279 - RNA, 21 nt, Human
auuuuacuuuaaaaggagcca

SEQ ID NO: 3076280 - RNA, 18 nt, Human
auuuuaaaagaaugauua

SEQ ID NO: 3076281 - RNA, 22 nt, Human
auuuuaaaagaaugauuaugaa

SEQ ID NO: 3076282 - RNA, 20 nt, Human
auuggggcucccagccaggc

SEQ ID NO: 3076283 - RNA, 21 nt, Human
auuggggcucccagccaggcc

SEQ ID NO: 3076284 - RNA, 22 nt, Human
auuggggcucccagccaggccc

SEQ ID NO: 3076285 - RNA, 23 nt, Human
auuggggcucccagccaggcccu

SEQ ID NO: 3076286 - RNA, 15 nt, Human
auuggggcucccagc

SEQ ID NO: 3076287 - RNA, 15 nt, Human
auugaaaaaccauuu

SEQ ID NO: 3076288 - RNA, 18 nt, Human
auugacaggauuauugga

SEQ ID NO: 3076289 - RNA, 18 nt, Human
auugacccacaagaaaug

SEQ ID NO: 3076290 - RNA, 24 nt, Human
auucugucucuggauuauauuaug

SEQ ID NO: 3076291 - RNA, 22 nt, Human
auucuuccucccucccucuuuc

SEQ ID NO: 3076292 - RNA, 13 nt, Human
auucuuccucccu

SEQ ID NO: 3076293 - RNA, 13 nt, Human
auucuucuccacu

SEQ ID NO: 3076294 - RNA, 18 nt, Human
auucuuauuuaaugaaag

SEQ ID NO: 3076295 - RNA, 14 nt, Human
auucuuauuuaaug

SEQ ID NO: 3076296 - RNA, 13 nt, Human
auucuuauuuaau

SEQ ID NO: 3076297 - RNA, 13 nt, Human
auuguauucagag

SEQ ID NO: 3076298 - RNA, 15 nt, Human
auuguauuacaaauc

SEQ ID NO: 3076299 - RNA, 17 nt, Human
auuguccccgacccuug

SEQ ID NO: 3076300 - RNA, 19 nt, Human
auuguccccgacccuugcc

SEQ ID NO: 3076301 - RNA, 20 nt, Human
auuguccccgacccuugccg

SEQ ID NO: 3076302 - RNA, 18 nt, Human
auugugucucuugguccu

SEQ ID NO: 3076303 - RNA, 14 nt, Human
auuuaaaaaaaauc

SEQ ID NO: 3076304 - RNA, 14 nt, Human
auugugucucuugg

SEQ ID NO: 3076305 - RNA, 13 nt, Human
auuuaguguucau

SEQ ID NO: 3076306 - RNA, 20 nt, Human
auuuaguaucuuuuuauuca

SEQ ID NO: 3076307 - RNA, 18 nt, Human
auuuaguauuuuguuuca

SEQ ID NO: 3076308 - RNA, 13 nt, Human
auuuagauguaua

SEQ ID NO: 3076309 - RNA, 22 nt, Human
auuuauaaaaauaaaaaacacu

SEQ ID NO: 3076310 - RNA, 17 nt, Human
auuuauaaaaauaaaaa

SEQ ID NO: 3076311 - RNA, 22 nt, Human
auuuauuaaaugcccagccccu

SEQ ID NO: 3076312 - RNA, 15 nt, Human
auuuagaaauauaau

SEQ ID NO: 3076313 - RNA, 16 nt, Human
auuuacuucuuauaca

SEQ ID NO: 3076314 - RNA, 14 nt, Human
auuuacuucuuaua

SEQ ID NO: 3076315 - RNA, 17 nt, Human
auuuacuucuuauacau

SEQ ID NO: 3076316 - RNA, 14 nt, Human
auuuaacagaaaug

SEQ ID NO: 3076317 - RNA, 12 nt, Human
auuuaacagaaa

SEQ ID NO: 3076318 - RNA, 14 nt, Human
auuuauucugcuca

SEQ ID NO: 3076319 - RNA, 16 nt, Human
auuuccguuaaaauac

SEQ ID NO: 3076320 - RNA, 15 nt, Human
auuuccguuaaaaua

SEQ ID NO: 3076321 - RNA, 14 nt, Human
auuugaaaauuuug

SEQ ID NO: 3076322 - RNA, 14 nt, Human
auuugaaauauuga

SEQ ID NO: 3076323 - RNA, 17 nt, Human
auuuccagccaaagccu

SEQ ID NO: 3076324 - RNA, 19 nt, Human
auuuauuuuaauaauguuu

SEQ ID NO: 3076325 - RNA, 20 nt, Human
auuuauuuuaauaauguuuc

SEQ ID NO: 3076326 - RNA, 12 nt, Human
auuucauuucuu

SEQ ID NO: 3076327 - RNA, 13 nt, Human
auuuauucugcuc

SEQ ID NO: 3076328 - RNA, 17 nt, Human
auuuauuuuaauaaugu

SEQ ID NO: 3076329 - RNA, 21 nt, Human
auaugagcuuccuucugugaa

SEQ ID NO: 3076330 - RNA, 22 nt, Human
auaugagcuuccuucugugaaa

SEQ ID NO: 3076331 - RNA, 14 nt, Human
auaugcaaagcacu

SEQ ID NO: 3076332 - RNA, 13 nt, Human
auaugcaaagcac

SEQ ID NO: 3076333 - RNA, 20 nt, Human
auauguggaguucaucuuga

SEQ ID NO: 3076334 - RNA, 21 nt, Human
auauguggaguucaucuugaa

SEQ ID NO: 3076335 - RNA, 23 nt, Human
auauguaccuaacgaaguauccu

SEQ ID NO: 3076336 - RNA, 20 nt, Human
uucaugcuguucaugaaaga

SEQ ID NO: 3076337 - RNA, 22 nt, Human
uucaugcuguucaugaaagauu

SEQ ID NO: 3076338 - RNA, 21 nt, Human
uuccacaagagcccaggccuc

SEQ ID NO: 3076339 - RNA, 13 nt, Human
uuccaggcuggga

SEQ ID NO: 3076340 - RNA, 15 nt, Human
uuccaggcugggaga

SEQ ID NO: 3076341 - RNA, 17 nt, Human
uuccaggcugggagagc

SEQ ID NO: 3076342 - RNA, 18 nt, Human
uuccagguuuaagcuguu

SEQ ID NO: 3076343 - RNA, 17 nt, Human
uuccagguuuaagcugu

SEQ ID NO: 3076344 - RNA, 22 nt, Human
uuccaauuuacauacucugcuu

SEQ ID NO: 3076345 - RNA, 14 nt, Human
uucauuaucucaaa

SEQ ID NO: 3076346 - RNA, 19 nt, Human
uucagauaugauucaaaug

SEQ ID NO: 3076347 - RNA, 16 nt, Human
uucagauaugauucaa

SEQ ID NO: 3076348 - RNA, 17 nt, Human
uucagauaugauucaaa

SEQ ID NO: 3076349 - RNA, 18 nt, Human
uucagauaugauucaaau

SEQ ID NO: 3076350 - RNA, 16 nt, Human
uucagaaauguguuau

SEQ ID NO: 3076351 - RNA, 16 nt, Human
uucagguaacaggcag

SEQ ID NO: 3076352 - RNA, 15 nt, Human
uucagguaacaggca

SEQ ID NO: 3076353 - RNA, 22 nt, Human
uucaggguuggccccugcccgg

SEQ ID NO: 3076354 - RNA, 19 nt, Human
uucaggguuggccccugcc

SEQ ID NO: 3076355 - RNA, 17 nt, Human
uucaggguuggccccug

SEQ ID NO: 3076356 - RNA, 16 nt, Human
uucaggguuggccccu

SEQ ID NO: 3076357 - RNA, 14 nt, Human
uucaggguuggccc

SEQ ID NO: 3076358 - RNA, 17 nt, Human
uucagcgguuuauauaa

SEQ ID NO: 3076359 - RNA, 13 nt, Human
auauaugcuaagu

SEQ ID NO: 3076360 - RNA, 15 nt, Human
uucaucaaugaauga

SEQ ID NO: 3076361 - RNA, 15 nt, Human
auauauuuuaagacg

SEQ ID NO: 3076362 - RNA, 16 nt, Human
auauauuuaaugauaa

SEQ ID NO: 3076363 - RNA, 22 nt, Human
auauauguuuuaagaggcaggg

SEQ ID NO: 3076364 - RNA, 21 nt, Human
auauauguuuuaagaggcagg

SEQ ID NO: 3076365 - RNA, 14 nt, Human
uucaguaagccgug

SEQ ID NO: 3076366 - RNA, 17 nt, Human
uucagguaacaggcaga

SEQ ID NO: 3076367 - RNA, 13 nt, Human
auauuuacaaaug

SEQ ID NO: 3076368 - RNA, 23 nt, Human
auauuuaaugauaaguaaaugcu

SEQ ID NO: 3076369 - RNA, 13 nt, Human
auauuuaaugaua

SEQ ID NO: 3076370 - RNA, 12 nt, Human
auauuuaaugau

SEQ ID NO: 3076371 - RNA, 13 nt, Human
auauuguuuucag

SEQ ID NO: 3076372 - RNA, 14 nt, Human
auauuguuugcuaa

SEQ ID NO: 3076373 - RNA, 15 nt, Human
auauugauaugcuua

SEQ ID NO: 3076374 - RNA, 18 nt, Human
auauucucacagcuccaa

SEQ ID NO: 3076375 - RNA, 22 nt, Human
auauugcugauggugcaaugac

SEQ ID NO: 3076376 - RNA, 17 nt, Human
uucccagugaauucuug

SEQ ID NO: 3076377 - RNA, 16 nt, Human
auauguucugacauaa

SEQ ID NO: 3076378 - RNA, 15 nt, Human
uuccagugaggcucu

SEQ ID NO: 3076379 - RNA, 16 nt, Human
uuccagugaggcucug

SEQ ID NO: 3076380 - RNA, 13 nt, Human
auauguuucaaac

SEQ ID NO: 3076381 - RNA, 14 nt, Human
auauguuucaaacu

SEQ ID NO: 3076382 - RNA, 16 nt, Human
auauguuucaaacuuu

SEQ ID NO: 3076383 - RNA, 17 nt, Human
auauuaagaaagacuau

SEQ ID NO: 3076384 - RNA, 15 nt, Human
auauuaagaaagacu

SEQ ID NO: 3076385 - RNA, 16 nt, Human
auauuaagaaagacua

SEQ ID NO: 3076386 - RNA, 17 nt, Human
auauuaccacagacaua

SEQ ID NO: 3076387 - RNA, 18 nt, Human
auauuuuucacauaucua

SEQ ID NO: 3076388 - RNA, 15 nt, Human
auauuuuuguagcac

SEQ ID NO: 3076389 - RNA, 16 nt, Human
auauuuuuguagcacu

SEQ ID NO: 3076390 - RNA, 23 nt, Human
auauuuuuguagcacugacagau

SEQ ID NO: 3076391 - RNA, 15 nt, Human
aucaaauaugcaaag

SEQ ID NO: 3076392 - RNA, 21 nt, Human
aucaacugcaucaagauguga

SEQ ID NO: 3076393 - RNA, 16 nt, Human
aucaaggguacacugc

SEQ ID NO: 3076394 - RNA, 18 nt, Human
aucaaauaugcaaagcac

SEQ ID NO: 3076395 - RNA, 17 nt, Human
aucaaauaugcaaagca

SEQ ID NO: 3076396 - RNA, 16 nt, Human
aucaaauaugcaaagc

SEQ ID NO: 3076397 - RNA, 17 nt, Human
aucacgccacugcacua

SEQ ID NO: 3076398 - RNA, 15 nt, Human
aucacgccacugcac

SEQ ID NO: 3076399 - RNA, 14 nt, Human
aucaauuuuucuua

SEQ ID NO: 3076400 - RNA, 14 nt, Human
aucacgccacugca

SEQ ID NO: 3076401 - RNA, 21 nt, Human
aucaaggguacacugccuucu

SEQ ID NO: 3076402 - RNA, 13 nt, Human
aucaauuuaaaaa

SEQ ID NO: 3076403 - RNA, 15 nt, Human
uucccuuuuuuuaag

SEQ ID NO: 3076404 - RNA, 21 nt, Human
uuccuaaauauauuuuaagac

SEQ ID NO: 3076405 - RNA, 20 nt, Human
uuccuaaauauauuuuaaga

SEQ ID NO: 3076406 - RNA, 22 nt, Human
uuccucuuuuuauuuaguuccu

SEQ ID NO: 3076407 - RNA, 19 nt, Human
uuccuggcacugcuuccag

SEQ ID NO: 3076408 - RNA, 12 nt, Human
uuccugaacagg

SEQ ID NO: 3076409 - RNA, 20 nt, Human
uuccuggcacugcuuccagu

SEQ ID NO: 3076410 - RNA, 22 nt, Human
uuccuggcacugcuuccaguga

SEQ ID NO: 3076411 - RNA, 22 nt, Human
uucuuaaccagaucauugugaa

SEQ ID NO: 3076412 - RNA, 18 nt, Human
uucuguuuagauaauaca

SEQ ID NO: 3076413 - RNA, 13 nt, Human
uucuguuuagaua

SEQ ID NO: 3076414 - RNA, 21 nt, Human
uucuguuggccagugugacaa

SEQ ID NO: 3076415 - RNA, 17 nt, Human
uucuguuuuauaauuuu

SEQ ID NO: 3076416 - RNA, 16 nt, Human
uucuguuuuauaauuu

SEQ ID NO: 3076417 - RNA, 20 nt, Human
uucuuucuggcuaugcauuu

SEQ ID NO: 3076418 - RNA, 17 nt, Human
uucuuucuggcuaugca

SEQ ID NO: 3076419 - RNA, 12 nt, Human
uucuuucuggcu

SEQ ID NO: 3076420 - RNA, 13 nt, Human
uucuugcaaagua

SEQ ID NO: 3076421 - RNA, 22 nt, Human
uucuucuccacuuucuagccag

SEQ ID NO: 3076422 - RNA, 16 nt, Human
auccaagcaaauguga

SEQ ID NO: 3076423 - RNA, 16 nt, Human
uucugccugcccaggc

SEQ ID NO: 3076424 - RNA, 15 nt, Human
uucugccugcccagg

SEQ ID NO: 3076425 - RNA, 14 nt, Human
auccaguaucuuga

SEQ ID NO: 3076426 - RNA, 17 nt, Human
auccagguucagcuugu

SEQ ID NO: 3076427 - RNA, 16 nt, Human
aucccaugagccucag

SEQ ID NO: 3076428 - RNA, 13 nt, Human
aucccaugagccu

SEQ ID NO: 3076429 - RNA, 11 nt, Human
aucccagcccc

SEQ ID NO: 3076430 - RNA, 18 nt, Human
aucccaugagccucagca

SEQ ID NO: 3076431 - RNA, 17 nt, Human
aucccaugagccucagc

SEQ ID NO: 3076432 - RNA, 17 nt, Human
aucccugaaggccccgc

SEQ ID NO: 3076433 - RNA, 22 nt, Human
aucccugaaggccccgcccagg

SEQ ID NO: 3076434 - RNA, 23 nt, Human
aucagugugucuaaauuugaaug

SEQ ID NO: 3076435 - RNA, 19 nt, Human
aucagucugauucccaagc

SEQ ID NO: 3076436 - RNA, 14 nt, Human
aucaggugcugcca

SEQ ID NO: 3076437 - RNA, 15 nt, Human
aucaggugcugccau

SEQ ID NO: 3076438 - RNA, 23 nt, Human
aucacuugaacccgggaggcaga

SEQ ID NO: 3076439 - RNA, 19 nt, Human
aucaggugcugccauccag

SEQ ID NO: 3076440 - RNA, 17 nt, Human
aucaggugcugccaucc

SEQ ID NO: 3076441 - RNA, 16 nt, Human
aucauuaggugugacu

SEQ ID NO: 3076442 - RNA, 23 nt, Human
aucauccacugugccaugugcca

SEQ ID NO: 3076443 - RNA, 21 nt, Human
aucauccacugugccaugugc

SEQ ID NO: 3076444 - RNA, 15 nt, Human
aucauaaaacuugau

SEQ ID NO: 3076445 - RNA, 23 nt, Human
aucauaguggcuuaaaacaacac

SEQ ID NO: 3076446 - RNA, 15 nt, Human
aucauugugaaauua

SEQ ID NO: 3076447 - RNA, 13 nt, Human
aucauugugaaau

SEQ ID NO: 3076448 - RNA, 19 nt, Human
aucauugugaaauuauuca

SEQ ID NO: 3076449 - RNA, 12 nt, Human
aucauugaaauc

SEQ ID NO: 3076450 - RNA, 21 nt, Human
uucucuaguuugauuaaauuc

SEQ ID NO: 3076451 - RNA, 14 nt, Human
uucugaagaagaug

SEQ ID NO: 3076452 - RNA, 20 nt, Human
uucucuaguuugauuaaauu

SEQ ID NO: 3076453 - RNA, 19 nt, Human
uucugcagccacuauuguu

SEQ ID NO: 3076454 - RNA, 17 nt, Human
uugaagggaaauuucag

SEQ ID NO: 3076455 - RNA, 16 nt, Human
uugaaggaugcugucu

SEQ ID NO: 3076456 - RNA, 14 nt, Human
uugaaggaugcugu

SEQ ID NO: 3076457 - RNA, 17 nt, Human
uugacacuuaaaaaugg

SEQ ID NO: 3076458 - RNA, 17 nt, Human
uugaaggaaaaugauac

SEQ ID NO: 3076459 - RNA, 15 nt, Human
aucuaaauguugaaa

SEQ ID NO: 3076460 - RNA, 19 nt, Human
aucuaaauggaaccacucu

SEQ ID NO: 3076461 - RNA, 14 nt, Human
aucgucacugcuua

SEQ ID NO: 3076462 - RNA, 18 nt, Human
aucgucacugcuuaacuu

SEQ ID NO: 3076463 - RNA, 15 nt, Human
aucgugacaacacuu

SEQ ID NO: 3076464 - RNA, 14 nt, Human
aucgugacaacacu

SEQ ID NO: 3076465 - RNA, 14 nt, Human
uugagaguucuaaa

SEQ ID NO: 3076466 - RNA, 24 nt, Human
uugaccauucuccaccugccaggg

SEQ ID NO: 3076467 - RNA, 19 nt, Human
uugacagggcacaccgggc

SEQ ID NO: 3076468 - RNA, 19 nt, Human
uugacacuuaaaaaugguu

SEQ ID NO: 3076469 - RNA, 18 nt, Human
uugaccauucuccaccug

SEQ ID NO: 3076470 - RNA, 19 nt, Human
uugaccauucuccaccugc

SEQ ID NO: 3076471 - RNA, 17 nt, Human
uugaccauucuccaccu

SEQ ID NO: 3076472 - RNA, 17 nt, Human
uugauaaguucauacau

SEQ ID NO: 3076473 - RNA, 16 nt, Human
uugauaaguucauaca

SEQ ID NO: 3076474 - RNA, 16 nt, Human
uugaggucuguucuuu

SEQ ID NO: 3076475 - RNA, 15 nt, Human
uugaggucuguucuu

SEQ ID NO: 3076476 - RNA, 12 nt, Human
uugauaaaguaa

SEQ ID NO: 3076477 - RNA, 14 nt, Human
aucguaaaauuaag

SEQ ID NO: 3076478 - RNA, 13 nt, Human
aucguaaaauuaa

SEQ ID NO: 3076479 - RNA, 17 nt, Human
aucguaaaauuaagaaa

SEQ ID NO: 3076480 - RNA, 12 nt, Human
aucguaaaauua

SEQ ID NO: 3076481 - RNA, 21 nt, Human
auccuggcacccggccccugc

SEQ ID NO: 3076482 - RNA, 20 nt, Human
auccuggcacccggccccug

SEQ ID NO: 3076483 - RNA, 19 nt, Human
auccuggcacccggccccu

SEQ ID NO: 3076484 - RNA, 17 nt, Human
auccuggcacccggccc

SEQ ID NO: 3076485 - RNA, 15 nt, Human
auccuggaguucugg

SEQ ID NO: 3076486 - RNA, 16 nt, Human
auccuggacugagggg

SEQ ID NO: 3076487 - RNA, 23 nt, Human
auccuggcacccggccccugcug

SEQ ID NO: 3076488 - RNA, 22 nt, Human
auccuggcacccggccccugcu

SEQ ID NO: 3076489 - RNA, 23 nt, Human
auccuggacugagggggccugga

SEQ ID NO: 3076490 - RNA, 17 nt, Human
auccuggcccagggcau

SEQ ID NO: 3076491 - RNA, 18 nt, Human
auccuggcccagggcauc

SEQ ID NO: 3076492 - RNA, 21 nt, Human
auccuggcccagggcaucugg

SEQ ID NO: 3076493 - RNA, 20 nt, Human
uucuuuugccguuauuaaaa

SEQ ID NO: 3076494 - RNA, 18 nt, Human
auccucuguacagagccc

SEQ ID NO: 3076495 - RNA, 20 nt, Human
auccucuguacagagcccac

SEQ ID NO: 3076496 - RNA, 13 nt, Human
auccucuguugau

SEQ ID NO: 3076497 - RNA, 17 nt, Human
auccucuuugagugaag

SEQ ID NO: 3076498 - RNA, 12 nt, Human
auccugagccag

SEQ ID NO: 3076499 - RNA, 13 nt, Human
auccugagccaga

SEQ ID NO: 3076500 - RNA, 11 nt, Human
auccugagcca

SEQ ID NO: 3076501 - RNA, 14 nt, Human
auccugagccagau

SEQ ID NO: 3076502 - RNA, 15 nt, Human
auccugagccagauu

SEQ ID NO: 3076503 - RNA, 17 nt, Human
auccugagccagauuuc

SEQ ID NO: 3076504 - RNA, 21 nt, Human
auccugagccagauuucacuc

SEQ ID NO: 3076505 - RNA, 11 nt, Human
auccugaggcu

SEQ ID NO: 3076506 - RNA, 13 nt, Human
auccugaggcucc

SEQ ID NO: 3076507 - RNA, 16 nt, Human
auccugaggcuccacu

SEQ ID NO: 3076508 - RNA, 18 nt, Human
auccugaggcuccacuug

SEQ ID NO: 3076509 - RNA, 13 nt, Human
auccugccccuga

SEQ ID NO: 3076510 - RNA, 22 nt, Human
auccugaggcuccacuuggucu

SEQ ID NO: 3076511 - RNA, 16 nt, Human
auccugcaauuccacu

SEQ ID NO: 3076512 - RNA, 14 nt, Human
uuuaugugaaacau

SEQ ID NO: 3076513 - RNA, 15 nt, Human
uuuaugugaaacaug

SEQ ID NO: 3076514 - RNA, 19 nt, Human
uuuauuaaaugcccagccc

SEQ ID NO: 3076515 - RNA, 16 nt, Human
uuuauuacuguaagaa

SEQ ID NO: 3076516 - RNA, 17 nt, Human
uuuauaugcuucuguuu

SEQ ID NO: 3076517 - RNA, 15 nt, Human
uuuagauaauacacc

SEQ ID NO: 3076518 - RNA, 13 nt, Human
uuuagauaauaca

SEQ ID NO: 3076519 - RNA, 18 nt, Human
uuuagaguugauacuaca

SEQ ID NO: 3076520 - RNA, 17 nt, Human
uuuagggguagcauuug

SEQ ID NO: 3076521 - RNA, 24 nt, Human
uuuaaagcuuauuaaaacucauuu

SEQ ID NO: 3076522 - RNA, 16 nt, Human
uuuaaagcuuccauug

SEQ ID NO: 3076523 - RNA, 13 nt, Human
augcuaagugaaa

SEQ ID NO: 3076524 - RNA, 21 nt, Human
uuuaccuuuuuuauacauaaa

SEQ ID NO: 3076525 - RNA, 17 nt, Human
uuuacuaauagacaauu

SEQ ID NO: 3076526 - RNA, 14 nt, Human
uuuacuaauagaca

SEQ ID NO: 3076527 - RNA, 18 nt, Human
uuuacuaauagacaauuu

SEQ ID NO: 3076528 - RNA, 18 nt, Human
augcuacacacugcaugu

SEQ ID NO: 3076529 - RNA, 22 nt, Human
uuuaccugaagucuuuguacag

SEQ ID NO: 3076530 - RNA, 17 nt, Human
augcuacacacugcaug

SEQ ID NO: 3076531 - RNA, 20 nt, Human
uuuaccuuuuuuauacauaa

SEQ ID NO: 3076532 - RNA, 19 nt, Human
uuuaccuuuuuuauacaua

SEQ ID NO: 3076533 - RNA, 14 nt, Human
uuuaccuuuuuuau

SEQ ID NO: 3076534 - RNA, 19 nt, Human
augcuguauauccuuucua

SEQ ID NO: 3076535 - RNA, 22 nt, Human
augcuggcuguuggcugggggc

SEQ ID NO: 3076536 - RNA, 19 nt, Human
uuuauuacuguaagaaaau

SEQ ID NO: 3076537 - RNA, 19 nt, Human
augcugugcccuaaagugu

SEQ ID NO: 3076538 - RNA, 23 nt, Human
augcugucuacacuaagagagaa

SEQ ID NO: 3076539 - RNA, 14 nt, Human
augcuguauuuuaa

SEQ ID NO: 3076540 - RNA, 15 nt, Human
auggaauaacaugua

SEQ ID NO: 3076541 - RNA, 14 nt, Human
auggaauaacaugu

SEQ ID NO: 3076542 - RNA, 16 nt, Human
uuuauuuuaauaaugu

SEQ ID NO: 3076543 - RNA, 21 nt, Human
auggaaguacuauaauuuacc

SEQ ID NO: 3076544 - RNA, 16 nt, Human
auggaacauaaaauac

SEQ ID NO: 3076545 - RNA, 18 nt, Human
auggaacacucugagacu

SEQ ID NO: 3076546 - RNA, 17 nt, Human
auggaacacucugagac

SEQ ID NO: 3076547 - RNA, 17 nt, Human
uuuauuuuuuucugaau

SEQ ID NO: 3076548 - RNA, 14 nt, Human
uuucacucuccuug

SEQ ID NO: 3076549 - RNA, 12 nt, Human
uuucauaaagca

SEQ ID NO: 3076550 - RNA, 22 nt, Human
uuucagaaaauauuauguguuu

SEQ ID NO: 3076551 - RNA, 15 nt, Human
uuucacucuccuugg

SEQ ID NO: 3076552 - RNA, 24 nt, Human
uuucacucuuauugcccacgcugg

SEQ ID NO: 3076553 - RNA, 19 nt, Human
uuuccagguuuaagcuguu

SEQ ID NO: 3076554 - RNA, 23 nt, Human
auggaauuggagcucgugggaca

SEQ ID NO: 3076555 - RNA, 19 nt, Human
uuugaaacacuuugcauaa

SEQ ID NO: 3076556 - RNA, 17 nt, Human
uuugaaacacuuugcau

SEQ ID NO: 3076557 - RNA, 23 nt, Human
augggcuggguucuacccaggug

SEQ ID NO: 3076558 - RNA, 14 nt, Human
uuugaaauauugac

SEQ ID NO: 3076559 - RNA, 14 nt, Human
auggggcccugccu

SEQ ID NO: 3076560 - RNA, 13 nt, Human
auggggcccugcc

SEQ ID NO: 3076561 - RNA, 13 nt, Human
uuucuuuguggcu

SEQ ID NO: 3076562 - RNA, 21 nt, Human
uuucuaugacacaugcaaggu

SEQ ID NO: 3076563 - RNA, 15 nt, Human
uuucuaugacacaug

SEQ ID NO: 3076564 - RNA, 13 nt, Human
uuucuaugaaaua

SEQ ID NO: 3076565 - RNA, 14 nt, Human
uuucuaugaaauau

SEQ ID NO: 3076566 - RNA, 20 nt, Human
uuucuaugaaauauuauguu

SEQ ID NO: 3076567 - RNA, 22 nt, Human
uuucuaggacugaauuaugaaa

SEQ ID NO: 3076568 - RNA, 21 nt, Human
uuucuaggacugaauuaugaa

SEQ ID NO: 3076569 - RNA, 17 nt, Human
uuucuaggacugaauua

SEQ ID NO: 3076570 - RNA, 21 nt, Human
uuucugcagccacuauuguua

SEQ ID NO: 3076571 - RNA, 14 nt, Human
uuucugccgcagcc

SEQ ID NO: 3076572 - RNA, 16 nt, Human
uuucugccgcagcccu

SEQ ID NO: 3076573 - RNA, 14 nt, Human
uuucugcaucagcu

SEQ ID NO: 3076574 - RNA, 18 nt, Human
auggccucuucagaucuc

SEQ ID NO: 3076575 - RNA, 19 nt, Human
auggcuauaggugcuacaa

SEQ ID NO: 3076576 - RNA, 16 nt, Human
auggcuauaggugcua

SEQ ID NO: 3076577 - RNA, 21 nt, Human
auggcuauaggugcuacaaaa

SEQ ID NO: 3076578 - RNA, 22 nt, Human
augggacauuugcucauggaau

SEQ ID NO: 3076579 - RNA, 21 nt, Human
augggacauuugcucauggaa

SEQ ID NO: 3076580 - RNA, 19 nt, Human
auggacaugaucuucuuua

SEQ ID NO: 3076581 - RNA, 17 nt, Human
auggaauuucucccagu

SEQ ID NO: 3076582 - RNA, 21 nt, Human
auggacccaauauuuaccaga

SEQ ID NO: 3076583 - RNA, 13 nt, Human
augggcagagcag

SEQ ID NO: 3076584 - RNA, 14 nt, Human
augggcagagcaga

SEQ ID NO: 3076585 - RNA, 15 nt, Human
augggcagagcagag

SEQ ID NO: 3076586 - RNA, 15 nt, Human
augggccuccugugu

SEQ ID NO: 3076587 - RNA, 17 nt, Human
augggccaccgccuugc

SEQ ID NO: 3076588 - RNA, 18 nt, Human
augggccaccgccuugcc

SEQ ID NO: 3076589 - RNA, 21 nt, Human
augggcaacccccagccugcu

SEQ ID NO: 3076590 - RNA, 19 nt, Human
augggcaacccccagccug

SEQ ID NO: 3076591 - RNA, 18 nt, Human
augggcaacccccagccu

SEQ ID NO: 3076592 - RNA, 13 nt, Human
augggagcucaug

SEQ ID NO: 3076593 - RNA, 15 nt, Human
auggcuauaggugcu

SEQ ID NO: 3076594 - RNA, 18 nt, Human
uuucgcaggauucuuccu

SEQ ID NO: 3076595 - RNA, 22 nt, Human
uuucgcaggauucuuccucccu

SEQ ID NO: 3076596 - RNA, 21 nt, Human
uuuccuucauucaacccaccu

SEQ ID NO: 3076597 - RNA, 22 nt, Human
uuuccuucagugccuuauggaa

SEQ ID NO: 3076598 - RNA, 18 nt, Human
uuuccuucagugccuuau

SEQ ID NO: 3076599 - RNA, 21 nt, Human
uuuccuucagugccuuaugga

SEQ ID NO: 3076600 - RNA, 23 nt, Human
uuuccuucauucaacccaccugc

SEQ ID NO: 3076601 - RNA, 12 nt, Human
uuuccugugucu

SEQ ID NO: 3076602 - RNA, 22 nt, Human
augggccaccgccuugcccagc

SEQ ID NO: 3076603 - RNA, 12 nt, Human
uuuccuucagug

SEQ ID NO: 3076604 - RNA, 15 nt, Human
uuuccuucagugccu

SEQ ID NO: 3076605 - RNA, 11 nt, Human
uuuccuucagu

SEQ ID NO: 3076606 - RNA, 16 nt, Human
uugcuuuuaaaaucca

SEQ ID NO: 3076607 - RNA, 17 nt, Human
uuggaaagaguaggaag

SEQ ID NO: 3076608 - RNA, 17 nt, Human
uugcugauggugcaaug

SEQ ID NO: 3076609 - RNA, 18 nt, Human
uugcugauggugcaauga

SEQ ID NO: 3076610 - RNA, 12 nt, Human
uugcucauggaa

SEQ ID NO: 3076611 - RNA, 11 nt, Human
uugcucaugga

SEQ ID NO: 3076612 - RNA, 19 nt, Human
uugcugaauacagaggcaa

SEQ ID NO: 3076613 - RNA, 20 nt, Human
uugcuaagugaggaugaaaa

SEQ ID NO: 3076614 - RNA, 11 nt, Human
uuggcugcuga

SEQ ID NO: 3076615 - RNA, 15 nt, Human
uuggcugcugaaggc

SEQ ID NO: 3076616 - RNA, 14 nt, Human
uuggcugcagggag

SEQ ID NO: 3076617 - RNA, 13 nt, Human
uuggcugcaggga

SEQ ID NO: 3076618 - RNA, 22 nt, Human
uuggcuagagguucaaagauau

SEQ ID NO: 3076619 - RNA, 22 nt, Human
uuggcuaggaccccuccaugug

SEQ ID NO: 3076620 - RNA, 21 nt, Human
uuggcuagagguucaaagaua

SEQ ID NO: 3076621 - RNA, 18 nt, Human
uuggaaagaguaggaaga

SEQ ID NO: 3076622 - RNA, 19 nt, Human
augaaagacuguacaaagu

SEQ ID NO: 3076623 - RNA, 20 nt, Human
augaaagacuguacaaagua

SEQ ID NO: 3076624 - RNA, 21 nt, Human
augaaauauuauguuaaaacu

SEQ ID NO: 3076625 - RNA, 20 nt, Human
augaaauauuauguuaaaac

SEQ ID NO: 3076626 - RNA, 22 nt, Human
uuguaagcaugcacaaauucug

SEQ ID NO: 3076627 - RNA, 14 nt, Human
uuguaaggaaugau

SEQ ID NO: 3076628 - RNA, 19 nt, Human
uugguuaggcauuguggga

SEQ ID NO: 3076629 - RNA, 22 nt, Human
uugggguacccacugcucuggu

SEQ ID NO: 3076630 - RNA, 20 nt, Human
augaaccacaucuugcucug

SEQ ID NO: 3076631 - RNA, 17 nt, Human
augaauuacauuuguau

SEQ ID NO: 3076632 - RNA, 13 nt, Human
augaaccacaucu

SEQ ID NO: 3076633 - RNA, 18 nt, Human
augaauuacauuuguaua

SEQ ID NO: 3076634 - RNA, 19 nt, Human
augaauuacauuuguauaa

SEQ ID NO: 3076635 - RNA, 19 nt, Human
uuggggaagaacgaagcca

SEQ ID NO: 3076636 - RNA, 17 nt, Human
uugggguacccacugcu

SEQ ID NO: 3076637 - RNA, 13 nt, Human
uuguaaugaaaac

SEQ ID NO: 3076638 - RNA, 12 nt, Human
uuguaaugaaaa

SEQ ID NO: 3076639 - RNA, 20 nt, Human
uuguaaggaaugauuaauua

SEQ ID NO: 3076640 - RNA, 23 nt, Human
uuguaguguuggagaagaacuga

SEQ ID NO: 3076641 - RNA, 13 nt, Human
uuguauaaaauaa

SEQ ID NO: 3076642 - RNA, 19 nt, Human
uuguauaaaauaauuuuua

SEQ ID NO: 3076643 - RNA, 19 nt, Human
augacacgaauauugcuga

SEQ ID NO: 3076644 - RNA, 20 nt, Human
augacacgaauauugcugau

SEQ ID NO: 3076645 - RNA, 23 nt, Human
augaauuaguuuuauaugcuucu

SEQ ID NO: 3076646 - RNA, 22 nt, Human
augaauuacauuuguauaaaau

SEQ ID NO: 3076647 - RNA, 21 nt, Human
augaauuaguuuuauaugcuu

SEQ ID NO: 3076648 - RNA, 22 nt, Human
augcaaacuuuauuuuguguuu

SEQ ID NO: 3076649 - RNA, 16 nt, Human
augcaaggucauuuuu

SEQ ID NO: 3076650 - RNA, 14 nt, Human
augcaaggucauuu

SEQ ID NO: 3076651 - RNA, 14 nt, Human
augcaccuggaaua

SEQ ID NO: 3076652 - RNA, 16 nt, Human
augcaccuggaauaua

SEQ ID NO: 3076653 - RNA, 22 nt, Human
augcaaggucauuuuuuuuaag

SEQ ID NO: 3076654 - RNA, 15 nt, Human
augaucuucuuuaua

SEQ ID NO: 3076655 - RNA, 16 nt, Human
augcaaaccaucauug

SEQ ID NO: 3076656 - RNA, 18 nt, Human
augcaaaccaucauugaa

SEQ ID NO: 3076657 - RNA, 19 nt, Human
augcaaaccaucauugaaa

SEQ ID NO: 3076658 - RNA, 20 nt, Human
augcaaaccaucauugaaau

SEQ ID NO: 3076659 - RNA, 21 nt, Human
augcaaaccaucauugaaauc

SEQ ID NO: 3076660 - RNA, 22 nt, Human
augcaaaccaucauugaaaucu

SEQ ID NO: 3076661 - RNA, 19 nt, Human
augcaccuggaauauauaa

SEQ ID NO: 3076662 - RNA, 20 nt, Human
uuuaaaaaagaaacauuugg

SEQ ID NO: 3076663 - RNA, 18 nt, Human
uugugaagguggaaauaa

SEQ ID NO: 3076664 - RNA, 17 nt, Human
uugugaagguggaaaua

SEQ ID NO: 3076665 - RNA, 18 nt, Human
uugugaagcaaaauuuuu

SEQ ID NO: 3076666 - RNA, 14 nt, Human
augaucuucuuuau

SEQ ID NO: 3076667 - RNA, 16 nt, Human
augauccuaggcauuu

SEQ ID NO: 3076668 - RNA, 23 nt, Human
augaucacggcucacugcagccu

SEQ ID NO: 3076669 - RNA, 15 nt, Human
augaucacggcucac

SEQ ID NO: 3076670 - RNA, 19 nt, Human
augaucacggcucacugca

SEQ ID NO: 3076671 - RNA, 18 nt, Human
augaucacggcucacugc

SEQ ID NO: 3076672 - RNA, 19 nt, Human
augacauaaaaacaacuuu

SEQ ID NO: 3076673 - RNA, 12 nt, Human
augagaggaaau

SEQ ID NO: 3076674 - RNA, 13 nt, Human
augagaggaaauc

SEQ ID NO: 3076675 - RNA, 23 nt, Human
augagagacacacugaagaagca

SEQ ID NO: 3076676 - RNA, 14 nt, Human
augagaggaaauca

SEQ ID NO: 3076677 - RNA, 15 nt, Human
augagaggaaaucac

SEQ ID NO: 3076678 - RNA, 16 nt, Human
augagaggaaaucacc

SEQ ID NO: 3076679 - RNA, 16 nt, Human
augagccucagcaucc

SEQ ID NO: 3076680 - RNA, 15 nt, Human
augagccucagcauc

SEQ ID NO: 3076681 - RNA, 12 nt, Human
augagccucagc

SEQ ID NO: 3076682 - RNA, 16 nt, Human
augagccgcccaaggc

SEQ ID NO: 3076683 - RNA, 18 nt, Human
augagccgcccaaggccu

SEQ ID NO: 3076684 - RNA, 19 nt, Human
augagccgcccaaggccuu

SEQ ID NO: 3076685 - RNA, 21 nt, Human
augagccgcccaaggccuucc

SEQ ID NO: 3076686 - RNA, 22 nt, Human
augagccgcccaaggccuuccc

SEQ ID NO: 3076687 - RNA, 22 nt, Human
augagcaucaggccaggcccuc

SEQ ID NO: 3076688 - RNA, 15 nt, Human
augagccgcccaagg

SEQ ID NO: 3076689 - RNA, 18 nt, Human
augagcaucaggccaggc

SEQ ID NO: 3076690 - RNA, 19 nt, Human
augagcaucaggccaggcc

SEQ ID NO: 3076691 - RNA, 20 nt, Human
augagcaucaggccaggccc

SEQ ID NO: 3076692 - RNA, 21 nt, Human
augagcaucaggccaggcccu

SEQ ID NO: 3076693 - RNA, 16 nt, Human
augagcaucaggccag

SEQ ID NO: 3076694 - RNA, 17 nt, Human
augagcaucaggccagg

SEQ ID NO: 3076695 - RNA, 15 nt, Human
augagcaucaggcca

SEQ ID NO: 3076696 - RNA, 13 nt, Human
uugugaaauuauu

SEQ ID NO: 3076697 - RNA, 21 nt, Human
uugucggccccaccagugccu

SEQ ID NO: 3076698 - RNA, 16 nt, Human
uuguccccgacccuug

SEQ ID NO: 3076699 - RNA, 18 nt, Human
uugucacacacuuuggcu

SEQ ID NO: 3076700 - RNA, 14 nt, Human
augauaacuggaaa

SEQ ID NO: 3076701 - RNA, 15 nt, Human
augauaaaacacaaa

SEQ ID NO: 3076702 - RNA, 18 nt, Human
augagccucagcauccug

SEQ ID NO: 3076703 - RNA, 17 nt, Human
augagccucagcauccu

SEQ ID NO: 3076704 - RNA, 22 nt, Human
augaggucagagccugcaguua

SEQ ID NO: 3076705 - RNA, 23 nt, Human
augaguccccuguuuguuucuga

SEQ ID NO: 3076706 - RNA, 14 nt, Human
ugaugggauuuggu

SEQ ID NO: 3076707 - RNA, 19 nt, Human
ugaugggaaagcauuguaa

SEQ ID NO: 3076708 - RNA, 14 nt, Human
ugauggggcccugc

SEQ ID NO: 3076709 - RNA, 15 nt, Human
ugauggggcccugcc

SEQ ID NO: 3076710 - RNA, 16 nt, Human
ugauggggcccugccu

SEQ ID NO: 3076711 - RNA, 19 nt, Human
ugauggggcccugccuccu

SEQ ID NO: 3076712 - RNA, 13 nt, Human
ugaugagaggaaa

SEQ ID NO: 3076713 - RNA, 14 nt, Human
ugaugagaggaaau

SEQ ID NO: 3076714 - RNA, 15 nt, Human
ugaugagaggaaauc

SEQ ID NO: 3076715 - RNA, 16 nt, Human
ugaugagaggaaauca

SEQ ID NO: 3076716 - RNA, 23 nt, Human
ugaugcuucuucagagacuccug

SEQ ID NO: 3076717 - RNA, 14 nt, Human
ugaugggaaagcau

SEQ ID NO: 3076718 - RNA, 16 nt, Human
ugauccuaguuccacc

SEQ ID NO: 3076719 - RNA, 15 nt, Human
ugauccucccaccuc

SEQ ID NO: 3076720 - RNA, 21 nt, Human
ugauccucccaccucagccuc

SEQ ID NO: 3076721 - RNA, 22 nt, Human
ugauccucccaccucagccucc

SEQ ID NO: 3076722 - RNA, 11 nt, Human
ugaugaagaag

SEQ ID NO: 3076723 - RNA, 12 nt, Human
ugaugaagaagu

SEQ ID NO: 3076724 - RNA, 15 nt, Human
agccacgguguucug

SEQ ID NO: 3076725 - RNA, 23 nt, Human
ugauuaaguaaugauaacuggaa

SEQ ID NO: 3076726 - RNA, 16 nt, Human
agccacugcaccgggc

SEQ ID NO: 3076727 - RNA, 19 nt, Human
ugauuaaccacuucagcug

SEQ ID NO: 3076728 - RNA, 18 nt, Human
ugauuaaguaaugauaac

SEQ ID NO: 3076729 - RNA, 20 nt, Human
ugauuaaauucuugcaaagu

SEQ ID NO: 3076730 - RNA, 19 nt, Human
ugauuaaauucuugcaaag

SEQ ID NO: 3076731 - RNA, 15 nt, Human
ugauggugcaaugac

SEQ ID NO: 3076732 - RNA, 13 nt, Human
ugauggugcaaug

SEQ ID NO: 3076733 - RNA, 10 nt, Human
agccagagga

SEQ ID NO: 3076734 - RNA, 11 nt, Human
agccagaggag

SEQ ID NO: 3076735 - RNA, 19 nt, Human
agccacugcaccgggccac

SEQ ID NO: 3076736 - RNA, 18 nt, Human
agccacugcaccgggcca

SEQ ID NO: 3076737 - RNA, 19 nt, Human
agccagacuggcacaguuu

SEQ ID NO: 3076738 - RNA, 16 nt, Human
agcccacuguacuugc

SEQ ID NO: 3076739 - RNA, 14 nt, Human
agcccacuguacuu

SEQ ID NO: 3076740 - RNA, 15 nt, Human
agcccacuucugcca

SEQ ID NO: 3076741 - RNA, 14 nt, Human
agcccacuucugcc

SEQ ID NO: 3076742 - RNA, 13 nt, Human
agcccacuucugc

SEQ ID NO: 3076743 - RNA, 13 nt, Human
agccaguaaaugg

SEQ ID NO: 3076744 - RNA, 21 nt, Human
agccaguaaaugggggugcau

SEQ ID NO: 3076745 - RNA, 14 nt, Human
agcccaggaaaggc

SEQ ID NO: 3076746 - RNA, 15 nt, Human
ugauucauaaugacu

SEQ ID NO: 3076747 - RNA, 16 nt, Human
ugauucauaaugacuu

SEQ ID NO: 3076748 - RNA, 21 nt, Human
ugauucauaaugacuuaagca

SEQ ID NO: 3076749 - RNA, 23 nt, Human
ugauucccaagcucugcuccucu

SEQ ID NO: 3076750 - RNA, 22 nt, Human
ugauucccaagcucugcuccuc

SEQ ID NO: 3076751 - RNA, 17 nt, Human
ugauuuggggauauuuu

SEQ ID NO: 3076752 - RNA, 22 nt, Human
ugauuuccguuaaaauaccagc

SEQ ID NO: 3076753 - RNA, 18 nt, Human
ugauuuccguuaaaauac

SEQ ID NO: 3076754 - RNA, 17 nt, Human
ugauuuagcaggaagcu

SEQ ID NO: 3076755 - RNA, 20 nt, Human
ugauuuagcaggaagcugug

SEQ ID NO: 3076756 - RNA, 18 nt, Human
ugcacacaccagagccca

SEQ ID NO: 3076757 - RNA, 17 nt, Human
ugcacacaccagagccc

SEQ ID NO: 3076758 - RNA, 21 nt, Human
ugcacacaccagagcccaccu

SEQ ID NO: 3076759 - RNA, 16 nt, Human
agcccugguggcagug

SEQ ID NO: 3076760 - RNA, 15 nt, Human
agcccugguggcagu

SEQ ID NO: 3076761 - RNA, 14 nt, Human
agcccugguggcag

SEQ ID NO: 3076762 - RNA, 22 nt, Human
agccccauucugccugcccagg

SEQ ID NO: 3076763 - RNA, 21 nt, Human
agccccauucugccugcccag

SEQ ID NO: 3076764 - RNA, 18 nt, Human
agccccaaaacucuccuc

SEQ ID NO: 3076765 - RNA, 20 nt, Human
agccccauucugccugccca

SEQ ID NO: 3076766 - RNA, 16 nt, Human
agccccaaaacucucc

SEQ ID NO: 3076767 - RNA, 17 nt, Human
agccccaaaacucuccu

SEQ ID NO: 3076768 - RNA, 21 nt, Human
agcccaggccuccuacagcuu

SEQ ID NO: 3076769 - RNA, 21 nt, Human
ugcaaaccaucauugaaaucu

SEQ ID NO: 3076770 - RNA, 20 nt, Human
ugcaaaccaucauugaaauc

SEQ ID NO: 3076771 - RNA, 19 nt, Human
agccucaaccuccugggcu

SEQ ID NO: 3076772 - RNA, 20 nt, Human
agccucaaccuccugggcua

SEQ ID NO: 3076773 - RNA, 17 nt, Human
agccucacaguccuuac

SEQ ID NO: 3076774 - RNA, 18 nt, Human
agccucacaguccuuacc

SEQ ID NO: 3076775 - RNA, 23 nt, Human
agccucugaaaaccaauguucuc

SEQ ID NO: 3076776 - RNA, 21 nt, Human
ugcagccucaaccuccugggc

SEQ ID NO: 3076777 - RNA, 20 nt, Human
ugcagccucaaccuccuggg

SEQ ID NO: 3076778 - RNA, 22 nt, Human
ugcagccucaaccuccugggcu

SEQ ID NO: 3076779 - RNA, 22 nt, Human
ugcagacaggcaagcaccuccu

SEQ ID NO: 3076780 - RNA, 15 nt, Human
ugcagaagacaguau

SEQ ID NO: 3076781 - RNA, 14 nt, Human
ugcagaagacagua

SEQ ID NO: 3076782 - RNA, 15 nt, Human
ugcacacauuuuuua

SEQ ID NO: 3076783 - RNA, 13 nt, Human
ugcacacauuuuu

SEQ ID NO: 3076784 - RNA, 12 nt, Human
ugcacacauuuu

SEQ ID NO: 3076785 - RNA, 11 nt, Human
ugcacacauuu

SEQ ID NO: 3076786 - RNA, 16 nt, Human
ugcacuccccugcugg

SEQ ID NO: 3076787 - RNA, 17 nt, Human
ugcacuccccugcuggg

SEQ ID NO: 3076788 - RNA, 19 nt, Human
ugcacuccccugcugggug

SEQ ID NO: 3076789 - RNA, 20 nt, Human
agccgagauagccaaggcca

SEQ ID NO: 3076790 - RNA, 21 nt, Human
agccgagauagccaaggccaa

SEQ ID NO: 3076791 - RNA, 17 nt, Human
agccgagaucacgccac

SEQ ID NO: 3076792 - RNA, 21 nt, Human
agcccuuagcagggaaacagc

SEQ ID NO: 3076793 - RNA, 17 nt, Human
ugcagacucuacagagg

SEQ ID NO: 3076794 - RNA, 16 nt, Human
ugcagacucuacagag

SEQ ID NO: 3076795 - RNA, 16 nt, Human
agcccuuagcagggaa

SEQ ID NO: 3076796 - RNA, 18 nt, Human
agcccugucuccucucuc

SEQ ID NO: 3076797 - RNA, 11 nt, Human
agcccugucuc

SEQ ID NO: 3076798 - RNA, 16 nt, Human
ugccagugccugggug

SEQ ID NO: 3076799 - RNA, 12 nt, Human
ugccagugccug

SEQ ID NO: 3076800 - RNA, 15 nt, Human
ugccagugccugggu

SEQ ID NO: 3076801 - RNA, 13 nt, Human
agcggcuggcagc

SEQ ID NO: 3076802 - RNA, 18 nt, Human
ugccagcuuaucucaggg

SEQ ID NO: 3076803 - RNA, 23 nt, Human
agcggcuggcagcccaccccuca

SEQ ID NO: 3076804 - RNA, 20 nt, Human
agcggggacagcuccuucug

SEQ ID NO: 3076805 - RNA, 19 nt, Human
agcggggacagcuccuucu

SEQ ID NO: 3076806 - RNA, 22 nt, Human
agcggggacagcuccuucuguc

SEQ ID NO: 3076807 - RNA, 21 nt, Human
ugcauuugaggucuguucuuu

SEQ ID NO: 3076808 - RNA, 20 nt, Human
ugcauuugaggucuguucuu

SEQ ID NO: 3076809 - RNA, 20 nt, Human
ugcauuuaaaagauacaguu

SEQ ID NO: 3076810 - RNA, 18 nt, Human
ugcauuugaggucuguuc

SEQ ID NO: 3076811 - RNA, 19 nt, Human
ugcauuugaggucuguucu

SEQ ID NO: 3076812 - RNA, 16 nt, Human
agcgcuggccgggacc

SEQ ID NO: 3076813 - RNA, 22 nt, Human
agcgcuggccgggaccccgagc

SEQ ID NO: 3076814 - RNA, 22 nt, Human
agccuugaacuuugaccucugc

SEQ ID NO: 3076815 - RNA, 16 nt, Human
agccuugaacuuugac

SEQ ID NO: 3076816 - RNA, 13 nt, Human
agccuugaacuuu

SEQ ID NO: 3076817 - RNA, 22 nt, Human
agccuugaccauucuccaccug

SEQ ID NO: 3076818 - RNA, 23 nt, Human
agccuugaccauucuccaccugc

SEQ ID NO: 3076819 - RNA, 22 nt, Human
agcgauucuucugcuucagccu

SEQ ID NO: 3076820 - RNA, 15 nt, Human
agccuugaacuuuga

SEQ ID NO: 3076821 - RNA, 18 nt, Human
agccuuccagggguggga

SEQ ID NO: 3076822 - RNA, 20 nt, Human
ugcagcucuccccuucucug

SEQ ID NO: 3076823 - RNA, 22 nt, Human
ugcagcucuccccuucucugua

SEQ ID NO: 3076824 - RNA, 17 nt, Human
agcuaucguaaaauuaa

SEQ ID NO: 3076825 - RNA, 19 nt, Human
agcuauggugucauaggcu

SEQ ID NO: 3076826 - RNA, 16 nt, Human
agcuaggccuggccag

SEQ ID NO: 3076827 - RNA, 21 nt, Human
agcuaggccuggccagaugca

SEQ ID NO: 3076828 - RNA, 15 nt, Human
agcuccaagcuccca

SEQ ID NO: 3076829 - RNA, 18 nt, Human
agcuccaagaauuucuag

SEQ ID NO: 3076830 - RNA, 15 nt, Human
agcuccaagaauuuc

SEQ ID NO: 3076831 - RNA, 22 nt, Human
ugccauuuaaagcuuauuaaaa

SEQ ID NO: 3076832 - RNA, 20 nt, Human
agcucagggccuggcucagg

SEQ ID NO: 3076833 - RNA, 18 nt, Human
agcucagggccuggcuca

SEQ ID NO: 3076834 - RNA, 19 nt, Human
agcucagggccuggcucag

SEQ ID NO: 3076835 - RNA, 12 nt, Human
agcucagggccu

SEQ ID NO: 3076836 - RNA, 13 nt, Human
agcucagggccug

SEQ ID NO: 3076837 - RNA, 19 nt, Human
agcuauucaguaauaacuc

SEQ ID NO: 3076838 - RNA, 20 nt, Human
ugcccuaaaguguauuuuuu

SEQ ID NO: 3076839 - RNA, 23 nt, Human
ugccccgaacauguuuuucuucu

SEQ ID NO: 3076840 - RNA, 16 nt, Human
ugccccauucaacauc

SEQ ID NO: 3076841 - RNA, 18 nt, Human
ugcccaggccccugccac

SEQ ID NO: 3076842 - RNA, 17 nt, Human
ugcccaggccccugcca

SEQ ID NO: 3076843 - RNA, 15 nt, Human
ugcccaggccccugc

SEQ ID NO: 3076844 - RNA, 14 nt, Human
ugcccaggccccug

SEQ ID NO: 3076845 - RNA, 13 nt, Human
ugcccagccccuu

SEQ ID NO: 3076846 - RNA, 12 nt, Human
ugcccagccccu

SEQ ID NO: 3076847 - RNA, 16 nt, Human
ugcccagccccuucug

SEQ ID NO: 3076848 - RNA, 17 nt, Human
ugcccagccccuucuga

SEQ ID NO: 3076849 - RNA, 17 nt, Human
ugcccaaagaugcagcc

SEQ ID NO: 3076850 - RNA, 20 nt, Human
ugcccaaagaugcagccggu

SEQ ID NO: 3076851 - RNA, 12 nt, Human
ugccucucugca

SEQ ID NO: 3076852 - RNA, 11 nt, Human
ugccucucugc

SEQ ID NO: 3076853 - RNA, 17 nt, Human
ugccucucucaggccaa

SEQ ID NO: 3076854 - RNA, 16 nt, Human
ugccucucucaggcca

SEQ ID NO: 3076855 - RNA, 22 nt, Human
ugccucccaucacccgcuaaga

SEQ ID NO: 3076856 - RNA, 18 nt, Human
ugccucagaaaacaagga

SEQ ID NO: 3076857 - RNA, 14 nt, Human
ugccgcagcccugc

SEQ ID NO: 3076858 - RNA, 20 nt, Human
ugccgcagcccugcagaggg

SEQ ID NO: 3076859 - RNA, 19 nt, Human
ugcccuuaccugccaggaa

SEQ ID NO: 3076860 - RNA, 15 nt, Human
ugccucaccccuugc

SEQ ID NO: 3076861 - RNA, 23 nt, Human
ugcccugugaguacuacaguccu

SEQ ID NO: 3076862 - RNA, 16 nt, Human
agcucuucuccaggcu

SEQ ID NO: 3076863 - RNA, 15 nt, Human
agcucuucuccaggc

SEQ ID NO: 3076864 - RNA, 15 nt, Human
ugcccugugggcccc

SEQ ID NO: 3076865 - RNA, 18 nt, Human
ugcccugugggcccccaa

SEQ ID NO: 3076866 - RNA, 22 nt, Human
ugcccuuaccugccaggaagcc

SEQ ID NO: 3076867 - RNA, 24 nt, Human
agcugcuuuugucuaugggacuca

SEQ ID NO: 3076868 - RNA, 23 nt, Human
agcugcuuuugucuaugggacuc

SEQ ID NO: 3076869 - RNA, 15 nt, Human
agcugggacuacagg

SEQ ID NO: 3076870 - RNA, 10 nt, Human
agcugccugu

SEQ ID NO: 3076871 - RNA, 22 nt, Human
agcugcuuuugucuaugggacu

SEQ ID NO: 3076872 - RNA, 13 nt, Human
agcugccuguuca

SEQ ID NO: 3076873 - RNA, 23 nt, Human
ugccucucugcaggucccuaaua

SEQ ID NO: 3076874 - RNA, 15 nt, Human
ugccucucugcaggu

SEQ ID NO: 3076875 - RNA, 16 nt, Human
ugccucugacacacag

SEQ ID NO: 3076876 - RNA, 14 nt, Human
ugccucugacacac

SEQ ID NO: 3076877 - RNA, 21 nt, Human
ugccucucugcaggucccuaa

SEQ ID NO: 3076878 - RNA, 11 nt, Human
ugccucugccu

SEQ ID NO: 3076879 - RNA, 19 nt, Human
ugccugcccaggccccugc

SEQ ID NO: 3076880 - RNA, 18 nt, Human
ugccugcccaggccccug

SEQ ID NO: 3076881 - RNA, 17 nt, Human
ugccugcccaggccccu

SEQ ID NO: 3076882 - RNA, 23 nt, Human
agcucuguccugggagugagcug

SEQ ID NO: 3076883 - RNA, 23 nt, Human
agcucugcccauccugccccuga

SEQ ID NO: 3076884 - RNA, 19 nt, Human
agcuccagcucaccagccc

SEQ ID NO: 3076885 - RNA, 18 nt, Human
agcuccagcucaccagcc

SEQ ID NO: 3076886 - RNA, 21 nt, Human
agcuccagcucaccagcccca

SEQ ID NO: 3076887 - RNA, 23 nt, Human
agcuccuucuguccuacucugug

SEQ ID NO: 3076888 - RNA, 22 nt, Human
agcuccuucuguccuacucugu

SEQ ID NO: 3076889 - RNA, 17 nt, Human
agcuccaagcucccagg

SEQ ID NO: 3076890 - RNA, 16 nt, Human
agcuccaagcucccag

SEQ ID NO: 3076891 - RNA, 18 nt, Human
agcuccaagcucccaggc

SEQ ID NO: 3076892 - RNA, 19 nt, Human
agcuccaagcucccaggca

SEQ ID NO: 3076893 - RNA, 17 nt, Human
agcuccagcucaccagc

SEQ ID NO: 3076894 - RNA, 13 nt, Human
agcuccagcucac

SEQ ID NO: 3076895 - RNA, 19 nt, Human
aggcucuggagcccacugu

SEQ ID NO: 3076896 - RNA, 18 nt, Human
aggcucuggagcccacug

SEQ ID NO: 3076897 - RNA, 15 nt, Human
aggcucuggagccca

SEQ ID NO: 3076898 - RNA, 14 nt, Human
aggcucuggagccc

SEQ ID NO: 3076899 - RNA, 13 nt, Human
aggcucuggagcc

SEQ ID NO: 3076900 - RNA, 16 nt, Human
aggcucugcccuuggu

SEQ ID NO: 3076901 - RNA, 17 nt, Human
aggcuggcgugcagugg

SEQ ID NO: 3076902 - RNA, 13 nt, Human
aggcuggcgugca

SEQ ID NO: 3076903 - RNA, 12 nt, Human
aggcucgagcau

SEQ ID NO: 3076904 - RNA, 19 nt, Human
aggcuccuuuagcgcccag

SEQ ID NO: 3076905 - RNA, 15 nt, Human
aggcucgagcaugcc

SEQ ID NO: 3076906 - RNA, 17 nt, Human
aggcucgagcaugccug

SEQ ID NO: 3076907 - RNA, 18 nt, Human
aggcucgagcaugccugg

SEQ ID NO: 3076908 - RNA, 19 nt, Human
aggcucgagcaugccugga

SEQ ID NO: 3076909 - RNA, 21 nt, Human
aggcucgagcaugccuggaug

SEQ ID NO: 3076910 - RNA, 11 nt, Human
aggcucucagg

SEQ ID NO: 3076911 - RNA, 12 nt, Human
aggcucucaggc

SEQ ID NO: 3076912 - RNA, 14 nt, Human
aggcucucaggcca

SEQ ID NO: 3076913 - RNA, 15 nt, Human
aggcucucaggccag

SEQ ID NO: 3076914 - RNA, 16 nt, Human
aggcucucaggccagc

SEQ ID NO: 3076915 - RNA, 18 nt, Human
aggcucucaggccagcug

SEQ ID NO: 3076916 - RNA, 19 nt, Human
aggcucucaggccagcugc

SEQ ID NO: 3076917 - RNA, 20 nt, Human
aggcucucaggccagcugcu

SEQ ID NO: 3076918 - RNA, 14 nt, Human
aggcucugcccuug

SEQ ID NO: 3076919 - RNA, 15 nt, Human
aggcucugcccuugg

SEQ ID NO: 3076920 - RNA, 13 nt, Human
aggcucugcccuu

SEQ ID NO: 3076921 - RNA, 12 nt, Human
aggcucugcccu

SEQ ID NO: 3076922 - RNA, 11 nt, Human
aggcucugccc

SEQ ID NO: 3076923 - RNA, 21 nt, Human
aggcucucaggccagcugcuu

SEQ ID NO: 3076924 - RNA, 19 nt, Human
uggcuaugcauuugaaaau

SEQ ID NO: 3076925 - RNA, 22 nt, Human
uggcuauuagagaucaaccccu

SEQ ID NO: 3076926 - RNA, 14 nt, Human
uggcuaugcauuug

SEQ ID NO: 3076927 - RNA, 17 nt, Human
uggcuaugcauuugaaa

SEQ ID NO: 3076928 - RNA, 15 nt, Human
uggcuaugcauuuga

SEQ ID NO: 3076929 - RNA, 20 nt, Human
aggcuggcgugcaguggugc

SEQ ID NO: 3076930 - RNA, 18 nt, Human
aggcuggcgugcaguggu

SEQ ID NO: 3076931 - RNA, 22 nt, Human
uggcuagagguucaaagauauu

SEQ ID NO: 3076932 - RNA, 14 nt, Human
aggcugggagagcc

SEQ ID NO: 3076933 - RNA, 12 nt, Human
uggcugcaaagg

SEQ ID NO: 3076934 - RNA, 20 nt, Human
uggcucuuccaggcugggag

SEQ ID NO: 3076935 - RNA, 21 nt, Human
uggcucuuccaggcugggaga

SEQ ID NO: 3076936 - RNA, 19 nt, Human
uggcucuuccaggcuggga

SEQ ID NO: 3076937 - RNA, 18 nt, Human
uggcucaaguccucuuuu

SEQ ID NO: 3076938 - RNA, 18 nt, Human
uggcugccaaugggagcu

SEQ ID NO: 3076939 - RNA, 20 nt, Human
uggcugccaaugggagcuca

SEQ ID NO: 3076940 - RNA, 14 nt, Human
uggcugcagggagu

SEQ ID NO: 3076941 - RNA, 13 nt, Human
uggcugcagggag

SEQ ID NO: 3076942 - RNA, 15 nt, Human
uggcugcagggaguc

SEQ ID NO: 3076943 - RNA, 17 nt, Human
uggcuuaaaacaacacu

SEQ ID NO: 3076944 - RNA, 15 nt, Human
uggcuguuggcuggg

SEQ ID NO: 3076945 - RNA, 14 nt, Human
uggcugugucuccc

SEQ ID NO: 3076946 - RNA, 13 nt, Human
uggcuguuggcug

SEQ ID NO: 3076947 - RNA, 22 nt, Human
uggcuucacggaagagccuugc

SEQ ID NO: 3076948 - RNA, 23 nt, Human
uggcuucacggaagagccuugcg

SEQ ID NO: 3076949 - RNA, 16 nt, Human
ugggaaaggggaaguu

SEQ ID NO: 3076950 - RNA, 20 nt, Human
ugggaaagggauuuucagcc

SEQ ID NO: 3076951 - RNA, 21 nt, Human
ugggaaagcauuguaaaugug

SEQ ID NO: 3076952 - RNA, 18 nt, Human
uggacgagaaaacaauaa

SEQ ID NO: 3076953 - RNA, 16 nt, Human
aggccaaacucaccug

SEQ ID NO: 3076954 - RNA, 18 nt, Human
aggcauuuguuugaacug

SEQ ID NO: 3076955 - RNA, 14 nt, Human
aggccaaaggaagc

SEQ ID NO: 3076956 - RNA, 20 nt, Human
aggccaaacucaccugcccc

SEQ ID NO: 3076957 - RNA, 23 nt, Human
aggccaaaggaagcacaugccuc

SEQ ID NO: 3076958 - RNA, 20 nt, Human
aggccaaaggaagcacaugc

SEQ ID NO: 3076959 - RNA, 18 nt, Human
aggccaaggugggaggau

SEQ ID NO: 3076960 - RNA, 19 nt, Human
uggaugccugguggcagcu

SEQ ID NO: 3076961 - RNA, 18 nt, Human
uggaugccugguggcagc

SEQ ID NO: 3076962 - RNA, 16 nt, Human
uggaguucaucuugaa

SEQ ID NO: 3076963 - RNA, 17 nt, Human
uggaguucaucuugaau

SEQ ID NO: 3076964 - RNA, 20 nt, Human
uggaguucaucuugaauugu

SEQ ID NO: 3076965 - RNA, 15 nt, Human
uggaugccugguggc

SEQ ID NO: 3076966 - RNA, 15 nt, Human
aggccacaagacccu

SEQ ID NO: 3076967 - RNA, 20 nt, Human
aggccacaagacccuugugg

SEQ ID NO: 3076968 - RNA, 12 nt, Human
uggcagccccug

SEQ ID NO: 3076969 - RNA, 18 nt, Human
uggcaccagcagccugga

SEQ ID NO: 3076970 - RNA, 20 nt, Human
uggcacaucagcacgauuuc

SEQ ID NO: 3076971 - RNA, 22 nt, Human
uggcacaguuuucugagaaaga

SEQ ID NO: 3076972 - RNA, 22 nt, Human
uggauuaaacuuaaucuaaaug

SEQ ID NO: 3076973 - RNA, 20 nt, Human
uggcacaguuuucugagaaa

SEQ ID NO: 3076974 - RNA, 12 nt, Human
uggauguucuga

SEQ ID NO: 3076975 - RNA, 21 nt, Human
uggcagaguugaagacagagc

SEQ ID NO: 3076976 - RNA, 15 nt, Human
uggcacccggccccu

SEQ ID NO: 3076977 - RNA, 22 nt, Human
uggcagaguugaagacagagcu

SEQ ID NO: 3076978 - RNA, 20 nt, Human
uggccccugcccggcugcgg

SEQ ID NO: 3076979 - RNA, 21 nt, Human
uggccccugcccggcugcgga

SEQ ID NO: 3076980 - RNA, 23 nt, Human
uggccgggaccccgagccuggcu

SEQ ID NO: 3076981 - RNA, 17 nt, Human
uggccgggaccccgagc

SEQ ID NO: 3076982 - RNA, 15 nt, Human
uggccgggaccccga

SEQ ID NO: 3076983 - RNA, 14 nt, Human
uggccucugcacuc

SEQ ID NO: 3076984 - RNA, 15 nt, Human
uggccucugcacucc

SEQ ID NO: 3076985 - RNA, 17 nt, Human
uggccucugcacucccc

SEQ ID NO: 3076986 - RNA, 13 nt, Human
uggccucugcacu

SEQ ID NO: 3076987 - RNA, 21 nt, Human
aggccuggccagaugcaccag

SEQ ID NO: 3076988 - RNA, 17 nt, Human
aggccuggccagaugca

SEQ ID NO: 3076989 - RNA, 16 nt, Human
aggccuggccagaugc

SEQ ID NO: 3076990 - RNA, 15 nt, Human
aggccuggccagaug

SEQ ID NO: 3076991 - RNA, 23 nt, Human
aggccugggggcugggcagagga

SEQ ID NO: 3076992 - RNA, 23 nt, Human
aggccuggccagaugcaccagcc

SEQ ID NO: 3076993 - RNA, 22 nt, Human
aggccuggccagaugcaccagc

SEQ ID NO: 3076994 - RNA, 13 nt, Human
aggcccucugccc

SEQ ID NO: 3076995 - RNA, 14 nt, Human
aggcccucugccca

SEQ ID NO: 3076996 - RNA, 12 nt, Human
uggcaugggaau

SEQ ID NO: 3076997 - RNA, 15 nt, Human
uggcaugggaaugaa

SEQ ID NO: 3076998 - RNA, 17 nt, Human
uggccaggcuggucuca

SEQ ID NO: 3076999 - RNA, 15 nt, Human
uggccaggcuggucu

SEQ ID NO: 3077000 - RNA, 19 nt, Human
aggagcccugggaggcucu

SEQ ID NO: 3077001 - RNA, 17 nt, Human
aggagccuccugcccuu

SEQ ID NO: 3077002 - RNA, 21 nt, Human
ugcuuggaggaaggaaaccca

SEQ ID NO: 3077003 - RNA, 12 nt, Human
ugcuugggcuuc

SEQ ID NO: 3077004 - RNA, 16 nt, Human
ugcuugggcuucaucc

SEQ ID NO: 3077005 - RNA, 19 nt, Human
ugcuugggcuucauccucc

SEQ ID NO: 3077006 - RNA, 17 nt, Human
ugcuuuuaaaaaaaaau

SEQ ID NO: 3077007 - RNA, 15 nt, Human
uggaaauauuaagaa

SEQ ID NO: 3077008 - RNA, 18 nt, Human
aggagcccugggaggcuc

SEQ ID NO: 3077009 - RNA, 22 nt, Human
aggagccccgaggccuucucug

SEQ ID NO: 3077010 - RNA, 14 nt, Human
aggagcagccacau

SEQ ID NO: 3077011 - RNA, 23 nt, Human
aggacuuuucuuuguggcuuccu

SEQ ID NO: 3077012 - RNA, 11 nt, Human
aggagaaacug

SEQ ID NO: 3077013 - RNA, 17 nt, Human
aggagauuggaaggaac

SEQ ID NO: 3077014 - RNA, 18 nt, Human
aggacauugcggacagcc

SEQ ID NO: 3077015 - RNA, 17 nt, Human
aggacauugcggacagc

SEQ ID NO: 3077016 - RNA, 15 nt, Human
aggacauugcggaca

SEQ ID NO: 3077017 - RNA, 23 nt, Human
aggacauugcggacagccacggc

SEQ ID NO: 3077018 - RNA, 19 nt, Human
aggacauugcggacagcca

SEQ ID NO: 3077019 - RNA, 19 nt, Human
aggacugaauuaugaaacu

SEQ ID NO: 3077020 - RNA, 20 nt, Human
aggacugaauuaugaaacuu

SEQ ID NO: 3077021 - RNA, 18 nt, Human
uggaauuggagcucgugg

SEQ ID NO: 3077022 - RNA, 17 nt, Human
aggcaacucaucuuagg

SEQ ID NO: 3077023 - RNA, 20 nt, Human
aggaugaucuaggaagacuu

SEQ ID NO: 3077024 - RNA, 14 nt, Human
aggaugcccaaaga

SEQ ID NO: 3077025 - RNA, 19 nt, Human
aggaugcccaaagaugcag

SEQ ID NO: 3077026 - RNA, 19 nt, Human
aggauuuugauccaagcug

SEQ ID NO: 3077027 - RNA, 16 nt, Human
uggacacagcucuucu

SEQ ID NO: 3077028 - RNA, 15 nt, Human
uggacacagcucuuc

SEQ ID NO: 3077029 - RNA, 18 nt, Human
uggacacagcucuucucc

SEQ ID NO: 3077030 - RNA, 14 nt, Human
uggacccugaggcc

SEQ ID NO: 3077031 - RNA, 12 nt, Human
uggacccugagg

SEQ ID NO: 3077032 - RNA, 13 nt, Human
uggacccugaggc

SEQ ID NO: 3077033 - RNA, 23 nt, Human
uggaaaugggcagagcagagacc

SEQ ID NO: 3077034 - RNA, 18 nt, Human
uggaaaugggcagagcag

SEQ ID NO: 3077035 - RNA, 20 nt, Human
uggaaauauuaagaaagacu

SEQ ID NO: 3077036 - RNA, 21 nt, Human
aggaucucuugagccugggag

SEQ ID NO: 3077037 - RNA, 22 nt, Human
aggaucucuugagccugggagg

SEQ ID NO: 3077038 - RNA, 17 nt, Human
aggauccugagccagau

SEQ ID NO: 3077039 - RNA, 18 nt, Human
aggauccugagccagauu

SEQ ID NO: 3077040 - RNA, 16 nt, Human
aggaugaucuaggaag

SEQ ID NO: 3077041 - RNA, 17 nt, Human
aggaugaucuaggaaga

SEQ ID NO: 3077042 - RNA, 15 nt, Human
aggauccugagccag

SEQ ID NO: 3077043 - RNA, 16 nt, Human
aggauccugagccaga

SEQ ID NO: 3077044 - RNA, 21 nt, Human
aggauacaaaagcaugugaga

SEQ ID NO: 3077045 - RNA, 19 nt, Human
aggacacuaaccacgcugg

SEQ ID NO: 3077046 - RNA, 23 nt, Human
aggacacuaaccacgcuggaccu

SEQ ID NO: 3077047 - RNA, 14 nt, Human
aggacacugauaug

SEQ ID NO: 3077048 - RNA, 22 nt, Human
aggacagggaggugaccccagg

SEQ ID NO: 3077049 - RNA, 23 nt, Human
aggacagcccuucuuuccacaga

SEQ ID NO: 3077050 - RNA, 16 nt, Human
ugcuucaaggauccug

SEQ ID NO: 3077051 - RNA, 18 nt, Human
ugcuucaaggauccugag

SEQ ID NO: 3077052 - RNA, 19 nt, Human
ugcuucaaggauccugagc

SEQ ID NO: 3077053 - RNA, 14 nt, Human
ugcuucagccuccc

SEQ ID NO: 3077054 - RNA, 13 nt, Human
ugcuucagccucc

SEQ ID NO: 3077055 - RNA, 12 nt, Human
ugcuucaaggau

SEQ ID NO: 3077056 - RNA, 13 nt, Human
ugcuuauacacuu

SEQ ID NO: 3077057 - RNA, 15 nt, Human
ugcugcccugugagu

SEQ ID NO: 3077058 - RNA, 13 nt, Human
ugcuggagcucug

SEQ ID NO: 3077059 - RNA, 14 nt, Human
ugcuggagcucugc

SEQ ID NO: 3077060 - RNA, 13 nt, Human
ugcugcccuguga

SEQ ID NO: 3077061 - RNA, 14 nt, Human
ugcugcccugugag

SEQ ID NO: 3077062 - RNA, 12 nt, Human
ugcugcccugug

SEQ ID NO: 3077063 - RNA, 16 nt, Human
ugcuggcugguuagag

SEQ ID NO: 3077064 - RNA, 18 nt, Human
ugcuguaacuuucugaaa

SEQ ID NO: 3077065 - RNA, 23 nt, Human
ugcuguauuuuaaaagaaugauu

SEQ ID NO: 3077066 - RNA, 23 nt, Human
aggaauuguguuuauaauuuuaa

SEQ ID NO: 3077067 - RNA, 11 nt, Human
aggaauuuaaa

SEQ ID NO: 3077068 - RNA, 23 nt, Human
aggaauugacccacaagaaauga

SEQ ID NO: 3077069 - RNA, 19 nt, Human
aggaaggaaacccagcucu

SEQ ID NO: 3077070 - RNA, 15 nt, Human
aggaaggagaggaga

SEQ ID NO: 3077071 - RNA, 17 nt, Human
aggaagccagcaggcuc

SEQ ID NO: 3077072 - RNA, 13 nt, Human
aggaagccagcag

SEQ ID NO: 3077073 - RNA, 18 nt, Human
aggaaggaaacccagcuc

SEQ ID NO: 3077074 - RNA, 18 nt, Human
aggaagcugugagagcag

SEQ ID NO: 3077075 - RNA, 16 nt, Human
ugcugagucugaaggc

SEQ ID NO: 3077076 - RNA, 17 nt, Human
ugcugagucugaaggcu

SEQ ID NO: 3077077 - RNA, 18 nt, Human
ugcugagucugaaggcug

SEQ ID NO: 3077078 - RNA, 21 nt, Human
ugcugagucugaaggcugggu

SEQ ID NO: 3077079 - RNA, 22 nt, Human
ugcugagucugaaggcuggguu

SEQ ID NO: 3077080 - RNA, 13 nt, Human
aggaagacuucau

SEQ ID NO: 3077081 - RNA, 19 nt, Human
aggaagacuucaucccucu

SEQ ID NO: 3077082 - RNA, 13 nt, Human
aggaagacuuugg

SEQ ID NO: 3077083 - RNA, 14 nt, Human
aggaagacuuugga

SEQ ID NO: 3077084 - RNA, 23 nt, Human
aggaagcacaugccucucucagg

SEQ ID NO: 3077085 - RNA, 24 nt, Human
aggaagcacaugccucucucaggc

SEQ ID NO: 3077086 - RNA, 14 nt, Human
aggaagccagcagg

SEQ ID NO: 3077087 - RNA, 15 nt, Human
aggaagccagcaggc

SEQ ID NO: 3077088 - RNA, 22 nt, Human
aggaagcacaugccucucucag

SEQ ID NO: 3077089 - RNA, 19 nt, Human
agcugggacuacaggcacc

SEQ ID NO: 3077090 - RNA, 18 nt, Human
agcugggacuacaggcac

SEQ ID NO: 3077091 - RNA, 16 nt, Human
agcugggacuacaggc

SEQ ID NO: 3077092 - RNA, 16 nt, Human
ugcuccagcuguucag

SEQ ID NO: 3077093 - RNA, 19 nt, Human
ugcuccagcuguucagcug

SEQ ID NO: 3077094 - RNA, 16 nt, Human
ugcucccaccuggcuc

SEQ ID NO: 3077095 - RNA, 18 nt, Human
ugcucccaccuggcucug

SEQ ID NO: 3077096 - RNA, 17 nt, Human
ugcucccaccuggcucu

SEQ ID NO: 3077097 - RNA, 22 nt, Human
ugcucugcugacagacacaggc

SEQ ID NO: 3077098 - RNA, 21 nt, Human
ugcucugcugacagacacagg

SEQ ID NO: 3077099 - RNA, 15 nt, Human
ugcugagucugaagg

SEQ ID NO: 3077100 - RNA, 14 nt, Human
ugcugagucugaag

SEQ ID NO: 3077101 - RNA, 16 nt, Human
ugcucugcugacagac

SEQ ID NO: 3077102 - RNA, 15 nt, Human
aguuucguuuucaaa

SEQ ID NO: 3077103 - RNA, 16 nt, Human
aguuucguuuucaaaa

SEQ ID NO: 3077104 - RNA, 13 nt, Human
aguuucuccaagc

SEQ ID NO: 3077105 - RNA, 15 nt, Human
aguuucuccaagcag

SEQ ID NO: 3077106 - RNA, 21 nt, Human
aguuucuccaagcaggacaug

SEQ ID NO: 3077107 - RNA, 13 nt, Human
uuaaauucuugca

SEQ ID NO: 3077108 - RNA, 16 nt, Human
uuaaauucuugcaaag

SEQ ID NO: 3077109 - RNA, 22 nt, Human
aguuuucacucuuauugcccac

SEQ ID NO: 3077110 - RNA, 16 nt, Human
aguuugguuucuagca

SEQ ID NO: 3077111 - RNA, 22 nt, Human
aguugcauagguuuaauaauuu

SEQ ID NO: 3077112 - RNA, 20 nt, Human
aguugccagucaccccggcc

SEQ ID NO: 3077113 - RNA, 15 nt, Human
uuaaaaaagaaacau

SEQ ID NO: 3077114 - RNA, 18 nt, Human
uuaaaaaagaaacauuug

SEQ ID NO: 3077115 - RNA, 17 nt, Human
uuaaaacaacacucaca

SEQ ID NO: 3077116 - RNA, 20 nt, Human
uuaaaaaugguuuaaauggu

SEQ ID NO: 3077117 - RNA, 18 nt, Human
uuaaaaaguggaaaaaua

SEQ ID NO: 3077118 - RNA, 17 nt, Human
uuaaaccgccaaggcug

SEQ ID NO: 3077119 - RNA, 21 nt, Human
uuaaauaaugugaaacuggau

SEQ ID NO: 3077120 - RNA, 20 nt, Human
uuaaauaaugugaaacugga

SEQ ID NO: 3077121 - RNA, 22 nt, Human
uuaaauaaugugaaacuggauu

SEQ ID NO: 3077122 - RNA, 19 nt, Human
uuaaauaaugugaaacugg

SEQ ID NO: 3077123 - RNA, 15 nt, Human
uuaaauaaaucauaa

SEQ ID NO: 3077124 - RNA, 13 nt, Human
uuaaauaaaucau

SEQ ID NO: 3077125 - RNA, 16 nt, Human
aguucucuccuucuuc

SEQ ID NO: 3077126 - RNA, 13 nt, Human
aguucucuccuuc

SEQ ID NO: 3077127 - RNA, 12 nt, Human
aguucucuccuu

SEQ ID NO: 3077128 - RNA, 15 nt, Human
uguuuucucuugaga

SEQ ID NO: 3077129 - RNA, 14 nt, Human
uguuuuaggagcau

SEQ ID NO: 3077130 - RNA, 13 nt, Human
uguuuuauaauuu

SEQ ID NO: 3077131 - RNA, 20 nt, Human
uguuuuauaauuuugugaag

SEQ ID NO: 3077132 - RNA, 15 nt, Human
uguuuucaguguaca

SEQ ID NO: 3077133 - RNA, 15 nt, Human
uguuugcaucugaaa

SEQ ID NO: 3077134 - RNA, 14 nt, Human
uguuugccucugcc

SEQ ID NO: 3077135 - RNA, 16 nt, Human
uguuugccucugccuc

SEQ ID NO: 3077136 - RNA, 15 nt, Human
uguuugcuaagcauu

SEQ ID NO: 3077137 - RNA, 14 nt, Human
uguugucagcugaa

SEQ ID NO: 3077138 - RNA, 15 nt, Human
uguuuggggaugaga

SEQ ID NO: 3077139 - RNA, 19 nt, Human
uguuugcuaagcauuccaa

SEQ ID NO: 3077140 - RNA, 19 nt, Human
aguugcaacuuuguauaaa

SEQ ID NO: 3077141 - RNA, 23 nt, Human
aguugauucagcucugcaagaau

SEQ ID NO: 3077142 - RNA, 14 nt, Human
aguugauucagcuc

SEQ ID NO: 3077143 - RNA, 15 nt, Human
aguugauucagcucu

SEQ ID NO: 3077144 - RNA, 17 nt, Human
aguugauucagcucugc

SEQ ID NO: 3077145 - RNA, 18 nt, Human
aguugauucagcucugca

SEQ ID NO: 3077146 - RNA, 22 nt, Human
aguugauagcacagacccugcc

SEQ ID NO: 3077147 - RNA, 23 nt, Human
aguugauagcacagacccugccc

SEQ ID NO: 3077148 - RNA, 21 nt, Human
aguugauaugccuuuucccaa

SEQ ID NO: 3077149 - RNA, 13 nt, Human
aguugauucagcu

SEQ ID NO: 3077150 - RNA, 15 nt, Human
aguugauagcacaga

SEQ ID NO: 3077151 - RNA, 19 nt, Human
aguugauagcacagacccu

SEQ ID NO: 3077152 - RNA, 20 nt, Human
aguugauagcacagacccug

SEQ ID NO: 3077153 - RNA, 21 nt, Human
aguugauagcacagacccugc

SEQ ID NO: 3077154 - RNA, 14 nt, Human
aguugauagcacag

SEQ ID NO: 3077155 - RNA, 15 nt, Human
aguucugaagaagau

SEQ ID NO: 3077156 - RNA, 13 nt, Human
aguucugaagaag

SEQ ID NO: 3077157 - RNA, 14 nt, Human
aguucugaagaaga

SEQ ID NO: 3077158 - RNA, 20 nt, Human
aguuauuauauuuacaaaug

SEQ ID NO: 3077159 - RNA, 19 nt, Human
aguuauggcuauaggugcu

SEQ ID NO: 3077160 - RNA, 17 nt, Human
aguuauugauaaguuca

SEQ ID NO: 3077161 - RNA, 19 nt, Human
aguuauugauaaguucaua

SEQ ID NO: 3077162 - RNA, 21 nt, Human
aguuauugauaaguucauaca

SEQ ID NO: 3077163 - RNA, 22 nt, Human
aguuauugauaaguucauacau

SEQ ID NO: 3077164 - RNA, 23 nt, Human
aguuauugauaaguucauacauu

SEQ ID NO: 3077165 - RNA, 18 nt, Human
uguucuuuccaaaguaca

SEQ ID NO: 3077166 - RNA, 18 nt, Human
aguuacccaaauuaagag

SEQ ID NO: 3077167 - RNA, 17 nt, Human
aguuacccaaauuaaga

SEQ ID NO: 3077168 - RNA, 20 nt, Human
aguucggugagcuacaaaug

SEQ ID NO: 3077169 - RNA, 21 nt, Human
aguuauuuuuauuuauuuaaa

SEQ ID NO: 3077170 - RNA, 15 nt, Human
aguucuaaauuuugu

SEQ ID NO: 3077171 - RNA, 13 nt, Human
uguugggccagga

SEQ ID NO: 3077172 - RNA, 16 nt, Human
uguugggccaggagcc

SEQ ID NO: 3077173 - RNA, 13 nt, Human
uguugucagcuga

SEQ ID NO: 3077174 - RNA, 13 nt, Human
uguucugggacac

SEQ ID NO: 3077175 - RNA, 12 nt, Human
uguucugggaca

SEQ ID NO: 3077176 - RNA, 16 nt, Human
uguucuuaauucuuag

SEQ ID NO: 3077177 - RNA, 14 nt, Human
uguucuuaauucuu

SEQ ID NO: 3077178 - RNA, 15 nt, Human
uguucugggacacag

SEQ ID NO: 3077179 - RNA, 14 nt, Human
uguucugggacaca

SEQ ID NO: 3077180 - RNA, 18 nt, Human
uguucuugguuuguaaau

SEQ ID NO: 3077181 - RNA, 17 nt, Human
uguucuugguuuguaaa

SEQ ID NO: 3077182 - RNA, 14 nt, Human
uguucuuuccaaag

SEQ ID NO: 3077183 - RNA, 13 nt, Human
uguucuuuccaaa

SEQ ID NO: 3077184 - RNA, 19 nt, Human
uguucuuucacccuuuucu

SEQ ID NO: 3077185 - RNA, 23 nt, Human
aguguacauggaauaacauguaa

SEQ ID NO: 3077186 - RNA, 22 nt, Human
aguguacauggaauaacaugua

SEQ ID NO: 3077187 - RNA, 21 nt, Human
aguguacauggaauaacaugu

SEQ ID NO: 3077188 - RNA, 21 nt, Human
agugguuccuaauccucuagg

SEQ ID NO: 3077189 - RNA, 19 nt, Human
agugggugaauaauacagu

SEQ ID NO: 3077190 - RNA, 20 nt, Human
aguggcagcugcuuuugucu

SEQ ID NO: 3077191 - RNA, 14 nt, Human
aguggcagcugcuu

SEQ ID NO: 3077192 - RNA, 13 nt, Human
aguggcagcugcu

SEQ ID NO: 3077193 - RNA, 12 nt, Human
aguggcagcugc

SEQ ID NO: 3077194 - RNA, 11 nt, Human
aguggcagcug

SEQ ID NO: 3077195 - RNA, 13 nt, Human
agugggugaauaa

SEQ ID NO: 3077196 - RNA, 18 nt, Human
agugggugaauaauacag

SEQ ID NO: 3077197 - RNA, 19 nt, Human
agugggggaguggccacag

SEQ ID NO: 3077198 - RNA, 20 nt, Human
agugggggaguggccacaga

SEQ ID NO: 3077199 - RNA, 17 nt, Human
uuaucaugugaaaucau

SEQ ID NO: 3077200 - RNA, 20 nt, Human
uuaucaugugaaaucauuca

SEQ ID NO: 3077201 - RNA, 18 nt, Human
uuaucaugugaaaucauu

SEQ ID NO: 3077202 - RNA, 22 nt, Human
uuaucaugugaaaucauucauu

SEQ ID NO: 3077203 - RNA, 22 nt, Human
uuaucaaagggugaaaauuauu

SEQ ID NO: 3077204 - RNA, 19 nt, Human
auaccagccaguaaauggg

SEQ ID NO: 3077205 - RNA, 17 nt, Human
auaccagccaguaaaug

SEQ ID NO: 3077206 - RNA, 21 nt, Human
auacuaaccagcagaaaugcc

SEQ ID NO: 3077207 - RNA, 20 nt, Human
auacuacaguuuguuaguau

SEQ ID NO: 3077208 - RNA, 16 nt, Human
auacuacaguuuguua

SEQ ID NO: 3077209 - RNA, 15 nt, Human
auacuacaguuuguu

SEQ ID NO: 3077210 - RNA, 13 nt, Human
auacuacaguuug

SEQ ID NO: 3077211 - RNA, 15 nt, Human
auacaggucauauua

SEQ ID NO: 3077212 - RNA, 21 nt, Human
auacaggucauauuaauauau

SEQ ID NO: 3077213 - RNA, 21 nt, Human
auacaguucggugagcuacaa

SEQ ID NO: 3077214 - RNA, 20 nt, Human
auacaggaaaagcugcugac

SEQ ID NO: 3077215 - RNA, 19 nt, Human
auacaggaaaagcugcuga

SEQ ID NO: 3077216 - RNA, 14 nt, Human
auacaggaaaagcu

SEQ ID NO: 3077217 - RNA, 19 nt, Human
auacauauuuuuguagcac

SEQ ID NO: 3077218 - RNA, 20 nt, Human
auacaucccuuaccugggaa

SEQ ID NO: 3077219 - RNA, 14 nt, Human
auacauuguacgaa

SEQ ID NO: 3077220 - RNA, 21 nt, Human
auacauuguacgaagaguauu

SEQ ID NO: 3077221 - RNA, 22 nt, Human
auacauuguacgaagaguauuu

SEQ ID NO: 3077222 - RNA, 16 nt, Human
auacauuugauaaagu

SEQ ID NO: 3077223 - RNA, 14 nt, Human
uuauauaaguauuc

SEQ ID NO: 3077224 - RNA, 16 nt, Human
uuauauaaguauucua

SEQ ID NO: 3077225 - RNA, 13 nt, Human
uuauauaaguauu

SEQ ID NO: 3077226 - RNA, 18 nt, Human
uuauauaagcuuguauuc

SEQ ID NO: 3077227 - RNA, 21 nt, Human
auaauuuuaagaaaucaaaga

SEQ ID NO: 3077228 - RNA, 15 nt, Human
auaauuuuaagaaau

SEQ ID NO: 3077229 - RNA, 14 nt, Human
auaauuuuaagaaa

SEQ ID NO: 3077230 - RNA, 22 nt, Human
uuauauauauuuuuuucugaaa

SEQ ID NO: 3077231 - RNA, 15 nt, Human
auacaaaagcaugug

SEQ ID NO: 3077232 - RNA, 13 nt, Human
auacaaaagcaug

SEQ ID NO: 3077233 - RNA, 12 nt, Human
auacaaaagcau

SEQ ID NO: 3077234 - RNA, 22 nt, Human
auacaaaaaaaaaaaaaaauua

SEQ ID NO: 3077235 - RNA, 21 nt, Human
auaauuuuuauauuugaaaua

SEQ ID NO: 3077236 - RNA, 22 nt, Human
auaauuuuuauauuugaaauau

SEQ ID NO: 3077237 - RNA, 14 nt, Human
auaauuuuuauauu

SEQ ID NO: 3077238 - RNA, 16 nt, Human
auaauuuuuauauuug

SEQ ID NO: 3077239 - RNA, 19 nt, Human
auaauuuuuauauuugaaa

SEQ ID NO: 3077240 - RNA, 13 nt, Human
auaauuuugugaa

SEQ ID NO: 3077241 - RNA, 14 nt, Human
auaauuuugugaag

SEQ ID NO: 3077242 - RNA, 15 nt, Human
auaauuuugugaagc

SEQ ID NO: 3077243 - RNA, 20 nt, Human
auaauuuugugaagcaaaau

SEQ ID NO: 3077244 - RNA, 23 nt, Human
uuauagaguguacuuaacuauuc

SEQ ID NO: 3077245 - RNA, 18 nt, Human
uuauacccagaaaguuau

SEQ ID NO: 3077246 - RNA, 19 nt, Human
uuauacccagaaaguuauu

SEQ ID NO: 3077247 - RNA, 23 nt, Human
uuauacccagaaaguuauugaua

SEQ ID NO: 3077248 - RNA, 13 nt, Human
uuauacauaaaca

SEQ ID NO: 3077249 - RNA, 21 nt, Human
uuagccguggugauuuagcag

SEQ ID NO: 3077250 - RNA, 20 nt, Human
auaaucagugugucuaaauu

SEQ ID NO: 3077251 - RNA, 21 nt, Human
auaaucuuucacaggggacag

SEQ ID NO: 3077252 - RNA, 19 nt, Human
auaauacaguaucucaggg

SEQ ID NO: 3077253 - RNA, 14 nt, Human
auaaugaauacuuu

SEQ ID NO: 3077254 - RNA, 14 nt, Human
auaauucuacuuug

SEQ ID NO: 3077255 - RNA, 18 nt, Human
uuagcaggaagcugugag

SEQ ID NO: 3077256 - RNA, 23 nt, Human
uuagaugcaguucugaagaagau

SEQ ID NO: 3077257 - RNA, 22 nt, Human
uuagaugcaguucugaagaaga

SEQ ID NO: 3077258 - RNA, 11 nt, Human
auaaguucaua

SEQ ID NO: 3077259 - RNA, 13 nt, Human
auaaguucauaca

SEQ ID NO: 3077260 - RNA, 14 nt, Human
auaaguucauacau

SEQ ID NO: 3077261 - RNA, 15 nt, Human
auaaguucauacauu

SEQ ID NO: 3077262 - RNA, 21 nt, Human
auaaguucauacauuguacga

SEQ ID NO: 3077263 - RNA, 22 nt, Human
auaaguuaacuuccaauuuaca

SEQ ID NO: 3077264 - RNA, 21 nt, Human
auaauacaccacuacauucug

SEQ ID NO: 3077265 - RNA, 23 nt, Human
auaauacaccacuacauucuguu

SEQ ID NO: 3077266 - RNA, 22 nt, Human
auaagaaccuuuugagugccuu

SEQ ID NO: 3077267 - RNA, 17 nt, Human
auaaguuaacuuccaau

SEQ ID NO: 3077268 - RNA, 23 nt, Human
auaagaaccuuuugagugccuua

SEQ ID NO: 3077269 - RNA, 18 nt, Human
auaaacacucuugaaaaa

SEQ ID NO: 3077270 - RNA, 16 nt, Human
auaaaccucaaaaugu

SEQ ID NO: 3077271 - RNA, 16 nt, Human
auaaaccgaacugaug

SEQ ID NO: 3077272 - RNA, 23 nt, Human
auaaacacucuugaaaaaugcau

SEQ ID NO: 3077273 - RNA, 17 nt, Human
aguuuucugagaaagac

SEQ ID NO: 3077274 - RNA, 14 nt, Human
aguuuucugagaaa

SEQ ID NO: 3077275 - RNA, 13 nt, Human
aguuuucugagaa

SEQ ID NO: 3077276 - RNA, 12 nt, Human
aguuuucugaga

SEQ ID NO: 3077277 - RNA, 15 nt, Human
auaaacucauuucua

SEQ ID NO: 3077278 - RNA, 18 nt, Human
auaaacgucuuaaauauu

SEQ ID NO: 3077279 - RNA, 15 nt, Human
auaaacgucuuaaau

SEQ ID NO: 3077280 - RNA, 16 nt, Human
auaaacgucuuaaaua

SEQ ID NO: 3077281 - RNA, 15 nt, Human
auaaacuuuaccuuu

SEQ ID NO: 3077282 - RNA, 13 nt, Human
auaaacuuuaccu

SEQ ID NO: 3077283 - RNA, 14 nt, Human
auaaauaaaaauaa

SEQ ID NO: 3077284 - RNA, 12 nt, Human
auaacugugaag

SEQ ID NO: 3077285 - RNA, 15 nt, Human
uuacaggaaguacug

SEQ ID NO: 3077286 - RNA, 16 nt, Human
uuacaggaaguacugg

SEQ ID NO: 3077287 - RNA, 18 nt, Human
uuacaggaaguacuggag

SEQ ID NO: 3077288 - RNA, 22 nt, Human
uuacaggaaguacuggagaaaa

SEQ ID NO: 3077289 - RNA, 23 nt, Human
uuaccauuuugggguacccacug

SEQ ID NO: 3077290 - RNA, 19 nt, Human
auaaauaaaguuuguugaa

SEQ ID NO: 3077291 - RNA, 13 nt, Human
auaaauaaaguuu

SEQ ID NO: 3077292 - RNA, 19 nt, Human
auaaaugugccuucauuuu

SEQ ID NO: 3077293 - RNA, 20 nt, Human
auaacauguaauuaaguacu

SEQ ID NO: 3077294 - RNA, 12 nt, Human
auaacuggaaac

SEQ ID NO: 3077295 - RNA, 15 nt, Human
uguacuugcucuuga

SEQ ID NO: 3077296 - RNA, 21 nt, Human
uguagaagucacauuccugaa

SEQ ID NO: 3077297 - RNA, 15 nt, Human
uguacuuaacuauuc

SEQ ID NO: 3077298 - RNA, 18 nt, Human
uguacaugaaaacacauu

SEQ ID NO: 3077299 - RNA, 17 nt, Human
uguacaugaaaacacau

SEQ ID NO: 3077300 - RNA, 19 nt, Human
uguacaugaaaacacauuu

SEQ ID NO: 3077301 - RNA, 15 nt, Human
uguaaggcaaucaug

SEQ ID NO: 3077302 - RNA, 16 nt, Human
uguaauuugugauaca

SEQ ID NO: 3077303 - RNA, 18 nt, Human
uguaaggaaugauuaauu

SEQ ID NO: 3077304 - RNA, 21 nt, Human
uguaauuugugauacaaugcu

SEQ ID NO: 3077305 - RNA, 17 nt, Human
uguaauuugugauacaa

SEQ ID NO: 3077306 - RNA, 14 nt, Human
uguacauauaagug

SEQ ID NO: 3077307 - RNA, 23 nt, Human
uguacaaaguagaagucuuagau

SEQ ID NO: 3077308 - RNA, 19 nt, Human
uguacaaaguagaagucuu

SEQ ID NO: 3077309 - RNA, 14 nt, Human
aggugugagucacc

SEQ ID NO: 3077310 - RNA, 20 nt, Human
aggugugacugaauuucuuu

SEQ ID NO: 3077311 - RNA, 22 nt, Human
aggugugaaccaccacacccag

SEQ ID NO: 3077312 - RNA, 18 nt, Human
aggugugacugaauuucu

SEQ ID NO: 3077313 - RNA, 23 nt, Human
aggugugaaccaccacacccagc

SEQ ID NO: 3077314 - RNA, 13 nt, Human
agguggggcagcu

SEQ ID NO: 3077315 - RNA, 23 nt, Human
agguggggucacucuggcagcuc

SEQ ID NO: 3077316 - RNA, 14 nt, Human
agguggggcagcuu

SEQ ID NO: 3077317 - RNA, 22 nt, Human
uguaagcucuacugaggugcua

SEQ ID NO: 3077318 - RNA, 17 nt, Human
uguaagaaaauaucacu

SEQ ID NO: 3077319 - RNA, 18 nt, Human
uguaagaaaauaucacuu

SEQ ID NO: 3077320 - RNA, 14 nt, Human
uguaaggaaugauu

SEQ ID NO: 3077321 - RNA, 15 nt, Human
uguaaggaaugauua

SEQ ID NO: 3077322 - RNA, 13 nt, Human
uguaaggaaugau

SEQ ID NO: 3077323 - RNA, 14 nt, Human
ugguuauggagagg

SEQ ID NO: 3077324 - RNA, 15 nt, Human
ugguguuuccuggca

SEQ ID NO: 3077325 - RNA, 17 nt, Human
ugguguuuccuggcacu

SEQ ID NO: 3077326 - RNA, 22 nt, Human
ugguucaggguuggccccugcc

SEQ ID NO: 3077327 - RNA, 20 nt, Human
ugguucaggguuggccccug

SEQ ID NO: 3077328 - RNA, 23 nt, Human
ugguucaggguuggccccugccc

SEQ ID NO: 3077329 - RNA, 12 nt, Human
ugguggcagcug

SEQ ID NO: 3077330 - RNA, 23 nt, Human
uggugugaccacugcagaagaca

SEQ ID NO: 3077331 - RNA, 15 nt, Human
ugguggcagagugga

SEQ ID NO: 3077332 - RNA, 12 nt, Human
ugguggcagcuc

SEQ ID NO: 3077333 - RNA, 16 nt, Human
ugguggcagcucaccu

SEQ ID NO: 3077334 - RNA, 19 nt, Human
ugguggcagcucaccucuc

SEQ ID NO: 3077335 - RNA, 20 nt, Human
ugguggcagcucaccucucc

SEQ ID NO: 3077336 - RNA, 23 nt, Human
ugguggcagcucaccucucccuu

SEQ ID NO: 3077337 - RNA, 18 nt, Human
ugguuuuaguugcaacuu

SEQ ID NO: 3077338 - RNA, 12 nt, Human
ugguuuucuguu

SEQ ID NO: 3077339 - RNA, 21 nt, Human
ugguuuguaaauuaacuuuua

SEQ ID NO: 3077340 - RNA, 15 nt, Human
ugguuucagaaaugu

SEQ ID NO: 3077341 - RNA, 14 nt, Human
ugguuucagaaaug

SEQ ID NO: 3077342 - RNA, 15 nt, Human
ugguuucuagcauga

SEQ ID NO: 3077343 - RNA, 15 nt, Human
ugguuuucuguucuu

SEQ ID NO: 3077344 - RNA, 13 nt, Human
ugguuuucuguuc

SEQ ID NO: 3077345 - RNA, 23 nt, Human
aggugauccacccaccucagccu

SEQ ID NO: 3077346 - RNA, 21 nt, Human
aggugauccacccaccucagc

SEQ ID NO: 3077347 - RNA, 17 nt, Human
aggguugggcugguguc

SEQ ID NO: 3077348 - RNA, 20 nt, Human
aggguuuauguuuaggaugu

SEQ ID NO: 3077349 - RNA, 15 nt, Human
aggucagugcaaaua

SEQ ID NO: 3077350 - RNA, 21 nt, Human
aggucaaggcugcagugagcc

SEQ ID NO: 3077351 - RNA, 23 nt, Human
aggucauuuuuuuuaagaaaaag

SEQ ID NO: 3077352 - RNA, 22 nt, Human
aggucauuuuuuuuaagaaaaa

SEQ ID NO: 3077353 - RNA, 21 nt, Human
aggucuugaacuccuggccuc

SEQ ID NO: 3077354 - RNA, 20 nt, Human
aggucuugaacuccuggccu

SEQ ID NO: 3077355 - RNA, 20 nt, Human
aggucauuuuuuuuaagaaa

SEQ ID NO: 3077356 - RNA, 18 nt, Human
aggucuugaacuccuggc

SEQ ID NO: 3077357 - RNA, 18 nt, Human
uggucugacccacugcuu

SEQ ID NO: 3077358 - RNA, 16 nt, Human
uggucuuauuuguaaa

SEQ ID NO: 3077359 - RNA, 12 nt, Human
uggucuguguga

SEQ ID NO: 3077360 - RNA, 22 nt, Human
uggucugugagaugcuagaacu

SEQ ID NO: 3077361 - RNA, 22 nt, Human
ugguccaugggccauaugaaaa

SEQ ID NO: 3077362 - RNA, 19 nt, Human
ugguccauagagagcaaga

SEQ ID NO: 3077363 - RNA, 19 nt, Human
aggguggugaccucugccu

SEQ ID NO: 3077364 - RNA, 17 nt, Human
aggguuaugauuaagua

SEQ ID NO: 3077365 - RNA, 18 nt, Human
aggguggugaccucugcc

SEQ ID NO: 3077366 - RNA, 17 nt, Human
aggguggugaccucugc

SEQ ID NO: 3077367 - RNA, 19 nt, Human
uggugaacagaacaaaagg

SEQ ID NO: 3077368 - RNA, 15 nt, Human
aggguugggcuggug

SEQ ID NO: 3077369 - RNA, 13 nt, Human
aggguugggcugg

SEQ ID NO: 3077370 - RNA, 14 nt, Human
aggguuggccccug

SEQ ID NO: 3077371 - RNA, 13 nt, Human
aggguuggccccu

SEQ ID NO: 3077372 - RNA, 16 nt, Human
aggggaauugaggaca

SEQ ID NO: 3077373 - RNA, 13 nt, Human
agggggcugggac

SEQ ID NO: 3077374 - RNA, 16 nt, Human
aggguaucaggugcug

SEQ ID NO: 3077375 - RNA, 19 nt, Human
aggguacuaaggaaucuuu

SEQ ID NO: 3077376 - RNA, 15 nt, Human
agggugaaaauuauu

SEQ ID NO: 3077377 - RNA, 22 nt, Human
agggugaugggaaagcauugua

SEQ ID NO: 3077378 - RNA, 21 nt, Human
agggugaugggaaagcauugu

SEQ ID NO: 3077379 - RNA, 14 nt, Human
uggguggaugccug

SEQ ID NO: 3077380 - RNA, 23 nt, Human
uggguggaugccugguggcagcu

SEQ ID NO: 3077381 - RNA, 15 nt, Human
ugguccauagagagc

SEQ ID NO: 3077382 - RNA, 16 nt, Human
ugguccauagagagca

SEQ ID NO: 3077383 - RNA, 21 nt, Human
uggucaccaaaucagcugcua

SEQ ID NO: 3077384 - RNA, 23 nt, Human
uggucaccaaaucagcugcuacu

SEQ ID NO: 3077385 - RNA, 20 nt, Human
uggucaccaaaucagcugcu

SEQ ID NO: 3077386 - RNA, 14 nt, Human
ugucaaagugguga

SEQ ID NO: 3077387 - RNA, 15 nt, Human
ugucaaaguggugag

SEQ ID NO: 3077388 - RNA, 14 nt, Human
aguagcugggacua

SEQ ID NO: 3077389 - RNA, 13 nt, Human
aguagcugggacu

SEQ ID NO: 3077390 - RNA, 16 nt, Human
ugucaaaguggugaga

SEQ ID NO: 3077391 - RNA, 19 nt, Human
ugucaaaguggugagaggc

SEQ ID NO: 3077392 - RNA, 15 nt, Human
uguagagccaggguc

SEQ ID NO: 3077393 - RNA, 12 nt, Human
uguagagccagg

SEQ ID NO: 3077394 - RNA, 23 nt, Human
agguuuggacaaaauggaauacu

SEQ ID NO: 3077395 - RNA, 15 nt, Human
uguaucccaugagcc

SEQ ID NO: 3077396 - RNA, 14 nt, Human
uguauguguaagua

SEQ ID NO: 3077397 - RNA, 21 nt, Human
aguauuuaauucauguugccu

SEQ ID NO: 3077398 - RNA, 15 nt, Human
aguauuguccagguc

SEQ ID NO: 3077399 - RNA, 16 nt, Human
aguauuguccaggucu

SEQ ID NO: 3077400 - RNA, 15 nt, Human
ugucagcauagaagu

SEQ ID NO: 3077401 - RNA, 17 nt, Human
agucacugagacagccc

SEQ ID NO: 3077402 - RNA, 15 nt, Human
agucacugagacagc

SEQ ID NO: 3077403 - RNA, 16 nt, Human
agucacugagacagcc

SEQ ID NO: 3077404 - RNA, 20 nt, Human
agucacauuccaagccucau

SEQ ID NO: 3077405 - RNA, 14 nt, Human
aguauguguaaaau

SEQ ID NO: 3077406 - RNA, 22 nt, Human
aguagcugggacuacaggcacc

SEQ ID NO: 3077407 - RNA, 21 nt, Human
aguagcugggacuacaggcac

SEQ ID NO: 3077408 - RNA, 19 nt, Human
aguagcugggacuacaggc

SEQ ID NO: 3077409 - RNA, 21 nt, Human
aguauuagaauaccacaggaa

SEQ ID NO: 3077410 - RNA, 18 nt, Human
aguauguuagugcaaauu

SEQ ID NO: 3077411 - RNA, 21 nt, Human
aguauguuagugcaaauuguc

SEQ ID NO: 3077412 - RNA, 14 nt, Human
aguauuauaccuuu

SEQ ID NO: 3077413 - RNA, 15 nt, Human
aguauuauaccuuuu

SEQ ID NO: 3077414 - RNA, 14 nt, Human
ugucuaagauagua

SEQ ID NO: 3077415 - RNA, 15 nt, Human
ugucuaagauaguaa

SEQ ID NO: 3077416 - RNA, 18 nt, Human
ugucuaaauuugaauguu

SEQ ID NO: 3077417 - RNA, 19 nt, Human
agucagggguucccuuuuu

SEQ ID NO: 3077418 - RNA, 15 nt, Human
agucagucauucaga

SEQ ID NO: 3077419 - RNA, 21 nt, Human
agucagucauucagauaugau

SEQ ID NO: 3077420 - RNA, 20 nt, Human
agucccaccuuggcugcagg

SEQ ID NO: 3077421 - RNA, 23 nt, Human
agucccaccuuggcugcagggag

SEQ ID NO: 3077422 - RNA, 21 nt, Human
agucccaccuuggcugcaggg

SEQ ID NO: 3077423 - RNA, 14 nt, Human
aguccccuguuugu

SEQ ID NO: 3077424 - RNA, 19 nt, Human
aguccccuguuuguuucug

SEQ ID NO: 3077425 - RNA, 12 nt, Human
ugucccuuuucc

SEQ ID NO: 3077426 - RNA, 16 nt, Human
ugucagccauuccugu

SEQ ID NO: 3077427 - RNA, 23 nt, Human
ugucagcuccccucggagaagag

SEQ ID NO: 3077428 - RNA, 21 nt, Human
ugucagcuccccucggagaag

SEQ ID NO: 3077429 - RNA, 20 nt, Human
ugucagcuccccucggagaa

SEQ ID NO: 3077430 - RNA, 16 nt, Human
ugugauguauucuagc

SEQ ID NO: 3077431 - RNA, 17 nt, Human
ugugauggggcccugcc

SEQ ID NO: 3077432 - RNA, 14 nt, Human
agugagagcugggu

SEQ ID NO: 3077433 - RNA, 21 nt, Human
agugagcagucaggaaagaga

SEQ ID NO: 3077434 - RNA, 22 nt, Human
agugagcacuaaggugugcucu

SEQ ID NO: 3077435 - RNA, 15 nt, Human
ugugauggggcccug

SEQ ID NO: 3077436 - RNA, 16 nt, Human
ugugauggggcccugc

SEQ ID NO: 3077437 - RNA, 16 nt, Human
agugagccgagauugu

SEQ ID NO: 3077438 - RNA, 17 nt, Human
agugaaagaaaauaaca

SEQ ID NO: 3077439 - RNA, 16 nt, Human
agugaaagaggcagcu

SEQ ID NO: 3077440 - RNA, 14 nt, Human
agugagacagcucu

SEQ ID NO: 3077441 - RNA, 22 nt, Human
agugaaagaggcagcuugaaac

SEQ ID NO: 3077442 - RNA, 17 nt, Human
agugagacucugucuca

SEQ ID NO: 3077443 - RNA, 16 nt, Human
agugagacucugucuc

SEQ ID NO: 3077444 - RNA, 22 nt, Human
agugagacucugucucaaaaaa

SEQ ID NO: 3077445 - RNA, 17 nt, Human
agugagacccugucuca

SEQ ID NO: 3077446 - RNA, 21 nt, Human
agugagacccugucucaaaaa

SEQ ID NO: 3077447 - RNA, 13 nt, Human
agugagacucugu

SEQ ID NO: 3077448 - RNA, 19 nt, Human
agucuccaaagucucugga

SEQ ID NO: 3077449 - RNA, 14 nt, Human
ugugaagcaaaauu

SEQ ID NO: 3077450 - RNA, 14 nt, Human
ugugaagagaacca

SEQ ID NO: 3077451 - RNA, 19 nt, Human
ugugagcacaaagguagcu

SEQ ID NO: 3077452 - RNA, 22 nt, Human
ugugagaugcuagaacucccuu

SEQ ID NO: 3077453 - RNA, 11 nt, Human
agugaaaaagg

SEQ ID NO: 3077454 - RNA, 17 nt, Human
agugaaaaaggaggaag

SEQ ID NO: 3077455 - RNA, 20 nt, Human
agugaaaaaggaggaagaga

SEQ ID NO: 3077456 - RNA, 23 nt, Human
agugaaaaaggaggaagagaaaa

SEQ ID NO: 3077457 - RNA, 22 nt, Human
ugucucuggauuauauuaugaa

SEQ ID NO: 3077458 - RNA, 13 nt, Human
ugucucugagagu

SEQ ID NO: 3077459 - RNA, 17 nt, Human
ugucucuacuaaaaaua

SEQ ID NO: 3077460 - RNA, 15 nt, Human
ugucuccucucucug

SEQ ID NO: 3077461 - RNA, 23 nt, Human
aguccccuguuuguuucugaaag

SEQ ID NO: 3077462 - RNA, 13 nt, Human
agucccugccaau

SEQ ID NO: 3077463 - RNA, 14 nt, Human
agucccugccaaug

SEQ ID NO: 3077464 - RNA, 16 nt, Human
agucccugccaaugga

SEQ ID NO: 3077465 - RNA, 22 nt, Human
ugucucuugguccugcugcagu

SEQ ID NO: 3077466 - RNA, 21 nt, Human
ugucucuuuaaugucacaggc

SEQ ID NO: 3077467 - RNA, 22 nt, Human
ugucucuuuaaugucacaggca

SEQ ID NO: 3077468 - RNA, 12 nt, Human
ugucuuaauuaa

SEQ ID NO: 3077469 - RNA, 14 nt, Human
ugucuuaauuaaaa

SEQ ID NO: 3077470 - RNA, 18 nt, Human
ugucucuugguccugcug

SEQ ID NO: 3077471 - RNA, 19 nt, Human
ugucucuugguccugcugc

SEQ ID NO: 3077472 - RNA, 20 nt, Human
ugucucuugguccugcugca

SEQ ID NO: 3077473 - RNA, 21 nt, Human
ugucucuugguccugcugcag

SEQ ID NO: 3077474 - RNA, 15 nt, Human
ugugaaccaccacac

SEQ ID NO: 3077475 - RNA, 22 nt, Human
ugugaacaguuguguuugaagc

SEQ ID NO: 3077476 - RNA, 23 nt, Human
ugugaaccaccacacccagccca

SEQ ID NO: 3077477 - RNA, 22 nt, Human
ugugaaccaccacacccagccc

SEQ ID NO: 3077478 - RNA, 16 nt, Human
ugugaaccaccacacc

SEQ ID NO: 3077479 - RNA, 21 nt, Human
ugucuugcaauggcagccuug

SEQ ID NO: 3077480 - RNA, 20 nt, Human
ugucuugcaauggcagccuu

SEQ ID NO: 3077481 - RNA, 18 nt, Human
ugucuugcaauggcagcc

SEQ ID NO: 3077482 - RNA, 17 nt, Human
ugucuugcaauggcagc

SEQ ID NO: 3077483 - RNA, 15 nt, Human
ugucuugcaauggca

SEQ ID NO: 3077484 - RNA, 14 nt, Human
ugucuucacaacag

SEQ ID NO: 3077485 - RNA, 18 nt, Human
ugaauauuuaguguucau

SEQ ID NO: 3077486 - RNA, 23 nt, Human
ugaauaauguaagacaaauaugu

SEQ ID NO: 3077487 - RNA, 13 nt, Human
ugaauaauacagu

SEQ ID NO: 3077488 - RNA, 12 nt, Human
ugaauaauacag

SEQ ID NO: 3077489 - RNA, 13 nt, Human
ugaagucacacag

SEQ ID NO: 3077490 - RNA, 17 nt, Human
ugaaguacucauacaug

SEQ ID NO: 3077491 - RNA, 22 nt, Human
ugaaguaauaugcacacauuuu

SEQ ID NO: 3077492 - RNA, 21 nt, Human
ugaaguaauaugcacacauuu

SEQ ID NO: 3077493 - RNA, 20 nt, Human
ugaaguaauaugcacacauu

SEQ ID NO: 3077494 - RNA, 16 nt, Human
ugaaguaauaugcaca

SEQ ID NO: 3077495 - RNA, 15 nt, Human
ugaaguaauaugcac

SEQ ID NO: 3077496 - RNA, 17 nt, Human
ugaagauuuaccacuug

SEQ ID NO: 3077497 - RNA, 20 nt, Human
ugaagauuuaccacuugugu

SEQ ID NO: 3077498 - RNA, 20 nt, Human
agaguaauccaagcaaaugu

SEQ ID NO: 3077499 - RNA, 18 nt, Human
agaguaauccaagcaaau

SEQ ID NO: 3077500 - RNA, 19 nt, Human
agagguucaaagauauuuu

SEQ ID NO: 3077501 - RNA, 16 nt, Human
agagguucaaagauau

SEQ ID NO: 3077502 - RNA, 20 nt, Human
agagguucaaagauauuuug

SEQ ID NO: 3077503 - RNA, 22 nt, Human
agaggcugccucucccaucacu

SEQ ID NO: 3077504 - RNA, 13 nt, Human
agagguucaaaga

SEQ ID NO: 3077505 - RNA, 20 nt, Human
agagggagugacagaggcag

SEQ ID NO: 3077506 - RNA, 15 nt, Human
agagggagugacaga

SEQ ID NO: 3077507 - RNA, 15 nt, Human
agagggagguaagga

SEQ ID NO: 3077508 - RNA, 23 nt, Human
agaggcagccccauucugccugc

SEQ ID NO: 3077509 - RNA, 21 nt, Human
agaggcagggucucacucugu

SEQ ID NO: 3077510 - RNA, 22 nt, Human
agaggcagccccauucugccug

SEQ ID NO: 3077511 - RNA, 21 nt, Human
agaggcagccccauucugccu

SEQ ID NO: 3077512 - RNA, 18 nt, Human
agagcuguucacagccag

SEQ ID NO: 3077513 - RNA, 16 nt, Human
ugaaauaacauggccu

SEQ ID NO: 3077514 - RNA, 17 nt, Human
ugaaauaacauggccuu

SEQ ID NO: 3077515 - RNA, 13 nt, Human
ugaaauaaacguc

SEQ ID NO: 3077516 - RNA, 18 nt, Human
ugaaauaaacgucuuaaa

SEQ ID NO: 3077517 - RNA, 22 nt, Human
ugaaauaaacgucuuaaauauu

SEQ ID NO: 3077518 - RNA, 23 nt, Human
ugaaauaaacgucuuaaauauuc

SEQ ID NO: 3077519 - RNA, 20 nt, Human
ugaaauuuuuauuaaauuau

SEQ ID NO: 3077520 - RNA, 21 nt, Human
ugaaauuuccugggagcuuuu

SEQ ID NO: 3077521 - RNA, 19 nt, Human
ugaaauuuuuauuaaauua

SEQ ID NO: 3077522 - RNA, 15 nt, Human
ugaaauuuccuggga

SEQ ID NO: 3077523 - RNA, 21 nt, Human
ugaaccaccacacccagccca

SEQ ID NO: 3077524 - RNA, 13 nt, Human
ugaacaaauuuac

SEQ ID NO: 3077525 - RNA, 22 nt, Human
ugaaccaccacacccagcccac

SEQ ID NO: 3077526 - RNA, 22 nt, Human
ugaacccauauuuguacaccaa

SEQ ID NO: 3077527 - RNA, 18 nt, Human
ugaacccgggaggcagag

SEQ ID NO: 3077528 - RNA, 21 nt, Human
ugaagacaaugacuuacugua

SEQ ID NO: 3077529 - RNA, 23 nt, Human
ugaagacaaugacuuacuguaca

SEQ ID NO: 3077530 - RNA, 22 nt, Human
ugaagacaaugacuuacuguac

SEQ ID NO: 3077531 - RNA, 22 nt, Human
ugaagaagcaccaaucaugaau

SEQ ID NO: 3077532 - RNA, 12 nt, Human
agacuuuuauga

SEQ ID NO: 3077533 - RNA, 19 nt, Human
agacuuuggaaagaguagg

SEQ ID NO: 3077534 - RNA, 15 nt, Human
agacuuuuaugauac

SEQ ID NO: 3077535 - RNA, 15 nt, Human
agacuuuuccaaccc

SEQ ID NO: 3077536 - RNA, 16 nt, Human
agagacacaagccuuc

SEQ ID NO: 3077537 - RNA, 19 nt, Human
agagacacaagccuucggc

SEQ ID NO: 3077538 - RNA, 15 nt, Human
agagacacaagccuu

SEQ ID NO: 3077539 - RNA, 20 nt, Human
agacugguuccauggccucu

SEQ ID NO: 3077540 - RNA, 17 nt, Human
agacuuuggaaagacuu

SEQ ID NO: 3077541 - RNA, 15 nt, Human
agacuuuggaaagag

SEQ ID NO: 3077542 - RNA, 15 nt, Human
agacuuuggaaagac

SEQ ID NO: 3077543 - RNA, 22 nt, Human
ucuuuuuucuaaaguaaaaaca

SEQ ID NO: 3077544 - RNA, 21 nt, Human
ucuuuuuucuaaaguaaaaac

SEQ ID NO: 3077545 - RNA, 16 nt, Human
ucuuuguaaugaaaac

SEQ ID NO: 3077546 - RNA, 14 nt, Human
ucuuuguacagaca

SEQ ID NO: 3077547 - RNA, 15 nt, Human
ucuuuguacagacaa

SEQ ID NO: 3077548 - RNA, 20 nt, Human
ucuuuguacagacaacaaac

SEQ ID NO: 3077549 - RNA, 14 nt, Human
agagacagaaagca

SEQ ID NO: 3077550 - RNA, 16 nt, Human
agagacacacugaaga

SEQ ID NO: 3077551 - RNA, 22 nt, Human
agacuccaaagaaauguaaggg

SEQ ID NO: 3077552 - RNA, 20 nt, Human
agacaggcaagcaccuccug

SEQ ID NO: 3077553 - RNA, 15 nt, Human
ucuuuaaugucacag

SEQ ID NO: 3077554 - RNA, 18 nt, Human
ucuuuaaugucacaggca

SEQ ID NO: 3077555 - RNA, 13 nt, Human
agacuccugcagg

SEQ ID NO: 3077556 - RNA, 16 nt, Human
agacucccaugaggga

SEQ ID NO: 3077557 - RNA, 23 nt, Human
agacuggcacaguuuucugagaa

SEQ ID NO: 3077558 - RNA, 18 nt, Human
agacuggcacaguuuucu

SEQ ID NO: 3077559 - RNA, 21 nt, Human
agacuggcacaguuuucugag

SEQ ID NO: 3077560 - RNA, 20 nt, Human
agacuggcacaguuuucuga

SEQ ID NO: 3077561 - RNA, 20 nt, Human
ugaaaaucuuauaauuuaaa

SEQ ID NO: 3077562 - RNA, 22 nt, Human
ugaaaauauuuguaucacaaau

SEQ ID NO: 3077563 - RNA, 21 nt, Human
ugaaaauauuuguaucacaaa

SEQ ID NO: 3077564 - RNA, 14 nt, Human
ugaaaauuaacaug

SEQ ID NO: 3077565 - RNA, 22 nt, Human
ugaaacugagaugugaacacau

SEQ ID NO: 3077566 - RNA, 13 nt, Human
ugaaagaaaauaa

SEQ ID NO: 3077567 - RNA, 18 nt, Human
ugaaacuggauuaaacuu

SEQ ID NO: 3077568 - RNA, 17 nt, Human
ugaaacuggauuaaacu

SEQ ID NO: 3077569 - RNA, 19 nt, Human
ugaaaacacauuuuucuua

SEQ ID NO: 3077570 - RNA, 17 nt, Human
ugaaaacacauuuuucu

SEQ ID NO: 3077571 - RNA, 15 nt, Human
ugaaaacacauuuuu

SEQ ID NO: 3077572 - RNA, 17 nt, Human
ugaaaauauuuguauca

SEQ ID NO: 3077573 - RNA, 13 nt, Human
ugaaaacacauuu

SEQ ID NO: 3077574 - RNA, 12 nt, Human
ugaaaacacauu

SEQ ID NO: 3077575 - RNA, 14 nt, Human
ugaaaacacauuuu

SEQ ID NO: 3077576 - RNA, 13 nt, Human
agagacuccugca

SEQ ID NO: 3077577 - RNA, 14 nt, Human
agagacuccugcag

SEQ ID NO: 3077578 - RNA, 12 nt, Human
agagacuccugc

SEQ ID NO: 3077579 - RNA, 11 nt, Human
agagacuccug

SEQ ID NO: 3077580 - RNA, 22 nt, Human
ugaaagaaaauaccaaggaaca

SEQ ID NO: 3077581 - RNA, 12 nt, Human
ugaaacuuuugg

SEQ ID NO: 3077582 - RNA, 16 nt, Human
ugaaagacuguacaaa

SEQ ID NO: 3077583 - RNA, 19 nt, Human
ugaaagacuguacaaagua

SEQ ID NO: 3077584 - RNA, 18 nt, Human
ugaaagacuguacaaagu

SEQ ID NO: 3077585 - RNA, 22 nt, Human
ugaaagacuguacaaaguagaa

SEQ ID NO: 3077586 - RNA, 17 nt, Human
ugaaagaggaaugaagu

SEQ ID NO: 3077587 - RNA, 19 nt, Human
agagaccaucccugaaggc

SEQ ID NO: 3077588 - RNA, 21 nt, Human
agagaccaucccugaaggccc

SEQ ID NO: 3077589 - RNA, 18 nt, Human
agagaccaucccugaagg

SEQ ID NO: 3077590 - RNA, 18 nt, Human
ugaaagaggaaugaagua

SEQ ID NO: 3077591 - RNA, 22 nt, Human
agagaccaucccugaaggcccc

SEQ ID NO: 3077592 - RNA, 23 nt, Human
agagaccaucccugaaggccccg

SEQ ID NO: 3077593 - RNA, 21 nt, Human
agauguagccccucuccugga

SEQ ID NO: 3077594 - RNA, 22 nt, Human
agauguagccccucuccuggaa

SEQ ID NO: 3077595 - RNA, 21 nt, Human
agaugcuagaacucccuuuca

SEQ ID NO: 3077596 - RNA, 15 nt, Human
agaugcuagaacucc

SEQ ID NO: 3077597 - RNA, 13 nt, Human
agaugcacaugag

SEQ ID NO: 3077598 - RNA, 16 nt, Human
agaugcacaugagcug

SEQ ID NO: 3077599 - RNA, 20 nt, Human
agaugcaguucugaagaaga

SEQ ID NO: 3077600 - RNA, 21 nt, Human
agaugcaguucugaagaagau

SEQ ID NO: 3077601 - RNA, 19 nt, Human
agaugcuagaacucccuuu

SEQ ID NO: 3077602 - RNA, 13 nt, Human
agauccuggaaau

SEQ ID NO: 3077603 - RNA, 22 nt, Human
ugacagggcacaccgggcacuc

SEQ ID NO: 3077604 - RNA, 21 nt, Human
ugacagggcacaccgggcacu

SEQ ID NO: 3077605 - RNA, 19 nt, Human
ugacaggcaaugcuggcug

SEQ ID NO: 3077606 - RNA, 17 nt, Human
ugacaggcaaugcuggc

SEQ ID NO: 3077607 - RNA, 13 nt, Human
ugacauguuuuau

SEQ ID NO: 3077608 - RNA, 16 nt, Human
ugacacgaauauugcu

SEQ ID NO: 3077609 - RNA, 19 nt, Human
ugacacgaauauugcugau

SEQ ID NO: 3077610 - RNA, 22 nt, Human
ugacagagugagacucugucuc

SEQ ID NO: 3077611 - RNA, 15 nt, Human
ugacacuuaaaaaug

SEQ ID NO: 3077612 - RNA, 14 nt, Human
ugacuaugacauaa

SEQ ID NO: 3077613 - RNA, 12 nt, Human
ugaccuuucaau

SEQ ID NO: 3077614 - RNA, 21 nt, Human
ugacuguuuucucuugagagg

SEQ ID NO: 3077615 - RNA, 15 nt, Human
ugaccuuuaagagaa

SEQ ID NO: 3077616 - RNA, 22 nt, Human
agaugugaacacaucagcuugc

SEQ ID NO: 3077617 - RNA, 17 nt, Human
agaugugaacacaucag

SEQ ID NO: 3077618 - RNA, 22 nt, Human
agauguauguacuucaugcugu

SEQ ID NO: 3077619 - RNA, 20 nt, Human
ugacuuacuguacaugaaaa

SEQ ID NO: 3077620 - RNA, 12 nt, Human
ugacuuacugua

SEQ ID NO: 3077621 - RNA, 19 nt, Human
ugacuuacuguacaugaaa

SEQ ID NO: 3077622 - RNA, 16 nt, Human
agauucauauuuacuu

SEQ ID NO: 3077623 - RNA, 13 nt, Human
agauucauauuua

SEQ ID NO: 3077624 - RNA, 19 nt, Human
agauuucacucuccuuggu

SEQ ID NO: 3077625 - RNA, 17 nt, Human
agauuucacucuccuug

SEQ ID NO: 3077626 - RNA, 21 nt, Human
agauugugccccugcacucca

SEQ ID NO: 3077627 - RNA, 15 nt, Human
agcaagucagaauag

SEQ ID NO: 3077628 - RNA, 22 nt, Human
agcaagggugaugggaaagcau

SEQ ID NO: 3077629 - RNA, 20 nt, Human
agcaagggugaugggaaagc

SEQ ID NO: 3077630 - RNA, 16 nt, Human
agcaagugagagcugg

SEQ ID NO: 3077631 - RNA, 15 nt, Human
agcaagugagagcug

SEQ ID NO: 3077632 - RNA, 16 nt, Human
agcaagugagacccug

SEQ ID NO: 3077633 - RNA, 19 nt, Human
agcaaggagauuuacaacu

SEQ ID NO: 3077634 - RNA, 17 nt, Human
agcaaggagauuuacaa

SEQ ID NO: 3077635 - RNA, 14 nt, Human
agcaaggagauuua

SEQ ID NO: 3077636 - RNA, 16 nt, Human
agcaagggugauggga

SEQ ID NO: 3077637 - RNA, 18 nt, Human
ugagccagauuucacucu

SEQ ID NO: 3077638 - RNA, 19 nt, Human
ugagccagauuucacucuc

SEQ ID NO: 3077639 - RNA, 14 nt, Human
ugagccacugcacc

SEQ ID NO: 3077640 - RNA, 20 nt, Human
ugagccagauuucacucucc

SEQ ID NO: 3077641 - RNA, 13 nt, Human
ugagccacugcac

SEQ ID NO: 3077642 - RNA, 12 nt, Human
ugagccacugca

SEQ ID NO: 3077643 - RNA, 16 nt, Human
agcaccuccugccucg

SEQ ID NO: 3077644 - RNA, 14 nt, Human
agcaccuccugccu

SEQ ID NO: 3077645 - RNA, 13 nt, Human
agcaccuccugcc

SEQ ID NO: 3077646 - RNA, 16 nt, Human
agcaccaucucuccuc

SEQ ID NO: 3077647 - RNA, 23 nt, Human
agcacaugccucucucaggccaa

SEQ ID NO: 3077648 - RNA, 19 nt, Human
agcacaugccucucucagg

SEQ ID NO: 3077649 - RNA, 20 nt, Human
agcacaugccucucucaggc

SEQ ID NO: 3077650 - RNA, 21 nt, Human
agcacaugccucucucaggcc

SEQ ID NO: 3077651 - RNA, 22 nt, Human
agcacaugccucucucaggcca

SEQ ID NO: 3077652 - RNA, 18 nt, Human
agcacaugccucucucag

SEQ ID NO: 3077653 - RNA, 16 nt, Human
agcacaugccucucuc

SEQ ID NO: 3077654 - RNA, 21 nt, Human
agcacagcuucauuuccugug

SEQ ID NO: 3077655 - RNA, 17 nt, Human
agcaagugagagcuggg

SEQ ID NO: 3077656 - RNA, 14 nt, Human
ugagauguguucac

SEQ ID NO: 3077657 - RNA, 24 nt, Human
ugagaugugaacacaucagcuugc

SEQ ID NO: 3077658 - RNA, 19 nt, Human
ugagaugugaacacaucag

SEQ ID NO: 3077659 - RNA, 18 nt, Human
ugagaugugaacacauca

SEQ ID NO: 3077660 - RNA, 23 nt, Human
ugagauguagccccucuccugga

SEQ ID NO: 3077661 - RNA, 13 nt, Human
ugagaugugaaca

SEQ ID NO: 3077662 - RNA, 17 nt, Human
ugagaggaaaucaccga

SEQ ID NO: 3077663 - RNA, 23 nt, Human
ugagaggacuuuucuuuguggcu

SEQ ID NO: 3077664 - RNA, 10 nt, Human
ugagaggaaa

SEQ ID NO: 3077665 - RNA, 14 nt, Human
ugagagcugggugu

SEQ ID NO: 3077666 - RNA, 11 nt, Human
ugagaggaaau

SEQ ID NO: 3077667 - RNA, 12 nt, Human
ugagaggaaauc

SEQ ID NO: 3077668 - RNA, 13 nt, Human
ugagaggaaauca

SEQ ID NO: 3077669 - RNA, 14 nt, Human
ugagaggaaaucac

SEQ ID NO: 3077670 - RNA, 23 nt, Human
ugagagcaguuugguuucuagca

SEQ ID NO: 3077671 - RNA, 21 nt, Human
ugagagcaguuugguuucuag

SEQ ID NO: 3077672 - RNA, 21 nt, Human
ugagagacacacugaagaagc

SEQ ID NO: 3077673 - RNA, 22 nt, Human
ugagagacacacugaagaagca

SEQ ID NO: 3077674 - RNA, 17 nt, Human
ugagacagcccgggcuc

SEQ ID NO: 3077675 - RNA, 18 nt, Human
ugagacagcccgggcucu

SEQ ID NO: 3077676 - RNA, 19 nt, Human
ugagacagcccgggcucug

SEQ ID NO: 3077677 - RNA, 20 nt, Human
ugagacagcccgggcucugc

SEQ ID NO: 3077678 - RNA, 22 nt, Human
ugagacagcccgggcucugccu

SEQ ID NO: 3077679 - RNA, 20 nt, Human
ugagacucugucucaaaaaa

SEQ ID NO: 3077680 - RNA, 20 nt, Human
ugagacucugucucagucca

SEQ ID NO: 3077681 - RNA, 16 nt, Human
ugagagacacacugaa

SEQ ID NO: 3077682 - RNA, 17 nt, Human
ugagagacacacugaag

SEQ ID NO: 3077683 - RNA, 19 nt, Human
ugagagacacacugaagaa

SEQ ID NO: 3077684 - RNA, 20 nt, Human
ugagagacacacugaagaag

SEQ ID NO: 3077685 - RNA, 13 nt, Human
ugagacagcccgg

SEQ ID NO: 3077686 - RNA, 21 nt, Human
ugagacagaguuuucacucuu

SEQ ID NO: 3077687 - RNA, 11 nt, Human
ugagacagagu

SEQ ID NO: 3077688 - RNA, 20 nt, Human
ugagaagcagaggaaggaga

SEQ ID NO: 3077689 - RNA, 16 nt, Human
agauuuuccugaaaac

SEQ ID NO: 3077690 - RNA, 15 nt, Human
agauuuuccugaaaa

SEQ ID NO: 3077691 - RNA, 14 nt, Human
agauuuuccugaaa

SEQ ID NO: 3077692 - RNA, 12 nt, Human
ucugcagguccc

SEQ ID NO: 3077693 - RNA, 11 nt, Human
ucugcaggucc

SEQ ID NO: 3077694 - RNA, 13 nt, Human
ucugcaggucccu

SEQ ID NO: 3077695 - RNA, 15 nt, Human
agaaauguacagcaa

SEQ ID NO: 3077696 - RNA, 14 nt, Human
agaaauguacagca

SEQ ID NO: 3077697 - RNA, 17 nt, Human
ucugcagcaauaaagca

SEQ ID NO: 3077698 - RNA, 13 nt, Human
ucugcacuccccu

SEQ ID NO: 3077699 - RNA, 18 nt, Human
ucugcagauaaacaguag

SEQ ID NO: 3077700 - RNA, 15 nt, Human
ucugcagauaaacag

SEQ ID NO: 3077701 - RNA, 14 nt, Human
ucugcacuccccug

SEQ ID NO: 3077702 - RNA, 15 nt, Human
ucugcacuccccugc

SEQ ID NO: 3077703 - RNA, 16 nt, Human
ucugcacuccccugcu

SEQ ID NO: 3077704 - RNA, 21 nt, Human
ucugaucauccacugugccau

SEQ ID NO: 3077705 - RNA, 17 nt, Human
ucugaucauccacugug

SEQ ID NO: 3077706 - RNA, 21 nt, Human
ucugagacucgcgacaaugca

SEQ ID NO: 3077707 - RNA, 15 nt, Human
ucugaauuauuuucu

SEQ ID NO: 3077708 - RNA, 12 nt, Human
ucugacacacag

SEQ ID NO: 3077709 - RNA, 14 nt, Human
ucugacacacagcu

SEQ ID NO: 3077710 - RNA, 13 nt, Human
ucugacacacagc

SEQ ID NO: 3077711 - RNA, 15 nt, Human
ucugacacacagcuc

SEQ ID NO: 3077712 - RNA, 10 nt, Human
ucugaauuau

SEQ ID NO: 3077713 - RNA, 21 nt, Human
ucugaaggacauugcggacag

SEQ ID NO: 3077714 - RNA, 14 nt, Human
agaaaugaaagcag

SEQ ID NO: 3077715 - RNA, 14 nt, Human
agaagaacugaaau

SEQ ID NO: 3077716 - RNA, 13 nt, Human
agaagaacugaaa

SEQ ID NO: 3077717 - RNA, 18 nt, Human
agaagaugguaccaccag

SEQ ID NO: 3077718 - RNA, 18 nt, Human
agaagauuuugaaauuuu

SEQ ID NO: 3077719 - RNA, 12 nt, Human
agaagcccagga

SEQ ID NO: 3077720 - RNA, 16 nt, Human
agaagcccaggaaagg

SEQ ID NO: 3077721 - RNA, 18 nt, Human
agaagcccaggaaaggcu

SEQ ID NO: 3077722 - RNA, 20 nt, Human
agaagcccaggaaaggcucc

SEQ ID NO: 3077723 - RNA, 21 nt, Human
agaagcccaggaaaggcucca

SEQ ID NO: 3077724 - RNA, 22 nt, Human
agaagcccaggaaaggcuccag

SEQ ID NO: 3077725 - RNA, 16 nt, Human
ucugcccacucccugc

SEQ ID NO: 3077726 - RNA, 17 nt, Human
ucugcccacucccugca

SEQ ID NO: 3077727 - RNA, 15 nt, Human
ucugcuucagccucc

SEQ ID NO: 3077728 - RNA, 14 nt, Human
ucugcuucagccuc

SEQ ID NO: 3077729 - RNA, 13 nt, Human
ucugcuucagccu

SEQ ID NO: 3077730 - RNA, 20 nt, Human
ucugcucacauaucugucau

SEQ ID NO: 3077731 - RNA, 19 nt, Human
ucugcucacauaucuguca

SEQ ID NO: 3077732 - RNA, 17 nt, Human
ucugcucacauaucugu

SEQ ID NO: 3077733 - RNA, 22 nt, Human
ucugccgcagcccugcagaggg

SEQ ID NO: 3077734 - RNA, 22 nt, Human
ucugccugcccaggccccugcc

SEQ ID NO: 3077735 - RNA, 21 nt, Human
ucugccugcccaggccccugc

SEQ ID NO: 3077736 - RNA, 18 nt, Human
ucugcgggggcagugcuc

SEQ ID NO: 3077737 - RNA, 20 nt, Human
ucugcgggggcagugcucac

SEQ ID NO: 3077738 - RNA, 22 nt, Human
ucugcggagcacacuggcucac

SEQ ID NO: 3077739 - RNA, 21 nt, Human
ucugcggagcacacuggcuca

SEQ ID NO: 3077740 - RNA, 14 nt, Human
ucugcggagcacac

SEQ ID NO: 3077741 - RNA, 18 nt, Human
ucugcccacucccugcaa

SEQ ID NO: 3077742 - RNA, 21 nt, Human
ucugcccacucccugcaaccu

SEQ ID NO: 3077743 - RNA, 18 nt, Human
ucugcccuccaagaccuu

SEQ ID NO: 3077744 - RNA, 19 nt, Human
ucugcccuccaagaccuuc

SEQ ID NO: 3077745 - RNA, 14 nt, Human
ucugccgcagcccu

SEQ ID NO: 3077746 - RNA, 15 nt, Human
ucugccgcagcccug

SEQ ID NO: 3077747 - RNA, 16 nt, Human
ucugugaaaguacauu

SEQ ID NO: 3077748 - RNA, 22 nt, Human
ucugugaaaggaaagagggagg

SEQ ID NO: 3077749 - RNA, 14 nt, Human
ucugugagaugcua

SEQ ID NO: 3077750 - RNA, 23 nt, Human
ucugugagaugcuagaacucccu

SEQ ID NO: 3077751 - RNA, 17 nt, Human
ucugugagaugcuagaa

SEQ ID NO: 3077752 - RNA, 22 nt, Human
ucugugagaugcuagaacuccc

SEQ ID NO: 3077753 - RNA, 13 nt, Human
ucuguucuuucca

SEQ ID NO: 3077754 - RNA, 22 nt, Human
ucuguucuuuccaaaguacacu

SEQ ID NO: 3077755 - RNA, 17 nt, Human
ucuguuggccaguguga

SEQ ID NO: 3077756 - RNA, 12 nt, Human
ucuguuggccag

SEQ ID NO: 3077757 - RNA, 16 nt, Human
agacacauguccaaga

SEQ ID NO: 3077758 - RNA, 18 nt, Human
agacaccuugacagggca

SEQ ID NO: 3077759 - RNA, 17 nt, Human
agacaccuugacagggc

SEQ ID NO: 3077760 - RNA, 16 nt, Human
agacaggaccagggau

SEQ ID NO: 3077761 - RNA, 24 nt, Human
agacagagccccacccucagaugc

SEQ ID NO: 3077762 - RNA, 22 nt, Human
agacagagccccacccucagau

SEQ ID NO: 3077763 - RNA, 13 nt, Human
agacacaggcccg

SEQ ID NO: 3077764 - RNA, 12 nt, Human
agacacaggccc

SEQ ID NO: 3077765 - RNA, 12 nt, Human
agacacacauga

SEQ ID NO: 3077766 - RNA, 21 nt, Human
agaauuugauaugugaacagu

SEQ ID NO: 3077767 - RNA, 22 nt, Human
agaauuugauaugugaacaguu

SEQ ID NO: 3077768 - RNA, 14 nt, Human
agaauaaaauuuuu

SEQ ID NO: 3077769 - RNA, 12 nt, Human
agaauaaaauuu

SEQ ID NO: 3077770 - RNA, 17 nt, Human
agaauaaaauuuuuaau

SEQ ID NO: 3077771 - RNA, 13 nt, Human
agaauauguuuca

SEQ ID NO: 3077772 - RNA, 17 nt, Human
agaauauguuucaaacu

SEQ ID NO: 3077773 - RNA, 18 nt, Human
agaauauguuucaaacuu

SEQ ID NO: 3077774 - RNA, 19 nt, Human
agaauauguuucaaacuuu

SEQ ID NO: 3077775 - RNA, 21 nt, Human
agaauauguuucaaacuuugg

SEQ ID NO: 3077776 - RNA, 14 nt, Human
ucugcuuguguuaa

SEQ ID NO: 3077777 - RNA, 21 nt, Human
agaaguuucugccgcagcccu

SEQ ID NO: 3077778 - RNA, 22 nt, Human
agaaguuucugccgcagcccug

SEQ ID NO: 3077779 - RNA, 23 nt, Human
agaaguuucugccgcagcccugc

SEQ ID NO: 3077780 - RNA, 15 nt, Human
agaauuaacacauga

SEQ ID NO: 3077781 - RNA, 14 nt, Human
acuugcuuuuaaaa

SEQ ID NO: 3077782 - RNA, 19 nt, Human
acuuguauuauguguguuu

SEQ ID NO: 3077783 - RNA, 18 nt, Human
acuuguauuauguguguu

SEQ ID NO: 3077784 - RNA, 15 nt, Human
acuugucaauaaaau

SEQ ID NO: 3077785 - RNA, 15 nt, Human
acuuguauuaugugu

SEQ ID NO: 3077786 - RNA, 22 nt, Human
acuuguggacacagcucuucuc

SEQ ID NO: 3077787 - RNA, 19 nt, Human
acuuguggacacagcucuu

SEQ ID NO: 3077788 - RNA, 20 nt, Human
acuugucuuuggacccugag

SEQ ID NO: 3077789 - RNA, 18 nt, Human
acuugucuuuggacccug

SEQ ID NO: 3077790 - RNA, 21 nt, Human
acuugucuuuggacccugagg

SEQ ID NO: 3077791 - RNA, 18 nt, Human
acuugcucuugaugccug

SEQ ID NO: 3077792 - RNA, 17 nt, Human
acuugcucuugaugccu

SEQ ID NO: 3077793 - RNA, 20 nt, Human
acuugcucuugaugccuggc

SEQ ID NO: 3077794 - RNA, 14 nt, Human
acuugcucuugaug

SEQ ID NO: 3077795 - RNA, 16 nt, Human
acuugcucuugaugcc

SEQ ID NO: 3077796 - RNA, 23 nt, Human
acuugcagacucuacagaggcca

SEQ ID NO: 3077797 - RNA, 22 nt, Human
acuugcagacucuacagaggcc

SEQ ID NO: 3077798 - RNA, 19 nt, Human
acuugcagacucuacagag

SEQ ID NO: 3077799 - RNA, 23 nt, Human
ucucacuauguugcccaggcagg

SEQ ID NO: 3077800 - RNA, 22 nt, Human
ucucacuauguugcccaggcag

SEQ ID NO: 3077801 - RNA, 21 nt, Human
ucucacuauguugcccaggca

SEQ ID NO: 3077802 - RNA, 20 nt, Human
ucucacuauguugcccaggc

SEQ ID NO: 3077803 - RNA, 14 nt, Human
ucucauuugucaca

SEQ ID NO: 3077804 - RNA, 15 nt, Human
ucucauuuccaagca

SEQ ID NO: 3077805 - RNA, 15 nt, Human
ucuccaagcaggaca

SEQ ID NO: 3077806 - RNA, 16 nt, Human
ucuccaagcaggacau

SEQ ID NO: 3077807 - RNA, 16 nt, Human
ucucauuugucacaca

SEQ ID NO: 3077808 - RNA, 17 nt, Human
ucucaggccagcugcuu

SEQ ID NO: 3077809 - RNA, 18 nt, Human
ucucaggccagcugcuug

SEQ ID NO: 3077810 - RNA, 21 nt, Human
ucucaggccagcugcuugggc

SEQ ID NO: 3077811 - RNA, 12 nt, Human
ucucaggccagc

SEQ ID NO: 3077812 - RNA, 13 nt, Human
ucucaggccagcu

SEQ ID NO: 3077813 - RNA, 12 nt, Human
ucucaggccaaa

SEQ ID NO: 3077814 - RNA, 10 nt, Human
ucucaggcca

SEQ ID NO: 3077815 - RNA, 12 nt, Human
ucucaggaaauc

SEQ ID NO: 3077816 - RNA, 23 nt, Human
ucucaggaaaucaaauaugcaaa

SEQ ID NO: 3077817 - RNA, 21 nt, Human
ucucaggaaaucaaauaugca

SEQ ID NO: 3077818 - RNA, 14 nt, Human
ucucaggaaaucaa

SEQ ID NO: 3077819 - RNA, 15 nt, Human
acuuuggaacaagau

SEQ ID NO: 3077820 - RNA, 13 nt, Human
acuuugaccucug

SEQ ID NO: 3077821 - RNA, 12 nt, Human
acuuugaccucu

SEQ ID NO: 3077822 - RNA, 13 nt, Human
acuuuuguucuug

SEQ ID NO: 3077823 - RNA, 12 nt, Human
acuuuuguucuu

SEQ ID NO: 3077824 - RNA, 21 nt, Human
acuuuguuaguuucuccaagc

SEQ ID NO: 3077825 - RNA, 14 nt, Human
acuuuguucuggcu

SEQ ID NO: 3077826 - RNA, 20 nt, Human
acuuuguuaguuucuccaag

SEQ ID NO: 3077827 - RNA, 18 nt, Human
acuuuguguucaccuugu

SEQ ID NO: 3077828 - RNA, 21 nt, Human
ucuccuuguguuacuaaguuu

SEQ ID NO: 3077829 - RNA, 13 nt, Human
ucuccuuguguua

SEQ ID NO: 3077830 - RNA, 16 nt, Human
ucuccuucaccuuugu

SEQ ID NO: 3077831 - RNA, 14 nt, Human
ucuccuucaccuuu

SEQ ID NO: 3077832 - RNA, 15 nt, Human
ucuccuucaccuuug

SEQ ID NO: 3077833 - RNA, 17 nt, Human
agaaaaaauauuuuccc

SEQ ID NO: 3077834 - RNA, 23 nt, Human
acuuuuguucuugguuuguaaau

SEQ ID NO: 3077835 - RNA, 15 nt, Human
acuuuuguucuuggu

SEQ ID NO: 3077836 - RNA, 23 nt, Human
ucuccgaccagacaccuugacag

SEQ ID NO: 3077837 - RNA, 17 nt, Human
ucuccgaccagacaccu

SEQ ID NO: 3077838 - RNA, 21 nt, Human
ucucccuuggauuguccccga

SEQ ID NO: 3077839 - RNA, 23 nt, Human
ucuccccagcaagugagagcugg

SEQ ID NO: 3077840 - RNA, 18 nt, Human
ucuccaagcaggacaugg

SEQ ID NO: 3077841 - RNA, 19 nt, Human
ucuccaagcaggacaugga

SEQ ID NO: 3077842 - RNA, 12 nt, Human
acuuuaccuuuu

SEQ ID NO: 3077843 - RNA, 20 nt, Human
acuuucugaaauaacauggc

SEQ ID NO: 3077844 - RNA, 14 nt, Human
acuuucugaaauaa

SEQ ID NO: 3077845 - RNA, 17 nt, Human
ucuccucugcugcuggc

SEQ ID NO: 3077846 - RNA, 18 nt, Human
ucuccucugcugcuggcu

SEQ ID NO: 3077847 - RNA, 15 nt, Human
ucuccucugcugcug

SEQ ID NO: 3077848 - RNA, 16 nt, Human
ucuccucugcugcugg

SEQ ID NO: 3077849 - RNA, 15 nt, Human
ucuccuccagaguca

SEQ ID NO: 3077850 - RNA, 23 nt, Human
acuuaacuauucaggagaguaga

SEQ ID NO: 3077851 - RNA, 20 nt, Human
acuuaaauaaugugaaacug

SEQ ID NO: 3077852 - RNA, 16 nt, Human
acuuacacuuuaugca

SEQ ID NO: 3077853 - RNA, 22 nt, Human
acuuaaucuaaauggaaccacu

SEQ ID NO: 3077854 - RNA, 19 nt, Human
acuuaaucuaaauggaacc

SEQ ID NO: 3077855 - RNA, 17 nt, Human
acuuaaucuaaauggaa

SEQ ID NO: 3077856 - RNA, 13 nt, Human
acuuaagcacacu

SEQ ID NO: 3077857 - RNA, 16 nt, Human
acuuacuguacaugaa

SEQ ID NO: 3077858 - RNA, 21 nt, Human
acuuacuguacaugaaaacac

SEQ ID NO: 3077859 - RNA, 17 nt, Human
acuuacacuuuaugcac

SEQ ID NO: 3077860 - RNA, 22 nt, Human
acuuacuguacaugaaaacaca

SEQ ID NO: 3077861 - RNA, 15 nt, Human
acuuagguguggggg

SEQ ID NO: 3077862 - RNA, 18 nt, Human
uccugggagugagcuggu

SEQ ID NO: 3077863 - RNA, 19 nt, Human
ucuaaguaaaaccacagca

SEQ ID NO: 3077864 - RNA, 15 nt, Human
ucuaaguaaaaccac

SEQ ID NO: 3077865 - RNA, 14 nt, Human
ucuaaguaaaacca

SEQ ID NO: 3077866 - RNA, 16 nt, Human
ucuacagaggccaugg

SEQ ID NO: 3077867 - RNA, 19 nt, Human
ucuacccagcgagcccugg

SEQ ID NO: 3077868 - RNA, 21 nt, Human
ucuacagaggccaugggccuc

SEQ ID NO: 3077869 - RNA, 14 nt, Human
ucuacccuggcacu

SEQ ID NO: 3077870 - RNA, 19 nt, Human
ucuacccuggcacuauaau

SEQ ID NO: 3077871 - RNA, 14 nt, Human
ucuacccaggugcu

SEQ ID NO: 3077872 - RNA, 20 nt, Human
ucuacccagcgagcccuggu

SEQ ID NO: 3077873 - RNA, 21 nt, Human
ucuacccuggcacuauaaugu

SEQ ID NO: 3077874 - RNA, 16 nt, Human
acuguucucugcccuc

SEQ ID NO: 3077875 - RNA, 17 nt, Human
acuguucucugcccucc

SEQ ID NO: 3077876 - RNA, 18 nt, Human
acuguucucugcccucca

SEQ ID NO: 3077877 - RNA, 15 nt, Human
acuguucucugcccu

SEQ ID NO: 3077878 - RNA, 21 nt, Human
ucuagcauggcauauuuuuca

SEQ ID NO: 3077879 - RNA, 22 nt, Human
ucuagcauggcauauuuuucac

SEQ ID NO: 3077880 - RNA, 23 nt, Human
ucuagcauggcauauuuuucaca

SEQ ID NO: 3077881 - RNA, 18 nt, Human
ucuagcauggcugccaau

SEQ ID NO: 3077882 - RNA, 22 nt, Human
ucuaguuguuugauucagacag

SEQ ID NO: 3077883 - RNA, 12 nt, Human
ucuaggaagacu

SEQ ID NO: 3077884 - RNA, 16 nt, Human
ucuaggaaauauuuau

SEQ ID NO: 3077885 - RNA, 17 nt, Human
ucuaggaaauauuuauu

SEQ ID NO: 3077886 - RNA, 21 nt, Human
ucuaguuugauuaaauucuug

SEQ ID NO: 3077887 - RNA, 23 nt, Human
ucuaguuguuugauucagacagc

SEQ ID NO: 3077888 - RNA, 13 nt, Human
ucuauaaaccgaa

SEQ ID NO: 3077889 - RNA, 16 nt, Human
ucucacuauguugccc

SEQ ID NO: 3077890 - RNA, 19 nt, Human
ucucacuauguugcccagg

SEQ ID NO: 3077891 - RNA, 17 nt, Human
ucucacuauguugccca

SEQ ID NO: 3077892 - RNA, 23 nt, Human
ucuaugggacucaaugcacugac

SEQ ID NO: 3077893 - RNA, 13 nt, Human
accuuuuuuauac

SEQ ID NO: 3077894 - RNA, 20 nt, Human
accuuuuggucuggagggaa

SEQ ID NO: 3077895 - RNA, 21 nt, Human
uccacugugccaugugccagg

SEQ ID NO: 3077896 - RNA, 22 nt, Human
uccacugguucuucuuggucuc

SEQ ID NO: 3077897 - RNA, 22 nt, Human
accuuuguuugcaucugaaaau

SEQ ID NO: 3077898 - RNA, 18 nt, Human
accuuuggagcaaagcug

SEQ ID NO: 3077899 - RNA, 18 nt, Human
accuuuguccccaccgca

SEQ ID NO: 3077900 - RNA, 18 nt, Human
accuuugacaaagguaaa

SEQ ID NO: 3077901 - RNA, 17 nt, Human
accuuugacaaagguaa

SEQ ID NO: 3077902 - RNA, 17 nt, Human
accuuuguccccaccgc

SEQ ID NO: 3077903 - RNA, 20 nt, Human
accuugaacuggguacuugu

SEQ ID NO: 3077904 - RNA, 19 nt, Human
accuugaaaacuuuaugcu

SEQ ID NO: 3077905 - RNA, 20 nt, Human
uccagccugcugccugcuuu

SEQ ID NO: 3077906 - RNA, 14 nt, Human
uccagaauuuccca

SEQ ID NO: 3077907 - RNA, 15 nt, Human
uccagaauuucccaa

SEQ ID NO: 3077908 - RNA, 13 nt, Human
uccagacacaugu

SEQ ID NO: 3077909 - RNA, 20 nt, Human
uccaggcugggagagccuuc

SEQ ID NO: 3077910 - RNA, 21 nt, Human
uccaggcugggagagccuucc

SEQ ID NO: 3077911 - RNA, 12 nt, Human
uccaggcuccuu

SEQ ID NO: 3077912 - RNA, 10 nt, Human
uccaggcucc

SEQ ID NO: 3077913 - RNA, 23 nt, Human
uccaggcugggagagccuuccag

SEQ ID NO: 3077914 - RNA, 22 nt, Human
accuuuuuuauacauaaacaag

SEQ ID NO: 3077915 - RNA, 15 nt, Human
acgaauauugcugau

SEQ ID NO: 3077916 - RNA, 18 nt, Human
acgaauauugcugauggu

SEQ ID NO: 3077917 - RNA, 13 nt, Human
acgcuggaccuug

SEQ ID NO: 3077918 - RNA, 11 nt, Human
acgcucucugg

SEQ ID NO: 3077919 - RNA, 16 nt, Human
acgcuggagugcagug

SEQ ID NO: 3077920 - RNA, 15 nt, Human
acgcuggagugcagu

SEQ ID NO: 3077921 - RNA, 23 nt, Human
acgcuggaccuugaacuggguac

SEQ ID NO: 3077922 - RNA, 20 nt, Human
acgcuggaccuugaacuggg

SEQ ID NO: 3077923 - RNA, 17 nt, Human
acgcuggagugcaguga

SEQ ID NO: 3077924 - RNA, 21 nt, Human
acggagucccaccuuggcugc

SEQ ID NO: 3077925 - RNA, 23 nt, Human
acggagucccaccuuggcugcag

SEQ ID NO: 3077926 - RNA, 21 nt, Human
acgaauauugcugauggugca

SEQ ID NO: 3077927 - RNA, 14 nt, Human
acgaauauugcuga

SEQ ID NO: 3077928 - RNA, 21 nt, Human
acgcuacccgggaagggggcu

SEQ ID NO: 3077929 - RNA, 18 nt, Human
acgcuacccgggaagggg

SEQ ID NO: 3077930 - RNA, 12 nt, Human
acggccaggcca

SEQ ID NO: 3077931 - RNA, 18 nt, Human
acggcucacugcagccuc

SEQ ID NO: 3077932 - RNA, 17 nt, Human
acggcucacugcagccu

SEQ ID NO: 3077933 - RNA, 15 nt, Human
acggcucacugcagc

SEQ ID NO: 3077934 - RNA, 16 nt, Human
acggcucacugcagcc

SEQ ID NO: 3077935 - RNA, 18 nt, Human
acggcuuuuacuuaaacc

SEQ ID NO: 3077936 - RNA, 14 nt, Human
uccaguaucuugaa

SEQ ID NO: 3077937 - RNA, 15 nt, Human
uccaguaucuugaag

SEQ ID NO: 3077938 - RNA, 15 nt, Human
uccagugaggcucug

SEQ ID NO: 3077939 - RNA, 18 nt, Human
uccagugagacagcucug

SEQ ID NO: 3077940 - RNA, 16 nt, Human
uccagugaggcucugc

SEQ ID NO: 3077941 - RNA, 22 nt, Human
uccagugaggcucugcccuugg

SEQ ID NO: 3077942 - RNA, 23 nt, Human
uccagugaggcucugcccuuggu

SEQ ID NO: 3077943 - RNA, 16 nt, Human
uccaguaucuugaaga

SEQ ID NO: 3077944 - RNA, 18 nt, Human
uccaguaucuugaagacu

SEQ ID NO: 3077945 - RNA, 15 nt, Human
acuaauuuuaaaaug

SEQ ID NO: 3077946 - RNA, 22 nt, Human
acguuucuaaaggcuaccuuug

SEQ ID NO: 3077947 - RNA, 16 nt, Human
ucccagauacuugggg

SEQ ID NO: 3077948 - RNA, 12 nt, Human
ucccagccccaa

SEQ ID NO: 3077949 - RNA, 18 nt, Human
ucccagauacuugggggg

SEQ ID NO: 3077950 - RNA, 17 nt, Human
acgguuuuacugcagcu

SEQ ID NO: 3077951 - RNA, 12 nt, Human
uccauccugagg

SEQ ID NO: 3077952 - RNA, 15 nt, Human
uccauccugaggcuc

SEQ ID NO: 3077953 - RNA, 11 nt, Human
uccauccugag

SEQ ID NO: 3077954 - RNA, 13 nt, Human
acguugugcauuu

SEQ ID NO: 3077955 - RNA, 15 nt, Human
acguugugcauuugg

SEQ ID NO: 3077956 - RNA, 14 nt, Human
acguugugcauuug

SEQ ID NO: 3077957 - RNA, 16 nt, Human
acguuucuaaaggcua

SEQ ID NO: 3077958 - RNA, 15 nt, Human
acguuucuaaaggcu

SEQ ID NO: 3077959 - RNA, 17 nt, Human
acguggcugcuucaagg

SEQ ID NO: 3077960 - RNA, 18 nt, Human
acguggcugcuucaagga

SEQ ID NO: 3077961 - RNA, 19 nt, Human
acguggcugcuucaaggau

SEQ ID NO: 3077962 - RNA, 21 nt, Human
acguggcugcuucaaggaucc

SEQ ID NO: 3077963 - RNA, 21 nt, Human
acuaucuaaauguugaaagau

SEQ ID NO: 3077964 - RNA, 16 nt, Human
acuaucuaaauguuga

SEQ ID NO: 3077965 - RNA, 15 nt, Human
acuaucucauuucca

SEQ ID NO: 3077966 - RNA, 16 nt, Human
acuaucucauuuccaa

SEQ ID NO: 3077967 - RNA, 17 nt, Human
acuaucucauuuccaag

SEQ ID NO: 3077968 - RNA, 18 nt, Human
acuauagccuaggugaca

SEQ ID NO: 3077969 - RNA, 17 nt, Human
acuauauuguuugcuaa

SEQ ID NO: 3077970 - RNA, 22 nt, Human
acuauauuguuugcuaagcauu

SEQ ID NO: 3077971 - RNA, 22 nt, Human
acuauagccuaggugacagagu

SEQ ID NO: 3077972 - RNA, 20 nt, Human
acuauagccuaggugacaga

SEQ ID NO: 3077973 - RNA, 16 nt, Human
acucaaugcacugaca

SEQ ID NO: 3077974 - RNA, 16 nt, Human
acuauguugcccaggc

SEQ ID NO: 3077975 - RNA, 15 nt, Human
acuauguugcccagg

SEQ ID NO: 3077976 - RNA, 22 nt, Human
acuauggcccuggccuagcaua

SEQ ID NO: 3077977 - RNA, 14 nt, Human
acuauguugcccag

SEQ ID NO: 3077978 - RNA, 23 nt, Human
uccccacccugaaagcccugagc

SEQ ID NO: 3077979 - RNA, 15 nt, Human
uccccaccgcagaca

SEQ ID NO: 3077980 - RNA, 16 nt, Human
uccccaccgcagacag

SEQ ID NO: 3077981 - RNA, 18 nt, Human
uccccaggaggccagccu

SEQ ID NO: 3077982 - RNA, 12 nt, Human
uccccacccuga

SEQ ID NO: 3077983 - RNA, 17 nt, Human
uccccaggaggccagcc

SEQ ID NO: 3077984 - RNA, 20 nt, Human
uccccaggaggccagccuug

SEQ ID NO: 3077985 - RNA, 21 nt, Human
uccccaggaggccagccuuga

SEQ ID NO: 3077986 - RNA, 11 nt, Human
ucccccagccc

SEQ ID NO: 3077987 - RNA, 13 nt, Human
ucccccagcccca

SEQ ID NO: 3077988 - RNA, 15 nt, Human
ucccccagccccauc

SEQ ID NO: 3077989 - RNA, 16 nt, Human
ucccccagccccaucc

SEQ ID NO: 3077990 - RNA, 21 nt, Human
acucuugaaaaaugcauguug

SEQ ID NO: 3077991 - RNA, 14 nt, Human
acucuugaccucag

SEQ ID NO: 3077992 - RNA, 16 nt, Human
acucuuauaucuauau

SEQ ID NO: 3077993 - RNA, 17 nt, Human
acucuuauaucuauauu

SEQ ID NO: 3077994 - RNA, 18 nt, Human
acucuuauaucuauauuu

SEQ ID NO: 3077995 - RNA, 21 nt, Human
acucuuaagaagacugcauua

SEQ ID NO: 3077996 - RNA, 16 nt, Human
acucuugaccucaggu

SEQ ID NO: 3077997 - RNA, 15 nt, Human
acucuugaccucagg

SEQ ID NO: 3077998 - RNA, 19 nt, Human
acucuuauaucuauauuuu

SEQ ID NO: 3077999 - RNA, 22 nt, Human
uccucauacccacccccaccca

SEQ ID NO: 3078000 - RNA, 22 nt, Human
uccucauaguaugguggcuggg

SEQ ID NO: 3078001 - RNA, 23 nt, Human
uccucauacccacccccacccaa

SEQ ID NO: 3078002 - RNA, 23 nt, Human
acuccuugaaaacacuguucucu

SEQ ID NO: 3078003 - RNA, 24 nt, Human
acuccuugaaaacacuguucucug

SEQ ID NO: 3078004 - RNA, 14 nt, Human
acucuccuccagag

SEQ ID NO: 3078005 - RNA, 17 nt, Human
acucuccuccagaguca

SEQ ID NO: 3078006 - RNA, 18 nt, Human
acucuccuggaaauauua

SEQ ID NO: 3078007 - RNA, 15 nt, Human
acucuccuugguguc

SEQ ID NO: 3078008 - RNA, 21 nt, Human
acucuccucugcugcuggcug

SEQ ID NO: 3078009 - RNA, 13 nt, Human
acucuccucugcu

SEQ ID NO: 3078010 - RNA, 14 nt, Human
acucuccucugcug

SEQ ID NO: 3078011 - RNA, 12 nt, Human
acucuccucugc

SEQ ID NO: 3078012 - RNA, 13 nt, Human
acucuggcagcuc

SEQ ID NO: 3078013 - RNA, 15 nt, Human
acucuggcagcucag

SEQ ID NO: 3078014 - RNA, 16 nt, Human
acucuccuuggugucg

SEQ ID NO: 3078015 - RNA, 23 nt, Human
acucuccuuggugucgggcauga

SEQ ID NO: 3078016 - RNA, 11 nt, Human
acucugagacu

SEQ ID NO: 3078017 - RNA, 22 nt, Human
acucugagacucgcgacaaugc

SEQ ID NO: 3078018 - RNA, 13 nt, Human
ucccuuuuuuuaa

SEQ ID NO: 3078019 - RNA, 23 nt, Human
ucccuuuuuuggcugcugaaggc

SEQ ID NO: 3078020 - RNA, 20 nt, Human
ucccuuuuuuggcugcugaa

SEQ ID NO: 3078021 - RNA, 22 nt, Human
ucccuuuuuuggcugcugaagg

SEQ ID NO: 3078022 - RNA, 19 nt, Human
ucccuuugacgccauccca

SEQ ID NO: 3078023 - RNA, 17 nt, Human
ucccuuuuuuggcugcu

SEQ ID NO: 3078024 - RNA, 19 nt, Human
ucccuuuuuuggcugcuga

SEQ ID NO: 3078025 - RNA, 22 nt, Human
ucccugguggcagcucaccucu

SEQ ID NO: 3078026 - RNA, 19 nt, Human
ucccuuggauuguccccga

SEQ ID NO: 3078027 - RNA, 20 nt, Human
ucccuuggauuguccccgac

SEQ ID NO: 3078028 - RNA, 16 nt, Human
ucccuuugacgccauc

SEQ ID NO: 3078029 - RNA, 18 nt, Human
ucccuuugacgccauccc

SEQ ID NO: 3078030 - RNA, 21 nt, Human
ucccuuuuuuuaaguaaggaa

SEQ ID NO: 3078031 - RNA, 16 nt, Human
ucccuuuuuuuaagua

SEQ ID NO: 3078032 - RNA, 14 nt, Human
uccuacucuguguc

SEQ ID NO: 3078033 - RNA, 13 nt, Human
uccuacucugugu

SEQ ID NO: 3078034 - RNA, 12 nt, Human
uccuacucugug

SEQ ID NO: 3078035 - RNA, 15 nt, Human
uccuacucuguguca

SEQ ID NO: 3078036 - RNA, 20 nt, Human
uccuaggacccgucuccagc

SEQ ID NO: 3078037 - RNA, 14 nt, Human
acuccuggccucaa

SEQ ID NO: 3078038 - RNA, 13 nt, Human
acuccuggccuca

SEQ ID NO: 3078039 - RNA, 13 nt, Human
uccuaggcauuug

SEQ ID NO: 3078040 - RNA, 12 nt, Human
acuccuggccuc

SEQ ID NO: 3078041 - RNA, 14 nt, Human
acucaccccagccc

SEQ ID NO: 3078042 - RNA, 15 nt, Human
acucaccccagcccc

SEQ ID NO: 3078043 - RNA, 16 nt, Human
acucaccccagcccca

SEQ ID NO: 3078044 - RNA, 13 nt, Human
acucaccccagcc

SEQ ID NO: 3078045 - RNA, 19 nt, Human
acuccagugagacagcucu

SEQ ID NO: 3078046 - RNA, 18 nt, Human
ucccugguggcagcucac

SEQ ID NO: 3078047 - RNA, 19 nt, Human
ucccugguggcagcucacc

SEQ ID NO: 3078048 - RNA, 20 nt, Human
ucccugguggcagcucaccu

SEQ ID NO: 3078049 - RNA, 21 nt, Human
ucccugguggcagcucaccuc

SEQ ID NO: 3078050 - RNA, 16 nt, Human
ucccugguggcagcuc

SEQ ID NO: 3078051 - RNA, 17 nt, Human
ucccugguggcagcuca

SEQ ID NO: 3078052 - RNA, 11 nt, Human
acuccuggccu

SEQ ID NO: 3078053 - RNA, 15 nt, Human
acuccugcaggcagc

SEQ ID NO: 3078054 - RNA, 16 nt, Human
acuccugcaggcagcc

SEQ ID NO: 3078055 - RNA, 22 nt, Human
acuccugcaggcagccaggcca

SEQ ID NO: 3078056 - RNA, 12 nt, Human
acuccugcaggc

SEQ ID NO: 3078057 - RNA, 14 nt, Human
acuccugcaggcag

SEQ ID NO: 3078058 - RNA, 15 nt, Human
acucuuguuuccuua

SEQ ID NO: 3078059 - RNA, 22 nt, Human
uccucuuuggucuacacugugc

SEQ ID NO: 3078060 - RNA, 22 nt, Human
uccugaaaacccuugccaugug

SEQ ID NO: 3078061 - RNA, 12 nt, Human
uccucuuuccau

SEQ ID NO: 3078062 - RNA, 11 nt, Human
uccucuuucca

SEQ ID NO: 3078063 - RNA, 14 nt, Human
uccucccucccucu

SEQ ID NO: 3078064 - RNA, 11 nt, Human
uccucccuccc

SEQ ID NO: 3078065 - RNA, 19 nt, Human
uccucuuuggucuacacug

SEQ ID NO: 3078066 - RNA, 21 nt, Human
uccucuuuggucuacacugug

SEQ ID NO: 3078067 - RNA, 19 nt, Human
uccucuuuccaucuacccu

SEQ ID NO: 3078068 - RNA, 21 nt, Human
acugagaaauuuauaaacuuu

SEQ ID NO: 3078069 - RNA, 17 nt, Human
acugagaaauuuauaaa

SEQ ID NO: 3078070 - RNA, 12 nt, Human
acugagaaauuu

SEQ ID NO: 3078071 - RNA, 15 nt, Human
acugagacagcccgg

SEQ ID NO: 3078072 - RNA, 18 nt, Human
acugagacagcccgggcu

SEQ ID NO: 3078073 - RNA, 21 nt, Human
acugagacagcccgggcucug

SEQ ID NO: 3078074 - RNA, 22 nt, Human
acugagacagcccgggcucugc

SEQ ID NO: 3078075 - RNA, 23 nt, Human
acugagacagcccgggcucugcc

SEQ ID NO: 3078076 - RNA, 18 nt, Human
acugagagugaacaaauu

SEQ ID NO: 3078077 - RNA, 22 nt, Human
acugagaugugaacacaucagc

SEQ ID NO: 3078078 - RNA, 17 nt, Human
acugagaugugaacaca

SEQ ID NO: 3078079 - RNA, 13 nt, Human
acugacucuuaag

SEQ ID NO: 3078080 - RNA, 14 nt, Human
acugacucuuaaga

SEQ ID NO: 3078081 - RNA, 15 nt, Human
acugacucuuaagaa

SEQ ID NO: 3078082 - RNA, 16 nt, Human
acugacucuuaagaag

SEQ ID NO: 3078083 - RNA, 22 nt, Human
acugacuucuaaguaaaaccac

SEQ ID NO: 3078084 - RNA, 16 nt, Human
acugacuucuaaguaa

SEQ ID NO: 3078085 - RNA, 15 nt, Human
acugacuucuaagua

SEQ ID NO: 3078086 - RNA, 13 nt, Human
acugacuucuaag

SEQ ID NO: 3078087 - RNA, 17 nt, Human
acugacucuuaagaaga

SEQ ID NO: 3078088 - RNA, 18 nt, Human
acugacucuuaagaagac

SEQ ID NO: 3078089 - RNA, 20 nt, Human
acugacucuuaagaagacug

SEQ ID NO: 3078090 - RNA, 23 nt, Human
uccuggaagugcuaauuuugaaa

SEQ ID NO: 3078091 - RNA, 22 nt, Human
uccuggaauaucuccgucaacu

SEQ ID NO: 3078092 - RNA, 15 nt, Human
uccuggaaauauuaa

SEQ ID NO: 3078093 - RNA, 16 nt, Human
uccuggaaaucagggu

SEQ ID NO: 3078094 - RNA, 17 nt, Human
uccugggagugagcugg

SEQ ID NO: 3078095 - RNA, 14 nt, Human
uccugggagugagc

SEQ ID NO: 3078096 - RNA, 12 nt, Human
uccugggaguga

SEQ ID NO: 3078097 - RNA, 15 nt, Human
uccugggagcuuuug

SEQ ID NO: 3078098 - RNA, 21 nt, Human
uccugcugcaguugccaguca

SEQ ID NO: 3078099 - RNA, 12 nt, Human
uccugcaggcag

SEQ ID NO: 3078100 - RNA, 13 nt, Human
uccugcaggcagc

SEQ ID NO: 3078101 - RNA, 14 nt, Human
uccugcaggcagcc

SEQ ID NO: 3078102 - RNA, 21 nt, Human
uccugccucgaacuggcugca

SEQ ID NO: 3078103 - RNA, 20 nt, Human
uccugaugcuucuucagaga

SEQ ID NO: 3078104 - RNA, 21 nt, Human
uccugaugcuucuucagagac

SEQ ID NO: 3078105 - RNA, 19 nt, Human
uccugaugcuucuucagag

SEQ ID NO: 3078106 - RNA, 19 nt, Human
acugcacuccagccugggu

SEQ ID NO: 3078107 - RNA, 20 nt, Human
acugcacuccagccugggug

SEQ ID NO: 3078108 - RNA, 18 nt, Human
acugcacuccagccuggg

SEQ ID NO: 3078109 - RNA, 17 nt, Human
acugcacuccagccugg

SEQ ID NO: 3078110 - RNA, 14 nt, Human
acugcacuccagcc

SEQ ID NO: 3078111 - RNA, 21 nt, Human
acugcacuauagccuagguga

SEQ ID NO: 3078112 - RNA, 20 nt, Human
acugcacuauagccuaggug

SEQ ID NO: 3078113 - RNA, 16 nt, Human
acugcaccgggccaca

SEQ ID NO: 3078114 - RNA, 14 nt, Human
acugcaccgggcca

SEQ ID NO: 3078115 - RNA, 21 nt, Human
acugauaaagaugagugagca

SEQ ID NO: 3078116 - RNA, 13 nt, Human
acugauaaagaug

SEQ ID NO: 3078117 - RNA, 19 nt, Human
acauucuuccaaaaagauu

SEQ ID NO: 3078118 - RNA, 23 nt, Human
ucaaugaaugaaugaauggcuaa

SEQ ID NO: 3078119 - RNA, 19 nt, Human
ucaauauuucagauaauca

SEQ ID NO: 3078120 - RNA, 15 nt, Human
ucaauauuucagaua

SEQ ID NO: 3078121 - RNA, 18 nt, Human
ucaauauccaaaccaaau

SEQ ID NO: 3078122 - RNA, 22 nt, Human
ucaauaucuuuuuuuuaauaaa

SEQ ID NO: 3078123 - RNA, 17 nt, Human
ucaagaaaacaacuuca

SEQ ID NO: 3078124 - RNA, 22 nt, Human
ucaaguccucuuuucugagagg

SEQ ID NO: 3078125 - RNA, 19 nt, Human
acauuguacgaagaguauu

SEQ ID NO: 3078126 - RNA, 20 nt, Human
acauuuuauuuuauuaugca

SEQ ID NO: 3078127 - RNA, 19 nt, Human
acauuuuauuuuauuaugc

SEQ ID NO: 3078128 - RNA, 14 nt, Human
acauuuuauuuuau

SEQ ID NO: 3078129 - RNA, 18 nt, Human
acauuuuauuuuauuaug

SEQ ID NO: 3078130 - RNA, 19 nt, Human
acauuuuuaagugcugcau

SEQ ID NO: 3078131 - RNA, 23 nt, Human
acauuuuuaagugcugcauuuaa

SEQ ID NO: 3078132 - RNA, 22 nt, Human
acauuuuuaagugcugcauuua

SEQ ID NO: 3078133 - RNA, 21 nt, Human
acauuuuuaagugcugcauuu

SEQ ID NO: 3078134 - RNA, 16 nt, Human
acauuuuuuaaaugca

SEQ ID NO: 3078135 - RNA, 14 nt, Human
acauuuuuuaaaug

SEQ ID NO: 3078136 - RNA, 17 nt, Human
acauuuuuuaaaugcac

SEQ ID NO: 3078137 - RNA, 23 nt, Human
accaaaaaucucaauauuucaga

SEQ ID NO: 3078138 - RNA, 20 nt, Human
acaugaauauuuaguguuca

SEQ ID NO: 3078139 - RNA, 16 nt, Human
acaugaaguccaagca

SEQ ID NO: 3078140 - RNA, 16 nt, Human
acaugagguacugaga

SEQ ID NO: 3078141 - RNA, 20 nt, Human
acaugagguacugagaguga

SEQ ID NO: 3078142 - RNA, 21 nt, Human
acaugcuacacacugcauguu

SEQ ID NO: 3078143 - RNA, 15 nt, Human
acaugcuacacacug

SEQ ID NO: 3078144 - RNA, 23 nt, Human
acaugagguacugagagugaaca

SEQ ID NO: 3078145 - RNA, 22 nt, Human
acauguaauuaaguacuaugua

SEQ ID NO: 3078146 - RNA, 21 nt, Human
acauguaauuaaguacuaugu

SEQ ID NO: 3078147 - RNA, 19 nt, Human
acauguaauuaaguacuau

SEQ ID NO: 3078148 - RNA, 17 nt, Human
acauguaauuaaguacu

SEQ ID NO: 3078149 - RNA, 15 nt, Human
acauguaauuaagua

SEQ ID NO: 3078150 - RNA, 22 nt, Human
acauggcuggagcuagaauuug

SEQ ID NO: 3078151 - RNA, 11 nt, Human
acaugggacau

SEQ ID NO: 3078152 - RNA, 14 nt, Human
acaugggacauuug

SEQ ID NO: 3078153 - RNA, 21 nt, Human
acaugggacauuugcucaugg

SEQ ID NO: 3078154 - RNA, 15 nt, Human
acaugggacauuugc

SEQ ID NO: 3078155 - RNA, 20 nt, Human
acaugggacauuugcucaug

SEQ ID NO: 3078156 - RNA, 14 nt, Human
ucaaccagcagaug

SEQ ID NO: 3078157 - RNA, 20 nt, Human
ucaacugcaucaagauguga

SEQ ID NO: 3078158 - RNA, 13 nt, Human
ucaaauuucuaaa

SEQ ID NO: 3078159 - RNA, 14 nt, Human
acauuccugaugcu

SEQ ID NO: 3078160 - RNA, 14 nt, Human
acauuccugaacag

SEQ ID NO: 3078161 - RNA, 15 nt, Human
acauuccugaacagg

SEQ ID NO: 3078162 - RNA, 15 nt, Human
ucaaauugugugaaa

SEQ ID NO: 3078163 - RNA, 18 nt, Human
ucaaauugugugaaaggu

SEQ ID NO: 3078164 - RNA, 23 nt, Human
acauguaauuaaguacuauguau

SEQ ID NO: 3078165 - RNA, 15 nt, Human
acauguccaagaagc

SEQ ID NO: 3078166 - RNA, 16 nt, Human
ucacaguucucuccuu

SEQ ID NO: 3078167 - RNA, 20 nt, Human
ucacaguucucuccuucuuc

SEQ ID NO: 3078168 - RNA, 13 nt, Human
ucacagccucuga

SEQ ID NO: 3078169 - RNA, 20 nt, Human
ucacagaugggugcuuggag

SEQ ID NO: 3078170 - RNA, 16 nt, Human
ucaauucuugccaaau

SEQ ID NO: 3078171 - RNA, 17 nt, Human
ucacaaaggaugcccaa

SEQ ID NO: 3078172 - RNA, 21 nt, Human
ucacaacagauuauuaccuua

SEQ ID NO: 3078173 - RNA, 14 nt, Human
ucacauaucuagua

SEQ ID NO: 3078174 - RNA, 24 nt, Human
accacauuggagauguuuaguaau

SEQ ID NO: 3078175 - RNA, 16 nt, Human
accacaucuugcucug

SEQ ID NO: 3078176 - RNA, 18 nt, Human
accacaugugcacaugca

SEQ ID NO: 3078177 - RNA, 20 nt, Human
accaccacacccagcccacu

SEQ ID NO: 3078178 - RNA, 15 nt, Human
accaccacacccagc

SEQ ID NO: 3078179 - RNA, 19 nt, Human
accacaucuugcucugcug

SEQ ID NO: 3078180 - RNA, 18 nt, Human
accacaucuugcucugcu

SEQ ID NO: 3078181 - RNA, 17 nt, Human
accacaucuugcucugc

SEQ ID NO: 3078182 - RNA, 15 nt, Human
accacuacauucugu

SEQ ID NO: 3078183 - RNA, 16 nt, Human
accacuacauucuguu

SEQ ID NO: 3078184 - RNA, 17 nt, Human
accacuacauucuguua

SEQ ID NO: 3078185 - RNA, 22 nt, Human
accagcgugugacuacuccccc

SEQ ID NO: 3078186 - RNA, 14 nt, Human
ucaccucauggaau

SEQ ID NO: 3078187 - RNA, 12 nt, Human
ucaccucaugga

SEQ ID NO: 3078188 - RNA, 13 nt, Human
ucaccucauggaa

SEQ ID NO: 3078189 - RNA, 17 nt, Human
ucacugagacagcccgg

SEQ ID NO: 3078190 - RNA, 21 nt, Human
ucacugagacagcccgggcuc

SEQ ID NO: 3078191 - RNA, 22 nt, Human
ucacugagacagcccgggcucu

SEQ ID NO: 3078192 - RNA, 14 nt, Human
ucacugcagccuca

SEQ ID NO: 3078193 - RNA, 16 nt, Human
ucacugagacagcccg

SEQ ID NO: 3078194 - RNA, 13 nt, Human
ucacugcagccuc

SEQ ID NO: 3078195 - RNA, 15 nt, Human
ucacugcagccucaa

SEQ ID NO: 3078196 - RNA, 19 nt, Human
ucacuguugcccaggcugg

SEQ ID NO: 3078197 - RNA, 23 nt, Human
ucacuguugcccaggcuggcgug

SEQ ID NO: 3078198 - RNA, 17 nt, Human
accaguguuguggauuu

SEQ ID NO: 3078199 - RNA, 15 nt, Human
accaguguuguggau

SEQ ID NO: 3078200 - RNA, 14 nt, Human
accagucugacugu

SEQ ID NO: 3078201 - RNA, 10 nt, Human
ucacuugagu

SEQ ID NO: 3078202 - RNA, 23 nt, Human
ucacuugaacccgggaggcagag

SEQ ID NO: 3078203 - RNA, 15 nt, Human
ucagcaaaagaugcu

SEQ ID NO: 3078204 - RNA, 21 nt, Human
ucagauuugaacucuucaauc

SEQ ID NO: 3078205 - RNA, 22 nt, Human
accauaagcuacugccauccug

SEQ ID NO: 3078206 - RNA, 12 nt, Human
ucagauuugaac

SEQ ID NO: 3078207 - RNA, 17 nt, Human
accauaagcuacugcca

SEQ ID NO: 3078208 - RNA, 18 nt, Human
accauaagcuacugccau

SEQ ID NO: 3078209 - RNA, 16 nt, Human
accauaagcuacugcc

SEQ ID NO: 3078210 - RNA, 13 nt, Human
accccagccccaa

SEQ ID NO: 3078211 - RNA, 22 nt, Human
accccagccccaaaacucuccu

SEQ ID NO: 3078212 - RNA, 17 nt, Human
accccacacacgccaga

SEQ ID NO: 3078213 - RNA, 23 nt, Human
acccaggagccccgaggccuucu

SEQ ID NO: 3078214 - RNA, 19 nt, Human
acccaggagccccgaggcc

SEQ ID NO: 3078215 - RNA, 13 nt, Human
ucagcccucagaa

SEQ ID NO: 3078216 - RNA, 14 nt, Human
ucagcccucagaau

SEQ ID NO: 3078217 - RNA, 14 nt, Human
accccugcuucuga

SEQ ID NO: 3078218 - RNA, 18 nt, Human
accccaucucuacaaaaa

SEQ ID NO: 3078219 - RNA, 12 nt, Human
ucagcucaugga

SEQ ID NO: 3078220 - RNA, 12 nt, Human
ucagcuccagcu

SEQ ID NO: 3078221 - RNA, 23 nt, Human
ucagcggggacagcuccuucugu

SEQ ID NO: 3078222 - RNA, 21 nt, Human
ucagcggggacagcuccuucu

SEQ ID NO: 3078223 - RNA, 20 nt, Human
ucagcggggacagcuccuuc

SEQ ID NO: 3078224 - RNA, 19 nt, Human
ucagcggggacagcuccuu

SEQ ID NO: 3078225 - RNA, 18 nt, Human
ucagcggggacagcuccu

SEQ ID NO: 3078226 - RNA, 19 nt, Human
ucagggucccugguggcag

SEQ ID NO: 3078227 - RNA, 16 nt, Human
ucaggguuggccccug

SEQ ID NO: 3078228 - RNA, 23 nt, Human
ucaggccaggcccucugcccacu

SEQ ID NO: 3078229 - RNA, 22 nt, Human
ucagcuuguaaauagcucaggu

SEQ ID NO: 3078230 - RNA, 21 nt, Human
ucagcuuguaaauagcucagg

SEQ ID NO: 3078231 - RNA, 14 nt, Human
ucagcuccagcuca

SEQ ID NO: 3078232 - RNA, 21 nt, Human
ucaggccaggcccucugccca

SEQ ID NO: 3078233 - RNA, 22 nt, Human
ucaggccaggcccucugcccac

SEQ ID NO: 3078234 - RNA, 20 nt, Human
ucaggccaggcccucugccc

SEQ ID NO: 3078235 - RNA, 12 nt, Human
acccgggaaggg

SEQ ID NO: 3078236 - RNA, 13 nt, Human
acccgggaagggg

SEQ ID NO: 3078237 - RNA, 15 nt, Human
acccgggaggcagag

SEQ ID NO: 3078238 - RNA, 17 nt, Human
acccgggaggcagaggu

SEQ ID NO: 3078239 - RNA, 20 nt, Human
acccggccccugcugguuca

SEQ ID NO: 3078240 - RNA, 17 nt, Human
acccggccccugcuggu

SEQ ID NO: 3078241 - RNA, 22 nt, Human
acccggccccugcugguucagg

SEQ ID NO: 3078242 - RNA, 16 nt, Human
acccggccccugcugg

SEQ ID NO: 3078243 - RNA, 15 nt, Human
acccggccccugcug

SEQ ID NO: 3078244 - RNA, 14 nt, Human
acccggccccugcu

SEQ ID NO: 3078245 - RNA, 22 nt, Human
ucagguaacaggcagauacagg

SEQ ID NO: 3078246 - RNA, 21 nt, Human
ucagguaacaggcagauacag

SEQ ID NO: 3078247 - RNA, 23 nt, Human
ucagguaacaggcagauacagga

SEQ ID NO: 3078248 - RNA, 20 nt, Human
acccuuguggucccacccca

SEQ ID NO: 3078249 - RNA, 23 nt, Human
acccuuguggucccaccccacac

SEQ ID NO: 3078250 - RNA, 17 nt, Human
acccuugccgucuaccu

SEQ ID NO: 3078251 - RNA, 15 nt, Human
accgaaaacguggcu

SEQ ID NO: 3078252 - RNA, 15 nt, Human
acccugaggcccaga

SEQ ID NO: 3078253 - RNA, 16 nt, Human
acccugaggcccagag

SEQ ID NO: 3078254 - RNA, 15 nt, Human
acccugcccuguggg

SEQ ID NO: 3078255 - RNA, 14 nt, Human
acccugcccugugg

SEQ ID NO: 3078256 - RNA, 17 nt, Human
acccugcccugugggcc

SEQ ID NO: 3078257 - RNA, 22 nt, Human
acccugcccugugggcccccaa

SEQ ID NO: 3078258 - RNA, 13 nt, Human
acccugaggccca

SEQ ID NO: 3078259 - RNA, 14 nt, Human
acccugaggcccag

SEQ ID NO: 3078260 - RNA, 16 nt, Human
acccugaaagcccuga

SEQ ID NO: 3078261 - RNA, 18 nt, Human
acccugaaagcccugagc

SEQ ID NO: 3078262 - RNA, 14 nt, Human
acccgucuccagcu

SEQ ID NO: 3078263 - RNA, 16 nt, Human
acccgucuccagcugc

SEQ ID NO: 3078264 - RNA, 18 nt, Human
acccucgaggcggaucuu

SEQ ID NO: 3078265 - RNA, 19 nt, Human
acccucgaggcggaucuuu

SEQ ID NO: 3078266 - RNA, 12 nt, Human
accgcagacagg

SEQ ID NO: 3078267 - RNA, 16 nt, Human
accgcagacaggacca

SEQ ID NO: 3078268 - RNA, 20 nt, Human
accucccacaaaggagagcu

SEQ ID NO: 3078269 - RNA, 13 nt, Human
ucaucuaggauuu

SEQ ID NO: 3078270 - RNA, 14 nt, Human
ucaugcaaacuuua

SEQ ID NO: 3078271 - RNA, 15 nt, Human
ucaugaaagauucaa

SEQ ID NO: 3078272 - RNA, 16 nt, Human
ucaugaaagauucaau

SEQ ID NO: 3078273 - RNA, 17 nt, Human
ucaugaaagauucaaug

SEQ ID NO: 3078274 - RNA, 23 nt, Human
ucaugcaaacuuuauuuuguguu

SEQ ID NO: 3078275 - RNA, 16 nt, Human
ucaugugaaaucauuc

SEQ ID NO: 3078276 - RNA, 17 nt, Human
ucaugugaaaucauuca

SEQ ID NO: 3078277 - RNA, 16 nt, Human
ucagugccaaaaacaa

SEQ ID NO: 3078278 - RNA, 12 nt, Human
ucagugccacua

SEQ ID NO: 3078279 - RNA, 17 nt, Human
accgaaaacguggcugc

SEQ ID NO: 3078280 - RNA, 19 nt, Human
accgaaaacguggcugcuu

SEQ ID NO: 3078281 - RNA, 11 nt, Human
ucagugccuua

SEQ ID NO: 3078282 - RNA, 12 nt, Human
ucagugccuuau

SEQ ID NO: 3078283 - RNA, 14 nt, Human
ucagugccuuaugg

SEQ ID NO: 3078284 - RNA, 15 nt, Human
ucagugccuuaugga

SEQ ID NO: 3078285 - RNA, 9 nt, Human
ucagugccu

SEQ ID NO: 3078286 - RNA, 10 nt, Human
ucagugccuu

SEQ ID NO: 3078287 - RNA, 22 nt, Human
ucauaaaaagccugcaauuuca

SEQ ID NO: 3078288 - RNA, 17 nt, Human
ucaguuuuugugaaaag

SEQ ID NO: 3078289 - RNA, 15 nt, Human
ucaguuuuugugaaa

SEQ ID NO: 3078290 - RNA, 16 nt, Human
ucagugccuuauggaa

SEQ ID NO: 3078291 - RNA, 11 nt, Human
ucaguggcagc

SEQ ID NO: 3078292 - RNA, 12 nt, Human
ucaguggcagcu

SEQ ID NO: 3078293 - RNA, 14 nt, Human
ucauaaccuagccu

SEQ ID NO: 3078294 - RNA, 19 nt, Human
ucauaguaugguggcuggg

SEQ ID NO: 3078295 - RNA, 18 nt, Human
ucauaguaugguggcugg

SEQ ID NO: 3078296 - RNA, 15 nt, Human
ucauaguaugguggc

SEQ ID NO: 3078297 - RNA, 21 nt, Human
ucauaguaugguggcuggguu

SEQ ID NO: 3078298 - RNA, 18 nt, Human
ucauauaagauucauauu

SEQ ID NO: 3078299 - RNA, 15 nt, Human
ucauauuuucaugcu

SEQ ID NO: 3078300 - RNA, 19 nt, Human
accgagggggcugcuccca

SEQ ID NO: 3078301 - RNA, 20 nt, Human
accgagggggcugcucccac

SEQ ID NO: 3078302 - RNA, 23 nt, Human
ucauauuuacuucuuauacauuu

SEQ ID NO: 3078303 - RNA, 15 nt, Human
ucauauuuacuucuu

SEQ ID NO: 3078304 - RNA, 16 nt, Human
aauuauuauuuggccc

SEQ ID NO: 3078305 - RNA, 21 nt, Human
aauuauuuuguucauacauau

SEQ ID NO: 3078306 - RNA, 22 nt, Human
aauuauuuuguucauacauauu

SEQ ID NO: 3078307 - RNA, 16 nt, Human
aauuauuuuguucaua

SEQ ID NO: 3078308 - RNA, 18 nt, Human
aauuauuuuguucauaca

SEQ ID NO: 3078309 - RNA, 19 nt, Human
aauuauuuuguucauacau

SEQ ID NO: 3078310 - RNA, 20 nt, Human
aauuauuuuguucauacaua

SEQ ID NO: 3078311 - RNA, 18 nt, Human
aauuccaagugauugaaa

SEQ ID NO: 3078312 - RNA, 14 nt, Human
aauuccccacccug

SEQ ID NO: 3078313 - RNA, 12 nt, Human
aauuccccagau

SEQ ID NO: 3078314 - RNA, 22 nt, Human
aauuccacuuauaggaauugac

SEQ ID NO: 3078315 - RNA, 19 nt, Human
uacauuguacgaagaguau

SEQ ID NO: 3078316 - RNA, 18 nt, Human
uaccugccaggaagccag

SEQ ID NO: 3078317 - RNA, 20 nt, Human
uaccugccaggaagccagca

SEQ ID NO: 3078318 - RNA, 23 nt, Human
uaccugccaggaagccagcaggc

SEQ ID NO: 3078319 - RNA, 13 nt, Human
uaccugucccccu

SEQ ID NO: 3078320 - RNA, 14 nt, Human
uaccugucccccug

SEQ ID NO: 3078321 - RNA, 16 nt, Human
uaccugucccccugac

SEQ ID NO: 3078322 - RNA, 17 nt, Human
uaccugucccccugaca

SEQ ID NO: 3078323 - RNA, 10 nt, Human
uaccuguccc

SEQ ID NO: 3078324 - RNA, 15 nt, Human
aauuagccaagugug

SEQ ID NO: 3078325 - RNA, 11 nt, Human
aauuacaggaa

SEQ ID NO: 3078326 - RNA, 18 nt, Human
uacuguaaggcaaucaug

SEQ ID NO: 3078327 - RNA, 14 nt, Human
uacuguaagaaaau

SEQ ID NO: 3078328 - RNA, 13 nt, Human
uacuguaagaaaa

SEQ ID NO: 3078329 - RNA, 19 nt, Human
uacuguaaggcaaucaugg

SEQ ID NO: 3078330 - RNA, 18 nt, Human
uacuguaauuugugauac

SEQ ID NO: 3078331 - RNA, 20 nt, Human
uacuguaauuugugauacaa

SEQ ID NO: 3078332 - RNA, 19 nt, Human
uacuguaauuugugauaca

SEQ ID NO: 3078333 - RNA, 16 nt, Human
uacuggagaaaaugga

SEQ ID NO: 3078334 - RNA, 12 nt, Human
uacucuguguca

SEQ ID NO: 3078335 - RNA, 14 nt, Human
aauugauguguuua

SEQ ID NO: 3078336 - RNA, 13 nt, Human
aauugauguguuu

SEQ ID NO: 3078337 - RNA, 19 nt, Human
aauugaugggauuugguca

SEQ ID NO: 3078338 - RNA, 21 nt, Human
uacuguacaugaaaacacauu

SEQ ID NO: 3078339 - RNA, 22 nt, Human
uacuguacaugaaaacacauuu

SEQ ID NO: 3078340 - RNA, 18 nt, Human
uacuguacaugaaaacac

SEQ ID NO: 3078341 - RNA, 22 nt, Human
aauugacccacaagaaaugaaa

SEQ ID NO: 3078342 - RNA, 21 nt, Human
aauugacccacaagaaaugaa

SEQ ID NO: 3078343 - RNA, 22 nt, Human
uacgccaggggaaaaucagccu

SEQ ID NO: 3078344 - RNA, 16 nt, Human
uacguugugcauuugg

SEQ ID NO: 3078345 - RNA, 15 nt, Human
uacguugugcauuug

SEQ ID NO: 3078346 - RNA, 13 nt, Human
uacguacacauuu

SEQ ID NO: 3078347 - RNA, 14 nt, Human
uacguugugcauuu

SEQ ID NO: 3078348 - RNA, 12 nt, Human
uacguacacauu

SEQ ID NO: 3078349 - RNA, 18 nt, Human
uacgggaggguaaggcug

SEQ ID NO: 3078350 - RNA, 23 nt, Human
uacucuccuggaaauauuaagaa

SEQ ID NO: 3078351 - RNA, 22 nt, Human
uacucuccuggaaauauuaaga

SEQ ID NO: 3078352 - RNA, 14 nt, Human
uacuauguaucaau

SEQ ID NO: 3078353 - RNA, 13 nt, Human
uacuauguaucaa

SEQ ID NO: 3078354 - RNA, 12 nt, Human
uacuauguauca

SEQ ID NO: 3078355 - RNA, 23 nt, Human
uacuauggcccuggccuagcaua

SEQ ID NO: 3078356 - RNA, 17 nt, Human
uacuacuccuguaggaa

SEQ ID NO: 3078357 - RNA, 13 nt, Human
uacuacuccugua

SEQ ID NO: 3078358 - RNA, 16 nt, Human
aaugcuucaucccuuu

SEQ ID NO: 3078359 - RNA, 20 nt, Human
aauggaaaugggcagagcag

SEQ ID NO: 3078360 - RNA, 21 nt, Human
aauggaaaugggcagagcaga

SEQ ID NO: 3078361 - RNA, 23 nt, Human
aauggacguguuaugacuccaga

SEQ ID NO: 3078362 - RNA, 20 nt, Human
aauggacuaacuugucuuug

SEQ ID NO: 3078363 - RNA, 14 nt, Human
aauggaaccacucu

SEQ ID NO: 3078364 - RNA, 21 nt, Human
aauggacguguuaugacucca

SEQ ID NO: 3078365 - RNA, 13 nt, Human
aaugcuguguuaa

SEQ ID NO: 3078366 - RNA, 12 nt, Human
aaugcuguguua

SEQ ID NO: 3078367 - RNA, 16 nt, Human
aaugcuguauuuuaaa

SEQ ID NO: 3078368 - RNA, 11 nt, Human
aaugcccagcc

SEQ ID NO: 3078369 - RNA, 12 nt, Human
aaugcccagccc

SEQ ID NO: 3078370 - RNA, 22 nt, Human
aaugcacuuuguucuggcucuu

SEQ ID NO: 3078371 - RNA, 21 nt, Human
uacaaugcugugcccuaaagu

SEQ ID NO: 3078372 - RNA, 18 nt, Human
aaugaccuuucaauagga

SEQ ID NO: 3078373 - RNA, 16 nt, Human
aaugaccuuucaauag

SEQ ID NO: 3078374 - RNA, 17 nt, Human
aaugaccuuucaauagg

SEQ ID NO: 3078375 - RNA, 21 nt, Human
aaugcacuuuguucuggcucu

SEQ ID NO: 3078376 - RNA, 15 nt, Human
uacacuaaaagguga

SEQ ID NO: 3078377 - RNA, 14 nt, Human
uacacuaagagaga

SEQ ID NO: 3078378 - RNA, 22 nt, Human
uacacauuuuauuuuauuaugc

SEQ ID NO: 3078379 - RNA, 21 nt, Human
uacacauuuuauuuuauuaug

SEQ ID NO: 3078380 - RNA, 19 nt, Human
uacacauuuuauuuuauua

SEQ ID NO: 3078381 - RNA, 22 nt, Human
uacagacaacaaaccuguuucu

SEQ ID NO: 3078382 - RNA, 19 nt, Human
uacagacaaagcguggugg

SEQ ID NO: 3078383 - RNA, 18 nt, Human
uacagaggccaugggccu

SEQ ID NO: 3078384 - RNA, 16 nt, Human
aauggcagccuuggca

SEQ ID NO: 3078385 - RNA, 12 nt, Human
aauggcagccuu

SEQ ID NO: 3078386 - RNA, 22 nt, Human
uacauauaagugauugcugguu

SEQ ID NO: 3078387 - RNA, 23 nt, Human
uacaggucauauuaauauauuuc

SEQ ID NO: 3078388 - RNA, 16 nt, Human
uacaggugugagucac

SEQ ID NO: 3078389 - RNA, 23 nt, Human
uacauaaugcgugcauaccacuu

SEQ ID NO: 3078390 - RNA, 21 nt, Human
uacauaaugcgugcauaccac

SEQ ID NO: 3078391 - RNA, 24 nt, Human
uacauaaugcgugcauaccacuuu

SEQ ID NO: 3078392 - RNA, 19 nt, Human
aaugugaaaagaaaaauga

SEQ ID NO: 3078393 - RNA, 14 nt, Human
aaugugaaacugga

SEQ ID NO: 3078394 - RNA, 15 nt, Human
aaugugaaacuggau

SEQ ID NO: 3078395 - RNA, 17 nt, Human
aaugugaaaagaaaaau

SEQ ID NO: 3078396 - RNA, 22 nt, Human
aauguauuacaguggggaauga

SEQ ID NO: 3078397 - RNA, 20 nt, Human
aauguauguguaaguauucu

SEQ ID NO: 3078398 - RNA, 19 nt, Human
aauguauguguaaguauuc

SEQ ID NO: 3078399 - RNA, 13 nt, Human
aauguuaagcaga

SEQ ID NO: 3078400 - RNA, 21 nt, Human
aauguucucucuucuccaccu

SEQ ID NO: 3078401 - RNA, 21 nt, Human
aauuaagaaaggauaaaguug

SEQ ID NO: 3078402 - RNA, 20 nt, Human
aauuaagaaaggauaaaguu

SEQ ID NO: 3078403 - RNA, 17 nt, Human
uacauuguaaauaguau

SEQ ID NO: 3078404 - RNA, 18 nt, Human
uaccaccagucugacugu

SEQ ID NO: 3078405 - RNA, 12 nt, Human
uacauucuguua

SEQ ID NO: 3078406 - RNA, 13 nt, Human
uacauucuguuaa

SEQ ID NO: 3078407 - RNA, 17 nt, Human
aauauuguguugugaau

SEQ ID NO: 3078408 - RNA, 15 nt, Human
aauauuuauuuuaau

SEQ ID NO: 3078409 - RNA, 19 nt, Human
aauauuuauuuuaauaaug

SEQ ID NO: 3078410 - RNA, 12 nt, Human
aauauuuagugu

SEQ ID NO: 3078411 - RNA, 18 nt, Human
aauauuuauuuuaauaau

SEQ ID NO: 3078412 - RNA, 15 nt, Human
uaagagaaaugagcu

SEQ ID NO: 3078413 - RNA, 17 nt, Human
aauaugcacacauuuuu

SEQ ID NO: 3078414 - RNA, 16 nt, Human
aauaugcacacauuuu

SEQ ID NO: 3078415 - RNA, 22 nt, Human
aauaugcacacauuuuuuaaau

SEQ ID NO: 3078416 - RNA, 21 nt, Human
aauaugccccauucaacaucu

SEQ ID NO: 3078417 - RNA, 24 nt, Human
aauaugccccauucaacaucuagu

SEQ ID NO: 3078418 - RNA, 22 nt, Human
uaagcuguuacugucuucagua

SEQ ID NO: 3078419 - RNA, 18 nt, Human
uaagcacacuugacauca

SEQ ID NO: 3078420 - RNA, 21 nt, Human
uaagcaaaaugugauauguac

SEQ ID NO: 3078421 - RNA, 16 nt, Human
aaucaggguuaguauu

SEQ ID NO: 3078422 - RNA, 21 nt, Human
aaucaggguuaguauugucca

SEQ ID NO: 3078423 - RNA, 22 nt, Human
aaucaggguuaguauuguccag

SEQ ID NO: 3078424 - RNA, 20 nt, Human
uaacgauaaaagacagugaa

SEQ ID NO: 3078425 - RNA, 17 nt, Human
uaacuuccaauuuacau

SEQ ID NO: 3078426 - RNA, 14 nt, Human
uaacuucaccauau

SEQ ID NO: 3078427 - RNA, 21 nt, Human
uaacuucacauauugauuucc

SEQ ID NO: 3078428 - RNA, 13 nt, Human
uaacuucacauau

SEQ ID NO: 3078429 - RNA, 18 nt, Human
uaagaagugaaaaucuac

SEQ ID NO: 3078430 - RNA, 13 nt, Human
uaagacaaauaug

SEQ ID NO: 3078431 - RNA, 16 nt, Human
uaacuuucugaaauaa

SEQ ID NO: 3078432 - RNA, 15 nt, Human
aauauauuuuaagac

SEQ ID NO: 3078433 - RNA, 14 nt, Human
aauauauuuuaaga

SEQ ID NO: 3078434 - RNA, 13 nt, Human
aauaguuggcuag

SEQ ID NO: 3078435 - RNA, 21 nt, Human
aauaguucagguaacaggcag

SEQ ID NO: 3078436 - RNA, 22 nt, Human
aauaguauuugagaguucuaaa

SEQ ID NO: 3078437 - RNA, 20 nt, Human
aauaguauuugagaguucua

SEQ ID NO: 3078438 - RNA, 16 nt, Human
aauagucaaauugugu

SEQ ID NO: 3078439 - RNA, 23 nt, Human
aauaguauuugagaguucuaaau

SEQ ID NO: 3078440 - RNA, 16 nt, Human
aauaguggugugauuu

SEQ ID NO: 3078441 - RNA, 22 nt, Human
aauaguggugugauuuggggau

SEQ ID NO: 3078442 - RNA, 23 nt, Human
uaacauggacaugaucuucuuua

SEQ ID NO: 3078443 - RNA, 18 nt, Human
uaacauggacaugaucuu

SEQ ID NO: 3078444 - RNA, 16 nt, Human
uaacauggaaguacua

SEQ ID NO: 3078445 - RNA, 22 nt, Human
aauaucacuugucaauaaaauc

SEQ ID NO: 3078446 - RNA, 20 nt, Human
aauaucacuugucaauaaaa

SEQ ID NO: 3078447 - RNA, 21 nt, Human
uaauagagcaaaauugaugug

SEQ ID NO: 3078448 - RNA, 12 nt, Human
uaauagagcaaa

SEQ ID NO: 3078449 - RNA, 22 nt, Human
uaauagacaauuuauuauggca

SEQ ID NO: 3078450 - RNA, 18 nt, Human
uaauagacaauuuauuau

SEQ ID NO: 3078451 - RNA, 16 nt, Human
aaucuuauaauuuaaa

SEQ ID NO: 3078452 - RNA, 14 nt, Human
uaauacaccacuac

SEQ ID NO: 3078453 - RNA, 16 nt, Human
uaauacaccacuacau

SEQ ID NO: 3078454 - RNA, 16 nt, Human
uaauagacaauuuauu

SEQ ID NO: 3078455 - RNA, 14 nt, Human
uaauagacaauuua

SEQ ID NO: 3078456 - RNA, 19 nt, Human
uaauacaccacuacauucu

SEQ ID NO: 3078457 - RNA, 18 nt, Human
uaauacaccacuacauuc

SEQ ID NO: 3078458 - RNA, 17 nt, Human
uaaugaaugaaacauuu

SEQ ID NO: 3078459 - RNA, 13 nt, Human
uaaucuuucacag

SEQ ID NO: 3078460 - RNA, 16 nt, Human
aaucuuuaauuuuaca

SEQ ID NO: 3078461 - RNA, 15 nt, Human
aaucuuuaauuuuac

SEQ ID NO: 3078462 - RNA, 18 nt, Human
uaauguaauaacugugaa

SEQ ID NO: 3078463 - RNA, 13 nt, Human
uaauguacugcau

SEQ ID NO: 3078464 - RNA, 18 nt, Human
uaaugucacaggcagguc

SEQ ID NO: 3078465 - RNA, 17 nt, Human
aaugaaaccugugucuc

SEQ ID NO: 3078466 - RNA, 17 nt, Human
aaugaaagacuguacaa

SEQ ID NO: 3078467 - RNA, 16 nt, Human
aaugaaagacuguaca

SEQ ID NO: 3078468 - RNA, 19 nt, Human
aaugaaacacucaguuguu

SEQ ID NO: 3078469 - RNA, 17 nt, Human
aaugaaacauuuuguca

SEQ ID NO: 3078470 - RNA, 22 nt, Human
aaugaauggcuaagcaaaaugu

SEQ ID NO: 3078471 - RNA, 13 nt, Human
aaugaaugucagu

SEQ ID NO: 3078472 - RNA, 22 nt, Human
aaugaaugucagugugacugau

SEQ ID NO: 3078473 - RNA, 15 nt, Human
aaugaccuuucaaua

SEQ ID NO: 3078474 - RNA, 18 nt, Human
uaauaaacacucuugaaa

SEQ ID NO: 3078475 - RNA, 12 nt, Human
uaauaaacacuc

SEQ ID NO: 3078476 - RNA, 12 nt, Human
uaauaaacucau

SEQ ID NO: 3078477 - RNA, 12 nt, Human
aaucaugaauua

SEQ ID NO: 3078478 - RNA, 15 nt, Human
aaucaugaauuaguu

SEQ ID NO: 3078479 - RNA, 13 nt, Human
uaaguaaaugcua

SEQ ID NO: 3078480 - RNA, 19 nt, Human
uaaguaaaaccacagcagu

SEQ ID NO: 3078481 - RNA, 19 nt, Human
uaaguaaugauaacuggaa

SEQ ID NO: 3078482 - RNA, 16 nt, Human
uaagcuuguauuccuu

SEQ ID NO: 3078483 - RNA, 16 nt, Human
uaaguauucuaaauuu

SEQ ID NO: 3078484 - RNA, 19 nt, Human
uaaguauucuuauuuaaug

SEQ ID NO: 3078485 - RNA, 20 nt, Human
uaaguauucuuauuuaauga

SEQ ID NO: 3078486 - RNA, 14 nt, Human
uaaguucauacauu

SEQ ID NO: 3078487 - RNA, 16 nt, Human
uaaguacuauguauca

SEQ ID NO: 3078488 - RNA, 13 nt, Human
uaaguacuaugua

SEQ ID NO: 3078489 - RNA, 17 nt, Human
uaaguacuauguaucaa

SEQ ID NO: 3078490 - RNA, 19 nt, Human
aaucuuauaauuuaaaaua

SEQ ID NO: 3078491 - RNA, 19 nt, Human
aaucuacacuccagugaga

SEQ ID NO: 3078492 - RNA, 12 nt, Human
aauccgcccauc

SEQ ID NO: 3078493 - RNA, 23 nt, Human
aaucauuaggugugacugaauuu

SEQ ID NO: 3078494 - RNA, 17 nt, Human
aaucauuaggugugacu

SEQ ID NO: 3078495 - RNA, 15 nt, Human
aaucauuagguguga

SEQ ID NO: 3078496 - RNA, 23 nt, Human
aaucgcuccaccuugcagcucuc

SEQ ID NO: 3078497 - RNA, 20 nt, Human
acagauuuccauccuaguca

SEQ ID NO: 3078498 - RNA, 17 nt, Human
acagcaaggagauuuac

SEQ ID NO: 3078499 - RNA, 18 nt, Human
acagagcccacgccccca

SEQ ID NO: 3078500 - RNA, 19 nt, Human
acagagcccacgcccccac

SEQ ID NO: 3078501 - RNA, 15 nt, Human
acagagcccacgccc

SEQ ID NO: 3078502 - RNA, 14 nt, Human
acagagcccacgcc

SEQ ID NO: 3078503 - RNA, 19 nt, Human
uaugaaauuauauaaguau

SEQ ID NO: 3078504 - RNA, 21 nt, Human
uaugaaauauuauguuaaaac

SEQ ID NO: 3078505 - RNA, 18 nt, Human
acagcccgggcucugccu

SEQ ID NO: 3078506 - RNA, 19 nt, Human
acagcccgggcucugccuc

SEQ ID NO: 3078507 - RNA, 17 nt, Human
acagcccgggcucugcc

SEQ ID NO: 3078508 - RNA, 21 nt, Human
acagcaaggagauuuacaacu

SEQ ID NO: 3078509 - RNA, 16 nt, Human
acagcaaggagauuua

SEQ ID NO: 3078510 - RNA, 16 nt, Human
acagccucuuagaugc

SEQ ID NO: 3078511 - RNA, 13 nt, Human
uauggguuuggcu

SEQ ID NO: 3078512 - RNA, 17 nt, Human
uauggcuuuugugcauu

SEQ ID NO: 3078513 - RNA, 21 nt, Human
uauggcuuuugugcauuaucu

SEQ ID NO: 3078514 - RNA, 18 nt, Human
uauggcuuuugugcauua

SEQ ID NO: 3078515 - RNA, 15 nt, Human
uaugcuuauacacuu

SEQ ID NO: 3078516 - RNA, 17 nt, Human
uaugccugggcagaagg

SEQ ID NO: 3078517 - RNA, 19 nt, Human
uaugccccauucaacaucu

SEQ ID NO: 3078518 - RNA, 15 nt, Human
uaugccccauucaac

SEQ ID NO: 3078519 - RNA, 24 nt, Human
uaugcauuugaaaauuuugauguu

SEQ ID NO: 3078520 - RNA, 23 nt, Human
uaugcauuugaaaauuuugaugu

SEQ ID NO: 3078521 - RNA, 11 nt, Human
uaugcauuuga

SEQ ID NO: 3078522 - RNA, 21 nt, Human
uaugauuaaguaaugauaacu

SEQ ID NO: 3078523 - RNA, 16 nt, Human
uaugauuaaguaauga

SEQ ID NO: 3078524 - RNA, 20 nt, Human
uaugauuaaguaaugauaac

SEQ ID NO: 3078525 - RNA, 19 nt, Human
uauccaaaccaaauaaaaa

SEQ ID NO: 3078526 - RNA, 15 nt, Human
uaucuauauuuuaca

SEQ ID NO: 3078527 - RNA, 14 nt, Human
uaucucccccagcc

SEQ ID NO: 3078528 - RNA, 13 nt, Human
uaucucccccagc

SEQ ID NO: 3078529 - RNA, 23 nt, Human
uaucuauauuuuacauaaauuua

SEQ ID NO: 3078530 - RNA, 18 nt, Human
acagagaaaguacuucuc

SEQ ID NO: 3078531 - RNA, 11 nt, Human
acagagaaagu

SEQ ID NO: 3078532 - RNA, 16 nt, Human
uauauuuaguaucuuu

SEQ ID NO: 3078533 - RNA, 15 nt, Human
uauauuguuugcuaa

SEQ ID NO: 3078534 - RNA, 13 nt, Human
acagacccugccc

SEQ ID NO: 3078535 - RNA, 14 nt, Human
acagacccugcccu

SEQ ID NO: 3078536 - RNA, 15 nt, Human
acagacccugcccug

SEQ ID NO: 3078537 - RNA, 23 nt, Human
uauaaguguguguuuuucauaaa

SEQ ID NO: 3078538 - RNA, 17 nt, Human
uauaaguguguguuuuu

SEQ ID NO: 3078539 - RNA, 19 nt, Human
uauaauuuugugaagcaaa

SEQ ID NO: 3078540 - RNA, 20 nt, Human
acagaaaauggaagacagcu

SEQ ID NO: 3078541 - RNA, 13 nt, Human
acagaaauguaca

SEQ ID NO: 3078542 - RNA, 17 nt, Human
acagaaaauucuucucc

SEQ ID NO: 3078543 - RNA, 16 nt, Human
acagaaauguacagca

SEQ ID NO: 3078544 - RNA, 14 nt, Human
acagaaauguacag

SEQ ID NO: 3078545 - RNA, 17 nt, Human
acagaaauguacagcaa

SEQ ID NO: 3078546 - RNA, 17 nt, Human
uauguguaaaaugugaa

SEQ ID NO: 3078547 - RNA, 21 nt, Human
uauguuuucaggcuagaugua

SEQ ID NO: 3078548 - RNA, 16 nt, Human
uauuaaaacucauuuu

SEQ ID NO: 3078549 - RNA, 14 nt, Human
uaugugaaacaugu

SEQ ID NO: 3078550 - RNA, 22 nt, Human
acaggcauguucucugaggaca

SEQ ID NO: 3078551 - RNA, 20 nt, Human
acaggcauguucucugagga

SEQ ID NO: 3078552 - RNA, 19 nt, Human
acaggcauguucucugagg

SEQ ID NO: 3078553 - RNA, 18 nt, Human
acaggcauguucucugag

SEQ ID NO: 3078554 - RNA, 15 nt, Human
acaggcauguucucu

SEQ ID NO: 3078555 - RNA, 17 nt, Human
uaugugaaacauguuuc

SEQ ID NO: 3078556 - RNA, 12 nt, Human
uaugugaacagu

SEQ ID NO: 3078557 - RNA, 22 nt, Human
uaugugaacaguuguguuugaa

SEQ ID NO: 3078558 - RNA, 23 nt, Human
uaugugccagauuuaugcauauu

SEQ ID NO: 3078559 - RNA, 20 nt, Human
uauguggaguucaucuugaa

SEQ ID NO: 3078560 - RNA, 13 nt, Human
acagcuaacaugg

SEQ ID NO: 3078561 - RNA, 17 nt, Human
acaggaaaagcugcuga

SEQ ID NO: 3078562 - RNA, 22 nt, Human
acaggaaccacaagacugcaca

SEQ ID NO: 3078563 - RNA, 16 nt, Human
acaggaaaagcugcug

SEQ ID NO: 3078564 - RNA, 15 nt, Human
acaggaaaagcugcu

SEQ ID NO: 3078565 - RNA, 13 nt, Human
acaggaaguacug

SEQ ID NO: 3078566 - RNA, 17 nt, Human
acaggaaguagaggagg

SEQ ID NO: 3078567 - RNA, 23 nt, Human
acaggaccagggauuuccaugau

SEQ ID NO: 3078568 - RNA, 13 nt, Human
acaggcaggucca

SEQ ID NO: 3078569 - RNA, 14 nt, Human
acaggaucagucug

SEQ ID NO: 3078570 - RNA, 16 nt, Human
acaggagugagcacua

SEQ ID NO: 3078571 - RNA, 16 nt, Human
acaggcagguccaggg

SEQ ID NO: 3078572 - RNA, 14 nt, Human
acaggcagguccag

SEQ ID NO: 3078573 - RNA, 14 nt, Human
acaggcauguucuc

SEQ ID NO: 3078574 - RNA, 21 nt, Human
uauucagcucauggacuucug

SEQ ID NO: 3078575 - RNA, 15 nt, Human
uauucagcucaugga

SEQ ID NO: 3078576 - RNA, 14 nt, Human
uauucaggaagcuc

SEQ ID NO: 3078577 - RNA, 20 nt, Human
uauucaguaauaacucuacc

SEQ ID NO: 3078578 - RNA, 14 nt, Human
uauuacuucugcua

SEQ ID NO: 3078579 - RNA, 13 nt, Human
uauuacuucugcu

SEQ ID NO: 3078580 - RNA, 14 nt, Human
uauuacuguaagaa

SEQ ID NO: 3078581 - RNA, 23 nt, Human
uauucaaacagucucaggaaauc

SEQ ID NO: 3078582 - RNA, 15 nt, Human
uauucaaacagucuc

SEQ ID NO: 3078583 - RNA, 17 nt, Human
acagucaccucauggaa

SEQ ID NO: 3078584 - RNA, 18 nt, Human
acagucaccucauggaau

SEQ ID NO: 3078585 - RNA, 16 nt, Human
acagucaccucaugga

SEQ ID NO: 3078586 - RNA, 12 nt, Human
acagggcacacc

SEQ ID NO: 3078587 - RNA, 20 nt, Human
acagggaggacgcucucugg

SEQ ID NO: 3078588 - RNA, 21 nt, Human
acagggaggacgcucucuggc

SEQ ID NO: 3078589 - RNA, 22 nt, Human
acaggcugggcuucaguggcag

SEQ ID NO: 3078590 - RNA, 23 nt, Human
acaggcugggcuucaguggcagc

SEQ ID NO: 3078591 - RNA, 18 nt, Human
uaggcaaccuuuauuuuu

SEQ ID NO: 3078592 - RNA, 16 nt, Human
uaggcauuugcugaau

SEQ ID NO: 3078593 - RNA, 20 nt, Human
uaggcauuugcugaauacag

SEQ ID NO: 3078594 - RNA, 14 nt, Human
uaggcauuguggga

SEQ ID NO: 3078595 - RNA, 21 nt, Human
uagggaaggauacaaaagcau

SEQ ID NO: 3078596 - RNA, 15 nt, Human
uagggagagaagaua

SEQ ID NO: 3078597 - RNA, 14 nt, Human
uagggagagaagau

SEQ ID NO: 3078598 - RNA, 12 nt, Human
uaggagcaugag

SEQ ID NO: 3078599 - RNA, 19 nt, Human
uaggaaauauuuauuuuaa

SEQ ID NO: 3078600 - RNA, 18 nt, Human
uaggaaauauuuauuuua

SEQ ID NO: 3078601 - RNA, 19 nt, Human
uagcuaauguaauaacugu

SEQ ID NO: 3078602 - RNA, 12 nt, Human
uagcuaauguaa

SEQ ID NO: 3078603 - RNA, 18 nt, Human
acaaugacuuacuguaca

SEQ ID NO: 3078604 - RNA, 17 nt, Human
acaaugacuuacuguac

SEQ ID NO: 3078605 - RNA, 12 nt, Human
acaaugacuuac

SEQ ID NO: 3078606 - RNA, 18 nt, Human
acaagaccacguuucuaa

SEQ ID NO: 3078607 - RNA, 13 nt, Human
acaagacugcaca

SEQ ID NO: 3078608 - RNA, 14 nt, Human
acaagacugcacau

SEQ ID NO: 3078609 - RNA, 23 nt, Human
acaauacaucccuuaccugggaa

SEQ ID NO: 3078610 - RNA, 21 nt, Human
uagcauggcauauuuuucaca

SEQ ID NO: 3078611 - RNA, 22 nt, Human
uagcauggcauauuuuucacau

SEQ ID NO: 3078612 - RNA, 19 nt, Human
uagcauggcugccaauggg

SEQ ID NO: 3078613 - RNA, 15 nt, Human
uagaugcaguucuga

SEQ ID NO: 3078614 - RNA, 21 nt, Human
uagccaaggccaaaggaagca

SEQ ID NO: 3078615 - RNA, 22 nt, Human
uagcauuuugcuaaaugugaau

SEQ ID NO: 3078616 - RNA, 14 nt, Human
uagccaaggccaaa

SEQ ID NO: 3078617 - RNA, 16 nt, Human
uagcauuuugcuaaau

SEQ ID NO: 3078618 - RNA, 19 nt, Human
uagcauuuguguugaagag

SEQ ID NO: 3078619 - RNA, 11 nt, Human
uagccagagga

SEQ ID NO: 3078620 - RNA, 15 nt, Human
uagccagaggagaga

SEQ ID NO: 3078621 - RNA, 18 nt, Human
acaaauuuacagagacag

SEQ ID NO: 3078622 - RNA, 19 nt, Human
acaaauuuacagagacaga

SEQ ID NO: 3078623 - RNA, 23 nt, Human
acaacacucauugaccugaggcc

SEQ ID NO: 3078624 - RNA, 21 nt, Human
acaacacucauugaccugagg

SEQ ID NO: 3078625 - RNA, 19 nt, Human
acaagacccuugugguccc

SEQ ID NO: 3078626 - RNA, 20 nt, Human
acaagacccaaaaggcagaa

SEQ ID NO: 3078627 - RNA, 19 nt, Human
acaagaccacguuucuaaa

SEQ ID NO: 3078628 - RNA, 21 nt, Human
uagagcaaaauugauguguuu

SEQ ID NO: 3078629 - RNA, 14 nt, Human
uagagcaaaauuga

SEQ ID NO: 3078630 - RNA, 22 nt, Human
uagagcaaaauugauguguuua

SEQ ID NO: 3078631 - RNA, 19 nt, Human
uagaggagaaacuggaacu

SEQ ID NO: 3078632 - RNA, 15 nt, Human
uagauauaugcucug

SEQ ID NO: 3078633 - RNA, 22 nt, Human
uagaggagaaacuggaacucuc

SEQ ID NO: 3078634 - RNA, 19 nt, Human
uagauauaugcucugcaug

SEQ ID NO: 3078635 - RNA, 21 nt, Human
aauuguguuuauaauuuuaaa

SEQ ID NO: 3078636 - RNA, 20 nt, Human
aauuguguuuauaauuuuaa

SEQ ID NO: 3078637 - RNA, 16 nt, Human
aauuguuacaaauugu

SEQ ID NO: 3078638 - RNA, 22 nt, Human
acaaaagcaugugagacugguu

SEQ ID NO: 3078639 - RNA, 11 nt, Human
acaaaagcaug

SEQ ID NO: 3078640 - RNA, 22 nt, Human
acaaaggaugcccaaagaugca

SEQ ID NO: 3078641 - RNA, 19 nt, Human
acaauggauaggcacagga

SEQ ID NO: 3078642 - RNA, 24 nt, Human
acaaugcugugcccuaaaguguau

SEQ ID NO: 3078643 - RNA, 23 nt, Human
acaaugcugugcccuaaagugua

SEQ ID NO: 3078644 - RNA, 22 nt, Human
acaaugcugugcccuaaagugu

SEQ ID NO: 3078645 - RNA, 21 nt, Human
acaaugcugugcccuaaagug

SEQ ID NO: 3078646 - RNA, 22 nt, Human
acaaugcuguauuuuaaaagaa

SEQ ID NO: 3078647 - RNA, 18 nt, Human
acaaugcuguauuuuaaa

SEQ ID NO: 3078648 - RNA, 14 nt, Human
acacacacauacac

SEQ ID NO: 3078649 - RNA, 19 nt, Human
acaaugugaaaagaaaaau

SEQ ID NO: 3078650 - RNA, 17 nt, Human
acaaugugaaaagaaaa

SEQ ID NO: 3078651 - RNA, 22 nt, Human
acacacacgcgugcacacacca

SEQ ID NO: 3078652 - RNA, 14 nt, Human
acacacagcucugu

SEQ ID NO: 3078653 - RNA, 13 nt, Human
acacacagcucug

SEQ ID NO: 3078654 - RNA, 17 nt, Human
acacacagcucuguccu

SEQ ID NO: 3078655 - RNA, 21 nt, Human
acacacugcauguuugugauu

SEQ ID NO: 3078656 - RNA, 15 nt, Human
acacacucaaaucaa

SEQ ID NO: 3078657 - RNA, 21 nt, Human
acacacgcgugcacacaccag

SEQ ID NO: 3078658 - RNA, 20 nt, Human
acacaccagagcccaccuug

SEQ ID NO: 3078659 - RNA, 15 nt, Human
acacaccagagccca

SEQ ID NO: 3078660 - RNA, 14 nt, Human
acacaccagagccc

SEQ ID NO: 3078661 - RNA, 16 nt, Human
acacaguauuacuucu

SEQ ID NO: 3078662 - RNA, 18 nt, Human
acacaguauuacuucugc

SEQ ID NO: 3078663 - RNA, 19 nt, Human
acacaguauuacuucugcu

SEQ ID NO: 3078664 - RNA, 13 nt, Human
acacagugagucg

SEQ ID NO: 3078665 - RNA, 23 nt, Human
uaguguuggagaagaacugaaau

SEQ ID NO: 3078666 - RNA, 17 nt, Human
uaguguuggagaagaac

SEQ ID NO: 3078667 - RNA, 22 nt, Human
uagugaaacucguuaauuugua

SEQ ID NO: 3078668 - RNA, 20 nt, Human
uauaaaagccuguuuaagag

SEQ ID NO: 3078669 - RNA, 19 nt, Human
uauaaaaauaaaaaacacu

SEQ ID NO: 3078670 - RNA, 22 nt, Human
uauaaaagggacugagaaauuu

SEQ ID NO: 3078671 - RNA, 19 nt, Human
uauaaaagccuguuuaaga

SEQ ID NO: 3078672 - RNA, 20 nt, Human
uaguuccaccaucaagccac

SEQ ID NO: 3078673 - RNA, 18 nt, Human
uaguucagguaacaggca

SEQ ID NO: 3078674 - RNA, 20 nt, Human
acacauuuuauuuuauuaug

SEQ ID NO: 3078675 - RNA, 19 nt, Human
acacauuuuauuuuauuau

SEQ ID NO: 3078676 - RNA, 14 nt, Human
acacauuuuauuuu

SEQ ID NO: 3078677 - RNA, 13 nt, Human
acacauuuuauuu

SEQ ID NO: 3078678 - RNA, 21 nt, Human
acacaugagcaucaggccagg

SEQ ID NO: 3078679 - RNA, 18 nt, Human
acacaugauccugcaauu

SEQ ID NO: 3078680 - RNA, 15 nt, Human
acacaugaaguccaa

SEQ ID NO: 3078681 - RNA, 15 nt, Human
acacaucagcuugcc

SEQ ID NO: 3078682 - RNA, 23 nt, Human
acaccauaagcuacugccauccu

SEQ ID NO: 3078683 - RNA, 21 nt, Human
acaccauaagcuacugccauc

SEQ ID NO: 3078684 - RNA, 22 nt, Human
acaccauaagcuacugccaucc

SEQ ID NO: 3078685 - RNA, 20 nt, Human
acaccauaagcuacugccau

SEQ ID NO: 3078686 - RNA, 15 nt, Human
uauaaguguguguuu

SEQ ID NO: 3078687 - RNA, 20 nt, Human
acacucacauuuauucugcu

SEQ ID NO: 3078688 - RNA, 18 nt, Human
acacucaaaucaagaaac

SEQ ID NO: 3078689 - RNA, 15 nt, Human
acacucaaaagcugg

SEQ ID NO: 3078690 - RNA, 19 nt, Human
acacucaaaucaagaaacu

SEQ ID NO: 3078691 - RNA, 13 nt, Human
acacuaagagaga

SEQ ID NO: 3078692 - RNA, 19 nt, Human
acaccucugcacaagcugc

SEQ ID NO: 3078693 - RNA, 21 nt, Human
acaccucugcacaagcugcac

SEQ ID NO: 3078694 - RNA, 19 nt, Human
acacccugugauggggccc

SEQ ID NO: 3078695 - RNA, 16 nt, Human
acaccgggcacucaga

SEQ ID NO: 3078696 - RNA, 20 nt, Human
acacuaaccacgcuggaccu

SEQ ID NO: 3078697 - RNA, 12 nt, Human
aaguaaaugcua

SEQ ID NO: 3078698 - RNA, 12 nt, Human
aagggggcuggg

SEQ ID NO: 3078699 - RNA, 23 nt, Human
aagggggcugggacaugggaaag

SEQ ID NO: 3078700 - RNA, 13 nt, Human
aaggggagaguaa

SEQ ID NO: 3078701 - RNA, 16 nt, Human
aaggcugggggaagaa

SEQ ID NO: 3078702 - RNA, 14 nt, Human
aaggcugggggaag

SEQ ID NO: 3078703 - RNA, 13 nt, Human
guuucagaaaugu

SEQ ID NO: 3078704 - RNA, 11 nt, Human
guuucagaaau

SEQ ID NO: 3078705 - RNA, 19 nt, Human
aaggcugggggaagaagcu

SEQ ID NO: 3078706 - RNA, 22 nt, Human
aaggcugggggaagaagcucuc

SEQ ID NO: 3078707 - RNA, 20 nt, Human
aaggcugucaauuacaggaa

SEQ ID NO: 3078708 - RNA, 15 nt, Human
aagggcuguuauaau

SEQ ID NO: 3078709 - RNA, 17 nt, Human
aagggcuguuauaaucu

SEQ ID NO: 3078710 - RNA, 17 nt, Human
aaggggaauugaggaca

SEQ ID NO: 3078711 - RNA, 17 nt, Human
guuucaaacuuuacuau

SEQ ID NO: 3078712 - RNA, 14 nt, Human
guuuaugauuccac

SEQ ID NO: 3078713 - RNA, 21 nt, Human
guuuaagugacugauggcuaa

SEQ ID NO: 3078714 - RNA, 17 nt, Human
aaggaaacccagcucug

SEQ ID NO: 3078715 - RNA, 22 nt, Human
aaggaaacccagcucuggucca

SEQ ID NO: 3078716 - RNA, 23 nt, Human
guuguuugauucagacagcugcc

SEQ ID NO: 3078717 - RNA, 20 nt, Human
guuguuugauucagacagcu

SEQ ID NO: 3078718 - RNA, 16 nt, Human
aaggaaacccagcucu

SEQ ID NO: 3078719 - RNA, 17 nt, Human
guuuuaaaaugagaaau

SEQ ID NO: 3078720 - RNA, 15 nt, Human
guuuuaaagcuucca

SEQ ID NO: 3078721 - RNA, 19 nt, Human
guuuggacaaaauggaaua

SEQ ID NO: 3078722 - RNA, 17 nt, Human
aaguaauaugcacacau

SEQ ID NO: 3078723 - RNA, 20 nt, Human
aaguaauaugcacacauuuu

SEQ ID NO: 3078724 - RNA, 18 nt, Human
aaguaauaugcacacauu

SEQ ID NO: 3078725 - RNA, 21 nt, Human
aaguaauaugcacacauuuuu

SEQ ID NO: 3078726 - RNA, 22 nt, Human
guuuuaaggaugcuuguacaua

SEQ ID NO: 3078727 - RNA, 18 nt, Human
guuuuaaggaugcuugua

SEQ ID NO: 3078728 - RNA, 16 nt, Human
guuuucuguucuuucu

SEQ ID NO: 3078729 - RNA, 15 nt, Human
guuuucuguucuuuc

SEQ ID NO: 3078730 - RNA, 14 nt, Human
guuuucuguucuuu

SEQ ID NO: 3078731 - RNA, 12 nt, Human
guuuucuguucu

SEQ ID NO: 3078732 - RNA, 19 nt, Human
aaguauuauaccuuuuuua

SEQ ID NO: 3078733 - RNA, 16 nt, Human
aaguauuauaccuuuu

SEQ ID NO: 3078734 - RNA, 19 nt, Human
aaguauucuuauuuaauga

SEQ ID NO: 3078735 - RNA, 21 nt, Human
aaguauucuuauuuaaugaaa

SEQ ID NO: 3078736 - RNA, 23 nt, Human
aaguauucuuauuuaaugaaaga

SEQ ID NO: 3078737 - RNA, 19 nt, Human
aaguauguguaaaauguga

SEQ ID NO: 3078738 - RNA, 15 nt, Human
aaguauuauaccuuu

SEQ ID NO: 3078739 - RNA, 18 nt, Human
aaguauguuagugcaaau

SEQ ID NO: 3078740 - RNA, 19 nt, Human
aaguauguuagugcaaauu

SEQ ID NO: 3078741 - RNA, 18 nt, Human
aaguacuucuccacccug

SEQ ID NO: 3078742 - RNA, 19 nt, Human
aaguacuucuccacccugc

SEQ ID NO: 3078743 - RNA, 18 nt, Human
aaguauguguaaaaugug

SEQ ID NO: 3078744 - RNA, 13 nt, Human
aaguacuauguau

SEQ ID NO: 3078745 - RNA, 17 nt, Human
aaguacuauaauuuacc

SEQ ID NO: 3078746 - RNA, 14 nt, Human
aaguacuauaauuu

SEQ ID NO: 3078747 - RNA, 19 nt, Human
aaguaaugauaacuggaaa

SEQ ID NO: 3078748 - RNA, 13 nt, Human
uaaaaugugaagu

SEQ ID NO: 3078749 - RNA, 11 nt, Human
uaaaaugugaa

SEQ ID NO: 3078750 - RNA, 20 nt, Human
aaguuugagaucagccuggg

SEQ ID NO: 3078751 - RNA, 9 nt, Human
uaaaauggu

SEQ ID NO: 3078752 - RNA, 19 nt, Human
aaguuucugccgcagcccu

SEQ ID NO: 3078753 - RNA, 21 nt, Human
aaguuucugccgcagcccugc

SEQ ID NO: 3078754 - RNA, 19 nt, Human
aaguuauuuuuaauuuggu

SEQ ID NO: 3078755 - RNA, 21 nt, Human
aaguguguguuuuucauaaag

SEQ ID NO: 3078756 - RNA, 16 nt, Human
aaguguguguuuuuca

SEQ ID NO: 3078757 - RNA, 12 nt, Human
aaguguguguuu

SEQ ID NO: 3078758 - RNA, 13 nt, Human
aagugugguagag

SEQ ID NO: 3078759 - RNA, 23 nt, Human
aaguguauuuuuuuacuaauaga

SEQ ID NO: 3078760 - RNA, 22 nt, Human
uaaaaagccugcaauuucauau

SEQ ID NO: 3078761 - RNA, 19 nt, Human
uaaaaagccugcaauuuca

SEQ ID NO: 3078762 - RNA, 21 nt, Human
uaaaaaaaaaccugagcccca

SEQ ID NO: 3078763 - RNA, 14 nt, Human
uaaaaauauugugu

SEQ ID NO: 3078764 - RNA, 22 nt, Human
uaaaaauauuguguugugaaug

SEQ ID NO: 3078765 - RNA, 21 nt, Human
uaaaaauauuguguugugaau

SEQ ID NO: 3078766 - RNA, 23 nt, Human
uaaaaaucucaaauuucuaaauc

SEQ ID NO: 3078767 - RNA, 15 nt, Human
uaaaaaugagguacu

SEQ ID NO: 3078768 - RNA, 22 nt, Human
uaaaaaugagguacucuccugg

SEQ ID NO: 3078769 - RNA, 14 nt, Human
uaaaaccacagcag

SEQ ID NO: 3078770 - RNA, 13 nt, Human
uaaaaccacagca

SEQ ID NO: 3078771 - RNA, 15 nt, Human
uaaaaccacagcagu

SEQ ID NO: 3078772 - RNA, 15 nt, Human
uaaaacuuuuuaaaa

SEQ ID NO: 3078773 - RNA, 12 nt, Human
uaaaacuuuuua

SEQ ID NO: 3078774 - RNA, 13 nt, Human
uaaaacccaagug

SEQ ID NO: 3078775 - RNA, 19 nt, Human
uaaaaggugaccaaugaug

SEQ ID NO: 3078776 - RNA, 13 nt, Human
uaaaagaauauuu

SEQ ID NO: 3078777 - RNA, 13 nt, Human
uaaaagucuugug

SEQ ID NO: 3078778 - RNA, 20 nt, Human
uaaaauaauuuuuauauuug

SEQ ID NO: 3078779 - RNA, 22 nt, Human
uaaaauaauuuuuauauuugaa

SEQ ID NO: 3078780 - RNA, 21 nt, Human
uaaaauacacacucaaaucaa

SEQ ID NO: 3078781 - RNA, 20 nt, Human
aagugauccucccaccucag

SEQ ID NO: 3078782 - RNA, 19 nt, Human
aagugauccucccaccuca

SEQ ID NO: 3078783 - RNA, 13 nt, Human
aagugauccuccc

SEQ ID NO: 3078784 - RNA, 20 nt, Human
aagugauucuccugccucag

SEQ ID NO: 3078785 - RNA, 23 nt, Human
aagugauccucccaccucagccu

SEQ ID NO: 3078786 - RNA, 22 nt, Human
aagagggucugaggaauccaga

SEQ ID NO: 3078787 - RNA, 14 nt, Human
aagauagcagggca

SEQ ID NO: 3078788 - RNA, 15 nt, Human
aagauagcagggcau

SEQ ID NO: 3078789 - RNA, 21 nt, Human
aagagggagggagggcuccag

SEQ ID NO: 3078790 - RNA, 22 nt, Human
aagagggagggagggcuccaga

SEQ ID NO: 3078791 - RNA, 11 nt, Human
aagaggcaggg

SEQ ID NO: 3078792 - RNA, 14 nt, Human
aagaggcagggucu

SEQ ID NO: 3078793 - RNA, 15 nt, Human
guguaaaaugugaag

SEQ ID NO: 3078794 - RNA, 15 nt, Human
gugguuucagaaaug

SEQ ID NO: 3078795 - RNA, 23 nt, Human
gugcugcccugcccaccuggccu

SEQ ID NO: 3078796 - RNA, 20 nt, Human
aagcaaaugugaaucauuuu

SEQ ID NO: 3078797 - RNA, 17 nt, Human
aagcaacccaaauguuc

SEQ ID NO: 3078798 - RNA, 20 nt, Human
aagaucaaaagguuaauaaa

SEQ ID NO: 3078799 - RNA, 23 nt, Human
aagaucaaaagguuaauaaagua

SEQ ID NO: 3078800 - RNA, 19 nt, Human
gugucagguggggcagcuu

SEQ ID NO: 3078801 - RNA, 22 nt, Human
gugucuuaauuaaaagaauauu

SEQ ID NO: 3078802 - RNA, 23 nt, Human
gugugaaccaccacacccagccc

SEQ ID NO: 3078803 - RNA, 14 nt, Human
gugucaccugaaga

SEQ ID NO: 3078804 - RNA, 18 nt, Human
gugucagguggggcagcu

SEQ ID NO: 3078805 - RNA, 14 nt, Human
gugucagguggggc

SEQ ID NO: 3078806 - RNA, 22 nt, Human
gugucaccugaagacucauucu

SEQ ID NO: 3078807 - RNA, 16 nt, Human
aagcacuaaacaaaga

SEQ ID NO: 3078808 - RNA, 17 nt, Human
aagcaccuccugccucg

SEQ ID NO: 3078809 - RNA, 17 nt, Human
aagcacugacuucuaag

SEQ ID NO: 3078810 - RNA, 16 nt, Human
aagcacugacuucuaa

SEQ ID NO: 3078811 - RNA, 16 nt, Human
aagcaccuccugccuc

SEQ ID NO: 3078812 - RNA, 15 nt, Human
aagcaccuccugccu

SEQ ID NO: 3078813 - RNA, 14 nt, Human
aagcaccuccugcc

SEQ ID NO: 3078814 - RNA, 13 nt, Human
aagcaccuccugc

SEQ ID NO: 3078815 - RNA, 21 nt, Human
aagcacaugccucucucaggc

SEQ ID NO: 3078816 - RNA, 16 nt, Human
aagcacacuugacauc

SEQ ID NO: 3078817 - RNA, 12 nt, Human
guguuugaagca

SEQ ID NO: 3078818 - RNA, 17 nt, Human
gugugaauaccccaaga

SEQ ID NO: 3078819 - RNA, 15 nt, Human
aagcacaugccucuc

SEQ ID NO: 3078820 - RNA, 16 nt, Human
aagcacaugccucucu

SEQ ID NO: 3078821 - RNA, 19 nt, Human
aagcacaugccucucucag

SEQ ID NO: 3078822 - RNA, 20 nt, Human
aagcacaugccucucucagg

SEQ ID NO: 3078823 - RNA, 14 nt, Human
aagcacaugccucu

SEQ ID NO: 3078824 - RNA, 23 nt, Human
aagcaugcacaaauucugucucu

SEQ ID NO: 3078825 - RNA, 12 nt, Human
aagcaugugaga

SEQ ID NO: 3078826 - RNA, 18 nt, Human
aagcauuguaaaugugcu

SEQ ID NO: 3078827 - RNA, 20 nt, Human
aagcacugacuucuaaguaa

SEQ ID NO: 3078828 - RNA, 19 nt, Human
aagcacugacuucuaagua

SEQ ID NO: 3078829 - RNA, 18 nt, Human
aagccaaagcuaggccug

SEQ ID NO: 3078830 - RNA, 17 nt, Human
aagccaaagcuaggccu

SEQ ID NO: 3078831 - RNA, 19 nt, Human
aagcauuguaaaugugcuu

SEQ ID NO: 3078832 - RNA, 19 nt, Human
guuaauuccaauuauauga

SEQ ID NO: 3078833 - RNA, 22 nt, Human
guuauugauaaguucauacauu

SEQ ID NO: 3078834 - RNA, 21 nt, Human
guuauugauaaguucauacau

SEQ ID NO: 3078835 - RNA, 17 nt, Human
guuauuauauuuacaaa

SEQ ID NO: 3078836 - RNA, 18 nt, Human
guuauugauaaguucaua

SEQ ID NO: 3078837 - RNA, 19 nt, Human
guuauuauauuuacaaaug

SEQ ID NO: 3078838 - RNA, 19 nt, Human
guuagagguucccuuugac

SEQ ID NO: 3078839 - RNA, 23 nt, Human
guucagcuuguaaauagcucagg

SEQ ID NO: 3078840 - RNA, 22 nt, Human
guucaggguuggccccugcccg

SEQ ID NO: 3078841 - RNA, 21 nt, Human
guucaggguuggccccugccc

SEQ ID NO: 3078842 - RNA, 20 nt, Human
guucaggguuggccccugcc

SEQ ID NO: 3078843 - RNA, 18 nt, Human
guucagguaacaggcaga

SEQ ID NO: 3078844 - RNA, 17 nt, Human
guucagguaacaggcag

SEQ ID NO: 3078845 - RNA, 21 nt, Human
aagccgugauuuucauugcug

SEQ ID NO: 3078846 - RNA, 18 nt, Human
aagccuguuuaagagaca

SEQ ID NO: 3078847 - RNA, 15 nt, Human
aagccuguuuaagag

SEQ ID NO: 3078848 - RNA, 15 nt, Human
aagccuccuccagcc

SEQ ID NO: 3078849 - RNA, 16 nt, Human
aagccucccacgacug

SEQ ID NO: 3078850 - RNA, 22 nt, Human
aagcuaggccuggccagaugca

SEQ ID NO: 3078851 - RNA, 21 nt, Human
aagccuuggggcugaugcagu

SEQ ID NO: 3078852 - RNA, 19 nt, Human
aaggaaaaaauaacaauga

SEQ ID NO: 3078853 - RNA, 14 nt, Human
guugauagcacaga

SEQ ID NO: 3078854 - RNA, 19 nt, Human
guugauagcacagacccug

SEQ ID NO: 3078855 - RNA, 14 nt, Human
guucuugguuugua

SEQ ID NO: 3078856 - RNA, 18 nt, Human
guucuugguuuguaaauu

SEQ ID NO: 3078857 - RNA, 15 nt, Human
guucuugguuuguaa

SEQ ID NO: 3078858 - RNA, 13 nt, Human
guucuuaauucuu

SEQ ID NO: 3078859 - RNA, 17 nt, Human
guucucugcccuccaag

SEQ ID NO: 3078860 - RNA, 18 nt, Human
guucucugcccuccaaga

SEQ ID NO: 3078861 - RNA, 17 nt, Human
guucuuaauucuuagcu

SEQ ID NO: 3078862 - RNA, 14 nt, Human
guucuuaauucuua

SEQ ID NO: 3078863 - RNA, 19 nt, Human
guucuagcauggcugccaa

SEQ ID NO: 3078864 - RNA, 13 nt, Human
guucucuccuucu

SEQ ID NO: 3078865 - RNA, 13 nt, Human
guucucugcccuc

SEQ ID NO: 3078866 - RNA, 15 nt, Human
guucucugcccucca

SEQ ID NO: 3078867 - RNA, 15 nt, Human
guucucucuucucca

SEQ ID NO: 3078868 - RNA, 12 nt, Human
guucucugagga

SEQ ID NO: 3078869 - RNA, 21 nt, Human
aagcuuuuaugugaaacaugu

SEQ ID NO: 3078870 - RNA, 19 nt, Human
aagcuuuuaugugaaacau

SEQ ID NO: 3078871 - RNA, 19 nt, Human
guucuagcauggcauauuu

SEQ ID NO: 3078872 - RNA, 22 nt, Human
guucuagcauggcauauuuuuc

SEQ ID NO: 3078873 - RNA, 21 nt, Human
guucccuuuuuuggcugcuga

SEQ ID NO: 3078874 - RNA, 22 nt, Human
guucccuuuuuuggcugcugaa

SEQ ID NO: 3078875 - RNA, 18 nt, Human
guucccuugaugaagaag

SEQ ID NO: 3078876 - RNA, 17 nt, Human
aagcucugcuccucucc

SEQ ID NO: 3078877 - RNA, 12 nt, Human
aacuauggccug

SEQ ID NO: 3078878 - RNA, 23 nt, Human
aacuauucaggagaguagaacag

SEQ ID NO: 3078879 - RNA, 24 nt, Human
aacucauuuuuguuuucauuaucu

SEQ ID NO: 3078880 - RNA, 21 nt, Human
aacucauuuuuguuuucauua

SEQ ID NO: 3078881 - RNA, 21 nt, Human
aacuaggugcauauuuauaaa

SEQ ID NO: 3078882 - RNA, 17 nt, Human
aacuagggaagauaaua

SEQ ID NO: 3078883 - RNA, 12 nt, Human
aacguggcugcu

SEQ ID NO: 3078884 - RNA, 13 nt, Human
aacguggcugcuu

SEQ ID NO: 3078885 - RNA, 13 nt, Human
aacgucugugcca

SEQ ID NO: 3078886 - RNA, 12 nt, Human
aacgucuuaaau

SEQ ID NO: 3078887 - RNA, 14 nt, Human
aacgucuuaaauau

SEQ ID NO: 3078888 - RNA, 15 nt, Human
aacgucuuaaauauu

SEQ ID NO: 3078889 - RNA, 19 nt, Human
gucuuauauauuguagaua

SEQ ID NO: 3078890 - RNA, 14 nt, Human
gucuuaauuaaaag

SEQ ID NO: 3078891 - RNA, 16 nt, Human
gucuggaaugcagugg

SEQ ID NO: 3078892 - RNA, 15 nt, Human
gucuggaaugcagug

SEQ ID NO: 3078893 - RNA, 14 nt, Human
gucugacaggcaau

SEQ ID NO: 3078894 - RNA, 13 nt, Human
gucugacaggcaa

SEQ ID NO: 3078895 - RNA, 12 nt, Human
gucugacaggca

SEQ ID NO: 3078896 - RNA, 18 nt, Human
gucugacaggcaaugcug

SEQ ID NO: 3078897 - RNA, 15 nt, Human
gucugacaggcaaug

SEQ ID NO: 3078898 - RNA, 20 nt, Human
gucugacaggcaaugcuggc

SEQ ID NO: 3078899 - RNA, 23 nt, Human
gucucuuuaaugucacaggcagg

SEQ ID NO: 3078900 - RNA, 17 nt, Human
gucucaaaaaaagaaaa

SEQ ID NO: 3078901 - RNA, 14 nt, Human
gucucaaaaaaaca

SEQ ID NO: 3078902 - RNA, 14 nt, Human
gugaaguuuacauu

SEQ ID NO: 3078903 - RNA, 23 nt, Human
gugaauaauacaguaucucaggg

SEQ ID NO: 3078904 - RNA, 22 nt, Human
gugacagagugagacucugucu

SEQ ID NO: 3078905 - RNA, 20 nt, Human
gugacagagugagacucugu

SEQ ID NO: 3078906 - RNA, 23 nt, Human
gugacagaggcagccccauucug

SEQ ID NO: 3078907 - RNA, 14 nt, Human
gugacaugucuuuu

SEQ ID NO: 3078908 - RNA, 19 nt, Human
gugacaugucuuuucuugc

SEQ ID NO: 3078909 - RNA, 16 nt, Human
gugagacucugucuca

SEQ ID NO: 3078910 - RNA, 14 nt, Human
gugagacucugucu

SEQ ID NO: 3078911 - RNA, 22 nt, Human
gugagacccugucucaaaaaaa

SEQ ID NO: 3078912 - RNA, 14 nt, Human
gugaggcucugccc

SEQ ID NO: 3078913 - RNA, 15 nt, Human
gugaggcucugcccu

SEQ ID NO: 3078914 - RNA, 16 nt, Human
gugaggcucugcccuu

SEQ ID NO: 3078915 - RNA, 17 nt, Human
gugaggcucugcccuug

SEQ ID NO: 3078916 - RNA, 12 nt, Human
gugaggcucugc

SEQ ID NO: 3078917 - RNA, 13 nt, Human
gugaggcucugcc

SEQ ID NO: 3078918 - RNA, 18 nt, Human
gugagacucugucucaaa

SEQ ID NO: 3078919 - RNA, 19 nt, Human
aacucuccucugcugcugg

SEQ ID NO: 3078920 - RNA, 21 nt, Human
aacucuccucugcugcuggcu

SEQ ID NO: 3078921 - RNA, 21 nt, Human
gugaguacuacaguccuccca

SEQ ID NO: 3078922 - RNA, 17 nt, Human
aacucuccucugcugcu

SEQ ID NO: 3078923 - RNA, 19 nt, Human
gugagucaccaagcccagu

SEQ ID NO: 3078924 - RNA, 23 nt, Human
gugaguacuacaguccucccauc

SEQ ID NO: 3078925 - RNA, 17 nt, Human
gugagucaccaagccca

SEQ ID NO: 3078926 - RNA, 18 nt, Human
gugaggcucugcccuugg

SEQ ID NO: 3078927 - RNA, 22 nt, Human
aacucuccucugcugcuggcug

SEQ ID NO: 3078928 - RNA, 23 nt, Human
aacucuccucugcugcuggcugg

SEQ ID NO: 3078929 - RNA, 20 nt, Human
aacugauuuuuuuuuccuuc

SEQ ID NO: 3078930 - RNA, 21 nt, Human
aacugauuuuuuuuuccuuca

SEQ ID NO: 3078931 - RNA, 22 nt, Human
aacugauuuuuuuuuccuucag

SEQ ID NO: 3078932 - RNA, 23 nt, Human
aacugauuuuuuuuuccuucagu

SEQ ID NO: 3078933 - RNA, 16 nt, Human
aacugcauuggcuuug

SEQ ID NO: 3078934 - RNA, 19 nt, Human
aacugugaaguuuacauug

SEQ ID NO: 3078935 - RNA, 17 nt, Human
aacugugaaguuuacau

SEQ ID NO: 3078936 - RNA, 22 nt, Human
aacuucaccauauuaccacaga

SEQ ID NO: 3078937 - RNA, 22 nt, Human
aacuucacauauugauuuccgu

SEQ ID NO: 3078938 - RNA, 13 nt, Human
aacuucacauauu

SEQ ID NO: 3078939 - RNA, 14 nt, Human
aacuucacauauug

SEQ ID NO: 3078940 - RNA, 13 nt, Human
aacuucagacaua

SEQ ID NO: 3078941 - RNA, 18 nt, Human
aacuucagcgguuuauau

SEQ ID NO: 3078942 - RNA, 22 nt, Human
aacuuccuuggacucauuuuaa

SEQ ID NO: 3078943 - RNA, 23 nt, Human
aacuuccuuggacucauuuuaaa

SEQ ID NO: 3078944 - RNA, 23 nt, Human
gugauccucccaccucagccucc

SEQ ID NO: 3078945 - RNA, 17 nt, Human
gugauuaccagggacug

SEQ ID NO: 3078946 - RNA, 11 nt, Human
gugauuaccag

SEQ ID NO: 3078947 - RNA, 16 nt, Human
gugauuaccagggacu

SEQ ID NO: 3078948 - RNA, 19 nt, Human
gugcauuugaggucuguuc

SEQ ID NO: 3078949 - RNA, 17 nt, Human
gugcauuugaggucugu

SEQ ID NO: 3078950 - RNA, 21 nt, Human
gugcauuuggugguuucagaa

SEQ ID NO: 3078951 - RNA, 23 nt, Human
gugccaaaaacaacaacaaaaug

SEQ ID NO: 3078952 - RNA, 18 nt, Human
gugcaaugaccuuucaau

SEQ ID NO: 3078953 - RNA, 13 nt, Human
gugcacaagcucc

SEQ ID NO: 3078954 - RNA, 16 nt, Human
gugcacaagcuccaag

SEQ ID NO: 3078955 - RNA, 21 nt, Human
gugcacaagcuccaagcuccc

SEQ ID NO: 3078956 - RNA, 21 nt, Human
gugcacaugcacgugugugca

SEQ ID NO: 3078957 - RNA, 16 nt, Human
gugcucaggagcccug

SEQ ID NO: 3078958 - RNA, 18 nt, Human
gugcucaggagcccuggg

SEQ ID NO: 3078959 - RNA, 19 nt, Human
gugcucaggagcccuggga

SEQ ID NO: 3078960 - RNA, 16 nt, Human
gugcucugaucaucca

SEQ ID NO: 3078961 - RNA, 14 nt, Human
gugcucuggacagg

SEQ ID NO: 3078962 - RNA, 13 nt, Human
gugcucuggacag

SEQ ID NO: 3078963 - RNA, 12 nt, Human
gugcugcccugc

SEQ ID NO: 3078964 - RNA, 13 nt, Human
gugcugcccugcc

SEQ ID NO: 3078965 - RNA, 14 nt, Human
gugcugcccugccc

SEQ ID NO: 3078966 - RNA, 15 nt, Human
gugcugcccugccca

SEQ ID NO: 3078967 - RNA, 15 nt, Human
gugcuaucuccccca

SEQ ID NO: 3078968 - RNA, 18 nt, Human
gugcuaucucccccagcc

SEQ ID NO: 3078969 - RNA, 18 nt, Human
gugcuaguaauuggaaag

SEQ ID NO: 3078970 - RNA, 22 nt, Human
gugcuacaaaaacacagcaagg

SEQ ID NO: 3078971 - RNA, 21 nt, Human
gugcuacaaaaacacagcaag

SEQ ID NO: 3078972 - RNA, 14 nt, Human
aagaaaacaacuuc

SEQ ID NO: 3078973 - RNA, 18 nt, Human
aagaaaaaugagccuggc

SEQ ID NO: 3078974 - RNA, 17 nt, Human
aagaaaaaugagccugg

SEQ ID NO: 3078975 - RNA, 13 nt, Human
aagaaaaagaaaa

SEQ ID NO: 3078976 - RNA, 18 nt, Human
aagaaaaagaaaaagaaa

SEQ ID NO: 3078977 - RNA, 19 nt, Human
aagaaaaaauauuuucccu

SEQ ID NO: 3078978 - RNA, 19 nt, Human
gugccagauuuaugcauau

SEQ ID NO: 3078979 - RNA, 23 nt, Human
aacuuuaccuuuuuuauacauaa

SEQ ID NO: 3078980 - RNA, 22 nt, Human
aacuuuaccuuuuuuauacaua

SEQ ID NO: 3078981 - RNA, 21 nt, Human
aacuuuaccuuuuuuauacau

SEQ ID NO: 3078982 - RNA, 16 nt, Human
aagaaagaaaaucagg

SEQ ID NO: 3078983 - RNA, 14 nt, Human
aagaaagaaaauca

SEQ ID NO: 3078984 - RNA, 13 nt, Human
aagaaagaaaauc

SEQ ID NO: 3078985 - RNA, 22 nt, Human
aagaaaauaguggugugauuug

SEQ ID NO: 3078986 - RNA, 21 nt, Human
aagaaaauaguggugugauuu

SEQ ID NO: 3078987 - RNA, 16 nt, Human
aagaaaauaccaagga

SEQ ID NO: 3078988 - RNA, 15 nt, Human
aagaaaauaguggug

SEQ ID NO: 3078989 - RNA, 11 nt, Human
aagaaacauuu

SEQ ID NO: 3078990 - RNA, 23 nt, Human
aaauuaugugccagauuuaugca

SEQ ID NO: 3078991 - RNA, 15 nt, Human
aaaugugcuuuuaaa

SEQ ID NO: 3078992 - RNA, 18 nt, Human
aaaugugccuucauuuuu

SEQ ID NO: 3078993 - RNA, 17 nt, Human
aaauuguauuacaaauc

SEQ ID NO: 3078994 - RNA, 17 nt, Human
aaauuccaagugauuga

SEQ ID NO: 3078995 - RNA, 16 nt, Human
aaaucauucauuuucu

SEQ ID NO: 3078996 - RNA, 21 nt, Human
guauucuaaauuuuauaucuu

SEQ ID NO: 3078997 - RNA, 24 nt, Human
guauucuaaauuuuauaucuugua

SEQ ID NO: 3078998 - RNA, 19 nt, Human
guauucuagcuaauguaau

SEQ ID NO: 3078999 - RNA, 18 nt, Human
guauucucuccuguaccu

SEQ ID NO: 3079000 - RNA, 21 nt, Human
aaaugucucuuuaaugucaca

SEQ ID NO: 3079001 - RNA, 24 nt, Human
aaaugucuaguuguaacaccauga

SEQ ID NO: 3079002 - RNA, 10 nt, Human
gucacugcuu

SEQ ID NO: 3079003 - RNA, 17 nt, Human
gucacugagacagcccg

SEQ ID NO: 3079004 - RNA, 18 nt, Human
gucacugagacagcccgg

SEQ ID NO: 3079005 - RNA, 21 nt, Human
gucacugagacagcccgggcu

SEQ ID NO: 3079006 - RNA, 23 nt, Human
gucacugagacagcccgggcucu

SEQ ID NO: 3079007 - RNA, 22 nt, Human
gucacucuggcagcucagagag

SEQ ID NO: 3079008 - RNA, 14 nt, Human
gucacugagacagc

SEQ ID NO: 3079009 - RNA, 15 nt, Human
gucacugagacagcc

SEQ ID NO: 3079010 - RNA, 16 nt, Human
gucacugagacagccc

SEQ ID NO: 3079011 - RNA, 23 nt, Human
gucacucuggcagcucagagagg

SEQ ID NO: 3079012 - RNA, 15 nt, Human
gucaccaagcccagu

SEQ ID NO: 3079013 - RNA, 12 nt, Human
gucaccaagccc

SEQ ID NO: 3079014 - RNA, 22 nt, Human
gucaauuacaggaaguacugga

SEQ ID NO: 3079015 - RNA, 21 nt, Human
gucaauuuuguuauguauauu

SEQ ID NO: 3079016 - RNA, 13 nt, Human
gucacaggaagua

SEQ ID NO: 3079017 - RNA, 15 nt, Human
gucacaggaaguaga

SEQ ID NO: 3079018 - RNA, 20 nt, Human
gucacaggaaguagaggagg

SEQ ID NO: 3079019 - RNA, 22 nt, Human
gucaccaaaucagcugcuacua

SEQ ID NO: 3079020 - RNA, 18 nt, Human
gucacauuccugaacagg

SEQ ID NO: 3079021 - RNA, 15 nt, Human
aaauuucuaaaucuc

SEQ ID NO: 3079022 - RNA, 13 nt, Human
aaauuucuaaauc

SEQ ID NO: 3079023 - RNA, 12 nt, Human
aaauuucuaaau

SEQ ID NO: 3079024 - RNA, 22 nt, Human
gucagguggggcagcuugaggg

SEQ ID NO: 3079025 - RNA, 18 nt, Human
gucagguggggcagcuug

SEQ ID NO: 3079026 - RNA, 17 nt, Human
gucagguggggcagcuu

SEQ ID NO: 3079027 - RNA, 16 nt, Human
gucagguggggcagcu

SEQ ID NO: 3079028 - RNA, 21 nt, Human
gucacugcuuaacuucacaua

SEQ ID NO: 3079029 - RNA, 15 nt, Human
gucacugcuuaacuu

SEQ ID NO: 3079030 - RNA, 21 nt, Human
gucagaaguuucugccgcagc

SEQ ID NO: 3079031 - RNA, 14 nt, Human
gucaggaaagagaa

SEQ ID NO: 3079032 - RNA, 13 nt, Human
gucaggaaagaga

SEQ ID NO: 3079033 - RNA, 18 nt, Human
gucgcccuggacugugug

SEQ ID NO: 3079034 - RNA, 14 nt, Human
gucuaccugagggg

SEQ ID NO: 3079035 - RNA, 13 nt, Human
gucuaccugaggg

SEQ ID NO: 3079036 - RNA, 15 nt, Human
gucuaccugaggggc

SEQ ID NO: 3079037 - RNA, 16 nt, Human
gucuaccugaggggcc

SEQ ID NO: 3079038 - RNA, 22 nt, Human
gucuaugggacucaaugcacug

SEQ ID NO: 3079039 - RNA, 15 nt, Human
gucuaugggacucaa

SEQ ID NO: 3079040 - RNA, 20 nt, Human
gucuauuuacggaacucaaa

SEQ ID NO: 3079041 - RNA, 16 nt, Human
gucgaggacagggagg

SEQ ID NO: 3079042 - RNA, 12 nt, Human
gucgaggcagga

SEQ ID NO: 3079043 - RNA, 19 nt, Human
guccugcugcaguugccag

SEQ ID NO: 3079044 - RNA, 17 nt, Human
guccugcugcaguugcc

SEQ ID NO: 3079045 - RNA, 16 nt, Human
guccuggcaugggaau

SEQ ID NO: 3079046 - RNA, 14 nt, Human
guccucuuuucuga

SEQ ID NO: 3079047 - RNA, 23 nt, Human
aacauguaauuaaguacuaugua

SEQ ID NO: 3079048 - RNA, 18 nt, Human
aacaguccauugaaaggg

SEQ ID NO: 3079049 - RNA, 13 nt, Human
aacagucucagga

SEQ ID NO: 3079050 - RNA, 12 nt, Human
aacauauauaac

SEQ ID NO: 3079051 - RNA, 14 nt, Human
aacagucucaggaa

SEQ ID NO: 3079052 - RNA, 14 nt, Human
aacauaaaauacaa

SEQ ID NO: 3079053 - RNA, 21 nt, Human
aacacugggagaaaugaaaaa

SEQ ID NO: 3079054 - RNA, 21 nt, Human
aacacucacauuuauucugcu

SEQ ID NO: 3079055 - RNA, 19 nt, Human
aacacuguucucugcccuc

SEQ ID NO: 3079056 - RNA, 17 nt, Human
gucauuugagcagggcu

SEQ ID NO: 3079057 - RNA, 17 nt, Human
aacacuguucucugccc

SEQ ID NO: 3079058 - RNA, 18 nt, Human
aacacuguucucugcccu

SEQ ID NO: 3079059 - RNA, 16 nt, Human
aacacuguucucugcc

SEQ ID NO: 3079060 - RNA, 19 nt, Human
aaauuucuaaaucuccaaa

SEQ ID NO: 3079061 - RNA, 19 nt, Human
aacacaaacgggcucagca

SEQ ID NO: 3079062 - RNA, 17 nt, Human
aacacaacuauauuguu

SEQ ID NO: 3079063 - RNA, 20 nt, Human
aacacagcaagggugauggg

SEQ ID NO: 3079064 - RNA, 18 nt, Human
aacacagcaagggugaug

SEQ ID NO: 3079065 - RNA, 22 nt, Human
guccccaccgcagacaggacca

SEQ ID NO: 3079066 - RNA, 18 nt, Human
guccccaccgcagacagg

SEQ ID NO: 3079067 - RNA, 17 nt, Human
guccccaccgcagacag

SEQ ID NO: 3079068 - RNA, 15 nt, Human
gucccaccccacaca

SEQ ID NO: 3079069 - RNA, 13 nt, Human
gucccaagugcca

SEQ ID NO: 3079070 - RNA, 14 nt, Human
gucccaagugccaa

SEQ ID NO: 3079071 - RNA, 22 nt, Human
guccaugaagauguagaggaga

SEQ ID NO: 3079072 - RNA, 19 nt, Human
gucauuugagcagggcuca

SEQ ID NO: 3079073 - RNA, 12 nt, Human
gucccuaauaaa

SEQ ID NO: 3079074 - RNA, 22 nt, Human
guccccuguuuguuucugaaag

SEQ ID NO: 3079075 - RNA, 18 nt, Human
guccccuguuuguuucug

SEQ ID NO: 3079076 - RNA, 19 nt, Human
gucccugguggcagcucac

SEQ ID NO: 3079077 - RNA, 18 nt, Human
gucccugguggcagcuca

SEQ ID NO: 3079078 - RNA, 18 nt, Human
gucccuuacgugaguccu

SEQ ID NO: 3079079 - RNA, 19 nt, Human
gucccuuacgugaguccug

SEQ ID NO: 3079080 - RNA, 12 nt, Human
aaaaacaacuuu

SEQ ID NO: 3079081 - RNA, 14 nt, Human
aaaaacacaaaagu

SEQ ID NO: 3079082 - RNA, 12 nt, Human
aaaacaacuuua

SEQ ID NO: 3079083 - RNA, 14 nt, Human
aaaacaaggaugaa

SEQ ID NO: 3079084 - RNA, 12 nt, Human
aaaacacauuuu

SEQ ID NO: 3079085 - RNA, 18 nt, Human
aaaacacagcaaggguga

SEQ ID NO: 3079086 - RNA, 13 nt, Human
aaaacacagcaag

SEQ ID NO: 3079087 - RNA, 12 nt, Human
aaaacacagcaa

SEQ ID NO: 3079088 - RNA, 17 nt, Human
aaaacaaggaugaauua

SEQ ID NO: 3079089 - RNA, 12 nt, Human
aaaaagaggcua

SEQ ID NO: 3079090 - RNA, 13 nt, Human
aaaaacugauuuu

SEQ ID NO: 3079091 - RNA, 14 nt, Human
aaaaacauggccuu

SEQ ID NO: 3079092 - RNA, 15 nt, Human
aaaaacugauuuuuu

SEQ ID NO: 3079093 - RNA, 15 nt, Human
auauaaguguguguu

SEQ ID NO: 3079094 - RNA, 22 nt, Human
auauaaguauucuaaauuuuau

SEQ ID NO: 3079095 - RNA, 15 nt, Human
auauaagugauugcu

SEQ ID NO: 3079096 - RNA, 16 nt, Human
auaguaugguggcugg

SEQ ID NO: 3079097 - RNA, 16 nt, Human
auacuugaaaauuaac

SEQ ID NO: 3079098 - RNA, 15 nt, Human
auacuugaaaauuaa

SEQ ID NO: 3079099 - RNA, 15 nt, Human
auaguaugguggcug

SEQ ID NO: 3079100 - RNA, 16 nt, Human
auauaggaacuuaaau

SEQ ID NO: 3079101 - RNA, 16 nt, Human
auauccuuucuaacaa

SEQ ID NO: 3079102 - RNA, 15 nt, Human
auauccuuucuaaca

SEQ ID NO: 3079103 - RNA, 22 nt, Human
auaugccugggcagaaggaaga

SEQ ID NO: 3079104 - RNA, 16 nt, Human
auaugcuuauacacuu

SEQ ID NO: 3079105 - RNA, 14 nt, Human
auaugcuuauacac

SEQ ID NO: 3079106 - RNA, 19 nt, Human
auaugcuuauacacuuaca

SEQ ID NO: 3079107 - RNA, 23 nt, Human
auaugcuucuguuuuauaauuuu

SEQ ID NO: 3079108 - RNA, 18 nt, Human
auaucacuugucaauaaa

SEQ ID NO: 3079109 - RNA, 15 nt, Human
auaucaauuuaaaaa

SEQ ID NO: 3079110 - RNA, 16 nt, Human
auauuuauaaaaauaa

SEQ ID NO: 3079111 - RNA, 18 nt, Human
auauuuaguguucauaaa

SEQ ID NO: 3079112 - RNA, 18 nt, Human
auauuuauuuuaauaaug

SEQ ID NO: 3079113 - RNA, 14 nt, Human
auauuuauuacugu

SEQ ID NO: 3079114 - RNA, 19 nt, Human
auauuuauuacuguaagaa

SEQ ID NO: 3079115 - RNA, 14 nt, Human
auauucaggaagcu

SEQ ID NO: 3079116 - RNA, 16 nt, Human
auauucaggaagcuca

SEQ ID NO: 3079117 - RNA, 13 nt, Human
auauucaggaagc

SEQ ID NO: 3079118 - RNA, 19 nt, Human
auaaguauuuaauucaugu

SEQ ID NO: 3079119 - RNA, 22 nt, Human
auaaguguguguuuuucauaaa

SEQ ID NO: 3079120 - RNA, 19 nt, Human
auaaguguguguuuuucau

SEQ ID NO: 3079121 - RNA, 18 nt, Human
auaaugugaaacuggauu

SEQ ID NO: 3079122 - RNA, 21 nt, Human
auaaugugaaacuggauuaaa

SEQ ID NO: 3079123 - RNA, 19 nt, Human
auaaugugaaacuggauua

SEQ ID NO: 3079124 - RNA, 14 nt, Human
auaauuacuauguc

SEQ ID NO: 3079125 - RNA, 12 nt, Human
auaccugucccc

SEQ ID NO: 3079126 - RNA, 21 nt, Human
agugucuuaauuaaaagaaua

SEQ ID NO: 3079127 - RNA, 18 nt, Human
agugauuaccagggacug

SEQ ID NO: 3079128 - RNA, 15 nt, Human
agugauuaccaggga

SEQ ID NO: 3079129 - RNA, 23 nt, Human
agugugacaaggauugcuacugu

SEQ ID NO: 3079130 - RNA, 19 nt, Human
aguuguaccgcaaugugac

SEQ ID NO: 3079131 - RNA, 18 nt, Human
aguuguaccgcaauguga

SEQ ID NO: 3079132 - RNA, 15 nt, Human
aguugaauuuuacau

SEQ ID NO: 3079133 - RNA, 17 nt, Human
aguuacagacaaagcgu

SEQ ID NO: 3079134 - RNA, 18 nt, Human
aguuacagacaaagcgug

SEQ ID NO: 3079135 - RNA, 16 nt, Human
aguuguuacauuuuua

SEQ ID NO: 3079136 - RNA, 15 nt, Human
aguuguuacauuuuu

SEQ ID NO: 3079137 - RNA, 13 nt, Human
aguuguuacauuu

SEQ ID NO: 3079138 - RNA, 16 nt, Human
agucaagugaaaaagg

SEQ ID NO: 3079139 - RNA, 15 nt, Human
agucaaauuguguga

SEQ ID NO: 3079140 - RNA, 17 nt, Human
agucaaauugugugaaa

SEQ ID NO: 3079141 - RNA, 13 nt, Human
agucaaauugugu

SEQ ID NO: 3079142 - RNA, 20 nt, Human
agucaagugaaaaaggagga

SEQ ID NO: 3079143 - RNA, 23 nt, Human
agucauucagauaugauucaaau

SEQ ID NO: 3079144 - RNA, 15 nt, Human
agucauucagauaug

SEQ ID NO: 3079145 - RNA, 20 nt, Human
agucauucagauaugauuca

SEQ ID NO: 3079146 - RNA, 16 nt, Human
aguccaagcauuuaga

SEQ ID NO: 3079147 - RNA, 11 nt, Human
aguccaagcau

SEQ ID NO: 3079148 - RNA, 21 nt, Human
aguccaagcauuuagauguau

SEQ ID NO: 3079149 - RNA, 13 nt, Human
agugauccuccca

SEQ ID NO: 3079150 - RNA, 13 nt, Human
aguccugcccgcc

SEQ ID NO: 3079151 - RNA, 21 nt, Human
augccuuuguacuuuagggaa

SEQ ID NO: 3079152 - RNA, 21 nt, Human
augccuggauggggcugcacc

SEQ ID NO: 3079153 - RNA, 23 nt, Human
augccuggauggggcugcaccgg

SEQ ID NO: 3079154 - RNA, 14 nt, Human
augccugguggcag

SEQ ID NO: 3079155 - RNA, 17 nt, Human
augccugggcagaagga

SEQ ID NO: 3079156 - RNA, 17 nt, Human
augccugguggcagcug

SEQ ID NO: 3079157 - RNA, 16 nt, Human
augccugguggcagcu

SEQ ID NO: 3079158 - RNA, 15 nt, Human
augccugguggcagc

SEQ ID NO: 3079159 - RNA, 12 nt, Human
augcauuugaaa

SEQ ID NO: 3079160 - RNA, 10 nt, Human
augcauuuga

SEQ ID NO: 3079161 - RNA, 18 nt, Human
augcauuugaaaauuuug

SEQ ID NO: 3079162 - RNA, 23 nt, Human
augcaugaaguaauaugcacaca

SEQ ID NO: 3079163 - RNA, 20 nt, Human
augcaugaaguaauaugcac

SEQ ID NO: 3079164 - RNA, 22 nt, Human
augcacacauuuuuuaaaugca

SEQ ID NO: 3079165 - RNA, 19 nt, Human
augcacacauuuuuuaaau

SEQ ID NO: 3079166 - RNA, 17 nt, Human
augcacacauuuuuuaa

SEQ ID NO: 3079167 - RNA, 23 nt, Human
augcacagaguuguuacauuuuu

SEQ ID NO: 3079168 - RNA, 14 nt, Human
augcacagcuaaca

SEQ ID NO: 3079169 - RNA, 21 nt, Human
augcacagcuaacauggaagu

SEQ ID NO: 3079170 - RNA, 23 nt, Human
auggcugccaaugggagcucaug

SEQ ID NO: 3079171 - RNA, 15 nt, Human
augggaaugaauguc

SEQ ID NO: 3079172 - RNA, 22 nt, Human
augcuucuucagagacuccugc

SEQ ID NO: 3079173 - RNA, 19 nt, Human
auggaaaugggcagagcag

SEQ ID NO: 3079174 - RNA, 20 nt, Human
auggaaaugggcagagcaga

SEQ ID NO: 3079175 - RNA, 18 nt, Human
auguuucuuuguaaugaa

SEQ ID NO: 3079176 - RNA, 14 nt, Human
auguucuuaauucu

SEQ ID NO: 3079177 - RNA, 22 nt, Human
auguucugacccugcuucaaau

SEQ ID NO: 3079178 - RNA, 20 nt, Human
auguucuuaguggauguucu

SEQ ID NO: 3079179 - RNA, 15 nt, Human
auguucuuaauucuu

SEQ ID NO: 3079180 - RNA, 17 nt, Human
auguucucugaggacac

SEQ ID NO: 3079181 - RNA, 18 nt, Human
auguucucugaggacacu

SEQ ID NO: 3079182 - RNA, 18 nt, Human
auguuuuaagaggcaggg

SEQ ID NO: 3079183 - RNA, 16 nt, Human
auguuuuaagaggcag

SEQ ID NO: 3079184 - RNA, 14 nt, Human
auuaaaugcccagc

SEQ ID NO: 3079185 - RNA, 15 nt, Human
auuaaaugcccagcc

SEQ ID NO: 3079186 - RNA, 13 nt, Human
auuaaauucuugc

SEQ ID NO: 3079187 - RNA, 16 nt, Human
auuaaaugcccagccc

SEQ ID NO: 3079188 - RNA, 11 nt, Human
auuaaauuaug

SEQ ID NO: 3079189 - RNA, 14 nt, Human
auguguaaguauuc

SEQ ID NO: 3079190 - RNA, 20 nt, Human
augugggcuaguugggcuuc

SEQ ID NO: 3079191 - RNA, 15 nt, Human
auggucggaaaacau

SEQ ID NO: 3079192 - RNA, 17 nt, Human
auguaauaacugugaag

SEQ ID NO: 3079193 - RNA, 16 nt, Human
auguaaguaaacgguc

SEQ ID NO: 3079194 - RNA, 17 nt, Human
auguaagcucuacugag

SEQ ID NO: 3079195 - RNA, 20 nt, Human
auguaagggaaacugccagc

SEQ ID NO: 3079196 - RNA, 22 nt, Human
auguaagggaaacugccagcaa

SEQ ID NO: 3079197 - RNA, 21 nt, Human
auguaagggaaacugccagca

SEQ ID NO: 3079198 - RNA, 16 nt, Human
augucacaggcagguc

SEQ ID NO: 3079199 - RNA, 14 nt, Human
augucacaggcagg

SEQ ID NO: 3079200 - RNA, 15 nt, Human
augucacaggcaggu

SEQ ID NO: 3079201 - RNA, 13 nt, Human
auccuuucuaaca

SEQ ID NO: 3079202 - RNA, 13 nt, Human
aucgaugcagugc

SEQ ID NO: 3079203 - RNA, 13 nt, Human
auccuccaggugc

SEQ ID NO: 3079204 - RNA, 14 nt, Human
auccuccaggugca

SEQ ID NO: 3079205 - RNA, 19 nt, Human
auccuccaggugcacaagc

SEQ ID NO: 3079206 - RNA, 22 nt, Human
auccuccaggugcacaagcucc

SEQ ID NO: 3079207 - RNA, 11 nt, Human
auccuccucag

SEQ ID NO: 3079208 - RNA, 16 nt, Human
auccacccaccucagc

SEQ ID NO: 3079209 - RNA, 20 nt, Human
auccacccaccucagccucc

SEQ ID NO: 3079210 - RNA, 18 nt, Human
auccacccaccucagccu

SEQ ID NO: 3079211 - RNA, 18 nt, Human
auccucauacccaccccc

SEQ ID NO: 3079212 - RNA, 19 nt, Human
auccucauacccaccccca

SEQ ID NO: 3079213 - RNA, 22 nt, Human
auccucauacccacccccaccc

SEQ ID NO: 3079214 - RNA, 15 nt, Human
aucccuacuguaauu

SEQ ID NO: 3079215 - RNA, 23 nt, Human
aucagcugcuacuacuccuguag

SEQ ID NO: 3079216 - RNA, 13 nt, Human
aucagcugcuacu

SEQ ID NO: 3079217 - RNA, 20 nt, Human
aucagccugcuccagcuguu

SEQ ID NO: 3079218 - RNA, 19 nt, Human
aucauggagguuugaagau

SEQ ID NO: 3079219 - RNA, 11 nt, Human
aucagccuggg

SEQ ID NO: 3079220 - RNA, 20 nt, Human
aucagccugggcaaugugau

SEQ ID NO: 3079221 - RNA, 21 nt, Human
aucagccugggcaaugugaua

SEQ ID NO: 3079222 - RNA, 12 nt, Human
aucagcugcuac

SEQ ID NO: 3079223 - RNA, 22 nt, Human
aucuuauaauuuaaaauaugcu

SEQ ID NO: 3079224 - RNA, 19 nt, Human
aucuuccaacucaaacucu

SEQ ID NO: 3079225 - RNA, 22 nt, Human
aucucucgugauugauaagaac

SEQ ID NO: 3079226 - RNA, 17 nt, Human
aucuugaagacuuuucu

SEQ ID NO: 3079227 - RNA, 17 nt, Human
aucuucuuuauaauucu

SEQ ID NO: 3079228 - RNA, 14 nt, Human
augacucagaauau

SEQ ID NO: 3079229 - RNA, 12 nt, Human
augacuccagaa

SEQ ID NO: 3079230 - RNA, 16 nt, Human
augacuccagaauuuc

SEQ ID NO: 3079231 - RNA, 17 nt, Human
augacuccagaauuucc

SEQ ID NO: 3079232 - RNA, 12 nt, Human
augagccuggca

SEQ ID NO: 3079233 - RNA, 21 nt, Human
augaagcuuuuaugugaaaca

SEQ ID NO: 3079234 - RNA, 20 nt, Human
augaagcuuuuaugugaaac

SEQ ID NO: 3079235 - RNA, 19 nt, Human
augaagcuuuuaugugaaa

SEQ ID NO: 3079236 - RNA, 18 nt, Human
augaagcuuuuaugugaa

SEQ ID NO: 3079237 - RNA, 12 nt, Human
augacccagugg

SEQ ID NO: 3079238 - RNA, 17 nt, Human
augaaaaaauauauauc

SEQ ID NO: 3079239 - RNA, 14 nt, Human
augaaaaaauauau

SEQ ID NO: 3079240 - RNA, 22 nt, Human
augaaaaaauauauaucaaaua

SEQ ID NO: 3079241 - RNA, 20 nt, Human
augaaacacucaguuguuca

SEQ ID NO: 3079242 - RNA, 13 nt, Human
augagccuggcaa

SEQ ID NO: 3079243 - RNA, 14 nt, Human
augagccuggcaag

SEQ ID NO: 3079244 - RNA, 14 nt, Human
agcaugcacaaauu

SEQ ID NO: 3079245 - RNA, 12 nt, Human
agcaugccugga

SEQ ID NO: 3079246 - RNA, 12 nt, Human
agcaugaagaca

SEQ ID NO: 3079247 - RNA, 23 nt, Human
agccaaagcuaggccuggccaga

SEQ ID NO: 3079248 - RNA, 20 nt, Human
agccaaagcuaggccuggcc

SEQ ID NO: 3079249 - RNA, 19 nt, Human
agccaaagcuaggccuggc

SEQ ID NO: 3079250 - RNA, 18 nt, Human
agccaaagcuaggccugg

SEQ ID NO: 3079251 - RNA, 20 nt, Human
agccagaggagagaggaccc

SEQ ID NO: 3079252 - RNA, 23 nt, Human
agccaaggccaaaggaagcacau

SEQ ID NO: 3079253 - RNA, 22 nt, Human
agccaaggccaaaggaagcaca

SEQ ID NO: 3079254 - RNA, 20 nt, Human
agccaaggccaaaggaagca

SEQ ID NO: 3079255 - RNA, 18 nt, Human
agccauuugucccaagug

SEQ ID NO: 3079256 - RNA, 17 nt, Human
agccauuugucccaagu

SEQ ID NO: 3079257 - RNA, 14 nt, Human
agccauuuguccca

SEQ ID NO: 3079258 - RNA, 15 nt, Human
agccagauuuuccug

SEQ ID NO: 3079259 - RNA, 19 nt, Human
agccagauuuuccugaaaa

SEQ ID NO: 3079260 - RNA, 19 nt, Human
agcacuaaggugugcucug

SEQ ID NO: 3079261 - RNA, 21 nt, Human
agcagccacauuccugaugcu

SEQ ID NO: 3079262 - RNA, 15 nt, Human
agcagccacauuccu

SEQ ID NO: 3079263 - RNA, 21 nt, Human
agcaguugaaaagacuccaaa

SEQ ID NO: 3079264 - RNA, 23 nt, Human
agcaguugaaaagacuccaaaga

SEQ ID NO: 3079265 - RNA, 21 nt, Human
agaugggagaaucacuugaac

SEQ ID NO: 3079266 - RNA, 14 nt, Human
agauguagaggaga

SEQ ID NO: 3079267 - RNA, 19 nt, Human
agccucccaaagugcuggg

SEQ ID NO: 3079268 - RNA, 18 nt, Human
agccucccaaagugcugg

SEQ ID NO: 3079269 - RNA, 21 nt, Human
agccgggcgugguggugagug

SEQ ID NO: 3079270 - RNA, 14 nt, Human
agccgcuggggcca

SEQ ID NO: 3079271 - RNA, 22 nt, Human
agccgcuggggccaguuggucc

SEQ ID NO: 3079272 - RNA, 18 nt, Human
agccgagaucacgccacu

SEQ ID NO: 3079273 - RNA, 20 nt, Human
agccgagauugcaccacugc

SEQ ID NO: 3079274 - RNA, 19 nt, Human
agccgagauugcaccacug

SEQ ID NO: 3079275 - RNA, 21 nt, Human
agccgagaucacgccacugca

SEQ ID NO: 3079276 - RNA, 17 nt, Human
agccucccgaguagcug

SEQ ID NO: 3079277 - RNA, 22 nt, Human
agccucccgaauagcugggacu

SEQ ID NO: 3079278 - RNA, 20 nt, Human
agccucccgaauagcuggga

SEQ ID NO: 3079279 - RNA, 19 nt, Human
agccucccgaauagcuggg

SEQ ID NO: 3079280 - RNA, 18 nt, Human
agccucccgaauagcugg

SEQ ID NO: 3079281 - RNA, 17 nt, Human
agccucccaaagugcug

SEQ ID NO: 3079282 - RNA, 22 nt, Human
agccucccgaguagcugggacu

SEQ ID NO: 3079283 - RNA, 20 nt, Human
agccgagaucacgccacugc

SEQ ID NO: 3079284 - RNA, 19 nt, Human
agccgagaucacgccacug

SEQ ID NO: 3079285 - RNA, 15 nt, Human
agcccugagcuuucu

SEQ ID NO: 3079286 - RNA, 20 nt, Human
agccccaucccaaacccuuc

SEQ ID NO: 3079287 - RNA, 11 nt, Human
agccccauccu

SEQ ID NO: 3079288 - RNA, 16 nt, Human
agccccagugcccaca

SEQ ID NO: 3079289 - RNA, 19 nt, Human
agccccacccucagaugca

SEQ ID NO: 3079290 - RNA, 21 nt, Human
agauaggucagugcaaauacu

SEQ ID NO: 3079291 - RNA, 15 nt, Human
agauagccaaggcca

SEQ ID NO: 3079292 - RNA, 16 nt, Human
agauagccaaggccaa

SEQ ID NO: 3079293 - RNA, 22 nt, Human
agaggggaacagacuggaagca

SEQ ID NO: 3079294 - RNA, 16 nt, Human
agaggggaagagacuu

SEQ ID NO: 3079295 - RNA, 13 nt, Human
agaggagaggggc

SEQ ID NO: 3079296 - RNA, 23 nt, Human
agaggguggugaccucugccuga

SEQ ID NO: 3079297 - RNA, 22 nt, Human
agauacuuggggggcugaggug

SEQ ID NO: 3079298 - RNA, 13 nt, Human
agauagccaaggc

SEQ ID NO: 3079299 - RNA, 14 nt, Human
agacacaacuauuu

SEQ ID NO: 3079300 - RNA, 16 nt, Human
agacagcccgggcucu

SEQ ID NO: 3079301 - RNA, 17 nt, Human
agacagcccgggcucug

SEQ ID NO: 3079302 - RNA, 18 nt, Human
agacagcccgggcucugc

SEQ ID NO: 3079303 - RNA, 20 nt, Human
agacagcccgggcucugccu

SEQ ID NO: 3079304 - RNA, 14 nt, Human
agaccaucccugaa

SEQ ID NO: 3079305 - RNA, 17 nt, Human
agaccaucccugaaggc

SEQ ID NO: 3079306 - RNA, 18 nt, Human
agaccaucccugaaggcc

SEQ ID NO: 3079307 - RNA, 21 nt, Human
agaccaucccugaaggccccg

SEQ ID NO: 3079308 - RNA, 13 nt, Human
agaccaucccuga

SEQ ID NO: 3079309 - RNA, 18 nt, Human
agacgggggcagagaggg

SEQ ID NO: 3079310 - RNA, 19 nt, Human
agacggagucccaccuugg

SEQ ID NO: 3079311 - RNA, 15 nt, Human
agacaauuuauuaug

SEQ ID NO: 3079312 - RNA, 19 nt, Human
agacaaugacuuacuguac

SEQ ID NO: 3079313 - RNA, 21 nt, Human
agacaauuuauuauggcacau

SEQ ID NO: 3079314 - RNA, 17 nt, Human
agacaaugacuuacugu

SEQ ID NO: 3079315 - RNA, 13 nt, Human
agacaaugacuua

SEQ ID NO: 3079316 - RNA, 10 nt, Human
agagaagaga

SEQ ID NO: 3079317 - RNA, 21 nt, Human
agagaagagauugugguuuca

SEQ ID NO: 3079318 - RNA, 17 nt, Human
agacugcauuauauuua

SEQ ID NO: 3079319 - RNA, 23 nt, Human
agagaggguggugaccucugccu

SEQ ID NO: 3079320 - RNA, 13 nt, Human
agagccccacagc

SEQ ID NO: 3079321 - RNA, 15 nt, Human
agagccccacagccc

SEQ ID NO: 3079322 - RNA, 23 nt, Human
agacugaguacguugugcauuug

SEQ ID NO: 3079323 - RNA, 15 nt, Human
aggaacuacugagga

SEQ ID NO: 3079324 - RNA, 20 nt, Human
aggaccccuccaugugggcu

SEQ ID NO: 3079325 - RNA, 14 nt, Human
aggaccucagguga

SEQ ID NO: 3079326 - RNA, 20 nt, Human
aggaccucaggugagaagca

SEQ ID NO: 3079327 - RNA, 15 nt, Human
aggagagcuagcagc

SEQ ID NO: 3079328 - RNA, 14 nt, Human
aggagaggggcaca

SEQ ID NO: 3079329 - RNA, 16 nt, Human
aggagaggggcacagg

SEQ ID NO: 3079330 - RNA, 18 nt, Human
aggagaggggcacagggu

SEQ ID NO: 3079331 - RNA, 12 nt, Human
aggauucuuccu

SEQ ID NO: 3079332 - RNA, 20 nt, Human
aggauguucugggacacagu

SEQ ID NO: 3079333 - RNA, 14 nt, Human
aggauguugaaaaa

SEQ ID NO: 3079334 - RNA, 18 nt, Human
aggauguucugggacaca

SEQ ID NO: 3079335 - RNA, 17 nt, Human
aggaggggauagagaga

SEQ ID NO: 3079336 - RNA, 15 nt, Human
agcuuuucccuuuuu

SEQ ID NO: 3079337 - RNA, 13 nt, Human
aggaaaaacugau

SEQ ID NO: 3079338 - RNA, 15 nt, Human
aggaaaaacugauuu

SEQ ID NO: 3079339 - RNA, 21 nt, Human
agcuuuuaugugaaacauguu

SEQ ID NO: 3079340 - RNA, 18 nt, Human
agcuucacuguaaaauaa

SEQ ID NO: 3079341 - RNA, 19 nt, Human
agcuuccuucugugaaagu

SEQ ID NO: 3079342 - RNA, 19 nt, Human
agcuggucccacucagucc

SEQ ID NO: 3079343 - RNA, 21 nt, Human
agcuggucccacucaguccau

SEQ ID NO: 3079344 - RNA, 22 nt, Human
agcugggugucaagagggucug

SEQ ID NO: 3079345 - RNA, 17 nt, Human
agcugggugucaagagg

SEQ ID NO: 3079346 - RNA, 13 nt, Human
aggcugccagugc

SEQ ID NO: 3079347 - RNA, 23 nt, Human
aggcuagugugguguuuccuggc

SEQ ID NO: 3079348 - RNA, 12 nt, Human
agggacagaggg

SEQ ID NO: 3079349 - RNA, 13 nt, Human
agggacagagggg

SEQ ID NO: 3079350 - RNA, 20 nt, Human
agggacagaggggguggccu

SEQ ID NO: 3079351 - RNA, 21 nt, Human
agggacgcuacccgggaaggg

SEQ ID NO: 3079352 - RNA, 17 nt, Human
agggacgcuacccggga

SEQ ID NO: 3079353 - RNA, 18 nt, Human
aggcugccucucccauca

SEQ ID NO: 3079354 - RNA, 19 nt, Human
aggcugccagugccugggu

SEQ ID NO: 3079355 - RNA, 20 nt, Human
aggcugccagugccugggug

SEQ ID NO: 3079356 - RNA, 14 nt, Human
aggcugccagugcc

SEQ ID NO: 3079357 - RNA, 15 nt, Human
aggcugccagugccu

SEQ ID NO: 3079358 - RNA, 16 nt, Human
aggcugccagugccug

SEQ ID NO: 3079359 - RNA, 15 nt, Human
aggggcacagggucu

SEQ ID NO: 3079360 - RNA, 21 nt, Human
aggggauagagagagaccacu

SEQ ID NO: 3079361 - RNA, 16 nt, Human
aggggauagagagaga

SEQ ID NO: 3079362 - RNA, 19 nt, Human
agggcgggaggauguucug

SEQ ID NO: 3079363 - RNA, 14 nt, Human
agggccuggccuga

SEQ ID NO: 3079364 - RNA, 15 nt, Human
agggccuggccugag

SEQ ID NO: 3079365 - RNA, 16 nt, Human
agggccuggccugagc

SEQ ID NO: 3079366 - RNA, 17 nt, Human
agggccuggccugagcu

SEQ ID NO: 3079367 - RNA, 22 nt, Human
agggcacagaaaauggaagaca

SEQ ID NO: 3079368 - RNA, 21 nt, Human
agggcacaccgggcacucaga

SEQ ID NO: 3079369 - RNA, 20 nt, Human
agggcacaccgggcacucag

SEQ ID NO: 3079370 - RNA, 17 nt, Human
agggcacaccgggcacu

SEQ ID NO: 3079371 - RNA, 22 nt, Human
agguuaauuccaauuauaugag

SEQ ID NO: 3079372 - RNA, 15 nt, Human
agguuaauuccaauu

SEQ ID NO: 3079373 - RNA, 14 nt, Human
agguuaauguucau

SEQ ID NO: 3079374 - RNA, 17 nt, Human
agguucaaagauauuuu

SEQ ID NO: 3079375 - RNA, 15 nt, Human
agguucaaagauauu

SEQ ID NO: 3079376 - RNA, 15 nt, Human
agguuaauaaaguaa

SEQ ID NO: 3079377 - RNA, 17 nt, Human
agguucaugcaaacuuu

SEQ ID NO: 3079378 - RNA, 13 nt, Human
agguucagcuugu

SEQ ID NO: 3079379 - RNA, 15 nt, Human
agguggaaauaaacu

SEQ ID NO: 3079380 - RNA, 14 nt, Human
aggucgaggcagga

SEQ ID NO: 3079381 - RNA, 16 nt, Human
aggugcugccauccag

SEQ ID NO: 3079382 - RNA, 17 nt, Human
aggugcugccauccagg

SEQ ID NO: 3079383 - RNA, 20 nt, Human
aggucccuaauaaagcugug

SEQ ID NO: 3079384 - RNA, 16 nt, Human
aggucccuaauaaagc

SEQ ID NO: 3079385 - RNA, 19 nt, Human
aggucccuaauaaagcugu

SEQ ID NO: 3079386 - RNA, 18 nt, Human
aggucccuaauaaagcug

SEQ ID NO: 3079387 - RNA, 17 nt, Human
aggucccuaauaaagcu

SEQ ID NO: 3079388 - RNA, 17 nt, Human
agguaaggaauaccugu

SEQ ID NO: 3079389 - RNA, 19 nt, Human
aagucucuggaauuugaaa

SEQ ID NO: 3079390 - RNA, 16 nt, Human
aagucuuagauguaua

SEQ ID NO: 3079391 - RNA, 15 nt, Human
aaguacuuuuggcau

SEQ ID NO: 3079392 - RNA, 14 nt, Human
aaguacuuuuggca

SEQ ID NO: 3079393 - RNA, 11 nt, Human
aaguacuucuu

SEQ ID NO: 3079394 - RNA, 23 nt, Human
aaguccaggcuuuuuuaucaugu

SEQ ID NO: 3079395 - RNA, 16 nt, Human
aaguaucccuacugua

SEQ ID NO: 3079396 - RNA, 11 nt, Human
aaggugggagg

SEQ ID NO: 3079397 - RNA, 16 nt, Human
aagguuaauaaaguaa

SEQ ID NO: 3079398 - RNA, 15 nt, Human
aagguuaauaaagua

SEQ ID NO: 3079399 - RNA, 20 nt, Human
aagguuaauguucaucaucc

SEQ ID NO: 3079400 - RNA, 21 nt, Human
aauaauccuaaacauaugaau

SEQ ID NO: 3079401 - RNA, 19 nt, Human
aauaauguaagacaaauau

SEQ ID NO: 3079402 - RNA, 12 nt, Human
aauaauguaaga

SEQ ID NO: 3079403 - RNA, 19 nt, Human
aauaaacuauuuguaaagu

SEQ ID NO: 3079404 - RNA, 17 nt, Human
aauaaacgucuuaaaua

SEQ ID NO: 3079405 - RNA, 16 nt, Human
aauaaacgucuuaaau

SEQ ID NO: 3079406 - RNA, 22 nt, Human
aaguuguaggcauaaagucagg

SEQ ID NO: 3079407 - RNA, 22 nt, Human
aagugcugggauuacaggugug

SEQ ID NO: 3079408 - RNA, 13 nt, Human
aagaaauuaugug

SEQ ID NO: 3079409 - RNA, 22 nt, Human
aagaaauuaugugccagauuua

SEQ ID NO: 3079410 - RNA, 16 nt, Human
aagauuuaccacuugu

SEQ ID NO: 3079411 - RNA, 14 nt, Human
aagcagaggaagga

SEQ ID NO: 3079412 - RNA, 23 nt, Human
aagcagaccauuggggcucccag

SEQ ID NO: 3079413 - RNA, 22 nt, Human
aagcagaccauuggggcuccca

SEQ ID NO: 3079414 - RNA, 11 nt, Human
aagcagcucuu

SEQ ID NO: 3079415 - RNA, 13 nt, Human
aagccagauuuuc

SEQ ID NO: 3079416 - RNA, 18 nt, Human
aagccauaauuguucuua

SEQ ID NO: 3079417 - RNA, 12 nt, Human
aagcguggugga

SEQ ID NO: 3079418 - RNA, 22 nt, Human
aagcugcacccucaggcaggug

SEQ ID NO: 3079419 - RNA, 21 nt, Human
aagcugcacccucaggcaggu

SEQ ID NO: 3079420 - RNA, 20 nt, Human
aagcugcacccucaggcagg

SEQ ID NO: 3079421 - RNA, 18 nt, Human
aaggacauugcggacagc

SEQ ID NO: 3079422 - RNA, 13 nt, Human
aagcugggcaggu

SEQ ID NO: 3079423 - RNA, 11 nt, Human
aagcugggcag

SEQ ID NO: 3079424 - RNA, 17 nt, Human
aaggcaaggcugucaau

SEQ ID NO: 3079425 - RNA, 18 nt, Human
aaggcaaggcugucaauu

SEQ ID NO: 3079426 - RNA, 16 nt, Human
aaggcaaggcugucaa

SEQ ID NO: 3079427 - RNA, 13 nt, Human
aaugucaguguga

SEQ ID NO: 3079428 - RNA, 15 nt, Human
aaugucagugugacu

SEQ ID NO: 3079429 - RNA, 16 nt, Human
aaugucagugugacug

SEQ ID NO: 3079430 - RNA, 20 nt, Human
aaugucucuuuaaugucaca

SEQ ID NO: 3079431 - RNA, 17 nt, Human
aaugucagugugacuga

SEQ ID NO: 3079432 - RNA, 21 nt, Human
aaugucagugugacugaucuc

SEQ ID NO: 3079433 - RNA, 22 nt, Human
aaugucuaguuguaacaccaug

SEQ ID NO: 3079434 - RNA, 15 nt, Human
aaugggcagagcaga

SEQ ID NO: 3079435 - RNA, 13 nt, Human
aaugggcagagca

SEQ ID NO: 3079436 - RNA, 14 nt, Human
aauuaaauuuugag

SEQ ID NO: 3079437 - RNA, 18 nt, Human
aauguuugccucugccuc

SEQ ID NO: 3079438 - RNA, 19 nt, Human
aauguuugccucugccucu

SEQ ID NO: 3079439 - RNA, 18 nt, Human
aauuaaaacacaacaucu

SEQ ID NO: 3079440 - RNA, 18 nt, Human
aauuaguggcacuugcuu

SEQ ID NO: 3079441 - RNA, 14 nt, Human
aauuaguuuuauau

SEQ ID NO: 3079442 - RNA, 17 nt, Human
aauuaguuuuauaugcu

SEQ ID NO: 3079443 - RNA, 20 nt, Human
aauuaguuuuauaugcuucu

SEQ ID NO: 3079444 - RNA, 18 nt, Human
aaucucauaauuuauaca

SEQ ID NO: 3079445 - RNA, 13 nt, Human
aaucuccaaaaua

SEQ ID NO: 3079446 - RNA, 14 nt, Human
aaucuccaaaauaa

SEQ ID NO: 3079447 - RNA, 13 nt, Human
aauccauacauuu

SEQ ID NO: 3079448 - RNA, 18 nt, Human
aaugauaaguaaaugcua

SEQ ID NO: 3079449 - RNA, 17 nt, Human
aaugaagauacugaaau

SEQ ID NO: 3079450 - RNA, 20 nt, Human
aaugauaacuggaaacuuca

SEQ ID NO: 3079451 - RNA, 21 nt, Human
aaugauaaguaaaugcuaggu

SEQ ID NO: 3079452 - RNA, 21 nt, Human
aaugaugauccuaggcauuug

SEQ ID NO: 3079453 - RNA, 17 nt, Human
aaugauaacuggaaacu

SEQ ID NO: 3079454 - RNA, 12 nt, Human
aaugaagauacu

SEQ ID NO: 3079455 - RNA, 23 nt, Human
aaugaaccacaucuugcucugcu

SEQ ID NO: 3079456 - RNA, 17 nt, Human
aaugaaccacaucuugc

SEQ ID NO: 3079457 - RNA, 16 nt, Human
aaugaaccacaucuug

SEQ ID NO: 3079458 - RNA, 22 nt, Human
aaucugcuuuuuaaagaaugcu

SEQ ID NO: 3079459 - RNA, 19 nt, Human
aaugaugccaugaggaaca

SEQ ID NO: 3079460 - RNA, 14 nt, Human
aauauuauguguuu

SEQ ID NO: 3079461 - RNA, 16 nt, Human
aauauuauguuaaaac

SEQ ID NO: 3079462 - RNA, 15 nt, Human
aaucaagaaacuuaa

SEQ ID NO: 3079463 - RNA, 13 nt, Human
aaucacaauacau

SEQ ID NO: 3079464 - RNA, 16 nt, Human
aauauaggaacuuaaa

SEQ ID NO: 3079465 - RNA, 21 nt, Human
aauauaggaacuuaaauaaug

SEQ ID NO: 3079466 - RNA, 20 nt, Human
aauauaggaacuuaaauaau

SEQ ID NO: 3079467 - RNA, 18 nt, Human
aauauaggaacuuaaaua

SEQ ID NO: 3079468 - RNA, 21 nt, Human
aaauugauguguuuauuuaua

SEQ ID NO: 3079469 - RNA, 17 nt, Human
aacaaagaaauuaugug

SEQ ID NO: 3079470 - RNA, 15 nt, Human
aacaaagaaauuaug

SEQ ID NO: 3079471 - RNA, 19 nt, Human
aacaccucugcacaagcug

SEQ ID NO: 3079472 - RNA, 15 nt, Human
aacacgagcaggcua

SEQ ID NO: 3079473 - RNA, 19 nt, Human
aacacauuuuucuuaggga

SEQ ID NO: 3079474 - RNA, 13 nt, Human
aacaugauuuggg

SEQ ID NO: 3079475 - RNA, 12 nt, Human
aaccagaucauu

SEQ ID NO: 3079476 - RNA, 14 nt, Human
aaccagaucauugu

SEQ ID NO: 3079477 - RNA, 21 nt, Human
aacauguaauuaaguacuaug

SEQ ID NO: 3079478 - RNA, 14 nt, Human
aacauguaauuaag

SEQ ID NO: 3079479 - RNA, 22 nt, Human
aaccacucuaucaaguauuaua

SEQ ID NO: 3079480 - RNA, 14 nt, Human
aacccuggugacca

SEQ ID NO: 3079481 - RNA, 16 nt, Human
aacuuuggaacaagau

SEQ ID NO: 3079482 - RNA, 20 nt, Human
aacuuugaccucugcagcaa

SEQ ID NO: 3079483 - RNA, 19 nt, Human
aacuuugaccucugcagca

SEQ ID NO: 3079484 - RNA, 15 nt, Human
aacuuuuauaaacuu

SEQ ID NO: 3079485 - RNA, 12 nt, Human
aacuuuuauaaa

SEQ ID NO: 3079486 - RNA, 17 nt, Human
aacuuugaccucugcag

SEQ ID NO: 3079487 - RNA, 14 nt, Human
aacuuugaccucug

SEQ ID NO: 3079488 - RNA, 13 nt, Human
aacuuugaccucu

SEQ ID NO: 3079489 - RNA, 19 nt, Human
aacuuuuauaaacuuuacc

SEQ ID NO: 3079490 - RNA, 16 nt, Human
aacuuuuauaaacuuu

SEQ ID NO: 3079491 - RNA, 14 nt, Human
aagaaauguaaggg

SEQ ID NO: 3079492 - RNA, 13 nt, Human
aagaaauguaagg

SEQ ID NO: 3079493 - RNA, 12 nt, Human
aacucaccccag

SEQ ID NO: 3079494 - RNA, 15 nt, Human
aacucaccugccccu

SEQ ID NO: 3079495 - RNA, 16 nt, Human
aacucaccugccccuc

SEQ ID NO: 3079496 - RNA, 17 nt, Human
aacuuaaauaaugugaa

SEQ ID NO: 3079497 - RNA, 17 nt, Human
aacugauuuuuuuuucc

SEQ ID NO: 3079498 - RNA, 19 nt, Human
aacugauuuuuuuuuccuu

SEQ ID NO: 3079499 - RNA, 23 nt, Human
aacugacacaugcugaacaucac

SEQ ID NO: 3079500 - RNA, 16 nt, Human
aaagggacugagaaau

SEQ ID NO: 3079501 - RNA, 19 nt, Human
aaagucucuggaauuugaa

SEQ ID NO: 3079502 - RNA, 22 nt, Human
aaagucucuggaauuugaaaca

SEQ ID NO: 3079503 - RNA, 20 nt, Human
aaagucucuggaauuugaaa

SEQ ID NO: 3079504 - RNA, 12 nt, Human
aaauaacaauga

SEQ ID NO: 3079505 - RNA, 17 nt, Human
aaauaaacgucuuaaau

SEQ ID NO: 3079506 - RNA, 11 nt, Human
aaagugcuggg

SEQ ID NO: 3079507 - RNA, 14 nt, Human
aaagugcugggauu

SEQ ID NO: 3079508 - RNA, 14 nt, Human
aaauaguauuugag

SEQ ID NO: 3079509 - RNA, 21 nt, Human
aaauggacguguuaugacucc

SEQ ID NO: 3079510 - RNA, 22 nt, Human
aaauggacguguuaugacucca

SEQ ID NO: 3079511 - RNA, 20 nt, Human
aaauggacguguuaugacuc

SEQ ID NO: 3079512 - RNA, 16 nt, Human
aaauggaaaugggcag

SEQ ID NO: 3079513 - RNA, 18 nt, Human
aaauggaagacagcucuu

SEQ ID NO: 3079514 - RNA, 16 nt, Human
aaaucaaauaugcaaa

SEQ ID NO: 3079515 - RNA, 19 nt, Human
aaaucaaauaugcaaagca

SEQ ID NO: 3079516 - RNA, 18 nt, Human
aaaucaaauaugcaaagc

SEQ ID NO: 3079517 - RNA, 21 nt, Human
aaaauuauuuuguucauacau

SEQ ID NO: 3079518 - RNA, 15 nt, Human
aaaacacauuuuucu

SEQ ID NO: 3079519 - RNA, 13 nt, Human
aaaacacauuuuu

SEQ ID NO: 3079520 - RNA, 13 nt, Human
aaaauucagugga

SEQ ID NO: 3079521 - RNA, 13 nt, Human
aaacacucuugaa

SEQ ID NO: 3079522 - RNA, 17 nt, Human
aaacacucuugaaaaau

SEQ ID NO: 3079523 - RNA, 14 nt, Human
aaacacucuugaaa

SEQ ID NO: 3079524 - RNA, 18 nt, Human
aaacacuguucucugccc

SEQ ID NO: 3079525 - RNA, 19 nt, Human
aaacacuguucucugcccu

SEQ ID NO: 3079526 - RNA, 22 nt, Human
aaacacuguucucugcccucca

SEQ ID NO: 3079527 - RNA, 12 nt, Human
aaagaguacucu

SEQ ID NO: 3079528 - RNA, 17 nt, Human
aaagaguacucuuguuu

SEQ ID NO: 3079529 - RNA, 15 nt, Human
aaagaaauuaugugc

SEQ ID NO: 3079530 - RNA, 11 nt, Human
aaagaacaucc

SEQ ID NO: 3079531 - RNA, 11 nt, Human
aaagagguuuu

SEQ ID NO: 3079532 - RNA, 13 nt, Human
aaagaaauuaugu

SEQ ID NO: 3079533 - RNA, 20 nt, Human
aaagaaaacuuguauuaugu

SEQ ID NO: 3079534 - RNA, 12 nt, Human
aaagaaaacuug

SEQ ID NO: 3079535 - RNA, 19 nt, Human
aaacugccagcaacgcagg

SEQ ID NO: 3079536 - RNA, 17 nt, Human
aaacugacucuuaagaa

SEQ ID NO: 3079537 - RNA, 15 nt, Human
aaacugccagcaacg

SEQ ID NO: 3079538 - RNA, 14 nt, Human
aaacugccagcaac

SEQ ID NO: 3079539 - RNA, 16 nt, Human
aaacugacucuuaaga

SEQ ID NO: 3079540 - RNA, 17 nt, Human
aaagaugaaaauauuug

SEQ ID NO: 3079541 - RNA, 16 nt, Human
aaagaugaaaauauuu

SEQ ID NO: 3079542 - RNA, 13 nt, Human
aaagaugaaaaua

SEQ ID NO: 3079543 - RNA, 12 nt, Human
acuguuuugaau

SEQ ID NO: 3079544 - RNA, 23 nt, Human
acuuauuguagcauccuggaaua

SEQ ID NO: 3079545 - RNA, 20 nt, Human
acuuauuguagcauccugga

SEQ ID NO: 3079546 - RNA, 19 nt, Human
acuucacauauugauuucc

SEQ ID NO: 3079547 - RNA, 19 nt, Human
acuuguaaaggaauuuaaa

SEQ ID NO: 3079548 - RNA, 20 nt, Human
acuuguaaaggaauuuaaaa

SEQ ID NO: 3079549 - RNA, 18 nt, Human
acuuguaaaggaauuuaa

SEQ ID NO: 3079550 - RNA, 15 nt, Human
acuuggucugugaga

SEQ ID NO: 3079551 - RNA, 14 nt, Human
acuuggucugugag

SEQ ID NO: 3079552 - RNA, 13 nt, Human
acuuggucuguga

SEQ ID NO: 3079553 - RNA, 22 nt, Human
acuucugccagcauaauacuug

SEQ ID NO: 3079554 - RNA, 18 nt, Human
acuucugccauauucugu

SEQ ID NO: 3079555 - RNA, 12 nt, Human
acugucuucagu

SEQ ID NO: 3079556 - RNA, 14 nt, Human
acuggaagcacagc

SEQ ID NO: 3079557 - RNA, 12 nt, Human
acuggaacucuc

SEQ ID NO: 3079558 - RNA, 15 nt, Human
acuggaagcacagcu

SEQ ID NO: 3079559 - RNA, 14 nt, Human
acuggagaaaaugg

SEQ ID NO: 3079560 - RNA, 19 nt, Human
acuuuauacccagaaaguu

SEQ ID NO: 3079561 - RNA, 23 nt, Human
acuuuagggaaguacuuuuggca

SEQ ID NO: 3079562 - RNA, 13 nt, Human
acuuuagggaagu

SEQ ID NO: 3079563 - RNA, 23 nt, Human
acuuuccuucauucaacccaccu

SEQ ID NO: 3079564 - RNA, 20 nt, Human
acuuuguucuggcucuucca

SEQ ID NO: 3079565 - RNA, 23 nt, Human
acuuuguucuggcucuuccaggc

SEQ ID NO: 3079566 - RNA, 23 nt, Human
agaaaauauuauguguuuccaua

SEQ ID NO: 3079567 - RNA, 22 nt, Human
agaaaauggacguguuaugacu

SEQ ID NO: 3079568 - RNA, 23 nt, Human
agaaaauggacguguuaugacuc

SEQ ID NO: 3079569 - RNA, 23 nt, Human
agaaaauggaagacagcucuuau

SEQ ID NO: 3079570 - RNA, 15 nt, Human
agaaaauggacgugu

SEQ ID NO: 3079571 - RNA, 20 nt, Human
agaaaauggacguguuauga

SEQ ID NO: 3079572 - RNA, 18 nt, Human
agaaaaguugaauuuuac

SEQ ID NO: 3079573 - RNA, 21 nt, Human
agaaaaguugaauuuuacaug

SEQ ID NO: 3079574 - RNA, 22 nt, Human
acuuuuauaaacuuuaccuuuu

SEQ ID NO: 3079575 - RNA, 19 nt, Human
acuuuuauaaacuuuaccu

SEQ ID NO: 3079576 - RNA, 15 nt, Human
acuuuuauaaacuuu

SEQ ID NO: 3079577 - RNA, 18 nt, Human
agaaauaaaguuucuguu

SEQ ID NO: 3079578 - RNA, 15 nt, Human
agaaauaaaguuucu

SEQ ID NO: 3079579 - RNA, 23 nt, Human
agaaaggaggggauagagagaga

SEQ ID NO: 3079580 - RNA, 20 nt, Human
agaaaggaggggauagagag

SEQ ID NO: 3079581 - RNA, 14 nt, Human
acuagcuauggugu

SEQ ID NO: 3079582 - RNA, 21 nt, Human
acucauaaaaagccugcaauu

SEQ ID NO: 3079583 - RNA, 14 nt, Human
acucccccaggugg

SEQ ID NO: 3079584 - RNA, 12 nt, Human
acuccccuccuu

SEQ ID NO: 3079585 - RNA, 13 nt, Human
acuccccugcugg

SEQ ID NO: 3079586 - RNA, 17 nt, Human
acuccccugcugggugu

SEQ ID NO: 3079587 - RNA, 17 nt, Human
acucaaacucuuaaaac

SEQ ID NO: 3079588 - RNA, 16 nt, Human
acucaaacucuuaaaa

SEQ ID NO: 3079589 - RNA, 11 nt, Human
acuauaaugua

SEQ ID NO: 3079590 - RNA, 18 nt, Human
acucaaaagcugggcagg

SEQ ID NO: 3079591 - RNA, 16 nt, Human
acucugugucaggugg

SEQ ID NO: 3079592 - RNA, 11 nt, Human
acucuuaaaac

SEQ ID NO: 3079593 - RNA, 18 nt, Human
acucuuaaaacccaagug

SEQ ID NO: 3079594 - RNA, 16 nt, Human
acucuaucaaguauua

SEQ ID NO: 3079595 - RNA, 14 nt, Human
acucuaucaaguau

SEQ ID NO: 3079596 - RNA, 13 nt, Human
acucuacccucuu

SEQ ID NO: 3079597 - RNA, 18 nt, Human
acucuacccucuuagaaa

SEQ ID NO: 3079598 - RNA, 21 nt, Human
acucuacccucuuagaaaaac

SEQ ID NO: 3079599 - RNA, 12 nt, Human
acucccuuucaa

SEQ ID NO: 3079600 - RNA, 13 nt, Human
acucccuuucaac

SEQ ID NO: 3079601 - RNA, 15 nt, Human
acgcugugcugcccu

SEQ ID NO: 3079602 - RNA, 16 nt, Human
acgcugugcugcccug

SEQ ID NO: 3079603 - RNA, 17 nt, Human
acgcugugcugcccugc

SEQ ID NO: 3079604 - RNA, 18 nt, Human
acgcugugcugcccugcc

SEQ ID NO: 3079605 - RNA, 16 nt, Human
acgugcacgcacacug

SEQ ID NO: 3079606 - RNA, 13 nt, Human
acguggcugcuuc

SEQ ID NO: 3079607 - RNA, 14 nt, Human
acguggcugcuuca

SEQ ID NO: 3079608 - RNA, 15 nt, Human
acguggcugcuucaa

SEQ ID NO: 3079609 - RNA, 11 nt, Human
acguggcugcu

SEQ ID NO: 3079610 - RNA, 15 nt, Human
acuaagagagaauga

SEQ ID NO: 3079611 - RNA, 16 nt, Human
acuaagagagaaugag

SEQ ID NO: 3079612 - RNA, 22 nt, Human
acuaaguuuuuauggcuuuugu

SEQ ID NO: 3079613 - RNA, 15 nt, Human
acuaaguuuuuaugg

SEQ ID NO: 3079614 - RNA, 17 nt, Human
acgauuucuguuuagau

SEQ ID NO: 3079615 - RNA, 14 nt, Human
acgauuucuguuua

SEQ ID NO: 3079616 - RNA, 18 nt, Human
acgccacugcacuauagc

SEQ ID NO: 3079617 - RNA, 13 nt, Human
acgauuucuguuu

SEQ ID NO: 3079618 - RNA, 12 nt, Human
acgauuucuguu

SEQ ID NO: 3079619 - RNA, 12 nt, Human
accuuggcugca

SEQ ID NO: 3079620 - RNA, 14 nt, Human
accuuggcucaagu

SEQ ID NO: 3079621 - RNA, 12 nt, Human
accuuggcucaa

SEQ ID NO: 3079622 - RNA, 16 nt, Human
accuuucaauaggaaa

SEQ ID NO: 3079623 - RNA, 14 nt, Human
accuuggcugcagg

SEQ ID NO: 3079624 - RNA, 17 nt, Human
accuuucaauaggaaaa

SEQ ID NO: 3079625 - RNA, 21 nt, Human
accuuucaauaggaaaaacug

SEQ ID NO: 3079626 - RNA, 23 nt, Human
accuuucaauaggaaaaacugau

SEQ ID NO: 3079627 - RNA, 16 nt, Human
accucugcacaagcug

SEQ ID NO: 3079628 - RNA, 18 nt, Human
accucugcacaagcugca

SEQ ID NO: 3079629 - RNA, 21 nt, Human
accucugcacaagcugcaccc

SEQ ID NO: 3079630 - RNA, 23 nt, Human
accugccccucaacucuccucca

SEQ ID NO: 3079631 - RNA, 20 nt, Human
accugccccucaacucuccu

SEQ ID NO: 3079632 - RNA, 15 nt, Human
acagaagcagcucuu

SEQ ID NO: 3079633 - RNA, 12 nt, Human
acagaagcagcu

SEQ ID NO: 3079634 - RNA, 14 nt, Human
acagaagcagcucu

SEQ ID NO: 3079635 - RNA, 13 nt, Human
acagaagcagcuc

SEQ ID NO: 3079636 - RNA, 16 nt, Human
acagaauauguuucaa

SEQ ID NO: 3079637 - RNA, 17 nt, Human
acagaauauguuucaaa

SEQ ID NO: 3079638 - RNA, 19 nt, Human
acagaauauguuucaaacu

SEQ ID NO: 3079639 - RNA, 21 nt, Human
acagaauauguuucaaacuuu

SEQ ID NO: 3079640 - RNA, 21 nt, Human
acagaggggguggccucccaa

SEQ ID NO: 3079641 - RNA, 14 nt, Human
acagagucucacug

SEQ ID NO: 3079642 - RNA, 12 nt, Human
acagagucucac

SEQ ID NO: 3079643 - RNA, 22 nt, Human
acagaggggguggccucccaac

SEQ ID NO: 3079644 - RNA, 19 nt, Human
acagagucucacuguugcc

SEQ ID NO: 3079645 - RNA, 17 nt, Human
acagagucucacuguug

SEQ ID NO: 3079646 - RNA, 16 nt, Human
acagcaggcugccagu

SEQ ID NO: 3079647 - RNA, 18 nt, Human
acagcaggcugccagugc

SEQ ID NO: 3079648 - RNA, 20 nt, Human
acagcaggcugccagugccu

SEQ ID NO: 3079649 - RNA, 15 nt, Human
acagcaggcugccag

SEQ ID NO: 3079650 - RNA, 15 nt, Human
acagcaguugaaaag

SEQ ID NO: 3079651 - RNA, 19 nt, Human
acagccacggccaggccag

SEQ ID NO: 3079652 - RNA, 16 nt, Human
acagccagacuggcac

SEQ ID NO: 3079653 - RNA, 15 nt, Human
acagccagacuggca

SEQ ID NO: 3079654 - RNA, 13 nt, Human
acagccagacugg

SEQ ID NO: 3079655 - RNA, 15 nt, Human
acagccaugauucuu

SEQ ID NO: 3079656 - RNA, 19 nt, Human
acaggucauauuaauauau

SEQ ID NO: 3079657 - RNA, 23 nt, Human
acaggugugaaccaccacaccca

SEQ ID NO: 3079658 - RNA, 20 nt, Human
acaggugugaaccaccacac

SEQ ID NO: 3079659 - RNA, 16 nt, Human
acaggcaagcaccucc

SEQ ID NO: 3079660 - RNA, 15 nt, Human
acaggcaagcaccuc

SEQ ID NO: 3079661 - RNA, 18 nt, Human
acaggcaagcaccuccug

SEQ ID NO: 3079662 - RNA, 14 nt, Human
acagcugccuggga

SEQ ID NO: 3079663 - RNA, 13 nt, Human
acagcugccuggg

SEQ ID NO: 3079664 - RNA, 23 nt, Human
acagcugccugggaucccucauc

SEQ ID NO: 3079665 - RNA, 20 nt, Human
acagcucugcauacucauua

SEQ ID NO: 3079666 - RNA, 23 nt, Human
acagcuccuucuguccuacucug

SEQ ID NO: 3079667 - RNA, 14 nt, Human
acagcuccuucugu

SEQ ID NO: 3079668 - RNA, 13 nt, Human
acagcuccuucug

SEQ ID NO: 3079669 - RNA, 12 nt, Human
acagcuccuucu

SEQ ID NO: 3079670 - RNA, 16 nt, Human
acaacuauuuuuccaa

SEQ ID NO: 3079671 - RNA, 17 nt, Human
acaacuucaauauccaa

SEQ ID NO: 3079672 - RNA, 18 nt, Human
acaacuucccagugaauu

SEQ ID NO: 3079673 - RNA, 13 nt, Human
acaacuuuauacc

SEQ ID NO: 3079674 - RNA, 14 nt, Human
acaacuuuauaccc

SEQ ID NO: 3079675 - RNA, 20 nt, Human
acaagucagucauucagaua

SEQ ID NO: 3079676 - RNA, 13 nt, Human
aauuuugaaaaac

SEQ ID NO: 3079677 - RNA, 15 nt, Human
aauuuuauaucuugu

SEQ ID NO: 3079678 - RNA, 20 nt, Human
aauuuugaguucuacauaag

SEQ ID NO: 3079679 - RNA, 15 nt, Human
acaaaauggaauacu

SEQ ID NO: 3079680 - RNA, 19 nt, Human
acaaaauggaauacucuua

SEQ ID NO: 3079681 - RNA, 20 nt, Human
acaaaauguaggguuauaau

SEQ ID NO: 3079682 - RNA, 20 nt, Human
acaaaauggaauacucuuau

SEQ ID NO: 3079683 - RNA, 15 nt, Human
acaaacgggcucagc

SEQ ID NO: 3079684 - RNA, 21 nt, Human
acaaaccuguuucugcagcca

SEQ ID NO: 3079685 - RNA, 13 nt, Human
acaaagacugagu

SEQ ID NO: 3079686 - RNA, 13 nt, Human
acaacuauauugu

SEQ ID NO: 3079687 - RNA, 12 nt, Human
acaccagagccc

SEQ ID NO: 3079688 - RNA, 21 nt, Human
acaccacuacauucuguuaau

SEQ ID NO: 3079689 - RNA, 12 nt, Human
acacagcucugu

SEQ ID NO: 3079690 - RNA, 11 nt, Human
acacagcucug

SEQ ID NO: 3079691 - RNA, 15 nt, Human
acacuaaccacgcug

SEQ ID NO: 3079692 - RNA, 14 nt, Human
acacuaaccacgcu

SEQ ID NO: 3079693 - RNA, 15 nt, Human
acacggacacucaaa

SEQ ID NO: 3079694 - RNA, 15 nt, Human
acaauuuauuauggc

SEQ ID NO: 3079695 - RNA, 14 nt, Human
acaauuuauuaugg

SEQ ID NO: 3079696 - RNA, 16 nt, Human
acaauuuauuauggca

SEQ ID NO: 3079697 - RNA, 18 nt, Human
acacaaacgggcucagca

SEQ ID NO: 3079698 - RNA, 14 nt, Human
accacuacauucug

SEQ ID NO: 3079699 - RNA, 19 nt, Human
accacguuucuaaaggcua

SEQ ID NO: 3079700 - RNA, 15 nt, Human
accacguuucuaaag

SEQ ID NO: 3079701 - RNA, 13 nt, Human
accagcagccugg

SEQ ID NO: 3079702 - RNA, 14 nt, Human
accagcagccugga

SEQ ID NO: 3079703 - RNA, 17 nt, Human
accagcagccuggaccc

SEQ ID NO: 3079704 - RNA, 21 nt, Human
accaacgucugugccauuuug

SEQ ID NO: 3079705 - RNA, 18 nt, Human
acauuugcucauggaauu

SEQ ID NO: 3079706 - RNA, 16 nt, Human
acauuugcucauggaa

SEQ ID NO: 3079707 - RNA, 23 nt, Human
acauaaacaagaccacguuucua

SEQ ID NO: 3079708 - RNA, 22 nt, Human
acaucagcacgauuucuguuua

SEQ ID NO: 3079709 - RNA, 21 nt, Human
acaucagcacgauuucuguuu

SEQ ID NO: 3079710 - RNA, 20 nt, Human
acaucagcacgauuucuguu

SEQ ID NO: 3079711 - RNA, 19 nt, Human
acaucagcacgauuucugu

SEQ ID NO: 3079712 - RNA, 21 nt, Human
acauguuuuucuucucccuca

SEQ ID NO: 3079713 - RNA, 13 nt, Human
acauguuacaaca

SEQ ID NO: 3079714 - RNA, 18 nt, Human
acaugcaaggucauuuuu

SEQ ID NO: 3079715 - RNA, 19 nt, Human
acaugcaaggucauuuuuu

SEQ ID NO: 3079716 - RNA, 20 nt, Human
acaugcacagcuaacaugga

SEQ ID NO: 3079717 - RNA, 19 nt, Human
acauguuuuucuucucccu

SEQ ID NO: 3079718 - RNA, 15 nt, Human
accccggccaccugc

SEQ ID NO: 3079719 - RNA, 13 nt, Human
acccaagggccug

SEQ ID NO: 3079720 - RNA, 16 nt, Human
acccaagggccuggcc

SEQ ID NO: 3079721 - RNA, 16 nt, Human
acccaaguccaagcau

SEQ ID NO: 3079722 - RNA, 17 nt, Human
acccaugcugcccugug

SEQ ID NO: 3079723 - RNA, 18 nt, Human
acccaugcugcccuguga

SEQ ID NO: 3079724 - RNA, 19 nt, Human
acccaugcugcccugugag

SEQ ID NO: 3079725 - RNA, 16 nt, Human
acccaugcugcccugu

SEQ ID NO: 3079726 - RNA, 14 nt, Human
accaucaugucugg

SEQ ID NO: 3079727 - RNA, 18 nt, Human
accaucccugaaggcccc

SEQ ID NO: 3079728 - RNA, 16 nt, Human
accaucccugaaggcc

SEQ ID NO: 3079729 - RNA, 17 nt, Human
accaucaugucuggcua

SEQ ID NO: 3079730 - RNA, 16 nt, Human
accaucaugucuggcu

SEQ ID NO: 3079731 - RNA, 21 nt, Human
accaucccugaaggccccgcc

SEQ ID NO: 3079732 - RNA, 22 nt, Human
accaucccugaaggccccgccc

SEQ ID NO: 3079733 - RNA, 17 nt, Human
caaagccuccuccagcc

SEQ ID NO: 3079734 - RNA, 18 nt, Human
caaagccuccuccagccg

SEQ ID NO: 3079735 - RNA, 22 nt, Human
caaagccaaagcuaggccuggc

SEQ ID NO: 3079736 - RNA, 17 nt, Human
caaacucaccugccccu

SEQ ID NO: 3079737 - RNA, 19 nt, Human
caaagcugaugacaacuuc

SEQ ID NO: 3079738 - RNA, 12 nt, Human
caaaggaagcac

SEQ ID NO: 3079739 - RNA, 13 nt, Human
caaaggaagcaca

SEQ ID NO: 3079740 - RNA, 18 nt, Human
caaagcuaggccuggcca

SEQ ID NO: 3079741 - RNA, 19 nt, Human
caaagcuaggccuggccag

SEQ ID NO: 3079742 - RNA, 14 nt, Human
caaagcuaggccug

SEQ ID NO: 3079743 - RNA, 13 nt, Human
caaagcuaggccu

SEQ ID NO: 3079744 - RNA, 18 nt, Human
caaaggguaucaggugcu

SEQ ID NO: 3079745 - RNA, 16 nt, Human
caaaggguaucaggug

SEQ ID NO: 3079746 - RNA, 14 nt, Human
caaaggaagcacau

SEQ ID NO: 3079747 - RNA, 16 nt, Human
caaaauugauguguuu

SEQ ID NO: 3079748 - RNA, 15 nt, Human
caaaauugauguguu

SEQ ID NO: 3079749 - RNA, 16 nt, Human
caaaauuguuacaaau

SEQ ID NO: 3079750 - RNA, 22 nt, Human
caaaauugauguguuuauuuau

SEQ ID NO: 3079751 - RNA, 15 nt, Human
caaaauguaggguua

SEQ ID NO: 3079752 - RNA, 12 nt, Human
caaaauaaaacu

SEQ ID NO: 3079753 - RNA, 15 nt, Human
caaacacauacagga

SEQ ID NO: 3079754 - RNA, 16 nt, Human
caaaauuuuuucucua

SEQ ID NO: 3079755 - RNA, 21 nt, Human
caaaauuuuuucucuaggaaa

SEQ ID NO: 3079756 - RNA, 22 nt, Human
caaaauuuuuucucuaggaaau

SEQ ID NO: 3079757 - RNA, 14 nt, Human
caaacccuucagug

SEQ ID NO: 3079758 - RNA, 20 nt, Human
caaacccuucagugccaaaa

SEQ ID NO: 3079759 - RNA, 17 nt, Human
caaauuguaagcaugca

SEQ ID NO: 3079760 - RNA, 15 nt, Human
caaaugucuauaaac

SEQ ID NO: 3079761 - RNA, 14 nt, Human
caaaugucuauaaa

SEQ ID NO: 3079762 - RNA, 21 nt, Human
caaauuguaagcaugcacaaa

SEQ ID NO: 3079763 - RNA, 14 nt, Human
caaauuucuaaauc

SEQ ID NO: 3079764 - RNA, 12 nt, Human
caaauuucuaaa

SEQ ID NO: 3079765 - RNA, 11 nt, Human
caaauuucuaa

SEQ ID NO: 3079766 - RNA, 19 nt, Human
caaaggguaucaggugcug

SEQ ID NO: 3079767 - RNA, 19 nt, Human
caaagugcugggauuacag

SEQ ID NO: 3079768 - RNA, 23 nt, Human
caaagugcugggauuacaggugu

SEQ ID NO: 3079769 - RNA, 21 nt, Human
caaauacgugggcauucaaau

SEQ ID NO: 3079770 - RNA, 22 nt, Human
caaauacgugggcauucaaaug

SEQ ID NO: 3079771 - RNA, 20 nt, Human
caaauacgugggcauucaaa

SEQ ID NO: 3079772 - RNA, 21 nt, Human
caaauaugcaaagcacugacu

SEQ ID NO: 3079773 - RNA, 19 nt, Human
caaauaugcaaagcacuga

SEQ ID NO: 3079774 - RNA, 19 nt, Human
caaaaaucucaauauuuca

SEQ ID NO: 3079775 - RNA, 19 nt, Human
caaaacucuccucugcugc

SEQ ID NO: 3079776 - RNA, 17 nt, Human
caaaauaaaaaugaggu

SEQ ID NO: 3079777 - RNA, 23 nt, Human
caaaacuucagacauagaauuaa

SEQ ID NO: 3079778 - RNA, 20 nt, Human
caaaacucuccucugcugcu

SEQ ID NO: 3079779 - RNA, 21 nt, Human
caaaacucuccucugcugcug

SEQ ID NO: 3079780 - RNA, 22 nt, Human
caaaacucuccucugcugcugg

SEQ ID NO: 3079781 - RNA, 21 nt, Human
auuuugggguacccacugcuc

SEQ ID NO: 3079782 - RNA, 13 nt, Human
auuuuccugaaaa

SEQ ID NO: 3079783 - RNA, 16 nt, Human
caaaaaaugcuugcuu

SEQ ID NO: 3079784 - RNA, 23 nt, Human
auuuugggguacccacugcucug

SEQ ID NO: 3079785 - RNA, 22 nt, Human
auuuugggguacccacugcucu

SEQ ID NO: 3079786 - RNA, 20 nt, Human
caaaaacauggccuuugcuu

SEQ ID NO: 3079787 - RNA, 17 nt, Human
caaaaacacagcaaggg

SEQ ID NO: 3079788 - RNA, 15 nt, Human
caaaaacacagcaag

SEQ ID NO: 3079789 - RNA, 14 nt, Human
caaaaacacagcaa

SEQ ID NO: 3079790 - RNA, 13 nt, Human
caaaaacacagca

SEQ ID NO: 3079791 - RNA, 13 nt, Human
caaaaaggcagga

SEQ ID NO: 3079792 - RNA, 22 nt, Human
caaugugacuuaaugccacuaa

SEQ ID NO: 3079793 - RNA, 20 nt, Human
caaugcacuuuguucuggcu

SEQ ID NO: 3079794 - RNA, 21 nt, Human
caaugcacuuuguucuggcuc

SEQ ID NO: 3079795 - RNA, 17 nt, Human
caaugcacuuuguucug

SEQ ID NO: 3079796 - RNA, 15 nt, Human
caaugugauaaaacc

SEQ ID NO: 3079797 - RNA, 17 nt, Human
caaugugauaaaacccc

SEQ ID NO: 3079798 - RNA, 16 nt, Human
caauuacaggaaguac

SEQ ID NO: 3079799 - RNA, 23 nt, Human
caauucucauuugucacacacuu

SEQ ID NO: 3079800 - RNA, 17 nt, Human
caauauucgcuguguca

SEQ ID NO: 3079801 - RNA, 21 nt, Human
caaugaccuuucaauaggaaa

SEQ ID NO: 3079802 - RNA, 15 nt, Human
caaugacuuacugua

SEQ ID NO: 3079803 - RNA, 18 nt, Human
caaugacuuacuguacau

SEQ ID NO: 3079804 - RNA, 17 nt, Human
caaugacuuacuguaca

SEQ ID NO: 3079805 - RNA, 23 nt, Human
caaugaccuuucaauaggaaaaa

SEQ ID NO: 3079806 - RNA, 12 nt, Human
caauaggaaaaa

SEQ ID NO: 3079807 - RNA, 13 nt, Human
caauaggaaaaac

SEQ ID NO: 3079808 - RNA, 23 nt, Human
caauacaucccuuaccugggaaa

SEQ ID NO: 3079809 - RNA, 14 nt, Human
caauaggaaaaacu

SEQ ID NO: 3079810 - RNA, 16 nt, Human
caagagcccaggccuc

SEQ ID NO: 3079811 - RNA, 17 nt, Human
caagcaccuccugccuc

SEQ ID NO: 3079812 - RNA, 16 nt, Human
caagcaccuccugccu

SEQ ID NO: 3079813 - RNA, 15 nt, Human
caagcaccuccugcc

SEQ ID NO: 3079814 - RNA, 18 nt, Human
caagacucuuuggacacu

SEQ ID NO: 3079815 - RNA, 13 nt, Human
caagagcccaggc

SEQ ID NO: 3079816 - RNA, 14 nt, Human
caagagcccaggcc

SEQ ID NO: 3079817 - RNA, 15 nt, Human
caagagcccaggccu

SEQ ID NO: 3079818 - RNA, 23 nt, Human
caagacgcugugcugcccugccc

SEQ ID NO: 3079819 - RNA, 14 nt, Human
caagacucccauga

SEQ ID NO: 3079820 - RNA, 15 nt, Human
caagacgcugugcug

SEQ ID NO: 3079821 - RNA, 18 nt, Human
caagacucccaugaggga

SEQ ID NO: 3079822 - RNA, 18 nt, Human
caagacgcugugcugccc

SEQ ID NO: 3079823 - RNA, 15 nt, Human
caagaaaacaacuuc

SEQ ID NO: 3079824 - RNA, 17 nt, Human
caagaccuucuccuuca

SEQ ID NO: 3079825 - RNA, 18 nt, Human
caagaccuucuccuucac

SEQ ID NO: 3079826 - RNA, 16 nt, Human
caagacgcugugcugc

SEQ ID NO: 3079827 - RNA, 17 nt, Human
caagacgcugugcugcc

SEQ ID NO: 3079828 - RNA, 14 nt, Human
caagaccuucuccu

SEQ ID NO: 3079829 - RNA, 16 nt, Human
caagaccuucuccuuc

SEQ ID NO: 3079830 - RNA, 20 nt, Human
caagaacuuuccaggaaggc

SEQ ID NO: 3079831 - RNA, 22 nt, Human
caaccccuucgcuccugugucu

SEQ ID NO: 3079832 - RNA, 20 nt, Human
caacacucauugaccugagg

SEQ ID NO: 3079833 - RNA, 22 nt, Human
caacacucauugaccugaggcc

SEQ ID NO: 3079834 - RNA, 18 nt, Human
caacacucauugaccuga

SEQ ID NO: 3079835 - RNA, 22 nt, Human
caacacucacauuuauucugcu

SEQ ID NO: 3079836 - RNA, 14 nt, Human
caaccuccugggcu

SEQ ID NO: 3079837 - RNA, 15 nt, Human
caaccuccugggcua

SEQ ID NO: 3079838 - RNA, 13 nt, Human
caacgucugugcc

SEQ ID NO: 3079839 - RNA, 14 nt, Human
caacgucugugcca

SEQ ID NO: 3079840 - RNA, 19 nt, Human
caagcuggucccacucagu

SEQ ID NO: 3079841 - RNA, 17 nt, Human
caagcuggucccacuca

SEQ ID NO: 3079842 - RNA, 17 nt, Human
caaggcugauuaaacca

SEQ ID NO: 3079843 - RNA, 22 nt, Human
caagccaccaacauacucccau

SEQ ID NO: 3079844 - RNA, 21 nt, Human
caagccagauuuuccugaaaa

SEQ ID NO: 3079845 - RNA, 14 nt, Human
caagcaccuccugc

SEQ ID NO: 3079846 - RNA, 14 nt, Human
caagcaggacaugg

SEQ ID NO: 3079847 - RNA, 18 nt, Human
caagcaggacauggacaa

SEQ ID NO: 3079848 - RNA, 19 nt, Human
caagcgauucuucugcuuc

SEQ ID NO: 3079849 - RNA, 22 nt, Human
caagcgauucuucugcuucagc

SEQ ID NO: 3079850 - RNA, 20 nt, Human
caagcgauucuucugcuuca

SEQ ID NO: 3079851 - RNA, 17 nt, Human
caagugagagcugggug

SEQ ID NO: 3079852 - RNA, 15 nt, Human
caagugagagcuggg

SEQ ID NO: 3079853 - RNA, 14 nt, Human
caagugagagcugg

SEQ ID NO: 3079854 - RNA, 21 nt, Human
caaguccucuuuucugagagg

SEQ ID NO: 3079855 - RNA, 18 nt, Human
caagugagagcugggugu

SEQ ID NO: 3079856 - RNA, 14 nt, Human
caaguuaaauaaau

SEQ ID NO: 3079857 - RNA, 14 nt, Human
caaguccucuuuuc

SEQ ID NO: 3079858 - RNA, 20 nt, Human
caaggucauuuuuuuuaaga

SEQ ID NO: 3079859 - RNA, 14 nt, Human
caaggucauuuuuu

SEQ ID NO: 3079860 - RNA, 13 nt, Human
caaggucauuuuu

SEQ ID NO: 3079861 - RNA, 17 nt, Human
caaggggcccaaauucu

SEQ ID NO: 3079862 - RNA, 18 nt, Human
caaggggcccaaauucuu

SEQ ID NO: 3079863 - RNA, 12 nt, Human
caaggcugcagu

SEQ ID NO: 3079864 - RNA, 15 nt, Human
caaggcugcagugag

SEQ ID NO: 3079865 - RNA, 23 nt, Human
caaggcugucaauuacaggaagu

SEQ ID NO: 3079866 - RNA, 21 nt, Human
caaggcugucaauuacaggaa

SEQ ID NO: 3079867 - RNA, 14 nt, Human
cacauaucugucau

SEQ ID NO: 3079868 - RNA, 15 nt, Human
cacaguuuucugaga

SEQ ID NO: 3079869 - RNA, 19 nt, Human
cacaguuuucugagaaaga

SEQ ID NO: 3079870 - RNA, 17 nt, Human
cacaguuuucugagaaa

SEQ ID NO: 3079871 - RNA, 16 nt, Human
cacaguuuucugagaa

SEQ ID NO: 3079872 - RNA, 22 nt, Human
cacagcuucauuuccugugucu

SEQ ID NO: 3079873 - RNA, 21 nt, Human
cacagcuucauuuccuguguc

SEQ ID NO: 3079874 - RNA, 22 nt, Human
cacagcugggguggggaccuca

SEQ ID NO: 3079875 - RNA, 23 nt, Human
cacagcugggguggggaccucag

SEQ ID NO: 3079876 - RNA, 15 nt, Human
cacaggcagguccag

SEQ ID NO: 3079877 - RNA, 14 nt, Human
cacaggcaggucca

SEQ ID NO: 3079878 - RNA, 11 nt, Human
cacaggcaggu

SEQ ID NO: 3079879 - RNA, 13 nt, Human
cacaguccuuacc

SEQ ID NO: 3079880 - RNA, 15 nt, Human
cacaguccuuaccag

SEQ ID NO: 3079881 - RNA, 21 nt, Human
cacaguccuuaccagcagagc

SEQ ID NO: 3079882 - RNA, 22 nt, Human
cacaguccuuaccagcagagca

SEQ ID NO: 3079883 - RNA, 21 nt, Human
cacagugagucgaggacaggg

SEQ ID NO: 3079884 - RNA, 22 nt, Human
cacagugagucgaggacaggga

SEQ ID NO: 3079885 - RNA, 19 nt, Human
cacagugaucaaguuauuu

SEQ ID NO: 3079886 - RNA, 15 nt, Human
cacaguucucuccuu

SEQ ID NO: 3079887 - RNA, 14 nt, Human
cacaguucucuccu

SEQ ID NO: 3079888 - RNA, 13 nt, Human
uuuuuaaucuuua

SEQ ID NO: 3079889 - RNA, 23 nt, Human
uuuugacagaauauguuucaaac

SEQ ID NO: 3079890 - RNA, 22 nt, Human
uuuugacagaauauguuucaaa

SEQ ID NO: 3079891 - RNA, 11 nt, Human
uuuugacagaa

SEQ ID NO: 3079892 - RNA, 11 nt, Human
uuuuuaaaugc

SEQ ID NO: 3079893 - RNA, 23 nt, Human
uuuuuaagugcugcauuuaaaag

SEQ ID NO: 3079894 - RNA, 22 nt, Human
uuuuuaagugcugcauuuaaaa

SEQ ID NO: 3079895 - RNA, 19 nt, Human
uuuuuaagugcugcauuua

SEQ ID NO: 3079896 - RNA, 18 nt, Human
uuuuuaagugcugcauuu

SEQ ID NO: 3079897 - RNA, 17 nt, Human
uuuuuaagugcugcauu

SEQ ID NO: 3079898 - RNA, 16 nt, Human
uuuuuaagugcugcau

SEQ ID NO: 3079899 - RNA, 12 nt, Human
uuuuuaagaaaa

SEQ ID NO: 3079900 - RNA, 12 nt, Human
uuuuuuuuaaga

SEQ ID NO: 3079901 - RNA, 11 nt, Human
uuuuuuuacua

SEQ ID NO: 3079902 - RNA, 15 nt, Human
uuuggucaacacuaa

SEQ ID NO: 3079903 - RNA, 17 nt, Human
uuuguauaaaauaauuu

SEQ ID NO: 3079904 - RNA, 16 nt, Human
uuuguauaaaauaauu

SEQ ID NO: 3079905 - RNA, 18 nt, Human
uuuguauaaaauaauuuu

SEQ ID NO: 3079906 - RNA, 15 nt, Human
uuuguauucucuccu

SEQ ID NO: 3079907 - RNA, 23 nt, Human
uuuuaaaauccacuuuaucuuga

SEQ ID NO: 3079908 - RNA, 14 nt, Human
uuuuaaaauccacu

SEQ ID NO: 3079909 - RNA, 22 nt, Human
uuuguuaguaugaggcauuugu

SEQ ID NO: 3079910 - RNA, 15 nt, Human
uuuguugucagcuga

SEQ ID NO: 3079911 - RNA, 18 nt, Human
uuugcauaacguauaaaa

SEQ ID NO: 3079912 - RNA, 13 nt, Human
uuuggacccugag

SEQ ID NO: 3079913 - RNA, 19 nt, Human
uuuggacaaaauggaauac

SEQ ID NO: 3079914 - RNA, 12 nt, Human
uuuggaaaauaa

SEQ ID NO: 3079915 - RNA, 12 nt, Human
uuugaguucuac

SEQ ID NO: 3079916 - RNA, 21 nt, Human
uuugagugccuuacacaaugg

SEQ ID NO: 3079917 - RNA, 15 nt, Human
uuuccguuaaaauac

SEQ ID NO: 3079918 - RNA, 13 nt, Human
uuugagugccuua

SEQ ID NO: 3079919 - RNA, 17 nt, Human
uuuccguuaaaauacca

SEQ ID NO: 3079920 - RNA, 15 nt, Human
uuuccacagaagcuc

SEQ ID NO: 3079921 - RNA, 21 nt, Human
uuuucuuaaccagaucauugu

SEQ ID NO: 3079922 - RNA, 13 nt, Human
uuuucuuauuuca

SEQ ID NO: 3079923 - RNA, 20 nt, Human
uuuucuacucgaguuacaga

SEQ ID NO: 3079924 - RNA, 22 nt, Human
uuuucuacucgaguuacagaca

SEQ ID NO: 3079925 - RNA, 13 nt, Human
uuuucuacucgag

SEQ ID NO: 3079926 - RNA, 22 nt, Human
uuuucuuguguguuuauuguca

SEQ ID NO: 3079927 - RNA, 13 nt, Human
uuuucuucucccu

SEQ ID NO: 3079928 - RNA, 16 nt, Human
uuuucuuucagccaag

SEQ ID NO: 3079929 - RNA, 22 nt, Human
uuuucagaaaauauuauguguu

SEQ ID NO: 3079930 - RNA, 16 nt, Human
uuuucacauuggaaac

SEQ ID NO: 3079931 - RNA, 21 nt, Human
uuuucaaaauuguuacaaauu

SEQ ID NO: 3079932 - RNA, 16 nt, Human
uuuucacauaucuagu

SEQ ID NO: 3079933 - RNA, 23 nt, Human
uuuucagaaaauauuauguguuu

SEQ ID NO: 3079934 - RNA, 18 nt, Human
uuuucccuauuagagaag

SEQ ID NO: 3079935 - RNA, 22 nt, Human
uuuucccuauuagagaagagau

SEQ ID NO: 3079936 - RNA, 18 nt, Human
uuuuauuuuuagacagag

SEQ ID NO: 3079937 - RNA, 17 nt, Human
uuuucaaaauaaaaaug

SEQ ID NO: 3079938 - RNA, 19 nt, Human
uuuuaucgucacugcuuaa

SEQ ID NO: 3079939 - RNA, 21 nt, Human
uuuuauacauaaacaagacca

SEQ ID NO: 3079940 - RNA, 13 nt, Human
uuuuauacauaaa

SEQ ID NO: 3079941 - RNA, 13 nt, Human
uuuuauauuugaa

SEQ ID NO: 3079942 - RNA, 18 nt, Human
uuuuauauuugaaauauu

SEQ ID NO: 3079943 - RNA, 21 nt, Human
uuuuaaaguaacccuacaaaa

SEQ ID NO: 3079944 - RNA, 19 nt, Human
uuuuacguccaucucuugu

SEQ ID NO: 3079945 - RNA, 15 nt, Human
uuuuacuaauagaca

SEQ ID NO: 3079946 - RNA, 21 nt, Human
uuuuauaauuuugugaagcaa

SEQ ID NO: 3079947 - RNA, 23 nt, Human
uuuuauaauuuugugaagcaaaa

SEQ ID NO: 3079948 - RNA, 13 nt, Human
uuuuuuuugacaa

SEQ ID NO: 3079949 - RNA, 12 nt, Human
uuauaauuuuaa

SEQ ID NO: 3079950 - RNA, 12 nt, Human
uuauaauuuaaa

SEQ ID NO: 3079951 - RNA, 21 nt, Human
uuauaauuuuaaauguuuuuu

SEQ ID NO: 3079952 - RNA, 17 nt, Human
uuauaauuuuaaauguu

SEQ ID NO: 3079953 - RNA, 14 nt, Human
uuauaauuuuguga

SEQ ID NO: 3079954 - RNA, 15 nt, Human
uuauaauuuugugaa

SEQ ID NO: 3079955 - RNA, 15 nt, Human
uuauaaugaaugaaa

SEQ ID NO: 3079956 - RNA, 11 nt, Human
uuauaaucuuu

SEQ ID NO: 3079957 - RNA, 15 nt, Human
uuauaauaauguuaa

SEQ ID NO: 3079958 - RNA, 18 nt, Human
uuauaauaauguuaacau

SEQ ID NO: 3079959 - RNA, 13 nt, Human
ugugaaaagaaaa

SEQ ID NO: 3079960 - RNA, 15 nt, Human
ugugaaaagaaaaau

SEQ ID NO: 3079961 - RNA, 17 nt, Human
ugugaaaagaaaaauga

SEQ ID NO: 3079962 - RNA, 22 nt, Human
uuauaucuuguagcuuuaucaa

SEQ ID NO: 3079963 - RNA, 15 nt, Human
uuauaucuuguagcu

SEQ ID NO: 3079964 - RNA, 16 nt, Human
uuauauuaugaagcuu

SEQ ID NO: 3079965 - RNA, 14 nt, Human
uuauacaggucaua

SEQ ID NO: 3079966 - RNA, 18 nt, Human
uuauaauuuugugaagca

SEQ ID NO: 3079967 - RNA, 16 nt, Human
uuauaauuuugugaag

SEQ ID NO: 3079968 - RNA, 17 nt, Human
uuauaauuuugugaagc

SEQ ID NO: 3079969 - RNA, 22 nt, Human
uuauacaggucauauuaauaua

SEQ ID NO: 3079970 - RNA, 11 nt, Human
uuauacauaaa

SEQ ID NO: 3079971 - RNA, 19 nt, Human
uuauaucuauauuuuacau

SEQ ID NO: 3079972 - RNA, 23 nt, Human
uuauaucuauauuuuacauaaau

SEQ ID NO: 3079973 - RNA, 16 nt, Human
uuauauuuacaaaugg

SEQ ID NO: 3079974 - RNA, 12 nt, Human
uuauauuugaaa

SEQ ID NO: 3079975 - RNA, 20 nt, Human
uuauauuuauuacuguaaga

SEQ ID NO: 3079976 - RNA, 11 nt, Human
uuauccucugu

SEQ ID NO: 3079977 - RNA, 13 nt, Human
uuauauuugaaau

SEQ ID NO: 3079978 - RNA, 14 nt, Human
uuaucuugaauaau

SEQ ID NO: 3079979 - RNA, 16 nt, Human
uuaucuugaauaaugu

SEQ ID NO: 3079980 - RNA, 22 nt, Human
uuaugauuaaguaaugauaacu

SEQ ID NO: 3079981 - RNA, 11 nt, Human
uuaucucaaaa

SEQ ID NO: 3079982 - RNA, 17 nt, Human
uuauguugcauagaaua

SEQ ID NO: 3079983 - RNA, 17 nt, Human
uuauggcuuuugugcau

SEQ ID NO: 3079984 - RNA, 16 nt, Human
uuauggcuuuugugca

SEQ ID NO: 3079985 - RNA, 18 nt, Human
uuauggcuauaggugcua

SEQ ID NO: 3079986 - RNA, 14 nt, Human
uuauggcacaucag

SEQ ID NO: 3079987 - RNA, 18 nt, Human
uuauggaacacucugaga

SEQ ID NO: 3079988 - RNA, 20 nt, Human
uuauggaacacucugagacu

SEQ ID NO: 3079989 - RNA, 21 nt, Human
uuauggacaaugacccagugg

SEQ ID NO: 3079990 - RNA, 17 nt, Human
uuauggaacacucugag

SEQ ID NO: 3079991 - RNA, 19 nt, Human
uuauuaaaugcccagcccc

SEQ ID NO: 3079992 - RNA, 21 nt, Human
uuauuaaaugcccagccccuu

SEQ ID NO: 3079993 - RNA, 17 nt, Human
uuauuuuaauaauguuu

SEQ ID NO: 3079994 - RNA, 19 nt, Human
uuauuuuaauaauguuuca

SEQ ID NO: 3079995 - RNA, 18 nt, Human
uuauuuuauuaugcauga

SEQ ID NO: 3079996 - RNA, 20 nt, Human
uuauuuuaauaauguuucaa

SEQ ID NO: 3079997 - RNA, 16 nt, Human
uucaauaauaaauauu

SEQ ID NO: 3079998 - RNA, 21 nt, Human
uucaacagguuuuccugaaga

SEQ ID NO: 3079999 - RNA, 18 nt, Human
uucaaauguauuacagug

SEQ ID NO: 3080000 - RNA, 14 nt, Human
uuauuuuguucaua

SEQ ID NO: 3080001 - RNA, 16 nt, Human
uuauuuuguucauaca

SEQ ID NO: 3080002 - RNA, 18 nt, Human
uucaaaugcuguaacuuu

SEQ ID NO: 3080003 - RNA, 17 nt, Human
uucaaauccuugaagau

SEQ ID NO: 3080004 - RNA, 22 nt, Human
uuauuuuggaaaauaaauuauu

SEQ ID NO: 3080005 - RNA, 22 nt, Human
uucaauaggaaaaacugauuuu

SEQ ID NO: 3080006 - RNA, 21 nt, Human
uucaauaggaaaaacugauuu

SEQ ID NO: 3080007 - RNA, 19 nt, Human
uucaccuuuguccccaccg

SEQ ID NO: 3080008 - RNA, 20 nt, Human
uucaccuuuguccccaccgc

SEQ ID NO: 3080009 - RNA, 14 nt, Human
uucaccuuuguccc

SEQ ID NO: 3080010 - RNA, 13 nt, Human
uucacccuuuucu

SEQ ID NO: 3080011 - RNA, 17 nt, Human
uucagacagcugccugg

SEQ ID NO: 3080012 - RNA, 20 nt, Human
uucagauaaucacaauacau

SEQ ID NO: 3080013 - RNA, 17 nt, Human
uucacggaagagccuug

SEQ ID NO: 3080014 - RNA, 14 nt, Human
uucagacagcugcc

SEQ ID NO: 3080015 - RNA, 15 nt, Human
uucagacagcugccu

SEQ ID NO: 3080016 - RNA, 16 nt, Human
uucagacagcugccug

SEQ ID NO: 3080017 - RNA, 22 nt, Human
uucaccuuuguccccaccgcag

SEQ ID NO: 3080018 - RNA, 13 nt, Human
uucacggaagagc

SEQ ID NO: 3080019 - RNA, 13 nt, Human
uucaguggcagcu

SEQ ID NO: 3080020 - RNA, 14 nt, Human
uucaguggcagcug

SEQ ID NO: 3080021 - RNA, 22 nt, Human
uucagcuuguaaauagcucagg

SEQ ID NO: 3080022 - RNA, 15 nt, Human
uucagcuccagcuca

SEQ ID NO: 3080023 - RNA, 12 nt, Human
uucagcuccagc

SEQ ID NO: 3080024 - RNA, 21 nt, Human
uucagcugguugagguuucaa

SEQ ID NO: 3080025 - RNA, 16 nt, Human
uucaguggcagcugcu

SEQ ID NO: 3080026 - RNA, 15 nt, Human
uucaguggcagcugc

SEQ ID NO: 3080027 - RNA, 17 nt, Human
uucaguggcagcugcuu

SEQ ID NO: 3080028 - RNA, 12 nt, Human
uucaguguacau

SEQ ID NO: 3080029 - RNA, 13 nt, Human
uucaguguacaug

SEQ ID NO: 3080030 - RNA, 20 nt, Human
uucauaaauaaaguuuguug

SEQ ID NO: 3080031 - RNA, 23 nt, Human
uucaguuauuauauuuacaaaug

SEQ ID NO: 3080032 - RNA, 15 nt, Human
uucauccuccucaga

SEQ ID NO: 3080033 - RNA, 19 nt, Human
uucauccuccucagaucuu

SEQ ID NO: 3080034 - RNA, 15 nt, Human
uucauaaccuagccu

SEQ ID NO: 3080035 - RNA, 21 nt, Human
uuccaaaaagauuuucagaaa

SEQ ID NO: 3080036 - RNA, 13 nt, Human
uuccaaaguacac

SEQ ID NO: 3080037 - RNA, 16 nt, Human
uuccaaaguacacugu

SEQ ID NO: 3080038 - RNA, 19 nt, Human
uuccaacccucaucaccaa

SEQ ID NO: 3080039 - RNA, 18 nt, Human
uuccagauccuggaaauc

SEQ ID NO: 3080040 - RNA, 14 nt, Human
uuccauggacuuug

SEQ ID NO: 3080041 - RNA, 15 nt, Human
uuccauggacuuugu

SEQ ID NO: 3080042 - RNA, 16 nt, Human
uucucugcccuccaag

SEQ ID NO: 3080043 - RNA, 23 nt, Human
uucugacccaugcugcccuguga

SEQ ID NO: 3080044 - RNA, 22 nt, Human
uucugacccaugcugcccugug

SEQ ID NO: 3080045 - RNA, 18 nt, Human
uucugacccugcuucaaa

SEQ ID NO: 3080046 - RNA, 21 nt, Human
uucugagaaagacuauucaaa

SEQ ID NO: 3080047 - RNA, 16 nt, Human
uucugagaaagacuau

SEQ ID NO: 3080048 - RNA, 19 nt, Human
uucugcucacauaucuguc

SEQ ID NO: 3080049 - RNA, 19 nt, Human
uucugauccuaguuccacc

SEQ ID NO: 3080050 - RNA, 18 nt, Human
uucucuccuguaccucuu

SEQ ID NO: 3080051 - RNA, 14 nt, Human
uucucuccuguacc

SEQ ID NO: 3080052 - RNA, 15 nt, Human
uucucuccagccccu

SEQ ID NO: 3080053 - RNA, 13 nt, Human
uucucuccagccc

SEQ ID NO: 3080054 - RNA, 14 nt, Human
uucucuccagcccc

SEQ ID NO: 3080055 - RNA, 11 nt, Human
uucucugcccu

SEQ ID NO: 3080056 - RNA, 12 nt, Human
uucucugcccuc

SEQ ID NO: 3080057 - RNA, 20 nt, Human
uucucugaggacacuaacca

SEQ ID NO: 3080058 - RNA, 14 nt, Human
uucucugaggacac

SEQ ID NO: 3080059 - RNA, 19 nt, Human
uucucuccuguaccucuug

SEQ ID NO: 3080060 - RNA, 23 nt, Human
uucucuccucuccccaugauguu

SEQ ID NO: 3080061 - RNA, 21 nt, Human
uucuccaccucccacaaagga

SEQ ID NO: 3080062 - RNA, 12 nt, Human
uucuccaccugc

SEQ ID NO: 3080063 - RNA, 14 nt, Human
uucuccaccugcca

SEQ ID NO: 3080064 - RNA, 15 nt, Human
uucuccaccugccag

SEQ ID NO: 3080065 - RNA, 16 nt, Human
uucuccaccugccagg

SEQ ID NO: 3080066 - RNA, 18 nt, Human
uucuccaccugccaggga

SEQ ID NO: 3080067 - RNA, 20 nt, Human
uucuccaccugccagggaca

SEQ ID NO: 3080068 - RNA, 16 nt, Human
uucuccacccugcucu

SEQ ID NO: 3080069 - RNA, 14 nt, Human
uucuaugaaauauu

SEQ ID NO: 3080070 - RNA, 14 nt, Human
uucuauagcuuuuc

SEQ ID NO: 3080071 - RNA, 22 nt, Human
uucuacucgaguuacagacaaa

SEQ ID NO: 3080072 - RNA, 14 nt, Human
uucuacccaggugc

SEQ ID NO: 3080073 - RNA, 21 nt, Human
uucuacccagcgagcccuggu

SEQ ID NO: 3080074 - RNA, 20 nt, Human
uucuacccagcgagcccugg

SEQ ID NO: 3080075 - RNA, 13 nt, Human
uucuacgccaggg

SEQ ID NO: 3080076 - RNA, 22 nt, Human
uucuacauaaguaauucaagaa

SEQ ID NO: 3080077 - RNA, 19 nt, Human
uucuacccagcgagcccug

SEQ ID NO: 3080078 - RNA, 12 nt, Human
uucuacccagcg

SEQ ID NO: 3080079 - RNA, 15 nt, Human
uucuacauacuaugg

SEQ ID NO: 3080080 - RNA, 20 nt, Human
uuccugaggcugggcucccu

SEQ ID NO: 3080081 - RNA, 15 nt, Human
uuccugaggcugggc

SEQ ID NO: 3080082 - RNA, 23 nt, Human
uuccugaugcuucuucagagacu

SEQ ID NO: 3080083 - RNA, 12 nt, Human
uuccauggccuc

SEQ ID NO: 3080084 - RNA, 16 nt, Human
uuccauggccucuuca

SEQ ID NO: 3080085 - RNA, 18 nt, Human
uuccugaagaauugaaaa

SEQ ID NO: 3080086 - RNA, 18 nt, Human
uucggugagcuacaaaug

SEQ ID NO: 3080087 - RNA, 20 nt, Human
uuccuugaguugauucagcu

SEQ ID NO: 3080088 - RNA, 21 nt, Human
uuccuugaguugauucagcuc

SEQ ID NO: 3080089 - RNA, 12 nt, Human
uugaauuuuaca

SEQ ID NO: 3080090 - RNA, 14 nt, Human
uugaauuguaagga

SEQ ID NO: 3080091 - RNA, 18 nt, Human
uugaacuggguacuugug

SEQ ID NO: 3080092 - RNA, 17 nt, Human
uugaccgugaggccaga

SEQ ID NO: 3080093 - RNA, 17 nt, Human
uugacccacaagaaaug

SEQ ID NO: 3080094 - RNA, 14 nt, Human
uugacccacaagaa

SEQ ID NO: 3080095 - RNA, 15 nt, Human
uugaccucugcagca

SEQ ID NO: 3080096 - RNA, 14 nt, Human
uugaccucugcagc

SEQ ID NO: 3080097 - RNA, 21 nt, Human
uugaccucaggugauccaccc

SEQ ID NO: 3080098 - RNA, 17 nt, Human
uugacgccaucccagcc

SEQ ID NO: 3080099 - RNA, 18 nt, Human
uugacgccaucccagccc

SEQ ID NO: 3080100 - RNA, 19 nt, Human
uugacgccaucccagcccc

SEQ ID NO: 3080101 - RNA, 15 nt, Human
uugacgccaucccag

SEQ ID NO: 3080102 - RNA, 23 nt, Human
uugauauccucuuugagugaagc

SEQ ID NO: 3080103 - RNA, 23 nt, Human
uugauagcacagacccugcccug

SEQ ID NO: 3080104 - RNA, 23 nt, Human
uugaugaagaaguugauaugccu

SEQ ID NO: 3080105 - RNA, 13 nt, Human
uugaugaagaagu

SEQ ID NO: 3080106 - RNA, 14 nt, Human
uugaugaagaaguu

SEQ ID NO: 3080107 - RNA, 11 nt, Human
uugagccuggg

SEQ ID NO: 3080108 - RNA, 16 nt, Human
uugaggguugggcugg

SEQ ID NO: 3080109 - RNA, 13 nt, Human
uugaggguugggc

SEQ ID NO: 3080110 - RNA, 21 nt, Human
uugcaaaguaucccuacugua

SEQ ID NO: 3080111 - RNA, 16 nt, Human
uugaugaucuuugcag

SEQ ID NO: 3080112 - RNA, 17 nt, Human
uucuuccaaaaagauuu

SEQ ID NO: 3080113 - RNA, 21 nt, Human
uucuuauacauuugauaaagu

SEQ ID NO: 3080114 - RNA, 21 nt, Human
uucuuccacaagagcccaggc

SEQ ID NO: 3080115 - RNA, 14 nt, Human
uucuuguguguuua

SEQ ID NO: 3080116 - RNA, 13 nt, Human
uucuuccucccuc

SEQ ID NO: 3080117 - RNA, 21 nt, Human
uucuuguguguuuauugucaa

SEQ ID NO: 3080118 - RNA, 14 nt, Human
uucuuuccaaagua

SEQ ID NO: 3080119 - RNA, 12 nt, Human
uucuuucagcca

SEQ ID NO: 3080120 - RNA, 16 nt, Human
uugaacuccuggccuc

SEQ ID NO: 3080121 - RNA, 15 nt, Human
uugaacuccuggccu

SEQ ID NO: 3080122 - RNA, 22 nt, Human
uugaaaacacuguucucugccc

SEQ ID NO: 3080123 - RNA, 23 nt, Human
uugaaaacacuguucucugcccu

SEQ ID NO: 3080124 - RNA, 20 nt, Human
uugaaaaaccauuuugcugu

SEQ ID NO: 3080125 - RNA, 21 nt, Human
uucuuuccaaaguacacuguu

SEQ ID NO: 3080126 - RNA, 18 nt, Human
uucugcuuguguuaagua

SEQ ID NO: 3080127 - RNA, 19 nt, Human
uucugcuucagccucccga

SEQ ID NO: 3080128 - RNA, 16 nt, Human
uucugcuucagccucc

SEQ ID NO: 3080129 - RNA, 15 nt, Human
uucugcuucagccuc

SEQ ID NO: 3080130 - RNA, 14 nt, Human
uucugcuucagccu

SEQ ID NO: 3080131 - RNA, 17 nt, Human
uucugucuucacaacag

SEQ ID NO: 3080132 - RNA, 18 nt, Human
uucuguauuuuguuuuug

SEQ ID NO: 3080133 - RNA, 19 nt, Human
uucuguccuacucuguguc

SEQ ID NO: 3080134 - RNA, 23 nt, Human
uuguacgaagaguauuuuugaca

SEQ ID NO: 3080135 - RNA, 21 nt, Human
uuguacgaagaguauuuuuga

SEQ ID NO: 3080136 - RNA, 21 nt, Human
uuguauucagaguugaugguu

SEQ ID NO: 3080137 - RNA, 16 nt, Human
uuguauucucuccugu

SEQ ID NO: 3080138 - RNA, 15 nt, Human
uuguauucucuccug

SEQ ID NO: 3080139 - RNA, 19 nt, Human
uuguauucucuccuguacc

SEQ ID NO: 3080140 - RNA, 15 nt, Human
uugucuuaaaaagug

SEQ ID NO: 3080141 - RNA, 15 nt, Human
uugucuagugaaacu

SEQ ID NO: 3080142 - RNA, 17 nt, Human
uugugauuuuuguaauu

SEQ ID NO: 3080143 - RNA, 16 nt, Human
uugugauuuuuguaau

SEQ ID NO: 3080144 - RNA, 12 nt, Human
uugugauuuuug

SEQ ID NO: 3080145 - RNA, 20 nt, Human
uugugaaaggaaagaggcuc

SEQ ID NO: 3080146 - RNA, 17 nt, Human
uuguaaauaguauuuga

SEQ ID NO: 3080147 - RNA, 17 nt, Human
uuguaaauagcucaggu

SEQ ID NO: 3080148 - RNA, 23 nt, Human
uuguaaauuaacuuuuauaaacu

SEQ ID NO: 3080149 - RNA, 18 nt, Human
uuguaaauuaacuuuuau

SEQ ID NO: 3080150 - RNA, 16 nt, Human
uuguaaauuaacuuuu

SEQ ID NO: 3080151 - RNA, 15 nt, Human
uuguaaauuaacuuu

SEQ ID NO: 3080152 - RNA, 14 nt, Human
uuguacauaaugcg

SEQ ID NO: 3080153 - RNA, 18 nt, Human
uuguacauaaugcgugca

SEQ ID NO: 3080154 - RNA, 22 nt, Human
uuggguucaagcgauucuucug

SEQ ID NO: 3080155 - RNA, 13 nt, Human
uuggucuguguga

SEQ ID NO: 3080156 - RNA, 16 nt, Human
uuggucugugagaugc

SEQ ID NO: 3080157 - RNA, 15 nt, Human
uuggucugugagaug

SEQ ID NO: 3080158 - RNA, 13 nt, Human
uuguguugugaau

SEQ ID NO: 3080159 - RNA, 20 nt, Human
uuguguugaagagguuuuaa

SEQ ID NO: 3080160 - RNA, 21 nt, Human
uuguguuuauauauaagccaa

SEQ ID NO: 3080161 - RNA, 23 nt, Human
uuguggauuuaacagaaauguac

SEQ ID NO: 3080162 - RNA, 22 nt, Human
uuguggauuuaacagaaaugua

SEQ ID NO: 3080163 - RNA, 13 nt, Human
uuguguucaccuu

SEQ ID NO: 3080164 - RNA, 16 nt, Human
uuguggacacagcucu

SEQ ID NO: 3080165 - RNA, 17 nt, Human
uuguggacacagcucuu

SEQ ID NO: 3080166 - RNA, 21 nt, Human
uuguggauuuaacagaaaugu

SEQ ID NO: 3080167 - RNA, 20 nt, Human
uuguggauuuaacagaaaug

SEQ ID NO: 3080168 - RNA, 23 nt, Human
uugugcauuaucuagauacugua

SEQ ID NO: 3080169 - RNA, 22 nt, Human
uugugcauuaucuagauacugu

SEQ ID NO: 3080170 - RNA, 12 nt, Human
uugugcauuugg

SEQ ID NO: 3080171 - RNA, 17 nt, Human
uugugcauuaucuagau

SEQ ID NO: 3080172 - RNA, 12 nt, Human
uugugccccugc

SEQ ID NO: 3080173 - RNA, 21 nt, Human
uuguuaguaugaggcauuugu

SEQ ID NO: 3080174 - RNA, 19 nt, Human
uuguuaguaugaggcauuu

SEQ ID NO: 3080175 - RNA, 14 nt, Human
uuguuacauuuuua

SEQ ID NO: 3080176 - RNA, 18 nt, Human
uuguguuuugcaagccag

SEQ ID NO: 3080177 - RNA, 22 nt, Human
uuguuaguaugaggcauuuguu

SEQ ID NO: 3080178 - RNA, 20 nt, Human
uuguuagugugucuuagugu

SEQ ID NO: 3080179 - RNA, 14 nt, Human
uuguuuaaaaucau

SEQ ID NO: 3080180 - RNA, 20 nt, Human
uuuacauuguaaauaguauu

SEQ ID NO: 3080181 - RNA, 13 nt, Human
uuuaccacuugug

SEQ ID NO: 3080182 - RNA, 21 nt, Human
uuuaauagguuuggacaaaau

SEQ ID NO: 3080183 - RNA, 23 nt, Human
uuuauaaaaauaaaaaacacugg

SEQ ID NO: 3080184 - RNA, 21 nt, Human
uuuauaaaaauaaaaaacacu

SEQ ID NO: 3080185 - RNA, 12 nt, Human
uuuagacagagu

SEQ ID NO: 3080186 - RNA, 14 nt, Human
uuuagaaauauaau

SEQ ID NO: 3080187 - RNA, 22 nt, Human
uuuacuucuuauacauuugaua

SEQ ID NO: 3080188 - RNA, 19 nt, Human
uuuacuucuuauacauuug

SEQ ID NO: 3080189 - RNA, 15 nt, Human
uuuacuucuuauaca

SEQ ID NO: 3080190 - RNA, 19 nt, Human
uuuaacucuauaauguguu

SEQ ID NO: 3080191 - RNA, 18 nt, Human
uuuaacagaaauguacag

SEQ ID NO: 3080192 - RNA, 18 nt, Human
uuuaagaaaaaggaugca

SEQ ID NO: 3080193 - RNA, 22 nt, Human
uuuaagaaaaaggaugcacaga

SEQ ID NO: 3080194 - RNA, 19 nt, Human
uuuaagugcugcauuuaaa

SEQ ID NO: 3080195 - RNA, 13 nt, Human
uuuaauaauguuu

SEQ ID NO: 3080196 - RNA, 18 nt, Human
uuucauuuaggugaggaa

SEQ ID NO: 3080197 - RNA, 14 nt, Human
uuucauuuagguga

SEQ ID NO: 3080198 - RNA, 14 nt, Human
uuucaguguacaug

SEQ ID NO: 3080199 - RNA, 13 nt, Human
uuucaguguacau

SEQ ID NO: 3080200 - RNA, 17 nt, Human
uuucaauaggaaaaacu

SEQ ID NO: 3080201 - RNA, 12 nt, Human
uuucaauaggaa

SEQ ID NO: 3080202 - RNA, 14 nt, Human
uuucaauaggaaaa

SEQ ID NO: 3080203 - RNA, 21 nt, Human
uuucagauaaucacaauacau

SEQ ID NO: 3080204 - RNA, 16 nt, Human
uuuauggcuuuugugc

SEQ ID NO: 3080205 - RNA, 14 nt, Human
uuuauggcuuuugu

SEQ ID NO: 3080206 - RNA, 17 nt, Human
uuuauggcacuaguauu

SEQ ID NO: 3080207 - RNA, 13 nt, Human
uuuauuauggcac

SEQ ID NO: 3080208 - RNA, 13 nt, Human
uuuauuaugcaug

SEQ ID NO: 3080209 - RNA, 22 nt, Human
uuuauaauuuugugaagcaaaa

SEQ ID NO: 3080210 - RNA, 22 nt, Human
uuuauuguuuaaaaucauuucu

SEQ ID NO: 3080211 - RNA, 17 nt, Human
uggagacacaacuauuu

SEQ ID NO: 3080212 - RNA, 19 nt, Human
uggacuaacuugucuuugg

SEQ ID NO: 3080213 - RNA, 20 nt, Human
uggacuaacuugucuuugga

SEQ ID NO: 3080214 - RNA, 19 nt, Human
uggacguguuaugacucca

SEQ ID NO: 3080215 - RNA, 23 nt, Human
uggacguguuaugacuccagaau

SEQ ID NO: 3080216 - RNA, 22 nt, Human
uggacaggcauguucucugagg

SEQ ID NO: 3080217 - RNA, 18 nt, Human
uggacaggcauguucucu

SEQ ID NO: 3080218 - RNA, 17 nt, Human
uggacaggcauguucuc

SEQ ID NO: 3080219 - RNA, 19 nt, Human
uggaucaaauccagccugc

SEQ ID NO: 3080220 - RNA, 13 nt, Human
uggaugcagccuc

SEQ ID NO: 3080221 - RNA, 21 nt, Human
uggaugcagccucacaguccu

SEQ ID NO: 3080222 - RNA, 22 nt, Human
uggaugcagccucacaguccuu

SEQ ID NO: 3080223 - RNA, 21 nt, Human
uggauuguccccgacccuugc

SEQ ID NO: 3080224 - RNA, 23 nt, Human
uggaggggggaggugggauccuc

SEQ ID NO: 3080225 - RNA, 18 nt, Human
uggcagcucagagagggu

SEQ ID NO: 3080226 - RNA, 13 nt, Human
uggcacuggcaaa

SEQ ID NO: 3080227 - RNA, 21 nt, Human
uggcacuggcaaacagggccu

SEQ ID NO: 3080228 - RNA, 22 nt, Human
uggcacuggcaaacagggccuc

SEQ ID NO: 3080229 - RNA, 22 nt, Human
uggcacugcuuccagugaggcu

SEQ ID NO: 3080230 - RNA, 19 nt, Human
uggcacugcuuccagugag

SEQ ID NO: 3080231 - RNA, 22 nt, Human
uggcacuauaauguaagcucua

SEQ ID NO: 3080232 - RNA, 21 nt, Human
uggcacuauaauguaagcucu

SEQ ID NO: 3080233 - RNA, 15 nt, Human
uggauuuaacagaaa

SEQ ID NO: 3080234 - RNA, 17 nt, Human
ugcuuuggaaaacccag

SEQ ID NO: 3080235 - RNA, 15 nt, Human
ugcuuguguuaagua

SEQ ID NO: 3080236 - RNA, 12 nt, Human
ugcuuguguuaa

SEQ ID NO: 3080237 - RNA, 18 nt, Human
ugcuugugaaaggaaaga

SEQ ID NO: 3080238 - RNA, 13 nt, Human
ugcuucuucagag

SEQ ID NO: 3080239 - RNA, 22 nt, Human
ugcuucuguuuuauaauuuugu

SEQ ID NO: 3080240 - RNA, 15 nt, Human
uggaacacucugaga

SEQ ID NO: 3080241 - RNA, 17 nt, Human
uggaacacucugagacu

SEQ ID NO: 3080242 - RNA, 14 nt, Human
uggaacacucugag

SEQ ID NO: 3080243 - RNA, 18 nt, Human
ugcuuaacuucacauauu

SEQ ID NO: 3080244 - RNA, 17 nt, Human
ugcuuaacuucacauau

SEQ ID NO: 3080245 - RNA, 14 nt, Human
ugcuuaacuucaca

SEQ ID NO: 3080246 - RNA, 13 nt, Human
ugcuuaacuucac

SEQ ID NO: 3080247 - RNA, 19 nt, Human
ugcuuaacuucacauauug

SEQ ID NO: 3080248 - RNA, 22 nt, Human
ugcuuccagugaggcucugccc

SEQ ID NO: 3080249 - RNA, 23 nt, Human
ugcuuccagugaggcucugcccu

SEQ ID NO: 3080250 - RNA, 21 nt, Human
ugcuuccagugaggcucugcc

SEQ ID NO: 3080251 - RNA, 12 nt, Human
ugcuucucacug

SEQ ID NO: 3080252 - RNA, 17 nt, Human
ugcuucuguuuuauaau

SEQ ID NO: 3080253 - RNA, 17 nt, Human
uggggccaggcuggguc

SEQ ID NO: 3080254 - RNA, 16 nt, Human
ugggggccucagugcc

SEQ ID NO: 3080255 - RNA, 19 nt, Human
uggggggcugaggugggag

SEQ ID NO: 3080256 - RNA, 19 nt, Human
ugggggcugggcagaggaa

SEQ ID NO: 3080257 - RNA, 17 nt, Human
ugggcuugucuguagau

SEQ ID NO: 3080258 - RNA, 23 nt, Human
ugggcuuggggaccagagcugcc

SEQ ID NO: 3080259 - RNA, 21 nt, Human
ugggcuugucuguagauuuua

SEQ ID NO: 3080260 - RNA, 22 nt, Human
ugggcuuggggaccagagcugc

SEQ ID NO: 3080261 - RNA, 15 nt, Human
ugggcuucauccucc

SEQ ID NO: 3080262 - RNA, 21 nt, Human
ugggcuucaguggcagcugcu

SEQ ID NO: 3080263 - RNA, 22 nt, Human
ugggcuucaguggcagcugcuu

SEQ ID NO: 3080264 - RNA, 18 nt, Human
ugggaugauuggaggggg

SEQ ID NO: 3080265 - RNA, 16 nt, Human
ugggaggaucucuuga

SEQ ID NO: 3080266 - RNA, 14 nt, Human
ugggacagggagga

SEQ ID NO: 3080267 - RNA, 16 nt, Human
ugggaaugaaugucag

SEQ ID NO: 3080268 - RNA, 13 nt, Human
ugggacacccugu

SEQ ID NO: 3080269 - RNA, 14 nt, Human
ugggacacccugug

SEQ ID NO: 3080270 - RNA, 15 nt, Human
ugggacacccuguga

SEQ ID NO: 3080271 - RNA, 15 nt, Human
ugggcagagcagaga

SEQ ID NO: 3080272 - RNA, 17 nt, Human
ugggcagagcagagacc

SEQ ID NO: 3080273 - RNA, 14 nt, Human
ugggcagagcagag

SEQ ID NO: 3080274 - RNA, 13 nt, Human
ugggcagagcaga

SEQ ID NO: 3080275 - RNA, 14 nt, Human
ugggaaugaagcaa

SEQ ID NO: 3080276 - RNA, 21 nt, Human
uggcuugaguuuaaauuguaa

SEQ ID NO: 3080277 - RNA, 22 nt, Human
uggccuucggccuccauccuga

SEQ ID NO: 3080278 - RNA, 20 nt, Human
uggccuucggccuccauccu

SEQ ID NO: 3080279 - RNA, 23 nt, Human
uggccuucggccuccauccugag

SEQ ID NO: 3080280 - RNA, 11 nt, Human
uggcugcugaa

SEQ ID NO: 3080281 - RNA, 13 nt, Human
uggcugcugaagg

SEQ ID NO: 3080282 - RNA, 14 nt, Human
uggcugcugaaggc

SEQ ID NO: 3080283 - RNA, 16 nt, Human
uggcugcugaaggcuc

SEQ ID NO: 3080284 - RNA, 20 nt, Human
uggccuagcauacguacaca

SEQ ID NO: 3080285 - RNA, 21 nt, Human
uggccccucagggucccuggu

SEQ ID NO: 3080286 - RNA, 22 nt, Human
uggccccucagggucccuggug

SEQ ID NO: 3080287 - RNA, 13 nt, Human
uggccccucaggg

SEQ ID NO: 3080288 - RNA, 20 nt, Human
uggccccucagggucccugg

SEQ ID NO: 3080289 - RNA, 17 nt, Human
uggcagcugcgguccac

SEQ ID NO: 3080290 - RNA, 23 nt, Human
uggccuagcauacguacacauuu

SEQ ID NO: 3080291 - RNA, 23 nt, Human
uggccucaagugauucuccugcc

SEQ ID NO: 3080292 - RNA, 18 nt, Human
uggccucaagugauucuc

SEQ ID NO: 3080293 - RNA, 11 nt, Human
uggccucccaa

SEQ ID NO: 3080294 - RNA, 14 nt, Human
uggccucccaacuc

SEQ ID NO: 3080295 - RNA, 19 nt, Human
uggccucccaacucacccc

SEQ ID NO: 3080296 - RNA, 20 nt, Human
uggccucccaacucacccca

SEQ ID NO: 3080297 - RNA, 21 nt, Human
uggccucccaacucaccccag

SEQ ID NO: 3080298 - RNA, 22 nt, Human
uggccucccaacucaccccagc

SEQ ID NO: 3080299 - RNA, 22 nt, Human
uguaauaacugugaaguuuaca

SEQ ID NO: 3080300 - RNA, 14 nt, Human
uguaauaacuguga

SEQ ID NO: 3080301 - RNA, 14 nt, Human
uguaacaagccacc

SEQ ID NO: 3080302 - RNA, 17 nt, Human
uguaacaagccacccca

SEQ ID NO: 3080303 - RNA, 17 nt, Human
uguaaugaaaaccacau

SEQ ID NO: 3080304 - RNA, 13 nt, Human
uguaaugaaaacc

SEQ ID NO: 3080305 - RNA, 12 nt, Human
uguaaugaaaac

SEQ ID NO: 3080306 - RNA, 11 nt, Human
uguaaugaaaa

SEQ ID NO: 3080307 - RNA, 14 nt, Human
uguacagacaacaa

SEQ ID NO: 3080308 - RNA, 11 nt, Human
uguacagagcc

SEQ ID NO: 3080309 - RNA, 20 nt, Human
ugguuguacauauaagugau

SEQ ID NO: 3080310 - RNA, 16 nt, Human
ugguuuucuguucuuu

SEQ ID NO: 3080311 - RNA, 23 nt, Human
ugguuuuuaaaaaacugcugacu

SEQ ID NO: 3080312 - RNA, 21 nt, Human
ugguuuuuaaaaaacugcuga

SEQ ID NO: 3080313 - RNA, 19 nt, Human
ugguuuucuuguguguuua

SEQ ID NO: 3080314 - RNA, 12 nt, Human
uguaaaauggug

SEQ ID NO: 3080315 - RNA, 11 nt, Human
uguaaaauggu

SEQ ID NO: 3080316 - RNA, 18 nt, Human
uggugucgggcaugacac

SEQ ID NO: 3080317 - RNA, 15 nt, Human
uggugucgggcauga

SEQ ID NO: 3080318 - RNA, 16 nt, Human
uggugucaccugaaga

SEQ ID NO: 3080319 - RNA, 16 nt, Human
ugguucccuugaugaa

SEQ ID NO: 3080320 - RNA, 17 nt, Human
ugguucccuugaugaag

SEQ ID NO: 3080321 - RNA, 20 nt, Human
ugguucccuugaugaagaag

SEQ ID NO: 3080322 - RNA, 18 nt, Human
ugguugaugaucuuugca

SEQ ID NO: 3080323 - RNA, 23 nt, Human
uggguacuuguggacacagcucu

SEQ ID NO: 3080324 - RNA, 20 nt, Human
uggguacuuguggacacagc

SEQ ID NO: 3080325 - RNA, 14 nt, Human
uggguagacacaca

SEQ ID NO: 3080326 - RNA, 14 nt, Human
uggugagaggcauc

SEQ ID NO: 3080327 - RNA, 18 nt, Human
ugguggcagugggagcug

SEQ ID NO: 3080328 - RNA, 13 nt, Human
ugguggcaguggg

SEQ ID NO: 3080329 - RNA, 20 nt, Human
ugguggcagugggagcugcc

SEQ ID NO: 3080330 - RNA, 14 nt, Human
uggugcaaugaccu

SEQ ID NO: 3080331 - RNA, 19 nt, Human
uggugcaaugaccuuucaa

SEQ ID NO: 3080332 - RNA, 12 nt, Human
ugguggcagugg

SEQ ID NO: 3080333 - RNA, 13 nt, Human
ugguggcuggguu

SEQ ID NO: 3080334 - RNA, 16 nt, Human
uggugggggccucggu

SEQ ID NO: 3080335 - RNA, 18 nt, Human
uggugggggccucggugu

SEQ ID NO: 3080336 - RNA, 18 nt, Human
uggugguuucagaaaugu

SEQ ID NO: 3080337 - RNA, 17 nt, Human
uggugguuucagaaaug

SEQ ID NO: 3080338 - RNA, 19 nt, Human
uggugguuuucuguucuuu

SEQ ID NO: 3080339 - RNA, 14 nt, Human
uguagcuuuaucaa

SEQ ID NO: 3080340 - RNA, 15 nt, Human
uguagcuuuaucaaa

SEQ ID NO: 3080341 - RNA, 23 nt, Human
uguacagcaaggagauuuacaac

SEQ ID NO: 3080342 - RNA, 21 nt, Human
uguacagagcccacgccccca

SEQ ID NO: 3080343 - RNA, 12 nt, Human
uguacagagccc

SEQ ID NO: 3080344 - RNA, 22 nt, Human
uguacagcaaggagauuuacaa

SEQ ID NO: 3080345 - RNA, 13 nt, Human
uguauaaaauaau

SEQ ID NO: 3080346 - RNA, 14 nt, Human
uguauaaaauaauu

SEQ ID NO: 3080347 - RNA, 19 nt, Human
uguaguguuggagaagaac

SEQ ID NO: 3080348 - RNA, 20 nt, Human
uguaguguuggagaagaacu

SEQ ID NO: 3080349 - RNA, 21 nt, Human
uguaguguuggagaagaacug

SEQ ID NO: 3080350 - RNA, 13 nt, Human
uguaucugagcag

SEQ ID NO: 3080351 - RNA, 19 nt, Human
ugucaauuacaggaaguac

SEQ ID NO: 3080352 - RNA, 18 nt, Human
uguauuuuaaaagaauga

SEQ ID NO: 3080353 - RNA, 19 nt, Human
uguauuuuaaaagaaugau

SEQ ID NO: 3080354 - RNA, 14 nt, Human
ugucacaggcaggu

SEQ ID NO: 3080355 - RNA, 21 nt, Human
ugucaauuacaggaaguacug

SEQ ID NO: 3080356 - RNA, 21 nt, Human
ugucacaggcagguccagggu

SEQ ID NO: 3080357 - RNA, 17 nt, Human
ugucacaggcaggucca

SEQ ID NO: 3080358 - RNA, 16 nt, Human
ugucacaggcaggucc

SEQ ID NO: 3080359 - RNA, 15 nt, Human
ugucacaggcagguc

SEQ ID NO: 3080360 - RNA, 13 nt, Human
ugucacaggcagg

SEQ ID NO: 3080361 - RNA, 16 nt, Human
ugucagugugacugau

SEQ ID NO: 3080362 - RNA, 19 nt, Human
ugucagugugacugaucuc

SEQ ID NO: 3080363 - RNA, 15 nt, Human
ugucagugugacuga

SEQ ID NO: 3080364 - RNA, 14 nt, Human
ugucagugugacug

SEQ ID NO: 3080365 - RNA, 20 nt, Human
uguccugggagugagcuggu

SEQ ID NO: 3080366 - RNA, 19 nt, Human
uguccugggagugagcugg

SEQ ID NO: 3080367 - RNA, 12 nt, Human
uguccugggagu

SEQ ID NO: 3080368 - RNA, 14 nt, Human
ugucuaaugaaacc

SEQ ID NO: 3080369 - RNA, 17 nt, Human
ugucuacacuaagagag

SEQ ID NO: 3080370 - RNA, 22 nt, Human
ugucuacacuaagagagaauga

SEQ ID NO: 3080371 - RNA, 17 nt, Human
uguccccgcacugggcu

SEQ ID NO: 3080372 - RNA, 19 nt, Human
uguccccgcacugggcuug

SEQ ID NO: 3080373 - RNA, 21 nt, Human
ugucucaaaaaaagaaaaaga

SEQ ID NO: 3080374 - RNA, 15 nt, Human
ugucuaguuguuuga

SEQ ID NO: 3080375 - RNA, 23 nt, Human
ugucuaguuguuugauucagaca

SEQ ID NO: 3080376 - RNA, 16 nt, Human
ugucuaugggacucaa

SEQ ID NO: 3080377 - RNA, 15 nt, Human
ugucuaugggacuca

SEQ ID NO: 3080378 - RNA, 14 nt, Human
ugucuaugggacuc

SEQ ID NO: 3080379 - RNA, 23 nt, Human
ugucuuuggacccugaggcccag

SEQ ID NO: 3080380 - RNA, 16 nt, Human
ugucuuuucuugcaug

SEQ ID NO: 3080381 - RNA, 20 nt, Human
ugauguauucuagcuaaugu

SEQ ID NO: 3080382 - RNA, 14 nt, Human
ugauguauucuagc

SEQ ID NO: 3080383 - RNA, 21 nt, Human
ugauguauucuagcuaaugua

SEQ ID NO: 3080384 - RNA, 13 nt, Human
ugauguauucuag

SEQ ID NO: 3080385 - RNA, 21 nt, Human
ugaugguuguacauauaagug

SEQ ID NO: 3080386 - RNA, 13 nt, Human
ugauguacaugua

SEQ ID NO: 3080387 - RNA, 18 nt, Human
ugaugcuucuucagagac

SEQ ID NO: 3080388 - RNA, 19 nt, Human
ugaugcuucuucagagacu

SEQ ID NO: 3080389 - RNA, 21 nt, Human
ugaugcuucuucagagacucc

SEQ ID NO: 3080390 - RNA, 22 nt, Human
ugaugcuucuucagagacuccu

SEQ ID NO: 3080391 - RNA, 22 nt, Human
ugaugaucuuugcagacaggca

SEQ ID NO: 3080392 - RNA, 20 nt, Human
ugaugaugaaaugaggucag

SEQ ID NO: 3080393 - RNA, 23 nt, Human
ugaugaucuuugcagacaggcaa

SEQ ID NO: 3080394 - RNA, 14 nt, Human
ugaugccaugagga

SEQ ID NO: 3080395 - RNA, 20 nt, Human
ugaucuuugcagacaggcaa

SEQ ID NO: 3080396 - RNA, 19 nt, Human
ugaucuuugcagacaggca

SEQ ID NO: 3080397 - RNA, 23 nt, Human
ugaucuuugcagacaggcaagca

SEQ ID NO: 3080398 - RNA, 21 nt, Human
ugaucuuugcagacaggcaag

SEQ ID NO: 3080399 - RNA, 18 nt, Human
ugaucuuugcagacaggc

SEQ ID NO: 3080400 - RNA, 23 nt, Human
ugauauaaguguguguuuuucau

SEQ ID NO: 3080401 - RNA, 17 nt, Human
ugauauaaguguguguu

SEQ ID NO: 3080402 - RNA, 24 nt, Human
ugauaguuguaccgcaaugugacu

SEQ ID NO: 3080403 - RNA, 22 nt, Human
ugaucacggcucacugcagccu

SEQ ID NO: 3080404 - RNA, 20 nt, Human
ugauccacccaccucagccu

SEQ ID NO: 3080405 - RNA, 15 nt, Human
ugauccacccaccuc

SEQ ID NO: 3080406 - RNA, 21 nt, Human
ugauccaagcuggucccacuc

SEQ ID NO: 3080407 - RNA, 17 nt, Human
ugauccaagcugguccc

SEQ ID NO: 3080408 - RNA, 24 nt, Human
ugaucauccacugugccaugugcc

SEQ ID NO: 3080409 - RNA, 13 nt, Human
ugaucauccacug

SEQ ID NO: 3080410 - RNA, 17 nt, Human
ugaucucucgugauuga

SEQ ID NO: 3080411 - RNA, 19 nt, Human
ugaucuaggaagacuuugg

SEQ ID NO: 3080412 - RNA, 21 nt, Human
ugaucuaggaagacuuuggaa

SEQ ID NO: 3080413 - RNA, 22 nt, Human
ugauccacccaccucagccucc

SEQ ID NO: 3080414 - RNA, 21 nt, Human
ugauccacccaccucagccuc

SEQ ID NO: 3080415 - RNA, 16 nt, Human
ugaguugauucagcuc

SEQ ID NO: 3080416 - RNA, 19 nt, Human
ugaguugauucagcucugc

SEQ ID NO: 3080417 - RNA, 21 nt, Human
ugaguugauagcacagacccu

SEQ ID NO: 3080418 - RNA, 23 nt, Human
ugaguugauagcacagacccugc

SEQ ID NO: 3080419 - RNA, 16 nt, Human
ugagucgaggacaggg

SEQ ID NO: 3080420 - RNA, 15 nt, Human
ugagucgaggacagg

SEQ ID NO: 3080421 - RNA, 17 nt, Human
ugauagcacagacccug

SEQ ID NO: 3080422 - RNA, 18 nt, Human
ugauagcacagacccugc

SEQ ID NO: 3080423 - RNA, 20 nt, Human
ugauagcacagacccugccc

SEQ ID NO: 3080424 - RNA, 21 nt, Human
ugauagcacagacccugcccu

SEQ ID NO: 3080425 - RNA, 15 nt, Human
ugauagcacagaccc

SEQ ID NO: 3080426 - RNA, 16 nt, Human
ugauagcacagacccu

SEQ ID NO: 3080427 - RNA, 22 nt, Human
ugauagcacagacccugcccug

SEQ ID NO: 3080428 - RNA, 23 nt, Human
ugauagcacagacccugcccugu

SEQ ID NO: 3080429 - RNA, 15 nt, Human
ugaggugcuauguuc

SEQ ID NO: 3080430 - RNA, 16 nt, Human
ugaggugcuauguucu

SEQ ID NO: 3080431 - RNA, 19 nt, Human
ugagguuucaaaccucccu

SEQ ID NO: 3080432 - RNA, 21 nt, Human
ugaguccccuguuuguuucug

SEQ ID NO: 3080433 - RNA, 19 nt, Human
ugaguccuggcaugggaau

SEQ ID NO: 3080434 - RNA, 22 nt, Human
ugaguccuggcaugggaaugaa

SEQ ID NO: 3080435 - RNA, 14 nt, Human
ugagucgaggacag

SEQ ID NO: 3080436 - RNA, 11 nt, Human
ugaguccuggc

SEQ ID NO: 3080437 - RNA, 18 nt, Human
ugaguccuggcaugggaa

SEQ ID NO: 3080438 - RNA, 20 nt, Human
ugaguccccuguuuguuucu

SEQ ID NO: 3080439 - RNA, 11 nt, Human
ugaggcugggc

SEQ ID NO: 3080440 - RNA, 15 nt, Human
ugaggucuguucuuu

SEQ ID NO: 3080441 - RNA, 14 nt, Human
ugaggucuguucuu

SEQ ID NO: 3080442 - RNA, 20 nt, Human
ugaggucuguucuuuccaaa

SEQ ID NO: 3080443 - RNA, 17 nt, Human
ugagaaaucuaaaaaac

SEQ ID NO: 3080444 - RNA, 13 nt, Human
ugagaaaucuaaa

SEQ ID NO: 3080445 - RNA, 15 nt, Human
ugagaaagacuauuc

SEQ ID NO: 3080446 - RNA, 18 nt, Human
ugagaaagacuauucaaa

SEQ ID NO: 3080447 - RNA, 17 nt, Human
ugagaaagacuauucaa

SEQ ID NO: 3080448 - RNA, 16 nt, Human
ugagaaagacuauuca

SEQ ID NO: 3080449 - RNA, 12 nt, Human
ugagacccuguc

SEQ ID NO: 3080450 - RNA, 12 nt, Human
ugagacagcucu

SEQ ID NO: 3080451 - RNA, 14 nt, Human
ugagacagcucugc

SEQ ID NO: 3080452 - RNA, 16 nt, Human
ugagacagcucugcau

SEQ ID NO: 3080453 - RNA, 17 nt, Human
ugagaguagagucacug

SEQ ID NO: 3080454 - RNA, 19 nt, Human
ugagaggggaacagacugg

SEQ ID NO: 3080455 - RNA, 15 nt, Human
ugagaucagccuggg

SEQ ID NO: 3080456 - RNA, 23 nt, Human
ugagaggcauccaguaucuugaa

SEQ ID NO: 3080457 - RNA, 22 nt, Human
ugagaggcauccaguaucuuga

SEQ ID NO: 3080458 - RNA, 14 nt, Human
ugagacucugucuc

SEQ ID NO: 3080459 - RNA, 13 nt, Human
ugagacucugucu

SEQ ID NO: 3080460 - RNA, 12 nt, Human
ugagacucuguc

SEQ ID NO: 3080461 - RNA, 13 nt, Human
ugagcaucaggcc

SEQ ID NO: 3080462 - RNA, 20 nt, Human
ugagcagucaggaaagagaa

SEQ ID NO: 3080463 - RNA, 17 nt, Human
ugagcagucaggaaaga

SEQ ID NO: 3080464 - RNA, 15 nt, Human
ugagcagucaggaaa

SEQ ID NO: 3080465 - RNA, 14 nt, Human
ugagaugcuagaac

SEQ ID NO: 3080466 - RNA, 16 nt, Human
ugagaugcuagaacuc

SEQ ID NO: 3080467 - RNA, 20 nt, Human
ugagaugcuagaacucccuu

SEQ ID NO: 3080468 - RNA, 14 nt, Human
ugagcaucaggcca

SEQ ID NO: 3080469 - RNA, 15 nt, Human
ugagcaucaggccag

SEQ ID NO: 3080470 - RNA, 13 nt, Human
ugagccucagcau

SEQ ID NO: 3080471 - RNA, 16 nt, Human
ucuugaauaauguaag

SEQ ID NO: 3080472 - RNA, 19 nt, Human
ucuugaaggaaaaugauac

SEQ ID NO: 3080473 - RNA, 15 nt, Human
ucuugaacuccuggc

SEQ ID NO: 3080474 - RNA, 17 nt, Human
ucuugaauuguaaggaa

SEQ ID NO: 3080475 - RNA, 20 nt, Human
ugaccauucuccaccugcca

SEQ ID NO: 3080476 - RNA, 21 nt, Human
ugaccauucuccaccugccag

SEQ ID NO: 3080477 - RNA, 22 nt, Human
ugaccauucuccaccugccagg

SEQ ID NO: 3080478 - RNA, 19 nt, Human
ugaccauucuccaccugcc

SEQ ID NO: 3080479 - RNA, 21 nt, Human
ugaccucugcagcaauaaagc

SEQ ID NO: 3080480 - RNA, 18 nt, Human
ugaccucugcagcaauaa

SEQ ID NO: 3080481 - RNA, 23 nt, Human
ugaccucugcagcaauaaagcag

SEQ ID NO: 3080482 - RNA, 12 nt, Human
ugaccucugccu

SEQ ID NO: 3080483 - RNA, 15 nt, Human
ugaccuuucaauagg

SEQ ID NO: 3080484 - RNA, 16 nt, Human
ugaccuuucaauagga

SEQ ID NO: 3080485 - RNA, 14 nt, Human
ugaccuuucaauag

SEQ ID NO: 3080486 - RNA, 13 nt, Human
ugaccuuucaaua

SEQ ID NO: 3080487 - RNA, 22 nt, Human
ugaccucaggugauccacccac

SEQ ID NO: 3080488 - RNA, 16 nt, Human
ugaccucugcagcaau

SEQ ID NO: 3080489 - RNA, 13 nt, Human
ugaccucugcagc

SEQ ID NO: 3080490 - RNA, 13 nt, Human
ugacugaauuucu

SEQ ID NO: 3080491 - RNA, 12 nt, Human
ugacucuuaaga

SEQ ID NO: 3080492 - RNA, 15 nt, Human
ugacugaauuucuuu

SEQ ID NO: 3080493 - RNA, 14 nt, Human
ugacugaauuucuu

SEQ ID NO: 3080494 - RNA, 13 nt, Human
ugacgccauccca

SEQ ID NO: 3080495 - RNA, 14 nt, Human
ugacgccaucccag

SEQ ID NO: 3080496 - RNA, 15 nt, Human
ugacgccaucccagc

SEQ ID NO: 3080497 - RNA, 16 nt, Human
ugacgccaucccagcc

SEQ ID NO: 3080498 - RNA, 18 nt, Human
ugaccuuucaauaggaaa

SEQ ID NO: 3080499 - RNA, 22 nt, Human
ugaccuuucaauaggaaaaacu

SEQ ID NO: 3080500 - RNA, 17 nt, Human
ugacgccaucccagccc

SEQ ID NO: 3080501 - RNA, 18 nt, Human
ugacgccaucccagcccc

SEQ ID NO: 3080502 - RNA, 19 nt, Human
ugacgccaucccagcccca

SEQ ID NO: 3080503 - RNA, 20 nt, Human
ugacgccaucccagccccaa

SEQ ID NO: 3080504 - RNA, 17 nt, Human
ugcauuaucuagauacu

SEQ ID NO: 3080505 - RNA, 12 nt, Human
ugcauuaucuag

SEQ ID NO: 3080506 - RNA, 21 nt, Human
ugcauuauauuuauuacugua

SEQ ID NO: 3080507 - RNA, 15 nt, Human
ugcauguuugugauu

SEQ ID NO: 3080508 - RNA, 17 nt, Human
ugcaugguuuggagcug

SEQ ID NO: 3080509 - RNA, 17 nt, Human
ugcaugguuuagaaagc

SEQ ID NO: 3080510 - RNA, 19 nt, Human
ugcagauaaacaguaguga

SEQ ID NO: 3080511 - RNA, 17 nt, Human
ugcagauaaacaguagu

SEQ ID NO: 3080512 - RNA, 12 nt, Human
ugccauccaggu

SEQ ID NO: 3080513 - RNA, 15 nt, Human
ugccauccagguuca

SEQ ID NO: 3080514 - RNA, 12 nt, Human
ugccauccaagu

SEQ ID NO: 3080515 - RNA, 17 nt, Human
ugccagguuuuuggucu

SEQ ID NO: 3080516 - RNA, 12 nt, Human
ugccaggaagcc

SEQ ID NO: 3080517 - RNA, 16 nt, Human
ugccaggaagccagca

SEQ ID NO: 3080518 - RNA, 18 nt, Human
ugccaggaagccagcagg

SEQ ID NO: 3080519 - RNA, 19 nt, Human
ugccaggaagccagcaggc

SEQ ID NO: 3080520 - RNA, 20 nt, Human
ugccaugaggaacaaggcaa

SEQ ID NO: 3080521 - RNA, 19 nt, Human
ugccaugagccgcccaagg

SEQ ID NO: 3080522 - RNA, 18 nt, Human
ugccaugagccgcccaag

SEQ ID NO: 3080523 - RNA, 23 nt, Human
ugccaugaggaacaaggcaaggc

SEQ ID NO: 3080524 - RNA, 23 nt, Human
ugccaugagccgcccaaggccuu

SEQ ID NO: 3080525 - RNA, 20 nt, Human
ugccaugagccgcccaaggc

SEQ ID NO: 3080526 - RNA, 21 nt, Human
ugccaugagccgcccaaggcc

SEQ ID NO: 3080527 - RNA, 14 nt, Human
ugccaugugccagg

SEQ ID NO: 3080528 - RNA, 15 nt, Human
ugccaugugccaggu

SEQ ID NO: 3080529 - RNA, 21 nt, Human
ugcccacucccugcaaccuga

SEQ ID NO: 3080530 - RNA, 19 nt, Human
ugcccaccuggccucugca

SEQ ID NO: 3080531 - RNA, 18 nt, Human
ugcccacgcuggagugca

SEQ ID NO: 3080532 - RNA, 20 nt, Human
ugcccaccuggccucugcac

SEQ ID NO: 3080533 - RNA, 16 nt, Human
ugccauguuggccagg

SEQ ID NO: 3080534 - RNA, 12 nt, Human
ugccauguuggc

SEQ ID NO: 3080535 - RNA, 15 nt, Human
ugccauguuggccag

SEQ ID NO: 3080536 - RNA, 19 nt, Human
ugccugguggcagcugcgg

SEQ ID NO: 3080537 - RNA, 18 nt, Human
ugccugguggcagcugcg

SEQ ID NO: 3080538 - RNA, 17 nt, Human
ugccugguggcagcugc

SEQ ID NO: 3080539 - RNA, 21 nt, Human
ugccucuucucuacucuaggg

SEQ ID NO: 3080540 - RNA, 19 nt, Human
ugccuggguggaugggcca

SEQ ID NO: 3080541 - RNA, 21 nt, Human
ugccuccuuugugaggaagcc

SEQ ID NO: 3080542 - RNA, 20 nt, Human
ugccuccuuugugaggaagc

SEQ ID NO: 3080543 - RNA, 22 nt, Human
ugccuccuuugugaggaagccg

SEQ ID NO: 3080544 - RNA, 13 nt, Human
ugccucugggacu

SEQ ID NO: 3080545 - RNA, 19 nt, Human
ugcccuaaaguguauuuuu

SEQ ID NO: 3080546 - RNA, 17 nt, Human
ugcccuaaaguguauuu

SEQ ID NO: 3080547 - RNA, 22 nt, Human
ugcccugcccaccuggccucug

SEQ ID NO: 3080548 - RNA, 23 nt, Human
ugcccugcccaccuggccucugc

SEQ ID NO: 3080549 - RNA, 21 nt, Human
ugcccugcccaccuggccucu

SEQ ID NO: 3080550 - RNA, 15 nt, Human
ugccgucuaccugag

SEQ ID NO: 3080551 - RNA, 16 nt, Human
ugccgucuaccugagg

SEQ ID NO: 3080552 - RNA, 17 nt, Human
ugccgucuaccugaggg

SEQ ID NO: 3080553 - RNA, 19 nt, Human
ugccgucuaccugaggggc

SEQ ID NO: 3080554 - RNA, 16 nt, Human
ugcaauggcagccuug

SEQ ID NO: 3080555 - RNA, 15 nt, Human
ugcaauggcagccuu

SEQ ID NO: 3080556 - RNA, 14 nt, Human
ugcaauggcagccu

SEQ ID NO: 3080557 - RNA, 13 nt, Human
ugcaauggcagcc

SEQ ID NO: 3080558 - RNA, 17 nt, Human
ugcaaugaccuuucaau

SEQ ID NO: 3080559 - RNA, 19 nt, Human
ugcaaugaccuuucaauag

SEQ ID NO: 3080560 - RNA, 22 nt, Human
ugcaaugaccuuucaauaggaa

SEQ ID NO: 3080561 - RNA, 23 nt, Human
ugcaaugaccuuucaauaggaaa

SEQ ID NO: 3080562 - RNA, 13 nt, Human
ugcaaugaccuuu

SEQ ID NO: 3080563 - RNA, 16 nt, Human
ugcaaugaccuuucaa

SEQ ID NO: 3080564 - RNA, 20 nt, Human
ugcaauuucauaugcuguau

SEQ ID NO: 3080565 - RNA, 14 nt, Human
ugcaauuucauaug

SEQ ID NO: 3080566 - RNA, 15 nt, Human
ugcacaaacagaggc

SEQ ID NO: 3080567 - RNA, 16 nt, Human
ugcacaaacagaggcc

SEQ ID NO: 3080568 - RNA, 17 nt, Human
ugcacaaacagaggccg

SEQ ID NO: 3080569 - RNA, 19 nt, Human
ugcacaaacagaggccgcc

SEQ ID NO: 3080570 - RNA, 20 nt, Human
ugcacaaacagaggccgcca

SEQ ID NO: 3080571 - RNA, 19 nt, Human
ugcacagaguuguuacauu

SEQ ID NO: 3080572 - RNA, 18 nt, Human
ugcacagaguuguuacau

SEQ ID NO: 3080573 - RNA, 17 nt, Human
ugcacagaguuguuaca

SEQ ID NO: 3080574 - RNA, 21 nt, Human
ugcacugacauuguuggccaa

SEQ ID NO: 3080575 - RNA, 18 nt, Human
ugcacugacauuguuggc

SEQ ID NO: 3080576 - RNA, 16 nt, Human
ugcacugucaagauga

SEQ ID NO: 3080577 - RNA, 19 nt, Human
ugcaccggcuggccuggcc

SEQ ID NO: 3080578 - RNA, 20 nt, Human
ugcaccggcuggccuggccc

SEQ ID NO: 3080579 - RNA, 18 nt, Human
ugcaccggcuggccuggc

SEQ ID NO: 3080580 - RNA, 22 nt, Human
ugcaccuggaauauauaaccag

SEQ ID NO: 3080581 - RNA, 20 nt, Human
ugcaccuggaauauauaacc

SEQ ID NO: 3080582 - RNA, 17 nt, Human
ugcaccuggaauauaua

SEQ ID NO: 3080583 - RNA, 21 nt, Human
ugcaccggcuggccuggcccc

SEQ ID NO: 3080584 - RNA, 16 nt, Human
ugcacgcacacugucu

SEQ ID NO: 3080585 - RNA, 18 nt, Human
ugcaacuuuguauaaaag

SEQ ID NO: 3080586 - RNA, 22 nt, Human
ugcaaccugauugugucucuug

SEQ ID NO: 3080587 - RNA, 22 nt, Human
ugcaacucugaaggguaauuau

SEQ ID NO: 3080588 - RNA, 21 nt, Human
ugcaaccuccgccucuugggu

SEQ ID NO: 3080589 - RNA, 20 nt, Human
ugcaaccuccgccucuuggg

SEQ ID NO: 3080590 - RNA, 18 nt, Human
ugcaaccuccgccucuug

SEQ ID NO: 3080591 - RNA, 19 nt, Human
ugcaaccugauugugucuc

SEQ ID NO: 3080592 - RNA, 20 nt, Human
ugcaaccugauugugucucu

SEQ ID NO: 3080593 - RNA, 14 nt, Human
ugcaaccuccgccu

SEQ ID NO: 3080594 - RNA, 13 nt, Human
ugcaaccuccgcc

SEQ ID NO: 3080595 - RNA, 20 nt, Human
ugcaacaggcugggcuucag

SEQ ID NO: 3080596 - RNA, 19 nt, Human
ugcaacaggcugggcuuca

SEQ ID NO: 3080597 - RNA, 17 nt, Human
ugcaacaggcugggcuu

SEQ ID NO: 3080598 - RNA, 16 nt, Human
ugcaacaggcugggcu

SEQ ID NO: 3080599 - RNA, 15 nt, Human
ugcaacaggcugggc

SEQ ID NO: 3080600 - RNA, 14 nt, Human
ugcaacaggcuggg

SEQ ID NO: 3080601 - RNA, 13 nt, Human
ugauuuuuuucca

SEQ ID NO: 3080602 - RNA, 16 nt, Human
ugauuuuuuuuuccuu

SEQ ID NO: 3080603 - RNA, 17 nt, Human
ugauuuuuuuuuccuuc

SEQ ID NO: 3080604 - RNA, 19 nt, Human
ugauuuuuuuuuccuucag

SEQ ID NO: 3080605 - RNA, 20 nt, Human
ugauuuuuuuuuccuucagu

SEQ ID NO: 3080606 - RNA, 22 nt, Human
ugauuuuuuuuuccuucagugc

SEQ ID NO: 3080607 - RNA, 23 nt, Human
ugauuuuuuuuuccuucagugcc

SEQ ID NO: 3080608 - RNA, 13 nt, Human
ugauuuucauugc

SEQ ID NO: 3080609 - RNA, 15 nt, Human
ugauuuucauugcug

SEQ ID NO: 3080610 - RNA, 17 nt, Human
ucucaaauaacuaaaag

SEQ ID NO: 3080611 - RNA, 15 nt, Human
ucucaacuccaaacu

SEQ ID NO: 3080612 - RNA, 22 nt, Human
ucuaucaaguauuauaccuuuu

SEQ ID NO: 3080613 - RNA, 21 nt, Human
ucuaucaaguauuauaccuuu

SEQ ID NO: 3080614 - RNA, 15 nt, Human
ucuaucaaguauuau

SEQ ID NO: 3080615 - RNA, 17 nt, Human
ucuaugaaauauuaugu

SEQ ID NO: 3080616 - RNA, 13 nt, Human
ucuaugaaauauu

SEQ ID NO: 3080617 - RNA, 14 nt, Human
ucuaugaaauauua

SEQ ID NO: 3080618 - RNA, 21 nt, Human
ucuaggaagacuuuggaaaga

SEQ ID NO: 3080619 - RNA, 16 nt, Human
ucuaggacugaauuau

SEQ ID NO: 3080620 - RNA, 23 nt, Human
ucuaggacugaauuaugaaacuu

SEQ ID NO: 3080621 - RNA, 22 nt, Human
ucuagugagcagucaggaaaga

SEQ ID NO: 3080622 - RNA, 19 nt, Human
ucuagugagcagucaggaa

SEQ ID NO: 3080623 - RNA, 13 nt, Human
ucguuaauuugua

SEQ ID NO: 3080624 - RNA, 21 nt, Human
ucuaaaucuccaaaauaaaac

SEQ ID NO: 3080625 - RNA, 16 nt, Human
ucgugauugauaagaa

SEQ ID NO: 3080626 - RNA, 18 nt, Human
ucggccuccauccugagg

SEQ ID NO: 3080627 - RNA, 17 nt, Human
ucggccuccauccugag

SEQ ID NO: 3080628 - RNA, 21 nt, Human
ucguggaacaguuaccucugc

SEQ ID NO: 3080629 - RNA, 22 nt, Human
ucgugggacagucaccucaugg

SEQ ID NO: 3080630 - RNA, 14 nt, Human
uccuuaccagcaga

SEQ ID NO: 3080631 - RNA, 19 nt, Human
uccugucggagcccugucu

SEQ ID NO: 3080632 - RNA, 20 nt, Human
uccuguaccucuugagccuu

SEQ ID NO: 3080633 - RNA, 18 nt, Human
uccuggcacugcuuccag

SEQ ID NO: 3080634 - RNA, 22 nt, Human
uccuggcacugcuuccagugag

SEQ ID NO: 3080635 - RNA, 17 nt, Human
uccuggcacugcuucca

SEQ ID NO: 3080636 - RNA, 21 nt, Human
uccuggcacccggccccugcu

SEQ ID NO: 3080637 - RNA, 20 nt, Human
uccuggcacccggccccugc

SEQ ID NO: 3080638 - RNA, 20 nt, Human
uccugccuaagugcagcccc

SEQ ID NO: 3080639 - RNA, 14 nt, Human
uccugccucagccu

SEQ ID NO: 3080640 - RNA, 13 nt, Human
uccugagccagau

SEQ ID NO: 3080641 - RNA, 14 nt, Human
uccuggcacccggc

SEQ ID NO: 3080642 - RNA, 17 nt, Human
uccuggcaauagucaaa

SEQ ID NO: 3080643 - RNA, 19 nt, Human
uccuggcacccggccccug

SEQ ID NO: 3080644 - RNA, 16 nt, Human
uccuggcacccggccc

SEQ ID NO: 3080645 - RNA, 15 nt, Human
uccugccucagccuc

SEQ ID NO: 3080646 - RNA, 13 nt, Human
uccugccucagcc

SEQ ID NO: 3080647 - RNA, 16 nt, Human
uccugccucagccucc

SEQ ID NO: 3080648 - RNA, 23 nt, Human
uccuuuucacaguucucuccuuc

SEQ ID NO: 3080649 - RNA, 16 nt, Human
uccuuggacucauuuu

SEQ ID NO: 3080650 - RNA, 22 nt, Human
ucgaggcggaucuuuggacaga

SEQ ID NO: 3080651 - RNA, 17 nt, Human
ucgaggcggaucuuugg

SEQ ID NO: 3080652 - RNA, 21 nt, Human
uccuucaccuuuguccccacc

SEQ ID NO: 3080653 - RNA, 22 nt, Human
uccuucaccuuuguccccaccg

SEQ ID NO: 3080654 - RNA, 16 nt, Human
uccuuaccagcagagc

SEQ ID NO: 3080655 - RNA, 17 nt, Human
uccuuaccagcagagca

SEQ ID NO: 3080656 - RNA, 18 nt, Human
uccuuaccagcagagcac

SEQ ID NO: 3080657 - RNA, 18 nt, Human
uccuucacagaugggugc

SEQ ID NO: 3080658 - RNA, 18 nt, Human
uccuucaccuuugucccc

SEQ ID NO: 3080659 - RNA, 20 nt, Human
uccuucaccuuuguccccac

SEQ ID NO: 3080660 - RNA, 19 nt, Human
uccuucacagaugggugcu

SEQ ID NO: 3080661 - RNA, 16 nt, Human
uccuaaucuucugaac

SEQ ID NO: 3080662 - RNA, 13 nt, Human
uccgaccagacac

SEQ ID NO: 3080663 - RNA, 18 nt, Human
uccuacccacccuccuuu

SEQ ID NO: 3080664 - RNA, 18 nt, Human
uccuauauuguuuucagu

SEQ ID NO: 3080665 - RNA, 22 nt, Human
uccuaguuccaccaucaagcca

SEQ ID NO: 3080666 - RNA, 12 nt, Human
uccucugcugcu

SEQ ID NO: 3080667 - RNA, 14 nt, Human
uccucugcugcugg

SEQ ID NO: 3080668 - RNA, 15 nt, Human
uccucugcugcuggc

SEQ ID NO: 3080669 - RNA, 16 nt, Human
uccucugcugcuggcu

SEQ ID NO: 3080670 - RNA, 16 nt, Human
uccucuguacagagcc

SEQ ID NO: 3080671 - RNA, 17 nt, Human
uccucuguacagagccc

SEQ ID NO: 3080672 - RNA, 18 nt, Human
uccucuguacagagccca

SEQ ID NO: 3080673 - RNA, 15 nt, Human
uccucuguacagagc

SEQ ID NO: 3080674 - RNA, 14 nt, Human
uccucuaggagguc

SEQ ID NO: 3080675 - RNA, 19 nt, Human
uccuccuuuucacaguucu

SEQ ID NO: 3080676 - RNA, 13 nt, Human
ucccuucccaccu

SEQ ID NO: 3080677 - RNA, 16 nt, Human
ucccuugaugaagaag

SEQ ID NO: 3080678 - RNA, 15 nt, Human
ucccuugaugaagaa

SEQ ID NO: 3080679 - RNA, 18 nt, Human
ucccugcugcuccuagga

SEQ ID NO: 3080680 - RNA, 13 nt, Human
ucccugcacuugc

SEQ ID NO: 3080681 - RNA, 14 nt, Human
ucccugcacuugca

SEQ ID NO: 3080682 - RNA, 15 nt, Human
ucccuaauaaagcug

SEQ ID NO: 3080683 - RNA, 14 nt, Human
ucccuaauaaagcu

SEQ ID NO: 3080684 - RNA, 21 nt, Human
uccccuguuuguuucugaaag

SEQ ID NO: 3080685 - RNA, 18 nt, Human
uccccuguuuguuucuga

SEQ ID NO: 3080686 - RNA, 20 nt, Human
uccccuguuuguuucugaaa

SEQ ID NO: 3080687 - RNA, 17 nt, Human
uccagguuuaagcuguu

SEQ ID NO: 3080688 - RNA, 16 nt, Human
ucccuaauaaagcugu

SEQ ID NO: 3080689 - RNA, 19 nt, Human
ucccuccugggaaugaagc

SEQ ID NO: 3080690 - RNA, 11 nt, Human
ucccuccuggg

SEQ ID NO: 3080691 - RNA, 16 nt, Human
ucucugcaggucccua

SEQ ID NO: 3080692 - RNA, 15 nt, Human
ucucugcaggucccu

SEQ ID NO: 3080693 - RNA, 23 nt, Human
ucucuggccuucggccuccaucc

SEQ ID NO: 3080694 - RNA, 18 nt, Human
ucucuguaauaaacucau

SEQ ID NO: 3080695 - RNA, 22 nt, Human
ucucuguaauaaacucauuucu

SEQ ID NO: 3080696 - RNA, 14 nt, Human
ucucugcagguccc

SEQ ID NO: 3080697 - RNA, 13 nt, Human
ucucugcaggucc

SEQ ID NO: 3080698 - RNA, 17 nt, Human
ucucugaggacacuaac

SEQ ID NO: 3080699 - RNA, 15 nt, Human
ucucugauacagaaa

SEQ ID NO: 3080700 - RNA, 14 nt, Human
ucucugaggacacu

SEQ ID NO: 3080701 - RNA, 15 nt, Human
ucucuaguuugauua

SEQ ID NO: 3080702 - RNA, 21 nt, Human
ucuccuggaagugcuaauuuu

SEQ ID NO: 3080703 - RNA, 21 nt, Human
ucuccuggaaauauuaagaaa

SEQ ID NO: 3080704 - RNA, 15 nt, Human
ucuccuguaccucuu

SEQ ID NO: 3080705 - RNA, 15 nt, Human
ucuccugccucagcc

SEQ ID NO: 3080706 - RNA, 17 nt, Human
ucuccugccucagccuc

SEQ ID NO: 3080707 - RNA, 17 nt, Human
ucuccuguaccucuuga

SEQ ID NO: 3080708 - RNA, 16 nt, Human
ucuccuguaccucuug

SEQ ID NO: 3080709 - RNA, 13 nt, Human
ucuccuguaccuc

SEQ ID NO: 3080710 - RNA, 14 nt, Human
ucucgugauugaua

SEQ ID NO: 3080711 - RNA, 22 nt, Human
ucucgugauugauaagaaccuu

SEQ ID NO: 3080712 - RNA, 12 nt, Human
ucucuaacuuca

SEQ ID NO: 3080713 - RNA, 19 nt, Human
ucucuaacuucaccauauu

SEQ ID NO: 3080714 - RNA, 19 nt, Human
ucucuaggaaauauuuauu

SEQ ID NO: 3080715 - RNA, 22 nt, Human
ucugaaaauugaugggauuugg

SEQ ID NO: 3080716 - RNA, 14 nt, Human
ucugaaaauugaug

SEQ ID NO: 3080717 - RNA, 13 nt, Human
ucugaaaauguau

SEQ ID NO: 3080718 - RNA, 15 nt, Human
ucugacauaaguauu

SEQ ID NO: 3080719 - RNA, 13 nt, Human
ucugacccacugc

SEQ ID NO: 3080720 - RNA, 22 nt, Human
ucugacaggcaaugcuggcugu

SEQ ID NO: 3080721 - RNA, 21 nt, Human
ucugacaggcaaugcuggcug

SEQ ID NO: 3080722 - RNA, 12 nt, Human
ucugacaggcaa

SEQ ID NO: 3080723 - RNA, 19 nt, Human
ucugacacacagcucuguc

SEQ ID NO: 3080724 - RNA, 18 nt, Human
ucugacacacagcucugu

SEQ ID NO: 3080725 - RNA, 17 nt, Human
ucugacacacagcucug

SEQ ID NO: 3080726 - RNA, 16 nt, Human
ucugacacacagcucu

SEQ ID NO: 3080727 - RNA, 17 nt, Human
ucugaaauuuccuggga

SEQ ID NO: 3080728 - RNA, 18 nt, Human
ucugaaauuuccugggag

SEQ ID NO: 3080729 - RNA, 20 nt, Human
ucugaaauuuccugggagcu

SEQ ID NO: 3080730 - RNA, 23 nt, Human
ucugaggaauccagacccggcug

SEQ ID NO: 3080731 - RNA, 14 nt, Human
ucugacccacugcu

SEQ ID NO: 3080732 - RNA, 20 nt, Human
ucugcaagaauugaagcagg

SEQ ID NO: 3080733 - RNA, 14 nt, Human
ucugcaacucugaa

SEQ ID NO: 3080734 - RNA, 15 nt, Human
ucugcaacucugaag

SEQ ID NO: 3080735 - RNA, 14 nt, Human
ucugcaucagcugc

SEQ ID NO: 3080736 - RNA, 21 nt, Human
ucugcaucagcugcugaaaca

SEQ ID NO: 3080737 - RNA, 19 nt, Human
ucugcaucagcugcugaaa

SEQ ID NO: 3080738 - RNA, 22 nt, Human
ucuuaaccagaucauugugaaa

SEQ ID NO: 3080739 - RNA, 12 nt, Human
ucuuaagaagac

SEQ ID NO: 3080740 - RNA, 18 nt, Human
ucuuaagaagacugcauu

SEQ ID NO: 3080741 - RNA, 17 nt, Human
ucuuaaccagaucauug

SEQ ID NO: 3080742 - RNA, 16 nt, Human
ucuuaaccagaucauu

SEQ ID NO: 3080743 - RNA, 22 nt, Human
ucuuaaauauguggaguucauc

SEQ ID NO: 3080744 - RNA, 15 nt, Human
ucugucuucacaaca

SEQ ID NO: 3080745 - RNA, 13 nt, Human
ucuugaaaaaugc

SEQ ID NO: 3080746 - RNA, 12 nt, Human
ucuugaacuccu

SEQ ID NO: 3080747 - RNA, 15 nt, Human
ucuucuccaggcugu

SEQ ID NO: 3080748 - RNA, 19 nt, Human
ucuucaucugacuaugaca

SEQ ID NO: 3080749 - RNA, 23 nt, Human
ucuucagaucucuaacuucacca

SEQ ID NO: 3080750 - RNA, 18 nt, Human
ucuucagaucucuaacuu

SEQ ID NO: 3080751 - RNA, 15 nt, Human
ucuucagaucucuaa

SEQ ID NO: 3080752 - RNA, 22 nt, Human
ucugucucuggauuauauuaug

SEQ ID NO: 3080753 - RNA, 14 nt, Human
ucugucgcccaguc

SEQ ID NO: 3080754 - RNA, 19 nt, Human
ucuguccuacucuguguca

SEQ ID NO: 3080755 - RNA, 15 nt, Human
ucuguccuacucugu

SEQ ID NO: 3080756 - RNA, 21 nt, Human
ucuguccugggagugagcugg

SEQ ID NO: 3080757 - RNA, 14 nt, Human
ucuguccuacucug

SEQ ID NO: 3080758 - RNA, 17 nt, Human
ucuggcuaugcauuuga

SEQ ID NO: 3080759 - RNA, 18 nt, Human
ucuggccuucggccucca

SEQ ID NO: 3080760 - RNA, 17 nt, Human
ucuggccuucggccucc

SEQ ID NO: 3080761 - RNA, 22 nt, Human
ucuggcuaugcauuugaaaauu

SEQ ID NO: 3080762 - RNA, 19 nt, Human
ucuggcuaugcauuugaaa

SEQ ID NO: 3080763 - RNA, 10 nt, Human
ucuggccuuc

SEQ ID NO: 3080764 - RNA, 18 nt, Human
ucuggcucuuccaggcug

SEQ ID NO: 3080765 - RNA, 23 nt, Human
ucuggcucuuccaggcugggaga

SEQ ID NO: 3080766 - RNA, 23 nt, Human
ucuggugacuuuccucuuugguc

SEQ ID NO: 3080767 - RNA, 13 nt, Human
ucugggacacagu

SEQ ID NO: 3080768 - RNA, 14 nt, Human
ucugggacacaguu

SEQ ID NO: 3080769 - RNA, 13 nt, Human
ucugccugcccag

SEQ ID NO: 3080770 - RNA, 14 nt, Human
ucugccugcccagg

SEQ ID NO: 3080771 - RNA, 17 nt, Human
ucugcugacagacacag

SEQ ID NO: 3080772 - RNA, 18 nt, Human
ucugcugacagacacagg

SEQ ID NO: 3080773 - RNA, 18 nt, Human
ucugcuccucuccccagc

SEQ ID NO: 3080774 - RNA, 15 nt, Human
ucugccugcccaggc

SEQ ID NO: 3080775 - RNA, 22 nt, Human
ucugcugacagacacaggcccg

SEQ ID NO: 3080776 - RNA, 21 nt, Human
ucugcugacagacacaggccc

SEQ ID NO: 3080777 - RNA, 20 nt, Human
ucugcugacagacacaggcc

SEQ ID NO: 3080778 - RNA, 19 nt, Human
ucugcugacagacacaggc

SEQ ID NO: 3080779 - RNA, 19 nt, Human
ucuggaauaaggagaauga

SEQ ID NO: 3080780 - RNA, 15 nt, Human
ucuggaaugcagugg

SEQ ID NO: 3080781 - RNA, 14 nt, Human
ucuggacaggcaug

SEQ ID NO: 3080782 - RNA, 21 nt, Human
ucuggacaggcauguucucug

SEQ ID NO: 3080783 - RNA, 22 nt, Human
uauuuuuuucugaauuauuuuc

SEQ ID NO: 3080784 - RNA, 14 nt, Human
uauuuuuuuacuaa

SEQ ID NO: 3080785 - RNA, 17 nt, Human
uauuuuuuucuuuucuu

SEQ ID NO: 3080786 - RNA, 14 nt, Human
ucaaaaaaagaaaa

SEQ ID NO: 3080787 - RNA, 15 nt, Human
ucaaaaaaagaaaaa

SEQ ID NO: 3080788 - RNA, 22 nt, Human
uauuuucccuauuagagaagag

SEQ ID NO: 3080789 - RNA, 17 nt, Human
uauuuuauguugcauag

SEQ ID NO: 3080790 - RNA, 17 nt, Human
uauuuuauuaugcauga

SEQ ID NO: 3080791 - RNA, 14 nt, Human
uauuuuauuaugca

SEQ ID NO: 3080792 - RNA, 23 nt, Human
ucaaauauauucagccuggcuuc

SEQ ID NO: 3080793 - RNA, 22 nt, Human
ucaaauauauucagccuggcuu

SEQ ID NO: 3080794 - RNA, 21 nt, Human
ucaaauauauucagccuggcu

SEQ ID NO: 3080795 - RNA, 20 nt, Human
ucaaaucaagaaacuuaagg

SEQ ID NO: 3080796 - RNA, 14 nt, Human
ucaaauaugcaaag

SEQ ID NO: 3080797 - RNA, 20 nt, Human
ucaaauuguaagcaugcaca

SEQ ID NO: 3080798 - RNA, 17 nt, Human
ucaaauuguaagcaugc

SEQ ID NO: 3080799 - RNA, 14 nt, Human
ucaaauugugugaa

SEQ ID NO: 3080800 - RNA, 23 nt, Human
ucaaccccuucgcuccugugucu

SEQ ID NO: 3080801 - RNA, 20 nt, Human
ucaauuacaggaaguacugg

SEQ ID NO: 3080802 - RNA, 13 nt, Human
ucacaagacccaa

SEQ ID NO: 3080803 - RNA, 17 nt, Human
ucacaagacccaaaagg

SEQ ID NO: 3080804 - RNA, 22 nt, Human
ucacaguccuuaccagcagagc

SEQ ID NO: 3080805 - RNA, 23 nt, Human
ucacaguccuuaccagcagagca

SEQ ID NO: 3080806 - RNA, 19 nt, Human
ucacaguccuuaccagcag

SEQ ID NO: 3080807 - RNA, 16 nt, Human
ucacagucacauucca

SEQ ID NO: 3080808 - RNA, 18 nt, Human
ucacaggcagguccaggg

SEQ ID NO: 3080809 - RNA, 17 nt, Human
ucacaggcagguccagg

SEQ ID NO: 3080810 - RNA, 16 nt, Human
ucacaggcagguccag

SEQ ID NO: 3080811 - RNA, 20 nt, Human
ucaccaaaucagcugcuacu

SEQ ID NO: 3080812 - RNA, 19 nt, Human
ucaccaaaucagcugcuac

SEQ ID NO: 3080813 - RNA, 14 nt, Human
ucaccaaggcugau

SEQ ID NO: 3080814 - RNA, 17 nt, Human
ucacauuuauucugcuc

SEQ ID NO: 3080815 - RNA, 19 nt, Human
ucacauuuauucugcucac

SEQ ID NO: 3080816 - RNA, 18 nt, Human
ucacauuuauucugcuca

SEQ ID NO: 3080817 - RNA, 21 nt, Human
ucaauuacaggaaguacugga

SEQ ID NO: 3080818 - RNA, 23 nt, Human
ucaauuacaggaaguacuggaga

SEQ ID NO: 3080819 - RNA, 17 nt, Human
ucaaugccccugaauuu

SEQ ID NO: 3080820 - RNA, 18 nt, Human
ucaaugccccugaauuua

SEQ ID NO: 3080821 - RNA, 20 nt, Human
ucaaugccccugaauuuaaa

SEQ ID NO: 3080822 - RNA, 13 nt, Human
ucaaugcagcccc

SEQ ID NO: 3080823 - RNA, 20 nt, Human
ucaagugauucuccugccuc

SEQ ID NO: 3080824 - RNA, 18 nt, Human
ucaagugauucuccugcc

SEQ ID NO: 3080825 - RNA, 14 nt, Human
ucaauaaaauccau

SEQ ID NO: 3080826 - RNA, 21 nt, Human
ucaauaaaauccauacauuug

SEQ ID NO: 3080827 - RNA, 16 nt, Human
uauuauucccauucua

SEQ ID NO: 3080828 - RNA, 14 nt, Human
uauucuaaauuuua

SEQ ID NO: 3080829 - RNA, 15 nt, Human
uauucuaaauuuuau

SEQ ID NO: 3080830 - RNA, 19 nt, Human
uauucuaaauuuuauaucu

SEQ ID NO: 3080831 - RNA, 20 nt, Human
uauucuaaauuuuauaucuu

SEQ ID NO: 3080832 - RNA, 19 nt, Human
uauucuagcuaauguaaua

SEQ ID NO: 3080833 - RNA, 14 nt, Human
uauuguguugugaa

SEQ ID NO: 3080834 - RNA, 22 nt, Human
uauuggaaauuuguuauaauga

SEQ ID NO: 3080835 - RNA, 17 nt, Human
uauugcugauggugcaa

SEQ ID NO: 3080836 - RNA, 21 nt, Human
uauugauaugcuuauacacuu

SEQ ID NO: 3080837 - RNA, 17 nt, Human
uauucucuccuguaccu

SEQ ID NO: 3080838 - RNA, 24 nt, Human
uauuuauaaaaauaaaaaacacug

SEQ ID NO: 3080839 - RNA, 20 nt, Human
uauuguuuucaguguacaug

SEQ ID NO: 3080840 - RNA, 18 nt, Human
uauuguuuucaguguaca

SEQ ID NO: 3080841 - RNA, 22 nt, Human
uauuguuuucaguguacaugga

SEQ ID NO: 3080842 - RNA, 12 nt, Human
uauuguuuucag

SEQ ID NO: 3080843 - RNA, 12 nt, Human
uauuaauauauu

SEQ ID NO: 3080844 - RNA, 12 nt, Human
uauuaaauuaug

SEQ ID NO: 3080845 - RNA, 24 nt, Human
uauuaagaaagacuaucuaaaugu

SEQ ID NO: 3080846 - RNA, 12 nt, Human
uauguugcauag

SEQ ID NO: 3080847 - RNA, 13 nt, Human
uauguuucaaacu

SEQ ID NO: 3080848 - RNA, 15 nt, Human
uauguuucaaacuuu

SEQ ID NO: 3080849 - RNA, 16 nt, Human
uauguuucaaacuuug

SEQ ID NO: 3080850 - RNA, 20 nt, Human
uauguugcccaggcaggucu

SEQ ID NO: 3080851 - RNA, 16 nt, Human
uauguugcauagaaua

SEQ ID NO: 3080852 - RNA, 13 nt, Human
uauguugcccagg

SEQ ID NO: 3080853 - RNA, 19 nt, Human
uauguugcccaggcagguc

SEQ ID NO: 3080854 - RNA, 16 nt, Human
uauguugcccaggcag

SEQ ID NO: 3080855 - RNA, 13 nt, Human
gggaguggccaca

SEQ ID NO: 3080856 - RNA, 15 nt, Human
gggaguggccacaga

SEQ ID NO: 3080857 - RNA, 13 nt, Human
uauguacuucaug

SEQ ID NO: 3080858 - RNA, 17 nt, Human
uauguacuucaugcugu

SEQ ID NO: 3080859 - RNA, 21 nt, Human
ucauucaacccaccugcgucu

SEQ ID NO: 3080860 - RNA, 20 nt, Human
ucauuaucucaaaacugcac

SEQ ID NO: 3080861 - RNA, 19 nt, Human
ucauuaucucaaaacugca

SEQ ID NO: 3080862 - RNA, 22 nt, Human
ucauuaggugugacugaauuuc

SEQ ID NO: 3080863 - RNA, 13 nt, Human
ucauuaucucaaa

SEQ ID NO: 3080864 - RNA, 18 nt, Human
ucauugugaaauuauuca

SEQ ID NO: 3080865 - RNA, 17 nt, Human
ucauugugaaauuauuc

SEQ ID NO: 3080866 - RNA, 15 nt, Human
ucauugugaaauuau

SEQ ID NO: 3080867 - RNA, 12 nt, Human
ucauugugaaau

SEQ ID NO: 3080868 - RNA, 16 nt, Human
ucauuuccugugucuu

SEQ ID NO: 3080869 - RNA, 13 nt, Human
ucauuuccugugu

SEQ ID NO: 3080870 - RNA, 16 nt, Human
ucauuuccaagcaagu

SEQ ID NO: 3080871 - RNA, 13 nt, Human
ucauuuccaagca

SEQ ID NO: 3080872 - RNA, 17 nt, Human
ucaucugacuaugacau

SEQ ID NO: 3080873 - RNA, 18 nt, Human
ucaucugacuaugacaua

SEQ ID NO: 3080874 - RNA, 23 nt, Human
ucaucuuagguuggcaaaaaggc

SEQ ID NO: 3080875 - RNA, 21 nt, Human
ucauacccacccccacccaag

SEQ ID NO: 3080876 - RNA, 18 nt, Human
ucauaccuaucaucuuaa

SEQ ID NO: 3080877 - RNA, 21 nt, Human
ucaggugagaagcagaggaag

SEQ ID NO: 3080878 - RNA, 23 nt, Human
ucaggugccucaagagaaggcaa

SEQ ID NO: 3080879 - RNA, 14 nt, Human
ucaggugcugccau

SEQ ID NO: 3080880 - RNA, 13 nt, Human
ucaggugcugcca

SEQ ID NO: 3080881 - RNA, 19 nt, Human
ucaucaccaacgucugugc

SEQ ID NO: 3080882 - RNA, 20 nt, Human
ucaucaccaacgucugugcc

SEQ ID NO: 3080883 - RNA, 21 nt, Human
ucaucaccaacgucugugcca

SEQ ID NO: 3080884 - RNA, 16 nt, Human
uccagguucagcuugu

SEQ ID NO: 3080885 - RNA, 15 nt, Human
uccagguucagcuug

SEQ ID NO: 3080886 - RNA, 18 nt, Human
uccaggugcacaagcucc

SEQ ID NO: 3080887 - RNA, 20 nt, Human
uccaggugcacaagcuccaa

SEQ ID NO: 3080888 - RNA, 21 nt, Human
uccaggugcacaagcuccaag

SEQ ID NO: 3080889 - RNA, 22 nt, Human
uccaggugcacaagcuccaagc

SEQ ID NO: 3080890 - RNA, 23 nt, Human
uccaggggugggacacccuguga

SEQ ID NO: 3080891 - RNA, 15 nt, Human
uccaggugcacaagc

SEQ ID NO: 3080892 - RNA, 17 nt, Human
uccaggagcagccacau

SEQ ID NO: 3080893 - RNA, 18 nt, Human
uccaggagcagccacauu

SEQ ID NO: 3080894 - RNA, 22 nt, Human
uccaggagcagccacauuccug

SEQ ID NO: 3080895 - RNA, 22 nt, Human
uccaggggugggacacccugug

SEQ ID NO: 3080896 - RNA, 23 nt, Human
uccagccaaagccuccuccagcc

SEQ ID NO: 3080897 - RNA, 14 nt, Human
uccacuuggucugu

SEQ ID NO: 3080898 - RNA, 15 nt, Human
uccacuuggucugug

SEQ ID NO: 3080899 - RNA, 16 nt, Human
uccacuuggucuguga

SEQ ID NO: 3080900 - RNA, 17 nt, Human
uccagcucaccagcccc

SEQ ID NO: 3080901 - RNA, 16 nt, Human
uccagcucaccagccc

SEQ ID NO: 3080902 - RNA, 18 nt, Human
uccagcucaccagcccca

SEQ ID NO: 3080903 - RNA, 15 nt, Human
uccagcucaccagcc

SEQ ID NO: 3080904 - RNA, 17 nt, Human
uccagcuguucagcugg

SEQ ID NO: 3080905 - RNA, 16 nt, Human
uccaggagcagccaca

SEQ ID NO: 3080906 - RNA, 19 nt, Human
uccaaaauaauuuuaagaa

SEQ ID NO: 3080907 - RNA, 15 nt, Human
uccaaaauaauuuua

SEQ ID NO: 3080908 - RNA, 18 nt, Human
uccaaaauaaaacuuuuu

SEQ ID NO: 3080909 - RNA, 20 nt, Human
uccaaaauaaaacuuuuuaa

SEQ ID NO: 3080910 - RNA, 18 nt, Human
uccaauuuacauacucug

SEQ ID NO: 3080911 - RNA, 17 nt, Human
uccaauuuacauacucu

SEQ ID NO: 3080912 - RNA, 16 nt, Human
uccacaagagcccagg

SEQ ID NO: 3080913 - RNA, 17 nt, Human
uccacaagagcccaggc

SEQ ID NO: 3080914 - RNA, 18 nt, Human
uccacaagagcccaggcc

SEQ ID NO: 3080915 - RNA, 15 nt, Human
uccacaagagcccag

SEQ ID NO: 3080916 - RNA, 18 nt, Human
uccacaaguuaaauaaau

SEQ ID NO: 3080917 - RNA, 17 nt, Human
uccacaaguuaaauaaa

SEQ ID NO: 3080918 - RNA, 12 nt, Human
uccacccugcuc

SEQ ID NO: 3080919 - RNA, 19 nt, Human
uccacagaagcuccaggua

SEQ ID NO: 3080920 - RNA, 17 nt, Human
uccaccugccagggaca

SEQ ID NO: 3080921 - RNA, 15 nt, Human
uccaccugccaggga

SEQ ID NO: 3080922 - RNA, 18 nt, Human
uccaccugccagggacag

SEQ ID NO: 3080923 - RNA, 21 nt, Human
uccaccugccagggacagagg

SEQ ID NO: 3080924 - RNA, 18 nt, Human
ucaggagcccugggaggc

SEQ ID NO: 3080925 - RNA, 19 nt, Human
ucaggagcccugggaggcu

SEQ ID NO: 3080926 - RNA, 23 nt, Human
ucaggagcccugggaggcucugg

SEQ ID NO: 3080927 - RNA, 20 nt, Human
ucaggagcccugggaggcuc

SEQ ID NO: 3080928 - RNA, 13 nt, Human
ucaggcuagaugu

SEQ ID NO: 3080929 - RNA, 17 nt, Human
ucaggcuagauguaugu

SEQ ID NO: 3080930 - RNA, 15 nt, Human
ucaggugagaagcag

SEQ ID NO: 3080931 - RNA, 16 nt, Human
ucaggugagaagcaga

SEQ ID NO: 3080932 - RNA, 14 nt, Human
ucagggccuggcuc

SEQ ID NO: 3080933 - RNA, 16 nt, Human
ucagggccuggcucag

SEQ ID NO: 3080934 - RNA, 15 nt, Human
ucagcugaaccuggg

SEQ ID NO: 3080935 - RNA, 16 nt, Human
ucagcugaaccugggu

SEQ ID NO: 3080936 - RNA, 18 nt, Human
ucagcuccccucggagaa

SEQ ID NO: 3080937 - RNA, 17 nt, Human
ucagcuccccucggaga

SEQ ID NO: 3080938 - RNA, 22 nt, Human
ucagccucccgaguagcuggga

SEQ ID NO: 3080939 - RNA, 21 nt, Human
ucagccucccgaguagcuggg

SEQ ID NO: 3080940 - RNA, 18 nt, Human
ucagccugcuccagcugu

SEQ ID NO: 3080941 - RNA, 19 nt, Human
ucagccugcuccagcuguu

SEQ ID NO: 3080942 - RNA, 21 nt, Human
ucagccucccaaagugcuggg

SEQ ID NO: 3080943 - RNA, 19 nt, Human
ucagccucccaaagugcug

SEQ ID NO: 3080944 - RNA, 14 nt, Human
ucagccucccaaag

SEQ ID NO: 3080945 - RNA, 13 nt, Human
ucagccucccaaa

SEQ ID NO: 3080946 - RNA, 22 nt, Human
ucagccucccgaauagcuggga

SEQ ID NO: 3080947 - RNA, 21 nt, Human
ucagccucccgaauagcuggg

SEQ ID NO: 3080948 - RNA, 18 nt, Human
ucagccucccgaguagcu

SEQ ID NO: 3080949 - RNA, 20 nt, Human
ucagccucccgaguagcugg

SEQ ID NO: 3080950 - RNA, 15 nt, Human
ucagauaugauucaa

SEQ ID NO: 3080951 - RNA, 18 nt, Human
ucacugccaugccagcuu

SEQ ID NO: 3080952 - RNA, 20 nt, Human
ucacucuuauugcccacgcu

SEQ ID NO: 3080953 - RNA, 22 nt, Human
ucaccccggccaccugcggugc

SEQ ID NO: 3080954 - RNA, 13 nt, Human
ucaccagccccag

SEQ ID NO: 3080955 - RNA, 22 nt, Human
ucacucugucgcccagucugga

SEQ ID NO: 3080956 - RNA, 17 nt, Human
ucacucuuauugcccac

SEQ ID NO: 3080957 - RNA, 14 nt, Human
ucacugcuuaacuu

SEQ ID NO: 3080958 - RNA, 20 nt, Human
ucacugcuuaacuucacaua

SEQ ID NO: 3080959 - RNA, 22 nt, Human
ucagaguaauccaagcaaaugu

SEQ ID NO: 3080960 - RNA, 21 nt, Human
ucagaguaauccaagcaaaug

SEQ ID NO: 3080961 - RNA, 13 nt, Human
ucagacagcugcc

SEQ ID NO: 3080962 - RNA, 16 nt, Human
ucagaauucucuaguu

SEQ ID NO: 3080963 - RNA, 15 nt, Human
ucagaaauguguuau

SEQ ID NO: 3080964 - RNA, 23 nt, Human
ucagaauucucuaguuugauuaa

SEQ ID NO: 3080965 - RNA, 10 nt, Human
ucagaaaugu

SEQ ID NO: 3080966 - RNA, 20 nt, Human
ucacuuguuuuauuuaaccu

SEQ ID NO: 3080967 - RNA, 19 nt, Human
ggcucuggagcccacugua

SEQ ID NO: 3080968 - RNA, 17 nt, Human
ggcucuggagcccacug

SEQ ID NO: 3080969 - RNA, 16 nt, Human
ggcucuggagcccacu

SEQ ID NO: 3080970 - RNA, 16 nt, Human
ggcucugccucccauc

SEQ ID NO: 3080971 - RNA, 14 nt, Human
ggcucugcccuugg

SEQ ID NO: 3080972 - RNA, 15 nt, Human
ggcucugcccuuggu

SEQ ID NO: 3080973 - RNA, 13 nt, Human
ggcucugccuccc

SEQ ID NO: 3080974 - RNA, 15 nt, Human
ggcucugccucccau

SEQ ID NO: 3080975 - RNA, 12 nt, Human
ggcucugcccuu

SEQ ID NO: 3080976 - RNA, 14 nt, Human
ggcucucaggccag

SEQ ID NO: 3080977 - RNA, 17 nt, Human
ggcucucaggccagcug

SEQ ID NO: 3080978 - RNA, 18 nt, Human
ggcucucaggccagcugc

SEQ ID NO: 3080979 - RNA, 19 nt, Human
ggcucucaggccagcugcu

SEQ ID NO: 3080980 - RNA, 20 nt, Human
ggcucucaggccagcugcuu

SEQ ID NO: 3080981 - RNA, 15 nt, Human
ggcucucaggccagc

SEQ ID NO: 3080982 - RNA, 16 nt, Human
ggcucucaggccagcu

SEQ ID NO: 3080983 - RNA, 14 nt, Human
ggcuccaggcuccu

SEQ ID NO: 3080984 - RNA, 9 nt, Human
ggcuccaga

SEQ ID NO: 3080985 - RNA, 16 nt, Human
ggcuccacuuggucug

SEQ ID NO: 3080986 - RNA, 16 nt, Human
ggcucacccaguccug

SEQ ID NO: 3080987 - RNA, 13 nt, Human
ggcuaugcauuug

SEQ ID NO: 3080988 - RNA, 12 nt, Human
ggcuaugcauuu

SEQ ID NO: 3080989 - RNA, 13 nt, Human
ggcucacccaguc

SEQ ID NO: 3080990 - RNA, 10 nt, Human
ggcuccagac

SEQ ID NO: 3080991 - RNA, 14 nt, Human
ggcuccaggagcag

SEQ ID NO: 3080992 - RNA, 16 nt, Human
ggcuccaggagcagcc

SEQ ID NO: 3080993 - RNA, 17 nt, Human
ggcuccaggagcagcca

SEQ ID NO: 3080994 - RNA, 13 nt, Human
ggcuccaggagca

SEQ ID NO: 3080995 - RNA, 13 nt, Human
ggcuccaggcucc

SEQ ID NO: 3080996 - RNA, 12 nt, Human
ggcuccaggcuc

SEQ ID NO: 3080997 - RNA, 11 nt, Human
ggcgcugcccc

SEQ ID NO: 3080998 - RNA, 17 nt, Human
ggcgcugccccuggcag

SEQ ID NO: 3080999 - RNA, 15 nt, Human
ggcgcgguggcucac

SEQ ID NO: 3081000 - RNA, 23 nt, Human
ggcuauaggugcuacaaaaacac

SEQ ID NO: 3081001 - RNA, 20 nt, Human
ggcuaguaucaaaagaaaga

SEQ ID NO: 3081002 - RNA, 16 nt, Human
ggccucugcacucccc

SEQ ID NO: 3081003 - RNA, 14 nt, Human
ggccuccugugugu

SEQ ID NO: 3081004 - RNA, 20 nt, Human
ggccucgguguggagaagcg

SEQ ID NO: 3081005 - RNA, 22 nt, Human
ggccuagcauacguacacauuu

SEQ ID NO: 3081006 - RNA, 20 nt, Human
ggccuagcauacguacacau

SEQ ID NO: 3081007 - RNA, 22 nt, Human
ggccucaagugauucuccugcc

SEQ ID NO: 3081008 - RNA, 14 nt, Human
ggccucaagugauu

SEQ ID NO: 3081009 - RNA, 23 nt, Human
ggccgggaccccgagccuggcuc

SEQ ID NO: 3081010 - RNA, 22 nt, Human
ggccgggaccccgagccuggcu

SEQ ID NO: 3081011 - RNA, 14 nt, Human
ggcccagagggccu

SEQ ID NO: 3081012 - RNA, 17 nt, Human
ggcccagagggccugca

SEQ ID NO: 3081013 - RNA, 19 nt, Human
ggcccagagggccugcaag

SEQ ID NO: 3081014 - RNA, 20 nt, Human
ggcccagagggccugcaagg

SEQ ID NO: 3081015 - RNA, 19 nt, Human
ggccucugcggagcacacu

SEQ ID NO: 3081016 - RNA, 22 nt, Human
ggccucugcacuccccugcugg

SEQ ID NO: 3081017 - RNA, 18 nt, Human
ggccucugcacuccccug

SEQ ID NO: 3081018 - RNA, 19 nt, Human
ggccucugcacuccccugc

SEQ ID NO: 3081019 - RNA, 13 nt, Human
ggccuggccccuc

SEQ ID NO: 3081020 - RNA, 14 nt, Human
ggccuggccccuca

SEQ ID NO: 3081021 - RNA, 15 nt, Human
ggccuggccccucag

SEQ ID NO: 3081022 - RNA, 17 nt, Human
ggccuggccccucaggg

SEQ ID NO: 3081023 - RNA, 18 nt, Human
ggccuggccccucagggu

SEQ ID NO: 3081024 - RNA, 23 nt, Human
ggccuggccccucagggucccug

SEQ ID NO: 3081025 - RNA, 10 nt, Human
ggccuggccu

SEQ ID NO: 3081026 - RNA, 13 nt, Human
ggccuggccugag

SEQ ID NO: 3081027 - RNA, 14 nt, Human
ggccuggccugagc

SEQ ID NO: 3081028 - RNA, 15 nt, Human
ggccuggccugagcu

SEQ ID NO: 3081029 - RNA, 16 nt, Human
ggccuggccugagcug

SEQ ID NO: 3081030 - RNA, 23 nt, Human
ggccugggggcugggcagaggaa

SEQ ID NO: 3081031 - RNA, 23 nt, Human
ggcgcagcauauucaggaagcuc

SEQ ID NO: 3081032 - RNA, 24 nt, Human
ggcgcagcauauucaggaagcuca

SEQ ID NO: 3081033 - RNA, 15 nt, Human
gggacugagaaauuu

SEQ ID NO: 3081034 - RNA, 23 nt, Human
gggacucaaugcacugacauugu

SEQ ID NO: 3081035 - RNA, 21 nt, Human
gggacugaggggaggggagca

SEQ ID NO: 3081036 - RNA, 16 nt, Human
gggacucaaugcacug

SEQ ID NO: 3081037 - RNA, 19 nt, Human
gggacucaaugcacugaca

SEQ ID NO: 3081038 - RNA, 17 nt, Human
gggacucaaugcacuga

SEQ ID NO: 3081039 - RNA, 14 nt, Human
gggacacccuguga

SEQ ID NO: 3081040 - RNA, 21 nt, Human
gggaauguuugccucugccuc

SEQ ID NO: 3081041 - RNA, 19 nt, Human
gggaauguuugccucugcc

SEQ ID NO: 3081042 - RNA, 23 nt, Human
gggaggaucucuugagccuggga

SEQ ID NO: 3081043 - RNA, 21 nt, Human
gggaggauugcuugagcucag

SEQ ID NO: 3081044 - RNA, 22 nt, Human
gggaggauguucugggacacag

SEQ ID NO: 3081045 - RNA, 17 nt, Human
gggaggacgcucucugg

SEQ ID NO: 3081046 - RNA, 20 nt, Human
gggaggacgcucucuggccu

SEQ ID NO: 3081047 - RNA, 21 nt, Human
gggagugaguugauagcacag

SEQ ID NO: 3081048 - RNA, 23 nt, Human
gggaggauugcuugagcucagga

SEQ ID NO: 3081049 - RNA, 20 nt, Human
gggaggugggauccuccagg

SEQ ID NO: 3081050 - RNA, 22 nt, Human
gggagcugccuguucagcucca

SEQ ID NO: 3081051 - RNA, 21 nt, Human
gggagcugccuguucagcucc

SEQ ID NO: 3081052 - RNA, 13 nt, Human
gggagcugccugu

SEQ ID NO: 3081053 - RNA, 23 nt, Human
ggcucuggagcccacuguacuug

SEQ ID NO: 3081054 - RNA, 15 nt, Human
ggcugcuucaaggau

SEQ ID NO: 3081055 - RNA, 19 nt, Human
ggcugcuucaaggauccug

SEQ ID NO: 3081056 - RNA, 18 nt, Human
ggcuggagcuagaauuug

SEQ ID NO: 3081057 - RNA, 20 nt, Human
ggcugcuucaaggauccuga

SEQ ID NO: 3081058 - RNA, 20 nt, Human
ggcugggcucccuucccacc

SEQ ID NO: 3081059 - RNA, 21 nt, Human
ggcugggcucccuucccaccu

SEQ ID NO: 3081060 - RNA, 18 nt, Human
ggcugggcucccuuccca

SEQ ID NO: 3081061 - RNA, 18 nt, Human
ggcugggcuucaguggca

SEQ ID NO: 3081062 - RNA, 22 nt, Human
ggcugggcuucaguggcagcug

SEQ ID NO: 3081063 - RNA, 21 nt, Human
ggcugggcuucaguggcagcu

SEQ ID NO: 3081064 - RNA, 11 nt, Human
ggcugggcuuc

SEQ ID NO: 3081065 - RNA, 14 nt, Human
ggcugggggccuca

SEQ ID NO: 3081066 - RNA, 16 nt, Human
ggcugggggaagaagc

SEQ ID NO: 3081067 - RNA, 15 nt, Human
ggcuguuggcugggg

SEQ ID NO: 3081068 - RNA, 14 nt, Human
ggcuguuggcuggg

SEQ ID NO: 3081069 - RNA, 20 nt, Human
ggcuguuggcugggggccuc

SEQ ID NO: 3081070 - RNA, 16 nt, Human
ggcuguuggcuggggg

SEQ ID NO: 3081071 - RNA, 17 nt, Human
ggcuuggggaccagagc

SEQ ID NO: 3081072 - RNA, 18 nt, Human
ggcuuggggaccagagcu

SEQ ID NO: 3081073 - RNA, 21 nt, Human
ggcuucacggaagagccuugc

SEQ ID NO: 3081074 - RNA, 20 nt, Human
ggcuucacggaagagccuug

SEQ ID NO: 3081075 - RNA, 14 nt, Human
ggcuuagucacuga

SEQ ID NO: 3081076 - RNA, 18 nt, Human
ggaugaugacuauggaaa

SEQ ID NO: 3081077 - RNA, 18 nt, Human
ggaugcccaaagaugcag

SEQ ID NO: 3081078 - RNA, 15 nt, Human
ggaugccauccaagu

SEQ ID NO: 3081079 - RNA, 17 nt, Human
ggaugccugguggcagc

SEQ ID NO: 3081080 - RNA, 13 nt, Human
ggaugccuggugg

SEQ ID NO: 3081081 - RNA, 19 nt, Human
ggaugcccaaagaugcagc

SEQ ID NO: 3081082 - RNA, 23 nt, Human
ggagucccaccuuggcugcaggg

SEQ ID NO: 3081083 - RNA, 18 nt, Human
ggaugaucuaggaagacu

SEQ ID NO: 3081084 - RNA, 22 nt, Human
ggaugaucuaggaagacuuugg

SEQ ID NO: 3081085 - RNA, 16 nt, Human
ggaugaucuaggaaga

SEQ ID NO: 3081086 - RNA, 12 nt, Human
ggauuauauuau

SEQ ID NO: 3081087 - RNA, 17 nt, Human
ggauuagggagagaaga

SEQ ID NO: 3081088 - RNA, 21 nt, Human
ggaugccugguggcagcugcg

SEQ ID NO: 3081089 - RNA, 20 nt, Human
ggaugccugguggcagcugc

SEQ ID NO: 3081090 - RNA, 19 nt, Human
ggaugccugguggcagcug

SEQ ID NO: 3081091 - RNA, 18 nt, Human
ggaugccugguggcagcu

SEQ ID NO: 3081092 - RNA, 22 nt, Human
ggcagagcagagaccaucccug

SEQ ID NO: 3081093 - RNA, 21 nt, Human
ggcagagguugcagugagccg

SEQ ID NO: 3081094 - RNA, 19 nt, Human
ggcacucagaagacacuga

SEQ ID NO: 3081095 - RNA, 18 nt, Human
ggcacucagaagacacug

SEQ ID NO: 3081096 - RNA, 17 nt, Human
ggcacccggccccugcu

SEQ ID NO: 3081097 - RNA, 20 nt, Human
ggcacccggccccugcuggu

SEQ ID NO: 3081098 - RNA, 19 nt, Human
ggcacccggccccugcugg

SEQ ID NO: 3081099 - RNA, 18 nt, Human
ggcacccggccccugcug

SEQ ID NO: 3081100 - RNA, 17 nt, Human
ggcaccagcagccugga

SEQ ID NO: 3081101 - RNA, 19 nt, Human
ggcaagcaccuccugccuc

SEQ ID NO: 3081102 - RNA, 18 nt, Human
ggcaagcaccuccugccu

SEQ ID NO: 3081103 - RNA, 16 nt, Human
ggauucuuccucccuc

SEQ ID NO: 3081104 - RNA, 21 nt, Human
ggauucuuccucccucccucu

SEQ ID NO: 3081105 - RNA, 17 nt, Human
ggcaagcaccuccugcc

SEQ ID NO: 3081106 - RNA, 19 nt, Human
ggauugaaggaugcugucu

SEQ ID NO: 3081107 - RNA, 12 nt, Human
ggcccagagagg

SEQ ID NO: 3081108 - RNA, 15 nt, Human
ggccaggcccucugc

SEQ ID NO: 3081109 - RNA, 16 nt, Human
ggccaggcccucugcc

SEQ ID NO: 3081110 - RNA, 17 nt, Human
ggccaggcccucugccc

SEQ ID NO: 3081111 - RNA, 13 nt, Human
ggccaggagccuc

SEQ ID NO: 3081112 - RNA, 14 nt, Human
ggccaggcccucug

SEQ ID NO: 3081113 - RNA, 11 nt, Human
ggccaggagcc

SEQ ID NO: 3081114 - RNA, 20 nt, Human
ggccacugugaagagaacca

SEQ ID NO: 3081115 - RNA, 22 nt, Human
ggccacagaaaauucuucucca

SEQ ID NO: 3081116 - RNA, 20 nt, Human
ggcauguucucugaggacac

SEQ ID NO: 3081117 - RNA, 18 nt, Human
ggccaccgccuugcccag

SEQ ID NO: 3081118 - RNA, 20 nt, Human
ggccaccgccuugcccagcc

SEQ ID NO: 3081119 - RNA, 19 nt, Human
ggcagaguugaagacagag

SEQ ID NO: 3081120 - RNA, 21 nt, Human
ggcagaguugaagacagagcu

SEQ ID NO: 3081121 - RNA, 17 nt, Human
ggcagaguugaagacag

SEQ ID NO: 3081122 - RNA, 21 nt, Human
ggcagcugcgguccacccagg

SEQ ID NO: 3081123 - RNA, 12 nt, Human
ggcaggguccua

SEQ ID NO: 3081124 - RNA, 24 nt, Human
ggcagcugcgguccacccaggagc

SEQ ID NO: 3081125 - RNA, 23 nt, Human
ggcagcugcgguccacccaggag

SEQ ID NO: 3081126 - RNA, 17 nt, Human
ggcagguuggugggggc

SEQ ID NO: 3081127 - RNA, 18 nt, Human
ggcagggucucacucugu

SEQ ID NO: 3081128 - RNA, 17 nt, Human
ggcagggucucacucug

SEQ ID NO: 3081129 - RNA, 18 nt, Human
ggcaugugaugagaggaa

SEQ ID NO: 3081130 - RNA, 23 nt, Human
ggcaugugaugagaggaaaucac

SEQ ID NO: 3081131 - RNA, 22 nt, Human
ggcaugacacgaauauugcuga

SEQ ID NO: 3081132 - RNA, 17 nt, Human
ggaggcaggaguuucgu

SEQ ID NO: 3081133 - RNA, 17 nt, Human
ggagggagggcuccaga

SEQ ID NO: 3081134 - RNA, 13 nt, Human
ggagggagggcuc

SEQ ID NO: 3081135 - RNA, 16 nt, Human
ggagggagggcuccag

SEQ ID NO: 3081136 - RNA, 21 nt, Human
ggaggauguucugggacacag

SEQ ID NO: 3081137 - RNA, 18 nt, Human
ggaggauguucugggaca

SEQ ID NO: 3081138 - RNA, 16 nt, Human
ggaggacgcucucugg

SEQ ID NO: 3081139 - RNA, 15 nt, Human
ggaggauguucuggg

SEQ ID NO: 3081140 - RNA, 22 nt, Human
ggagucccaccuuggcugcagg

SEQ ID NO: 3081141 - RNA, 21 nt, Human
ggagucccaccuuggcugcag

SEQ ID NO: 3081142 - RNA, 19 nt, Human
ggaggggagcaugggaagu

SEQ ID NO: 3081143 - RNA, 19 nt, Human
ggagcccugggaggcucug

SEQ ID NO: 3081144 - RNA, 16 nt, Human
ggagcccugggaggcu

SEQ ID NO: 3081145 - RNA, 16 nt, Human
ggagcacacuggcuca

SEQ ID NO: 3081146 - RNA, 20 nt, Human
ggagcccugggaggcucugg

SEQ ID NO: 3081147 - RNA, 18 nt, Human
ggagcccugucuccucuc

SEQ ID NO: 3081148 - RNA, 14 nt, Human
ggagccuccugccc

SEQ ID NO: 3081149 - RNA, 15 nt, Human
ggagccuccugcccu

SEQ ID NO: 3081150 - RNA, 14 nt, Human
ggagcuagaauuug

SEQ ID NO: 3081151 - RNA, 14 nt, Human
ggacugagaaauuu

SEQ ID NO: 3081152 - RNA, 17 nt, Human
ggacugaauuaugaaac

SEQ ID NO: 3081153 - RNA, 19 nt, Human
ggacugaauuaugaaacuu

SEQ ID NO: 3081154 - RNA, 19 nt, Human
ggacgcucucuggccuucg

SEQ ID NO: 3081155 - RNA, 15 nt, Human
ggacgcucucuggcc

SEQ ID NO: 3081156 - RNA, 16 nt, Human
ggacgcucucuggccu

SEQ ID NO: 3081157 - RNA, 18 nt, Human
ggaccuugaacuggguac

SEQ ID NO: 3081158 - RNA, 18 nt, Human
ggacugagaaauuuauaa

SEQ ID NO: 3081159 - RNA, 20 nt, Human
ggacugagggggccuggaug

SEQ ID NO: 3081160 - RNA, 15 nt, Human
ggagaagagcuguuc

SEQ ID NO: 3081161 - RNA, 11 nt, Human
ggagaagaacu

SEQ ID NO: 3081162 - RNA, 14 nt, Human
ggagaagaacugaa

SEQ ID NO: 3081163 - RNA, 23 nt, Human
ggagaagagcuguucacagccag

SEQ ID NO: 3081164 - RNA, 20 nt, Human
gcuuuuaugugaaacauguu

SEQ ID NO: 3081165 - RNA, 19 nt, Human
gcuuuuaugugaaacaugu

SEQ ID NO: 3081166 - RNA, 21 nt, Human
gcuuuuaugugaaacauguuu

SEQ ID NO: 3081167 - RNA, 22 nt, Human
ggacacucaaaagcugggcagg

SEQ ID NO: 3081168 - RNA, 16 nt, Human
ggacagaggggguggc

SEQ ID NO: 3081169 - RNA, 14 nt, Human
ggacagaagcagcu

SEQ ID NO: 3081170 - RNA, 17 nt, Human
ggacagaagcagcucuu

SEQ ID NO: 3081171 - RNA, 16 nt, Human
ggacagaagcagcucu

SEQ ID NO: 3081172 - RNA, 15 nt, Human
ggacagaagcagcuc

SEQ ID NO: 3081173 - RNA, 19 nt, Human
ggaccagagcugccaccug

SEQ ID NO: 3081174 - RNA, 14 nt, Human
ggaccagagcugcc

SEQ ID NO: 3081175 - RNA, 20 nt, Human
ggacauuugcucauggaauu

SEQ ID NO: 3081176 - RNA, 16 nt, Human
ggacauuugcucaugg

SEQ ID NO: 3081177 - RNA, 17 nt, Human
ggacauuugcucaugga

SEQ ID NO: 3081178 - RNA, 16 nt, Human
ggacagcuccuucugu

SEQ ID NO: 3081179 - RNA, 15 nt, Human
ggacagcuccuucug

SEQ ID NO: 3081180 - RNA, 11 nt, Human
ggacagcuccu

SEQ ID NO: 3081181 - RNA, 20 nt, Human
ggacagaggggguggccucc

SEQ ID NO: 3081182 - RNA, 22 nt, Human
ggacagccacggccaggccaga

SEQ ID NO: 3081183 - RNA, 18 nt, Human
gccuuggggcugaugcag

SEQ ID NO: 3081184 - RNA, 15 nt, Human
gccuuacacaauggu

SEQ ID NO: 3081185 - RNA, 12 nt, Human
gcgacaaugcaa

SEQ ID NO: 3081186 - RNA, 13 nt, Human
gcgacaaugcaaa

SEQ ID NO: 3081187 - RNA, 20 nt, Human
gcgacaaugcaaaccaucau

SEQ ID NO: 3081188 - RNA, 21 nt, Human
gcgacaaugcaaaccaucauu

SEQ ID NO: 3081189 - RNA, 23 nt, Human
gcgcccaguuggguggaugccug

SEQ ID NO: 3081190 - RNA, 21 nt, Human
gcgccuuaaggauguucuagc

SEQ ID NO: 3081191 - RNA, 14 nt, Human
gcggggacagcucc

SEQ ID NO: 3081192 - RNA, 19 nt, Human
gcggagacggagucccacc

SEQ ID NO: 3081193 - RNA, 16 nt, Human
gcggagaaaggaaggg

SEQ ID NO: 3081194 - RNA, 17 nt, Human
gcgcugccccuggcagc

SEQ ID NO: 3081195 - RNA, 18 nt, Human
gcgcugccccuggcagcc

SEQ ID NO: 3081196 - RNA, 21 nt, Human
gcgcugccccuggcagccccu

SEQ ID NO: 3081197 - RNA, 14 nt, Human
gcgguccacccagg

SEQ ID NO: 3081198 - RNA, 13 nt, Human
gcgguccacccag

SEQ ID NO: 3081199 - RNA, 19 nt, Human
gcggugagaggggaacaga

SEQ ID NO: 3081200 - RNA, 17 nt, Human
gcggggacagcuccuuc

SEQ ID NO: 3081201 - RNA, 15 nt, Human
gcggggacagcuccu

SEQ ID NO: 3081202 - RNA, 16 nt, Human
gccuggauggggcugc

SEQ ID NO: 3081203 - RNA, 18 nt, Human
gccuggauggggcugcac

SEQ ID NO: 3081204 - RNA, 20 nt, Human
gccuggauggggcugcaccg

SEQ ID NO: 3081205 - RNA, 18 nt, Human
gccugaagucacacagug

SEQ ID NO: 3081206 - RNA, 17 nt, Human
gccugaagucacacagu

SEQ ID NO: 3081207 - RNA, 17 nt, Human
gccugagcgacagugag

SEQ ID NO: 3081208 - RNA, 20 nt, Human
gccugagcgacagugagacu

SEQ ID NO: 3081209 - RNA, 16 nt, Human
gccugaagucacacag

SEQ ID NO: 3081210 - RNA, 15 nt, Human
gccugaagucacaca

SEQ ID NO: 3081211 - RNA, 21 nt, Human
gcccaguuggguggaugccug

SEQ ID NO: 3081212 - RNA, 19 nt, Human
gcccaguuggguggaugcc

SEQ ID NO: 3081213 - RNA, 12 nt, Human
gccugagcuggg

SEQ ID NO: 3081214 - RNA, 15 nt, Human
gccuguaauccuagc

SEQ ID NO: 3081215 - RNA, 20 nt, Human
gccuguaauccuagcacuuu

SEQ ID NO: 3081216 - RNA, 18 nt, Human
gccugggcagaaggaaga

SEQ ID NO: 3081217 - RNA, 13 nt, Human
gccuggccccuca

SEQ ID NO: 3081218 - RNA, 14 nt, Human
gccuggccccucag

SEQ ID NO: 3081219 - RNA, 21 nt, Human
gccuggccagaugcaccagcc

SEQ ID NO: 3081220 - RNA, 16 nt, Human
gccuggccagaugcac

SEQ ID NO: 3081221 - RNA, 20 nt, Human
gccuggccagaugcaccagc

SEQ ID NO: 3081222 - RNA, 18 nt, Human
gcucauggacuucugcca

SEQ ID NO: 3081223 - RNA, 23 nt, Human
gcucagcggggacagcuccuucu

SEQ ID NO: 3081224 - RNA, 18 nt, Human
gcucagcggggacagcuc

SEQ ID NO: 3081225 - RNA, 17 nt, Human
gcucagcggggacagcu

SEQ ID NO: 3081226 - RNA, 16 nt, Human
gcucagcggggacagc

SEQ ID NO: 3081227 - RNA, 15 nt, Human
gcucaccagccccag

SEQ ID NO: 3081228 - RNA, 14 nt, Human
gcucaccagcccca

SEQ ID NO: 3081229 - RNA, 13 nt, Human
gcucaccagcccc

SEQ ID NO: 3081230 - RNA, 12 nt, Human
gcucaccagccc

SEQ ID NO: 3081231 - RNA, 16 nt, Human
gcucacauaucuguca

SEQ ID NO: 3081232 - RNA, 14 nt, Human
gcucaccucucccu

SEQ ID NO: 3081233 - RNA, 16 nt, Human
gcucaccucucccuug

SEQ ID NO: 3081234 - RNA, 17 nt, Human
gcucaccucucccuugg

SEQ ID NO: 3081235 - RNA, 18 nt, Human
gcucaccucucccuugga

SEQ ID NO: 3081236 - RNA, 16 nt, Human
gcuaucguaaaauuaa

SEQ ID NO: 3081237 - RNA, 15 nt, Human
gcuaucguaaaauua

SEQ ID NO: 3081238 - RNA, 17 nt, Human
gcuaucguaaaauuaag

SEQ ID NO: 3081239 - RNA, 13 nt, Human
gcuaucuccccca

SEQ ID NO: 3081240 - RNA, 18 nt, Human
gcucaaguccucuuuucu

SEQ ID NO: 3081241 - RNA, 14 nt, Human
gcuaucucccccag

SEQ ID NO: 3081242 - RNA, 22 nt, Human
gcucaaguccucuuuucugaga

SEQ ID NO: 3081243 - RNA, 19 nt, Human
gcucaaguccucuuuucug

SEQ ID NO: 3081244 - RNA, 19 nt, Human
gcggugcuaucucccccag

SEQ ID NO: 3081245 - RNA, 22 nt, Human
gcggugcuaucucccccagccc

SEQ ID NO: 3081246 - RNA, 13 nt, Human
gcuagauguaugu

SEQ ID NO: 3081247 - RNA, 21 nt, Human
gcuaguugggcuuccucauag

SEQ ID NO: 3081248 - RNA, 14 nt, Human
gcuagauguaugua

SEQ ID NO: 3081249 - RNA, 19 nt, Human
gcuauaggugcuacaaaaa

SEQ ID NO: 3081250 - RNA, 21 nt, Human
gcuauaggugcuacaaaaaca

SEQ ID NO: 3081251 - RNA, 24 nt, Human
gcuccaggcuccuuuagcgcccag

SEQ ID NO: 3081252 - RNA, 12 nt, Human
gcuccaggcucc

SEQ ID NO: 3081253 - RNA, 15 nt, Human
gcuccaggagcagcc

SEQ ID NO: 3081254 - RNA, 16 nt, Human
gcuccaggagcagcca

SEQ ID NO: 3081255 - RNA, 17 nt, Human
gcuccaggagcagccac

SEQ ID NO: 3081256 - RNA, 18 nt, Human
gcuccaggagcagccaca

SEQ ID NO: 3081257 - RNA, 12 nt, Human
gcuccaggagca

SEQ ID NO: 3081258 - RNA, 14 nt, Human
gcuccaggagcagc

SEQ ID NO: 3081259 - RNA, 11 nt, Human
gcuccaggagc

SEQ ID NO: 3081260 - RNA, 21 nt, Human
gcuccagcuguucagcugguu

SEQ ID NO: 3081261 - RNA, 20 nt, Human
gcuccagcuguucagcuggu

SEQ ID NO: 3081262 - RNA, 20 nt, Human
gcuccauuuuuagugaaaua

SEQ ID NO: 3081263 - RNA, 19 nt, Human
gcucccuucccaccucucu

SEQ ID NO: 3081264 - RNA, 23 nt, Human
gcuccgcuuucuacccagcgagc

SEQ ID NO: 3081265 - RNA, 22 nt, Human
gcuccgcuuucuacccagcgag

SEQ ID NO: 3081266 - RNA, 21 nt, Human
gcuccgcuuucuacccagcga

SEQ ID NO: 3081267 - RNA, 18 nt, Human
gcuccgcuuucuacccag

SEQ ID NO: 3081268 - RNA, 20 nt, Human
gcucccuucccaccucucuc

SEQ ID NO: 3081269 - RNA, 13 nt, Human
gcuccugugucuu

SEQ ID NO: 3081270 - RNA, 12 nt, Human
gcuccugugucu

SEQ ID NO: 3081271 - RNA, 19 nt, Human
gcucgagcaugccuggaug

SEQ ID NO: 3081272 - RNA, 21 nt, Human
gcucgagcaugccuggauggg

SEQ ID NO: 3081273 - RNA, 17 nt, Human
gcucgagcaugccugga

SEQ ID NO: 3081274 - RNA, 17 nt, Human
gcuccuuuagcgcccag

SEQ ID NO: 3081275 - RNA, 13 nt, Human
gcuccuucugucc

SEQ ID NO: 3081276 - RNA, 24 nt, Human
gcuccgcuuucuacccagcgagcc

SEQ ID NO: 3081277 - RNA, 21 nt, Human
gcuccuaggacccgucuccag

SEQ ID NO: 3081278 - RNA, 22 nt, Human
gcuccuaggacccgucuccagc

SEQ ID NO: 3081279 - RNA, 19 nt, Human
gcucuugaugccuggcggg

SEQ ID NO: 3081280 - RNA, 21 nt, Human
gcucucaggccagcugcuugg

SEQ ID NO: 3081281 - RNA, 20 nt, Human
gcucucaggccagcugcuug

SEQ ID NO: 3081282 - RNA, 19 nt, Human
gcugacagacacaggcccg

SEQ ID NO: 3081283 - RNA, 18 nt, Human
gcugacagacacaggccc

SEQ ID NO: 3081284 - RNA, 17 nt, Human
gcugacagacacaggcc

SEQ ID NO: 3081285 - RNA, 22 nt, Human
gcugacuguuuucucuugagag

SEQ ID NO: 3081286 - RNA, 15 nt, Human
gcugaucgcuucucc

SEQ ID NO: 3081287 - RNA, 21 nt, Human
gcugauuaaaccaaggcuaga

SEQ ID NO: 3081288 - RNA, 22 nt, Human
gcugcaaaggguaucaggugcu

SEQ ID NO: 3081289 - RNA, 12 nt, Human
gcugccaccugc

SEQ ID NO: 3081290 - RNA, 20 nt, Human
gcugccaaugggagcucaug

SEQ ID NO: 3081291 - RNA, 18 nt, Human
gcugcauuuaaaagauac

SEQ ID NO: 3081292 - RNA, 17 nt, Human
gcugcauuuaaaagaua

SEQ ID NO: 3081293 - RNA, 19 nt, Human
gcugcauuuaaaagauaca

SEQ ID NO: 3081294 - RNA, 13 nt, Human
gcugcaguugcca

SEQ ID NO: 3081295 - RNA, 14 nt, Human
gcugcaguugccag

SEQ ID NO: 3081296 - RNA, 22 nt, Human
gcugcgguccacccaggagccc

SEQ ID NO: 3081297 - RNA, 21 nt, Human
gcugcgguccacccaggagcc

SEQ ID NO: 3081298 - RNA, 19 nt, Human
gcugcgguccacccaggag

SEQ ID NO: 3081299 - RNA, 15 nt, Human
gcugcgguccaccca

SEQ ID NO: 3081300 - RNA, 14 nt, Human
gcugcgguccaccc

SEQ ID NO: 3081301 - RNA, 19 nt, Human
gcugccuguucagcuccag

SEQ ID NO: 3081302 - RNA, 18 nt, Human
gcugccuguucagcucca

SEQ ID NO: 3081303 - RNA, 22 nt, Human
gcugccuguucagcuccagcuc

SEQ ID NO: 3081304 - RNA, 20 nt, Human
gcugccuguucagcuccagc

SEQ ID NO: 3081305 - RNA, 13 nt, Human
gcugcccugccca

SEQ ID NO: 3081306 - RNA, 14 nt, Human
gcugcccugcccac

SEQ ID NO: 3081307 - RNA, 12 nt, Human
gcugcccugccc

SEQ ID NO: 3081308 - RNA, 16 nt, Human
gcugcccugcccaccu

SEQ ID NO: 3081309 - RNA, 18 nt, Human
gcugcccugcccaccugg

SEQ ID NO: 3081310 - RNA, 20 nt, Human
gcugcccugcccaccuggcc

SEQ ID NO: 3081311 - RNA, 21 nt, Human
gcugcccugcccaccuggccu

SEQ ID NO: 3081312 - RNA, 22 nt, Human
gcugcccugcccaccuggccuc

SEQ ID NO: 3081313 - RNA, 23 nt, Human
gcugcccugcccaccuggccucu

SEQ ID NO: 3081314 - RNA, 24 nt, Human
gcugcccugcccaccuggccucug

SEQ ID NO: 3081315 - RNA, 15 nt, Human
gcuggaccuugaacu

SEQ ID NO: 3081316 - RNA, 22 nt, Human
gcugcuuuugucuaugggacuc

SEQ ID NO: 3081317 - RNA, 23 nt, Human
gcuggaaaaguauguuagugcaa

SEQ ID NO: 3081318 - RNA, 21 nt, Human
gcuggaaaaguauguuagugc

SEQ ID NO: 3081319 - RNA, 15 nt, Human
gcuuuuaugugaaac

SEQ ID NO: 3081320 - RNA, 13 nt, Human
gcuuuuaugugaa

SEQ ID NO: 3081321 - RNA, 12 nt, Human
gcuuguguuaag

SEQ ID NO: 3081322 - RNA, 18 nt, Human
gcuugcccuguuaaaaga

SEQ ID NO: 3081323 - RNA, 21 nt, Human
gcuucauccuccucagaucuu

SEQ ID NO: 3081324 - RNA, 20 nt, Human
gcuucaguggcagcugcuuu

SEQ ID NO: 3081325 - RNA, 19 nt, Human
gcuucaguggcagcugcuu

SEQ ID NO: 3081326 - RNA, 20 nt, Human
gcuuauacacuuacacuuua

SEQ ID NO: 3081327 - RNA, 18 nt, Human
gcuucauuuccugugucu

SEQ ID NO: 3081328 - RNA, 22 nt, Human
gcuucucacugccaugccagcu

SEQ ID NO: 3081329 - RNA, 17 nt, Human
gcuucucacugccaugc

SEQ ID NO: 3081330 - RNA, 19 nt, Human
gcuucuguuuuauaauuuu

SEQ ID NO: 3081331 - RNA, 18 nt, Human
gcuguguuaaauaaaccu

SEQ ID NO: 3081332 - RNA, 16 nt, Human
gcuguguggcagucug

SEQ ID NO: 3081333 - RNA, 15 nt, Human
gcugugucucccuuc

SEQ ID NO: 3081334 - RNA, 15 nt, Human
gcuggugucaccuga

SEQ ID NO: 3081335 - RNA, 14 nt, Human
gcuggugucaccug

SEQ ID NO: 3081336 - RNA, 17 nt, Human
gcugucagccauuccug

SEQ ID NO: 3081337 - RNA, 23 nt, Human
gcugucccuuacgugaguccugg

SEQ ID NO: 3081338 - RNA, 22 nt, Human
gcugucccuuacgugaguccug

SEQ ID NO: 3081339 - RNA, 16 nt, Human
gcugucccuuuuccuu

SEQ ID NO: 3081340 - RNA, 15 nt, Human
gcugggggccucagu

SEQ ID NO: 3081341 - RNA, 14 nt, Human
gcugggggccucag

SEQ ID NO: 3081342 - RNA, 13 nt, Human
gcugggggccuca

SEQ ID NO: 3081343 - RNA, 18 nt, Human
gcugggggccucagugcc

SEQ ID NO: 3081344 - RNA, 19 nt, Human
gcugggcuucaguggcagc

SEQ ID NO: 3081345 - RNA, 22 nt, Human
gcugggcuucaguggcagcugc

SEQ ID NO: 3081346 - RNA, 21 nt, Human
gcugggcuucaguggcagcug

SEQ ID NO: 3081347 - RNA, 20 nt, Human
gcugggcuucaguggcagcu

SEQ ID NO: 3081348 - RNA, 19 nt, Human
gcugggaugauuggagggg

SEQ ID NO: 3081349 - RNA, 21 nt, Human
gcugggcucccuucccaccuc

SEQ ID NO: 3081350 - RNA, 13 nt, Human
gcuggccuggccc

SEQ ID NO: 3081351 - RNA, 12 nt, Human
gcuggccuggcc

SEQ ID NO: 3081352 - RNA, 14 nt, Human
gcuggccuggcccc

SEQ ID NO: 3081353 - RNA, 15 nt, Human
gcuggccuggccccu

SEQ ID NO: 3081354 - RNA, 17 nt, Human
gcaccaucucuccuccu

SEQ ID NO: 3081355 - RNA, 14 nt, Human
gcaccaucucuccu

SEQ ID NO: 3081356 - RNA, 15 nt, Human
gcaccaucucuccuc

SEQ ID NO: 3081357 - RNA, 13 nt, Human
gcaccagcagccu

SEQ ID NO: 3081358 - RNA, 20 nt, Human
gauugugucucuugguccug

SEQ ID NO: 3081359 - RNA, 12 nt, Human
gcacagcaggcu

SEQ ID NO: 3081360 - RNA, 15 nt, Human
gcacagccucuuaga

SEQ ID NO: 3081361 - RNA, 17 nt, Human
gcacagcaggcugccag

SEQ ID NO: 3081362 - RNA, 23 nt, Human
gcacagcaggcugccagugccug

SEQ ID NO: 3081363 - RNA, 18 nt, Human
gcacagcaggcugccagu

SEQ ID NO: 3081364 - RNA, 22 nt, Human
gcacagcaggcugccagugccu

SEQ ID NO: 3081365 - RNA, 21 nt, Human
gcacagcuucauuuccugugu

SEQ ID NO: 3081366 - RNA, 23 nt, Human
gcacagcuucauuuccugugucu

SEQ ID NO: 3081367 - RNA, 14 nt, Human
gcacgugugugcac

SEQ ID NO: 3081368 - RNA, 20 nt, Human
gcacuaaggugugcucugau

SEQ ID NO: 3081369 - RNA, 19 nt, Human
gcacuaaggugugcucuga

SEQ ID NO: 3081370 - RNA, 16 nt, Human
gcacccucaggcaggu

SEQ ID NO: 3081371 - RNA, 19 nt, Human
gcacccucaggcagguggg

SEQ ID NO: 3081372 - RNA, 16 nt, Human
gcacgcacacugucug

SEQ ID NO: 3081373 - RNA, 15 nt, Human
gcacgcacacugucu

SEQ ID NO: 3081374 - RNA, 19 nt, Human
gcacuguuuuauuuuaauu

SEQ ID NO: 3081375 - RNA, 19 nt, Human
gcacuguggguagacacac

SEQ ID NO: 3081376 - RNA, 12 nt, Human
gcacugggcuug

SEQ ID NO: 3081377 - RNA, 12 nt, Human
gcacugcuucca

SEQ ID NO: 3081378 - RNA, 13 nt, Human
gcacugcuuccag

SEQ ID NO: 3081379 - RNA, 14 nt, Human
gcacugcuuccagu

SEQ ID NO: 3081380 - RNA, 15 nt, Human
gcacugcuuccagug

SEQ ID NO: 3081381 - RNA, 15 nt, Human
gcacuauaauguaag

SEQ ID NO: 3081382 - RNA, 14 nt, Human
gcacuauaauguaa

SEQ ID NO: 3081383 - RNA, 20 nt, Human
gcacuauaauguaagcucua

SEQ ID NO: 3081384 - RNA, 18 nt, Human
gcagcucagagagggugg

SEQ ID NO: 3081385 - RNA, 19 nt, Human
gcagcucagagaggguggg

SEQ ID NO: 3081386 - RNA, 16 nt, Human
gcaggaagcugugaga

SEQ ID NO: 3081387 - RNA, 17 nt, Human
gcagcucaccucucccu

SEQ ID NO: 3081388 - RNA, 20 nt, Human
gcagcucaccucucccuugg

SEQ ID NO: 3081389 - RNA, 21 nt, Human
gcagcucaccucucccuugga

SEQ ID NO: 3081390 - RNA, 14 nt, Human
gcagcucagagagg

SEQ ID NO: 3081391 - RNA, 16 nt, Human
gcagcucaccucuccc

SEQ ID NO: 3081392 - RNA, 18 nt, Human
gcagcagggagggcuucu

SEQ ID NO: 3081393 - RNA, 19 nt, Human
gcagcagggagggcuucug

SEQ ID NO: 3081394 - RNA, 19 nt, Human
gcagccucacaguccuuac

SEQ ID NO: 3081395 - RNA, 15 nt, Human
gcagccucacagucc

SEQ ID NO: 3081396 - RNA, 17 nt, Human
gcagccucacaguccuu

SEQ ID NO: 3081397 - RNA, 22 nt, Human
gcagauggaaugcuguguuaaa

SEQ ID NO: 3081398 - RNA, 18 nt, Human
gcagauggagaccccuug

SEQ ID NO: 3081399 - RNA, 23 nt, Human
gcagagguugcagugagccgaga

SEQ ID NO: 3081400 - RNA, 18 nt, Human
gcagagguugcagugagc

SEQ ID NO: 3081401 - RNA, 22 nt, Human
gcagagaccaucccugaaggcc

SEQ ID NO: 3081402 - RNA, 20 nt, Human
gcagagaccaucccugaagg

SEQ ID NO: 3081403 - RNA, 21 nt, Human
gcagagaccaucccugaaggc

SEQ ID NO: 3081404 - RNA, 19 nt, Human
gcagagaccaucccugaag

SEQ ID NO: 3081405 - RNA, 22 nt, Human
gcagacucuacagaggccaugg

SEQ ID NO: 3081406 - RNA, 19 nt, Human
gcagacucuacagaggcca

SEQ ID NO: 3081407 - RNA, 18 nt, Human
gcagacucuacagaggcc

SEQ ID NO: 3081408 - RNA, 17 nt, Human
gcagacucuacagaggc

SEQ ID NO: 3081409 - RNA, 14 nt, Human
gcacuugcagacuc

SEQ ID NO: 3081410 - RNA, 22 nt, Human
gcacuucgggaggucgaggcag

SEQ ID NO: 3081411 - RNA, 20 nt, Human
gcaucuagcaugucgucaaa

SEQ ID NO: 3081412 - RNA, 18 nt, Human
gcaucaggccaggcccuc

SEQ ID NO: 3081413 - RNA, 23 nt, Human
gcaucaggccaggcccucugccc

SEQ ID NO: 3081414 - RNA, 12 nt, Human
gcaucaggccag

SEQ ID NO: 3081415 - RNA, 23 nt, Human
gcaucagcugcugaaacaacaaa

SEQ ID NO: 3081416 - RNA, 22 nt, Human
gcaucagcugcugaaacaacaa

SEQ ID NO: 3081417 - RNA, 20 nt, Human
gcaugacacgaauauugcug

SEQ ID NO: 3081418 - RNA, 21 nt, Human
gcaugacacgaauauugcuga

SEQ ID NO: 3081419 - RNA, 18 nt, Human
gcaugaaguaauaugcac

SEQ ID NO: 3081420 - RNA, 22 nt, Human
gcaugacacgaauauugcugau

SEQ ID NO: 3081421 - RNA, 22 nt, Human
gcaugaaguaauaugcacacau

SEQ ID NO: 3081422 - RNA, 21 nt, Human
gcaugaaguaauaugcacaca

SEQ ID NO: 3081423 - RNA, 20 nt, Human
gcaugaaguaauaugcacac

SEQ ID NO: 3081424 - RNA, 13 nt, Human
gcauguuacauaa

SEQ ID NO: 3081425 - RNA, 14 nt, Human
gcaugccuggaugg

SEQ ID NO: 3081426 - RNA, 24 nt, Human
gcauuaucuagauacuguaucaug

SEQ ID NO: 3081427 - RNA, 22 nt, Human
gcauuaucuagauacuguauca

SEQ ID NO: 3081428 - RNA, 19 nt, Human
gcauuaucuagauacugua

SEQ ID NO: 3081429 - RNA, 12 nt, Human
gcauuccccagg

SEQ ID NO: 3081430 - RNA, 14 nt, Human
gcauuccccaggag

SEQ ID NO: 3081431 - RNA, 15 nt, Human
gcauuccccaggagg

SEQ ID NO: 3081432 - RNA, 16 nt, Human
gcauuccccaggaggc

SEQ ID NO: 3081433 - RNA, 17 nt, Human
gcauuccccaggaggcc

SEQ ID NO: 3081434 - RNA, 18 nt, Human
gcauuccccaggaggcca

SEQ ID NO: 3081435 - RNA, 19 nt, Human
gcauuccccaggaggccag

SEQ ID NO: 3081436 - RNA, 20 nt, Human
gcauuccccaggaggccagc

SEQ ID NO: 3081437 - RNA, 21 nt, Human
gcauuccccaggaggccagcc

SEQ ID NO: 3081438 - RNA, 22 nt, Human
gcauuccccaggaggccagccu

SEQ ID NO: 3081439 - RNA, 18 nt, Human
gcauuugaggucuguucu

SEQ ID NO: 3081440 - RNA, 19 nt, Human
gcaggucccuaauaaagcu

SEQ ID NO: 3081441 - RNA, 18 nt, Human
gcaggucccuaauaaagc

SEQ ID NO: 3081442 - RNA, 17 nt, Human
gcaggucccuaauaaag

SEQ ID NO: 3081443 - RNA, 16 nt, Human
gcaggucccuaauaaa

SEQ ID NO: 3081444 - RNA, 21 nt, Human
gcaggucccuaauaaagcugu

SEQ ID NO: 3081445 - RNA, 20 nt, Human
gcaggucccuaauaaagcug

SEQ ID NO: 3081446 - RNA, 23 nt, Human
gcaggucccuaauaaagcugugu

SEQ ID NO: 3081447 - RNA, 11 nt, Human
gcagugggagc

SEQ ID NO: 3081448 - RNA, 19 nt, Human
gcaguggugcgaucugggu

SEQ ID NO: 3081449 - RNA, 18 nt, Human
gcaguggugcgaucuggg

SEQ ID NO: 3081450 - RNA, 21 nt, Human
gcaguggugguuuucuguucu

SEQ ID NO: 3081451 - RNA, 20 nt, Human
gcaguggugguuuucuguuc

SEQ ID NO: 3081452 - RNA, 21 nt, Human
gcaguggugcgaucuggguuc

SEQ ID NO: 3081453 - RNA, 20 nt, Human
gcaguggugcgaucuggguu

SEQ ID NO: 3081454 - RNA, 19 nt, Human
gcaguggugguuuucuguu

SEQ ID NO: 3081455 - RNA, 22 nt, Human
gcaguggugcgaucuggguuca

SEQ ID NO: 3081456 - RNA, 19 nt, Human
gcauacguacacauuuuau

SEQ ID NO: 3081457 - RNA, 21 nt, Human
gcaguugaaaagacuccaaag

SEQ ID NO: 3081458 - RNA, 18 nt, Human
gcauacguacacauuuua

SEQ ID NO: 3081459 - RNA, 15 nt, Human
gcaguugaaaagacu

SEQ ID NO: 3081460 - RNA, 19 nt, Human
gcaguugaaaagacuccaa

SEQ ID NO: 3081461 - RNA, 16 nt, Human
gcaguugaaaagacuc

SEQ ID NO: 3081462 - RNA, 15 nt, Human
gcaggucccuaauaa

SEQ ID NO: 3081463 - RNA, 14 nt, Human
gcaggucccuaaua

SEQ ID NO: 3081464 - RNA, 19 nt, Human
gcaggguccuagaaauucc

SEQ ID NO: 3081465 - RNA, 16 nt, Human
gcagggucucacucug

SEQ ID NO: 3081466 - RNA, 22 nt, Human
gcagggcucagcggggacagcu

SEQ ID NO: 3081467 - RNA, 18 nt, Human
gcaggcagccaggccaca

SEQ ID NO: 3081468 - RNA, 17 nt, Human
gcaggcagccaggccac

SEQ ID NO: 3081469 - RNA, 13 nt, Human
gccaggcuggguc

SEQ ID NO: 3081470 - RNA, 16 nt, Human
gccagauuucacucuc

SEQ ID NO: 3081471 - RNA, 18 nt, Human
gccagauuucacucuccu

SEQ ID NO: 3081472 - RNA, 21 nt, Human
gccagauuucacucuccuugg

SEQ ID NO: 3081473 - RNA, 23 nt, Human
gccagggacagaggggguggccu

SEQ ID NO: 3081474 - RNA, 15 nt, Human
gccaggcuggucuca

SEQ ID NO: 3081475 - RNA, 16 nt, Human
gccagggacagagggg

SEQ ID NO: 3081476 - RNA, 18 nt, Human
gccagggacagagggggu

SEQ ID NO: 3081477 - RNA, 13 nt, Human
gccagggacagag

SEQ ID NO: 3081478 - RNA, 17 nt, Human
gccagucaccccggcca

SEQ ID NO: 3081479 - RNA, 18 nt, Human
gccagucaccccggccac

SEQ ID NO: 3081480 - RNA, 20 nt, Human
gccagucaccccggccaccu

SEQ ID NO: 3081481 - RNA, 17 nt, Human
gccagguuuuuggucug

SEQ ID NO: 3081482 - RNA, 16 nt, Human
gccauuuguguuuaua

SEQ ID NO: 3081483 - RNA, 23 nt, Human
gccaugggacagggaggacgcuc

SEQ ID NO: 3081484 - RNA, 22 nt, Human
gccaugggacagggaggacgcu

SEQ ID NO: 3081485 - RNA, 18 nt, Human
gccaugaggaacaaggca

SEQ ID NO: 3081486 - RNA, 19 nt, Human
gccaugagccgcccaaggc

SEQ ID NO: 3081487 - RNA, 21 nt, Human
gccaugagccgcccaaggccu

SEQ ID NO: 3081488 - RNA, 18 nt, Human
gccaugagccgcccaagg

SEQ ID NO: 3081489 - RNA, 13 nt, Human
gccaugccagcuu

SEQ ID NO: 3081490 - RNA, 18 nt, Human
gccaugccagcuuaucuc

SEQ ID NO: 3081491 - RNA, 19 nt, Human
gccaugccagcuuaucuca

SEQ ID NO: 3081492 - RNA, 24 nt, Human
gccaugcuccuggcccacugcauc

SEQ ID NO: 3081493 - RNA, 23 nt, Human
gccauccuggcccagggcaucug

SEQ ID NO: 3081494 - RNA, 14 nt, Human
gccagugccugggu

SEQ ID NO: 3081495 - RNA, 13 nt, Human
gccagugccuggg

SEQ ID NO: 3081496 - RNA, 12 nt, Human
gccagugccugg

SEQ ID NO: 3081497 - RNA, 20 nt, Human
gcccagagggccugcaaggg

SEQ ID NO: 3081498 - RNA, 21 nt, Human
gcccagagggccugcaaggga

SEQ ID NO: 3081499 - RNA, 22 nt, Human
gcccagagggccugcaagggag

SEQ ID NO: 3081500 - RNA, 11 nt, Human
gcccagccccu

SEQ ID NO: 3081501 - RNA, 12 nt, Human
gcccagccccuu

SEQ ID NO: 3081502 - RNA, 9 nt, Human
gcccagccc

SEQ ID NO: 3081503 - RNA, 14 nt, Human
gcccagagggccug

SEQ ID NO: 3081504 - RNA, 15 nt, Human
gcccagagggccugc

SEQ ID NO: 3081505 - RNA, 18 nt, Human
gcccagagggccugcaag

SEQ ID NO: 3081506 - RNA, 19 nt, Human
gcccagagggccugcaagg

SEQ ID NO: 3081507 - RNA, 12 nt, Human
gcccagagggcc

SEQ ID NO: 3081508 - RNA, 21 nt, Human
gcccaaugcacuuuguucugg

SEQ ID NO: 3081509 - RNA, 18 nt, Human
gcccaggaaaggcuccag

SEQ ID NO: 3081510 - RNA, 19 nt, Human
gcccaggaaaggcuccagg

SEQ ID NO: 3081511 - RNA, 20 nt, Human
gcccaggaaaggcuccagga

SEQ ID NO: 3081512 - RNA, 20 nt, Human
gcccaggcuggcgugcagug

SEQ ID NO: 3081513 - RNA, 19 nt, Human
gcccaggcuggcgugcagu

SEQ ID NO: 3081514 - RNA, 22 nt, Human
gcccaggcuggcgugcaguggu

SEQ ID NO: 3081515 - RNA, 19 nt, Human
gcccaggcuuagucacuga

SEQ ID NO: 3081516 - RNA, 21 nt, Human
gcccaggcuuagucacugaga

SEQ ID NO: 3081517 - RNA, 23 nt, Human
gcccaggcuuagucacugagaca

SEQ ID NO: 3081518 - RNA, 19 nt, Human
gcccagucuggaaugcagu

SEQ ID NO: 3081519 - RNA, 15 nt, Human
gcccaguugggugga

SEQ ID NO: 3081520 - RNA, 13 nt, Human
gcccagccccuuc

SEQ ID NO: 3081521 - RNA, 14 nt, Human
gcccagccccuucu

SEQ ID NO: 3081522 - RNA, 16 nt, Human
gcccagccccuucuga

SEQ ID NO: 3081523 - RNA, 17 nt, Human
gcccagccccuucugac

SEQ ID NO: 3081524 - RNA, 20 nt, Human
gcccagccccuucugaccca

SEQ ID NO: 3081525 - RNA, 24 nt, Human
gcccagccccuucugacccaugcu

SEQ ID NO: 3081526 - RNA, 14 nt, Human
gcccagccuggaug

SEQ ID NO: 3081527 - RNA, 16 nt, Human
gcccagccuggaugcc

SEQ ID NO: 3081528 - RNA, 16 nt, Human
gccacaagacccuugu

SEQ ID NO: 3081529 - RNA, 22 nt, Human
gccacaagacccuugugguccc

SEQ ID NO: 3081530 - RNA, 20 nt, Human
gccacagagaaaguacuucu

SEQ ID NO: 3081531 - RNA, 14 nt, Human
gccacagagaaagu

SEQ ID NO: 3081532 - RNA, 13 nt, Human
gccacagagaaag

SEQ ID NO: 3081533 - RNA, 19 nt, Human
gccacaccucuaucccggc

SEQ ID NO: 3081534 - RNA, 23 nt, Human
gccacagagaaaguacuucucca

SEQ ID NO: 3081535 - RNA, 23 nt, Human
gcauuuggugguuucagaaaugu

SEQ ID NO: 3081536 - RNA, 22 nt, Human
gcauuuggugguuucagaaaug

SEQ ID NO: 3081537 - RNA, 20 nt, Human
gcauuugaggucuguucuuu

SEQ ID NO: 3081538 - RNA, 19 nt, Human
gcauuugaggucuguucuu

SEQ ID NO: 3081539 - RNA, 21 nt, Human
gccaaggcugggggaagaagc

SEQ ID NO: 3081540 - RNA, 23 nt, Human
gccaaggugggaggauugcuuga

SEQ ID NO: 3081541 - RNA, 14 nt, Human
gccaaggugggagg

SEQ ID NO: 3081542 - RNA, 15 nt, Human
gccaaggugggagga

SEQ ID NO: 3081543 - RNA, 14 nt, Human
gccaccugcggugc

SEQ ID NO: 3081544 - RNA, 20 nt, Human
gccaccugcggugcuaucuc

SEQ ID NO: 3081545 - RNA, 22 nt, Human
gccaccugcggugcuaucuccc

SEQ ID NO: 3081546 - RNA, 19 nt, Human
gccacggccaggccagagg

SEQ ID NO: 3081547 - RNA, 17 nt, Human
gccacggccaggccaga

SEQ ID NO: 3081548 - RNA, 18 nt, Human
gccacggccaggccagag

SEQ ID NO: 3081549 - RNA, 13 nt, Human
gccaccgccuugc

SEQ ID NO: 3081550 - RNA, 16 nt, Human
gccaccgccuugccca

SEQ ID NO: 3081551 - RNA, 20 nt, Human
gccaccgccuugcccagccu

SEQ ID NO: 3081552 - RNA, 17 nt, Human
gccaccugccuguuggg

SEQ ID NO: 3081553 - RNA, 20 nt, Human
gccagagacacaagccuucg

SEQ ID NO: 3081554 - RNA, 10 nt, Human
gccagaggag

SEQ ID NO: 3081555 - RNA, 17 nt, Human
gccagagacacaagccu

SEQ ID NO: 3081556 - RNA, 19 nt, Human
gccagagacacaagccuuc

SEQ ID NO: 3081557 - RNA, 16 nt, Human
gccagagacacaagcc

SEQ ID NO: 3081558 - RNA, 19 nt, Human
gccagacuggcacaguuuu

SEQ ID NO: 3081559 - RNA, 18 nt, Human
gccagacuggcacaguuu

SEQ ID NO: 3081560 - RNA, 15 nt, Human
gccagacuggcacag

SEQ ID NO: 3081561 - RNA, 18 nt, Human
gccagaugcaccagcccu

SEQ ID NO: 3081562 - RNA, 17 nt, Human
gccagaugcaccagccc

SEQ ID NO: 3081563 - RNA, 16 nt, Human
gccagaugcaccagcc

SEQ ID NO: 3081564 - RNA, 23 nt, Human
gccagagggagugacagaggcag

SEQ ID NO: 3081565 - RNA, 12 nt, Human
gccagaggagag

SEQ ID NO: 3081566 - RNA, 13 nt, Human
gccagaggagaga

SEQ ID NO: 3081567 - RNA, 15 nt, Human
gccagaggagagagg

SEQ ID NO: 3081568 - RNA, 17 nt, Human
gccagaggagagaggac

SEQ ID NO: 3081569 - RNA, 19 nt, Human
gccagaggagagaggaccc

SEQ ID NO: 3081570 - RNA, 22 nt, Human
gccagaggagagaggacccccu

SEQ ID NO: 3081571 - RNA, 22 nt, Human
gccagagggagugacagaggca

SEQ ID NO: 3081572 - RNA, 21 nt, Human
gccagagggagugacagaggc

SEQ ID NO: 3081573 - RNA, 12 nt, Human
gaggauguucug

SEQ ID NO: 3081574 - RNA, 20 nt, Human
gaggauguucugggacacag

SEQ ID NO: 3081575 - RNA, 17 nt, Human
gaggauguucugggaca

SEQ ID NO: 3081576 - RNA, 16 nt, Human
gaggauugcuugagcu

SEQ ID NO: 3081577 - RNA, 23 nt, Human
gaggaguuugggguaugggagag

SEQ ID NO: 3081578 - RNA, 13 nt, Human
gaggcagccccau

SEQ ID NO: 3081579 - RNA, 19 nt, Human
gaggcagagguugcaguga

SEQ ID NO: 3081580 - RNA, 22 nt, Human
gaggcagccccauucugccugc

SEQ ID NO: 3081581 - RNA, 21 nt, Human
gaggcagccccauucugccug

SEQ ID NO: 3081582 - RNA, 23 nt, Human
gaggcagccccauucugccugcc

SEQ ID NO: 3081583 - RNA, 13 nt, Human
gaggccagccuug

SEQ ID NO: 3081584 - RNA, 12 nt, Human
gaggccagccuu

SEQ ID NO: 3081585 - RNA, 23 nt, Human
gaggacagggaggugaccccagg

SEQ ID NO: 3081586 - RNA, 22 nt, Human
gaggacagggaggugaccccag

SEQ ID NO: 3081587 - RNA, 13 nt, Human
gaggacagggagg

SEQ ID NO: 3081588 - RNA, 15 nt, Human
gaggaauccagaccc

SEQ ID NO: 3081589 - RNA, 22 nt, Human
gaggaaggaaacccagcucugg

SEQ ID NO: 3081590 - RNA, 14 nt, Human
gaggaauccagacc

SEQ ID NO: 3081591 - RNA, 23 nt, Human
gaggcccuucucuccagccccug

SEQ ID NO: 3081592 - RNA, 24 nt, Human
gaggcccuucucuccagccccugg

SEQ ID NO: 3081593 - RNA, 22 nt, Human
gaggcccuucucuccagccccu

SEQ ID NO: 3081594 - RNA, 14 nt, Human
gaggccuucucuga

SEQ ID NO: 3081595 - RNA, 19 nt, Human
gaggcggaucuuuggacag

SEQ ID NO: 3081596 - RNA, 13 nt, Human
gaggcugggcucc

SEQ ID NO: 3081597 - RNA, 14 nt, Human
gaggcugggcuccc

SEQ ID NO: 3081598 - RNA, 15 nt, Human
gaggcugggcucccu

SEQ ID NO: 3081599 - RNA, 15 nt, Human
gagggagggagggcu

SEQ ID NO: 3081600 - RNA, 15 nt, Human
gagggagggcuccag

SEQ ID NO: 3081601 - RNA, 14 nt, Human
gagggagggagggc

SEQ ID NO: 3081602 - RNA, 14 nt, Human
gagggagugacaga

SEQ ID NO: 3081603 - RNA, 14 nt, Human
gagggagguaagga

SEQ ID NO: 3081604 - RNA, 13 nt, Human
gagggagugacag

SEQ ID NO: 3081605 - RNA, 14 nt, Human
gagggcacagaaaa

SEQ ID NO: 3081606 - RNA, 22 nt, Human
gagggcacagaaaauggaagac

SEQ ID NO: 3081607 - RNA, 23 nt, Human
gagggcacagaaaauggaagaca

SEQ ID NO: 3081608 - RNA, 22 nt, Human
gaggggccucuuaugggcuggg

SEQ ID NO: 3081609 - RNA, 12 nt, Human
gaggggccucuu

SEQ ID NO: 3081610 - RNA, 13 nt, Human
gagcaaagcugau

SEQ ID NO: 3081611 - RNA, 19 nt, Human
gagcaaaaucgaugcagug

SEQ ID NO: 3081612 - RNA, 21 nt, Human
gagcaagacgcugugcugccc

SEQ ID NO: 3081613 - RNA, 18 nt, Human
gagcaagacgcugugcug

SEQ ID NO: 3081614 - RNA, 22 nt, Human
gagcaagacgcugugcugcccu

SEQ ID NO: 3081615 - RNA, 17 nt, Human
gagcaccuuagacaguc

SEQ ID NO: 3081616 - RNA, 15 nt, Human
gagcacacuggcuca

SEQ ID NO: 3081617 - RNA, 20 nt, Human
gagaucaaccccuucgcucc

SEQ ID NO: 3081618 - RNA, 14 nt, Human
gagaucagccuggg

SEQ ID NO: 3081619 - RNA, 16 nt, Human
gagaucagccugggca

SEQ ID NO: 3081620 - RNA, 13 nt, Human
gagaucagccugg

SEQ ID NO: 3081621 - RNA, 13 nt, Human
gagauccuggacu

SEQ ID NO: 3081622 - RNA, 20 nt, Human
gagccacugcaccgggccac

SEQ ID NO: 3081623 - RNA, 21 nt, Human
gagcaggcuacugucagcucc

SEQ ID NO: 3081624 - RNA, 18 nt, Human
gagcagccacauuccuga

SEQ ID NO: 3081625 - RNA, 12 nt, Human
gagcccacgccc

SEQ ID NO: 3081626 - RNA, 15 nt, Human
gagcccacgccccca

SEQ ID NO: 3081627 - RNA, 16 nt, Human
gagcccacgcccccac

SEQ ID NO: 3081628 - RNA, 12 nt, Human
gagcccaggccu

SEQ ID NO: 3081629 - RNA, 13 nt, Human
gagcccaggccuc

SEQ ID NO: 3081630 - RNA, 14 nt, Human
gagcccaggccucc

SEQ ID NO: 3081631 - RNA, 11 nt, Human
gagcccacgcc

SEQ ID NO: 3081632 - RNA, 23 nt, Human
gagccauuugucccaagugccaa

SEQ ID NO: 3081633 - RNA, 18 nt, Human
gagccauuugucccaagu

SEQ ID NO: 3081634 - RNA, 19 nt, Human
gagccauuugucccaagug

SEQ ID NO: 3081635 - RNA, 20 nt, Human
gagccauuugucccaagugc

SEQ ID NO: 3081636 - RNA, 22 nt, Human
gagccauuugucccaagugcca

SEQ ID NO: 3081637 - RNA, 15 nt, Human
gagccauuuguccca

SEQ ID NO: 3081638 - RNA, 16 nt, Human
gagccauuugucccaa

SEQ ID NO: 3081639 - RNA, 17 nt, Human
gagccauuugucccaag

SEQ ID NO: 3081640 - RNA, 22 nt, Human
gagccacugcaccgggccacag

SEQ ID NO: 3081641 - RNA, 20 nt, Human
gagccuccugcccuuaccug

SEQ ID NO: 3081642 - RNA, 22 nt, Human
gagccuccugcccuuaccugcc

SEQ ID NO: 3081643 - RNA, 17 nt, Human
gagcccugguggcagug

SEQ ID NO: 3081644 - RNA, 19 nt, Human
gagccucagcauccuggca

SEQ ID NO: 3081645 - RNA, 16 nt, Human
gagcccugguggcagu

SEQ ID NO: 3081646 - RNA, 15 nt, Human
gagcccugguggcag

SEQ ID NO: 3081647 - RNA, 14 nt, Human
gagccuccugcccu

SEQ ID NO: 3081648 - RNA, 21 nt, Human
gagccucagcauccuggcacc

SEQ ID NO: 3081649 - RNA, 20 nt, Human
gagccucagcauccuggcac

SEQ ID NO: 3081650 - RNA, 12 nt, Human
gagcuacaaaug

SEQ ID NO: 3081651 - RNA, 13 nt, Human
gagcuacaaaugc

SEQ ID NO: 3081652 - RNA, 13 nt, Human
gagccugggaggu

SEQ ID NO: 3081653 - RNA, 21 nt, Human
gagccugggaggucaaggcug

SEQ ID NO: 3081654 - RNA, 10 nt, Human
gagccuggca

SEQ ID NO: 3081655 - RNA, 15 nt, Human
gagccuggcaagaau

SEQ ID NO: 3081656 - RNA, 14 nt, Human
gagcuacaaaugca

SEQ ID NO: 3081657 - RNA, 23 nt, Human
gagcuacacaggggaaaagagga

SEQ ID NO: 3081658 - RNA, 15 nt, Human
gagcugccaccugcc

SEQ ID NO: 3081659 - RNA, 16 nt, Human
gagcugccaccugccu

SEQ ID NO: 3081660 - RNA, 13 nt, Human
gagcugccaccug

SEQ ID NO: 3081661 - RNA, 19 nt, Human
gauucaacagguuuuccug

SEQ ID NO: 3081662 - RNA, 19 nt, Human
gauuaaccacuucagcuga

SEQ ID NO: 3081663 - RNA, 21 nt, Human
gauuaaccacuucagcugacu

SEQ ID NO: 3081664 - RNA, 18 nt, Human
gauuaaccacuucagcug

SEQ ID NO: 3081665 - RNA, 19 nt, Human
gauuaaauucuugcaaagu

SEQ ID NO: 3081666 - RNA, 12 nt, Human
gauuaaauucuu

SEQ ID NO: 3081667 - RNA, 15 nt, Human
gauguuuuccaugag

SEQ ID NO: 3081668 - RNA, 23 nt, Human
gauguuuuccaugaguccccugu

SEQ ID NO: 3081669 - RNA, 14 nt, Human
gauguuuuccauga

SEQ ID NO: 3081670 - RNA, 21 nt, Human
gauguuuuaaggaugcuugua

SEQ ID NO: 3081671 - RNA, 21 nt, Human
gauguucuuucacccuuuucu

SEQ ID NO: 3081672 - RNA, 16 nt, Human
gauguucugggacaca

SEQ ID NO: 3081673 - RNA, 14 nt, Human
gauguucugggaca

SEQ ID NO: 3081674 - RNA, 23 nt, Human
gauggugcaaugaccuuucaaua

SEQ ID NO: 3081675 - RNA, 20 nt, Human
gauggugcaaugaccuuuca

SEQ ID NO: 3081676 - RNA, 18 nt, Human
gaugggccaccgccuugc

SEQ ID NO: 3081677 - RNA, 12 nt, Human
gauucagacagc

SEQ ID NO: 3081678 - RNA, 22 nt, Human
gauucccaagcucugcuccucu

SEQ ID NO: 3081679 - RNA, 21 nt, Human
gauucccaagcucugcuccuc

SEQ ID NO: 3081680 - RNA, 23 nt, Human
gauugacgggacuguugguauug

SEQ ID NO: 3081681 - RNA, 18 nt, Human
gauugcuugagcucagga

SEQ ID NO: 3081682 - RNA, 15 nt, Human
gauuguccccgaccc

SEQ ID NO: 3081683 - RNA, 20 nt, Human
gauuguccccgacccuugcc

SEQ ID NO: 3081684 - RNA, 13 nt, Human
gauugugccccug

SEQ ID NO: 3081685 - RNA, 18 nt, Human
gaugcaguucugaagaag

SEQ ID NO: 3081686 - RNA, 14 nt, Human
gaugacuauggaaa

SEQ ID NO: 3081687 - RNA, 20 nt, Human
gaugaccuugaaugaugcca

SEQ ID NO: 3081688 - RNA, 11 nt, Human
gaugagaaagg

SEQ ID NO: 3081689 - RNA, 22 nt, Human
gaugagaaagguugaagcacca

SEQ ID NO: 3081690 - RNA, 21 nt, Human
gaugccuggcgggguggggug

SEQ ID NO: 3081691 - RNA, 22 nt, Human
gaugcuagaacucccuuucaac

SEQ ID NO: 3081692 - RNA, 22 nt, Human
gaugggcaacccccagccugcu

SEQ ID NO: 3081693 - RNA, 16 nt, Human
gaugggaaagcauugu

SEQ ID NO: 3081694 - RNA, 16 nt, Human
gaucuucaucugacua

SEQ ID NO: 3081695 - RNA, 18 nt, Human
gauccucccaccucagcc

SEQ ID NO: 3081696 - RNA, 23 nt, Human
gaucuucaucugacuaugacaua

SEQ ID NO: 3081697 - RNA, 13 nt, Human
gaucuuuaaaaua

SEQ ID NO: 3081698 - RNA, 14 nt, Human
gaucuuuaaaauac

SEQ ID NO: 3081699 - RNA, 16 nt, Human
gaucuuugcagacagg

SEQ ID NO: 3081700 - RNA, 15 nt, Human
gaugaaaaaauaaca

SEQ ID NO: 3081701 - RNA, 13 nt, Human
gauccugagccag

SEQ ID NO: 3081702 - RNA, 14 nt, Human
gauccugagccaga

SEQ ID NO: 3081703 - RNA, 15 nt, Human
gauccugagccagau

SEQ ID NO: 3081704 - RNA, 19 nt, Human
gauccugagccagauuuca

SEQ ID NO: 3081705 - RNA, 20 nt, Human
gauccucccaccucagccuc

SEQ ID NO: 3081706 - RNA, 12 nt, Human
gauccuccaggu

SEQ ID NO: 3081707 - RNA, 19 nt, Human
gauccucccaccucagccu

SEQ ID NO: 3081708 - RNA, 11 nt, Human
gauccuccagg

SEQ ID NO: 3081709 - RNA, 18 nt, Human
gauccuaggcauuugcug

SEQ ID NO: 3081710 - RNA, 18 nt, Human
gauccuaguuccaccauc

SEQ ID NO: 3081711 - RNA, 15 nt, Human
gaucacgccacugca

SEQ ID NO: 3081712 - RNA, 14 nt, Human
gaucacgccacugc

SEQ ID NO: 3081713 - RNA, 13 nt, Human
gaucacgccacug

SEQ ID NO: 3081714 - RNA, 23 nt, Human
gaucaaccccuucgcuccugugu

SEQ ID NO: 3081715 - RNA, 21 nt, Human
gaguugaaaaucuuauaauuu

SEQ ID NO: 3081716 - RNA, 13 nt, Human
gaguucugguucc

SEQ ID NO: 3081717 - RNA, 17 nt, Human
gagugugccugaagucc

SEQ ID NO: 3081718 - RNA, 23 nt, Human
gaguucaucuugaauuguaagga

SEQ ID NO: 3081719 - RNA, 20 nt, Human
gaguucaucuugaauuguaa

SEQ ID NO: 3081720 - RNA, 15 nt, Human
gagucugaaggcugg

SEQ ID NO: 3081721 - RNA, 19 nt, Human
gagugaacaaauuuacaga

SEQ ID NO: 3081722 - RNA, 22 nt, Human
gagugaacaaauuuacagagac

SEQ ID NO: 3081723 - RNA, 12 nt, Human
gagugggcccaa

SEQ ID NO: 3081724 - RNA, 19 nt, Human
gagugucuuaauuaaaaga

SEQ ID NO: 3081725 - RNA, 21 nt, Human
gauauaaguguguguuuuuca

SEQ ID NO: 3081726 - RNA, 17 nt, Human
gauauaaguguguguuu

SEQ ID NO: 3081727 - RNA, 13 nt, Human
gauagccaaggcc

SEQ ID NO: 3081728 - RNA, 16 nt, Human
gauagcacagacccug

SEQ ID NO: 3081729 - RNA, 12 nt, Human
gauagccaaggc

SEQ ID NO: 3081730 - RNA, 19 nt, Human
gauagcacagacccugccc

SEQ ID NO: 3081731 - RNA, 13 nt, Human
gauagcagggcau

SEQ ID NO: 3081732 - RNA, 22 nt, Human
gaucaaccccuucgcuccugug

SEQ ID NO: 3081733 - RNA, 21 nt, Human
gaucaaccccuucgcuccugu

SEQ ID NO: 3081734 - RNA, 23 nt, Human
gauauaugcucugcauguuacau

SEQ ID NO: 3081735 - RNA, 21 nt, Human
gauaaucagugugucuaaauu

SEQ ID NO: 3081736 - RNA, 17 nt, Human
gauacaaaagcauguga

SEQ ID NO: 3081737 - RNA, 17 nt, Human
gauagcacagacccugc

SEQ ID NO: 3081738 - RNA, 18 nt, Human
gauagcacagacccugcc

SEQ ID NO: 3081739 - RNA, 18 nt, Human
gauacaaugcugugcccu

SEQ ID NO: 3081740 - RNA, 13 nt, Human
gauacaaugcugu

SEQ ID NO: 3081741 - RNA, 14 nt, Human
gagguucccuuuga

SEQ ID NO: 3081742 - RNA, 19 nt, Human
gagguucaaagauauuuug

SEQ ID NO: 3081743 - RNA, 16 nt, Human
gaguacguugugcauu

SEQ ID NO: 3081744 - RNA, 19 nt, Human
gagguuuuaaaaaaauccc

SEQ ID NO: 3081745 - RNA, 20 nt, Human
gaguacguugugcauuuggu

SEQ ID NO: 3081746 - RNA, 15 nt, Human
gaguacuacaguccu

SEQ ID NO: 3081747 - RNA, 18 nt, Human
gaguacguugugcauuug

SEQ ID NO: 3081748 - RNA, 17 nt, Human
gaguacguugugcauuu

SEQ ID NO: 3081749 - RNA, 18 nt, Human
gaguacuacaguccuccc

SEQ ID NO: 3081750 - RNA, 19 nt, Human
gaguacuacaguccuccca

SEQ ID NO: 3081751 - RNA, 21 nt, Human
gaggugggauccuccaggugc

SEQ ID NO: 3081752 - RNA, 22 nt, Human
gaggugggauccuccaggugca

SEQ ID NO: 3081753 - RNA, 18 nt, Human
gaggugggauccuccagg

SEQ ID NO: 3081754 - RNA, 15 nt, Human
gaggggggagguggg

SEQ ID NO: 3081755 - RNA, 15 nt, Human
gaggggguggccucc

SEQ ID NO: 3081756 - RNA, 22 nt, Human
gaggggggaggugggauccucc

SEQ ID NO: 3081757 - RNA, 17 nt, Human
gagucgaggacagggag

SEQ ID NO: 3081758 - RNA, 16 nt, Human
gagucgaggacaggga

SEQ ID NO: 3081759 - RNA, 21 nt, Human
gagucucacuguugcccaggc

SEQ ID NO: 3081760 - RNA, 20 nt, Human
gagucucacuguugcccagg

SEQ ID NO: 3081761 - RNA, 19 nt, Human
gagucucacuguugcccag

SEQ ID NO: 3081762 - RNA, 23 nt, Human
gagucucacuguugcccaggcug

SEQ ID NO: 3081763 - RNA, 22 nt, Human
gagucucacuguugcccaggcu

SEQ ID NO: 3081764 - RNA, 21 nt, Human
gagucugaaggcuggguucug

SEQ ID NO: 3081765 - RNA, 18 nt, Human
gaguauuuuugacagaau

SEQ ID NO: 3081766 - RNA, 21 nt, Human
gagucccaccuuggcugcagg

SEQ ID NO: 3081767 - RNA, 14 nt, Human
gaguauuuuugaca

SEQ ID NO: 3081768 - RNA, 16 nt, Human
gaguauuuuugacaga

SEQ ID NO: 3081769 - RNA, 17 nt, Human
gaguauuuuugacagaa

SEQ ID NO: 3081770 - RNA, 14 nt, Human
gaguagcugggacu

SEQ ID NO: 3081771 - RNA, 12 nt, Human
gaguagcuggga

SEQ ID NO: 3081772 - RNA, 14 nt, Human
gaguccccuguuug

SEQ ID NO: 3081773 - RNA, 23 nt, Human
gaguccccuguuuguuucugaaa

SEQ ID NO: 3081774 - RNA, 12 nt, Human
gaguccccuguu

SEQ ID NO: 3081775 - RNA, 17 nt, Human
cugauugugucucuugg

SEQ ID NO: 3081776 - RNA, 17 nt, Human
cugauggugcaaugacc

SEQ ID NO: 3081777 - RNA, 19 nt, Human
cugauggugcaaugaccuu

SEQ ID NO: 3081778 - RNA, 20 nt, Human
cugauggugcaaugaccuuu

SEQ ID NO: 3081779 - RNA, 21 nt, Human
cugauggugcaaugaccuuuc

SEQ ID NO: 3081780 - RNA, 21 nt, Human
cugauugugucucuugguccu

SEQ ID NO: 3081781 - RNA, 16 nt, Human
cugauuuuuuuuuccu

SEQ ID NO: 3081782 - RNA, 18 nt, Human
cugauuuuuuuuuccuuc

SEQ ID NO: 3081783 - RNA, 19 nt, Human
cugauuuuuuuuuccuuca

SEQ ID NO: 3081784 - RNA, 20 nt, Human
cugauuuuuuuuuccuucag

SEQ ID NO: 3081785 - RNA, 21 nt, Human
cugauuuuuuuuuccuucagu

SEQ ID NO: 3081786 - RNA, 22 nt, Human
cugauuuuuuuuuccuucagug

SEQ ID NO: 3081787 - RNA, 23 nt, Human
cugauuuuuuuuuccuucagugc

SEQ ID NO: 3081788 - RNA, 18 nt, Human
cugcaauaaggggagagu

SEQ ID NO: 3081789 - RNA, 22 nt, Human
cugcacaagcugcacccucagg

SEQ ID NO: 3081790 - RNA, 18 nt, Human
cugcacaagcugcacccu

SEQ ID NO: 3081791 - RNA, 19 nt, Human
cugcacagcaggcugccag

SEQ ID NO: 3081792 - RNA, 18 nt, Human
cugcacagcaggcugcca

SEQ ID NO: 3081793 - RNA, 16 nt, Human
cugcacuccccugcug

SEQ ID NO: 3081794 - RNA, 17 nt, Human
cugcacuccccugcugg

SEQ ID NO: 3081795 - RNA, 18 nt, Human
cugcacuugcagacucua

SEQ ID NO: 3081796 - RNA, 13 nt, Human
cugcacccucagg

SEQ ID NO: 3081797 - RNA, 14 nt, Human
cugcacccucaggc

SEQ ID NO: 3081798 - RNA, 20 nt, Human
cugcaccggcuggccuggcc

SEQ ID NO: 3081799 - RNA, 22 nt, Human
cugcaccggcuggccuggcccc

SEQ ID NO: 3081800 - RNA, 14 nt, Human
cugcacuccccugc

SEQ ID NO: 3081801 - RNA, 15 nt, Human
cugcacuccccugcu

SEQ ID NO: 3081802 - RNA, 23 nt, Human
cugcaccggcuggccuggccccu

SEQ ID NO: 3081803 - RNA, 12 nt, Human
cugcaccgggcc

SEQ ID NO: 3081804 - RNA, 22 nt, Human
cugagugggggaucacagccuc

SEQ ID NO: 3081805 - RNA, 18 nt, Human
cugagucugaaggcuggg

SEQ ID NO: 3081806 - RNA, 19 nt, Human
cugagucugaaggcugggu

SEQ ID NO: 3081807 - RNA, 17 nt, Human
cugagucugaaggcugg

SEQ ID NO: 3081808 - RNA, 21 nt, Human
cugauaaagaugagugagcau

SEQ ID NO: 3081809 - RNA, 20 nt, Human
cugauccuaguuccaccauc

SEQ ID NO: 3081810 - RNA, 21 nt, Human
cugauccuaguuccaccauca

SEQ ID NO: 3081811 - RNA, 15 nt, Human
cugauggugcaauga

SEQ ID NO: 3081812 - RNA, 16 nt, Human
cugauggugcaaugac

SEQ ID NO: 3081813 - RNA, 14 nt, Human
cugauggugcaaug

SEQ ID NO: 3081814 - RNA, 22 nt, Human
cugauacagaaaaguugaauuu

SEQ ID NO: 3081815 - RNA, 24 nt, Human
cugaggcccuucucuccagccccu

SEQ ID NO: 3081816 - RNA, 15 nt, Human
cugaggcuccacuug

SEQ ID NO: 3081817 - RNA, 21 nt, Human
cugaggcuccacuuggucugu

SEQ ID NO: 3081818 - RNA, 15 nt, Human
cugaggcugggcucc

SEQ ID NO: 3081819 - RNA, 16 nt, Human
cugaggcugggcuccc

SEQ ID NO: 3081820 - RNA, 17 nt, Human
cugaggcugggcucccu

SEQ ID NO: 3081821 - RNA, 22 nt, Human
cugaggcugggcucccuuccca

SEQ ID NO: 3081822 - RNA, 13 nt, Human
cugaggcugggcu

SEQ ID NO: 3081823 - RNA, 11 nt, Human
cugccaggcau

SEQ ID NO: 3081824 - RNA, 13 nt, Human
cugccaggcaugg

SEQ ID NO: 3081825 - RNA, 14 nt, Human
cugcccaccuggcc

SEQ ID NO: 3081826 - RNA, 15 nt, Human
cugcccaccuggccu

SEQ ID NO: 3081827 - RNA, 13 nt, Human
cugcccaccuggc

SEQ ID NO: 3081828 - RNA, 14 nt, Human
cugccaugccagcu

SEQ ID NO: 3081829 - RNA, 17 nt, Human
cugcccaccuggccucu

SEQ ID NO: 3081830 - RNA, 18 nt, Human
cugcccaccuggccucug

SEQ ID NO: 3081831 - RNA, 19 nt, Human
cugcccaccuggccucugc

SEQ ID NO: 3081832 - RNA, 20 nt, Human
cugcccaccuggccucugca

SEQ ID NO: 3081833 - RNA, 22 nt, Human
cugcccaccuggccucugcacu

SEQ ID NO: 3081834 - RNA, 14 nt, Human
cugcccacucccug

SEQ ID NO: 3081835 - RNA, 15 nt, Human
cugcccacucccugc

SEQ ID NO: 3081836 - RNA, 16 nt, Human
cugcccacucccugca

SEQ ID NO: 3081837 - RNA, 18 nt, Human
cugcccacucccugcaac

SEQ ID NO: 3081838 - RNA, 21 nt, Human
cugcaguugccagucaccccg

SEQ ID NO: 3081839 - RNA, 22 nt, Human
cugcaguugccagucaccccgg

SEQ ID NO: 3081840 - RNA, 17 nt, Human
cugcaguugccagucac

SEQ ID NO: 3081841 - RNA, 20 nt, Human
cugcaucagcugcugaaaca

SEQ ID NO: 3081842 - RNA, 19 nt, Human
cugcaguugccagucaccc

SEQ ID NO: 3081843 - RNA, 23 nt, Human
cugcacuugcagacucuacagag

SEQ ID NO: 3081844 - RNA, 16 nt, Human
cugcaucguuucaucu

SEQ ID NO: 3081845 - RNA, 22 nt, Human
cugcaucguuucaucuuccaac

SEQ ID NO: 3081846 - RNA, 18 nt, Human
cugccaaugggagcucau

SEQ ID NO: 3081847 - RNA, 19 nt, Human
cugccaaugggagcucaug

SEQ ID NO: 3081848 - RNA, 18 nt, Human
cugcaugcgggcuuccuc

SEQ ID NO: 3081849 - RNA, 22 nt, Human
cugcaugcgggcuuccuccugg

SEQ ID NO: 3081850 - RNA, 18 nt, Human
cugccucucugcaggucc

SEQ ID NO: 3081851 - RNA, 17 nt, Human
cugccucucugcagguc

SEQ ID NO: 3081852 - RNA, 16 nt, Human
cugccucucugcaggu

SEQ ID NO: 3081853 - RNA, 15 nt, Human
cugccucucugcagg

SEQ ID NO: 3081854 - RNA, 14 nt, Human
cugccucagccucc

SEQ ID NO: 3081855 - RNA, 15 nt, Human
cugccucagccuccc

SEQ ID NO: 3081856 - RNA, 19 nt, Human
cugccucagccucccaaag

SEQ ID NO: 3081857 - RNA, 19 nt, Human
cugccgcagcccugcagag

SEQ ID NO: 3081858 - RNA, 20 nt, Human
cugccgcagcccugcagagg

SEQ ID NO: 3081859 - RNA, 21 nt, Human
cugccgcagcccugcagaggg

SEQ ID NO: 3081860 - RNA, 22 nt, Human
cugccgcagcccugcagagggc

SEQ ID NO: 3081861 - RNA, 23 nt, Human
cugccgcagcccugcagagggca

SEQ ID NO: 3081862 - RNA, 12 nt, Human
cugccgcagccc

SEQ ID NO: 3081863 - RNA, 13 nt, Human
cugccgcagcccu

SEQ ID NO: 3081864 - RNA, 14 nt, Human
cugccccugcacag

SEQ ID NO: 3081865 - RNA, 15 nt, Human
cugccccugcacagc

SEQ ID NO: 3081866 - RNA, 19 nt, Human
cugccccugcacagcaggc

SEQ ID NO: 3081867 - RNA, 21 nt, Human
cugccucugacacacagcucu

SEQ ID NO: 3081868 - RNA, 18 nt, Human
cugccucugacacacagc

SEQ ID NO: 3081869 - RNA, 15 nt, Human
cugccucugacacac

SEQ ID NO: 3081870 - RNA, 17 nt, Human
cugccucugacacacag

SEQ ID NO: 3081871 - RNA, 22 nt, Human
cugccugcccaggccccugcca

SEQ ID NO: 3081872 - RNA, 21 nt, Human
cugccugcccaggccccugcc

SEQ ID NO: 3081873 - RNA, 19 nt, Human
cugcggagcacacuggcuc

SEQ ID NO: 3081874 - RNA, 20 nt, Human
cugcggagcacacuggcuca

SEQ ID NO: 3081875 - RNA, 18 nt, Human
cugcgguccacccaggag

SEQ ID NO: 3081876 - RNA, 17 nt, Human
cugcgguccacccagga

SEQ ID NO: 3081877 - RNA, 20 nt, Human
cugcgguccacccaggagcc

SEQ ID NO: 3081878 - RNA, 19 nt, Human
cugcgguccacccaggagc

SEQ ID NO: 3081879 - RNA, 13 nt, Human
cugagccagauuu

SEQ ID NO: 3081880 - RNA, 14 nt, Human
cugagccagauuuc

SEQ ID NO: 3081881 - RNA, 16 nt, Human
cugagcaggauuuuaa

SEQ ID NO: 3081882 - RNA, 21 nt, Human
cugagacagcccgggcucugc

SEQ ID NO: 3081883 - RNA, 22 nt, Human
cugagacagcccgggcucugcc

SEQ ID NO: 3081884 - RNA, 20 nt, Human
cugagaugugaacacaucag

SEQ ID NO: 3081885 - RNA, 16 nt, Human
cugagaugugaacaca

SEQ ID NO: 3081886 - RNA, 20 nt, Human
cugagacagcccgggcucug

SEQ ID NO: 3081887 - RNA, 19 nt, Human
cugagacagcccgggcucu

SEQ ID NO: 3081888 - RNA, 20 nt, Human
cugagaaagacuauucaaac

SEQ ID NO: 3081889 - RNA, 19 nt, Human
cugagaaagacuauucaaa

SEQ ID NO: 3081890 - RNA, 21 nt, Human
cugagaugugaacacaucagc

SEQ ID NO: 3081891 - RNA, 18 nt, Human
cugacagacacaggcccg

SEQ ID NO: 3081892 - RNA, 17 nt, Human
cugacagacacaggccc

SEQ ID NO: 3081893 - RNA, 15 nt, Human
cugacagacacaggc

SEQ ID NO: 3081894 - RNA, 14 nt, Human
cugaauuucuuuug

SEQ ID NO: 3081895 - RNA, 16 nt, Human
cugaauuaugaaacuu

SEQ ID NO: 3081896 - RNA, 16 nt, Human
cugacagacacaggcc

SEQ ID NO: 3081897 - RNA, 23 nt, Human
cugacgacuugagugcucaguag

SEQ ID NO: 3081898 - RNA, 18 nt, Human
cugagaaagacuauucaa

SEQ ID NO: 3081899 - RNA, 15 nt, Human
cugagaaagacuauu

SEQ ID NO: 3081900 - RNA, 13 nt, Human
cugagaaagacua

SEQ ID NO: 3081901 - RNA, 12 nt, Human
cugagaaagacu

SEQ ID NO: 3081902 - RNA, 12 nt, Human
cugaauuauuuu

SEQ ID NO: 3081903 - RNA, 12 nt, Human
cugaauuucuuu

SEQ ID NO: 3081904 - RNA, 14 nt, Human
cugaauuaugaaac

SEQ ID NO: 3081905 - RNA, 15 nt, Human
cugaauuaugaaacu

SEQ ID NO: 3081906 - RNA, 13 nt, Human
cugaauuaugaaa

SEQ ID NO: 3081907 - RNA, 20 nt, Human
cugaaugguuuucaaaauaa

SEQ ID NO: 3081908 - RNA, 19 nt, Human
cugaaugguuuucaaaaua

SEQ ID NO: 3081909 - RNA, 18 nt, Human
cugaauggacuuugcaca

SEQ ID NO: 3081910 - RNA, 17 nt, Human
cugaagucacacaguga

SEQ ID NO: 3081911 - RNA, 19 nt, Human
cugaagucacacagugagu

SEQ ID NO: 3081912 - RNA, 18 nt, Human
cugaagucacacagugag

SEQ ID NO: 3081913 - RNA, 21 nt, Human
cugaagucacacagugagucg

SEQ ID NO: 3081914 - RNA, 16 nt, Human
cugaagucacacagug

SEQ ID NO: 3081915 - RNA, 22 nt, Human
cugaagucccagauacuugggg

SEQ ID NO: 3081916 - RNA, 17 nt, Human
cugaagucuuuguacag

SEQ ID NO: 3081917 - RNA, 20 nt, Human
cugaagucuuuguacagaca

SEQ ID NO: 3081918 - RNA, 17 nt, Human
cugaaguucagcugcau

SEQ ID NO: 3081919 - RNA, 23 nt, Human
cugaaagggacgcuacccgggaa

SEQ ID NO: 3081920 - RNA, 14 nt, Human
cucuuuucaaaaca

SEQ ID NO: 3081921 - RNA, 22 nt, Human
cucuuuggucuacacugugcug

SEQ ID NO: 3081922 - RNA, 23 nt, Human
cucuuuggucuacacugugcuga

SEQ ID NO: 3081923 - RNA, 16 nt, Human
cucuucuccaggcugu

SEQ ID NO: 3081924 - RNA, 17 nt, Human
cugaacaucacagcuua

SEQ ID NO: 3081925 - RNA, 20 nt, Human
cugaaauaaacgucuuaaau

SEQ ID NO: 3081926 - RNA, 20 nt, Human
cucuggauuauauuaugaag

SEQ ID NO: 3081927 - RNA, 19 nt, Human
cucuggauuauauuaugaa

SEQ ID NO: 3081928 - RNA, 20 nt, Human
cucugccucugacacacagc

SEQ ID NO: 3081929 - RNA, 19 nt, Human
cucugccucugacacacag

SEQ ID NO: 3081930 - RNA, 21 nt, Human
cucugccucccaucacccgcu

SEQ ID NO: 3081931 - RNA, 16 nt, Human
cucugccucugacaca

SEQ ID NO: 3081932 - RNA, 23 nt, Human
cucuggcagcucagagagggugg

SEQ ID NO: 3081933 - RNA, 20 nt, Human
cucuggcagcucagagaggg

SEQ ID NO: 3081934 - RNA, 21 nt, Human
cucuggccuucggccuccauc

SEQ ID NO: 3081935 - RNA, 22 nt, Human
cucuggccuucggccuccaucc

SEQ ID NO: 3081936 - RNA, 13 nt, Human
cucugucgcccag

SEQ ID NO: 3081937 - RNA, 17 nt, Human
cucugucgcccagucug

SEQ ID NO: 3081938 - RNA, 19 nt, Human
cucugucgcccagucugga

SEQ ID NO: 3081939 - RNA, 18 nt, Human
cucugucgcccagucugg

SEQ ID NO: 3081940 - RNA, 22 nt, Human
cucuguccugggagugagcugg

SEQ ID NO: 3081941 - RNA, 15 nt, Human
cucuguccugggagu

SEQ ID NO: 3081942 - RNA, 13 nt, Human
cucuguccuggga

SEQ ID NO: 3081943 - RNA, 14 nt, Human
cucuguccugggag

SEQ ID NO: 3081944 - RNA, 13 nt, Human
cucuucuccaggc

SEQ ID NO: 3081945 - RNA, 15 nt, Human
cucuucuccaggcug

SEQ ID NO: 3081946 - RNA, 23 nt, Human
cucugugucagguggggcagcuu

SEQ ID NO: 3081947 - RNA, 22 nt, Human
cucugugucagguggggcagcu

SEQ ID NO: 3081948 - RNA, 21 nt, Human
cucugugucagguggggcagc

SEQ ID NO: 3081949 - RNA, 20 nt, Human
cucugugucagguggggcag

SEQ ID NO: 3081950 - RNA, 19 nt, Human
cucugugucagguggggca

SEQ ID NO: 3081951 - RNA, 19 nt, Human
cucuuaagaagacugcauu

SEQ ID NO: 3081952 - RNA, 13 nt, Human
cucuuaagaagac

SEQ ID NO: 3081953 - RNA, 18 nt, Human
cucugcaggucccuaaua

SEQ ID NO: 3081954 - RNA, 21 nt, Human
cucugcaggucccuaauaaag

SEQ ID NO: 3081955 - RNA, 20 nt, Human
cucugcaggucccuaauaaa

SEQ ID NO: 3081956 - RNA, 19 nt, Human
cucugcaggucccuaauaa

SEQ ID NO: 3081957 - RNA, 14 nt, Human
cucugcacaagcug

SEQ ID NO: 3081958 - RNA, 15 nt, Human
cucugcacaagcugc

SEQ ID NO: 3081959 - RNA, 10 nt, Human
cucugcacaa

SEQ ID NO: 3081960 - RNA, 13 nt, Human
cucugcacaagcu

SEQ ID NO: 3081961 - RNA, 15 nt, Human
cucugauacagaaaa

SEQ ID NO: 3081962 - RNA, 18 nt, Human
cucugcccacucccugca

SEQ ID NO: 3081963 - RNA, 20 nt, Human
cucugcccacucccugcaac

SEQ ID NO: 3081964 - RNA, 13 nt, Human
cucugcccacucc

SEQ ID NO: 3081965 - RNA, 15 nt, Human
cucugcccacucccu

SEQ ID NO: 3081966 - RNA, 16 nt, Human
cucugcccacucccug

SEQ ID NO: 3081967 - RNA, 17 nt, Human
cucugcccacucccugc

SEQ ID NO: 3081968 - RNA, 12 nt, Human
cucugcccuugg

SEQ ID NO: 3081969 - RNA, 13 nt, Human
cucugccucccau

SEQ ID NO: 3081970 - RNA, 14 nt, Human
cucugccucccauc

SEQ ID NO: 3081971 - RNA, 16 nt, Human
cucugccucccaucac

SEQ ID NO: 3081972 - RNA, 17 nt, Human
cucugccucccaucacc

SEQ ID NO: 3081973 - RNA, 14 nt, Human
cucugaggacacua

SEQ ID NO: 3081974 - RNA, 12 nt, Human
cucugaggacac

SEQ ID NO: 3081975 - RNA, 20 nt, Human
cucugagacucgcgacaaug

SEQ ID NO: 3081976 - RNA, 23 nt, Human
cucugagacucgcgacaaugcaa

SEQ ID NO: 3081977 - RNA, 21 nt, Human
cucugagacucgcgacaaugc

SEQ ID NO: 3081978 - RNA, 23 nt, Human
cucugacagaagaaccccagggu

SEQ ID NO: 3081979 - RNA, 19 nt, Human
cucugacacacagcucugu

SEQ ID NO: 3081980 - RNA, 18 nt, Human
cucugacacacagcucug

SEQ ID NO: 3081981 - RNA, 17 nt, Human
cucugacacacagcucu

SEQ ID NO: 3081982 - RNA, 16 nt, Human
cucugacacacagcuc

SEQ ID NO: 3081983 - RNA, 15 nt, Human
cucugacacacagcu

SEQ ID NO: 3081984 - RNA, 14 nt, Human
cucugacacacagc

SEQ ID NO: 3081985 - RNA, 22 nt, Human
cucugaaggacauugcggacag

SEQ ID NO: 3081986 - RNA, 19 nt, Human
cucugaaggguaauuauau

SEQ ID NO: 3081987 - RNA, 13 nt, Human
cucacauuuauau

SEQ ID NO: 3081988 - RNA, 22 nt, Human
cucacaguccuuaccagcagag

SEQ ID NO: 3081989 - RNA, 17 nt, Human
cucacaguccuuaccag

SEQ ID NO: 3081990 - RNA, 19 nt, Human
cucacaguccuuaccagca

SEQ ID NO: 3081991 - RNA, 22 nt, Human
cucacauuuauucugcucacau

SEQ ID NO: 3081992 - RNA, 19 nt, Human
cucacauuuauucugcuca

SEQ ID NO: 3081993 - RNA, 15 nt, Human
cucacauuuauucug

SEQ ID NO: 3081994 - RNA, 18 nt, Human
cucaccagccccagugcc

SEQ ID NO: 3081995 - RNA, 17 nt, Human
cucaccagccccagugc

SEQ ID NO: 3081996 - RNA, 15 nt, Human
cucaccagccccagu

SEQ ID NO: 3081997 - RNA, 14 nt, Human
cucaccagccccag

SEQ ID NO: 3081998 - RNA, 13 nt, Human
cucaccagcccca

SEQ ID NO: 3081999 - RNA, 22 nt, Human
cucacacaugagcaucaggcca

SEQ ID NO: 3082000 - RNA, 24 nt, Human
cucacacaugagcaucaggccagg

SEQ ID NO: 3082001 - RNA, 15 nt, Human
cucacaguccuuacc

SEQ ID NO: 3082002 - RNA, 14 nt, Human
cucaaguccucuuu

SEQ ID NO: 3082003 - RNA, 21 nt, Human
cucaaguccucuuuucugaga

SEQ ID NO: 3082004 - RNA, 17 nt, Human
cucaagugauucuccug

SEQ ID NO: 3082005 - RNA, 17 nt, Human
cucaaccuccugggcua

SEQ ID NO: 3082006 - RNA, 15 nt, Human
cucaaccuccugggc

SEQ ID NO: 3082007 - RNA, 13 nt, Human
cucaaccuccugg

SEQ ID NO: 3082008 - RNA, 21 nt, Human
cucaacaccucugcacaagcu

SEQ ID NO: 3082009 - RNA, 12 nt, Human
cucaaauuugga

SEQ ID NO: 3082010 - RNA, 23 nt, Human
cucaaauacgugggcauucaaau

SEQ ID NO: 3082011 - RNA, 21 nt, Human
cucacucugucgcccagucug

SEQ ID NO: 3082012 - RNA, 13 nt, Human
cucacucugucgc

SEQ ID NO: 3082013 - RNA, 22 nt, Human
cucacucugucgcccagucugg

SEQ ID NO: 3082014 - RNA, 12 nt, Human
cucacugcagcc

SEQ ID NO: 3082015 - RNA, 13 nt, Human
cucacugcagccu

SEQ ID NO: 3082016 - RNA, 13 nt, Human
cucacuccuugaa

SEQ ID NO: 3082017 - RNA, 12 nt, Human
cucacucugucg

SEQ ID NO: 3082018 - RNA, 11 nt, Human
cucacucuguc

SEQ ID NO: 3082019 - RNA, 20 nt, Human
cucacuauguugcccaggca

SEQ ID NO: 3082020 - RNA, 19 nt, Human
cucacuauguugcccaggc

SEQ ID NO: 3082021 - RNA, 15 nt, Human
cucacccaguccugc

SEQ ID NO: 3082022 - RNA, 15 nt, Human
cucaccccagcccca

SEQ ID NO: 3082023 - RNA, 12 nt, Human
cucacccagucc

SEQ ID NO: 3082024 - RNA, 14 nt, Human
cucaccccagcccc

SEQ ID NO: 3082025 - RNA, 13 nt, Human
cucacccacacca

SEQ ID NO: 3082026 - RNA, 22 nt, Human
cucacuauguugcccaggcagg

SEQ ID NO: 3082027 - RNA, 21 nt, Human
cucacuauguugcccaggcag

SEQ ID NO: 3082028 - RNA, 23 nt, Human
cucacuauguugcccaggcaggu

SEQ ID NO: 3082029 - RNA, 14 nt, Human
cucagagagggugg

SEQ ID NO: 3082030 - RNA, 22 nt, Human
cucacuguugcccaggcuggcg

SEQ ID NO: 3082031 - RNA, 21 nt, Human
cucacuguugcccaggcuggc

SEQ ID NO: 3082032 - RNA, 19 nt, Human
cucacugccaugccagcuu

SEQ ID NO: 3082033 - RNA, 22 nt, Human
cucacugccaugccagcuuauc

SEQ ID NO: 3082034 - RNA, 20 nt, Human
cucacuguugcccaggcugg

SEQ ID NO: 3082035 - RNA, 21 nt, Human
cucagcaaaagaugcuucuca

SEQ ID NO: 3082036 - RNA, 15 nt, Human
cucagaucuucugug

SEQ ID NO: 3082037 - RNA, 17 nt, Human
cucagcauccuggcacc

SEQ ID NO: 3082038 - RNA, 16 nt, Human
cucagcauccuggcac

SEQ ID NO: 3082039 - RNA, 13 nt, Human
cuauggccugugg

SEQ ID NO: 3082040 - RNA, 15 nt, Human
cuauuagagaagaga

SEQ ID NO: 3082041 - RNA, 23 nt, Human
cuauucaaacagucucaggaaau

SEQ ID NO: 3082042 - RNA, 16 nt, Human
cuauucaaacagucuc

SEQ ID NO: 3082043 - RNA, 18 nt, Human
cuauucaaacagucucag

SEQ ID NO: 3082044 - RNA, 23 nt, Human
cuaugggacucaaugcacugaca

SEQ ID NO: 3082045 - RNA, 22 nt, Human
cuaugggacucaaugcacugac

SEQ ID NO: 3082046 - RNA, 18 nt, Human
cuaugggacucaaugcac

SEQ ID NO: 3082047 - RNA, 13 nt, Human
cuauaauuuaaau

SEQ ID NO: 3082048 - RNA, 21 nt, Human
cuauaauguaagcucuacuga

SEQ ID NO: 3082049 - RNA, 22 nt, Human
cuauaauuuaccugaagucuuu

SEQ ID NO: 3082050 - RNA, 16 nt, Human
cuauaauguaagcucu

SEQ ID NO: 3082051 - RNA, 17 nt, Human
cuauagccuaggugaca

SEQ ID NO: 3082052 - RNA, 20 nt, Human
cuauaggugcuacaaaaaca

SEQ ID NO: 3082053 - RNA, 22 nt, Human
cuauaggugcuacaaaaacaca

SEQ ID NO: 3082054 - RNA, 21 nt, Human
cuauaggugcuacaaaaacac

SEQ ID NO: 3082055 - RNA, 15 nt, Human
cuauaggugcuacaa

SEQ ID NO: 3082056 - RNA, 17 nt, Human
cuauauuuuacauaaau

SEQ ID NO: 3082057 - RNA, 22 nt, Human
cuagguaaauuacaguuccuag

SEQ ID NO: 3082058 - RNA, 23 nt, Human
cgcccaguuggguggaugccugg

SEQ ID NO: 3082059 - RNA, 15 nt, Human
cgccaugcuccuggc

SEQ ID NO: 3082060 - RNA, 20 nt, Human
cgccaucccagccccaauga

SEQ ID NO: 3082061 - RNA, 17 nt, Human
cgccaucccagccccaa

SEQ ID NO: 3082062 - RNA, 22 nt, Human
cgcccaguuggguggaugccug

SEQ ID NO: 3082063 - RNA, 18 nt, Human
cuaggugacagagugaga

SEQ ID NO: 3082064 - RNA, 14 nt, Human
cuaggugacagagu

SEQ ID NO: 3082065 - RNA, 24 nt, Human
cuaggugacagagugagacucugu

SEQ ID NO: 3082066 - RNA, 16 nt, Human
cuaguaauuggaaagg

SEQ ID NO: 3082067 - RNA, 20 nt, Human
cuagugaaacucguuaauuu

SEQ ID NO: 3082068 - RNA, 19 nt, Human
cuagugaaagaggcagcuu

SEQ ID NO: 3082069 - RNA, 18 nt, Human
cuagugaaagaggcagcu

SEQ ID NO: 3082070 - RNA, 21 nt, Human
cuagugagcagucaggaaaga

SEQ ID NO: 3082071 - RNA, 13 nt, Human
cuccacccugcuc

SEQ ID NO: 3082072 - RNA, 15 nt, Human
cuccacccugcucuc

SEQ ID NO: 3082073 - RNA, 16 nt, Human
cuccaaaauaaaacuu

SEQ ID NO: 3082074 - RNA, 15 nt, Human
cuccaaaauaaaacu

SEQ ID NO: 3082075 - RNA, 21 nt, Human
cuccaaacugacucuuaagaa

SEQ ID NO: 3082076 - RNA, 12 nt, Human
cuccaaagaaau

SEQ ID NO: 3082077 - RNA, 13 nt, Human
cuccaaagaaaug

SEQ ID NO: 3082078 - RNA, 17 nt, Human
cucauuugucacacacu

SEQ ID NO: 3082079 - RNA, 14 nt, Human
cucauuucuagcag

SEQ ID NO: 3082080 - RNA, 21 nt, Human
cucauuuccaagcaaguauua

SEQ ID NO: 3082081 - RNA, 17 nt, Human
cuccaccuugcagcucu

SEQ ID NO: 3082082 - RNA, 15 nt, Human
cuccagccccuggau

SEQ ID NO: 3082083 - RNA, 12 nt, Human
cuccaccugcca

SEQ ID NO: 3082084 - RNA, 13 nt, Human
cuccaccugccag

SEQ ID NO: 3082085 - RNA, 14 nt, Human
cuccaccugccagg

SEQ ID NO: 3082086 - RNA, 20 nt, Human
cuccagccccuggaugcagc

SEQ ID NO: 3082087 - RNA, 16 nt, Human
cuccagccccuggaug

SEQ ID NO: 3082088 - RNA, 17 nt, Human
cuccagccccuggaugc

SEQ ID NO: 3082089 - RNA, 12 nt, Human
cuccagccuggg

SEQ ID NO: 3082090 - RNA, 18 nt, Human
cuccaggagcagccacau

SEQ ID NO: 3082091 - RNA, 23 nt, Human
cuccaggagcagccacauuccug

SEQ ID NO: 3082092 - RNA, 12 nt, Human
cuccauccugag

SEQ ID NO: 3082093 - RNA, 11 nt, Human
cuccauccuga

SEQ ID NO: 3082094 - RNA, 14 nt, Human
cuccaggagcagcc

SEQ ID NO: 3082095 - RNA, 15 nt, Human
cuccaggagcagcca

SEQ ID NO: 3082096 - RNA, 16 nt, Human
cuccaggagcagccac

SEQ ID NO: 3082097 - RNA, 17 nt, Human
cuccaggagcagccaca

SEQ ID NO: 3082098 - RNA, 11 nt, Human
cuccaggagca

SEQ ID NO: 3082099 - RNA, 13 nt, Human
cuccaggagcagc

SEQ ID NO: 3082100 - RNA, 16 nt, Human
cucaggugagaagcag

SEQ ID NO: 3082101 - RNA, 14 nt, Human
cucaggugagaagc

SEQ ID NO: 3082102 - RNA, 19 nt, Human
cucaggugagaagcagagg

SEQ ID NO: 3082103 - RNA, 20 nt, Human
cucaggugagaagcagagga

SEQ ID NO: 3082104 - RNA, 15 nt, Human
cucagggucccuggu

SEQ ID NO: 3082105 - RNA, 16 nt, Human
cucagggucccuggug

SEQ ID NO: 3082106 - RNA, 17 nt, Human
cucagggucccuggugg

SEQ ID NO: 3082107 - RNA, 15 nt, Human
cucagggccuggucg

SEQ ID NO: 3082108 - RNA, 16 nt, Human
cucagggccuggcuca

SEQ ID NO: 3082109 - RNA, 14 nt, Human
cucagggccuggcu

SEQ ID NO: 3082110 - RNA, 15 nt, Human
cucagggccuggcuc

SEQ ID NO: 3082111 - RNA, 13 nt, Human
cucagggccuggc

SEQ ID NO: 3082112 - RNA, 18 nt, Human
cucaggaguuugagacca

SEQ ID NO: 3082113 - RNA, 23 nt, Human
cucaggaguuugagaccaaccug

SEQ ID NO: 3082114 - RNA, 18 nt, Human
cucagcauccuggcaccc

SEQ ID NO: 3082115 - RNA, 15 nt, Human
cucagcauccuggca

SEQ ID NO: 3082116 - RNA, 15 nt, Human
cucauccucauaccc

SEQ ID NO: 3082117 - RNA, 21 nt, Human
cucaucaccaacgucugugcc

SEQ ID NO: 3082118 - RNA, 23 nt, Human
cucauaguaugguggcuggguug

SEQ ID NO: 3082119 - RNA, 20 nt, Human
cucauaguaugguggcuggg

SEQ ID NO: 3082120 - RNA, 22 nt, Human
cucaucaccaacgucugugcca

SEQ ID NO: 3082121 - RNA, 16 nt, Human
cucauacccaccccca

SEQ ID NO: 3082122 - RNA, 18 nt, Human
cucauacccacccccacc

SEQ ID NO: 3082123 - RNA, 19 nt, Human
cucauacccacccccaccc

SEQ ID NO: 3082124 - RNA, 21 nt, Human
cucauacccacccccacccaa

SEQ ID NO: 3082125 - RNA, 19 nt, Human
cucaggugauccacccacc

SEQ ID NO: 3082126 - RNA, 18 nt, Human
cucaggugauccacccac

SEQ ID NO: 3082127 - RNA, 14 nt, Human
cucagggucccugg

SEQ ID NO: 3082128 - RNA, 20 nt, Human
cucaggugauccacccaccu

SEQ ID NO: 3082129 - RNA, 22 nt, Human
cucauacucaccucaccccacu

SEQ ID NO: 3082130 - RNA, 14 nt, Human
cucauacucaccuc

SEQ ID NO: 3082131 - RNA, 15 nt, Human
cucauacccaccccc

SEQ ID NO: 3082132 - RNA, 21 nt, Human
cucauaguaugguggcugggu

SEQ ID NO: 3082133 - RNA, 15 nt, Human
cuccuccagccgcca

SEQ ID NO: 3082134 - RNA, 13 nt, Human
cuccuccagaguc

SEQ ID NO: 3082135 - RNA, 15 nt, Human
cuccuccagagucag

SEQ ID NO: 3082136 - RNA, 20 nt, Human
cucccuuggauuguccccga

SEQ ID NO: 3082137 - RNA, 18 nt, Human
cuccucagaucuucugug

SEQ ID NO: 3082138 - RNA, 23 nt, Human
cuccccagcaagugagagcuggg

SEQ ID NO: 3082139 - RNA, 22 nt, Human
cuccccagcaagugagagcugg

SEQ ID NO: 3082140 - RNA, 13 nt, Human
cuccauccugagg

SEQ ID NO: 3082141 - RNA, 21 nt, Human
cuccccagcaagugagagcug

SEQ ID NO: 3082142 - RNA, 20 nt, Human
cucccgaguagcugggacua

SEQ ID NO: 3082143 - RNA, 19 nt, Human
cucccgaguagcugggacu

SEQ ID NO: 3082144 - RNA, 18 nt, Human
cucccgaguagcugggac

SEQ ID NO: 3082145 - RNA, 13 nt, Human
cucgagcaugccu

SEQ ID NO: 3082146 - RNA, 15 nt, Human
cucgagcaugccugg

SEQ ID NO: 3082147 - RNA, 16 nt, Human
cucgagcaugccugga

SEQ ID NO: 3082148 - RNA, 19 nt, Human
cucgagcaugccuggaugg

SEQ ID NO: 3082149 - RNA, 23 nt, Human
cuccuuggugucgggcaugacac

SEQ ID NO: 3082150 - RNA, 22 nt, Human
cucgagcaugccuggauggggc

SEQ ID NO: 3082151 - RNA, 24 nt, Human
cuccugugugugcgccuacaggag

SEQ ID NO: 3082152 - RNA, 23 nt, Human
cuccugugugugcgccuacagga

SEQ ID NO: 3082153 - RNA, 21 nt, Human
cuccugugugugcgccuacag

SEQ ID NO: 3082154 - RNA, 14 nt, Human
cuccuggaaauauu

SEQ ID NO: 3082155 - RNA, 15 nt, Human
cuccucuccccagca

SEQ ID NO: 3082156 - RNA, 13 nt, Human
cuccucuccccag

SEQ ID NO: 3082157 - RNA, 11 nt, Human
cuccugccuca

SEQ ID NO: 3082158 - RNA, 12 nt, Human
cuccugccucag

SEQ ID NO: 3082159 - RNA, 16 nt, Human
cuccugccucagccuc

SEQ ID NO: 3082160 - RNA, 17 nt, Human
cuccugccucagccucc

SEQ ID NO: 3082161 - RNA, 21 nt, Human
cuccugccucgaacuggcugc

SEQ ID NO: 3082162 - RNA, 20 nt, Human
cuccugccucgaacuggcug

SEQ ID NO: 3082163 - RNA, 18 nt, Human
cuccugccucgaacuggc

SEQ ID NO: 3082164 - RNA, 20 nt, Human
cuuuuacguccaucucuugu

SEQ ID NO: 3082165 - RNA, 18 nt, Human
cuuuguuuguugucagcu

SEQ ID NO: 3082166 - RNA, 20 nt, Human
cuuuguuuguugucagcuga

SEQ ID NO: 3082167 - RNA, 20 nt, Human
cuuuucauaaccuagccuua

SEQ ID NO: 3082168 - RNA, 22 nt, Human
cuuuucauaaccuagccuuaga

SEQ ID NO: 3082169 - RNA, 18 nt, Human
cuuuucuguccgagcuuu

SEQ ID NO: 3082170 - RNA, 18 nt, Human
cuuuucuugcaugaggcu

SEQ ID NO: 3082171 - RNA, 23 nt, Human
cuuuucuugcaugaggcuagugu

SEQ ID NO: 3082172 - RNA, 19 nt, Human
cuuuggacccugaggccca

SEQ ID NO: 3082173 - RNA, 17 nt, Human
cuuuggacccugaggcc

SEQ ID NO: 3082174 - RNA, 18 nt, Human
cuuuggacccugaggccc

SEQ ID NO: 3082175 - RNA, 15 nt, Human
cuuuggacccugagg

SEQ ID NO: 3082176 - RNA, 16 nt, Human
cuuuggacccugaggc

SEQ ID NO: 3082177 - RNA, 21 nt, Human
cuuuggacagaagcagcucuu

SEQ ID NO: 3082178 - RNA, 20 nt, Human
cuuuggacagaagcagcucu

SEQ ID NO: 3082179 - RNA, 19 nt, Human
cuuuggacagaagcagcuc

SEQ ID NO: 3082180 - RNA, 18 nt, Human
cuuuggacagaagcagcu

SEQ ID NO: 3082181 - RNA, 16 nt, Human
cuuucccaucuuccaa

SEQ ID NO: 3082182 - RNA, 18 nt, Human
cuuugugauuuuuguaau

SEQ ID NO: 3082183 - RNA, 17 nt, Human
cuuugugauuuuuguaa

SEQ ID NO: 3082184 - RNA, 14 nt, Human
cuuuguucuggcuc

SEQ ID NO: 3082185 - RNA, 15 nt, Human
cuuuguucuggcucu

SEQ ID NO: 3082186 - RNA, 13 nt, Human
cuuugggaggcca

SEQ ID NO: 3082187 - RNA, 18 nt, Human
cuuuguccccaccgcaga

SEQ ID NO: 3082188 - RNA, 22 nt, Human
cuuuguccccaccgcagacagg

SEQ ID NO: 3082189 - RNA, 14 nt, Human
cuuugugauuuuug

SEQ ID NO: 3082190 - RNA, 14 nt, Human
cuuuuuucuaaagu

SEQ ID NO: 3082191 - RNA, 20 nt, Human
cuuuuuucucugauacagaa

SEQ ID NO: 3082192 - RNA, 15 nt, Human
cuuuuuucacuacau

SEQ ID NO: 3082193 - RNA, 16 nt, Human
cuuuugagcauuuaga

SEQ ID NO: 3082194 - RNA, 21 nt, Human
cuuuugagugccuuacacaau

SEQ ID NO: 3082195 - RNA, 14 nt, Human
cuuuuuuggcugcu

SEQ ID NO: 3082196 - RNA, 15 nt, Human
cuuuuuuggcugcug

SEQ ID NO: 3082197 - RNA, 22 nt, Human
cuuuuuucucugauacagaaaa

SEQ ID NO: 3082198 - RNA, 17 nt, Human
gaaaaaggaugcacaga

SEQ ID NO: 3082199 - RNA, 23 nt, Human
gaaaaaggaugcacagaguuguu

SEQ ID NO: 3082200 - RNA, 22 nt, Human
gaaaacaauaacgauaaaagac

SEQ ID NO: 3082201 - RNA, 13 nt, Human
gaaaacacauuuu

SEQ ID NO: 3082202 - RNA, 14 nt, Human
gaaaacaaggauga

SEQ ID NO: 3082203 - RNA, 15 nt, Human
gaaaacaugcuacac

SEQ ID NO: 3082204 - RNA, 14 nt, Human
gaaaacaugcuaca

SEQ ID NO: 3082205 - RNA, 12 nt, Human
gaaaacaugcua

SEQ ID NO: 3082206 - RNA, 15 nt, Human
gaaaacguggcugcu

SEQ ID NO: 3082207 - RNA, 16 nt, Human
gaaaacguggcugcuu

SEQ ID NO: 3082208 - RNA, 18 nt, Human
gaaaacguggcugcuuca

SEQ ID NO: 3082209 - RNA, 14 nt, Human
gaaaacguggcugc

SEQ ID NO: 3082210 - RNA, 20 nt, Human
gaaaaucuuauaauuuaaaa

SEQ ID NO: 3082211 - RNA, 16 nt, Human
gaaacacuuugcauaa

SEQ ID NO: 3082212 - RNA, 18 nt, Human
gaaacagcuaaugggaca

SEQ ID NO: 3082213 - RNA, 19 nt, Human
gaaaauaacgauaaaagac

SEQ ID NO: 3082214 - RNA, 17 nt, Human
gaaaagcugcugacagu

SEQ ID NO: 3082215 - RNA, 13 nt, Human
gaaaagcugcuga

SEQ ID NO: 3082216 - RNA, 19 nt, Human
gaaaauaacaauaaaagac

SEQ ID NO: 3082217 - RNA, 19 nt, Human
gaaaaucuuauaauuuaaa

SEQ ID NO: 3082218 - RNA, 16 nt, Human
gaaaaucagccugcuc

SEQ ID NO: 3082219 - RNA, 18 nt, Human
gaaaaucagccugcucca

SEQ ID NO: 3082220 - RNA, 17 nt, Human
gaaaauauuauguguuu

SEQ ID NO: 3082221 - RNA, 14 nt, Human
gaaaaucagccugc

SEQ ID NO: 3082222 - RNA, 12 nt, Human
gaaaauaucacu

SEQ ID NO: 3082223 - RNA, 16 nt, Human
cuuggcugcagggagu

SEQ ID NO: 3082224 - RNA, 12 nt, Human
cuuggagggcau

SEQ ID NO: 3082225 - RNA, 23 nt, Human
cuuggagggcaugaagacagaua

SEQ ID NO: 3082226 - RNA, 22 nt, Human
cuuggaggaaggaaacccagcu

SEQ ID NO: 3082227 - RNA, 17 nt, Human
cuuggcugcagggaguc

SEQ ID NO: 3082228 - RNA, 14 nt, Human
cuuggcugcaggga

SEQ ID NO: 3082229 - RNA, 22 nt, Human
cuugggcuucauccuccucaga

SEQ ID NO: 3082230 - RNA, 20 nt, Human
cuuggggaccagagcugcca

SEQ ID NO: 3082231 - RNA, 21 nt, Human
cuuggggaccagagcugccac

SEQ ID NO: 3082232 - RNA, 14 nt, Human
cuugggccacugug

SEQ ID NO: 3082233 - RNA, 13 nt, Human
cuugggcuucauc

SEQ ID NO: 3082234 - RNA, 19 nt, Human
cuuguaaaggaauuuaaaa

SEQ ID NO: 3082235 - RNA, 18 nt, Human
cuuguaaaggaauuuaaa

SEQ ID NO: 3082236 - RNA, 16 nt, Human
cuuggggggcugaggu

SEQ ID NO: 3082237 - RNA, 15 nt, Human
cuuggggggcugagg

SEQ ID NO: 3082238 - RNA, 22 nt, Human
cuuggggaccagagcugccacc

SEQ ID NO: 3082239 - RNA, 14 nt, Human
cuugcucugcugac

SEQ ID NO: 3082240 - RNA, 13 nt, Human
cuugcucugcuga

SEQ ID NO: 3082241 - RNA, 15 nt, Human
cuugcccagccugga

SEQ ID NO: 3082242 - RNA, 13 nt, Human
cuugcccagccug

SEQ ID NO: 3082243 - RNA, 17 nt, Human
cuugcccagccuggaug

SEQ ID NO: 3082244 - RNA, 16 nt, Human
cuugcccagccuggau

SEQ ID NO: 3082245 - RNA, 21 nt, Human
cuucuccacccugcucuccga

SEQ ID NO: 3082246 - RNA, 16 nt, Human
cuucuccacccugcuc

SEQ ID NO: 3082247 - RNA, 18 nt, Human
cuucuccacccugcucuc

SEQ ID NO: 3082248 - RNA, 17 nt, Human
cuucuccacccugcucu

SEQ ID NO: 3082249 - RNA, 16 nt, Human
cuuggaaaugggagac

SEQ ID NO: 3082250 - RNA, 13 nt, Human
cuuggaggaagga

SEQ ID NO: 3082251 - RNA, 13 nt, Human
cuuggaagcuccg

SEQ ID NO: 3082252 - RNA, 16 nt, Human
cuugcucugcugacag

SEQ ID NO: 3082253 - RNA, 19 nt, Human
cuuguguuaaguaugugua

SEQ ID NO: 3082254 - RNA, 21 nt, Human
cuuguguguuuauugucaaag

SEQ ID NO: 3082255 - RNA, 20 nt, Human
cuuguguguuuauugucaaa

SEQ ID NO: 3082256 - RNA, 18 nt, Human
cuuuaaagggauggcaag

SEQ ID NO: 3082257 - RNA, 18 nt, Human
cuuuccaaaugcccagcu

SEQ ID NO: 3082258 - RNA, 19 nt, Human
cuuuccaaaugcccagcuu

SEQ ID NO: 3082259 - RNA, 22 nt, Human
cuuuccaaaugcccagcuuaaa

SEQ ID NO: 3082260 - RNA, 13 nt, Human
cuuuccacagaag

SEQ ID NO: 3082261 - RNA, 21 nt, Human
gaacuuguaaaggaauuuaaa

SEQ ID NO: 3082262 - RNA, 23 nt, Human
gaacuugguucccauuugcuccu

SEQ ID NO: 3082263 - RNA, 12 nt, Human
gaacuugguucc

SEQ ID NO: 3082264 - RNA, 15 nt, Human
gaacuuggcgcugcc

SEQ ID NO: 3082265 - RNA, 16 nt, Human
gaacuuggcgcugccc

SEQ ID NO: 3082266 - RNA, 13 nt, Human
gaacuuggcgcug

SEQ ID NO: 3082267 - RNA, 21 nt, Human
gaagaagcaccaaucaugaau

SEQ ID NO: 3082268 - RNA, 22 nt, Human
gaacucaucuagguaaauuaca

SEQ ID NO: 3082269 - RNA, 14 nt, Human
gaacucccuuucaa

SEQ ID NO: 3082270 - RNA, 22 nt, Human
gaacuggguacuuguggacaca

SEQ ID NO: 3082271 - RNA, 22 nt, Human
gaacuuccagauccuggaaauc

SEQ ID NO: 3082272 - RNA, 21 nt, Human
gaacuagaguuuagcuggaaa

SEQ ID NO: 3082273 - RNA, 22 nt, Human
gaacuagaguuuagcuggaaaa

SEQ ID NO: 3082274 - RNA, 21 nt, Human
gaaccacaucuugcucugcug

SEQ ID NO: 3082275 - RNA, 20 nt, Human
gaaccacaucuugcucugcu

SEQ ID NO: 3082276 - RNA, 16 nt, Human
gaacagacuggaagca

SEQ ID NO: 3082277 - RNA, 15 nt, Human
gaacagacuggaagc

SEQ ID NO: 3082278 - RNA, 17 nt, Human
gaaccaccacacccagc

SEQ ID NO: 3082279 - RNA, 16 nt, Human
gaaccaccacacccag

SEQ ID NO: 3082280 - RNA, 18 nt, Human
gaaauuguauuacaaauc

SEQ ID NO: 3082281 - RNA, 17 nt, Human
gaaauuuguuauaauga

SEQ ID NO: 3082282 - RNA, 20 nt, Human
gaaaugggcagagcagagac

SEQ ID NO: 3082283 - RNA, 14 nt, Human
gaaaugggcagagc

SEQ ID NO: 3082284 - RNA, 13 nt, Human
gaaauauuauguu

SEQ ID NO: 3082285 - RNA, 16 nt, Human
gaaauauuauguuaaa

SEQ ID NO: 3082286 - RNA, 21 nt, Human
gaaauaucugaaaauguaugu

SEQ ID NO: 3082287 - RNA, 13 nt, Human
gaaauauaauuga

SEQ ID NO: 3082288 - RNA, 20 nt, Human
gaaauaucugaaaauguaug

SEQ ID NO: 3082289 - RNA, 19 nt, Human
gaaugaaagggcccagaga

SEQ ID NO: 3082290 - RNA, 14 nt, Human
gaaugaaagggccc

SEQ ID NO: 3082291 - RNA, 16 nt, Human
gaaucucaaauaacua

SEQ ID NO: 3082292 - RNA, 14 nt, Human
gaauagcugggacu

SEQ ID NO: 3082293 - RNA, 15 nt, Human
gaauagcugggacua

SEQ ID NO: 3082294 - RNA, 14 nt, Human
gaauacuuuauaaa

SEQ ID NO: 3082295 - RNA, 20 nt, Human
gaauaauccuaaacauauga

SEQ ID NO: 3082296 - RNA, 14 nt, Human
gaauaacauguaau

SEQ ID NO: 3082297 - RNA, 17 nt, Human
gaaguuuacauuguaaa

SEQ ID NO: 3082298 - RNA, 16 nt, Human
gaaguuuacauuguaa

SEQ ID NO: 3082299 - RNA, 12 nt, Human
gaauaaaauuuu

SEQ ID NO: 3082300 - RNA, 12 nt, Human
gaaguuucugcc

SEQ ID NO: 3082301 - RNA, 18 nt, Human
gaagcuuuuaugugaaac

SEQ ID NO: 3082302 - RNA, 21 nt, Human
gaagccuuggggcugaugcag

SEQ ID NO: 3082303 - RNA, 20 nt, Human
gaagcccaggaaaggcucca

SEQ ID NO: 3082304 - RNA, 21 nt, Human
gaagcccaggaaaggcuccag

SEQ ID NO: 3082305 - RNA, 22 nt, Human
gaagcccaggaaaggcuccagg

SEQ ID NO: 3082306 - RNA, 21 nt, Human
gaagccgcuggggccaguugg

SEQ ID NO: 3082307 - RNA, 23 nt, Human
gaagccagcaggcucucaggcca

SEQ ID NO: 3082308 - RNA, 22 nt, Human
gaagccacgguguucugugaua

SEQ ID NO: 3082309 - RNA, 15 nt, Human
gaagccagcaggcuc

SEQ ID NO: 3082310 - RNA, 16 nt, Human
gaagccagcaggcucu

SEQ ID NO: 3082311 - RNA, 21 nt, Human
gaagacucauucuucuguacg

SEQ ID NO: 3082312 - RNA, 19 nt, Human
gaagacucauucuucugua

SEQ ID NO: 3082313 - RNA, 14 nt, Human
gaaggaaaaugaua

SEQ ID NO: 3082314 - RNA, 18 nt, Human
gaaggaaacccagcucug

SEQ ID NO: 3082315 - RNA, 14 nt, Human
gaaggaaacccagc

SEQ ID NO: 3082316 - RNA, 17 nt, Human
gaaggaaacccagcucu

SEQ ID NO: 3082317 - RNA, 21 nt, Human
gaaggauacaaaagcauguga

SEQ ID NO: 3082318 - RNA, 19 nt, Human
gaaggauacaaaagcaugu

SEQ ID NO: 3082319 - RNA, 12 nt, Human
gaaggauacaaa

SEQ ID NO: 3082320 - RNA, 14 nt, Human
gaaggccccgccca

SEQ ID NO: 3082321 - RNA, 15 nt, Human
gaaggccccgcccag

SEQ ID NO: 3082322 - RNA, 16 nt, Human
gaaggccccgcccagg

SEQ ID NO: 3082323 - RNA, 17 nt, Human
cuuaaccagaucauugu

SEQ ID NO: 3082324 - RNA, 21 nt, Human
cuuaagaagacugcauuauau

SEQ ID NO: 3082325 - RNA, 23 nt, Human
cuuaagaagacugcauuauauuu

SEQ ID NO: 3082326 - RNA, 16 nt, Human
cuuaaucuaaauggaa

SEQ ID NO: 3082327 - RNA, 17 nt, Human
cuuaauuaaaagaauau

SEQ ID NO: 3082328 - RNA, 16 nt, Human
cuuaauuaaaagaaua

SEQ ID NO: 3082329 - RNA, 20 nt, Human
cuuaauucuuagcucauucu

SEQ ID NO: 3082330 - RNA, 20 nt, Human
cuuaauuaaaagaauauuuu

SEQ ID NO: 3082331 - RNA, 19 nt, Human
cuuaauuaaaagaauauuu

SEQ ID NO: 3082332 - RNA, 20 nt, Human
cuuagaagucacacaguauu

SEQ ID NO: 3082333 - RNA, 17 nt, Human
cuuagaagucacacagu

SEQ ID NO: 3082334 - RNA, 20 nt, Human
cuuagaaaaaccaccaccau

SEQ ID NO: 3082335 - RNA, 13 nt, Human
cuuaccugccagg

SEQ ID NO: 3082336 - RNA, 20 nt, Human
cuuaccugccaggaagccag

SEQ ID NO: 3082337 - RNA, 23 nt, Human
cuuagguuggcaaaaaggcagga

SEQ ID NO: 3082338 - RNA, 21 nt, Human
cuuagguuggcaaaaaggcag

SEQ ID NO: 3082339 - RNA, 19 nt, Human
cuuagaauuaguggcacuu

SEQ ID NO: 3082340 - RNA, 23 nt, Human
cuguucuuucuggcuaugcauuu

SEQ ID NO: 3082341 - RNA, 16 nt, Human
cuguugcccaggcugg

SEQ ID NO: 3082342 - RNA, 15 nt, Human
cuguugcccaggcug

SEQ ID NO: 3082343 - RNA, 14 nt, Human
cuguugcccaggcu

SEQ ID NO: 3082344 - RNA, 13 nt, Human
cuguugcccaggc

SEQ ID NO: 3082345 - RNA, 12 nt, Human
cuguugcccagg

SEQ ID NO: 3082346 - RNA, 21 nt, Human
cuguucuuucuggcuaugcau

SEQ ID NO: 3082347 - RNA, 14 nt, Human
cuguucuuucuggc

SEQ ID NO: 3082348 - RNA, 13 nt, Human
cuguucuuucugg

SEQ ID NO: 3082349 - RNA, 21 nt, Human
cuguucuuuccaaaguacacu

SEQ ID NO: 3082350 - RNA, 19 nt, Human
cuguucuuuccaaaguaca

SEQ ID NO: 3082351 - RNA, 16 nt, Human
cuguucuuuccaaagu

SEQ ID NO: 3082352 - RNA, 15 nt, Human
cuguucuuuccaaag

SEQ ID NO: 3082353 - RNA, 16 nt, Human
cuguuaauaguucagg

SEQ ID NO: 3082354 - RNA, 17 nt, Human
cuguuugcuaagugagg

SEQ ID NO: 3082355 - RNA, 19 nt, Human
cuguuugcuaagugaggau

SEQ ID NO: 3082356 - RNA, 18 nt, Human
cuguuuagauaauacacc

SEQ ID NO: 3082357 - RNA, 17 nt, Human
cuguuucaaacuuuacu

SEQ ID NO: 3082358 - RNA, 15 nt, Human
cuguuucaaacuuua

SEQ ID NO: 3082359 - RNA, 17 nt, Human
cuguuuagauaauacac

SEQ ID NO: 3082360 - RNA, 14 nt, Human
cuguuuagauaaua

SEQ ID NO: 3082361 - RNA, 17 nt, Human
cuguugcccaggcuggc

SEQ ID NO: 3082362 - RNA, 16 nt, Human
cuuaaaaaguggaaaa

SEQ ID NO: 3082363 - RNA, 17 nt, Human
cuuaaaaaguggaaaaa

SEQ ID NO: 3082364 - RNA, 14 nt, Human
cuguuuuauaauuu

SEQ ID NO: 3082365 - RNA, 15 nt, Human
cuguuuuauaauuuu

SEQ ID NO: 3082366 - RNA, 21 nt, Human
cuguuuuauuuuaauucaguu

SEQ ID NO: 3082367 - RNA, 14 nt, Human
cuuccacaagagcc

SEQ ID NO: 3082368 - RNA, 15 nt, Human
cuuccacaagagccc

SEQ ID NO: 3082369 - RNA, 13 nt, Human
cuuccacaagagc

SEQ ID NO: 3082370 - RNA, 14 nt, Human
cuucagugccaaaa

SEQ ID NO: 3082371 - RNA, 20 nt, Human
cuucagccucccgaguagcu

SEQ ID NO: 3082372 - RNA, 16 nt, Human
cuucagccucccgagu

SEQ ID NO: 3082373 - RNA, 15 nt, Human
cuucagccugaaaga

SEQ ID NO: 3082374 - RNA, 14 nt, Human
cuucagccucccga

SEQ ID NO: 3082375 - RNA, 14 nt, Human
cuucaguaagccgu

SEQ ID NO: 3082376 - RNA, 15 nt, Human
cuucagcugacuuuu

SEQ ID NO: 3082377 - RNA, 19 nt, Human
cuucagcugacuuuucugu

SEQ ID NO: 3082378 - RNA, 21 nt, Human
cuucaaggauccugagccaga

SEQ ID NO: 3082379 - RNA, 22 nt, Human
cuucaaggauccugagccagau

SEQ ID NO: 3082380 - RNA, 23 nt, Human
cuucaaggauccugagccagauu

SEQ ID NO: 3082381 - RNA, 14 nt, Human
cuucacaacagauu

SEQ ID NO: 3082382 - RNA, 12 nt, Human
cuucacaacaga

SEQ ID NO: 3082383 - RNA, 23 nt, Human
cuucacauauugauuuccguuaa

SEQ ID NO: 3082384 - RNA, 14 nt, Human
cuucacauauugau

SEQ ID NO: 3082385 - RNA, 24 nt, Human
cuucagagacuccugcaggcagcc

SEQ ID NO: 3082386 - RNA, 21 nt, Human
cuuagucacugagacagcccg

SEQ ID NO: 3082387 - RNA, 20 nt, Human
cuuagucacugagacagccc

SEQ ID NO: 3082388 - RNA, 22 nt, Human
cuuagucacugagacagcccgg

SEQ ID NO: 3082389 - RNA, 15 nt, Human
cuucaaauauuuccc

SEQ ID NO: 3082390 - RNA, 17 nt, Human
cuucaaauccuugaaga

SEQ ID NO: 3082391 - RNA, 17 nt, Human
cuucaaggauccugagc

SEQ ID NO: 3082392 - RNA, 18 nt, Human
cuucaaggauccugagcc

SEQ ID NO: 3082393 - RNA, 19 nt, Human
cuucaaggauccugagcca

SEQ ID NO: 3082394 - RNA, 20 nt, Human
cuucaaggauccugagccag

SEQ ID NO: 3082395 - RNA, 16 nt, Human
cuucaaggauccugag

SEQ ID NO: 3082396 - RNA, 17 nt, Human
cuucccuacaguugaaa

SEQ ID NO: 3082397 - RNA, 17 nt, Human
cuucgcuccugugucuu

SEQ ID NO: 3082398 - RNA, 16 nt, Human
cuucgcuccugugucu

SEQ ID NO: 3082399 - RNA, 20 nt, Human
cuuccuuggacucauuuuaa

SEQ ID NO: 3082400 - RNA, 21 nt, Human
cuucucacugccaugccagcu

SEQ ID NO: 3082401 - RNA, 16 nt, Human
cuucucacugccaugc

SEQ ID NO: 3082402 - RNA, 19 nt, Human
cuucgggaggucgaggcag

SEQ ID NO: 3082403 - RNA, 19 nt, Human
cuucggccuccauccugag

SEQ ID NO: 3082404 - RNA, 20 nt, Human
cuucggccuccauccugagg

SEQ ID NO: 3082405 - RNA, 21 nt, Human
cugucuuuuuucuaaaguaaa

SEQ ID NO: 3082406 - RNA, 15 nt, Human
cugugaaaggaaaga

SEQ ID NO: 3082407 - RNA, 18 nt, Human
cugucuucaguaagccgu

SEQ ID NO: 3082408 - RNA, 18 nt, Human
cugucuucacaacagauu

SEQ ID NO: 3082409 - RNA, 18 nt, Human
cugucaauuacaggaagu

SEQ ID NO: 3082410 - RNA, 20 nt, Human
cugucauuugagcagggcuc

SEQ ID NO: 3082411 - RNA, 22 nt, Human
cugucauuugagcagggcucag

SEQ ID NO: 3082412 - RNA, 21 nt, Human
cugucauuugagcagggcuca

SEQ ID NO: 3082413 - RNA, 18 nt, Human
cugugaaaguacauuugg

SEQ ID NO: 3082414 - RNA, 16 nt, Human
cugugaaaggaaagag

SEQ ID NO: 3082415 - RNA, 22 nt, Human
cugugaaaggaaagagggaggu

SEQ ID NO: 3082416 - RNA, 15 nt, Human
cugugauggggcccu

SEQ ID NO: 3082417 - RNA, 16 nt, Human
cugugauggggcccug

SEQ ID NO: 3082418 - RNA, 21 nt, Human
cugugauggggcccugccucc

SEQ ID NO: 3082419 - RNA, 23 nt, Human
cugugauggggcccugccuccuu

SEQ ID NO: 3082420 - RNA, 22 nt, Human
cugugccauuuuguauuuuacu

SEQ ID NO: 3082421 - RNA, 15 nt, Human
cugugccaugugcca

SEQ ID NO: 3082422 - RNA, 19 nt, Human
cugugcccuaaaguguauu

SEQ ID NO: 3082423 - RNA, 14 nt, Human
cugugccaugugcc

SEQ ID NO: 3082424 - RNA, 19 nt, Human
cuguuaaaagaugaaaaua

SEQ ID NO: 3082425 - RNA, 16 nt, Human
cuguuaaaagaugaaa

SEQ ID NO: 3082426 - RNA, 15 nt, Human
cuguuaaaagaugaa

SEQ ID NO: 3082427 - RNA, 14 nt, Human
cugugugcucagga

SEQ ID NO: 3082428 - RNA, 20 nt, Human
cugugucuuuuuucacuaca

SEQ ID NO: 3082429 - RNA, 23 nt, Human
cugugucuugcaauggcagccuu

SEQ ID NO: 3082430 - RNA, 24 nt, Human
cuguggaucaaauccagccugcug

SEQ ID NO: 3082431 - RNA, 14 nt, Human
cuguggaucaaauc

SEQ ID NO: 3082432 - RNA, 22 nt, Human
cuguggguuucuaaagcugcca

SEQ ID NO: 3082433 - RNA, 21 nt, Human
cuguggguuucuaaagcugcc

SEQ ID NO: 3082434 - RNA, 15 nt, Human
cugggucgcccugga

SEQ ID NO: 3082435 - RNA, 13 nt, Human
cugggucgcccug

SEQ ID NO: 3082436 - RNA, 16 nt, Human
cugggggccucuucug

SEQ ID NO: 3082437 - RNA, 14 nt, Human
cugggggcugggca

SEQ ID NO: 3082438 - RNA, 18 nt, Human
cugggcuugucuguagau

SEQ ID NO: 3082439 - RNA, 22 nt, Human
cugggcuuggggaccagagcug

SEQ ID NO: 3082440 - RNA, 15 nt, Human
cugggcuucaguggc

SEQ ID NO: 3082441 - RNA, 23 nt, Human
cugggccccugccucucugcagg

SEQ ID NO: 3082442 - RNA, 20 nt, Human
cugggccccugccucucugc

SEQ ID NO: 3082443 - RNA, 19 nt, Human
cugggccccugccucucug

SEQ ID NO: 3082444 - RNA, 21 nt, Human
cugggauuacaagcgugagcc

SEQ ID NO: 3082445 - RNA, 19 nt, Human
cugggccucggaccccacu

SEQ ID NO: 3082446 - RNA, 17 nt, Human
cugggccucggacccca

SEQ ID NO: 3082447 - RNA, 18 nt, Human
cugguggcagugggagcu

SEQ ID NO: 3082448 - RNA, 14 nt, Human
cugguggcaguggg

SEQ ID NO: 3082449 - RNA, 20 nt, Human
cugguggcagcucaccucuc

SEQ ID NO: 3082450 - RNA, 15 nt, Human
cugguggcagcugcg

SEQ ID NO: 3082451 - RNA, 17 nt, Human
cugguggcagcucaccu

SEQ ID NO: 3082452 - RNA, 18 nt, Human
cugguggcagcucaccuc

SEQ ID NO: 3082453 - RNA, 16 nt, Human
cugguggcagcucacc

SEQ ID NO: 3082454 - RNA, 21 nt, Human
cugguuagagguucccuuuga

SEQ ID NO: 3082455 - RNA, 22 nt, Human
cugguuagagguucccuuugac

SEQ ID NO: 3082456 - RNA, 14 nt, Human
cuguacagagccca

SEQ ID NO: 3082457 - RNA, 15 nt, Human
cuguacagagcccac

SEQ ID NO: 3082458 - RNA, 18 nt, Human
cuguacagagcccacgcc

SEQ ID NO: 3082459 - RNA, 22 nt, Human
cuguacagagcccacgccccca

SEQ ID NO: 3082460 - RNA, 15 nt, Human
cuguaauuugugaua

SEQ ID NO: 3082461 - RNA, 14 nt, Human
cuguaauuugugau

SEQ ID NO: 3082462 - RNA, 18 nt, Human
cuguacgucugacaggca

SEQ ID NO: 3082463 - RNA, 16 nt, Human
cuguacgucugacagg

SEQ ID NO: 3082464 - RNA, 15 nt, Human
cuguacgucugacag

SEQ ID NO: 3082465 - RNA, 14 nt, Human
cuguacgucugaca

SEQ ID NO: 3082466 - RNA, 21 nt, Human
cuguacaugaaaacacauuuu

SEQ ID NO: 3082467 - RNA, 20 nt, Human
cuguacaugaaaacacauuu

SEQ ID NO: 3082468 - RNA, 17 nt, Human
cuguacaugaaaacaca

SEQ ID NO: 3082469 - RNA, 20 nt, Human
cuguacgucugacaggcaau

SEQ ID NO: 3082470 - RNA, 19 nt, Human
cuguacgucugacaggcaa

SEQ ID NO: 3082471 - RNA, 19 nt, Human
cuguaucccaugagccuca

SEQ ID NO: 3082472 - RNA, 20 nt, Human
cuguaucccaugagccucag

SEQ ID NO: 3082473 - RNA, 22 nt, Human
cuguaucccaugagccucagca

SEQ ID NO: 3082474 - RNA, 21 nt, Human
cuguaucccaugagccucagc

SEQ ID NO: 3082475 - RNA, 15 nt, Human
cugucaauuacagga

SEQ ID NO: 3082476 - RNA, 16 nt, Human
cugucaauuacaggaa

SEQ ID NO: 3082477 - RNA, 13 nt, Human
cugucaauuacag

SEQ ID NO: 3082478 - RNA, 20 nt, Human
cuguauuuuguuuuugucuu

SEQ ID NO: 3082479 - RNA, 20 nt, Human
cccaccgcagacaggaccag

SEQ ID NO: 3082480 - RNA, 23 nt, Human
cccaccagugccucucccugcug

SEQ ID NO: 3082481 - RNA, 15 nt, Human
cccaccagugccucu

SEQ ID NO: 3082482 - RNA, 16 nt, Human
cccaccagugccucuc

SEQ ID NO: 3082483 - RNA, 19 nt, Human
cccaccgcagacaggacca

SEQ ID NO: 3082484 - RNA, 13 nt, Human
cccaccagugccu

SEQ ID NO: 3082485 - RNA, 14 nt, Human
cccaccagugccuc

SEQ ID NO: 3082486 - RNA, 19 nt, Human
cccaccucucucacuccuu

SEQ ID NO: 3082487 - RNA, 22 nt, Human
cccaccucucucacuccuugaa

SEQ ID NO: 3082488 - RNA, 17 nt, Human
cccaccucagccucccg

SEQ ID NO: 3082489 - RNA, 20 nt, Human
cccacgcuggagugcaguga

SEQ ID NO: 3082490 - RNA, 19 nt, Human
cccacgcuggagugcagug

SEQ ID NO: 3082491 - RNA, 14 nt, Human
cccacgcuggagug

SEQ ID NO: 3082492 - RNA, 23 nt, Human
cccacuugagaauuacccuuuug

SEQ ID NO: 3082493 - RNA, 12 nt, Human
cccacuucugcc

SEQ ID NO: 3082494 - RNA, 20 nt, Human
cccacgacugcccggcaggg

SEQ ID NO: 3082495 - RNA, 21 nt, Human
cccacgacugcccggcagggu

SEQ ID NO: 3082496 - RNA, 20 nt, Human
cccaccuuggcugcagggag

SEQ ID NO: 3082497 - RNA, 16 nt, Human
cccaccuggccucugc

SEQ ID NO: 3082498 - RNA, 19 nt, Human
cccaccuggccucugcacu

SEQ ID NO: 3082499 - RNA, 21 nt, Human
cccaccuggccucugcacucc

SEQ ID NO: 3082500 - RNA, 17 nt, Human
cccaccuggccucugca

SEQ ID NO: 3082501 - RNA, 19 nt, Human
cccacagcgcuggccggga

SEQ ID NO: 3082502 - RNA, 13 nt, Human
cccacagcgcugg

SEQ ID NO: 3082503 - RNA, 20 nt, Human
cccacaagaaaugaaagcag

SEQ ID NO: 3082504 - RNA, 16 nt, Human
cccaaugcacuuuguu

SEQ ID NO: 3082505 - RNA, 20 nt, Human
cccaaugcacuuuguucugg

SEQ ID NO: 3082506 - RNA, 21 nt, Human
cccacaaaggagagcuagcag

SEQ ID NO: 3082507 - RNA, 13 nt, Human
cccacaagaaaug

SEQ ID NO: 3082508 - RNA, 15 nt, Human
cccuggacugugugc

SEQ ID NO: 3082509 - RNA, 16 nt, Human
cccugguggcagcuca

SEQ ID NO: 3082510 - RNA, 17 nt, Human
cccugguggcagcucac

SEQ ID NO: 3082511 - RNA, 15 nt, Human
cccugguggcagcuc

SEQ ID NO: 3082512 - RNA, 13 nt, Human
cccugcccaccug

SEQ ID NO: 3082513 - RNA, 14 nt, Human
cccugcccaccugg

SEQ ID NO: 3082514 - RNA, 17 nt, Human
cccugcccaccuggccu

SEQ ID NO: 3082515 - RNA, 18 nt, Human
cccugcccaccuggccuc

SEQ ID NO: 3082516 - RNA, 16 nt, Human
cccugcuggguguggc

SEQ ID NO: 3082517 - RNA, 21 nt, Human
cccugcuggguguggcgcagc

SEQ ID NO: 3082518 - RNA, 13 nt, Human
cccuccagagccc

SEQ ID NO: 3082519 - RNA, 12 nt, Human
cccucuggggcu

SEQ ID NO: 3082520 - RNA, 14 nt, Human
cccugaggcccaga

SEQ ID NO: 3082521 - RNA, 15 nt, Human
cccugaggcccagag

SEQ ID NO: 3082522 - RNA, 16 nt, Human
cccugaggcccagagg

SEQ ID NO: 3082523 - RNA, 17 nt, Human
cccugaggcccagaggg

SEQ ID NO: 3082524 - RNA, 18 nt, Human
cccugaggcccagagggc

SEQ ID NO: 3082525 - RNA, 19 nt, Human
cccugaggcccagagggcc

SEQ ID NO: 3082526 - RNA, 20 nt, Human
cccugaggcccagagggccu

SEQ ID NO: 3082527 - RNA, 23 nt, Human
cccugaggcccagagggccugca

SEQ ID NO: 3082528 - RNA, 16 nt, Human
cccucuggggcuguuc

SEQ ID NO: 3082529 - RNA, 13 nt, Human
cccugaggcccag

SEQ ID NO: 3082530 - RNA, 15 nt, Human
cccugaaagcccuga

SEQ ID NO: 3082531 - RNA, 19 nt, Human
cccugcacuugcagacucu

SEQ ID NO: 3082532 - RNA, 12 nt, Human
cccugcacuugc

SEQ ID NO: 3082533 - RNA, 13 nt, Human
cccugcacagcag

SEQ ID NO: 3082534 - RNA, 22 nt, Human
cccugcacagcaggcugccagu

SEQ ID NO: 3082535 - RNA, 14 nt, Human
cccugcacagcagg

SEQ ID NO: 3082536 - RNA, 15 nt, Human
cccugcacagcaggc

SEQ ID NO: 3082537 - RNA, 20 nt, Human
cccugcacagcaggcugcca

SEQ ID NO: 3082538 - RNA, 21 nt, Human
cccugcacagcaggcugccag

SEQ ID NO: 3082539 - RNA, 20 nt, Human
cccuacaguugaaaaacagc

SEQ ID NO: 3082540 - RNA, 16 nt, Human
cccgggcucugccucc

SEQ ID NO: 3082541 - RNA, 13 nt, Human
cccgucuccagcu

SEQ ID NO: 3082542 - RNA, 16 nt, Human
cccgucuccagcugcu

SEQ ID NO: 3082543 - RNA, 17 nt, Human
cccgucuccagcugcug

SEQ ID NO: 3082544 - RNA, 15 nt, Human
cccgugggguuccuc

SEQ ID NO: 3082545 - RNA, 21 nt, Human
cccgaguagcugggacuacag

SEQ ID NO: 3082546 - RNA, 18 nt, Human
cccgaguagcugggacua

SEQ ID NO: 3082547 - RNA, 17 nt, Human
cccgaguagcugggacu

SEQ ID NO: 3082548 - RNA, 16 nt, Human
cccgaguagcugggac

SEQ ID NO: 3082549 - RNA, 15 nt, Human
cccgaguagcuggga

SEQ ID NO: 3082550 - RNA, 14 nt, Human
cccgaguagcuggg

SEQ ID NO: 3082551 - RNA, 13 nt, Human
cccgaguagcugg

SEQ ID NO: 3082552 - RNA, 15 nt, Human
cccagagggccugca

SEQ ID NO: 3082553 - RNA, 21 nt, Human
cccgaggccuucucugaagga

SEQ ID NO: 3082554 - RNA, 14 nt, Human
cccagagggccugc

SEQ ID NO: 3082555 - RNA, 19 nt, Human
cccgcugucagccauuccu

SEQ ID NO: 3082556 - RNA, 20 nt, Human
cccgcugucagccauuccug

SEQ ID NO: 3082557 - RNA, 22 nt, Human
cccgaguagcugggacuacagg

SEQ ID NO: 3082558 - RNA, 14 nt, Human
cccgggcucugccu

SEQ ID NO: 3082559 - RNA, 15 nt, Human
cccgggcucugccuc

SEQ ID NO: 3082560 - RNA, 12 nt, Human
cccgggcucugc

SEQ ID NO: 3082561 - RNA, 21 nt, Human
ccucaucuccccaucauuggu

SEQ ID NO: 3082562 - RNA, 13 nt, Human
ccucauccucaua

SEQ ID NO: 3082563 - RNA, 20 nt, Human
ccucauccucauacccaccc

SEQ ID NO: 3082564 - RNA, 13 nt, Human
ccucaucaccaac

SEQ ID NO: 3082565 - RNA, 14 nt, Human
ccucaucaccaacg

SEQ ID NO: 3082566 - RNA, 22 nt, Human
ccucauaguaugguggcugggu

SEQ ID NO: 3082567 - RNA, 21 nt, Human
ccucauaguaugguggcuggg

SEQ ID NO: 3082568 - RNA, 13 nt, Human
ccucauacccacc

SEQ ID NO: 3082569 - RNA, 20 nt, Human
ccucauaguaugguggcugg

SEQ ID NO: 3082570 - RNA, 20 nt, Human
ccucagucuggcccuuccuu

SEQ ID NO: 3082571 - RNA, 12 nt, Human
ccucauacccac

SEQ ID NO: 3082572 - RNA, 11 nt, Human
ccucagugcca

SEQ ID NO: 3082573 - RNA, 19 nt, Human
ccucagucuggcccuuccu

SEQ ID NO: 3082574 - RNA, 13 nt, Human
ccuccagagcccc

SEQ ID NO: 3082575 - RNA, 12 nt, Human
ccuccagagccc

SEQ ID NO: 3082576 - RNA, 15 nt, Human
ccuccagagccccac

SEQ ID NO: 3082577 - RNA, 18 nt, Human
ccuccagagccccacagc

SEQ ID NO: 3082578 - RNA, 19 nt, Human
ccuccagagccccacagcc

SEQ ID NO: 3082579 - RNA, 20 nt, Human
ccuccagagccccacagccc

SEQ ID NO: 3082580 - RNA, 19 nt, Human
ccuccaggugcacaagcuc

SEQ ID NO: 3082581 - RNA, 21 nt, Human
ccuccaggugcacaagcucca

SEQ ID NO: 3082582 - RNA, 22 nt, Human
ccuccaggugcacaagcuccaa

SEQ ID NO: 3082583 - RNA, 14 nt, Human
ccuccauccugagg

SEQ ID NO: 3082584 - RNA, 15 nt, Human
ccucccaaagugcug

SEQ ID NO: 3082585 - RNA, 23 nt, Human
ccuccaugugggcuaguugggcu

SEQ ID NO: 3082586 - RNA, 16 nt, Human
ccucccaaagugcugg

SEQ ID NO: 3082587 - RNA, 18 nt, Human
ccucuaucccggcuuugg

SEQ ID NO: 3082588 - RNA, 16 nt, Human
ccucuaggaggucucu

SEQ ID NO: 3082589 - RNA, 16 nt, Human
ccucggugccuuccuc

SEQ ID NO: 3082590 - RNA, 14 nt, Human
ccucgguguggaga

SEQ ID NO: 3082591 - RNA, 10 nt, Human
ccucccuccc

SEQ ID NO: 3082592 - RNA, 14 nt, Human
ccuccucagaucuu

SEQ ID NO: 3082593 - RNA, 21 nt, Human
ccucccgaguagcugggacua

SEQ ID NO: 3082594 - RNA, 20 nt, Human
ccucccgaguagcugggacu

SEQ ID NO: 3082595 - RNA, 19 nt, Human
ccucccgaguagcugggac

SEQ ID NO: 3082596 - RNA, 14 nt, Human
ccuccugggcuaag

SEQ ID NO: 3082597 - RNA, 23 nt, Human
ccuccugccucgaacuggcugca

SEQ ID NO: 3082598 - RNA, 13 nt, Human
ccuccugccucga

SEQ ID NO: 3082599 - RNA, 17 nt, Human
ccucccgaauagcuggg

SEQ ID NO: 3082600 - RNA, 16 nt, Human
ccuaaauauauuuuaa

SEQ ID NO: 3082601 - RNA, 18 nt, Human
ccuaaauauauuuuaaga

SEQ ID NO: 3082602 - RNA, 14 nt, Human
ccuaaaguguauuu

SEQ ID NO: 3082603 - RNA, 13 nt, Human
ccuaguuccacca

SEQ ID NO: 3082604 - RNA, 21 nt, Human
ccuaguuccaccaucaagcca

SEQ ID NO: 3082605 - RNA, 23 nt, Human
ccuaguuccaccaucaagccacc

SEQ ID NO: 3082606 - RNA, 18 nt, Human
ccuauauuguuuucagug

SEQ ID NO: 3082607 - RNA, 22 nt, Human
ccuauauuguuuucaguguaca

SEQ ID NO: 3082608 - RNA, 14 nt, Human
ccgaggccuucucu

SEQ ID NO: 3082609 - RNA, 20 nt, Human
cccugguggcagcucaccuc

SEQ ID NO: 3082610 - RNA, 17 nt, Human
ccgaguagcugggacua

SEQ ID NO: 3082611 - RNA, 16 nt, Human
ccgaguagcugggacu

SEQ ID NO: 3082612 - RNA, 20 nt, Human
ccgaguagcugggacuacag

SEQ ID NO: 3082613 - RNA, 14 nt, Human
ccgcacugggcuug

SEQ ID NO: 3082614 - RNA, 15 nt, Human
ccgccuugcccagcc

SEQ ID NO: 3082615 - RNA, 16 nt, Human
ccgccuugcccagccu

SEQ ID NO: 3082616 - RNA, 17 nt, Human
ccgccuugcccagccug

SEQ ID NO: 3082617 - RNA, 22 nt, Human
ccgccuugcccagccuggaugc

SEQ ID NO: 3082618 - RNA, 23 nt, Human
ccgcuaagagggagggagggcuc

SEQ ID NO: 3082619 - RNA, 21 nt, Human
ccgcuaagagggagggagggc

SEQ ID NO: 3082620 - RNA, 20 nt, Human
ccgggcgcgguggcucacgc

SEQ ID NO: 3082621 - RNA, 18 nt, Human
ccgggaccccgagccugg

SEQ ID NO: 3082622 - RNA, 16 nt, Human
ccgggcguggugguga

SEQ ID NO: 3082623 - RNA, 22 nt, Human
ccgggcucugccucccaucacc

SEQ ID NO: 3082624 - RNA, 17 nt, Human
ccgggaccccgagccug

SEQ ID NO: 3082625 - RNA, 20 nt, Human
ccgggaagggggcugggaca

SEQ ID NO: 3082626 - RNA, 17 nt, Human
ccggcuggccuggcccc

SEQ ID NO: 3082627 - RNA, 18 nt, Human
ccggcuggccuggccccu

SEQ ID NO: 3082628 - RNA, 15 nt, Human
ccggcuggccuggcc

SEQ ID NO: 3082629 - RNA, 19 nt, Human
ccgcuuucuacccagcgag

SEQ ID NO: 3082630 - RNA, 12 nt, Human
ccgcuuucuacc

SEQ ID NO: 3082631 - RNA, 15 nt, Human
ccuguuuaagagaca

SEQ ID NO: 3082632 - RNA, 12 nt, Human
ccuguuuaagag

SEQ ID NO: 3082633 - RNA, 23 nt, Human
ccuguugggccaggagccuccug

SEQ ID NO: 3082634 - RNA, 21 nt, Human
ccuguuaaaagaugaaaauau

SEQ ID NO: 3082635 - RNA, 20 nt, Human
ccuguuaaaagaugaaaaua

SEQ ID NO: 3082636 - RNA, 14 nt, Human
ccuguuuguuucug

SEQ ID NO: 3082637 - RNA, 18 nt, Human
ccuguuuguuucugaaag

SEQ ID NO: 3082638 - RNA, 16 nt, Human
ccuguuucugcagcca

SEQ ID NO: 3082639 - RNA, 21 nt, Human
ccugugugugcgccuacagga

SEQ ID NO: 3082640 - RNA, 20 nt, Human
ccugugugugcgccuacagg

SEQ ID NO: 3082641 - RNA, 22 nt, Human
ccugugucuugcaauggcagcc

SEQ ID NO: 3082642 - RNA, 21 nt, Human
ccugugucuugcaauggcagc

SEQ ID NO: 3082643 - RNA, 19 nt, Human
ccugugucuugcaauggca

SEQ ID NO: 3082644 - RNA, 17 nt, Human
ccugugucuugcaaugg

SEQ ID NO: 3082645 - RNA, 14 nt, Human
ccuuacacaauggu

SEQ ID NO: 3082646 - RNA, 20 nt, Human
ccuuacacaaugguuuucuu

SEQ ID NO: 3082647 - RNA, 13 nt, Human
ccuuaccagcaga

SEQ ID NO: 3082648 - RNA, 20 nt, Human
ccuuaccagcagagcaccuu

SEQ ID NO: 3082649 - RNA, 15 nt, Human
ccuuacccucauguu

SEQ ID NO: 3082650 - RNA, 19 nt, Human
ccuuaccugccaggaagcc

SEQ ID NO: 3082651 - RNA, 18 nt, Human
ccuuagaagucacacagu

SEQ ID NO: 3082652 - RNA, 17 nt, Human
ccuuagaagucacacag

SEQ ID NO: 3082653 - RNA, 22 nt, Human
ccuucauuuggcauuccccacu

SEQ ID NO: 3082654 - RNA, 14 nt, Human
ccuucggccuccau

SEQ ID NO: 3082655 - RNA, 19 nt, Human
ccuucggccuccauccuga

SEQ ID NO: 3082656 - RNA, 20 nt, Human
ccuucggccuccauccugag

SEQ ID NO: 3082657 - RNA, 19 nt, Human
ccuucauuuggcauucccc

SEQ ID NO: 3082658 - RNA, 14 nt, Human
ccuucagugccaaa

SEQ ID NO: 3082659 - RNA, 11 nt, Human
ccuucagugcc

SEQ ID NO: 3082660 - RNA, 10 nt, Human
ccuucagugc

SEQ ID NO: 3082661 - RNA, 21 nt, Human
ccuucaccuuuguccccaccg

SEQ ID NO: 3082662 - RNA, 19 nt, Human
ccuucaccuuuguccccac

SEQ ID NO: 3082663 - RNA, 20 nt, Human
ccuucaccuuuguccccacc

SEQ ID NO: 3082664 - RNA, 17 nt, Human
ccuucacagaugggugc

SEQ ID NO: 3082665 - RNA, 13 nt, Human
ccuugaacuagga

SEQ ID NO: 3082666 - RNA, 20 nt, Human
ccuugaaaacuuuaugcuaa

SEQ ID NO: 3082667 - RNA, 19 nt, Human
ccuugaacuuugaccucug

SEQ ID NO: 3082668 - RNA, 13 nt, Human
ccuugacucuuuc

SEQ ID NO: 3082669 - RNA, 22 nt, Human
ccuugaccauucuccaccugcc

SEQ ID NO: 3082670 - RNA, 23 nt, Human
ccuugaccauucuccaccugcca

SEQ ID NO: 3082671 - RNA, 15 nt, Human
ccuucugugaaagua

SEQ ID NO: 3082672 - RNA, 15 nt, Human
ccuucuccuucaccu

SEQ ID NO: 3082673 - RNA, 19 nt, Human
ccuucuccuucaccuuugu

SEQ ID NO: 3082674 - RNA, 15 nt, Human
ccuucggcgccuuaa

SEQ ID NO: 3082675 - RNA, 15 nt, Human
ccuugucggccccac

SEQ ID NO: 3082676 - RNA, 21 nt, Human
ccuugucggccccaccagugc

SEQ ID NO: 3082677 - RNA, 16 nt, Human
ccuuugacgccauccc

SEQ ID NO: 3082678 - RNA, 17 nt, Human
ccuuugacgccauccca

SEQ ID NO: 3082679 - RNA, 18 nt, Human
ccuuugacgccaucccag

SEQ ID NO: 3082680 - RNA, 21 nt, Human
ccuugguuaggcauuguggga

SEQ ID NO: 3082681 - RNA, 22 nt, Human
ccuugguuaggcauugugggaa

SEQ ID NO: 3082682 - RNA, 22 nt, Human
ccuuggugucgggcaugacacg

SEQ ID NO: 3082683 - RNA, 21 nt, Human
ccuuggugucgggcaugacac

SEQ ID NO: 3082684 - RNA, 19 nt, Human
ccuuggggcugaugcaguu

SEQ ID NO: 3082685 - RNA, 14 nt, Human
ccuugaugaagaag

SEQ ID NO: 3082686 - RNA, 21 nt, Human
cgaagaguauuuuugacagaa

SEQ ID NO: 3082687 - RNA, 14 nt, Human
cgaacuggcugcaa

SEQ ID NO: 3082688 - RNA, 12 nt, Human
cgaacuggcugc

SEQ ID NO: 3082689 - RNA, 22 nt, Human
cgaaagggacuuggaagcuccg

SEQ ID NO: 3082690 - RNA, 20 nt, Human
cgaaaggaugaaagugacca

SEQ ID NO: 3082691 - RNA, 19 nt, Human
cgaaagggacuuggaagcu

SEQ ID NO: 3082692 - RNA, 12 nt, Human
cgaaagaacagu

SEQ ID NO: 3082693 - RNA, 21 nt, Human
cgaaagaacaguccauugaaa

SEQ ID NO: 3082694 - RNA, 18 nt, Human
cgaaaacguggcugcuuc

SEQ ID NO: 3082695 - RNA, 19 nt, Human
cgaaaacguggcugcuuca

SEQ ID NO: 3082696 - RNA, 15 nt, Human
cgaaaacguggcugc

SEQ ID NO: 3082697 - RNA, 20 nt, Human
cgaaaacguggcugcuucaa

SEQ ID NO: 3082698 - RNA, 20 nt, Human
ccuuugacgccaucccagcc

SEQ ID NO: 3082699 - RNA, 21 nt, Human
ccuuugacgccaucccagccc

SEQ ID NO: 3082700 - RNA, 22 nt, Human
ccuuugacgccaucccagcccc

SEQ ID NO: 3082701 - RNA, 20 nt, Human
cgagaucacgccacugcacu

SEQ ID NO: 3082702 - RNA, 18 nt, Human
cgagaucacgccacugca

SEQ ID NO: 3082703 - RNA, 20 nt, Human
cgagauugcaccacugcacu

SEQ ID NO: 3082704 - RNA, 14 nt, Human
cgagcaugccugga

SEQ ID NO: 3082705 - RNA, 13 nt, Human
cgagcaugccugg

SEQ ID NO: 3082706 - RNA, 16 nt, Human
cgagcaugccuggaug

SEQ ID NO: 3082707 - RNA, 17 nt, Human
cgagcaugccuggaugg

SEQ ID NO: 3082708 - RNA, 20 nt, Human
cgagcaggcuucuucccccc

SEQ ID NO: 3082709 - RNA, 18 nt, Human
cgagcaggcuacugucag

SEQ ID NO: 3082710 - RNA, 18 nt, Human
cgagauagccaaggccaa

SEQ ID NO: 3082711 - RNA, 17 nt, Human
cgagaucacgccacugc

SEQ ID NO: 3082712 - RNA, 14 nt, Human
cgaauagcugggac

SEQ ID NO: 3082713 - RNA, 13 nt, Human
cgaauagcuggga

SEQ ID NO: 3082714 - RNA, 17 nt, Human
cgccaugcuccuggccc

SEQ ID NO: 3082715 - RNA, 17 nt, Human
cgccagauucuuuccug

SEQ ID NO: 3082716 - RNA, 19 nt, Human
cgccagauucuuuccugag

SEQ ID NO: 3082717 - RNA, 20 nt, Human
cgccagauucuuuccugagg

SEQ ID NO: 3082718 - RNA, 21 nt, Human
cgccagauucuuuccugaggc

SEQ ID NO: 3082719 - RNA, 22 nt, Human
cgccaggggaaaaucagccugc

SEQ ID NO: 3082720 - RNA, 15 nt, Human
cgcagacaggaccag

SEQ ID NO: 3082721 - RNA, 16 nt, Human
cgcagacaggaccagg

SEQ ID NO: 3082722 - RNA, 14 nt, Human
cgcagcccugcaga

SEQ ID NO: 3082723 - RNA, 20 nt, Human
cgauuucuguuuagauaaua

SEQ ID NO: 3082724 - RNA, 18 nt, Human
cgagcaugccuggauggg

SEQ ID NO: 3082725 - RNA, 16 nt, Human
cgagccauuuguccca

SEQ ID NO: 3082726 - RNA, 19 nt, Human
cgagccauuugucccaagu

SEQ ID NO: 3082727 - RNA, 20 nt, Human
cgagccauuugucccaagug

SEQ ID NO: 3082728 - RNA, 21 nt, Human
cgagccauuugucccaagugc

SEQ ID NO: 3082729 - RNA, 16 nt, Human
cgagcccugguggcag

SEQ ID NO: 3082730 - RNA, 15 nt, Human
cgagcccugguggca

SEQ ID NO: 3082731 - RNA, 22 nt, Human
cgagccauuugucccaagugcc

SEQ ID NO: 3082732 - RNA, 23 nt, Human
cgagccauuugucccaagugcca

SEQ ID NO: 3082733 - RNA, 16 nt, Human
ccugagcuuucugcua

SEQ ID NO: 3082734 - RNA, 21 nt, Human
ccugaggcccagagggccugc

SEQ ID NO: 3082735 - RNA, 18 nt, Human
ccugaggcccagagggcc

SEQ ID NO: 3082736 - RNA, 14 nt, Human
ccugagcuuucugc

SEQ ID NO: 3082737 - RNA, 11 nt, Human
ccugagcccca

SEQ ID NO: 3082738 - RNA, 20 nt, Human
ccugagccagauuucacucu

SEQ ID NO: 3082739 - RNA, 23 nt, Human
ccugacaacacucauugaccuga

SEQ ID NO: 3082740 - RNA, 13 nt, Human
ccugccaggaagc

SEQ ID NO: 3082741 - RNA, 14 nt, Human
ccugccaggaagcc

SEQ ID NO: 3082742 - RNA, 15 nt, Human
ccugccaggaagcca

SEQ ID NO: 3082743 - RNA, 17 nt, Human
ccugccaggaagccagc

SEQ ID NO: 3082744 - RNA, 15 nt, Human
ccugccaggcauggu

SEQ ID NO: 3082745 - RNA, 23 nt, Human
ccugccaggaagccagcaggcuc

SEQ ID NO: 3082746 - RNA, 16 nt, Human
ccugccaggcauggug

SEQ ID NO: 3082747 - RNA, 11 nt, Human
ccugccaggga

SEQ ID NO: 3082748 - RNA, 18 nt, Human
ccugccaggaagccagca

SEQ ID NO: 3082749 - RNA, 19 nt, Human
ccugccaggaagccagcag

SEQ ID NO: 3082750 - RNA, 21 nt, Human
ccugccaggaagccagcaggc

SEQ ID NO: 3082751 - RNA, 22 nt, Human
ccugccaggaagccagcaggcu

SEQ ID NO: 3082752 - RNA, 12 nt, Human
ccugccagggac

SEQ ID NO: 3082753 - RNA, 13 nt, Human
ccugccagggaca

SEQ ID NO: 3082754 - RNA, 14 nt, Human
ccugccagggacag

SEQ ID NO: 3082755 - RNA, 15 nt, Human
ccugccagggacaga

SEQ ID NO: 3082756 - RNA, 16 nt, Human
ccugccagggacagag

SEQ ID NO: 3082757 - RNA, 19 nt, Human
ccugcaauuucauaugcug

SEQ ID NO: 3082758 - RNA, 14 nt, Human
ccugcaagaacaag

SEQ ID NO: 3082759 - RNA, 22 nt, Human
ccugcaaccugauugugucucu

SEQ ID NO: 3082760 - RNA, 21 nt, Human
ccugcaaccugauugugucuc

SEQ ID NO: 3082761 - RNA, 17 nt, Human
ccugauugugucucuug

SEQ ID NO: 3082762 - RNA, 19 nt, Human
ccugauugugucucuuggu

SEQ ID NO: 3082763 - RNA, 11 nt, Human
ccugaggcccu

SEQ ID NO: 3082764 - RNA, 12 nt, Human
ccugaggcccuu

SEQ ID NO: 3082765 - RNA, 19 nt, Human
ccugaugcuucuucagaga

SEQ ID NO: 3082766 - RNA, 20 nt, Human
ccugaugcuucuucagagac

SEQ ID NO: 3082767 - RNA, 21 nt, Human
ccugaugcuucuucagagacu

SEQ ID NO: 3082768 - RNA, 22 nt, Human
ccugaugcuucuucagagacuc

SEQ ID NO: 3082769 - RNA, 15 nt, Human
ccugauugugucucu

SEQ ID NO: 3082770 - RNA, 23 nt, Human
ccugccuguugggccaggagccu

SEQ ID NO: 3082771 - RNA, 22 nt, Human
ccugccccucaacucuccucca

SEQ ID NO: 3082772 - RNA, 16 nt, Human
ccugcggugcuaucuc

SEQ ID NO: 3082773 - RNA, 17 nt, Human
ccugcggugcuaucucc

SEQ ID NO: 3082774 - RNA, 14 nt, Human
ccugcuucaaauau

SEQ ID NO: 3082775 - RNA, 23 nt, Human
ccuggaaaucaggguuaguauug

SEQ ID NO: 3082776 - RNA, 22 nt, Human
ccugcucuccgaccagacaccu

SEQ ID NO: 3082777 - RNA, 22 nt, Human
ccugcggugcuaucucccccag

SEQ ID NO: 3082778 - RNA, 21 nt, Human
ccugcucuccgaccagacacc

SEQ ID NO: 3082779 - RNA, 18 nt, Human
ccuggaauauauaaccag

SEQ ID NO: 3082780 - RNA, 12 nt, Human
ccuggcagcccc

SEQ ID NO: 3082781 - RNA, 13 nt, Human
ccuggcagccccu

SEQ ID NO: 3082782 - RNA, 23 nt, Human
ccuggcacccggccccugcuggu

SEQ ID NO: 3082783 - RNA, 22 nt, Human
ccuggcacccggccccugcugg

SEQ ID NO: 3082784 - RNA, 22 nt, Human
ccuggcuccaaacccucgaggc

SEQ ID NO: 3082785 - RNA, 15 nt, Human
ccuggccagaugcac

SEQ ID NO: 3082786 - RNA, 20 nt, Human
ccuggcuccaaacccucgag

SEQ ID NO: 3082787 - RNA, 20 nt, Human
ccaggcccucugcccacucc

SEQ ID NO: 3082788 - RNA, 21 nt, Human
ccaggcccucugcccacuccc

SEQ ID NO: 3082789 - RNA, 22 nt, Human
ccaggcccucugcccacucccu

SEQ ID NO: 3082790 - RNA, 23 nt, Human
ccaggcccucugcccacucccug

SEQ ID NO: 3082791 - RNA, 17 nt, Human
ccaggcuuagucacuga

SEQ ID NO: 3082792 - RNA, 24 nt, Human
ccaggcuguaucccaugagccuca

SEQ ID NO: 3082793 - RNA, 19 nt, Human
ccaggagccccgaggccuu

SEQ ID NO: 3082794 - RNA, 16 nt, Human
ccaggagccccgaggc

SEQ ID NO: 3082795 - RNA, 20 nt, Human
ccaggagccccgaggccuuc

SEQ ID NO: 3082796 - RNA, 19 nt, Human
ccaggagccuccugcccuu

SEQ ID NO: 3082797 - RNA, 17 nt, Human
ccaggcauuccccagga

SEQ ID NO: 3082798 - RNA, 18 nt, Human
ccaggcauuccccaggag

SEQ ID NO: 3082799 - RNA, 19 nt, Human
ccaggcauuccccaggagg

SEQ ID NO: 3082800 - RNA, 21 nt, Human
ccaggcauuccccaggaggcc

SEQ ID NO: 3082801 - RNA, 22 nt, Human
ccagggacagaggggguggccu

SEQ ID NO: 3082802 - RNA, 20 nt, Human
ccaggcuuagucacugagac

SEQ ID NO: 3082803 - RNA, 14 nt, Human
ccagggacagaggg

SEQ ID NO: 3082804 - RNA, 15 nt, Human
ccagggacagagggg

SEQ ID NO: 3082805 - RNA, 21 nt, Human
ccagggacagaggggguggcc

SEQ ID NO: 3082806 - RNA, 19 nt, Human
ccaggugcacaagcuccaa

SEQ ID NO: 3082807 - RNA, 20 nt, Human
ccaggugcacaagcuccaag

SEQ ID NO: 3082808 - RNA, 18 nt, Human
ccaggugcacaagcucca

SEQ ID NO: 3082809 - RNA, 18 nt, Human
ccagucuggaaugcagug

SEQ ID NO: 3082810 - RNA, 13 nt, Human
ccagugaggcucu

SEQ ID NO: 3082811 - RNA, 20 nt, Human
ccagucuggaaugcaguggu

SEQ ID NO: 3082812 - RNA, 19 nt, Human
ccagucuggaaugcagugg

SEQ ID NO: 3082813 - RNA, 17 nt, Human
ccagguuuuuggucuga

SEQ ID NO: 3082814 - RNA, 24 nt, Human
ccaggugcacaagcuccaagcucc

SEQ ID NO: 3082815 - RNA, 15 nt, Human
ccagguucagcuugu

SEQ ID NO: 3082816 - RNA, 20 nt, Human
ccagugccgagaaggaagcc

SEQ ID NO: 3082817 - RNA, 22 nt, Human
ccagugguuccuaauccucuag

SEQ ID NO: 3082818 - RNA, 14 nt, Human
ccagugaggcucug

SEQ ID NO: 3082819 - RNA, 15 nt, Human
ccagugaggcucugc

SEQ ID NO: 3082820 - RNA, 16 nt, Human
ccagugaggcucugcc

SEQ ID NO: 3082821 - RNA, 23 nt, Human
ccagugcccacaggaucagucug

SEQ ID NO: 3082822 - RNA, 23 nt, Human
ccauauucuguuggccaguguga

SEQ ID NO: 3082823 - RNA, 21 nt, Human
ccaguuauggcuauaggugcu

SEQ ID NO: 3082824 - RNA, 14 nt, Human
ccaguuauggcuau

SEQ ID NO: 3082825 - RNA, 22 nt, Human
ccaguguuguggauuuaacaga

SEQ ID NO: 3082826 - RNA, 19 nt, Human
ccaguguuuuaggagcaug

SEQ ID NO: 3082827 - RNA, 16 nt, Human
cccaaaacucuccucu

SEQ ID NO: 3082828 - RNA, 18 nt, Human
cccaaaacucuccucugc

SEQ ID NO: 3082829 - RNA, 15 nt, Human
cccaaagugcuggga

SEQ ID NO: 3082830 - RNA, 13 nt, Human
cccaaagugcugg

SEQ ID NO: 3082831 - RNA, 14 nt, Human
ccauuuguguuuau

SEQ ID NO: 3082832 - RNA, 13 nt, Human
ccauuugucccaa

SEQ ID NO: 3082833 - RNA, 15 nt, Human
ccauuugucccaagu

SEQ ID NO: 3082834 - RNA, 17 nt, Human
ccauuugucccaagugc

SEQ ID NO: 3082835 - RNA, 19 nt, Human
ccauucuccaccugccagg

SEQ ID NO: 3082836 - RNA, 20 nt, Human
ccauucuccaccugccaggg

SEQ ID NO: 3082837 - RNA, 16 nt, Human
cccaaagugcugggau

SEQ ID NO: 3082838 - RNA, 18 nt, Human
cccaaauggaaaugggca

SEQ ID NO: 3082839 - RNA, 22 nt, Human
cccaaauggaaaugggcagagc

SEQ ID NO: 3082840 - RNA, 23 nt, Human
cccaaggccuuccccuggcacug

SEQ ID NO: 3082841 - RNA, 19 nt, Human
ccauauucuguuggccagu

SEQ ID NO: 3082842 - RNA, 22 nt, Human
ccaucugcgggggcagugcuca

SEQ ID NO: 3082843 - RNA, 20 nt, Human
ccaucugcgggggcagugcu

SEQ ID NO: 3082844 - RNA, 21 nt, Human
ccaucugcgggggcagugcuc

SEQ ID NO: 3082845 - RNA, 16 nt, Human
ccauguuggccaggcu

SEQ ID NO: 3082846 - RNA, 17 nt, Human
ccauguuggccaggcug

SEQ ID NO: 3082847 - RNA, 16 nt, Human
ccaugggacagggagg

SEQ ID NO: 3082848 - RNA, 19 nt, Human
ccaugggacagggaggacg

SEQ ID NO: 3082849 - RNA, 18 nt, Human
ccauucuccaccugccag

SEQ ID NO: 3082850 - RNA, 14 nt, Human
ccacaucuugcucu

SEQ ID NO: 3082851 - RNA, 23 nt, Human
ccacaucuugcucugcugacaga

SEQ ID NO: 3082852 - RNA, 22 nt, Human
ccacaucuugcucugcugacag

SEQ ID NO: 3082853 - RNA, 20 nt, Human
ccacaucuugcucugcugac

SEQ ID NO: 3082854 - RNA, 16 nt, Human
ccacaucuugcucugc

SEQ ID NO: 3082855 - RNA, 14 nt, Human
ccaccaacauacuc

SEQ ID NO: 3082856 - RNA, 18 nt, Human
ccaccaacauacucccau

SEQ ID NO: 3082857 - RNA, 20 nt, Human
ccaccaacauacucccaucu

SEQ ID NO: 3082858 - RNA, 16 nt, Human
ccaccacacccagccc

SEQ ID NO: 3082859 - RNA, 14 nt, Human
ccaccacacccagc

SEQ ID NO: 3082860 - RNA, 17 nt, Human
ccacccaagggccuggc

SEQ ID NO: 3082861 - RNA, 19 nt, Human
ccacccaagggccuggccu

SEQ ID NO: 3082862 - RNA, 16 nt, Human
ccacccaagggccugg

SEQ ID NO: 3082863 - RNA, 20 nt, Human
ccacccaagggccuggccug

SEQ ID NO: 3082864 - RNA, 21 nt, Human
ccacccaagggccuggccuga

SEQ ID NO: 3082865 - RNA, 22 nt, Human
ccacccaagggccuggccugag

SEQ ID NO: 3082866 - RNA, 13 nt, Human
ccacccaccucag

SEQ ID NO: 3082867 - RNA, 15 nt, Human
ccacccaccucagcc

SEQ ID NO: 3082868 - RNA, 14 nt, Human
ccacccaccucagc

SEQ ID NO: 3082869 - RNA, 16 nt, Human
ccacccaccucagccu

SEQ ID NO: 3082870 - RNA, 23 nt, Human
ccacaccauaagcuacugccauc

SEQ ID NO: 3082871 - RNA, 12 nt, Human
ccacacccagcc

SEQ ID NO: 3082872 - RNA, 14 nt, Human
ccacacccagccca

SEQ ID NO: 3082873 - RNA, 13 nt, Human
ccacacccagccc

SEQ ID NO: 3082874 - RNA, 15 nt, Human
ccaccucagccuccc

SEQ ID NO: 3082875 - RNA, 14 nt, Human
ccaccucagccucc

SEQ ID NO: 3082876 - RNA, 13 nt, Human
ccaccucagccuc

SEQ ID NO: 3082877 - RNA, 16 nt, Human
ccacccugaaagcccu

SEQ ID NO: 3082878 - RNA, 17 nt, Human
ccacccugaaagcccug

SEQ ID NO: 3082879 - RNA, 12 nt, Human
ccaccucagccu

SEQ ID NO: 3082880 - RNA, 14 nt, Human
ccacccaggagccc

SEQ ID NO: 3082881 - RNA, 12 nt, Human
ccacccaggagc

SEQ ID NO: 3082882 - RNA, 17 nt, Human
ccaccucccacaaagga

SEQ ID NO: 3082883 - RNA, 17 nt, Human
ccaccugccuguugggc

SEQ ID NO: 3082884 - RNA, 20 nt, Human
ccaccugccuguugggccag

SEQ ID NO: 3082885 - RNA, 16 nt, Human
ccaccugccagggaca

SEQ ID NO: 3082886 - RNA, 15 nt, Human
ccacggccaggccag

SEQ ID NO: 3082887 - RNA, 14 nt, Human
ccacggccaggcca

SEQ ID NO: 3082888 - RNA, 13 nt, Human
ccacggccaggcc

SEQ ID NO: 3082889 - RNA, 12 nt, Human
ccacggccaggc

SEQ ID NO: 3082890 - RNA, 17 nt, Human
ccaccuggccucugcac

SEQ ID NO: 3082891 - RNA, 14 nt, Human
ccaccuggccucug

SEQ ID NO: 3082892 - RNA, 22 nt, Human
ccaccugcggugcuaucucccc

SEQ ID NO: 3082893 - RNA, 15 nt, Human
ccaccuggccucugc

SEQ ID NO: 3082894 - RNA, 16 nt, Human
ccaccuggccucugca

SEQ ID NO: 3082895 - RNA, 18 nt, Human
ccacucaguccauagcag

SEQ ID NO: 3082896 - RNA, 12 nt, Human
ccacucccugca

SEQ ID NO: 3082897 - RNA, 13 nt, Human
ccacucccugcaa

SEQ ID NO: 3082898 - RNA, 18 nt, Human
ccacuacauucuguuaau

SEQ ID NO: 3082899 - RNA, 22 nt, Human
ccacuacggaauaguuggcuag

SEQ ID NO: 3082900 - RNA, 23 nt, Human
ccacuacggaauaguuggcuagg

SEQ ID NO: 3082901 - RNA, 16 nt, Human
ccacugcgaccacaag

SEQ ID NO: 3082902 - RNA, 20 nt, Human
ccacugcacuccagccuggg

SEQ ID NO: 3082903 - RNA, 19 nt, Human
ccacugcacuccagccugg

SEQ ID NO: 3082904 - RNA, 15 nt, Human
ccacucccugcaacc

SEQ ID NO: 3082905 - RNA, 18 nt, Human
ccacugcacuccagccug

SEQ ID NO: 3082906 - RNA, 13 nt, Human
ccacguuucuaaa

SEQ ID NO: 3082907 - RNA, 13 nt, Human
ccagauuuaugca

SEQ ID NO: 3082908 - RNA, 21 nt, Human
ccagauugcaacaggcugggc

SEQ ID NO: 3082909 - RNA, 22 nt, Human
ccagauuuaugcauauuauuuu

SEQ ID NO: 3082910 - RNA, 12 nt, Human
ccagauuucacu

SEQ ID NO: 3082911 - RNA, 18 nt, Human
ccagauugcaacaggcug

SEQ ID NO: 3082912 - RNA, 23 nt, Human
ccagauucuuuccugaggcuggg

SEQ ID NO: 3082913 - RNA, 20 nt, Human
ccagauugcaacaggcuggg

SEQ ID NO: 3082914 - RNA, 19 nt, Human
ccagauugcaacaggcugg

SEQ ID NO: 3082915 - RNA, 15 nt, Human
ccagagggccugcaa

SEQ ID NO: 3082916 - RNA, 16 nt, Human
ccagagggccugcaag

SEQ ID NO: 3082917 - RNA, 23 nt, Human
ccagaugcaccagcccuuagcag

SEQ ID NO: 3082918 - RNA, 23 nt, Human
ccagagggagugacagaggcagc

SEQ ID NO: 3082919 - RNA, 22 nt, Human
ccagagggagugacagaggcag

SEQ ID NO: 3082920 - RNA, 13 nt, Human
ccagagggccugc

SEQ ID NO: 3082921 - RNA, 19 nt, Human
ccagauucuuuccugaggc

SEQ ID NO: 3082922 - RNA, 20 nt, Human
ccagauucuuuccugaggcu

SEQ ID NO: 3082923 - RNA, 21 nt, Human
ccagauucuuuccugaggcug

SEQ ID NO: 3082924 - RNA, 22 nt, Human
ccagauucuuuccugaggcugg

SEQ ID NO: 3082925 - RNA, 18 nt, Human
ccagauucuuuccugagg

SEQ ID NO: 3082926 - RNA, 19 nt, Human
ccacuguacuugcucuuga

SEQ ID NO: 3082927 - RNA, 18 nt, Human
ccacuguacuugcucuug

SEQ ID NO: 3082928 - RNA, 17 nt, Human
ccacuguacuugcucuu

SEQ ID NO: 3082929 - RNA, 20 nt, Human
ccacuguacuugcucuugau

SEQ ID NO: 3082930 - RNA, 19 nt, Human
ccagacaccuugacagggc

SEQ ID NO: 3082931 - RNA, 17 nt, Human
ccagacaccuugacagg

SEQ ID NO: 3082932 - RNA, 13 nt, Human
ccagagagggugg

SEQ ID NO: 3082933 - RNA, 14 nt, Human
ccagagaggguggu

SEQ ID NO: 3082934 - RNA, 23 nt, Human
ccagagaggguggugaccucugc

SEQ ID NO: 3082935 - RNA, 21 nt, Human
ccagagaggguggugaccucu

SEQ ID NO: 3082936 - RNA, 22 nt, Human
ccagaggagagaggacccccug

SEQ ID NO: 3082937 - RNA, 21 nt, Human
ccagaggagagaggacccccu

SEQ ID NO: 3082938 - RNA, 21 nt, Human
ccagagggagugacagaggca

SEQ ID NO: 3082939 - RNA, 20 nt, Human
ccagagggagugacagaggc

SEQ ID NO: 3082940 - RNA, 19 nt, Human
ccagagggagugacagagg

SEQ ID NO: 3082941 - RNA, 18 nt, Human
ccagagggagugacagag

SEQ ID NO: 3082942 - RNA, 17 nt, Human
ccagagggagugacaga

SEQ ID NO: 3082943 - RNA, 16 nt, Human
ccagagggagugacag

SEQ ID NO: 3082944 - RNA, 14 nt, Human
ccagagcugccacc

SEQ ID NO: 3082945 - RNA, 15 nt, Human
ccagagcugccaccu

SEQ ID NO: 3082946 - RNA, 16 nt, Human
ccagagcugccaccug

SEQ ID NO: 3082947 - RNA, 19 nt, Human
ccagagcugccaccugccu

SEQ ID NO: 3082948 - RNA, 12 nt, Human
ccagagcugcca

SEQ ID NO: 3082949 - RNA, 13 nt, Human
ccagagcugccac

SEQ ID NO: 3082950 - RNA, 11 nt, Human
ccagagcugcc

SEQ ID NO: 3082951 - RNA, 23 nt, Human
ccagcauaauacuugcuuuggaa

SEQ ID NO: 3082952 - RNA, 15 nt, Human
ccagccaaagccucc

SEQ ID NO: 3082953 - RNA, 18 nt, Human
ccagccaaagccuccucc

SEQ ID NO: 3082954 - RNA, 19 nt, Human
ccagccaaagccuccucca

SEQ ID NO: 3082955 - RNA, 13 nt, Human
ccagccaggcccu

SEQ ID NO: 3082956 - RNA, 18 nt, Human
ccagccgccaugcuccug

SEQ ID NO: 3082957 - RNA, 14 nt, Human
ccagccgccaugcu

SEQ ID NO: 3082958 - RNA, 23 nt, Human
ccagccgagauagccaaggccaa

SEQ ID NO: 3082959 - RNA, 17 nt, Human
ccagcccuuagcaggga

SEQ ID NO: 3082960 - RNA, 16 nt, Human
ccagcccuuagcaggg

SEQ ID NO: 3082961 - RNA, 16 nt, Human
ccagccccagugccca

SEQ ID NO: 3082962 - RNA, 23 nt, Human
ccagccccaaaacucuccucugc

SEQ ID NO: 3082963 - RNA, 15 nt, Human
ccagccccagugccc

SEQ ID NO: 3082964 - RNA, 13 nt, Human
ccagccccagugc

SEQ ID NO: 3082965 - RNA, 22 nt, Human
ccagcaagugagagcugggugu

SEQ ID NO: 3082966 - RNA, 21 nt, Human
ccagcaagugagagcugggug

SEQ ID NO: 3082967 - RNA, 20 nt, Human
ccagcaagugagagcugggu

SEQ ID NO: 3082968 - RNA, 16 nt, Human
ccagcaagugagagcu

SEQ ID NO: 3082969 - RNA, 14 nt, Human
ccagauuucacucu

SEQ ID NO: 3082970 - RNA, 15 nt, Human
ccagcaagugagagc

SEQ ID NO: 3082971 - RNA, 23 nt, Human
cauggcauauuuuucacauaucu

SEQ ID NO: 3082972 - RNA, 15 nt, Human
cauggcauauuuuuc

SEQ ID NO: 3082973 - RNA, 19 nt, Human
cauggcauauuuuucacau

SEQ ID NO: 3082974 - RNA, 23 nt, Human
caugggacagggaggacgcucuc

SEQ ID NO: 3082975 - RNA, 13 nt, Human
cauggcauauuuu

SEQ ID NO: 3082976 - RNA, 18 nt, Human
caugggccuccugugugu

SEQ ID NO: 3082977 - RNA, 13 nt, Human
caugcugucccuu

SEQ ID NO: 3082978 - RNA, 15 nt, Human
caugcugucccuuac

SEQ ID NO: 3082979 - RNA, 15 nt, Human
caugcuguucaugaa

SEQ ID NO: 3082980 - RNA, 15 nt, Human
cauggacuuccacug

SEQ ID NO: 3082981 - RNA, 20 nt, Human
cauggaauuggagcucgugg

SEQ ID NO: 3082982 - RNA, 16 nt, Human
caugcuguucaugaaa

SEQ ID NO: 3082983 - RNA, 18 nt, Human
caugcuguucaugaaaga

SEQ ID NO: 3082984 - RNA, 21 nt, Human
cauuaaaaaaucaguuguaca

SEQ ID NO: 3082985 - RNA, 18 nt, Human
cauguuuuucuucucccu

SEQ ID NO: 3082986 - RNA, 20 nt, Human
cauguuuuucuucucccuca

SEQ ID NO: 3082987 - RNA, 19 nt, Human
cauguuuuucuucucccuc

SEQ ID NO: 3082988 - RNA, 14 nt, Human
cauguuugugauug

SEQ ID NO: 3082989 - RNA, 12 nt, Human
cauguuugugau

SEQ ID NO: 3082990 - RNA, 23 nt, Human
cauguuugauguaucugagcagg

SEQ ID NO: 3082991 - RNA, 12 nt, Human
caugucuggcua

SEQ ID NO: 3082992 - RNA, 21 nt, Human
caugugaugagaggaaaucac

SEQ ID NO: 3082993 - RNA, 18 nt, Human
caugugaugagaggaaau

SEQ ID NO: 3082994 - RNA, 20 nt, Human
caugugaugagaggaaauca

SEQ ID NO: 3082995 - RNA, 16 nt, Human
caugugaugagaggaa

SEQ ID NO: 3082996 - RNA, 17 nt, Human
caugugaugagaggaaa

SEQ ID NO: 3082997 - RNA, 15 nt, Human
caugugaugagagga

SEQ ID NO: 3082998 - RNA, 14 nt, Human
caugugcacaugca

SEQ ID NO: 3082999 - RNA, 22 nt, Human
caugugccagguuuuuggucug

SEQ ID NO: 3083000 - RNA, 20 nt, Human
caugugcuaguaauuggaaa

SEQ ID NO: 3083001 - RNA, 19 nt, Human
cauggucggaaaacaugcu

SEQ ID NO: 3083002 - RNA, 17 nt, Human
cauggucggaaaacaug

SEQ ID NO: 3083003 - RNA, 23 nt, Human
cauggucggaaaacaugcuacac

SEQ ID NO: 3083004 - RNA, 14 nt, Human
caugguuuggagcu

SEQ ID NO: 3083005 - RNA, 15 nt, Human
caugguuuggagcug

SEQ ID NO: 3083006 - RNA, 16 nt, Human
caugguuuggagcuga

SEQ ID NO: 3083007 - RNA, 18 nt, Human
caugguuuggagcugauc

SEQ ID NO: 3083008 - RNA, 20 nt, Human
cauuguacgaagaguauuuu

SEQ ID NO: 3083009 - RNA, 19 nt, Human
cauuguacgaagaguauuu

SEQ ID NO: 3083010 - RNA, 13 nt, Human
cauugugggaagg

SEQ ID NO: 3083011 - RNA, 15 nt, Human
cauugugggaagggg

SEQ ID NO: 3083012 - RNA, 21 nt, Human
cauuguaaaugugcuuuuaaa

SEQ ID NO: 3083013 - RNA, 15 nt, Human
cauuuaaaaaaaauc

SEQ ID NO: 3083014 - RNA, 15 nt, Human
cauugaccugaggcc

SEQ ID NO: 3083015 - RNA, 17 nt, Human
cauugaccugaggcccu

SEQ ID NO: 3083016 - RNA, 14 nt, Human
cauugaccugaggc

SEQ ID NO: 3083017 - RNA, 18 nt, Human
cauugaccugaggcccuu

SEQ ID NO: 3083018 - RNA, 19 nt, Human
cauuugaaaauuuugaugu

SEQ ID NO: 3083019 - RNA, 17 nt, Human
cauuugaaaauuuugau

SEQ ID NO: 3083020 - RNA, 23 nt, Human
cauuuuaccuuugacaaagguaa

SEQ ID NO: 3083021 - RNA, 23 nt, Human
cauuuuauuuuauuaugcaugaa

SEQ ID NO: 3083022 - RNA, 22 nt, Human
cauuuuauuuuauuaugcauga

SEQ ID NO: 3083023 - RNA, 13 nt, Human
cauuugcugaaua

SEQ ID NO: 3083024 - RNA, 22 nt, Human
cauuugaggucuguucuuucca

SEQ ID NO: 3083025 - RNA, 17 nt, Human
cauuuuuaguagagaca

SEQ ID NO: 3083026 - RNA, 21 nt, Human
cauuuuuaagugcugcauuua

SEQ ID NO: 3083027 - RNA, 19 nt, Human
cauucauuuucuggguguu

SEQ ID NO: 3083028 - RNA, 22 nt, Human
cauuccaacuaucucauuucca

SEQ ID NO: 3083029 - RNA, 21 nt, Human
cauucagauaugauucaaaug

SEQ ID NO: 3083030 - RNA, 15 nt, Human
cauuccccaggaggc

SEQ ID NO: 3083031 - RNA, 17 nt, Human
cauuccccaggaggcca

SEQ ID NO: 3083032 - RNA, 13 nt, Human
cauuccccaggag

SEQ ID NO: 3083033 - RNA, 18 nt, Human
cauuccccaggaggccag

SEQ ID NO: 3083034 - RNA, 19 nt, Human
cauuccccaggaggccagc

SEQ ID NO: 3083035 - RNA, 20 nt, Human
cauuccccaggaggccagcc

SEQ ID NO: 3083036 - RNA, 20 nt, Human
cauucaaauguauuacagug

SEQ ID NO: 3083037 - RNA, 13 nt, Human
cauucuggaauaa

SEQ ID NO: 3083038 - RNA, 17 nt, Human
cauucuguuaaucauua

SEQ ID NO: 3083039 - RNA, 20 nt, Human
cauucugccugcccaggccc

SEQ ID NO: 3083040 - RNA, 19 nt, Human
cauucugccugcccaggcc

SEQ ID NO: 3083041 - RNA, 18 nt, Human
cauucugccugcccaggc

SEQ ID NO: 3083042 - RNA, 17 nt, Human
cauucugccugcccagg

SEQ ID NO: 3083043 - RNA, 16 nt, Human
cauucugccugcccag

SEQ ID NO: 3083044 - RNA, 15 nt, Human
cauucugccugccca

SEQ ID NO: 3083045 - RNA, 13 nt, Human
cauucugccugcc

SEQ ID NO: 3083046 - RNA, 12 nt, Human
cauucugccugc

SEQ ID NO: 3083047 - RNA, 14 nt, Human
cauuccugaugcuu

SEQ ID NO: 3083048 - RNA, 16 nt, Human
cauuccugaugcuucu

SEQ ID NO: 3083049 - RNA, 19 nt, Human
cauuccugaugcuucuuca

SEQ ID NO: 3083050 - RNA, 22 nt, Human
cauuccugaugcuucuucagag

SEQ ID NO: 3083051 - RNA, 14 nt, Human
cauuccugaacagg

SEQ ID NO: 3083052 - RNA, 23 nt, Human
cauuccugaugcuucuucagaga

SEQ ID NO: 3083053 - RNA, 23 nt, Human
cauucuucuguacgucugacagg

SEQ ID NO: 3083054 - RNA, 17 nt, Human
caucugacuaugacaua

SEQ ID NO: 3083055 - RNA, 16 nt, Human
caucucuuguuuaaau

SEQ ID NO: 3083056 - RNA, 15 nt, Human
caucucuccuccuuu

SEQ ID NO: 3083057 - RNA, 16 nt, Human
caucucuacaaaaagc

SEQ ID NO: 3083058 - RNA, 17 nt, Human
caucuugcucugcugac

SEQ ID NO: 3083059 - RNA, 16 nt, Human
caucuugcucugcuga

SEQ ID NO: 3083060 - RNA, 15 nt, Human
caucuugcucugcug

SEQ ID NO: 3083061 - RNA, 16 nt, Human
caucuugaauuguaag

SEQ ID NO: 3083062 - RNA, 21 nt, Human
caucuugaauuguaaggaaug

SEQ ID NO: 3083063 - RNA, 13 nt, Human
caugagcaucagg

SEQ ID NO: 3083064 - RNA, 18 nt, Human
caugaagauguagaggag

SEQ ID NO: 3083065 - RNA, 19 nt, Human
caugaagauguagaggaga

SEQ ID NO: 3083066 - RNA, 15 nt, Human
caugagcaucaggcc

SEQ ID NO: 3083067 - RNA, 16 nt, Human
caugagcaucaggcca

SEQ ID NO: 3083068 - RNA, 17 nt, Human
caugagcaucaggccag

SEQ ID NO: 3083069 - RNA, 18 nt, Human
caugagcaucaggccagg

SEQ ID NO: 3083070 - RNA, 20 nt, Human
caugagcaucaggccaggcc

SEQ ID NO: 3083071 - RNA, 21 nt, Human
caugagcaucaggccaggccc

SEQ ID NO: 3083072 - RNA, 22 nt, Human
caugagcaucaggccaggcccu

SEQ ID NO: 3083073 - RNA, 23 nt, Human
caugagcaucaggccaggcccuc

SEQ ID NO: 3083074 - RNA, 21 nt, Human
caugagccucagcauccuggc

SEQ ID NO: 3083075 - RNA, 20 nt, Human
caugagccucagcauccugg

SEQ ID NO: 3083076 - RNA, 19 nt, Human
caugagccucagcauccug

SEQ ID NO: 3083077 - RNA, 18 nt, Human
caugagccucagcauccu

SEQ ID NO: 3083078 - RNA, 17 nt, Human
caugagccucagcaucc

SEQ ID NO: 3083079 - RNA, 15 nt, Human
caugagccucagcau

SEQ ID NO: 3083080 - RNA, 12 nt, Human
caugagccucag

SEQ ID NO: 3083081 - RNA, 16 nt, Human
caugagccgcccaagg

SEQ ID NO: 3083082 - RNA, 17 nt, Human
caugagccgcccaaggc

SEQ ID NO: 3083083 - RNA, 19 nt, Human
caugagccgcccaaggccu

SEQ ID NO: 3083084 - RNA, 21 nt, Human
caugagccgcccaaggccuuc

SEQ ID NO: 3083085 - RNA, 22 nt, Human
caugagccgcccaaggccuucc

SEQ ID NO: 3083086 - RNA, 13 nt, Human
caugaguccccug

SEQ ID NO: 3083087 - RNA, 19 nt, Human
caugagguacugagaguga

SEQ ID NO: 3083088 - RNA, 14 nt, Human
caugaguccccugu

SEQ ID NO: 3083089 - RNA, 15 nt, Human
caugaguccccuguu

SEQ ID NO: 3083090 - RNA, 23 nt, Human
caugaguccccuguuuguuucug

SEQ ID NO: 3083091 - RNA, 23 nt, Human
caugaggaacaaggcaaggcugu

SEQ ID NO: 3083092 - RNA, 16 nt, Human
caugagguacugagag

SEQ ID NO: 3083093 - RNA, 18 nt, Human
caugagggagaugccaug

SEQ ID NO: 3083094 - RNA, 16 nt, Human
caugaggaacaaggca

SEQ ID NO: 3083095 - RNA, 17 nt, Human
caugaggaacaaggcaa

SEQ ID NO: 3083096 - RNA, 20 nt, Human
caugaggaacaaggcaaggc

SEQ ID NO: 3083097 - RNA, 21 nt, Human
caugaggaacaaggcaaggcu

SEQ ID NO: 3083098 - RNA, 23 nt, Human
caugagccucagcauccuggcac

SEQ ID NO: 3083099 - RNA, 22 nt, Human
caugagccucagcauccuggca

SEQ ID NO: 3083100 - RNA, 21 nt, Human
caugaaaacacauuuuucuua

SEQ ID NO: 3083101 - RNA, 19 nt, Human
caugaaaacacauuuuucu

SEQ ID NO: 3083102 - RNA, 14 nt, Human
caugaaagauucaa

SEQ ID NO: 3083103 - RNA, 12 nt, Human
caugaagacaga

SEQ ID NO: 3083104 - RNA, 17 nt, Human
caugaaaacacauuuuu

SEQ ID NO: 3083105 - RNA, 16 nt, Human
caugaaaacacauuuu

SEQ ID NO: 3083106 - RNA, 15 nt, Human
caugaaaacacauuu

SEQ ID NO: 3083107 - RNA, 14 nt, Human
caugaaaacacauu

SEQ ID NO: 3083108 - RNA, 13 nt, Human
caugaaaacacau

SEQ ID NO: 3083109 - RNA, 21 nt, Human
cauaucuaguaugaaauuaua

SEQ ID NO: 3083110 - RNA, 17 nt, Human
cauauugauuuccguua

SEQ ID NO: 3083111 - RNA, 18 nt, Human
cauauucuguuggccagu

SEQ ID NO: 3083112 - RNA, 22 nt, Human
cauauucuguuggccaguguga

SEQ ID NO: 3083113 - RNA, 21 nt, Human
cauauugauuuccguuaaaau

SEQ ID NO: 3083114 - RNA, 13 nt, Human
cauauuguuacug

SEQ ID NO: 3083115 - RNA, 19 nt, Human
cauauuguuacugguacca

SEQ ID NO: 3083116 - RNA, 17 nt, Human
cauaucuaguaugaaau

SEQ ID NO: 3083117 - RNA, 18 nt, Human
cauaucuaguaugaaauu

SEQ ID NO: 3083118 - RNA, 15 nt, Human
cauaucuaguaugaa

SEQ ID NO: 3083119 - RNA, 23 nt, Human
cauauauauguuuuaagaggcag

SEQ ID NO: 3083120 - RNA, 15 nt, Human
cauauauaacaaugc

SEQ ID NO: 3083121 - RNA, 16 nt, Human
cauauaagugauugcu

SEQ ID NO: 3083122 - RNA, 23 nt, Human
cauauaagauucauauuuacuuc

SEQ ID NO: 3083123 - RNA, 13 nt, Human
cauauauaacaau

SEQ ID NO: 3083124 - RNA, 16 nt, Human
cauagguuuaauaauu

SEQ ID NO: 3083125 - RNA, 19 nt, Human
cagugcucacccacaccau

SEQ ID NO: 3083126 - RNA, 15 nt, Human
cauaguaugguggcu

SEQ ID NO: 3083127 - RNA, 16 nt, Human
cauaguaugguggcug

SEQ ID NO: 3083128 - RNA, 14 nt, Human
caucaacaucuugg

SEQ ID NO: 3083129 - RNA, 15 nt, Human
caucaugucuggcua

SEQ ID NO: 3083130 - RNA, 14 nt, Human
caucaugucuggcu

SEQ ID NO: 3083131 - RNA, 13 nt, Human
caucaugucuggc

SEQ ID NO: 3083132 - RNA, 16 nt, Human
caucauccuaagcuau

SEQ ID NO: 3083133 - RNA, 20 nt, Human
caucaccaacgucugugcca

SEQ ID NO: 3083134 - RNA, 12 nt, Human
caucacccgcua

SEQ ID NO: 3083135 - RNA, 13 nt, Human
caucccuccuggg

SEQ ID NO: 3083136 - RNA, 15 nt, Human
caucccucuggggcu

SEQ ID NO: 3083137 - RNA, 22 nt, Human
caucccugaaggccccgcccag

SEQ ID NO: 3083138 - RNA, 18 nt, Human
caucccuuaccugggaaa

SEQ ID NO: 3083139 - RNA, 17 nt, Human
cauccagguucagcuug

SEQ ID NO: 3083140 - RNA, 23 nt, Human
cauccacugugccaugugccagg

SEQ ID NO: 3083141 - RNA, 17 nt, Human
cauccacugugccaugu

SEQ ID NO: 3083142 - RNA, 14 nt, Human
cauccacugugcca

SEQ ID NO: 3083143 - RNA, 23 nt, Human
caggugugagucaccaagcccag

SEQ ID NO: 3083144 - RNA, 22 nt, Human
caggugugagucaccaagccca

SEQ ID NO: 3083145 - RNA, 16 nt, Human
caggugugagucacca

SEQ ID NO: 3083146 - RNA, 21 nt, Human
caggugugagucaccaagccc

SEQ ID NO: 3083147 - RNA, 20 nt, Human
caggugugagucaccaagcc

SEQ ID NO: 3083148 - RNA, 23 nt, Human
caggugugaaccaccacacccag

SEQ ID NO: 3083149 - RNA, 22 nt, Human
caggugugaaccaccacaccca

SEQ ID NO: 3083150 - RNA, 19 nt, Human
caggugugaaccaccacac

SEQ ID NO: 3083151 - RNA, 16 nt, Human
caggugugaaccacca

SEQ ID NO: 3083152 - RNA, 12 nt, Human
caggugugaacc

SEQ ID NO: 3083153 - RNA, 19 nt, Human
caggugucccugcacuugc

SEQ ID NO: 3083154 - RNA, 18 nt, Human
caggugucccugcacuug

SEQ ID NO: 3083155 - RNA, 16 nt, Human
caggugucccugcacu

SEQ ID NO: 3083156 - RNA, 15 nt, Human
caggugucccugcac

SEQ ID NO: 3083157 - RNA, 12 nt, Human
cagguucagcuu

SEQ ID NO: 3083158 - RNA, 13 nt, Human
cagguucagcuug

SEQ ID NO: 3083159 - RNA, 21 nt, Human
caguaaaugggggugcauuug

SEQ ID NO: 3083160 - RNA, 20 nt, Human
caguaaaugggggugcauuu

SEQ ID NO: 3083161 - RNA, 22 nt, Human
caguaaaugggggugcauuuga

SEQ ID NO: 3083162 - RNA, 13 nt, Human
caguaauaacucu

SEQ ID NO: 3083163 - RNA, 12 nt, Human
caguaauaacuc

SEQ ID NO: 3083164 - RNA, 18 nt, Human
cagguggggucacucugg

SEQ ID NO: 3083165 - RNA, 17 nt, Human
cagguggggcagcuuga

SEQ ID NO: 3083166 - RNA, 16 nt, Human
cagguggggcagcuug

SEQ ID NO: 3083167 - RNA, 15 nt, Human
cagguggggcagcuu

SEQ ID NO: 3083168 - RNA, 14 nt, Human
cagguggggcagcu

SEQ ID NO: 3083169 - RNA, 13 nt, Human
cagguggggcagc

SEQ ID NO: 3083170 - RNA, 19 nt, Human
cagguggggucacucuggc

SEQ ID NO: 3083171 - RNA, 20 nt, Human
cagguggggucacucuggca

SEQ ID NO: 3083172 - RNA, 21 nt, Human
cagguggggucacucuggcag

SEQ ID NO: 3083173 - RNA, 22 nt, Human
cagguggggucacucuggcagc

SEQ ID NO: 3083174 - RNA, 23 nt, Human
cagguggggucacucuggcagcu

SEQ ID NO: 3083175 - RNA, 18 nt, Human
caggugguuauggagagg

SEQ ID NO: 3083176 - RNA, 14 nt, Human
caggugucccugca

SEQ ID NO: 3083177 - RNA, 11 nt, Human
caggugucccu

SEQ ID NO: 3083178 - RNA, 20 nt, Human
caggugguuauggagagggu

SEQ ID NO: 3083179 - RNA, 18 nt, Human
caggucccuaauaaagcu

SEQ ID NO: 3083180 - RNA, 17 nt, Human
caggucccuaauaaagc

SEQ ID NO: 3083181 - RNA, 16 nt, Human
caggucccuaauaaag

SEQ ID NO: 3083182 - RNA, 15 nt, Human
caggucccuaauaaa

SEQ ID NO: 3083183 - RNA, 14 nt, Human
caggucccuaauaa

SEQ ID NO: 3083184 - RNA, 13 nt, Human
caggucccuaaua

SEQ ID NO: 3083185 - RNA, 12 nt, Human
caggucccuaau

SEQ ID NO: 3083186 - RNA, 11 nt, Human
caggucccuaa

SEQ ID NO: 3083187 - RNA, 21 nt, Human
caggucauauuaauauauuuc

SEQ ID NO: 3083188 - RNA, 20 nt, Human
caggucauauuaauauauuu

SEQ ID NO: 3083189 - RNA, 21 nt, Human
cagguaacaggcagauacagg

SEQ ID NO: 3083190 - RNA, 20 nt, Human
cagguaacaggcagauacag

SEQ ID NO: 3083191 - RNA, 22 nt, Human
caggucccuaauaaagcugugu

SEQ ID NO: 3083192 - RNA, 21 nt, Human
caggucccuaauaaagcugug

SEQ ID NO: 3083193 - RNA, 20 nt, Human
caggucccuaauaaagcugu

SEQ ID NO: 3083194 - RNA, 19 nt, Human
caggucccuaauaaagcug

SEQ ID NO: 3083195 - RNA, 23 nt, Human
caggucuugaacuccuggccuca

SEQ ID NO: 3083196 - RNA, 22 nt, Human
caggucuugaacuccuggccuc

SEQ ID NO: 3083197 - RNA, 21 nt, Human
caggucuugaacuccuggccu

SEQ ID NO: 3083198 - RNA, 20 nt, Human
caggucuugaacuccuggcc

SEQ ID NO: 3083199 - RNA, 19 nt, Human
caggucuugaacuccuggc

SEQ ID NO: 3083200 - RNA, 18 nt, Human
caggucuugaacuccugg

SEQ ID NO: 3083201 - RNA, 13 nt, Human
caggugagaagca

SEQ ID NO: 3083202 - RNA, 20 nt, Human
caggugagaagcagaggaag

SEQ ID NO: 3083203 - RNA, 21 nt, Human
caggugagaagcagaggaagg

SEQ ID NO: 3083204 - RNA, 23 nt, Human
cagggucccugguggcagcucac

SEQ ID NO: 3083205 - RNA, 18 nt, Human
caggguccuguagcccua

SEQ ID NO: 3083206 - RNA, 15 nt, Human
cagggucucacucug

SEQ ID NO: 3083207 - RNA, 23 nt, Human
cagggucucacuauguugcccag

SEQ ID NO: 3083208 - RNA, 22 nt, Human
cagggucucacuauguugccca

SEQ ID NO: 3083209 - RNA, 21 nt, Human
cagggucucacuauguugccc

SEQ ID NO: 3083210 - RNA, 16 nt, Human
cagggucucacucugu

SEQ ID NO: 3083211 - RNA, 16 nt, Human
caggguuuugccaugu

SEQ ID NO: 3083212 - RNA, 17 nt, Human
cagguaacaggcagaua

SEQ ID NO: 3083213 - RNA, 16 nt, Human
cagguaacaggcagau

SEQ ID NO: 3083214 - RNA, 15 nt, Human
cagguaacaggcaga

SEQ ID NO: 3083215 - RNA, 14 nt, Human
cagguaacaggcag

SEQ ID NO: 3083216 - RNA, 15 nt, Human
cagggucccuggugg

SEQ ID NO: 3083217 - RNA, 18 nt, Human
cagggucccugguggcag

SEQ ID NO: 3083218 - RNA, 19 nt, Human
cagggucccugguggcagc

SEQ ID NO: 3083219 - RNA, 22 nt, Human
cagggucccugguggcagcuca

SEQ ID NO: 3083220 - RNA, 14 nt, Human
cagggucccuggug

SEQ ID NO: 3083221 - RNA, 12 nt, Human
cagggucccugg

SEQ ID NO: 3083222 - RNA, 20 nt, Human
caggguauuccagagugggg

SEQ ID NO: 3083223 - RNA, 21 nt, Human
caggguauuccagagugggga

SEQ ID NO: 3083224 - RNA, 14 nt, Human
caggggugggacac

SEQ ID NO: 3083225 - RNA, 15 nt, Human
caggggugggacacc

SEQ ID NO: 3083226 - RNA, 20 nt, Human
caggggugggacacccugug

SEQ ID NO: 3083227 - RNA, 21 nt, Human
caggggugggacacccuguga

SEQ ID NO: 3083228 - RNA, 16 nt, Human
caguauuacuucugcu

SEQ ID NO: 3083229 - RNA, 18 nt, Human
caguauuacuucugcuac

SEQ ID NO: 3083230 - RNA, 22 nt, Human
cagucaggaaagagaacuucca

SEQ ID NO: 3083231 - RNA, 15 nt, Human
cagucaggaaagaga

SEQ ID NO: 3083232 - RNA, 18 nt, Human
cagucaggaaagagaacu

SEQ ID NO: 3083233 - RNA, 14 nt, Human
caguccauugaaag

SEQ ID NO: 3083234 - RNA, 13 nt, Human
caguccaugaaga

SEQ ID NO: 3083235 - RNA, 16 nt, Human
caguccauagcagaga

SEQ ID NO: 3083236 - RNA, 20 nt, Human
cagucauucagauaugauuc

SEQ ID NO: 3083237 - RNA, 17 nt, Human
cagucauucagauauga

SEQ ID NO: 3083238 - RNA, 15 nt, Human
caguaucucagggcc

SEQ ID NO: 3083239 - RNA, 12 nt, Human
caguaucuugaa

SEQ ID NO: 3083240 - RNA, 18 nt, Human
caguaucuugaagacuuu

SEQ ID NO: 3083241 - RNA, 21 nt, Human
caguaucuugaagacuuuucu

SEQ ID NO: 3083242 - RNA, 12 nt, Human
caguauggcagc

SEQ ID NO: 3083243 - RNA, 13 nt, Human
caguaucucaggg

SEQ ID NO: 3083244 - RNA, 12 nt, Human
caguagugauag

SEQ ID NO: 3083245 - RNA, 12 nt, Human
cagucccugcca

SEQ ID NO: 3083246 - RNA, 13 nt, Human
cagucccugccaa

SEQ ID NO: 3083247 - RNA, 14 nt, Human
cagucccugccaau

SEQ ID NO: 3083248 - RNA, 15 nt, Human
cagucccugccaaug

SEQ ID NO: 3083249 - RNA, 16 nt, Human
cagucccugccaaugg

SEQ ID NO: 3083250 - RNA, 12 nt, Human
caguccucccau

SEQ ID NO: 3083251 - RNA, 13 nt, Human
caguccucccauc

SEQ ID NO: 3083252 - RNA, 14 nt, Human
caguccucccaucu

SEQ ID NO: 3083253 - RNA, 15 nt, Human
caguccucccaucuc

SEQ ID NO: 3083254 - RNA, 17 nt, Human
cagucccugccaaugga

SEQ ID NO: 3083255 - RNA, 16 nt, Human
cagugaaagaaaauaa

SEQ ID NO: 3083256 - RNA, 20 nt, Human
cagugaaagaaaauaacaau

SEQ ID NO: 3083257 - RNA, 19 nt, Human
cagucuggaaugcaguggu

SEQ ID NO: 3083258 - RNA, 15 nt, Human
caguccuuaccagca

SEQ ID NO: 3083259 - RNA, 18 nt, Human
caguccuuaccagcagag

SEQ ID NO: 3083260 - RNA, 15 nt, Human
caguccugcccgcca

SEQ ID NO: 3083261 - RNA, 19 nt, Human
caguccuuaccagcagagc

SEQ ID NO: 3083262 - RNA, 20 nt, Human
caguccuuaccagcagagca

SEQ ID NO: 3083263 - RNA, 21 nt, Human
caguccuuaccagcagagcac

SEQ ID NO: 3083264 - RNA, 18 nt, Human
cagucuggaaugcagugg

SEQ ID NO: 3083265 - RNA, 16 nt, Human
caguccucccaucuca

SEQ ID NO: 3083266 - RNA, 17 nt, Human
caguccucccaucucac

SEQ ID NO: 3083267 - RNA, 14 nt, Human
caguccugcccgcc

SEQ ID NO: 3083268 - RNA, 12 nt, Human
cagugaauucuu

SEQ ID NO: 3083269 - RNA, 15 nt, Human
cagugagacagcucu

SEQ ID NO: 3083270 - RNA, 17 nt, Human
cagugaggcucugcccu

SEQ ID NO: 3083271 - RNA, 18 nt, Human
cagugaggcucugcccuu

SEQ ID NO: 3083272 - RNA, 19 nt, Human
cagugaggcucugcccuug

SEQ ID NO: 3083273 - RNA, 20 nt, Human
cagugaggcucugcccuugg

SEQ ID NO: 3083274 - RNA, 18 nt, Human
cagugagucgaggacagg

SEQ ID NO: 3083275 - RNA, 17 nt, Human
cagugagucgaggacag

SEQ ID NO: 3083276 - RNA, 21 nt, Human
cagugaggcucugcccuuggu

SEQ ID NO: 3083277 - RNA, 13 nt, Human
cagugaggcucug

SEQ ID NO: 3083278 - RNA, 14 nt, Human
cagugaggcucugc

SEQ ID NO: 3083279 - RNA, 15 nt, Human
cagugaggcucugcc

SEQ ID NO: 3083280 - RNA, 16 nt, Human
cagugaggcucugccc

SEQ ID NO: 3083281 - RNA, 12 nt, Human
cagugaggcucu

SEQ ID NO: 3083282 - RNA, 24 nt, Human
cagugagccgagauugcaccacug

SEQ ID NO: 3083283 - RNA, 23 nt, Human
cagugagucgaggacagggaggu

SEQ ID NO: 3083284 - RNA, 22 nt, Human
cagugagucgaggacagggagg

SEQ ID NO: 3083285 - RNA, 20 nt, Human
cagugagucgaggacaggga

SEQ ID NO: 3083286 - RNA, 19 nt, Human
cagugagucgaggacaggg

SEQ ID NO: 3083287 - RNA, 18 nt, Human
cagugauuaccagggacu

SEQ ID NO: 3083288 - RNA, 17 nt, Human
cagugauuaccagggac

SEQ ID NO: 3083289 - RNA, 15 nt, Human
cagugccuuauggaa

SEQ ID NO: 3083290 - RNA, 16 nt, Human
cagugccuuauggaac

SEQ ID NO: 3083291 - RNA, 17 nt, Human
cagugccuuauggaaca

SEQ ID NO: 3083292 - RNA, 18 nt, Human
cagugccuuauggaacac

SEQ ID NO: 3083293 - RNA, 19 nt, Human
cagugccuuauggaacacu

SEQ ID NO: 3083294 - RNA, 20 nt, Human
cagugccuuauggaacacuc

SEQ ID NO: 3083295 - RNA, 21 nt, Human
cagugccuuauggaacacucu

SEQ ID NO: 3083296 - RNA, 22 nt, Human
cagugccuuauggaacacucug

SEQ ID NO: 3083297 - RNA, 15 nt, Human
cagugccgagaagga

SEQ ID NO: 3083298 - RNA, 18 nt, Human
cagugccgagaaggaagc

SEQ ID NO: 3083299 - RNA, 12 nt, Human
cagugccucucc

SEQ ID NO: 3083300 - RNA, 20 nt, Human
cagugccucucccugcugcu

SEQ ID NO: 3083301 - RNA, 21 nt, Human
cagugccucucccugcugcuc

SEQ ID NO: 3083302 - RNA, 22 nt, Human
cagugccucucccugcugcucc

SEQ ID NO: 3083303 - RNA, 11 nt, Human
cagugccuuau

SEQ ID NO: 3083304 - RNA, 13 nt, Human
cagugccuuaugg

SEQ ID NO: 3083305 - RNA, 22 nt, Human
cagugccuggguggaugggcca

SEQ ID NO: 3083306 - RNA, 23 nt, Human
cagugccuuauggaacacucuga

SEQ ID NO: 3083307 - RNA, 13 nt, Human
cagugcucaccca

SEQ ID NO: 3083308 - RNA, 12 nt, Human
cagugcucaccc

SEQ ID NO: 3083309 - RNA, 17 nt, Human
cagugcucacccacacc

SEQ ID NO: 3083310 - RNA, 18 nt, Human
cagugcucacccacacca

SEQ ID NO: 3083311 - RNA, 19 nt, Human
caggggaggguagagcgga

SEQ ID NO: 3083312 - RNA, 14 nt, Human
cagggccuggcuca

SEQ ID NO: 3083313 - RNA, 15 nt, Human
cagggccuggcucag

SEQ ID NO: 3083314 - RNA, 13 nt, Human
cagggccuggcuc

SEQ ID NO: 3083315 - RNA, 21 nt, Human
cagggccucugcggagcacac

SEQ ID NO: 3083316 - RNA, 16 nt, Human
cagggccuggcucagg

SEQ ID NO: 3083317 - RNA, 19 nt, Human
cagggccuggcucaggugg

SEQ ID NO: 3083318 - RNA, 11 nt, Human
caggggacagg

SEQ ID NO: 3083319 - RNA, 16 nt, Human
caggggacaggauggu

SEQ ID NO: 3083320 - RNA, 23 nt, Human
cagggacagaggggguggccucc

SEQ ID NO: 3083321 - RNA, 18 nt, Human
cagggacaggauaagagg

SEQ ID NO: 3083322 - RNA, 14 nt, Human
cagggcacaccggg

SEQ ID NO: 3083323 - RNA, 21 nt, Human
cagggcacaccgggcacucag

SEQ ID NO: 3083324 - RNA, 19 nt, Human
cagggcacaccgggcacuc

SEQ ID NO: 3083325 - RNA, 17 nt, Human
cagggcacaccgggcac

SEQ ID NO: 3083326 - RNA, 15 nt, Human
cagggcacaccgggc

SEQ ID NO: 3083327 - RNA, 23 nt, Human
cagggcacaccgggcacucagaa

SEQ ID NO: 3083328 - RNA, 22 nt, Human
cagggcacaccgggcacucaga

SEQ ID NO: 3083329 - RNA, 12 nt, Human
cagggccucugc

SEQ ID NO: 3083330 - RNA, 13 nt, Human
cagggccucugcg

SEQ ID NO: 3083331 - RNA, 14 nt, Human
cagggccucugcgg

SEQ ID NO: 3083332 - RNA, 15 nt, Human
cagggccucugcgga

SEQ ID NO: 3083333 - RNA, 17 nt, Human
cagggccucugcggagc

SEQ ID NO: 3083334 - RNA, 14 nt, Human
cagggcaucuggga

SEQ ID NO: 3083335 - RNA, 17 nt, Human
cagggcauggcugggaa

SEQ ID NO: 3083336 - RNA, 14 nt, Human
cagggacagagggg

SEQ ID NO: 3083337 - RNA, 20 nt, Human
cagggacagaggggguggcc

SEQ ID NO: 3083338 - RNA, 13 nt, Human
cagggacagaggg

SEQ ID NO: 3083339 - RNA, 22 nt, Human
cagggaaacagcuaaugggaca

SEQ ID NO: 3083340 - RNA, 16 nt, Human
cagggaaacagcuaau

SEQ ID NO: 3083341 - RNA, 23 nt, Human
caggcugggucgcccuggacugu

SEQ ID NO: 3083342 - RNA, 21 nt, Human
caggcugggucgcccuggacu

SEQ ID NO: 3083343 - RNA, 23 nt, Human
caggcugggcuucaguggcagcu

SEQ ID NO: 3083344 - RNA, 12 nt, Human
caggcugccagu

SEQ ID NO: 3083345 - RNA, 21 nt, Human
caggcugccagugccugggug

SEQ ID NO: 3083346 - RNA, 19 nt, Human
caggcugccagugccuggg

SEQ ID NO: 3083347 - RNA, 20 nt, Human
caggcugccagugccugggu

SEQ ID NO: 3083348 - RNA, 14 nt, Human
caggcugccagugc

SEQ ID NO: 3083349 - RNA, 16 nt, Human
caggcugccagugccu

SEQ ID NO: 3083350 - RNA, 17 nt, Human
caggcugccagugccug

SEQ ID NO: 3083351 - RNA, 23 nt, Human
caggcuuuuuuaucaugugaaau

SEQ ID NO: 3083352 - RNA, 22 nt, Human
caggcuuagucacugagacagc

SEQ ID NO: 3083353 - RNA, 23 nt, Human
caggcuuagucacugagacagcc

SEQ ID NO: 3083354 - RNA, 16 nt, Human
caggcuuagucacuga

SEQ ID NO: 3083355 - RNA, 17 nt, Human
caggcuuagucacugag

SEQ ID NO: 3083356 - RNA, 20 nt, Human
caggcuuagucacugagaca

SEQ ID NO: 3083357 - RNA, 21 nt, Human
caggcuuagucacugagacag

SEQ ID NO: 3083358 - RNA, 23 nt, Human
caggcuguaucccaugagccuca

SEQ ID NO: 3083359 - RNA, 22 nt, Human
caggcuguaucccaugagccuc

SEQ ID NO: 3083360 - RNA, 21 nt, Human
caggcuguaucccaugagccu

SEQ ID NO: 3083361 - RNA, 20 nt, Human
caggcuguaucccaugagcc

SEQ ID NO: 3083362 - RNA, 14 nt, Human
caggcuguauccca

SEQ ID NO: 3083363 - RNA, 19 nt, Human
caggcuggucucaaacucu

SEQ ID NO: 3083364 - RNA, 12 nt, Human
caggcuggucuc

SEQ ID NO: 3083365 - RNA, 14 nt, Human
caggcuacugucag

SEQ ID NO: 3083366 - RNA, 13 nt, Human
caggcuagaugua

SEQ ID NO: 3083367 - RNA, 19 nt, Human
caggcuagauguauguacu

SEQ ID NO: 3083368 - RNA, 20 nt, Human
caggcuccuuuagcgcccag

SEQ ID NO: 3083369 - RNA, 19 nt, Human
caggcuccuuuagcgccca

SEQ ID NO: 3083370 - RNA, 14 nt, Human
caggcuccuuuagc

SEQ ID NO: 3083371 - RNA, 13 nt, Human
caggcucucaggc

SEQ ID NO: 3083372 - RNA, 14 nt, Human
caggcucucaggcc

SEQ ID NO: 3083373 - RNA, 15 nt, Human
caggcucucaggcca

SEQ ID NO: 3083374 - RNA, 16 nt, Human
caggcucucaggccag

SEQ ID NO: 3083375 - RNA, 20 nt, Human
caggcucgggcuccccagcc

SEQ ID NO: 3083376 - RNA, 12 nt, Human
caggcucucagg

SEQ ID NO: 3083377 - RNA, 21 nt, Human
caggcuccuuuagcgcccagu

SEQ ID NO: 3083378 - RNA, 17 nt, Human
caggcucucaggccagc

SEQ ID NO: 3083379 - RNA, 18 nt, Human
caggcucucaggccagcu

SEQ ID NO: 3083380 - RNA, 19 nt, Human
caggcucucaggccagcug

SEQ ID NO: 3083381 - RNA, 20 nt, Human
caggcucucaggccagcugc

SEQ ID NO: 3083382 - RNA, 21 nt, Human
caggcucucaggccagcugcu

SEQ ID NO: 3083383 - RNA, 23 nt, Human
caggcucucaggccagcugcuug

SEQ ID NO: 3083384 - RNA, 19 nt, Human
caggcccggcuccaggcuc

SEQ ID NO: 3083385 - RNA, 18 nt, Human
caggcccggcuccaggcu

SEQ ID NO: 3083386 - RNA, 16 nt, Human
caggcccggcuccagg

SEQ ID NO: 3083387 - RNA, 17 nt, Human
caggcccggcuccaggc

SEQ ID NO: 3083388 - RNA, 13 nt, Human
caggcccucugcc

SEQ ID NO: 3083389 - RNA, 14 nt, Human
caggcccucugccc

SEQ ID NO: 3083390 - RNA, 15 nt, Human
caggcccucugccca

SEQ ID NO: 3083391 - RNA, 21 nt, Human
caggcccggcuccaggcuccu

SEQ ID NO: 3083392 - RNA, 20 nt, Human
caggcccggcuccaggcucc

SEQ ID NO: 3083393 - RNA, 22 nt, Human
caggcccggcuccaggcuccuu

SEQ ID NO: 3083394 - RNA, 16 nt, Human
caggcccucugcccac

SEQ ID NO: 3083395 - RNA, 17 nt, Human
caggcccucugcccacu

SEQ ID NO: 3083396 - RNA, 19 nt, Human
caggcccucugcccacucc

SEQ ID NO: 3083397 - RNA, 20 nt, Human
caggcccucugcccacuccc

SEQ ID NO: 3083398 - RNA, 21 nt, Human
caggcccucugcccacucccu

SEQ ID NO: 3083399 - RNA, 22 nt, Human
caggcccucugcccacucccug

SEQ ID NO: 3083400 - RNA, 20 nt, Human
caggcccuugucggccccac

SEQ ID NO: 3083401 - RNA, 20 nt, Human
caggccaggcccucugccca

SEQ ID NO: 3083402 - RNA, 21 nt, Human
caggccaggcccucugcccac

SEQ ID NO: 3083403 - RNA, 22 nt, Human
caggccaggcccucugcccacu

SEQ ID NO: 3083404 - RNA, 20 nt, Human
caggccacaagacccuugug

SEQ ID NO: 3083405 - RNA, 17 nt, Human
caggccacaagacccuu

SEQ ID NO: 3083406 - RNA, 18 nt, Human
caggccacaagacccuug

SEQ ID NO: 3083407 - RNA, 13 nt, Human
caggccacaagac

SEQ ID NO: 3083408 - RNA, 18 nt, Human
caggccaaacucaccugc

SEQ ID NO: 3083409 - RNA, 23 nt, Human
caggccaaacucaccugccccuc

SEQ ID NO: 3083410 - RNA, 19 nt, Human
caggcccccaggugccagu

SEQ ID NO: 3083411 - RNA, 14 nt, Human
caggcccccaggug

SEQ ID NO: 3083412 - RNA, 13 nt, Human
caggccccugcca

SEQ ID NO: 3083413 - RNA, 20 nt, Human
caggcccccaggugccaguu

SEQ ID NO: 3083414 - RNA, 20 nt, Human
caggccccugccacccuggg

SEQ ID NO: 3083415 - RNA, 19 nt, Human
caggccccugccacccugg

SEQ ID NO: 3083416 - RNA, 17 nt, Human
caggccccugccacccu

SEQ ID NO: 3083417 - RNA, 15 nt, Human
caggccccugccacc

SEQ ID NO: 3083418 - RNA, 15 nt, Human
caggcccggcuccag

SEQ ID NO: 3083419 - RNA, 14 nt, Human
caggcccggcucca

SEQ ID NO: 3083420 - RNA, 13 nt, Human
caggcccggcucc

SEQ ID NO: 3083421 - RNA, 20 nt, Human
caggaugaugacuauggaaa

SEQ ID NO: 3083422 - RNA, 18 nt, Human
caggaugaugacuaugga

SEQ ID NO: 3083423 - RNA, 22 nt, Human
caggaugaugacuauggaaaga

SEQ ID NO: 3083424 - RNA, 23 nt, Human
caggauggccgggcgcgguggcu

SEQ ID NO: 3083425 - RNA, 18 nt, Human
caggauucuuccucccuc

SEQ ID NO: 3083426 - RNA, 17 nt, Human
caggauucuuccucccu

SEQ ID NO: 3083427 - RNA, 21 nt, Human
caggaugguucccuugaugaa

SEQ ID NO: 3083428 - RNA, 23 nt, Human
caggaugguucccuugaugaaga

SEQ ID NO: 3083429 - RNA, 13 nt, Human
caggaucagucug

SEQ ID NO: 3083430 - RNA, 21 nt, Human
caggauauucucacagcucca

SEQ ID NO: 3083431 - RNA, 14 nt, Human
caggaucagucuga

SEQ ID NO: 3083432 - RNA, 17 nt, Human
caggcaugguggcccac

SEQ ID NO: 3083433 - RNA, 12 nt, Human
caggcaggucuu

SEQ ID NO: 3083434 - RNA, 19 nt, Human
caggcagguccaggguuug

SEQ ID NO: 3083435 - RNA, 15 nt, Human
caggcagguccaggg

SEQ ID NO: 3083436 - RNA, 14 nt, Human
caggcagguccagg

SEQ ID NO: 3083437 - RNA, 22 nt, Human
caggcaggucuugaacuccugg

SEQ ID NO: 3083438 - RNA, 13 nt, Human
caggcaggucuug

SEQ ID NO: 3083439 - RNA, 15 nt, Human
caggcaggugggaug

SEQ ID NO: 3083440 - RNA, 23 nt, Human
caggcaggucuugaacuccuggc

SEQ ID NO: 3083441 - RNA, 13 nt, Human
caggcauucccca

SEQ ID NO: 3083442 - RNA, 15 nt, Human
caggcauuccccagg

SEQ ID NO: 3083443 - RNA, 16 nt, Human
caggcauuccccagga

SEQ ID NO: 3083444 - RNA, 17 nt, Human
caggcauuccccaggag

SEQ ID NO: 3083445 - RNA, 20 nt, Human
caggcauguucucugaggac

SEQ ID NO: 3083446 - RNA, 19 nt, Human
caggcauguucucugagga

SEQ ID NO: 3083447 - RNA, 18 nt, Human
caggcauguucucugagg

SEQ ID NO: 3083448 - RNA, 15 nt, Human
caggcauguucucug

SEQ ID NO: 3083449 - RNA, 18 nt, Human
caggcauuccccaggagg

SEQ ID NO: 3083450 - RNA, 19 nt, Human
caggcauuccccaggaggc

SEQ ID NO: 3083451 - RNA, 20 nt, Human
caggcauuccccaggaggcc

SEQ ID NO: 3083452 - RNA, 21 nt, Human
caggcauuccccaggaggcca

SEQ ID NO: 3083453 - RNA, 22 nt, Human
caggcauuccccaggaggccag

SEQ ID NO: 3083454 - RNA, 23 nt, Human
caggcauuccccaggaggccagc

SEQ ID NO: 3083455 - RNA, 24 nt, Human
caggcauuccccaggaggccagcc

SEQ ID NO: 3083456 - RNA, 20 nt, Human
caggauucuuccucccuccc

SEQ ID NO: 3083457 - RNA, 16 nt, Human
caggauuuuaaucuuu

SEQ ID NO: 3083458 - RNA, 14 nt, Human
caggcagccaggcc

SEQ ID NO: 3083459 - RNA, 15 nt, Human
caggcagccaggcca

SEQ ID NO: 3083460 - RNA, 21 nt, Human
caggcaagcaccuccugccuc

SEQ ID NO: 3083461 - RNA, 16 nt, Human
caggcaagcaccuccu

SEQ ID NO: 3083462 - RNA, 15 nt, Human
caggcaagcaccucc

SEQ ID NO: 3083463 - RNA, 14 nt, Human
caggcaagcaccuc

SEQ ID NO: 3083464 - RNA, 13 nt, Human
caggcagguccag

SEQ ID NO: 3083465 - RNA, 16 nt, Human
caggcagccaggccac

SEQ ID NO: 3083466 - RNA, 17 nt, Human
caggcagccaggccaca

SEQ ID NO: 3083467 - RNA, 19 nt, Human
caggaguuucguuuucaaa

SEQ ID NO: 3083468 - RNA, 21 nt, Human
caggaguuugagaccaaccug

SEQ ID NO: 3083469 - RNA, 22 nt, Human
caggaguuugagaccaaccugg

SEQ ID NO: 3083470 - RNA, 23 nt, Human
caggaguuugagaccaaccuggg

SEQ ID NO: 3083471 - RNA, 19 nt, Human
caggagcccugggaggcuc

SEQ ID NO: 3083472 - RNA, 18 nt, Human
caggagcccugggaggcu

SEQ ID NO: 3083473 - RNA, 16 nt, Human
caggagcccugggagg

SEQ ID NO: 3083474 - RNA, 14 nt, Human
caggagcccuggga

SEQ ID NO: 3083475 - RNA, 11 nt, Human
caggagcccug

SEQ ID NO: 3083476 - RNA, 23 nt, Human
caggagccccgaggccuucucug

SEQ ID NO: 3083477 - RNA, 22 nt, Human
caggagccccgaggccuucucu

SEQ ID NO: 3083478 - RNA, 20 nt, Human
caggagccccgaggccuucu

SEQ ID NO: 3083479 - RNA, 12 nt, Human
caggagcagcca

SEQ ID NO: 3083480 - RNA, 13 nt, Human
caggagcagccac

SEQ ID NO: 3083481 - RNA, 14 nt, Human
caggagcagccaca

SEQ ID NO: 3083482 - RNA, 19 nt, Human
caggagcagccacauuccu

SEQ ID NO: 3083483 - RNA, 18 nt, Human
caggagccccgaggccuu

SEQ ID NO: 3083484 - RNA, 16 nt, Human
caggagccccgaggcc

SEQ ID NO: 3083485 - RNA, 15 nt, Human
caggagccccgaggc

SEQ ID NO: 3083486 - RNA, 21 nt, Human
caggagcccugggaggcucug

SEQ ID NO: 3083487 - RNA, 14 nt, Human
caggagccuccugc

SEQ ID NO: 3083488 - RNA, 17 nt, Human
caggagccuccugcccu

SEQ ID NO: 3083489 - RNA, 20 nt, Human
caggagccuccugcccuuac

SEQ ID NO: 3083490 - RNA, 12 nt, Human
caggagugagca

SEQ ID NO: 3083491 - RNA, 12 nt, Human
caggagaguaga

SEQ ID NO: 3083492 - RNA, 21 nt, Human
cagauggaaugcuguguuaaa

SEQ ID NO: 3083493 - RNA, 19 nt, Human
cagauggaaugcuguguua

SEQ ID NO: 3083494 - RNA, 17 nt, Human
cagauggaaugcugugu

SEQ ID NO: 3083495 - RNA, 16 nt, Human
cagauggaaugcugug

SEQ ID NO: 3083496 - RNA, 18 nt, Human
cagaugggugcuuggagg

SEQ ID NO: 3083497 - RNA, 23 nt, Human
cagaugggugcuuggaggaagga

SEQ ID NO: 3083498 - RNA, 14 nt, Human
cagauucuuuccug

SEQ ID NO: 3083499 - RNA, 14 nt, Human
cagauuuuccugaa

SEQ ID NO: 3083500 - RNA, 15 nt, Human
cagauuuuccugaaa

SEQ ID NO: 3083501 - RNA, 18 nt, Human
cagcaaaagaugcuucuc

SEQ ID NO: 3083502 - RNA, 23 nt, Human
cagcaacgcaggcccccaggugc

SEQ ID NO: 3083503 - RNA, 11 nt, Human
cagcagagcac

SEQ ID NO: 3083504 - RNA, 13 nt, Human
cagcagagcaccu

SEQ ID NO: 3083505 - RNA, 22 nt, Human
cagcagaaaugccuuacccuca

SEQ ID NO: 3083506 - RNA, 19 nt, Human
cagcagaaaugccuuaccc

SEQ ID NO: 3083507 - RNA, 17 nt, Human
cagcagaaaugccuuac

SEQ ID NO: 3083508 - RNA, 15 nt, Human
cagcagaaaugccuu

SEQ ID NO: 3083509 - RNA, 12 nt, Human
cagcaagugaga

SEQ ID NO: 3083510 - RNA, 23 nt, Human
cagcaagggugaugggaaagcau

SEQ ID NO: 3083511 - RNA, 22 nt, Human
cagcaagggugaugggaaagca

SEQ ID NO: 3083512 - RNA, 17 nt, Human
cagcaagugagagcugg

SEQ ID NO: 3083513 - RNA, 16 nt, Human
cagcaagugagagcug

SEQ ID NO: 3083514 - RNA, 15 nt, Human
cagcaagugagagcu

SEQ ID NO: 3083515 - RNA, 14 nt, Human
cagcaagugagagc

SEQ ID NO: 3083516 - RNA, 18 nt, Human
cagcaaggagauuuacaa

SEQ ID NO: 3083517 - RNA, 17 nt, Human
cagcaaggagauuuaca

SEQ ID NO: 3083518 - RNA, 19 nt, Human
cagcaagggugaugggaaa

SEQ ID NO: 3083519 - RNA, 21 nt, Human
cagcaauaaagcagcguuucu

SEQ ID NO: 3083520 - RNA, 13 nt, Human
cagcaauaaagca

SEQ ID NO: 3083521 - RNA, 21 nt, Human
cagcaagugagagcugggugu

SEQ ID NO: 3083522 - RNA, 19 nt, Human
cagcaagugagagcugggu

SEQ ID NO: 3083523 - RNA, 22 nt, Human
cagcaauaaagcagcguuucua

SEQ ID NO: 3083524 - RNA, 15 nt, Human
cagcccacuucugcc

SEQ ID NO: 3083525 - RNA, 15 nt, Human
cagcccaccccucaa

SEQ ID NO: 3083526 - RNA, 20 nt, Human
cagccccaaaacucuccucu

SEQ ID NO: 3083527 - RNA, 21 nt, Human
cagccccaaaacucuccucug

SEQ ID NO: 3083528 - RNA, 22 nt, Human
cagccccaaaacucuccucugc

SEQ ID NO: 3083529 - RNA, 18 nt, Human
cagcccacuucugccaua

SEQ ID NO: 3083530 - RNA, 14 nt, Human
cagccacauuccug

SEQ ID NO: 3083531 - RNA, 15 nt, Human
cagccacauuccuga

SEQ ID NO: 3083532 - RNA, 17 nt, Human
cagccacauuccugaug

SEQ ID NO: 3083533 - RNA, 19 nt, Human
cagccacauuccugaugcu

SEQ ID NO: 3083534 - RNA, 22 nt, Human
cagccacggccaggccagaggg

SEQ ID NO: 3083535 - RNA, 21 nt, Human
cagccacggccaggccagagg

SEQ ID NO: 3083536 - RNA, 19 nt, Human
cagccacggccaggccaga

SEQ ID NO: 3083537 - RNA, 18 nt, Human
cagccacggccaggccag

SEQ ID NO: 3083538 - RNA, 17 nt, Human
cagccacggccaggcca

SEQ ID NO: 3083539 - RNA, 16 nt, Human
cagccacggccaggcc

SEQ ID NO: 3083540 - RNA, 15 nt, Human
cagccacggccaggc

SEQ ID NO: 3083541 - RNA, 14 nt, Human
cagccacggccagg

SEQ ID NO: 3083542 - RNA, 13 nt, Human
cagccaguaaaug

SEQ ID NO: 3083543 - RNA, 22 nt, Human
cagccaguaaaugggggugcau

SEQ ID NO: 3083544 - RNA, 23 nt, Human
cagccacggccaggccagaggga

SEQ ID NO: 3083545 - RNA, 18 nt, Human
cagccaacuauggccugu

SEQ ID NO: 3083546 - RNA, 18 nt, Human
cagccaaagccuccucca

SEQ ID NO: 3083547 - RNA, 21 nt, Human
cagccaaagccuccuccagcc

SEQ ID NO: 3083548 - RNA, 15 nt, Human
cagccaaagccuccu

SEQ ID NO: 3083549 - RNA, 16 nt, Human
cagccaaagccuccuc

SEQ ID NO: 3083550 - RNA, 20 nt, Human
cagcauccuggcacccggcc

SEQ ID NO: 3083551 - RNA, 19 nt, Human
cagcauccuggcacccggc

SEQ ID NO: 3083552 - RNA, 21 nt, Human
cagcauccuggcacccggccc

SEQ ID NO: 3083553 - RNA, 12 nt, Human
cagcagccugga

SEQ ID NO: 3083554 - RNA, 14 nt, Human
cagcagccuggacc

SEQ ID NO: 3083555 - RNA, 15 nt, Human
cagcagccuggaccc

SEQ ID NO: 3083556 - RNA, 18 nt, Human
cagcagccuggacccugu

SEQ ID NO: 3083557 - RNA, 19 nt, Human
cagcagccuggacccugug

SEQ ID NO: 3083558 - RNA, 22 nt, Human
cagcagccuggacccuguggau

SEQ ID NO: 3083559 - RNA, 14 nt, Human
cagcaggcucucag

SEQ ID NO: 3083560 - RNA, 15 nt, Human
cagcaggcucucagg

SEQ ID NO: 3083561 - RNA, 12 nt, Human
cagcaggcucuc

SEQ ID NO: 3083562 - RNA, 18 nt, Human
cagcagggagggcuucug

SEQ ID NO: 3083563 - RNA, 13 nt, Human
cagcaggcugcca

SEQ ID NO: 3083564 - RNA, 14 nt, Human
cagcaggcugccag

SEQ ID NO: 3083565 - RNA, 15 nt, Human
cagcaggcugccagu

SEQ ID NO: 3083566 - RNA, 18 nt, Human
cagcaggcugccagugcc

SEQ ID NO: 3083567 - RNA, 19 nt, Human
cagcaggcugccagugccu

SEQ ID NO: 3083568 - RNA, 20 nt, Human
cagcaggcucucaggccagc

SEQ ID NO: 3083569 - RNA, 22 nt, Human
cagcaggcucucaggccagcug

SEQ ID NO: 3083570 - RNA, 16 nt, Human
cagcaggcucucaggc

SEQ ID NO: 3083571 - RNA, 17 nt, Human
cagcaggcucucaggcc

SEQ ID NO: 3083572 - RNA, 18 nt, Human
cagcaggcucucaggcca

SEQ ID NO: 3083573 - RNA, 19 nt, Human
cagcaggcucucaggccag

SEQ ID NO: 3083574 - RNA, 20 nt, Human
cagcagggagggcuucugcc

SEQ ID NO: 3083575 - RNA, 20 nt, Human
cagcaggcugccagugccug

SEQ ID NO: 3083576 - RNA, 17 nt, Human
cagcauccuggcacccg

SEQ ID NO: 3083577 - RNA, 16 nt, Human
cagcauccuggcaccc

SEQ ID NO: 3083578 - RNA, 15 nt, Human
cagcauccuggcacc

SEQ ID NO: 3083579 - RNA, 14 nt, Human
cagcauccuggcac

SEQ ID NO: 3083580 - RNA, 14 nt, Human
cagcucaccagccc

SEQ ID NO: 3083581 - RNA, 20 nt, Human
cagcuggggccaggcugggu

SEQ ID NO: 3083582 - RNA, 19 nt, Human
cagcuggggccaggcuggg

SEQ ID NO: 3083583 - RNA, 18 nt, Human
cagcuggggccaggcugg

SEQ ID NO: 3083584 - RNA, 22 nt, Human
cagcugcuuuugucuaugggac

SEQ ID NO: 3083585 - RNA, 23 nt, Human
cagcugcuuuugucuaugggacu

SEQ ID NO: 3083586 - RNA, 22 nt, Human
cagcuggggccaggcugggucg

SEQ ID NO: 3083587 - RNA, 21 nt, Human
cagcuggggccaggcuggguc

SEQ ID NO: 3083588 - RNA, 21 nt, Human
cagcugggguggggaccucag

SEQ ID NO: 3083589 - RNA, 22 nt, Human
cagcugggguggggaccucagg

SEQ ID NO: 3083590 - RNA, 23 nt, Human
cagcugggguggggaccucaggc

SEQ ID NO: 3083591 - RNA, 18 nt, Human
cagcugguugagguuuca

SEQ ID NO: 3083592 - RNA, 18 nt, Human
cagcuguaugauucccag

SEQ ID NO: 3083593 - RNA, 13 nt, Human
cagcugcuugggc

SEQ ID NO: 3083594 - RNA, 14 nt, Human
cagcugcuugggcu

SEQ ID NO: 3083595 - RNA, 15 nt, Human
cagcugcuugggcuu

SEQ ID NO: 3083596 - RNA, 16 nt, Human
cagcugcuugggcuuc

SEQ ID NO: 3083597 - RNA, 18 nt, Human
cagcugcuugggcuucau

SEQ ID NO: 3083598 - RNA, 19 nt, Human
cagcugcuugggcuucauc

SEQ ID NO: 3083599 - RNA, 21 nt, Human
cagcugcuugggcuucauccu

SEQ ID NO: 3083600 - RNA, 22 nt, Human
cagcugcuugggcuucauccuc

SEQ ID NO: 3083601 - RNA, 17 nt, Human
cagcugcuacuacuccu

SEQ ID NO: 3083602 - RNA, 21 nt, Human
cagcugcugagauccuggacu

SEQ ID NO: 3083603 - RNA, 12 nt, Human
cagcugcugaga

SEQ ID NO: 3083604 - RNA, 19 nt, Human
cagcugcugagauccugga

SEQ ID NO: 3083605 - RNA, 21 nt, Human
cagcugcugaaacaacaaaua

SEQ ID NO: 3083606 - RNA, 20 nt, Human
cagcugcugaaacaacaaau

SEQ ID NO: 3083607 - RNA, 18 nt, Human
cagcugccugggaucccu

SEQ ID NO: 3083608 - RNA, 23 nt, Human
cagcugccugggaucccucaucc

SEQ ID NO: 3083609 - RNA, 24 nt, Human
cagcugcgguccacccaggagccc

SEQ ID NO: 3083610 - RNA, 23 nt, Human
cagcugcgguccacccaggagcc

SEQ ID NO: 3083611 - RNA, 22 nt, Human
cagcugcgguccacccaggagc

SEQ ID NO: 3083612 - RNA, 21 nt, Human
cagcugcgguccacccaggag

SEQ ID NO: 3083613 - RNA, 20 nt, Human
cagcugcgguccacccagga

SEQ ID NO: 3083614 - RNA, 19 nt, Human
cagcugcgguccacccagg

SEQ ID NO: 3083615 - RNA, 15 nt, Human
cagcugccugggauc

SEQ ID NO: 3083616 - RNA, 18 nt, Human
cagcugcgguccacccag

SEQ ID NO: 3083617 - RNA, 23 nt, Human
cagcucuucuccaggcuguaucc

SEQ ID NO: 3083618 - RNA, 19 nt, Human
cagcucuucuccaggcugu

SEQ ID NO: 3083619 - RNA, 18 nt, Human
cagcucuucuccaggcug

SEQ ID NO: 3083620 - RNA, 17 nt, Human
cagcucuucuccaggcu

SEQ ID NO: 3083621 - RNA, 16 nt, Human
cagcucuucuccaggc

SEQ ID NO: 3083622 - RNA, 15 nt, Human
cagcucuucuccagg

SEQ ID NO: 3083623 - RNA, 14 nt, Human
cagcucuucuccag

SEQ ID NO: 3083624 - RNA, 13 nt, Human
cagcucuucucca

SEQ ID NO: 3083625 - RNA, 10 nt, Human
cagcucuuau

SEQ ID NO: 3083626 - RNA, 21 nt, Human
cagcucuuauauugccauuuc

SEQ ID NO: 3083627 - RNA, 23 nt, Human
cagcucuguccugggagugagcu

SEQ ID NO: 3083628 - RNA, 18 nt, Human
cagcucuguccugggagu

SEQ ID NO: 3083629 - RNA, 17 nt, Human
cagcucuguccugggag

SEQ ID NO: 3083630 - RNA, 16 nt, Human
cagcucuguccuggga

SEQ ID NO: 3083631 - RNA, 14 nt, Human
cagcucuguccugg

SEQ ID NO: 3083632 - RNA, 22 nt, Human
cagcucugguccauagagagca

SEQ ID NO: 3083633 - RNA, 23 nt, Human
cagcucugguccauagagagcaa

SEQ ID NO: 3083634 - RNA, 13 nt, Human
cagcucuguccug

SEQ ID NO: 3083635 - RNA, 12 nt, Human
cagcucuguccu

SEQ ID NO: 3083636 - RNA, 16 nt, Human
cagcucugguccauag

SEQ ID NO: 3083637 - RNA, 17 nt, Human
cagcucugguccauaga

SEQ ID NO: 3083638 - RNA, 18 nt, Human
cagcucugguccauagag

SEQ ID NO: 3083639 - RNA, 21 nt, Human
cagcucugguccauagagagc

SEQ ID NO: 3083640 - RNA, 10 nt, Human
cagcucuggu

SEQ ID NO: 3083641 - RNA, 13 nt, Human
cagcucuggucca

SEQ ID NO: 3083642 - RNA, 23 nt, Human
cagcuccuucuguccuacucugu

SEQ ID NO: 3083643 - RNA, 21 nt, Human
cagcuccuucuguccuacucu

SEQ ID NO: 3083644 - RNA, 17 nt, Human
cagcuccuucuguccua

SEQ ID NO: 3083645 - RNA, 16 nt, Human
cagcuccuucuguccu

SEQ ID NO: 3083646 - RNA, 13 nt, Human
cagcucagagagg

SEQ ID NO: 3083647 - RNA, 17 nt, Human
cagcucagagagggugg

SEQ ID NO: 3083648 - RNA, 19 nt, Human
cagcucagagaggguggga

SEQ ID NO: 3083649 - RNA, 20 nt, Human
cagcucagagagggugggag

SEQ ID NO: 3083650 - RNA, 21 nt, Human
cagcucugcaagaauugaagc

SEQ ID NO: 3083651 - RNA, 20 nt, Human
cagcucugcauacucauuag

SEQ ID NO: 3083652 - RNA, 15 nt, Human
cagcucugcaagaau

SEQ ID NO: 3083653 - RNA, 16 nt, Human
cagcucugcaagaauu

SEQ ID NO: 3083654 - RNA, 16 nt, Human
cagcucuccccuucuc

SEQ ID NO: 3083655 - RNA, 14 nt, Human
caggaagccagcag

SEQ ID NO: 3083656 - RNA, 16 nt, Human
caggaagccagcaggc

SEQ ID NO: 3083657 - RNA, 17 nt, Human
caggaagccagcaggcu

SEQ ID NO: 3083658 - RNA, 18 nt, Human
caggaagccagcaggcuc

SEQ ID NO: 3083659 - RNA, 19 nt, Human
caggaagccagcaggcucu

SEQ ID NO: 3083660 - RNA, 21 nt, Human
caggaagccagcaggcucuca

SEQ ID NO: 3083661 - RNA, 22 nt, Human
caggaagccagcaggcucucag

SEQ ID NO: 3083662 - RNA, 16 nt, Human
caggaagcucagggcc

SEQ ID NO: 3083663 - RNA, 17 nt, Human
caggaagcucagggccu

SEQ ID NO: 3083664 - RNA, 18 nt, Human
caggaagcucagggccug

SEQ ID NO: 3083665 - RNA, 19 nt, Human
caggaagcucagggccugg

SEQ ID NO: 3083666 - RNA, 14 nt, Human
caggaagcucaggg

SEQ ID NO: 3083667 - RNA, 15 nt, Human
caggaagcucagggc

SEQ ID NO: 3083668 - RNA, 13 nt, Human
caggaagcucagg

SEQ ID NO: 3083669 - RNA, 20 nt, Human
caggaagcucagggccuggc

SEQ ID NO: 3083670 - RNA, 21 nt, Human
caggaagcucagggccuggcu

SEQ ID NO: 3083671 - RNA, 23 nt, Human
caggaagcucagggccuggcuca

SEQ ID NO: 3083672 - RNA, 14 nt, Human
caggaagcugugag

SEQ ID NO: 3083673 - RNA, 13 nt, Human
caggaagcuguga

SEQ ID NO: 3083674 - RNA, 22 nt, Human
caggaagcugugagagcaguuu

SEQ ID NO: 3083675 - RNA, 15 nt, Human
caggaaggcuaaagg

SEQ ID NO: 3083676 - RNA, 14 nt, Human
caggaaguacugga

SEQ ID NO: 3083677 - RNA, 16 nt, Human
caggaaguacuggaga

SEQ ID NO: 3083678 - RNA, 12 nt, Human
caggaaguacug

SEQ ID NO: 3083679 - RNA, 17 nt, Human
caggaaguacuggagaa

SEQ ID NO: 3083680 - RNA, 18 nt, Human
caggaaguacuggagaaa

SEQ ID NO: 3083681 - RNA, 20 nt, Human
caggaaguacuggagaaaau

SEQ ID NO: 3083682 - RNA, 15 nt, Human
caggaaguagaggag

SEQ ID NO: 3083683 - RNA, 16 nt, Human
caggaaguagaggagg

SEQ ID NO: 3083684 - RNA, 18 nt, Human
cagcuugaaacugagaug

SEQ ID NO: 3083685 - RNA, 21 nt, Human
cagcuucauuuccugugucuu

SEQ ID NO: 3083686 - RNA, 20 nt, Human
cagcuucauuuccugugucu

SEQ ID NO: 3083687 - RNA, 19 nt, Human
cagcuucauuuccuguguc

SEQ ID NO: 3083688 - RNA, 21 nt, Human
cagcuugaggguugggcuggu

SEQ ID NO: 3083689 - RNA, 20 nt, Human
cagcuugaggguugggcugg

SEQ ID NO: 3083690 - RNA, 19 nt, Human
cagcuugaggguugggcug

SEQ ID NO: 3083691 - RNA, 18 nt, Human
cagcuugaggguugggcu

SEQ ID NO: 3083692 - RNA, 18 nt, Human
cagcuugaccgugaggcc

SEQ ID NO: 3083693 - RNA, 19 nt, Human
cagcuugaccgugaggcca

SEQ ID NO: 3083694 - RNA, 20 nt, Human
cagcuugaccgugaggccag

SEQ ID NO: 3083695 - RNA, 21 nt, Human
cagcuugaccgugaggccaga

SEQ ID NO: 3083696 - RNA, 15 nt, Human
cagcuugaggguugg

SEQ ID NO: 3083697 - RNA, 14 nt, Human
cagcuugaggguug

SEQ ID NO: 3083698 - RNA, 22 nt, Human
cagcuuguaaauagcucaggug

SEQ ID NO: 3083699 - RNA, 21 nt, Human
cagcuuguaaauagcucaggu

SEQ ID NO: 3083700 - RNA, 20 nt, Human
cagcuuguaaauagcucagg

SEQ ID NO: 3083701 - RNA, 19 nt, Human
cagcuuguaaauagcucag

SEQ ID NO: 3083702 - RNA, 18 nt, Human
cagcuuguaaauagcuca

SEQ ID NO: 3083703 - RNA, 23 nt, Human
cagcuuuccucaaaacuucagac

SEQ ID NO: 3083704 - RNA, 12 nt, Human
cagcuuuguuug

SEQ ID NO: 3083705 - RNA, 21 nt, Human
cagcuuuguuuguugucagcu

SEQ ID NO: 3083706 - RNA, 22 nt, Human
cagcuuuguuuguugucagcug

SEQ ID NO: 3083707 - RNA, 23 nt, Human
cagcuuuguuuguugucagcuga

SEQ ID NO: 3083708 - RNA, 18 nt, Human
caggaaccacaagacugc

SEQ ID NO: 3083709 - RNA, 22 nt, Human
caggaagcucagggccuggcuc

SEQ ID NO: 3083710 - RNA, 15 nt, Human
cagccuggacccugu

SEQ ID NO: 3083711 - RNA, 19 nt, Human
cagccuggacccuguggau

SEQ ID NO: 3083712 - RNA, 12 nt, Human
cagccuggaugc

SEQ ID NO: 3083713 - RNA, 15 nt, Human
cagccuggaugccau

SEQ ID NO: 3083714 - RNA, 16 nt, Human
cagccuggaugccauc

SEQ ID NO: 3083715 - RNA, 11 nt, Human
cagccuggaug

SEQ ID NO: 3083716 - RNA, 17 nt, Human
cagccuggaugccaucc

SEQ ID NO: 3083717 - RNA, 21 nt, Human
cagccuggaugccauccaagu

SEQ ID NO: 3083718 - RNA, 23 nt, Human
cagccucccgaguagcugggacu

SEQ ID NO: 3083719 - RNA, 22 nt, Human
cagccucccgaguagcugggac

SEQ ID NO: 3083720 - RNA, 21 nt, Human
cagccucccgaguagcuggga

SEQ ID NO: 3083721 - RNA, 20 nt, Human
cagccucccgaguagcuggg

SEQ ID NO: 3083722 - RNA, 19 nt, Human
cagccucccgaguagcugg

SEQ ID NO: 3083723 - RNA, 23 nt, Human
cagccucccgaauagcugggacu

SEQ ID NO: 3083724 - RNA, 20 nt, Human
cagccugcuccagcuguuca

SEQ ID NO: 3083725 - RNA, 20 nt, Human
cagccuugaccauucuccac

SEQ ID NO: 3083726 - RNA, 21 nt, Human
cagccuugaccauucuccacc

SEQ ID NO: 3083727 - RNA, 17 nt, Human
cagccuugaccauucuc

SEQ ID NO: 3083728 - RNA, 22 nt, Human
cagccuugaccauucuccaccu

SEQ ID NO: 3083729 - RNA, 23 nt, Human
cagccuugaccauucuccaccug

SEQ ID NO: 3083730 - RNA, 24 nt, Human
cagccuugaccauucuccaccugc

SEQ ID NO: 3083731 - RNA, 16 nt, Human
cagccugggcaaugug

SEQ ID NO: 3083732 - RNA, 19 nt, Human
cagccugggcaaugugaua

SEQ ID NO: 3083733 - RNA, 16 nt, Human
cagcuaaugggacacu

SEQ ID NO: 3083734 - RNA, 15 nt, Human
cagcuaaugggacac

SEQ ID NO: 3083735 - RNA, 20 nt, Human
cagcuaacauggaaguacua

SEQ ID NO: 3083736 - RNA, 19 nt, Human
cagcuacuugggaggcuga

SEQ ID NO: 3083737 - RNA, 20 nt, Human
cagcgagcccugguggcagu

SEQ ID NO: 3083738 - RNA, 19 nt, Human
cagcgagcccugguggcag

SEQ ID NO: 3083739 - RNA, 17 nt, Human
cagcgagcccugguggc

SEQ ID NO: 3083740 - RNA, 16 nt, Human
cagcgagcccuggugg

SEQ ID NO: 3083741 - RNA, 13 nt, Human
cagcgagcccugg

SEQ ID NO: 3083742 - RNA, 19 nt, Human
cagcuaacauggaaguacu

SEQ ID NO: 3083743 - RNA, 18 nt, Human
cagcuaacauggaaguac

SEQ ID NO: 3083744 - RNA, 21 nt, Human
cagcgagcccugguggcagug

SEQ ID NO: 3083745 - RNA, 19 nt, Human
cagcucaccagccccagug

SEQ ID NO: 3083746 - RNA, 17 nt, Human
cagcucaccagccccag

SEQ ID NO: 3083747 - RNA, 16 nt, Human
cagcucaccagcccca

SEQ ID NO: 3083748 - RNA, 15 nt, Human
cagcucaccagcccc

SEQ ID NO: 3083749 - RNA, 13 nt, Human
cagcucaccagcc

SEQ ID NO: 3083750 - RNA, 13 nt, Human
cagcucaccucuc

SEQ ID NO: 3083751 - RNA, 15 nt, Human
cagcucaccucuccc

SEQ ID NO: 3083752 - RNA, 16 nt, Human
cagcucaccucucccu

SEQ ID NO: 3083753 - RNA, 17 nt, Human
cagcucaccucucccuu

SEQ ID NO: 3083754 - RNA, 21 nt, Human
cagcucaccagccccagugcc

SEQ ID NO: 3083755 - RNA, 20 nt, Human
cagcucaccagccccagugc

SEQ ID NO: 3083756 - RNA, 22 nt, Human
cagcucaccagccccagugccc

SEQ ID NO: 3083757 - RNA, 19 nt, Human
cagcucaccucucccuugg

SEQ ID NO: 3083758 - RNA, 20 nt, Human
cagcucaccucucccuugga

SEQ ID NO: 3083759 - RNA, 12 nt, Human
cagcucagagag

SEQ ID NO: 3083760 - RNA, 13 nt, Human
cagcccucagaau

SEQ ID NO: 3083761 - RNA, 17 nt, Human
cagcccgggcucugccu

SEQ ID NO: 3083762 - RNA, 18 nt, Human
cagcccgggcucugccuc

SEQ ID NO: 3083763 - RNA, 19 nt, Human
cagcccgggcucugccucc

SEQ ID NO: 3083764 - RNA, 20 nt, Human
cagcccgggcucugccuccc

SEQ ID NO: 3083765 - RNA, 21 nt, Human
cagcccgggcucugccuccca

SEQ ID NO: 3083766 - RNA, 22 nt, Human
cagcccgggcucugccucccau

SEQ ID NO: 3083767 - RNA, 16 nt, Human
cagccccuucugaccc

SEQ ID NO: 3083768 - RNA, 17 nt, Human
cagccccuucugaccca

SEQ ID NO: 3083769 - RNA, 19 nt, Human
cagccccuucugacccaug

SEQ ID NO: 3083770 - RNA, 21 nt, Human
cagccccuucugacccaugcu

SEQ ID NO: 3083771 - RNA, 22 nt, Human
cagccccuucugacccaugcug

SEQ ID NO: 3083772 - RNA, 23 nt, Human
cagccccuucugacccaugcugc

SEQ ID NO: 3083773 - RNA, 24 nt, Human
cagccccuucugacccaugcugcc

SEQ ID NO: 3083774 - RNA, 13 nt, Human
cagcccgggcucu

SEQ ID NO: 3083775 - RNA, 14 nt, Human
cagcccgggcucug

SEQ ID NO: 3083776 - RNA, 15 nt, Human
cagcccgggcucugc

SEQ ID NO: 3083777 - RNA, 16 nt, Human
cagcccgggcucugcc

SEQ ID NO: 3083778 - RNA, 22 nt, Human
cagccccaucccaaacccuuca

SEQ ID NO: 3083779 - RNA, 12 nt, Human
cagccccauccu

SEQ ID NO: 3083780 - RNA, 13 nt, Human
cagccccauccuc

SEQ ID NO: 3083781 - RNA, 14 nt, Human
cagccccauccucu

SEQ ID NO: 3083782 - RNA, 16 nt, Human
cagccccauccucugu

SEQ ID NO: 3083783 - RNA, 22 nt, Human
cagccccauccucuguacagag

SEQ ID NO: 3083784 - RNA, 14 nt, Human
cagccccauucugc

SEQ ID NO: 3083785 - RNA, 13 nt, Human
cagccccauucug

SEQ ID NO: 3083786 - RNA, 23 nt, Human
cagccccuggaugcagccucaca

SEQ ID NO: 3083787 - RNA, 18 nt, Human
cagccccauucugccugc

SEQ ID NO: 3083788 - RNA, 17 nt, Human
cagccccauucugccug

SEQ ID NO: 3083789 - RNA, 16 nt, Human
cagccccauucugccu

SEQ ID NO: 3083790 - RNA, 20 nt, Human
cagccccuguucuggcagag

SEQ ID NO: 3083791 - RNA, 22 nt, Human
cagccccuggaugcagccucac

SEQ ID NO: 3083792 - RNA, 21 nt, Human
cagccccuguucuggcagagu

SEQ ID NO: 3083793 - RNA, 11 nt, Human
cagccccaucc

SEQ ID NO: 3083794 - RNA, 21 nt, Human
cagccccaucccaaacccuuc

SEQ ID NO: 3083795 - RNA, 18 nt, Human
cagccccagugcccacag

SEQ ID NO: 3083796 - RNA, 17 nt, Human
cagccccagugcccaca

SEQ ID NO: 3083797 - RNA, 16 nt, Human
cagccccagugcccac

SEQ ID NO: 3083798 - RNA, 15 nt, Human
cagccccagugccca

SEQ ID NO: 3083799 - RNA, 14 nt, Human
cagccccagugccc

SEQ ID NO: 3083800 - RNA, 13 nt, Human
cagccccagugcc

SEQ ID NO: 3083801 - RNA, 18 nt, Human
cagcccugcagagggcac

SEQ ID NO: 3083802 - RNA, 20 nt, Human
cagcccugcagagggcacag

SEQ ID NO: 3083803 - RNA, 13 nt, Human
cagcccugcagag

SEQ ID NO: 3083804 - RNA, 14 nt, Human
cagcccugcagagg

SEQ ID NO: 3083805 - RNA, 15 nt, Human
cagcccugcagaggg

SEQ ID NO: 3083806 - RNA, 16 nt, Human
cagcccugcagagggc

SEQ ID NO: 3083807 - RNA, 21 nt, Human
cagccguguaaccauggaccc

SEQ ID NO: 3083808 - RNA, 23 nt, Human
cagccucccaaagugcugggauu

SEQ ID NO: 3083809 - RNA, 21 nt, Human
cagccucccaaagugcuggga

SEQ ID NO: 3083810 - RNA, 20 nt, Human
cagccucccaaagugcuggg

SEQ ID NO: 3083811 - RNA, 19 nt, Human
cagccucccaaagugcugg

SEQ ID NO: 3083812 - RNA, 22 nt, Human
cagccucccgaauagcugggac

SEQ ID NO: 3083813 - RNA, 21 nt, Human
cagccucccgaauagcuggga

SEQ ID NO: 3083814 - RNA, 20 nt, Human
cagccucccgaauagcuggg

SEQ ID NO: 3083815 - RNA, 18 nt, Human
cagccucaaccuccuggg

SEQ ID NO: 3083816 - RNA, 17 nt, Human
cagccucaaccuccugg

SEQ ID NO: 3083817 - RNA, 16 nt, Human
cagccuaguugaucag

SEQ ID NO: 3083818 - RNA, 21 nt, Human
cagccucaaccuccugggcua

SEQ ID NO: 3083819 - RNA, 20 nt, Human
cagccucaaccuccugggcu

SEQ ID NO: 3083820 - RNA, 19 nt, Human
cagccucaaccuccugggc

SEQ ID NO: 3083821 - RNA, 14 nt, Human
cagccucacagucc

SEQ ID NO: 3083822 - RNA, 15 nt, Human
cagccucacaguccu

SEQ ID NO: 3083823 - RNA, 20 nt, Human
cagccucacaguccuuacca

SEQ ID NO: 3083824 - RNA, 15 nt, Human
cagaggagagaggac

SEQ ID NO: 3083825 - RNA, 19 nt, Human
cagaggagagaggaccccc

SEQ ID NO: 3083826 - RNA, 13 nt, Human
cagaggagagagg

SEQ ID NO: 3083827 - RNA, 20 nt, Human
cagaggagagaggacccccu

SEQ ID NO: 3083828 - RNA, 11 nt, Human
cagaggcagcc

SEQ ID NO: 3083829 - RNA, 23 nt, Human
cagagcccacgcccccacuggug

SEQ ID NO: 3083830 - RNA, 15 nt, Human
cagagccccacagcc

SEQ ID NO: 3083831 - RNA, 16 nt, Human
cagagccccacagccc

SEQ ID NO: 3083832 - RNA, 22 nt, Human
cagagccccacagccccaucug

SEQ ID NO: 3083833 - RNA, 13 nt, Human
cagagccccacag

SEQ ID NO: 3083834 - RNA, 17 nt, Human
cagagcccacgccccca

SEQ ID NO: 3083835 - RNA, 19 nt, Human
cagagcccacgcccccacu

SEQ ID NO: 3083836 - RNA, 20 nt, Human
cagagcccacgcccccacug

SEQ ID NO: 3083837 - RNA, 21 nt, Human
cagagcccacgcccccacugg

SEQ ID NO: 3083838 - RNA, 20 nt, Human
cagaggaaagcaaaggagau

SEQ ID NO: 3083839 - RNA, 13 nt, Human
cagagccugcagu

SEQ ID NO: 3083840 - RNA, 13 nt, Human
cagaggaaggaga

SEQ ID NO: 3083841 - RNA, 12 nt, Human
cagagccugcag

SEQ ID NO: 3083842 - RNA, 20 nt, Human
cagagccccacccucagaug

SEQ ID NO: 3083843 - RNA, 16 nt, Human
cagagcccacgccccc

SEQ ID NO: 3083844 - RNA, 20 nt, Human
cagagcccaccuuggcucaa

SEQ ID NO: 3083845 - RNA, 19 nt, Human
cagagcccaccuuggcuca

SEQ ID NO: 3083846 - RNA, 17 nt, Human
cagagcccaccuuggcu

SEQ ID NO: 3083847 - RNA, 15 nt, Human
cagagcccaccuugg

SEQ ID NO: 3083848 - RNA, 13 nt, Human
cagagcagagacc

SEQ ID NO: 3083849 - RNA, 14 nt, Human
cagagcagagacca

SEQ ID NO: 3083850 - RNA, 15 nt, Human
cagagcagagaccau

SEQ ID NO: 3083851 - RNA, 17 nt, Human
cagagcagagaccaucc

SEQ ID NO: 3083852 - RNA, 18 nt, Human
cagagcagagaccauccc

SEQ ID NO: 3083853 - RNA, 19 nt, Human
cagagcagagaccaucccu

SEQ ID NO: 3083854 - RNA, 21 nt, Human
cagagcagagaccaucccuga

SEQ ID NO: 3083855 - RNA, 18 nt, Human
cagagcaccuuagacagu

SEQ ID NO: 3083856 - RNA, 19 nt, Human
cagagcaccuuagacaguc

SEQ ID NO: 3083857 - RNA, 21 nt, Human
cagagcaccuuagacaguccc

SEQ ID NO: 3083858 - RNA, 22 nt, Human
cagagcaccuuagacagucccu

SEQ ID NO: 3083859 - RNA, 11 nt, Human
cagagcagaga

SEQ ID NO: 3083860 - RNA, 12 nt, Human
cagagcagagac

SEQ ID NO: 3083861 - RNA, 23 nt, Human
cagagcaccuuagacagucccug

SEQ ID NO: 3083862 - RNA, 16 nt, Human
cagagacacaagccuu

SEQ ID NO: 3083863 - RNA, 17 nt, Human
cagagacacaagccuuc

SEQ ID NO: 3083864 - RNA, 14 nt, Human
cagagacacaagcc

SEQ ID NO: 3083865 - RNA, 15 nt, Human
cagagacacaagccu

SEQ ID NO: 3083866 - RNA, 14 nt, Human
cagagaccaucccu

SEQ ID NO: 3083867 - RNA, 16 nt, Human
cagagaccaucccuga

SEQ ID NO: 3083868 - RNA, 13 nt, Human
cagagaccauccc

SEQ ID NO: 3083869 - RNA, 21 nt, Human
cagagaaugaaagggcccaga

SEQ ID NO: 3083870 - RNA, 20 nt, Human
cagagaaugaaagggcccag

SEQ ID NO: 3083871 - RNA, 15 nt, Human
cagagaauucucuua

SEQ ID NO: 3083872 - RNA, 19 nt, Human
cagagaaugaaagggccca

SEQ ID NO: 3083873 - RNA, 16 nt, Human
cagagacuccugcagg

SEQ ID NO: 3083874 - RNA, 17 nt, Human
cagagacuccugcaggc

SEQ ID NO: 3083875 - RNA, 18 nt, Human
cagagacuccugcaggca

SEQ ID NO: 3083876 - RNA, 19 nt, Human
cagagacuccugcaggcag

SEQ ID NO: 3083877 - RNA, 14 nt, Human
cagagacuccugca

SEQ ID NO: 3083878 - RNA, 15 nt, Human
cagagacuccugcag

SEQ ID NO: 3083879 - RNA, 13 nt, Human
cagagacuccugc

SEQ ID NO: 3083880 - RNA, 17 nt, Human
cagagaccaucccugaa

SEQ ID NO: 3083881 - RNA, 18 nt, Human
cagagaccaucccugaag

SEQ ID NO: 3083882 - RNA, 19 nt, Human
cagagaccaucccugaagg

SEQ ID NO: 3083883 - RNA, 20 nt, Human
cagagaccaucccugaaggc

SEQ ID NO: 3083884 - RNA, 21 nt, Human
cagagaccaucccugaaggcc

SEQ ID NO: 3083885 - RNA, 14 nt, Human
cagagcaagugaga

SEQ ID NO: 3083886 - RNA, 20 nt, Human
cagagcaagugagacccugu

SEQ ID NO: 3083887 - RNA, 16 nt, Human
cagagcaccuuagaca

SEQ ID NO: 3083888 - RNA, 14 nt, Human
cagauaaucagugu

SEQ ID NO: 3083889 - RNA, 14 nt, Human
cagauaaucacaau

SEQ ID NO: 3083890 - RNA, 22 nt, Human
cagauaaagguucaugcaaacu

SEQ ID NO: 3083891 - RNA, 23 nt, Human
cagauaaauaguuuaugauucca

SEQ ID NO: 3083892 - RNA, 14 nt, Human
cagauaaacaguag

SEQ ID NO: 3083893 - RNA, 18 nt, Human
cagaguuguuacauuuuu

SEQ ID NO: 3083894 - RNA, 15 nt, Human
cagaguuguuacauu

SEQ ID NO: 3083895 - RNA, 19 nt, Human
cagaguuguuacauuuuua

SEQ ID NO: 3083896 - RNA, 15 nt, Human
cagaguugaagacag

SEQ ID NO: 3083897 - RNA, 16 nt, Human
cagaguugaagacaga

SEQ ID NO: 3083898 - RNA, 14 nt, Human
cagaguugaagaca

SEQ ID NO: 3083899 - RNA, 17 nt, Human
cagaguugaagacagag

SEQ ID NO: 3083900 - RNA, 18 nt, Human
cagaguugaagacagagc

SEQ ID NO: 3083901 - RNA, 19 nt, Human
cagaguugaagacagagcu

SEQ ID NO: 3083902 - RNA, 20 nt, Human
cagaguugaagacagagcua

SEQ ID NO: 3083903 - RNA, 14 nt, Human
cagaguuguuacau

SEQ ID NO: 3083904 - RNA, 22 nt, Human
cagaguugaagacagagcuaca

SEQ ID NO: 3083905 - RNA, 22 nt, Human
cagaugcaccagcccuuagcag

SEQ ID NO: 3083906 - RNA, 17 nt, Human
cagaugcaccagcccuu

SEQ ID NO: 3083907 - RNA, 16 nt, Human
cagaugcaccagcccu

SEQ ID NO: 3083908 - RNA, 14 nt, Human
cagaugcaccagcc

SEQ ID NO: 3083909 - RNA, 13 nt, Human
cagaugcaccagc

SEQ ID NO: 3083910 - RNA, 17 nt, Human
cagaugcacaugagcug

SEQ ID NO: 3083911 - RNA, 20 nt, Human
cagaucucuaacuucaccau

SEQ ID NO: 3083912 - RNA, 14 nt, Human
cagauccuggaaau

SEQ ID NO: 3083913 - RNA, 22 nt, Human
cagauacaggaaaagcugcuga

SEQ ID NO: 3083914 - RNA, 13 nt, Human
cagauccuggaaa

SEQ ID NO: 3083915 - RNA, 21 nt, Human
cagauacaggaaaagcugcug

SEQ ID NO: 3083916 - RNA, 20 nt, Human
cagauacaggaaaagcugcu

SEQ ID NO: 3083917 - RNA, 23 nt, Human
cagaggcgcaugaauuugugaag

SEQ ID NO: 3083918 - RNA, 13 nt, Human
cagaggcugccuc

SEQ ID NO: 3083919 - RNA, 19 nt, Human
cagagggagugacagaggc

SEQ ID NO: 3083920 - RNA, 18 nt, Human
cagagggagugacagagg

SEQ ID NO: 3083921 - RNA, 16 nt, Human
cagagggagugacaga

SEQ ID NO: 3083922 - RNA, 14 nt, Human
cagagggagugaca

SEQ ID NO: 3083923 - RNA, 23 nt, Human
cagaggcugccucucccaucacu

SEQ ID NO: 3083924 - RNA, 22 nt, Human
cagaggcagccccauucugccu

SEQ ID NO: 3083925 - RNA, 20 nt, Human
cagaggcagccccauucugc

SEQ ID NO: 3083926 - RNA, 19 nt, Human
cagaggcagccccauucug

SEQ ID NO: 3083927 - RNA, 18 nt, Human
cagaggcagccccauucu

SEQ ID NO: 3083928 - RNA, 15 nt, Human
cagaggcagccccau

SEQ ID NO: 3083929 - RNA, 14 nt, Human
cagaggcagcccca

SEQ ID NO: 3083930 - RNA, 13 nt, Human
cagaggcagcccc

SEQ ID NO: 3083931 - RNA, 12 nt, Human
cagaggcagccc

SEQ ID NO: 3083932 - RNA, 16 nt, Human
cagaggccaugggccu

SEQ ID NO: 3083933 - RNA, 19 nt, Human
cagaggccaugggccuccu

SEQ ID NO: 3083934 - RNA, 23 nt, Human
cagaggcagccccauucugccug

SEQ ID NO: 3083935 - RNA, 21 nt, Human
cagaggccaugggccuccugu

SEQ ID NO: 3083936 - RNA, 20 nt, Human
cagaggccaugggccuccug

SEQ ID NO: 3083937 - RNA, 13 nt, Human
cagagucucacug

SEQ ID NO: 3083938 - RNA, 21 nt, Human
cagagucucacuguugcccag

SEQ ID NO: 3083939 - RNA, 20 nt, Human
cagagucucacuguugccca

SEQ ID NO: 3083940 - RNA, 19 nt, Human
cagagucucacuguugccc

SEQ ID NO: 3083941 - RNA, 17 nt, Human
cagagucucacuguugc

SEQ ID NO: 3083942 - RNA, 23 nt, Human
cagagggagugacagaggcagcc

SEQ ID NO: 3083943 - RNA, 22 nt, Human
cagagggagugacagaggcagc

SEQ ID NO: 3083944 - RNA, 21 nt, Human
cagagggagugacagaggcag

SEQ ID NO: 3083945 - RNA, 20 nt, Human
cagagggagugacagaggca

SEQ ID NO: 3083946 - RNA, 15 nt, Human
cagagggccugcaag

SEQ ID NO: 3083947 - RNA, 19 nt, Human
cagagggccugcaagggag

SEQ ID NO: 3083948 - RNA, 18 nt, Human
cagagugagacucugucu

SEQ ID NO: 3083949 - RNA, 17 nt, Human
cagagugagacucuguc

SEQ ID NO: 3083950 - RNA, 16 nt, Human
cagagugagacucugu

SEQ ID NO: 3083951 - RNA, 23 nt, Human
cagagucucacuguugcccaggc

SEQ ID NO: 3083952 - RNA, 22 nt, Human
cagagucucacuguugcccagg

SEQ ID NO: 3083953 - RNA, 20 nt, Human
cagagugagacucugucuca

SEQ ID NO: 3083954 - RNA, 19 nt, Human
cagagugagacucugucuc

SEQ ID NO: 3083955 - RNA, 19 nt, Human
cagaagcaacccaaauguu

SEQ ID NO: 3083956 - RNA, 20 nt, Human
cagaagcaacccaaauguuc

SEQ ID NO: 3083957 - RNA, 13 nt, Human
cagaagcagcucu

SEQ ID NO: 3083958 - RNA, 14 nt, Human
cagaagcagcucuu

SEQ ID NO: 3083959 - RNA, 21 nt, Human
cagaagacacugaugggcaac

SEQ ID NO: 3083960 - RNA, 17 nt, Human
cagaaggaucuucaucu

SEQ ID NO: 3083961 - RNA, 19 nt, Human
cagaaggaagacuucaucc

SEQ ID NO: 3083962 - RNA, 16 nt, Human
cagaaggaagacuuca

SEQ ID NO: 3083963 - RNA, 17 nt, Human
cagaaggaagacuucau

SEQ ID NO: 3083964 - RNA, 18 nt, Human
cagaaggaagacuucauc

SEQ ID NO: 3083965 - RNA, 18 nt, Human
cagaaucucaaauaacua

SEQ ID NO: 3083966 - RNA, 17 nt, Human
cagaaucucaaauaacu

SEQ ID NO: 3083967 - RNA, 21 nt, Human
cagaaucgcuccaccuugcag

SEQ ID NO: 3083968 - RNA, 23 nt, Human
cagaaucgcuccaccuugcagcu

SEQ ID NO: 3083969 - RNA, 12 nt, Human
cacuuugcauaa

SEQ ID NO: 3083970 - RNA, 13 nt, Human
cacuuuggcccag

SEQ ID NO: 3083971 - RNA, 16 nt, Human
cacuuuggcccagggu

SEQ ID NO: 3083972 - RNA, 22 nt, Human
cacuuucuagccagaggagaga

SEQ ID NO: 3083973 - RNA, 13 nt, Human
cacuuuguucugg

SEQ ID NO: 3083974 - RNA, 14 nt, Human
cacuuuguucuggc

SEQ ID NO: 3083975 - RNA, 16 nt, Human
cacuuuguucuggcuc

SEQ ID NO: 3083976 - RNA, 23 nt, Human
cacuuuguucuggcucuuccagg

SEQ ID NO: 3083977 - RNA, 12 nt, Human
cacuuugggagg

SEQ ID NO: 3083978 - RNA, 13 nt, Human
cacuuugggaggc

SEQ ID NO: 3083979 - RNA, 16 nt, Human
cacuuugggaggccaa

SEQ ID NO: 3083980 - RNA, 14 nt, Human
cacuuuuguucuug

SEQ ID NO: 3083981 - RNA, 22 nt, Human
cacuuuuguucuugguuuguaa

SEQ ID NO: 3083982 - RNA, 19 nt, Human
cagaaaauauuauguguuu

SEQ ID NO: 3083983 - RNA, 23 nt, Human
cagaaaauggaagacagcucuua

SEQ ID NO: 3083984 - RNA, 16 nt, Human
cagaaaauggaagaca

SEQ ID NO: 3083985 - RNA, 20 nt, Human
cagaaaauggaagacagcuc

SEQ ID NO: 3083986 - RNA, 21 nt, Human
cagaaaauggaagacagcucu

SEQ ID NO: 3083987 - RNA, 22 nt, Human
cagaaaauggaagacagcucuu

SEQ ID NO: 3083988 - RNA, 17 nt, Human
cagaaaaguugaauuuu

SEQ ID NO: 3083989 - RNA, 20 nt, Human
cagaaaaguugaauuuuaca

SEQ ID NO: 3083990 - RNA, 22 nt, Human
cagaaaaguugaauuuuacaug

SEQ ID NO: 3083991 - RNA, 18 nt, Human
cagaaagcagaacaguga

SEQ ID NO: 3083992 - RNA, 19 nt, Human
cagaaagcagaacagugau

SEQ ID NO: 3083993 - RNA, 18 nt, Human
cagaacagugauuaccag

SEQ ID NO: 3083994 - RNA, 23 nt, Human
cagaacagugauuaccagggacu

SEQ ID NO: 3083995 - RNA, 14 nt, Human
cagaauuucccaaa

SEQ ID NO: 3083996 - RNA, 18 nt, Human
cagaauucucuaguuuga

SEQ ID NO: 3083997 - RNA, 15 nt, Human
cagaauucucuaguu

SEQ ID NO: 3083998 - RNA, 11 nt, Human
cagaauucuca

SEQ ID NO: 3083999 - RNA, 17 nt, Human
cagaauuucccaaagca

SEQ ID NO: 3084000 - RNA, 18 nt, Human
cagaauuucccaaagcag

SEQ ID NO: 3084001 - RNA, 19 nt, Human
cagaauuucccaaagcagu

SEQ ID NO: 3084002 - RNA, 20 nt, Human
cagaauuucccaaagcagug

SEQ ID NO: 3084003 - RNA, 24 nt, Human
cagaauuucccaaagcagugcaug

SEQ ID NO: 3084004 - RNA, 12 nt, Human
cagacaaagcgu

SEQ ID NO: 3084005 - RNA, 20 nt, Human
cagacaacaaaccuguuucu

SEQ ID NO: 3084006 - RNA, 22 nt, Human
cagacaaagcgugguggacaug

SEQ ID NO: 3084007 - RNA, 14 nt, Human
cagacacaugucca

SEQ ID NO: 3084008 - RNA, 17 nt, Human
cagacacauguccaaga

SEQ ID NO: 3084009 - RNA, 21 nt, Human
cagacacauguccaagaagcc

SEQ ID NO: 3084010 - RNA, 22 nt, Human
cagacacauguccaagaagccc

SEQ ID NO: 3084011 - RNA, 23 nt, Human
cagacacauguccaagaagccca

SEQ ID NO: 3084012 - RNA, 23 nt, Human
cagacacaggcccggcuccaggc

SEQ ID NO: 3084013 - RNA, 22 nt, Human
cagacacaggcccggcuccagg

SEQ ID NO: 3084014 - RNA, 21 nt, Human
cagacacaggcccggcuccag

SEQ ID NO: 3084015 - RNA, 18 nt, Human
cagacacaggcccggcuc

SEQ ID NO: 3084016 - RNA, 17 nt, Human
cagacacaggcccggcu

SEQ ID NO: 3084017 - RNA, 15 nt, Human
cagacacaggcccgg

SEQ ID NO: 3084018 - RNA, 14 nt, Human
cagacacaggcccg

SEQ ID NO: 3084019 - RNA, 13 nt, Human
cagacacaggccc

SEQ ID NO: 3084020 - RNA, 19 nt, Human
cagacauacuaaccagcag

SEQ ID NO: 3084021 - RNA, 17 nt, Human
cagacauagaauuaaca

SEQ ID NO: 3084022 - RNA, 19 nt, Human
cagacauagaauuaacaca

SEQ ID NO: 3084023 - RNA, 22 nt, Human
cagacaccuugacagggcacac

SEQ ID NO: 3084024 - RNA, 20 nt, Human
cagacaccuugacagggcac

SEQ ID NO: 3084025 - RNA, 19 nt, Human
cagacaccuugacagggca

SEQ ID NO: 3084026 - RNA, 20 nt, Human
cagacaguuaagagaaauga

SEQ ID NO: 3084027 - RNA, 22 nt, Human
cagaccauuggggcucccagcc

SEQ ID NO: 3084028 - RNA, 23 nt, Human
cagaccauuggggcucccagcca

SEQ ID NO: 3084029 - RNA, 20 nt, Human
cagaccauuggggcucccag

SEQ ID NO: 3084030 - RNA, 21 nt, Human
cagaccauuggggcucccagc

SEQ ID NO: 3084031 - RNA, 19 nt, Human
cagaccauuggggcuccca

SEQ ID NO: 3084032 - RNA, 14 nt, Human
cagaccacaaaacu

SEQ ID NO: 3084033 - RNA, 20 nt, Human
cagaccacaaaacuuuucua

SEQ ID NO: 3084034 - RNA, 22 nt, Human
cagacccugcccugugggcccc

SEQ ID NO: 3084035 - RNA, 15 nt, Human
cagacccugcccugu

SEQ ID NO: 3084036 - RNA, 16 nt, Human
cagacccugcccugug

SEQ ID NO: 3084037 - RNA, 17 nt, Human
cagacccugcccugugg

SEQ ID NO: 3084038 - RNA, 21 nt, Human
cagacccugcccugugggccc

SEQ ID NO: 3084039 - RNA, 14 nt, Human
cagacccggcugcg

SEQ ID NO: 3084040 - RNA, 12 nt, Human
cagacccggcug

SEQ ID NO: 3084041 - RNA, 13 nt, Human
cagacccugcccu

SEQ ID NO: 3084042 - RNA, 14 nt, Human
cagacccugcccug

SEQ ID NO: 3084043 - RNA, 12 nt, Human
cagacccugccc

SEQ ID NO: 3084044 - RNA, 16 nt, Human
cagacccggcugcgug

SEQ ID NO: 3084045 - RNA, 23 nt, Human
cagagaaaguacuucuccacccu

SEQ ID NO: 3084046 - RNA, 19 nt, Human
cagagaaaguacuucucca

SEQ ID NO: 3084047 - RNA, 16 nt, Human
cagacaacaaaccugu

SEQ ID NO: 3084048 - RNA, 18 nt, Human
caccgccuugcccagccu

SEQ ID NO: 3084049 - RNA, 23 nt, Human
caccgccuugcccagccuggaug

SEQ ID NO: 3084050 - RNA, 15 nt, Human
caccgccuugcccag

SEQ ID NO: 3084051 - RNA, 17 nt, Human
caccgccuugcccagcc

SEQ ID NO: 3084052 - RNA, 21 nt, Human
caccgcagacaggaccaggga

SEQ ID NO: 3084053 - RNA, 15 nt, Human
caccggcuggccugg

SEQ ID NO: 3084054 - RNA, 16 nt, Human
caccggcuggccuggc

SEQ ID NO: 3084055 - RNA, 14 nt, Human
caccggcuggccug

SEQ ID NO: 3084056 - RNA, 17 nt, Human
caccggcuggccuggcc

SEQ ID NO: 3084057 - RNA, 18 nt, Human
caccggcuggccuggccc

SEQ ID NO: 3084058 - RNA, 20 nt, Human
caccggcuggccuggccccu

SEQ ID NO: 3084059 - RNA, 14 nt, Human
caccgggcacucag

SEQ ID NO: 3084060 - RNA, 18 nt, Human
caccgggccacagagaaa

SEQ ID NO: 3084061 - RNA, 15 nt, Human
caccgggccacagag

SEQ ID NO: 3084062 - RNA, 22 nt, Human
caccgggcacucagaagacacu

SEQ ID NO: 3084063 - RNA, 15 nt, Human
caccgggcacucaga

SEQ ID NO: 3084064 - RNA, 11 nt, Human
caccucaugga

SEQ ID NO: 3084065 - RNA, 12 nt, Human
caccucauggaa

SEQ ID NO: 3084066 - RNA, 14 nt, Human
caccucauggaauu

SEQ ID NO: 3084067 - RNA, 11 nt, Human
caccuccugcc

SEQ ID NO: 3084068 - RNA, 13 nt, Human
caccuccugccuc

SEQ ID NO: 3084069 - RNA, 14 nt, Human
caccuccugccucg

SEQ ID NO: 3084070 - RNA, 13 nt, Human
caccucucccuug

SEQ ID NO: 3084071 - RNA, 14 nt, Human
caccucucccuugg

SEQ ID NO: 3084072 - RNA, 17 nt, Human
caccucucccuuggauu

SEQ ID NO: 3084073 - RNA, 22 nt, Human
caccucuaucccggcuuuggug

SEQ ID NO: 3084074 - RNA, 12 nt, Human
caccuggccucu

SEQ ID NO: 3084075 - RNA, 13 nt, Human
caccuggccucug

SEQ ID NO: 3084076 - RNA, 14 nt, Human
caccuggccucugc

SEQ ID NO: 3084077 - RNA, 15 nt, Human
caccuggccucugca

SEQ ID NO: 3084078 - RNA, 17 nt, Human
caccuggccucugcacu

SEQ ID NO: 3084079 - RNA, 18 nt, Human
caccuggccucugcacuc

SEQ ID NO: 3084080 - RNA, 19 nt, Human
caccuggccucugcacucc

SEQ ID NO: 3084081 - RNA, 20 nt, Human
caccuggccucugcacuccc

SEQ ID NO: 3084082 - RNA, 23 nt, Human
caccuggccucugcacuccccug

SEQ ID NO: 3084083 - RNA, 12 nt, Human
caccuggcucug

SEQ ID NO: 3084084 - RNA, 13 nt, Human
caccuggcucugu

SEQ ID NO: 3084085 - RNA, 14 nt, Human
caccuggcucugug

SEQ ID NO: 3084086 - RNA, 15 nt, Human
caccuggcucugugg

SEQ ID NO: 3084087 - RNA, 23 nt, Human
caccuggcucuguggcgagccau

SEQ ID NO: 3084088 - RNA, 23 nt, Human
caccugaagacucauucuucugu

SEQ ID NO: 3084089 - RNA, 15 nt, Human
caccugaagacucau

SEQ ID NO: 3084090 - RNA, 14 nt, Human
caccugaagacuca

SEQ ID NO: 3084091 - RNA, 15 nt, Human
caccucucucacucc

SEQ ID NO: 3084092 - RNA, 17 nt, Human
caccucucucacuccuu

SEQ ID NO: 3084093 - RNA, 18 nt, Human
caccucucucacuccuug

SEQ ID NO: 3084094 - RNA, 19 nt, Human
caccucucucacuccuuga

SEQ ID NO: 3084095 - RNA, 18 nt, Human
caccucugcacaagcugc

SEQ ID NO: 3084096 - RNA, 19 nt, Human
caccucugcacaagcugca

SEQ ID NO: 3084097 - RNA, 20 nt, Human
caccuggaauauauaaccag

SEQ ID NO: 3084098 - RNA, 23 nt, Human
caccugcggugcuaucuccccca

SEQ ID NO: 3084099 - RNA, 20 nt, Human
caccugcggugcuaucuccc

SEQ ID NO: 3084100 - RNA, 11 nt, Human
cacccugugau

SEQ ID NO: 3084101 - RNA, 12 nt, Human
cacccugugaug

SEQ ID NO: 3084102 - RNA, 15 nt, Human
cacccugugaugggg

SEQ ID NO: 3084103 - RNA, 18 nt, Human
cacccugugauggggccc

SEQ ID NO: 3084104 - RNA, 20 nt, Human
cacccugugauggggcccug

SEQ ID NO: 3084105 - RNA, 21 nt, Human
cacccugugauggggcccugc

SEQ ID NO: 3084106 - RNA, 22 nt, Human
cacccugugauggggcccugcc

SEQ ID NO: 3084107 - RNA, 23 nt, Human
cacccugugauggggcccugccu

SEQ ID NO: 3084108 - RNA, 15 nt, Human
caccgaaaacguggc

SEQ ID NO: 3084109 - RNA, 18 nt, Human
caccgaaaacguggcugc

SEQ ID NO: 3084110 - RNA, 19 nt, Human
caccgaaaacguggcugcu

SEQ ID NO: 3084111 - RNA, 21 nt, Human
caccgaaaacguggcugcuuc

SEQ ID NO: 3084112 - RNA, 22 nt, Human
caccgaaaacguggcugcuuca

SEQ ID NO: 3084113 - RNA, 14 nt, Human
caccgcagacagga

SEQ ID NO: 3084114 - RNA, 15 nt, Human
caccgcagacaggac

SEQ ID NO: 3084115 - RNA, 17 nt, Human
caccgcagacaggacca

SEQ ID NO: 3084116 - RNA, 18 nt, Human
caccgcagacaggaccag

SEQ ID NO: 3084117 - RNA, 12 nt, Human
caccgcagacag

SEQ ID NO: 3084118 - RNA, 13 nt, Human
caccgcagacagg

SEQ ID NO: 3084119 - RNA, 20 nt, Human
caccccucaacaccucugca

SEQ ID NO: 3084120 - RNA, 13 nt, Human
cacauauugauuu

SEQ ID NO: 3084121 - RNA, 21 nt, Human
cacccggccccugcugguuca

SEQ ID NO: 3084122 - RNA, 18 nt, Human
cacccggccccugcuggu

SEQ ID NO: 3084123 - RNA, 17 nt, Human
cacccggccccugcugg

SEQ ID NO: 3084124 - RNA, 16 nt, Human
cacccggccccugcug

SEQ ID NO: 3084125 - RNA, 14 nt, Human
cacccggccccugc

SEQ ID NO: 3084126 - RNA, 13 nt, Human
cacccggccccug

SEQ ID NO: 3084127 - RNA, 19 nt, Human
cacccgcuaagagggaggg

SEQ ID NO: 3084128 - RNA, 12 nt, Human
cacccggccccu

SEQ ID NO: 3084129 - RNA, 20 nt, Human
cacccucagaugcacaugag

SEQ ID NO: 3084130 - RNA, 16 nt, Human
cacgccagauucuuuc

SEQ ID NO: 3084131 - RNA, 24 nt, Human
cacugaugggcaacccccagccug

SEQ ID NO: 3084132 - RNA, 18 nt, Human
cacugaugggcaaccccc

SEQ ID NO: 3084133 - RNA, 14 nt, Human
cacugaugggcaac

SEQ ID NO: 3084134 - RNA, 23 nt, Human
cacugagacagcccgggcucugc

SEQ ID NO: 3084135 - RNA, 13 nt, Human
cacugcaaccucc

SEQ ID NO: 3084136 - RNA, 23 nt, Human
cacugcaaccuccgccucuuggg

SEQ ID NO: 3084137 - RNA, 16 nt, Human
cacugcaaccuccgcc

SEQ ID NO: 3084138 - RNA, 14 nt, Human
cacugcaaccuccg

SEQ ID NO: 3084139 - RNA, 13 nt, Human
cacugacagauuu

SEQ ID NO: 3084140 - RNA, 17 nt, Human
cacugacagauuuccau

SEQ ID NO: 3084141 - RNA, 22 nt, Human
cacugacagauuuccauccuag

SEQ ID NO: 3084142 - RNA, 23 nt, Human
cacugacauuguuggccaaagcc

SEQ ID NO: 3084143 - RNA, 19 nt, Human
cacucugucgcccagucug

SEQ ID NO: 3084144 - RNA, 16 nt, Human
cacucugucgcccagu

SEQ ID NO: 3084145 - RNA, 15 nt, Human
cacucugucgcccag

SEQ ID NO: 3084146 - RNA, 15 nt, Human
cacucuggcagcuca

SEQ ID NO: 3084147 - RNA, 16 nt, Human
cacucuggcagcucag

SEQ ID NO: 3084148 - RNA, 17 nt, Human
cacucuggcagcucaga

SEQ ID NO: 3084149 - RNA, 19 nt, Human
cacucuggcagcucagaga

SEQ ID NO: 3084150 - RNA, 20 nt, Human
cacucuggcagcucagagag

SEQ ID NO: 3084151 - RNA, 21 nt, Human
cacucuggcagcucagagagg

SEQ ID NO: 3084152 - RNA, 23 nt, Human
cacucuggcagcucagagagggu

SEQ ID NO: 3084153 - RNA, 14 nt, Human
cacugagacagccc

SEQ ID NO: 3084154 - RNA, 17 nt, Human
cacugagacagcccggg

SEQ ID NO: 3084155 - RNA, 19 nt, Human
cacugagacagcccgggcu

SEQ ID NO: 3084156 - RNA, 22 nt, Human
cacugagacagcccgggcucug

SEQ ID NO: 3084157 - RNA, 12 nt, Human
cacugagacagc

SEQ ID NO: 3084158 - RNA, 13 nt, Human
cacugagacagcc

SEQ ID NO: 3084159 - RNA, 21 nt, Human
cacugacuucuaaguaaaacc

SEQ ID NO: 3084160 - RNA, 20 nt, Human
cacugacuucuaaguaaaac

SEQ ID NO: 3084161 - RNA, 16 nt, Human
cacugacuucuaagua

SEQ ID NO: 3084162 - RNA, 15 nt, Human
cacugacuucuaagu

SEQ ID NO: 3084163 - RNA, 14 nt, Human
cacugacuucuaag

SEQ ID NO: 3084164 - RNA, 20 nt, Human
cacugccuucucaacuccaa

SEQ ID NO: 3084165 - RNA, 12 nt, Human
cacugcucuggu

SEQ ID NO: 3084166 - RNA, 18 nt, Human
cacugcacuauagccuag

SEQ ID NO: 3084167 - RNA, 19 nt, Human
cacugcaccgggccacaga

SEQ ID NO: 3084168 - RNA, 18 nt, Human
cacugcaccgggccacag

SEQ ID NO: 3084169 - RNA, 16 nt, Human
cacugcaccgggccac

SEQ ID NO: 3084170 - RNA, 15 nt, Human
cacugcaccgggcca

SEQ ID NO: 3084171 - RNA, 14 nt, Human
cacugcaccgggcc

SEQ ID NO: 3084172 - RNA, 18 nt, Human
cacugcuuccagugaggc

SEQ ID NO: 3084173 - RNA, 19 nt, Human
cacugcuuccagugaggcu

SEQ ID NO: 3084174 - RNA, 20 nt, Human
cacugcuuccagugaggcuc

SEQ ID NO: 3084175 - RNA, 21 nt, Human
cacugcuuccagugaggcucu

SEQ ID NO: 3084176 - RNA, 22 nt, Human
cacugcuuccagugaggcucug

SEQ ID NO: 3084177 - RNA, 20 nt, Human
cacugcuuuuggucugugug

SEQ ID NO: 3084178 - RNA, 13 nt, Human
cacugcuuaacuu

SEQ ID NO: 3084179 - RNA, 14 nt, Human
cacugcuuccagug

SEQ ID NO: 3084180 - RNA, 15 nt, Human
cacugcuuccaguga

SEQ ID NO: 3084181 - RNA, 16 nt, Human
cacugcuuccagugag

SEQ ID NO: 3084182 - RNA, 17 nt, Human
cacuggaacacuaauga

SEQ ID NO: 3084183 - RNA, 21 nt, Human
cacugcuuuuggucuguguga

SEQ ID NO: 3084184 - RNA, 22 nt, Human
cacuggcaaacagggccucugc

SEQ ID NO: 3084185 - RNA, 20 nt, Human
cacuggcaaacagggccucu

SEQ ID NO: 3084186 - RNA, 21 nt, Human
cacuggcaaacagggccucug

SEQ ID NO: 3084187 - RNA, 17 nt, Human
cacuggcaaacagggcc

SEQ ID NO: 3084188 - RNA, 18 nt, Human
cacuggcaaacagggccu

SEQ ID NO: 3084189 - RNA, 19 nt, Human
cacuggcaaacagggccuc

SEQ ID NO: 3084190 - RNA, 18 nt, Human
cacuguacuugcucuuga

SEQ ID NO: 3084191 - RNA, 15 nt, Human
cacuguacuugcucu

SEQ ID NO: 3084192 - RNA, 19 nt, Human
cacuguacuugcucuugau

SEQ ID NO: 3084193 - RNA, 13 nt, Human
cacuggcucaccc

SEQ ID NO: 3084194 - RNA, 14 nt, Human
cacuggcucaccca

SEQ ID NO: 3084195 - RNA, 15 nt, Human
cacuggcucacccag

SEQ ID NO: 3084196 - RNA, 17 nt, Human
cacuggcucacccaguc

SEQ ID NO: 3084197 - RNA, 18 nt, Human
cacuggcucacccagucc

SEQ ID NO: 3084198 - RNA, 14 nt, Human
cacugugccaugug

SEQ ID NO: 3084199 - RNA, 13 nt, Human
cacugugaagaga

SEQ ID NO: 3084200 - RNA, 14 nt, Human
cacugucaagauga

SEQ ID NO: 3084201 - RNA, 17 nt, Human
cacugugcugagucuga

SEQ ID NO: 3084202 - RNA, 20 nt, Human
cacugugcugagucugaagg

SEQ ID NO: 3084203 - RNA, 21 nt, Human
cacugugcugagucugaaggc

SEQ ID NO: 3084204 - RNA, 22 nt, Human
cacugugcugagucugaaggcu

SEQ ID NO: 3084205 - RNA, 19 nt, Human
cacuguggguagacacaca

SEQ ID NO: 3084206 - RNA, 16 nt, Human
cacugugccaugugcc

SEQ ID NO: 3084207 - RNA, 15 nt, Human
cacugugccaugugc

SEQ ID NO: 3084208 - RNA, 18 nt, Human
cacugugccaugugccag

SEQ ID NO: 3084209 - RNA, 13 nt, Human
cacugugcugagu

SEQ ID NO: 3084210 - RNA, 15 nt, Human
cacugugcugagucu

SEQ ID NO: 3084211 - RNA, 13 nt, Human
cacuguucucugc

SEQ ID NO: 3084212 - RNA, 14 nt, Human
cacuguucucugcc

SEQ ID NO: 3084213 - RNA, 15 nt, Human
cacuguucucugccc

SEQ ID NO: 3084214 - RNA, 16 nt, Human
cacuguucucugcccu

SEQ ID NO: 3084215 - RNA, 17 nt, Human
cacuguucucugcccuc

SEQ ID NO: 3084216 - RNA, 19 nt, Human
cacuguucucugcccucca

SEQ ID NO: 3084217 - RNA, 21 nt, Human
cacuguucucugcccuccaag

SEQ ID NO: 3084218 - RNA, 22 nt, Human
cacuguucucugcccuccaaga

SEQ ID NO: 3084219 - RNA, 22 nt, Human
cacuguggguagacacacauga

SEQ ID NO: 3084220 - RNA, 24 nt, Human
cacuguggguagacacacaugaag

SEQ ID NO: 3084221 - RNA, 24 nt, Human
cacuugcagacucuacagaggcca

SEQ ID NO: 3084222 - RNA, 22 nt, Human
cacuugcagacucuacagaggc

SEQ ID NO: 3084223 - RNA, 19 nt, Human
cacuugcagacucuacaga

SEQ ID NO: 3084224 - RNA, 18 nt, Human
cacuugcagacucuacag

SEQ ID NO: 3084225 - RNA, 14 nt, Human
cacuugcagacucu

SEQ ID NO: 3084226 - RNA, 19 nt, Human
cacuuucuagccagaggag

SEQ ID NO: 3084227 - RNA, 20 nt, Human
cacuuucuagccagaggaga

SEQ ID NO: 3084228 - RNA, 18 nt, Human
cacuuucuagccagagga

SEQ ID NO: 3084229 - RNA, 15 nt, Human
cacuuggucugugag

SEQ ID NO: 3084230 - RNA, 16 nt, Human
cacuugacaucaacug

SEQ ID NO: 3084231 - RNA, 23 nt, Human
cacuugaacccgggaggcagagg

SEQ ID NO: 3084232 - RNA, 20 nt, Human
cacuugaacccgggaggcag

SEQ ID NO: 3084233 - RNA, 21 nt, Human
cacuugaacccgggaggcaga

SEQ ID NO: 3084234 - RNA, 13 nt, Human
cacuugcagacuc

SEQ ID NO: 3084235 - RNA, 13 nt, Human
cacuugaguccag

SEQ ID NO: 3084236 - RNA, 17 nt, Human
cacuugagaauuacccu

SEQ ID NO: 3084237 - RNA, 19 nt, Human
cacuugacaucaacugcau

SEQ ID NO: 3084238 - RNA, 20 nt, Human
cacuugagaauuacccuuuu

SEQ ID NO: 3084239 - RNA, 22 nt, Human
cacuucugccauauucuguugg

SEQ ID NO: 3084240 - RNA, 21 nt, Human
cacuucgggaggucgaggcag

SEQ ID NO: 3084241 - RNA, 23 nt, Human
cacuucgggaggucgaggcagga

SEQ ID NO: 3084242 - RNA, 16 nt, Human
cacuucccuacaugga

SEQ ID NO: 3084243 - RNA, 12 nt, Human
cacuucagcuga

SEQ ID NO: 3084244 - RNA, 21 nt, Human
cacuucagcugacuuuucugu

SEQ ID NO: 3084245 - RNA, 13 nt, Human
cacuaaacaaaga

SEQ ID NO: 3084246 - RNA, 14 nt, Human
cacguuucuaaagg

SEQ ID NO: 3084247 - RNA, 12 nt, Human
cacguuucuaaa

SEQ ID NO: 3084248 - RNA, 23 nt, Human
cacguuucuaaaggcuaccuuug

SEQ ID NO: 3084249 - RNA, 16 nt, Human
cacgugguccuaaucu

SEQ ID NO: 3084250 - RNA, 19 nt, Human
cacgugguccuaaucuucu

SEQ ID NO: 3084251 - RNA, 22 nt, Human
cacguucuuacuaguuucccuu

SEQ ID NO: 3084252 - RNA, 14 nt, Human
cacguacacacaca

SEQ ID NO: 3084253 - RNA, 19 nt, Human
cacguacacacacauacac

SEQ ID NO: 3084254 - RNA, 18 nt, Human
cacguacacacacauaca

SEQ ID NO: 3084255 - RNA, 20 nt, Human
cacggcucacugcagccuca

SEQ ID NO: 3084256 - RNA, 19 nt, Human
cacggcucacugcagccuc

SEQ ID NO: 3084257 - RNA, 17 nt, Human
cacggcucacugcagcc

SEQ ID NO: 3084258 - RNA, 16 nt, Human
cacggcucacugcagc

SEQ ID NO: 3084259 - RNA, 17 nt, Human
cacgcuggaccuugaac

SEQ ID NO: 3084260 - RNA, 20 nt, Human
cacgcuggaccuugaacugg

SEQ ID NO: 3084261 - RNA, 15 nt, Human
cacggcucacugcag

SEQ ID NO: 3084262 - RNA, 23 nt, Human
cacgcgugcacacaccagagccc

SEQ ID NO: 3084263 - RNA, 21 nt, Human
cacgcgugcacacaccagagc

SEQ ID NO: 3084264 - RNA, 16 nt, Human
cacgcgugcacacacc

SEQ ID NO: 3084265 - RNA, 15 nt, Human
cacgcgugcacacac

SEQ ID NO: 3084266 - RNA, 19 nt, Human
cacgccuguaauccuagca

SEQ ID NO: 3084267 - RNA, 20 nt, Human
cacgccuguaauccuagcac

SEQ ID NO: 3084268 - RNA, 14 nt, Human
caccuuagacaguc

SEQ ID NO: 3084269 - RNA, 16 nt, Human
caccuuagacaguccc

SEQ ID NO: 3084270 - RNA, 18 nt, Human
caccuuagacagucccug

SEQ ID NO: 3084271 - RNA, 19 nt, Human
caccuuagacagucccugc

SEQ ID NO: 3084272 - RNA, 21 nt, Human
caccuuagacagucccugcca

SEQ ID NO: 3084273 - RNA, 23 nt, Human
caccuuagacagucccugccaau

SEQ ID NO: 3084274 - RNA, 16 nt, Human
cacgaauauugcugau

SEQ ID NO: 3084275 - RNA, 19 nt, Human
cacgaauauugcugauggu

SEQ ID NO: 3084276 - RNA, 22 nt, Human
cacgaauauugcugauggugca

SEQ ID NO: 3084277 - RNA, 16 nt, Human
cacgacugcccggcag

SEQ ID NO: 3084278 - RNA, 17 nt, Human
cacgacugcccggcagg

SEQ ID NO: 3084279 - RNA, 13 nt, Human
caccuugacaggg

SEQ ID NO: 3084280 - RNA, 16 nt, Human
caccuugacagggcac

SEQ ID NO: 3084281 - RNA, 15 nt, Human
caccuugacagggca

SEQ ID NO: 3084282 - RNA, 20 nt, Human
cacgccagauucuuuccuga

SEQ ID NO: 3084283 - RNA, 22 nt, Human
cacgccagauucuuuccugagg

SEQ ID NO: 3084284 - RNA, 19 nt, Human
cacgccagauucuuuccug

SEQ ID NO: 3084285 - RNA, 15 nt, Human
cacgccacugcacua

SEQ ID NO: 3084286 - RNA, 13 nt, Human
cacgccacugcac

SEQ ID NO: 3084287 - RNA, 13 nt, Human
cacgcccccacug

SEQ ID NO: 3084288 - RNA, 15 nt, Human
cacgcccccacuggu

SEQ ID NO: 3084289 - RNA, 23 nt, Human
cacgccagauucuuuccugaggc

SEQ ID NO: 3084290 - RNA, 17 nt, Human
cacgcccccacugguga

SEQ ID NO: 3084291 - RNA, 18 nt, Human
cacgcccccacuggugac

SEQ ID NO: 3084292 - RNA, 14 nt, Human
cacgauuucuguuu

SEQ ID NO: 3084293 - RNA, 12 nt, Human
cacgauuucugu

SEQ ID NO: 3084294 - RNA, 16 nt, Human
cacgauuucuguuuag

SEQ ID NO: 3084295 - RNA, 17 nt, Human
cacgcacuucgggaggu

SEQ ID NO: 3084296 - RNA, 15 nt, Human
cacgcacacugucug

SEQ ID NO: 3084297 - RNA, 22 nt, Human
cacgagcaggcuacugucagcu

SEQ ID NO: 3084298 - RNA, 17 nt, Human
cacgagcaggcuacugu

SEQ ID NO: 3084299 - RNA, 20 nt, Human
cacgagcaggcuacugucag

SEQ ID NO: 3084300 - RNA, 19 nt, Human
cacgagcaggcuacuguca

SEQ ID NO: 3084301 - RNA, 16 nt, Human
cacuaacaugauuugg

SEQ ID NO: 3084302 - RNA, 21 nt, Human
cacuaaauugacacuuaaaaa

SEQ ID NO: 3084303 - RNA, 16 nt, Human
cacuaaccacgcugga

SEQ ID NO: 3084304 - RNA, 15 nt, Human
cacuaaccacgcugg

SEQ ID NO: 3084305 - RNA, 14 nt, Human
cacuaaccacgcug

SEQ ID NO: 3084306 - RNA, 18 nt, Human
cacuaaccacgcuggacc

SEQ ID NO: 3084307 - RNA, 17 nt, Human
cacuaagagagaaugag

SEQ ID NO: 3084308 - RNA, 18 nt, Human
cacuaaggugugcucuga

SEQ ID NO: 3084309 - RNA, 17 nt, Human
cacuaaggugugcucug

SEQ ID NO: 3084310 - RNA, 14 nt, Human
cacuauaauguaag

SEQ ID NO: 3084311 - RNA, 14 nt, Human
cacuaguauuucua

SEQ ID NO: 3084312 - RNA, 19 nt, Human
cacuaguauuucuaugaaa

SEQ ID NO: 3084313 - RNA, 21 nt, Human
cacuauagccuaggugacaga

SEQ ID NO: 3084314 - RNA, 18 nt, Human
cacuauaauguaagcucu

SEQ ID NO: 3084315 - RNA, 14 nt, Human
cacuauagccuagg

SEQ ID NO: 3084316 - RNA, 19 nt, Human
cacuauguugcccaggcag

SEQ ID NO: 3084317 - RNA, 18 nt, Human
cacuauguugcccaggca

SEQ ID NO: 3084318 - RNA, 17 nt, Human
cacuauguugcccaggc

SEQ ID NO: 3084319 - RNA, 16 nt, Human
cacuauguugcccagg

SEQ ID NO: 3084320 - RNA, 15 nt, Human
cacuauguugcccag

SEQ ID NO: 3084321 - RNA, 20 nt, Human
cacucaaaagcugggcaggu

SEQ ID NO: 3084322 - RNA, 16 nt, Human
cacucaaaucaagaaa

SEQ ID NO: 3084323 - RNA, 15 nt, Human
cacucaaaagcuggg

SEQ ID NO: 3084324 - RNA, 17 nt, Human
cacucaaaagcugggca

SEQ ID NO: 3084325 - RNA, 18 nt, Human
cacucaaaagcugggcag

SEQ ID NO: 3084326 - RNA, 19 nt, Human
cacucaaaagcugggcagg

SEQ ID NO: 3084327 - RNA, 21 nt, Human
cacuauguugcccaggcaggu

SEQ ID NO: 3084328 - RNA, 20 nt, Human
cacuauguugcccaggcagg

SEQ ID NO: 3084329 - RNA, 19 nt, Human
cacucagaagacacugaug

SEQ ID NO: 3084330 - RNA, 18 nt, Human
cacucagaagacacugau

SEQ ID NO: 3084331 - RNA, 22 nt, Human
cacucagaagacacugaugggc

SEQ ID NO: 3084332 - RNA, 20 nt, Human
cacucacauuuauucugcuc

SEQ ID NO: 3084333 - RNA, 19 nt, Human
cacucacauuuauucugcu

SEQ ID NO: 3084334 - RNA, 17 nt, Human
cacucagaagacacuga

SEQ ID NO: 3084335 - RNA, 16 nt, Human
cacucagaagacacug

SEQ ID NO: 3084336 - RNA, 12 nt, Human
cacucagaagac

SEQ ID NO: 3084337 - RNA, 14 nt, Human
cacuccuucacaga

SEQ ID NO: 3084338 - RNA, 21 nt, Human
cacuccuucacagaugggugc

SEQ ID NO: 3084339 - RNA, 17 nt, Human
cacucccugcaaccuga

SEQ ID NO: 3084340 - RNA, 18 nt, Human
cacuccggcccuccagag

SEQ ID NO: 3084341 - RNA, 20 nt, Human
cacuccggcccuccagagcc

SEQ ID NO: 3084342 - RNA, 21 nt, Human
cacuccggcccuccagagccc

SEQ ID NO: 3084343 - RNA, 17 nt, Human
cacuccggcccuccaga

SEQ ID NO: 3084344 - RNA, 15 nt, Human
cacucauugaccuga

SEQ ID NO: 3084345 - RNA, 16 nt, Human
cacucaguccauagca

SEQ ID NO: 3084346 - RNA, 18 nt, Human
cacucauugaccugaggc

SEQ ID NO: 3084347 - RNA, 19 nt, Human
cacucauugaccugaggcc

SEQ ID NO: 3084348 - RNA, 20 nt, Human
cacucauugaccugaggccc

SEQ ID NO: 3084349 - RNA, 22 nt, Human
cacucauugaccugaggcccuu

SEQ ID NO: 3084350 - RNA, 13 nt, Human
cacucccugcaac

SEQ ID NO: 3084351 - RNA, 16 nt, Human
cacucccugcaaccug

SEQ ID NO: 3084352 - RNA, 12 nt, Human
cacucccugcaa

SEQ ID NO: 3084353 - RNA, 15 nt, Human
cacuccccugcuggg

SEQ ID NO: 3084354 - RNA, 12 nt, Human
cacucugagacu

SEQ ID NO: 3084355 - RNA, 23 nt, Human
cacucugagacucgcgacaaugc

SEQ ID NO: 3084356 - RNA, 12 nt, Human
cacucuccuugg

SEQ ID NO: 3084357 - RNA, 12 nt, Human
cacucuggcagc

SEQ ID NO: 3084358 - RNA, 13 nt, Human
cacucuggcagcu

SEQ ID NO: 3084359 - RNA, 14 nt, Human
cacucuggcagcuc

SEQ ID NO: 3084360 - RNA, 23 nt, Human
cugcaccggcuggccuggccccu

SEQ ID NO: 3084361 - RNA, 13 nt, Human
aaucauaaaacuu

SEQ ID NO: 3084362 - RNA, 22 nt, Human
aauaauguaagacaaauauguu

SEQ ID NO: 3084363 - RNA, 18 nt, Human
aacugcucauaugaugua

SEQ ID NO: 3084364 - RNA, 13 nt, Human
ucucaggccaaac

SEQ ID NO: 3084365 - RNA, 15 nt, Human
gucgcagcgcaggac

SEQ ID NO: 3084366 - RNA, 15 nt, Human
uagccaaggccaaag

SEQ ID NO: 3084367 - RNA, 16 nt, Human
auaaggggagaguaac

SEQ ID NO: 3084368 - RNA, 19 nt, Human
aagcuaggccuggccagau

SEQ ID NO: 3084369 - RNA, 17 nt, Human
aagaaggaugauucaac

SEQ ID NO: 3084370 - RNA, 21 nt, Human
agagacagaaagcagaacagu

SEQ ID NO: 3084371 - RNA, 14 nt, Human
cuuggucugugaga

SEQ ID NO: 3084372 - RNA, 14 nt, Human
cucuccucugcugc

SEQ ID NO: 3084373 - RNA, 20 nt, Human
cuacucuagggaaaaaccag

SEQ ID NO: 3084374 - RNA, 15 nt, Human
cuuccuucugugaaa

SEQ ID NO: 3084375 - RNA, 21 nt, Human
ccuccuccagccgccaugcuc

SEQ ID NO: 3084376 - RNA, 17 nt, Human
ccucuuagaaaaaccac

SEQ ID NO: 3084377 - RNA, 17 nt, Human
ccugcacagcaggcugc

SEQ ID NO: 3084378 - RNA, 23 nt, Human
cagccccuucugacccaugcugc

SEQ ID NO: 3084379 - RNA, 11 nt, Human
cccaaaaccaa

SEQ ID NO: 3084380 - RNA, 17 nt, Human
cccccuguggaugcugc

SEQ ID NO: 3084381 - RNA, 15 nt, Human
caacaucaacaucuu

SEQ ID NO: 3084382 - RNA, 19 nt, Human
cacagccucugaaaaccaa

SEQ ID NO: 3084383 - RNA, 22 nt, Human
gcacugacauuguuggccaaag

SEQ ID NO: 3084384 - RNA, 22 nt, Human
ugucuuuaaaaguauccagaga

SEQ ID NO: 3084385 - RNA, 15 nt, Human
gggcagcugcaggac

SEQ ID NO: 3084386 - RNA, 17 nt, Human
uguaauaacugugaagu

SEQ ID NO: 3084387 - RNA, 14 nt, Human
ccucucccugcugc

SEQ ID NO: 3084388 - RNA, 18 nt, Human
ccuucaccuuugucccca

SEQ ID NO: 3084389 - RNA, 16 nt, Human
ccucugcacaagcugc

SEQ ID NO: 3084390 - RNA, 18 nt, Human
ccccacagccccaucugc

SEQ ID NO: 3084391 - RNA, 20 nt, Human
ugaaucgagauguccauagu

SEQ ID NO: 3084392 - RNA, 17 nt, Human
uguguaaaaugugaagu

SEQ ID NO: 3084393 - RNA, 23 nt, Human
gggaccccgagccuggcuccaaa

SEQ ID NO: 3084394 - RNA, 12 nt, Human
guggagcaggcc

SEQ ID NO: 3084395 - RNA, 19 nt, Human
gucuccauguuugauguau

SEQ ID NO: 3084396 - RNA, 18 nt, Human
gaugcucugugcagacac

SEQ ID NO: 3084397 - RNA, 16 nt, Human
uuuggauuggaugaau

SEQ ID NO: 3084398 - RNA, 14 nt, Measles virus
ccacaacccgcgca

SEQ ID NO: 3084399 - RNA, 17 nt, Measles virus
gcccaccugaaauuguc

SEQ ID NO: 3084400 - RNA, 17 nt, Measles virus
ccaucaguuccucaaga

SEQ ID NO: 3084401 - RNA, 17 nt, Measles virus
ucaacccgccagagaga

SEQ ID NO: 3084402 - RNA, 20 nt, Measles virus
uagaccgcagugcccagcaa

SEQ ID NO: 3084403 - RNA, 14 nt, Measles virus
cgaucgagcaucag

SEQ ID NO: 3084404 - RNA, 16 nt, Measles virus
uccuaaaaaagggaaa

SEQ ID NO: 3084405 - RNA, 14 nt, Measles virus
gugaugucauagag

SEQ ID NO: 3084406 - RNA, 15 nt, Measles virus
cggucuccuccucuu

SEQ ID NO: 3084407 - RNA, 18 nt, Measles virus
aaauacgaaguuucuauu

SEQ ID NO: 3084408 - RNA, 19 nt, Measles virus
acccgaaccagcacccaag

SEQ ID NO: 3084409 - RNA, 14 nt, Measles virus
gggaaacugcucag

SEQ ID NO: 3084410 - RNA, 18 nt, Measles virus
uuacauccugauugcagu

SEQ ID NO: 3084411 - RNA, 12 nt, Measles virus
aguuaugacucg

SEQ ID NO: 3084412 - RNA, 19 nt, Measles virus
acaccccacuaacccuccu

SEQ ID NO: 3084413 - RNA, 15 nt, Measles virus
cggcuucccucuggc

SEQ ID NO: 3084414 - RNA, 14 nt, Measles virus
caaugccgcacuga

SEQ ID NO: 3084415 - RNA, 16 nt, Measles virus
gacuccuuagacagau

SEQ ID NO: 3084416 - RNA, 15 nt, Measles virus
uggcugcugaagaac

SEQ ID NO: 3084417 - RNA, 17 nt, Measles virus
aauauauuaaagaaaac

SEQ ID NO: 3084418 - RNA, 23 nt, Measles virus
gucggcaugggacaucaaagggu

SEQ ID NO: 3084419 - RNA, 15 nt, Measles virus
cucaaugaaaaacug

SEQ ID NO: 3084420 - RNA, 18 nt, Measles virus
gacaaaaaacucuggugc

SEQ ID NO: 3084421 - RNA, 23 nt, Measles virus
cugcuggggguuguugaggacag

SEQ ID NO: 3084422 - RNA, 17 nt, Measles virus
ggccaccaccagccauc

SEQ ID NO: 3084423 - RNA, 12 nt, Measles virus
gacuucagagau

SEQ ID NO: 3084424 - RNA, 14 nt, Measles virus
caaggccaccacca

SEQ ID NO: 3084425 - RNA, 17 nt, Measles virus
ucugaaaacagcgaugu

SEQ ID NO: 3084426 - RNA, 23 nt, Measles virus
ccaguccaugcugaacucucaag

SEQ ID NO: 3084427 - RNA, 15 nt, Measles virus
cauuauaaaaaacuu

SEQ ID NO: 3084428 - RNA, 13 nt, Measles virus
ccagguccacaca

SEQ ID NO: 3084429 - RNA, 20 nt, Measles virus
cuccucgugggacccccgag

SEQ ID NO: 3084430 - RNA, 15 nt, Measles virus
cuuucaugccagagg

SEQ ID NO: 3084431 - RNA, 13 nt, Measles virus
cccccucccccaa

SEQ ID NO: 3084432 - RNA, 15 nt, Measles virus
gaaccgggucacgga

SEQ ID NO: 3084433 - RNA, 12 nt, Measles virus
gcuuugucuggu

SEQ ID NO: 3084434 - RNA, 14 nt, Measles virus
uucaagaagaccuu

SEQ ID NO: 3084435 - RNA, 14 nt, Measles virus
cagaacccagaccc

SEQ ID NO: 3084436 - RNA, 11 nt, Measles virus
cccgccagaga

SEQ ID NO: 3084437 - RNA, 13 nt, Measles virus
aggccuaaagccu

SEQ ID NO: 3084438 - RNA, 23 nt, Measles virus
ugcagauguggcugcugaagaac

SEQ ID NO: 3084439 - RNA, 16 nt, Measles virus
gaaaggucaugccaua

SEQ ID NO: 3084440 - RNA, 22 nt, Measles virus
acuuugaaaauacgaaguuucu

SEQ ID NO: 3084441 - RNA, 18 nt, Measles virus
cauaagagccucagcacc

SEQ ID NO: 3084442 - RNA, 22 nt, Measles virus
caggaguccccaaagaucucaa

SEQ ID NO: 3084443 - RNA, 16 nt, Measles virus
cauaugacaaacuauu

SEQ ID NO: 3084444 - RNA, 18 nt, Measles virus
caaccauccacucccacg

SEQ ID NO: 3084445 - RNA, 18 nt, Measles virus
aagcuaggugucuggaaa

SEQ ID NO: 3084446 - RNA, 21 nt, Measles virus
cgcagaauacaggagacuacu

SEQ ID NO: 3084447 - RNA, 18 nt, Measles virus
agaggggagguuaaugac

SEQ ID NO: 3084448 - RNA, 15 nt, Measles virus
cagaaucaagacuca

SEQ ID NO: 3084449 - RNA, 22 nt, Measles virus
aacaaaacuuagggccaaggaa

SEQ ID NO: 3084450 - RNA, 22 nt, Measles virus
ugaaauucaucucugacaaaau

SEQ ID NO: 3084451 - RNA, 23 nt, Measles virus
agaaaucuccaggcaucaagcac

SEQ ID NO: 3084452 - RNA, 23 nt, Measles virus
gcaaaccaugccucucagcaauu

SEQ ID NO: 3084453 - RNA, 22 nt, Measles virus
cccaaaaaaaggcccccagggg

SEQ ID NO: 3084454 - RNA, 21 nt, Measles virus
ugcuccaagaaugccuccggg

SEQ ID NO: 3084455 - RNA, 19 nt, Measles virus
cgagcuccugaaacuccaa

SEQ ID NO: 3084456 - RNA, 13 nt, Measles virus
ccaaccucuucac

SEQ ID NO: 3084457 - RNA, 16 nt, Measles virus
gggaccaaaagaucaa

SEQ ID NO: 3084458 - RNA, 16 nt, Measles virus
cauaaugacagccaga

SEQ ID NO: 3084459 - RNA, 22 nt, Measles virus
gauuaugaucaauacugugcag

SEQ ID NO: 3084460 - RNA, 15 nt, Measles virus
guagggccagcacuu

SEQ ID NO: 3084461 - RNA, 22 nt, Measles virus
aagcgguuaagggaauccaaga

SEQ ID NO: 3084462 - RNA, 17 nt, Measles virus
cgcaagaaccccacaac

SEQ ID NO: 3084463 - RNA, 16 nt, Measles virus
agcaucaggucaagga

SEQ ID NO: 3084464 - RNA, 20 nt, Measles virus
cccaaguauguugcaaccca

SEQ ID NO: 3084465 - RNA, 14 nt, Measles virus
uauuaacagagaac

SEQ ID NO: 3084466 - RNA, 16 nt, Measles virus
cagccggcuagaggag

SEQ ID NO: 3084467 - RNA, 12 nt, Measles virus
gggccagcacuu

SEQ ID NO: 3084468 - RNA, 12 nt, Measles virus
ccgaccagaccc

SEQ ID NO: 3084469 - RNA, 19 nt, Measles virus
caaaccgcaaaagacauca

SEQ ID NO: 3084470 - RNA, 13 nt, Measles virus
cccaguagggcca

SEQ ID NO: 3084471 - RNA, 13 nt, Measles virus
caugucaaaaacg

SEQ ID NO: 3084472 - RNA, 17 nt, Measles virus
ugcucuccaaagggaau

SEQ ID NO: 3084473 - RNA, 20 nt, Measles virus
aaaugauuauaaacaaugug

SEQ ID NO: 3084474 - RNA, 18 nt, Measles virus
auuuaacauagaagacaa

SEQ ID NO: 3084475 - RNA, 23 nt, Measles virus
ggucaugccauauuuuguggaau

SEQ ID NO: 3084476 - RNA, 20 nt, Measles virus
agaugauauuggcuguucag

SEQ ID NO: 3084477 - RNA, 14 nt, Measles virus
cauccagcaucaag

SEQ ID NO: 3084478 - RNA, 12 nt, Measles virus
uacgaaguuucu

SEQ ID NO: 3084479 - RNA, 18 nt, Measles virus
cuccggcuucccucuggc

SEQ ID NO: 3084480 - RNA, 22 nt, Measles virus
cucaaggugaacgucucugcca

SEQ ID NO: 3084481 - RNA, 20 nt, Measles virus
uguucuacaacaacacccca

SEQ ID NO: 3084482 - RNA, 23 nt, Measles virus
cuaucacaauucccuaucagggg

SEQ ID NO: 3084483 - RNA, 18 nt, Measles virus
cuccggggguccaccaag

SEQ ID NO: 3084484 - RNA, 21 nt, Measles virus
auuaaagaaaacuuugaaaau

SEQ ID NO: 3084485 - RNA, 15 nt, Measles virus
auuguagccaugcug

SEQ ID NO: 3084486 - RNA, 19 nt, Measles virus
cagauccucuccccccggc

SEQ ID NO: 3084487 - RNA, 11 nt, Measles virus
agcccccucca

SEQ ID NO: 3084488 - RNA, 20 nt, Measles virus
ggaggcuuguagauguuuuc

SEQ ID NO: 3084489 - RNA, 19 nt, Measles virus
caacucuugaaacacagau

SEQ ID NO: 3084490 - RNA, 10 nt, Measles virus
gagaucccag

SEQ ID NO: 3084491 - RNA, 13 nt, Measles virus
ucuacaacaacac

SEQ ID NO: 3084492 - RNA, 15 nt, Measles virus
uuaucacaagggaac

SEQ ID NO: 3084493 - RNA, 22 nt, Measles virus
aagcgaugacgacgcugaaacu

SEQ ID NO: 3084494 - RNA, 20 nt, Measles virus
aguucucaagaagcccguug

SEQ ID NO: 3084495 - RNA, 18 nt, Measles virus
uuggacguagggacaaau

SEQ ID NO: 3084496 - RNA, 11 nt, Measles virus
uugcuggcugu

SEQ ID NO: 3084497 - RNA, 11 nt, Measles virus
gaaccagcacc

SEQ ID NO: 3084498 - RNA, 16 nt, Measles virus
cagcacccagccaccg

SEQ ID NO: 3084499 - RNA, 15 nt, Measles virus
gggucucagcaaacc

SEQ ID NO: 3084500 - RNA, 16 nt, Measles virus
augccucucagcaauu

SEQ ID NO: 3084501 - RNA, 12 nt, Measles virus
accagacccagc

SEQ ID NO: 3084502 - RNA, 13 nt, Measles virus
gcugcagacacaa

SEQ ID NO: 3084503 - RNA, 13 nt, Measles virus
acucacucuggga

SEQ ID NO: 3084504 - RNA, 16 nt, Measles virus
acuuagggccaaggaa

SEQ ID NO: 3084505 - RNA, 21 nt, Measles virus
gaucccugggggacccccaaa

SEQ ID NO: 3084506 - RNA, 20 nt, Measles virus
aucauaggcagagauucagg

SEQ ID NO: 3084507 - RNA, 17 nt, Measles virus
cauccacucccacgacu

SEQ ID NO: 3084508 - RNA, 17 nt, Measles virus
uugucacaacugagcau

SEQ ID NO: 3084509 - RNA, 14 nt, Measles virus
ugacaucccaggga

SEQ ID NO: 3084510 - RNA, 19 nt, Measles virus
ccgggaaucccagaaucaa

SEQ ID NO: 3084511 - RNA, 22 nt, Measles virus
cccaaguauguugcaacccaag

SEQ ID NO: 3084512 - RNA, 23 nt, Measles virus
gcuuuaccucucaucucacagag

SEQ ID NO: 3084513 - RNA, 15 nt, Measles virus
gaaauagacaucaga

SEQ ID NO: 3084514 - RNA, 17 nt, Measles virus
auaggaaggaugaaugc

SEQ ID NO: 3084515 - RNA, 14 nt, Measles virus
ugcuucaggauucg

SEQ ID NO: 3084516 - RNA, 15 nt, Measles virus
caggcauccgacucc

SEQ ID NO: 3084517 - RNA, 16 nt, Measles virus
ucuggcugucucagga

SEQ ID NO: 3084518 - RNA, 19 nt, Measles virus
cggagauauccauccaggc

SEQ ID NO: 3084519 - RNA, 17 nt, Measles virus
gcaauauauuaaagaaa

SEQ ID NO: 3084520 - RNA, 13 nt, Measles virus
ucuucaagaucau

SEQ ID NO: 3084521 - RNA, 19 nt, Measles virus
cguugccacagcugcucag

SEQ ID NO: 3084522 - RNA, 16 nt, Measles virus
aaaccaugccucucag

SEQ ID NO: 3084523 - RNA, 13 nt, Measles virus
acuugggaaggau

SEQ ID NO: 3084524 - RNA, 19 nt, Measles virus
cggaaccaucagggccagg

SEQ ID NO: 3084525 - RNA, 19 nt, Measles virus
aaccucuucacuguuccaa

SEQ ID NO: 3084526 - RNA, 16 nt, Measles virus
cuuggaggagauauca

SEQ ID NO: 3084527 - RNA, 16 nt, Measles virus
caguagaacucagagg

SEQ ID NO: 3084528 - RNA, 21 nt, Measles virus
acauacaucugacaggggaga

SEQ ID NO: 3084529 - RNA, 17 nt, Measles virus
ucuucacauuagaagca

SEQ ID NO: 3084530 - RNA, 21 nt, Measles virus
gcgagcauucgggucccugcc

SEQ ID NO: 3084531 - RNA, 16 nt, Measles virus
gcuuacagccuggagg

SEQ ID NO: 3084532 - RNA, 19 nt, Measles virus
ccgaggaacuccucaaaga

SEQ ID NO: 3084533 - RNA, 14 nt, Measles virus
gccgacagccagca

SEQ ID NO: 3084534 - RNA, 13 nt, Measles virus
caccucagagauu

SEQ ID NO: 3084535 - RNA, 22 nt, Measles virus
uaggauaguuauuaacagagaa

SEQ ID NO: 3084536 - RNA, 16 nt, Measles virus
agacuauuaugaugau

SEQ ID NO: 3084537 - RNA, 17 nt, Measles virus
accgcauccagcaucaa

SEQ ID NO: 3084538 - RNA, 22 nt, Measles virus
ccagucaguaaugauuucagca

SEQ ID NO: 3084539 - RNA, 19 nt, Measles virus
aaaugauuauaaacaaugu

SEQ ID NO: 3084540 - RNA, 20 nt, Measles virus
ccgaguguuugaaguagggg

SEQ ID NO: 3084541 - RNA, 18 nt, Measles virus
uuaaagaaaacuuugaaa

SEQ ID NO: 3084542 - RNA, 19 nt, Measles virus
aagcgagaggccagccagc

SEQ ID NO: 3084543 - RNA, 18 nt, Measles virus
augcauccgggcucucaa

SEQ ID NO: 3084544 - RNA, 17 nt, Measles virus
gcauuggugaacucaac

SEQ ID NO: 3084545 - RNA, 16 nt, Measles virus
gaaaauacgaaguuuc

SEQ ID NO: 3084546 - RNA, 16 nt, Measles virus
augucaucaaguccaa

SEQ ID NO: 3084547 - RNA, 23 nt, Measles virus
cugaaagaaaaggagaucaagga

SEQ ID NO: 3084548 - RNA, 18 nt, Measles virus
ccccaguagggccagcac

SEQ ID NO: 3084549 - RNA, 18 nt, Measles virus
gcaaccaccgcauccagc

SEQ ID NO: 3084550 - RNA, 18 nt, Measles virus
acacucaauuccccaccc

SEQ ID NO: 3084551 - RNA, 16 nt, Measles virus
agccgacaacuccagg

SEQ ID NO: 3084552 - RNA, 22 nt, Measles virus
ucagcuuccagcucgucaagcu

SEQ ID NO: 3084553 - RNA, 20 nt, Measles virus
agaugcugacucuaucaugg

SEQ ID NO: 3084554 - RNA, 14 nt, Measles virus
guuucuauucccag

SEQ ID NO: 3084555 - RNA, 16 nt, Measles virus
augacagccagaaggc

SEQ ID NO: 3084556 - RNA, 13 nt, Measles virus
caaugaagaccuu

SEQ ID NO: 3084557 - RNA, 17 nt, Measles virus
cagcagggcucaaugaa

SEQ ID NO: 3084558 - RNA, 16 nt, Measles virus
gccaccagcucccaga

SEQ ID NO: 3084559 - RNA, 14 nt, Measles virus
ggagccgauggcag

SEQ ID NO: 3084560 - RNA, 14 nt, Measles virus
agcuauccuggagu

SEQ ID NO: 3084561 - RNA, 12 nt, Measles virus
gaugucacccag

SEQ ID NO: 3084562 - RNA, 17 nt, Measles virus
uuacugaaauacaugau

SEQ ID NO: 3084563 - RNA, 16 nt, Measles virus
gacugugugcagccaa

SEQ ID NO: 3084564 - RNA, 20 nt, Measles virus
acucaacccgaaccagcacc

SEQ ID NO: 3084565 - RNA, 18 nt, Measles virus
caacugaaggcggugcac

SEQ ID NO: 3084566 - RNA, 16 nt, Measles virus
ugguaauucuaccugg

SEQ ID NO: 3084567 - RNA, 18 nt, Measles virus
gagcccuuucuguuuugg

SEQ ID NO: 3084568 - RNA, 18 nt, Measles virus
ccacagguaggcacacca

SEQ ID NO: 3084569 - RNA, 21 nt, Measles virus
cuggaaggacaccucucaagc

SEQ ID NO: 3084570 - RNA, 10 nt, Measles virus
caacaaugug

SEQ ID NO: 3084571 - RNA, 21 nt, Measles virus
cagagggagcccccaaccaaa

SEQ ID NO: 3084572 - RNA, 18 nt, Measles virus
cccauuaaaaagggcaca

SEQ ID NO: 3084573 - RNA, 20 nt, Measles virus
uacgauccucccaagggaac

SEQ ID NO: 3084574 - RNA, 15 nt, Measles virus
caggcaucaagcacu

SEQ ID NO: 3084575 - RNA, 16 nt, Measles virus
uccaguguccaucaug

SEQ ID NO: 3084576 - RNA, 19 nt, Measles virus
ucagacaagcagggcagga

SEQ ID NO: 3084577 - RNA, 20 nt, Measles virus
ccagcucccagacucggcca

SEQ ID NO: 3084578 - RNA, 13 nt, Measles virus
gauggccaaggau

SEQ ID NO: 3084579 - RNA, 19 nt, Measles virus
aaugucaggaaauacauga

SEQ ID NO: 3084580 - RNA, 15 nt, Measles virus
gagcuccugaaacuc

SEQ ID NO: 3084581 - RNA, 20 nt, Measles virus
gaacccuaauccugcccuag

SEQ ID NO: 3084582 - RNA, 23 nt, Measles virus
cagaaucugguggacauaucacu

SEQ ID NO: 3084583 - RNA, 15 nt, Measles virus
gcaugcugcagacac

SEQ ID NO: 3084584 - RNA, 18 nt, Measles virus
gcagaugucgaacucaau

SEQ ID NO: 3084585 - RNA, 14 nt, Measles virus
cagucaguaaugau

SEQ ID NO: 3084586 - RNA, 11 nt, Measles virus
gccaaccccau

SEQ ID NO: 3084587 - RNA, 23 nt, Measles virus
cagaagauaaucuccaagcuaga

SEQ ID NO: 3084588 - RNA, 19 nt, Measles virus
ucaaccugucuuacagccu

SEQ ID NO: 3084589 - RNA, 16 nt, Measles virus
ccaaaggagacaccgg

SEQ ID NO: 3084590 - RNA, 22 nt, Measles virus
agguguugguagauccacagca

SEQ ID NO: 3084591 - RNA, 17 nt, Measles virus
caggcuggugccccagg

SEQ ID NO: 3084592 - RNA, 22 nt, Measles virus
gcacccaagagcgaucccuggg

SEQ ID NO: 3084593 - RNA, 21 nt, Measles virus
ucaugauugccauuccuggac

SEQ ID NO: 3084594 - RNA, 19 nt, Measles virus
cuccaagaaugccuccggg

SEQ ID NO: 3084595 - RNA, 18 nt, Measles virus
gggaaaaaggugagcuca

SEQ ID NO: 3084596 - RNA, 18 nt, Measles virus
agaucauccacaauguca

SEQ ID NO: 3084597 - RNA, 17 nt, Measles virus
acaugcuuccagcaggc

SEQ ID NO: 3084598 - RNA, 14 nt, Measles virus
aggugucuggaaau

SEQ ID NO: 3084599 - RNA, 20 nt, Measles virus
aaccgcacaagcgaccgagg

SEQ ID NO: 3084600 - RNA, 15 nt, Measles virus
caacacggacagaug

SEQ ID NO: 3084601 - RNA, 21 nt, Measles virus
aacggugugaccauccaaguc

SEQ ID NO: 3084602 - RNA, 14 nt, Measles virus
gcggcccaagcaca

SEQ ID NO: 3084603 - RNA, 12 nt, Measles virus
ucuucaaugcaa

SEQ ID NO: 3084604 - RNA, 13 nt, Measles virus
cguacagcagggc

SEQ ID NO: 3084605 - RNA, 21 nt, Measles virus
ucuccaagucccccggucucc

SEQ ID NO: 3084606 - RNA, 14 nt, Measles virus
agugaucugacaau

SEQ ID NO: 3084607 - RNA, 14 nt, Measles virus
ggacagcugcugaa

SEQ ID NO: 3084608 - RNA, 13 nt, Measles virus
aggaccaaccccg

SEQ ID NO: 3084609 - RNA, 17 nt, Measles virus
caagcagggcaggagau

SEQ ID NO: 3084610 - RNA, 18 nt, Measles virus
gccagccgacaacuccag

SEQ ID NO: 3084611 - RNA, 18 nt, Measles virus
gccugaaagaaaaggaga

SEQ ID NO: 3084612 - RNA, 22 nt, Measles virus
auaucacucacucugggauggu

SEQ ID NO: 3084613 - RNA, 21 nt, Measles virus
caccaaccgcauccccacagc

SEQ ID NO: 3084614 - RNA, 22 nt, Measles virus
ccaagucccccggucuccuccu

SEQ ID NO: 3084615 - RNA, 12 nt, Measles virus
cagcuuccagcu

SEQ ID NO: 3084616 - RNA, 16 nt, Measles virus
aggacaccucagagau

SEQ ID NO: 3084617 - RNA, 20 nt, Measles virus
agagaucucacuugguguau

SEQ ID NO: 3084618 - RNA, 17 nt, Measles virus
ccugcggggaauguccc

SEQ ID NO: 3084619 - RNA, 12 nt, Measles virus
auuauuugcaau

SEQ ID NO: 3084620 - RNA, 22 nt, Measles virus
accaacccccgaccagacccag

SEQ ID NO: 3084621 - RNA, 22 nt, Measles virus
cucaaagggaaacugcucaggg

SEQ ID NO: 3084622 - RNA, 14 nt, Measles virus
cccaccccacacac

SEQ ID NO: 3084623 - RNA, 18 nt, Measles virus
gcacuuaaugcaaugacc

SEQ ID NO: 3084624 - RNA, 20 nt, Measles virus
auccacucccacgacuggag

SEQ ID NO: 3084625 - RNA, 13 nt, Measles virus
cucagaaucuggu

SEQ ID NO: 3084626 - RNA, 20 nt, Measles virus
ugaaaauacgaaguuucuau

SEQ ID NO: 3084627 - RNA, 17 nt, Measles virus
cggcaccgcgcccccac

SEQ ID NO: 3084628 - RNA, 18 nt, Measles virus
caaucagacaagcagggc

SEQ ID NO: 3084629 - RNA, 13 nt, Measles virus
ucuucccugcacu

SEQ ID NO: 3084630 - RNA, 13 nt, Measles virus
gcaacugagggau

SEQ ID NO: 3084631 - RNA, 16 nt, Measles virus
cgcgcaccccagcccc

SEQ ID NO: 3084632 - RNA, 15 nt, Measles virus
ucagaguugucacaa

SEQ ID NO: 3084633 - RNA, 16 nt, Measles virus
uuaaucggccagaagc

SEQ ID NO: 3084634 - RNA, 19 nt, Measles virus
cuggaaggccccucccccc

SEQ ID NO: 3084635 - RNA, 19 nt, Measles virus
caaaacuuagggccaagga

SEQ ID NO: 3084636 - RNA, 14 nt, Measles virus
aacccuaauccugc

SEQ ID NO: 3084637 - RNA, 18 nt, Measles virus
cgacuccuuagacagauc

SEQ ID NO: 3084638 - RNA, 15 nt, Measles virus
uauauuaaagaaaac

SEQ ID NO: 3084639 - RNA, 12 nt, Measles virus
uaacaggauucc

SEQ ID NO: 3084640 - RNA, 22 nt, Measles virus
agucgagguuacaaugugucau

SEQ ID NO: 3084641 - RNA, 22 nt, Measles virus
aggcguugccacagcugcucag

SEQ ID NO: 3084642 - RNA, 14 nt, Measles virus
accaucagggccag

SEQ ID NO: 3084643 - RNA, 18 nt, Measles virus
caacccgaaccagcaccc

SEQ ID NO: 3084644 - RNA, 15 nt, Measles virus
ugaggcaaucagaca

SEQ ID NO: 3084645 - RNA, 14 nt, Measles virus
caaaauugcuucag

SEQ ID NO: 3084646 - RNA, 18 nt, Measles virus
ugugcagccaaaaugccu

SEQ ID NO: 3084647 - RNA, 23 nt, Measles virus
uuuacagucaagacugagaugag

SEQ ID NO: 3084648 - RNA, 21 nt, Measles virus
ugggcaugggagucagcugca

SEQ ID NO: 3084649 - RNA, 22 nt, Measles virus
caccggcccugcaucacgcagu

SEQ ID NO: 3084650 - RNA, 13 nt, Measles virus
gccaccagcuccc

SEQ ID NO: 3084651 - RNA, 19 nt, Measles virus
cauaagagccucagcacca

SEQ ID NO: 3084652 - RNA, 13 nt, Measles virus
cagacccagcacc

SEQ ID NO: 3084653 - RNA, 24 nt, Measles virus
uuagacguacagcagggcucaaug

SEQ ID NO: 3084654 - RNA, 20 nt, Measles virus
acgaggauaaucagaagaua

SEQ ID NO: 3084655 - RNA, 22 nt, Measles virus
caugauguucuugaccaaaacg

SEQ ID NO: 3084656 - RNA, 21 nt, Measles virus
agcugucucaaagggaaacug

SEQ ID NO: 3084657 - RNA, 16 nt, Measles virus
caaaccgcaaaagaca

SEQ ID NO: 3084658 - RNA, 14 nt, Measles virus
uccgauacaaccua

SEQ ID NO: 3084659 - RNA, 20 nt, Measles virus
gcauccccacagcucccggg

SEQ ID NO: 3084660 - RNA, 21 nt, Measles virus
ugccagccgacaacuccaggg

SEQ ID NO: 3084661 - RNA, 15 nt, Measles virus
cauaaaauuaaugcc

SEQ ID NO: 3084662 - RNA, 18 nt, Measles virus
gccuucuacaaagacaac

SEQ ID NO: 3084663 - RNA, 16 nt, Measles virus
gccaucaguuccucaa

SEQ ID NO: 3084664 - RNA, 21 nt, Measles virus
gcacuugcugcucuccaaagg

SEQ ID NO: 3084665 - RNA, 15 nt, Measles virus
gcuaaguuggaggau

SEQ ID NO: 3084666 - RNA, 12 nt, Measles virus
aaugccuccggg

SEQ ID NO: 3084667 - RNA, 18 nt, Measles virus
cagccaaccaaccaucca

SEQ ID NO: 3084668 - RNA, 14 nt, Measles virus
cagccgacagcaag

SEQ ID NO: 3084669 - RNA, 13 nt, Measles virus
gucaauucucaaa

SEQ ID NO: 3084670 - RNA, 18 nt, Measles virus
ggccuaggcuccgaauug

SEQ ID NO: 3084671 - RNA, 14 nt, Measles virus
ugguggacauauca

SEQ ID NO: 3084672 - RNA, 20 nt, Measles virus
cguacagcagggcucaauga

SEQ ID NO: 3084673 - RNA, 21 nt, Measles virus
gguuggacguagggacaaauc

SEQ ID NO: 3084674 - RNA, 15 nt, Measles virus
gccucuuagccugga

SEQ ID NO: 3084675 - RNA, 20 nt, Measles virus
cauaagagccucagcaccaa

SEQ ID NO: 3084676 - RNA, 20 nt, Measles virus
ccgaaccccaguagggccag

SEQ ID NO: 3084677 - RNA, 13 nt, Measles virus
caucaauccucug

SEQ ID NO: 3084678 - RNA, 19 nt, Measles virus
caaucagacaagcagggca

SEQ ID NO: 3084679 - RNA, 20 nt, Measles virus
gccccgacacaaggccacca

SEQ ID NO: 3084680 - RNA, 19 nt, Measles virus
ccgaccagacccagcaccc

SEQ ID NO: 3084681 - RNA, 17 nt, Measles virus
gaucaauacugugcaga

SEQ ID NO: 3084682 - RNA, 17 nt, Measles virus
aacccuaauccugcccu

SEQ ID NO: 3084683 - RNA, 15 nt, Measles virus
aacauaccuaccugc

SEQ ID NO: 3084684 - RNA, 21 nt, Measles virus
ccccaggggccgacagccagc

SEQ ID NO: 3084685 - RNA, 17 nt, Measles virus
cccagacucggccauca

SEQ ID NO: 3084686 - RNA, 19 nt, Measles virus
cgggaaaggaacccccagc

SEQ ID NO: 3084687 - RNA, 19 nt, Measles virus
cugcacagucacucgggaa

SEQ ID NO: 3084688 - RNA, 22 nt, Measles virus
ucuugugauuuaaucggccaga

SEQ ID NO: 3084689 - RNA, 22 nt, Measles virus
gcaggcaguucgggucucagca

SEQ ID NO: 3084690 - RNA, 21 nt, Measles virus
cucaacucuacuggaggccag

SEQ ID NO: 3084691 - RNA, 22 nt, Measles virus
cccgaugaguccucugcuccaa

SEQ ID NO: 3084692 - RNA, 23 nt, Measles virus
cacucaacccgaaccagcaccca

SEQ ID NO: 3084693 - RNA, 13 nt, Measles virus
ccagacccagcac

SEQ ID NO: 3084694 - RNA, 22 nt, Measles virus
ucccucacgcuuacagccugga

SEQ ID NO: 3084695 - RNA, 21 nt, Measles virus
aaggcccccaggggccgacag

SEQ ID NO: 3084696 - RNA, 17 nt, Measles virus
agagcaagccuggaaac

SEQ ID NO: 3084697 - RNA, 15 nt, Measles virus
ucuggugccgucacu

SEQ ID NO: 3084698 - RNA, 11 nt, Measles virus
uccagaagacu

SEQ ID NO: 3084699 - RNA, 21 nt, Measles virus
augucaaaaacggacuggaau

SEQ ID NO: 3084700 - RNA, 16 nt, Measles virus
gccagagagaaucaaa

SEQ ID NO: 3084701 - RNA, 17 nt, Measles virus
uaacauacauugcugcc

SEQ ID NO: 3084702 - RNA, 23 nt, Measles virus
agauuuucucauuuuucagaagu

SEQ ID NO: 3084703 - RNA, 16 nt, Measles virus
acucgaucgagcauca

SEQ ID NO: 3084704 - RNA, 18 nt, Measles virus
aaguuucuauucccagcu

SEQ ID NO: 3084705 - RNA, 21 nt, Measles virus
cgcuccgaacacagaccacca

SEQ ID NO: 3084706 - RNA, 20 nt, Measles virus
ucaguaaggagucucaacau

SEQ ID NO: 3084707 - RNA, 21 nt, Measles virus
cggaugauccagugauagaua

SEQ ID NO: 3084708 - RNA, 17 nt, Measles virus
ccagaguccagaccacc

SEQ ID NO: 3084709 - RNA, 19 nt, Measles virus
aaugcccaauauaacucuc

SEQ ID NO: 3084710 - RNA, 16 nt, Measles virus
cagccgacaacuccag

SEQ ID NO: 3084711 - RNA, 19 nt, Measles virus
cucaaauugcucagauacu

SEQ ID NO: 3084712 - RNA, 20 nt, Measles virus
gacacaauccggaaugcuca

SEQ ID NO: 3084713 - RNA, 13 nt, Measles virus
ugccucucagcaa

SEQ ID NO: 3084714 - RNA, 17 nt, Measles virus
gacaccaggcggcccaa

SEQ ID NO: 3084715 - RNA, 16 nt, Measles virus
agucagauacaugugg

SEQ ID NO: 3084716 - RNA, 14 nt, Measles virus
uaaugacagccaga

SEQ ID NO: 3084717 - RNA, 10 nt, Measles virus
gaaccagagu

SEQ ID NO: 3084718 - RNA, 20 nt, Measles virus
aucgagcaucaggucaagga

SEQ ID NO: 3084719 - RNA, 12 nt, Measles virus
ccacccuggaag

SEQ ID NO: 3084720 - RNA, 18 nt, Measles virus
auggagacaugcuuccag

SEQ ID NO: 3084721 - RNA, 21 nt, Measles virus
cucuucacuguuccaaucaag

SEQ ID NO: 3084722 - RNA, 20 nt, Measles virus
aaccacugcuuuacugaaau

SEQ ID NO: 3084723 - RNA, 16 nt, Measles virus
cgcggcaccgcgcccc

SEQ ID NO: 3084724 - RNA, 21 nt, Measles virus
gcaucgcgaggaagcacaccc

SEQ ID NO: 3084725 - RNA, 20 nt, Measles virus
agaugcacuuaaugcaauga

SEQ ID NO: 3084726 - RNA, 14 nt, Measles virus
accgcauccccaca

SEQ ID NO: 3084727 - RNA, 23 nt, Measles virus
aucacaagggaaccuaauagcca

SEQ ID NO: 3084728 - RNA, 13 nt, Measles virus
cucaaagaggcca

SEQ ID NO: 3084729 - RNA, 17 nt, Measles virus
aggcauuauuugcaaua

SEQ ID NO: 3084730 - RNA, 18 nt, Measles virus
ccaagcgagaggccagcc

SEQ ID NO: 3084731 - RNA, 16 nt, Measles virus
ucaauuaagaagcaga

SEQ ID NO: 3084732 - RNA, 22 nt, Measles virus
uaucucgaauuuugaugaguca

SEQ ID NO: 3084733 - RNA, 21 nt, Measles virus
gcuggggguuguugaggacag

SEQ ID NO: 3084734 - RNA, 15 nt, Measles virus
uauaggcucucaaga

SEQ ID NO: 3084735 - RNA, 21 nt, Measles virus
acccgaaccagcacccaagag

SEQ ID NO: 3084736 - RNA, 17 nt, Measles virus
guuccagaggacagcug

SEQ ID NO: 3084737 - RNA, 17 nt, Measles virus
caucauaggcagagauu

SEQ ID NO: 3084738 - RNA, 18 nt, Measles virus
acuccggaacccuaaucc

SEQ ID NO: 3084739 - RNA, 14 nt, Measles virus
auccccacagcucc

SEQ ID NO: 3084740 - RNA, 20 nt, Measles virus
uccaagacggggggcccccc

SEQ ID NO: 3084741 - RNA, 18 nt, Measles virus
caaacaugucgcuguccc

SEQ ID NO: 3084742 - RNA, 12 nt, Measles virus
cagccugaaaga

SEQ ID NO: 3084743 - RNA, 16 nt, Measles virus
guuaucgcugacaauc

SEQ ID NO: 3084744 - RNA, 15 nt, Measles virus
cagguaggcacacca

SEQ ID NO: 3084745 - RNA, 19 nt, Measles virus
ccaagcgagaggccagcca

SEQ ID NO: 3084746 - RNA, 15 nt, Measles virus
caggaaauacaugaa

SEQ ID NO: 3084747 - RNA, 18 nt, Measles virus
aaacuuugaaaauacgaa

SEQ ID NO: 3084748 - RNA, 15 nt, Measles virus
uagacagauccucuc

SEQ ID NO: 3084749 - RNA, 21 nt, Measles virus
gaggugaacggugugaccauc

SEQ ID NO: 3084750 - RNA, 14 nt, Measles virus
cccaagcacagaac

SEQ ID NO: 3084751 - RNA, 18 nt, Measles virus
cuaaguuccacaaugaca

SEQ ID NO: 3084752 - RNA, 16 nt, Measles virus
uacagucaagacugag

SEQ ID NO: 3084753 - RNA, 16 nt, Measles virus
ugaggacaccucagag

SEQ ID NO: 3084754 - RNA, 17 nt, Measles virus
aguuucuauucccagcu

SEQ ID NO: 3084755 - RNA, 18 nt, Measles virus
ccucacgcuuacagccug

SEQ ID NO: 3084756 - RNA, 17 nt, Measles virus
agucaucggaccagaua

SEQ ID NO: 3084757 - RNA, 17 nt, Measles virus
caggugcggcccuaggc

SEQ ID NO: 3084758 - RNA, 16 nt, Measles virus
caagacggggggcccc

SEQ ID NO: 3084759 - RNA, 20 nt, Measles virus
ucaaauuguagccaugcugg

SEQ ID NO: 3084760 - RNA, 20 nt, Measles virus
cagaagagcaggcacgccau

SEQ ID NO: 3084761 - RNA, 22 nt, Measles virus
aacucaguuccaaucugguaau

SEQ ID NO: 3084762 - RNA, 15 nt, Measles virus
cgaggaacuccucaa

SEQ ID NO: 3084763 - RNA, 14 nt, Measles virus
uaaacaauguggaa

SEQ ID NO: 3084764 - RNA, 17 nt, Measles virus
cuccucgugggaccccc

SEQ ID NO: 3084765 - RNA, 15 nt, Measles virus
uccaagcuagaauca

SEQ ID NO: 3084766 - RNA, 21 nt, Measles virus
ugaagcaguaacggcugcuga

SEQ ID NO: 3084767 - RNA, 13 nt, Measles virus
uaaggagucucaa

SEQ ID NO: 3084768 - RNA, 22 nt, Measles virus
cagcuuccagcucgucaagcua

SEQ ID NO: 3084769 - RNA, 13 nt, Measles virus
cgcgcaccccagc

SEQ ID NO: 3084770 - RNA, 15 nt, Measles virus
ucaaagaggccacug

SEQ ID NO: 3084771 - RNA, 21 nt, Measles virus
cagaacaacauccgccuaccc

SEQ ID NO: 3084772 - RNA, 14 nt, Measles virus
ccugcacucgggaa

SEQ ID NO: 3084773 - RNA, 13 nt, Measles virus
ucucaaagggaaa

SEQ ID NO: 3084774 - RNA, 18 nt, Measles virus
cacauuagaagcacaggc

SEQ ID NO: 3084775 - RNA, 17 nt, Measles virus
uccggaacccuaauccu

SEQ ID NO: 3084776 - RNA, 15 nt, Measles virus
ccaucaguuccucaa

SEQ ID NO: 3084777 - RNA, 17 nt, Measles virus
ucagcugcacagucacu

SEQ ID NO: 3084778 - RNA, 15 nt, Measles virus
uaucgcugacaauca

SEQ ID NO: 3084779 - RNA, 12 nt, Measles virus
auaauaaugaag

SEQ ID NO: 3084780 - RNA, 16 nt, Measles virus
gcugacaaucaagcaa

SEQ ID NO: 3084781 - RNA, 15 nt, Measles virus
aguagcuauccugga

SEQ ID NO: 3084782 - RNA, 22 nt, Measles virus
cgaccccccucauaaugacagc

SEQ ID NO: 3084783 - RNA, 12 nt, Measles virus
cucuccccccgg

SEQ ID NO: 3084784 - RNA, 19 nt, Measles virus
gacaacacggacagaugac

SEQ ID NO: 3084785 - RNA, 17 nt, Measles virus
aaccgcauccccacagc

SEQ ID NO: 3084786 - RNA, 21 nt, Measles virus
guauuacaccguucccagaag

SEQ ID NO: 3084787 - RNA, 10 nt, Measles virus
ucaaggaaac

SEQ ID NO: 3084788 - RNA, 13 nt, Measles virus
gauaacuggaaau

SEQ ID NO: 3084789 - RNA, 16 nt, Measles virus
cuauucccagcuuugu

SEQ ID NO: 3084790 - RNA, 13 nt, Measles virus
cauuauuugcaau

SEQ ID NO: 3084791 - RNA, 17 nt, Measles virus
agucgggagcaggaggu

SEQ ID NO: 3084792 - RNA, 17 nt, Measles virus
gcggagauauccaucca

SEQ ID NO: 3084793 - RNA, 15 nt, Measles virus
uacaaagacaaccca

SEQ ID NO: 3084794 - RNA, 22 nt, Measles virus
cuacaccgcagagauccauaag

SEQ ID NO: 3084795 - RNA, 21 nt, Measles virus
ccccccaaaaaaaggccccca

SEQ ID NO: 3084796 - RNA, 15 nt, Measles virus
ccacagcugcucaga

SEQ ID NO: 3084797 - RNA, 13 nt, Measles virus
aguuaggcauuau

SEQ ID NO: 3084798 - RNA, 16 nt, Measles virus
agcagggcucaaugaa

SEQ ID NO: 3084799 - RNA, 13 nt, Measles virus
guggaaugcuuca

SEQ ID NO: 3084800 - RNA, 16 nt, Measles virus
caugaugucacccaga

SEQ ID NO: 3084801 - RNA, 17 nt, Measles virus
caaguggaaugcuucac

SEQ ID NO: 3084802 - RNA, 19 nt, Measles virus
ggucaggaucuccaauaug

SEQ ID NO: 3084803 - RNA, 21 nt, Measles virus
ggagauccacgagcuccugaa

SEQ ID NO: 3084804 - RNA, 15 nt, Measles virus
acuaacccuccucac

SEQ ID NO: 3084805 - RNA, 13 nt, Measles virus
gcgaucccugggg

SEQ ID NO: 3084806 - RNA, 14 nt, Measles virus
gacaucccagggaa

SEQ ID NO: 3084807 - RNA, 21 nt, Measles virus
cccaaccgcaggcauccgacu

SEQ ID NO: 3084808 - RNA, 17 nt, Measles virus
cuccaaacacccaccgg

SEQ ID NO: 3084809 - RNA, 18 nt, Measles virus
caaccugucuuacagccu

SEQ ID NO: 3084810 - RNA, 20 nt, Measles virus
gacugccaugccccaacaua

SEQ ID NO: 3084811 - RNA, 18 nt, Measles virus
cugaucuuacagggacau

SEQ ID NO: 3084812 - RNA, 17 nt, Measles virus
cccggugcccacaggua

SEQ ID NO: 3084813 - RNA, 13 nt, Measles virus
cuacccuccauca

SEQ ID NO: 3084814 - RNA, 18 nt, Measles virus
gagcaucaggucaaggac

SEQ ID NO: 3084815 - RNA, 15 nt, Measles virus
ccaauccagaggcaa

SEQ ID NO: 3084816 - RNA, 18 nt, Measles virus
guugaaacugcagaagga

SEQ ID NO: 3084817 - RNA, 22 nt, Measles virus
caguccacacaaguaccaggaa

SEQ ID NO: 3084818 - RNA, 18 nt, Measles virus
cagacucggccaucaccc

SEQ ID NO: 3084819 - RNA, 16 nt, Measles virus
agaggaggcaggcagu

SEQ ID NO: 3084820 - RNA, 20 nt, Measles virus
gguuuaucgagcacuagcau

SEQ ID NO: 3084821 - RNA, 15 nt, Measles virus
ugucacagggaagau

SEQ ID NO: 3084822 - RNA, 21 nt, Measles virus
gggaaaggaacccccagcaac

SEQ ID NO: 3084823 - RNA, 13 nt, Measles virus
ggccagccagcag

SEQ ID NO: 3084824 - RNA, 13 nt, Measles virus
agcugucucaaag

SEQ ID NO: 3084825 - RNA, 19 nt, Measles virus
ggcaugggagucagcugca

SEQ ID NO: 3084826 - RNA, 13 nt, Measles virus
aggaacuccucaa

SEQ ID NO: 3084827 - RNA, 16 nt, Measles virus
ugcugcagacacaauc

SEQ ID NO: 3084828 - RNA, 14 nt, Measles virus
gccggcccccccgg

SEQ ID NO: 3084829 - RNA, 16 nt, Measles virus
ucagauacauguggaa

SEQ ID NO: 3084830 - RNA, 16 nt, Measles virus
uguaccuaaaggacaa

SEQ ID NO: 3084831 - RNA, 13 nt, Measles virus
ccuaaagccugau

SEQ ID NO: 3084832 - RNA, 21 nt, Measles virus
acugcagaugucgaacucaau

SEQ ID NO: 3084833 - RNA, 22 nt, Measles virus
caaaaaagcccccuccagaaga

SEQ ID NO: 3084834 - RNA, 21 nt, Measles virus
uggcaguacuguuaacucucc

SEQ ID NO: 3084835 - RNA, 15 nt, Measles virus
caaggccaccaccag

SEQ ID NO: 3084836 - RNA, 19 nt, Measles virus
cacaaggccaccaccagcc

SEQ ID NO: 3084837 - RNA, 19 nt, Measles virus
uucuauucccagcuuuguc

SEQ ID NO: 3084838 - RNA, 13 nt, Measles virus
cggugcccacagg

SEQ ID NO: 3084839 - RNA, 21 nt, Measles virus
ccaggcaguuuugcagccauc

SEQ ID NO: 3084840 - RNA, 16 nt, Measles virus
cacgccaugucaaaaa

SEQ ID NO: 3084841 - RNA, 17 nt, Measles virus
cuugccaaguuccacca

SEQ ID NO: 3084842 - RNA, 12 nt, Measles virus
ggacaaggcacu

SEQ ID NO: 3084843 - RNA, 20 nt, Measles virus
gcccuagguaguuaggcauu

SEQ ID NO: 3084844 - RNA, 19 nt, Measles virus
ucccagacucggccaucac

SEQ ID NO: 3084845 - RNA, 12 nt, Measles virus
aggaugccaagg

SEQ ID NO: 3084846 - RNA, 22 nt, Measles virus
cagaaggaggggagauccacga

SEQ ID NO: 3084847 - RNA, 20 nt, Measles virus
cuggagccacuuucacuugc

SEQ ID NO: 3084848 - RNA, 15 nt, Measles virus
auccgacgcuguccg

SEQ ID NO: 3084849 - RNA, 23 nt, Measles virus
caaaguuaugacucguuccagcc

SEQ ID NO: 3084850 - RNA, 17 nt, Measles virus
cagaggucaauucucaa

SEQ ID NO: 3084851 - RNA, 11 nt, Measles virus
cagggcccacu

SEQ ID NO: 3084852 - RNA, 16 nt, Measles virus
cuuccagcucgucaag

SEQ ID NO: 3084853 - RNA, 17 nt, Measles virus
cuuagagagcagaggaa

SEQ ID NO: 3084854 - RNA, 20 nt, Measles virus
ugcugcagacacaauccgga

SEQ ID NO: 3084855 - RNA, 16 nt, Measles virus
uccagaccacccuggg

SEQ ID NO: 3084856 - RNA, 20 nt, Measles virus
gaggcaaucagacaagcagg

SEQ ID NO: 3084857 - RNA, 14 nt, Measles virus
gacacuaacucacg

SEQ ID NO: 3084858 - RNA, 21 nt, Measles virus
ggccgagcccaucggcucacu

SEQ ID NO: 3084859 - RNA, 15 nt, Measles virus
ccagaguccagacca

SEQ ID NO: 3084860 - RNA, 19 nt, Measles virus
cuaucaggggucagggaaa

SEQ ID NO: 3084861 - RNA, 16 nt, Measles virus
gucaacaaggaagauc

SEQ ID NO: 3084862 - RNA, 19 nt, Measles virus
cuugucuguuaaucugagu

SEQ ID NO: 3084863 - RNA, 15 nt, Measles virus
aaggucaugccauau

SEQ ID NO: 3084864 - RNA, 19 nt, Measles virus
cagcaacuggaaggccccu

SEQ ID NO: 3084865 - RNA, 15 nt, Measles virus
ggaacccccagcaac

SEQ ID NO: 3084866 - RNA, 22 nt, Measles virus
ugaacuccggaacccuaauccu

SEQ ID NO: 3084867 - RNA, 23 nt, Measles virus
cgaaggucgcuccgaacacagac

SEQ ID NO: 3084868 - RNA, 15 nt, Measles virus
ccggcgggcagccac

SEQ ID NO: 3084869 - RNA, 18 nt, Measles virus
aaaacuuagggccaagga

SEQ ID NO: 3084870 - RNA, 24 nt, Measles virus
cgacagcaaguguggacaccaggc

SEQ ID NO: 3084871 - RNA, 17 nt, Measles virus
uauguuuugcuggcugu

SEQ ID NO: 3084872 - RNA, 23 nt, Measles virus
guugaggacagcgauccccuagg

SEQ ID NO: 3084873 - RNA, 16 nt, Measles virus
ccucaagaaaucucca

SEQ ID NO: 3084874 - RNA, 15 nt, Measles virus
caaucugagagcaag

SEQ ID NO: 3084875 - RNA, 18 nt, Measles virus
cagaggucaauucucaaa

SEQ ID NO: 3084876 - RNA, 18 nt, Measles virus
cacaaggccaccaccagc

SEQ ID NO: 3084877 - RNA, 18 nt, Measles virus
gcaguaacggcugcugaa

SEQ ID NO: 3084878 - RNA, 23 nt, Measles virus
accccgcaaaaaggaaaggccac

SEQ ID NO: 3084879 - RNA, 19 nt, Measles virus
cccacuacaaucagagguc

SEQ ID NO: 3084880 - RNA, 11 nt, Measles virus
gccauggcagc

SEQ ID NO: 3084881 - RNA, 15 nt, Measles virus
ggacuugggaaggau

SEQ ID NO: 3084882 - RNA, 18 nt, Measles virus
ggucagggaucuggagaa

SEQ ID NO: 3084883 - RNA, 15 nt, Measles virus
aguuauuaacagaga

SEQ ID NO: 3084884 - RNA, 17 nt, Measles virus
agccuaaucugagcagu

SEQ ID NO: 3084885 - RNA, 18 nt, Measles virus
caggcuggugccccaggu

SEQ ID NO: 3084886 - RNA, 23 nt, Measles virus
aggccacaacccgcgcaccccag

SEQ ID NO: 3084887 - RNA, 21 nt, Measles virus
auggcaggcuggugccccagg

SEQ ID NO: 3084888 - RNA, 21 nt, Measles virus
ccucugcuccaagaaugccuc

SEQ ID NO: 3084889 - RNA, 20 nt, Measles virus
aucaugauugccauuccugg

SEQ ID NO: 3084890 - RNA, 17 nt, Measles virus
cucaguuccaaucuggu

SEQ ID NO: 3084891 - RNA, 22 nt, Measles virus
cagccccgacacaaggccacca

SEQ ID NO: 3084892 - RNA, 18 nt, Measles virus
cccaaaaaaaggccccca

SEQ ID NO: 3084893 - RNA, 18 nt, Measles virus
cgaggaagccauggcagc

SEQ ID NO: 3084894 - RNA, 13 nt, Measles virus
cgaaccagcaccc

SEQ ID NO: 3084895 - RNA, 15 nt, Measles virus
accucgguccuccca

SEQ ID NO: 3084896 - RNA, 21 nt, Measles virus
aauaaaugccuucuacaaaga

SEQ ID NO: 3084897 - RNA, 17 nt, Measles virus
gacauacaucugacagg

SEQ ID NO: 3084898 - RNA, 18 nt, Measles virus
cauaaugacagccagaag

SEQ ID NO: 3084899 - RNA, 15 nt, Measles virus
gggaaucccagaauc

SEQ ID NO: 3084900 - RNA, 14 nt, Measles virus
gccaaaaugccuug

SEQ ID NO: 3084901 - RNA, 12 nt, Measles virus
augccucucagc

SEQ ID NO: 3084902 - RNA, 18 nt, Measles virus
auaacugaugacauacau

SEQ ID NO: 3084903 - RNA, 19 nt, Measles virus
cucccccugcaugcugcag

SEQ ID NO: 3084904 - RNA, 16 nt, Measles virus
accuccaugacccuga

SEQ ID NO: 3084905 - RNA, 20 nt, Measles virus
gacaaaauuaaauuccuuaa

SEQ ID NO: 3084906 - RNA, 14 nt, Measles virus
aagcacacccaccc

SEQ ID NO: 3084907 - RNA, 20 nt, Measles virus
acuccacacucuggcugucu

SEQ ID NO: 3084908 - RNA, 14 nt, Measles virus
gccgccagccaacc

SEQ ID NO: 3084909 - RNA, 15 nt, Measles virus
ucacgcuuacagccu

SEQ ID NO: 3084910 - RNA, 22 nt, Measles virus
uacaccguucccagaagaaugc

SEQ ID NO: 3084911 - RNA, 17 nt, Measles virus
gcauccccacagcuccc

SEQ ID NO: 3084912 - RNA, 19 nt, Measles virus
agcaaguguggacaccagg

SEQ ID NO: 3084913 - RNA, 16 nt, Measles virus
aucugagagcaagccu

SEQ ID NO: 3084914 - RNA, 20 nt, Measles virus
agauguggcugcugaagaac

SEQ ID NO: 3084915 - RNA, 16 nt, Measles virus
auauuaaagaaaacuu

SEQ ID NO: 3084916 - RNA, 13 nt, Measles virus
accaguuccagag

SEQ ID NO: 3084917 - RNA, 18 nt, Measles virus
guugagcuuaaaaucaaa

SEQ ID NO: 3084918 - RNA, 19 nt, Measles virus
ucggaaccaucagggccag

SEQ ID NO: 3084919 - RNA, 19 nt, Measles virus
ggaccgagccaccugcaag

SEQ ID NO: 3084920 - RNA, 23 nt, Measles virus
caacccgaaccagcacccaagag

SEQ ID NO: 3084921 - RNA, 14 nt, Measles virus
cucguuccagccau

SEQ ID NO: 3084922 - RNA, 18 nt, Measles virus
aggcauuauuugcaauau

SEQ ID NO: 3084923 - RNA, 14 nt, Measles virus
ccguucccagaaga

SEQ ID NO: 3084924 - RNA, 19 nt, Measles virus
gaacuccucaaagaggcca

SEQ ID NO: 3084925 - RNA, 13 nt, Measles virus
cacccccaaagga

SEQ ID NO: 3084926 - RNA, 19 nt, Measles virus
aaaugacuuacaaaaugag

SEQ ID NO: 3084927 - RNA, 16 nt, Measles virus
uccagggaaugacuaa

SEQ ID NO: 3084928 - RNA, 13 nt, Measles virus
acccuggaaggac

SEQ ID NO: 3084929 - RNA, 20 nt, Measles virus
ccugggccaccagcucccag

SEQ ID NO: 3084930 - RNA, 15 nt, Measles virus
caccugcaaggaaga

SEQ ID NO: 3084931 - RNA, 14 nt, Measles virus
cagacccagcaccc

SEQ ID NO: 3084932 - RNA, 18 nt, Measles virus
gucaaaaacggacuggaa

SEQ ID NO: 3084933 - RNA, 15 nt, Measles virus
ucaggggucagggaa

SEQ ID NO: 3084934 - RNA, 19 nt, Measles virus
uaucccgccaaugaagaac

SEQ ID NO: 3084935 - RNA, 17 nt, Measles virus
gccacagcugcucagau

SEQ ID NO: 3084936 - RNA, 15 nt, Measles virus
ugacaucccagggaa

SEQ ID NO: 3084937 - RNA, 17 nt, Measles virus
caucaguaucccacagc

SEQ ID NO: 3084938 - RNA, 13 nt, Measles virus
aucucaaagaaag

SEQ ID NO: 3084939 - RNA, 15 nt, Measles virus
ccagcacccagccac

SEQ ID NO: 3084940 - RNA, 12 nt, Measles virus
gugugaaauaga

SEQ ID NO: 3084941 - RNA, 19 nt, Measles virus
gcgaauggagacaugcuuc

SEQ ID NO: 3084942 - RNA, 23 nt, Measles virus
ucgugggacccccgaggaccaac

SEQ ID NO: 3084943 - RNA, 16 nt, Measles virus
ccagcuuacgggaccc

SEQ ID NO: 3084944 - RNA, 19 nt, Measles virus
uuaugccucuuagccugga

SEQ ID NO: 3084945 - RNA, 15 nt, Measles virus
aaggaaaggccacaa

SEQ ID NO: 3084946 - RNA, 12 nt, Measles virus
cagaccccggcc

SEQ ID NO: 3084947 - RNA, 22 nt, Measles virus
ucagcauauccacccuggaagg

SEQ ID NO: 3084948 - RNA, 13 nt, Measles virus
agaggaggaucgg

SEQ ID NO: 3084949 - RNA, 17 nt, Measles virus
gaugucacccagacauc

SEQ ID NO: 3084950 - RNA, 19 nt, Measles virus
acccgcgcaccccagcccc

SEQ ID NO: 3084951 - RNA, 14 nt, Measles virus
ugcuccaagaaugc

SEQ ID NO: 3084952 - RNA, 13 nt, Measles virus
caucaggucaagg

SEQ ID NO: 3084953 - RNA, 14 nt, Measles virus
gguccacacagccg

SEQ ID NO: 3084954 - RNA, 15 nt, Measles virus
ucaagguuaguccca

SEQ ID NO: 3084955 - RNA, 16 nt, Measles virus
agguuaaugacagaga

SEQ ID NO: 3084956 - RNA, 13 nt, Measles virus
caguggaggugau

SEQ ID NO: 3084957 - RNA, 15 nt, Measles virus
aguaagaauccaggc

SEQ ID NO: 3084958 - RNA, 20 nt, Measles virus
uccagccggcuagaggagga

SEQ ID NO: 3084959 - RNA, 22 nt, Measles virus
aaucaguuccuagcugucucaa

SEQ ID NO: 3084960 - RNA, 20 nt, Measles virus
acgaucuugccaaguuccac

SEQ ID NO: 3084961 - RNA, 12 nt, Measles virus
cgaggaagccau

SEQ ID NO: 3084962 - RNA, 21 nt, Measles virus
caguacuguuaacucuccaaa

SEQ ID NO: 3084963 - RNA, 13 nt, Measles virus
ccucugucacagg

SEQ ID NO: 3084964 - RNA, 16 nt, Measles virus
gugucagcuuccagcu

SEQ ID NO: 3084965 - RNA, 21 nt, Measles virus
cauggcagcauggucagaaau

SEQ ID NO: 3084966 - RNA, 24 nt, Measles virus
ugagcuugaucggguugcuagcca

SEQ ID NO: 3084967 - RNA, 21 nt, Measles virus
ugggaaagccuaaucugagca

SEQ ID NO: 3084968 - RNA, 22 nt, Measles virus
ccaggcggcccaagcacagaac

SEQ ID NO: 3084969 - RNA, 21 nt, Measles virus
gccacucaacccgaaccagca

SEQ ID NO: 3084970 - RNA, 21 nt, Measles virus
ccacaaccgaaccgcacaagc

SEQ ID NO: 3084971 - RNA, 21 nt, Measles virus
acuaacucgaucgagcaucag

SEQ ID NO: 3084972 - RNA, 20 nt, Measles virus
acacaccuguauucuucacu

SEQ ID NO: 3084973 - RNA, 20 nt, Measles virus
cagauccucuccccccggca

SEQ ID NO: 3084974 - RNA, 18 nt, Measles virus
uucagaguguagcuucaa

SEQ ID NO: 3084975 - RNA, 18 nt, Measles virus
accccccgaaaaccagag

SEQ ID NO: 3084976 - RNA, 14 nt, Measles virus
ggcacgccauguca

SEQ ID NO: 3084977 - RNA, 18 nt, Measles virus
ggccgacagccagcaucg

SEQ ID NO: 3084978 - RNA, 18 nt, Measles virus
gcauaguuuacauccuga

SEQ ID NO: 3084979 - RNA, 19 nt, Measles virus
caauguaccuaaaggacaa

SEQ ID NO: 3084980 - RNA, 14 nt, Measles virus
guacgggggaacuu

SEQ ID NO: 3084981 - RNA, 14 nt, Measles virus
uccccacagcuccc

SEQ ID NO: 3084982 - RNA, 15 nt, Measles virus
ccaaggaacacacac

SEQ ID NO: 3084983 - RNA, 14 nt, Measles virus
gagucaacaaggaa

SEQ ID NO: 3084984 - RNA, 19 nt, Measles virus
agguguuaucgcugacaau

SEQ ID NO: 3084985 - RNA, 20 nt, Measles virus
cccaauauaacucuccucaa

SEQ ID NO: 3084986 - RNA, 14 nt, Measles virus
gacccagcacccag

SEQ ID NO: 3084987 - RNA, 23 nt, Measles virus
cgaggaacuccucaaagaggcca

SEQ ID NO: 3084988 - RNA, 13 nt, Measles virus
uaaugacagagac

SEQ ID NO: 3084989 - RNA, 16 nt, Measles virus
ugccucuuagccugga

SEQ ID NO: 3084990 - RNA, 16 nt, Measles virus
uaauccgcuccauuau

SEQ ID NO: 3084991 - RNA, 18 nt, Measles virus
ccacacagccgccagcca

SEQ ID NO: 3084992 - RNA, 21 nt, Measles virus
ccagcacuuccgagacaccca

SEQ ID NO: 3084993 - RNA, 19 nt, Measles virus
gacagguggugcaacccaa

SEQ ID NO: 3084994 - RNA, 17 nt, Measles virus
cagaagacuccacggac

SEQ ID NO: 3084995 - RNA, 17 nt, Measles virus
cacaaugucaccacaac

SEQ ID NO: 3084996 - RNA, 16 nt, Measles virus
cagaguugucacaacu

SEQ ID NO: 3084997 - RNA, 17 nt, Measles virus
agaccgaauaaaugccu

SEQ ID NO: 3084998 - RNA, 15 nt, Measles virus
augcgcuuggaggag

SEQ ID NO: 3084999 - RNA, 15 nt, Measles virus
gaccuuauguuuugc

SEQ ID NO: 3085000 - RNA, 23 nt, Measles virus
gagcacgauuugacuaaggcacu

SEQ ID NO: 3085001 - RNA, 19 nt, Measles virus
aagcuaggugucuggaaau

SEQ ID NO: 3085002 - RNA, 17 nt, Measles virus
ccucugucacagggaag

SEQ ID NO: 3085003 - RNA, 14 nt, Measles virus
cuccuuagacagau

SEQ ID NO: 3085004 - RNA, 20 nt, Measles virus
ugccauauuuuguggaauca

SEQ ID NO: 3085005 - RNA, 17 nt, Measles virus
aaggacaccucucaagc

SEQ ID NO: 3085006 - RNA, 19 nt, Measles virus
uuacaccguucccagaaga

SEQ ID NO: 3085007 - RNA, 19 nt, Measles virus
acaaugucaccacaacgag

SEQ ID NO: 3085008 - RNA, 18 nt, Measles virus
uuggccaccccugacccu

SEQ ID NO: 3085009 - RNA, 11 nt, Measles virus
gacagccagaa

SEQ ID NO: 3085010 - RNA, 18 nt, Measles virus
ccacaaccgaaccgcaca

SEQ ID NO: 3085011 - RNA, 15 nt, Measles virus
cugugugcagccaaa

SEQ ID NO: 3085012 - RNA, 22 nt, Measles virus
ugucucaaagggaaacugcuca

SEQ ID NO: 3085013 - RNA, 12 nt, Measles virus
gccagccagcag

SEQ ID NO: 3085014 - RNA, 21 nt, Measles virus
agcuguucuccgauguccaag

SEQ ID NO: 3085015 - RNA, 23 nt, Measles virus
auuggcaaguauuuuaaggacaa

SEQ ID NO: 3085016 - RNA, 14 nt, Measles virus
caaaaaacucuggu

SEQ ID NO: 3085017 - RNA, 20 nt, Measles virus
agugcguugauaacuggaaa

SEQ ID NO: 3085018 - RNA, 19 nt, Measles virus
agccgacaacuccagggaa

SEQ ID NO: 3085019 - RNA, 13 nt, Measles virus
gcugacaaucaag

SEQ ID NO: 3085020 - RNA, 12 nt, Measles virus
ugaugacauaca

SEQ ID NO: 3085021 - RNA, 15 nt, Measles virus
cggaccaagcgagag

SEQ ID NO: 3085022 - RNA, 13 nt, Measles virus
cggauucuccaac

SEQ ID NO: 3085023 - RNA, 16 nt, Measles virus
gcacaccaacccccga

SEQ ID NO: 3085024 - RNA, 19 nt, Measles virus
ggcaggcuggugccccagg

SEQ ID NO: 3085025 - RNA, 20 nt, Measles virus
agccgucggguuuguuccug

SEQ ID NO: 3085026 - RNA, 23 nt, Measles virus
guccaagacaucaaaacagccuu

SEQ ID NO: 3085027 - RNA, 23 nt, Measles virus
gucagaaauaucagacaacccag

SEQ ID NO: 3085028 - RNA, 21 nt, Measles virus
gugggacccccgaggaccaac

SEQ ID NO: 3085029 - RNA, 20 nt, Measles virus
gaguugucacaacugagcau

SEQ ID NO: 3085030 - RNA, 14 nt, Measles virus
aagacucauccagu

SEQ ID NO: 3085031 - RNA, 13 nt, Measles virus
cagugauggcagg

SEQ ID NO: 3085032 - RNA, 14 nt, Measles virus
augcauuggugaac

SEQ ID NO: 3085033 - RNA, 15 nt, Measles virus
gacagugaucugaca

SEQ ID NO: 3085034 - RNA, 19 nt, Measles virus
agucccccggucuccuccu

SEQ ID NO: 3085035 - RNA, 19 nt, Measles virus
gcuguucaggguguccaag

SEQ ID NO: 3085036 - RNA, 21 nt, Measles virus
uaguuauuaacagagaacauc

SEQ ID NO: 3085037 - RNA, 19 nt, Measles virus
cuagugugaaauagacauc

SEQ ID NO: 3085038 - RNA, 12 nt, Measles virus
aguuaggcauua

SEQ ID NO: 3085039 - RNA, 16 nt, Measles virus
cucacgcuuacagccu

SEQ ID NO: 3085040 - RNA, 19 nt, Measles virus
caaacccgccggccccccc

SEQ ID NO: 3085041 - RNA, 13 nt, Measles virus
cccgcgcacccca

SEQ ID NO: 3085042 - RNA, 22 nt, Measles virus
gcucucaaggccgagcccaucg

SEQ ID NO: 3085043 - RNA, 23 nt, Measles virus
ccucccccaacgcaagaacccca

SEQ ID NO: 3085044 - RNA, 13 nt, Measles virus
ucgacaaugcaga

SEQ ID NO: 3085045 - RNA, 20 nt, Measles virus
acaccucagagauucacuga

SEQ ID NO: 3085046 - RNA, 18 nt, Measles virus
uggcaaguauuuuaagga

SEQ ID NO: 3085047 - RNA, 14 nt, Measles virus
agccugaaagaaaa

SEQ ID NO: 3085048 - RNA, 17 nt, Measles virus
ccaggcaucaagcacug

SEQ ID NO: 3085049 - RNA, 20 nt, Measles virus
ccaggcggcccaagcacaga

SEQ ID NO: 3085050 - RNA, 17 nt, Measles virus
ugaggacaccucagaga

SEQ ID NO: 3085051 - RNA, 15 nt, Measles virus
caaguguuacacaac

SEQ ID NO: 3085052 - RNA, 17 nt, Measles virus
auccacccuggaaggac

SEQ ID NO: 3085053 - RNA, 18 nt, Measles virus
gccgucgaggaagccaug

SEQ ID NO: 3085054 - RNA, 19 nt, Measles virus
gggcucaaauugcucagau

SEQ ID NO: 3085055 - RNA, 20 nt, Measles virus
gcugaaaaucuaaucucaaa

SEQ ID NO: 3085056 - RNA, 23 nt, Measles virus
cccgggaaaggaacccccagcaa

SEQ ID NO: 3085057 - RNA, 19 nt, Measles virus
gaagacuccacggaccaag

SEQ ID NO: 3085058 - RNA, 20 nt, Measles virus
uucagaucggucaaugcagu

SEQ ID NO: 3085059 - RNA, 14 nt, Measles virus
acuaacccuccuca

SEQ ID NO: 3085060 - RNA, 11 nt, Measles virus
ucguuccagcc

SEQ ID NO: 3085061 - RNA, 22 nt, Measles virus
uagaagacaaagagucaacaag

SEQ ID NO: 3085062 - RNA, 17 nt, Measles virus
gcccccaggggccgaca

SEQ ID NO: 3085063 - RNA, 16 nt, Measles virus
gggagaaguugaguca

SEQ ID NO: 3085064 - RNA, 20 nt, Measles virus
ccccagcuuacgggacccca

SEQ ID NO: 3085065 - RNA, 13 nt, Measles virus
accggggaucugc

SEQ ID NO: 3085066 - RNA, 21 nt, Measles virus
gaggggagguuaaugacagag

SEQ ID NO: 3085067 - RNA, 13 nt, Measles virus
ccaucgacaaucu

SEQ ID NO: 3085068 - RNA, 20 nt, Measles virus
ccacugauggauaucaauga

SEQ ID NO: 3085069 - RNA, 11 nt, Measles virus
caaucaaggaa

SEQ ID NO: 3085070 - RNA, 21 nt, Measles virus
auacccgaaaacgaccccccu

SEQ ID NO: 3085071 - RNA, 15 nt, Measles virus
caugccucucagcaa

SEQ ID NO: 3085072 - RNA, 22 nt, Measles virus
aguucaaccugucuuacagccu

SEQ ID NO: 3085073 - RNA, 16 nt, Measles virus
ccgaggaccagaacaa

SEQ ID NO: 3085074 - RNA, 18 nt, Measles virus
gagaucuacgauuucgac

SEQ ID NO: 3085075 - RNA, 14 nt, Measles virus
gagccgauggcaga

SEQ ID NO: 3085076 - RNA, 13 nt, Measles virus
uugaacaugcugu

SEQ ID NO: 3085077 - RNA, 19 nt, Measles virus
caagcgagaggccagccag

SEQ ID NO: 3085078 - RNA, 15 nt, Measles virus
gucuuuugggaaccg

SEQ ID NO: 3085079 - RNA, 20 nt, Measles virus
ccauaucugcggagauaucc

SEQ ID NO: 3085080 - RNA, 23 nt, Measles virus
accgguucauuuuaucacaaggg

SEQ ID NO: 3085081 - RNA, 16 nt, Measles virus
ccagccaaccaaccau

SEQ ID NO: 3085082 - RNA, 20 nt, Measles virus
ggcagaagagcaggcacgcc

SEQ ID NO: 3085083 - RNA, 23 nt, Measles virus
caagucuccucuucgucaucaag

SEQ ID NO: 3085084 - RNA, 15 nt, Measles virus
cucagaaucuggugg

SEQ ID NO: 3085085 - RNA, 18 nt, Measles virus
gccauggcagcaugguca

SEQ ID NO: 3085086 - RNA, 15 nt, Measles virus
ucacaugaugucacc

SEQ ID NO: 3085087 - RNA, 15 nt, Measles virus
gcaagaucauccaca

SEQ ID NO: 3085088 - RNA, 17 nt, Measles virus
gaacuccggaacccuaa

SEQ ID NO: 3085089 - RNA, 17 nt, Measles virus
ugagcaagacucuccau

SEQ ID NO: 3085090 - RNA, 21 nt, Measles virus
acaccaggcggcccaagcaca

SEQ ID NO: 3085091 - RNA, 16 nt, Measles virus
uuguagccaugcugga

SEQ ID NO: 3085092 - RNA, 13 nt, Measles virus
uccuagcugucuc

SEQ ID NO: 3085093 - RNA, 14 nt, Measles virus
uccacaaugucacc

SEQ ID NO: 3085094 - RNA, 12 nt, Measles virus
agcgagaggcca

SEQ ID NO: 3085095 - RNA, 21 nt, Measles virus
cuccacggaccaagcgagagg

SEQ ID NO: 3085096 - RNA, 12 nt, Measles virus
gcucucaagagu

SEQ ID NO: 3085097 - RNA, 22 nt, Measles virus
ucaggcaauugaggcaaucaga

SEQ ID NO: 3085098 - RNA, 21 nt, Measles virus
cccauuaaaaagggcacagac

SEQ ID NO: 3085099 - RNA, 12 nt, Measles virus
cagaacccagac

SEQ ID NO: 3085100 - RNA, 14 nt, Measles virus
ggucagggaucugg

SEQ ID NO: 3085101 - RNA, 22 nt, Measles virus
gacaaaaaagcccccuccagaa

SEQ ID NO: 3085102 - RNA, 23 nt, Measles virus
ucccgggaaaggaacccccagca

SEQ ID NO: 3085103 - RNA, 12 nt, Measles virus
ccaccagcuccc

SEQ ID NO: 3085104 - RNA, 12 nt, Measles virus
ggagcaaaguga

SEQ ID NO: 3085105 - RNA, 18 nt, Measles virus
gacagauccucucccccc

SEQ ID NO: 3085106 - RNA, 23 nt, Measles virus
cggucagggaucuggagaaagcg

SEQ ID NO: 3085107 - RNA, 15 nt, Measles virus
acaaccuaaauccau

SEQ ID NO: 3085108 - RNA, 19 nt, Measles virus
caggaccgagccaccugca

SEQ ID NO: 3085109 - RNA, 15 nt, Measles virus
cuuuacugaaauaca

SEQ ID NO: 3085110 - RNA, 16 nt, Measles virus
accgcauccccacagc

SEQ ID NO: 3085111 - RNA, 20 nt, Measles virus
aagaagcagaucaacaggca

SEQ ID NO: 3085112 - RNA, 22 nt, Measles virus
acuggagccgauggcagaagag

SEQ ID NO: 3085113 - RNA, 14 nt, Measles virus
cagaccacccuggg

SEQ ID NO: 3085114 - RNA, 17 nt, Measles virus
caaucagacaagcaggg

SEQ ID NO: 3085115 - RNA, 15 nt, Measles virus
gaagaagggggagac

SEQ ID NO: 3085116 - RNA, 20 nt, Measles virus
acgagcuccugaaacuccaa

SEQ ID NO: 3085117 - RNA, 23 nt, Measles virus
gggaagaucaucgacaaugcaga

SEQ ID NO: 3085118 - RNA, 22 nt, Measles virus
ugcaaggaagaggaggcaggca

SEQ ID NO: 3085119 - RNA, 16 nt, Measles virus
aguuucuauucccagc

SEQ ID NO: 3085120 - RNA, 23 nt, Measles virus
cccagaauaaugaagaaggggga

SEQ ID NO: 3085121 - RNA, 14 nt, Measles virus
aaacucaguuccaa

SEQ ID NO: 3085122 - RNA, 13 nt, Measles virus
aggaacccccagc

SEQ ID NO: 3085123 - RNA, 19 nt, Measles virus
acacaaggccaccaccagc

SEQ ID NO: 3085124 - RNA, 17 nt, Measles virus
acugguaguucaguuga

SEQ ID NO: 3085125 - RNA, 18 nt, Measles virus
ggcauccgacuccuuaga

SEQ ID NO: 3085126 - RNA, 13 nt, Measles virus
gcugucccgacaa

SEQ ID NO: 3085127 - RNA, 22 nt, Measles virus
acagcaaguguggacaccaggc

SEQ ID NO: 3085128 - RNA, 21 nt, Measles virus
uaaagaaaacuuugaaaauac

SEQ ID NO: 3085129 - RNA, 17 nt, Measles virus
gggaggacaucaaggag

SEQ ID NO: 3085130 - RNA, 18 nt, Measles virus
gaguccucugcuccaaga

SEQ ID NO: 3085131 - RNA, 16 nt, Measles virus
ugaugucaaacucagu

SEQ ID NO: 3085132 - RNA, 16 nt, Measles virus
ccccgaaaaccagagg

SEQ ID NO: 3085133 - RNA, 13 nt, Measles virus
ccaccgacaaucc

SEQ ID NO: 3085134 - RNA, 19 nt, Measles virus
cacagauuucccacaaguc

SEQ ID NO: 3085135 - RNA, 21 nt, Measles virus
ucagaagauaaucuccaagcu

SEQ ID NO: 3085136 - RNA, 15 nt, Measles virus
accagaacaacaucc

SEQ ID NO: 3085137 - RNA, 23 nt, Measles virus
ugacccucccccugcaugcugca

SEQ ID NO: 3085138 - RNA, 14 nt, Measles virus
cuucuaggaagagu

SEQ ID NO: 3085139 - RNA, 19 nt, Measles virus
ggaacccuaauccugcccu

SEQ ID NO: 3085140 - RNA, 19 nt, Measles virus
aucagaggucaauucucaa

SEQ ID NO: 3085141 - RNA, 17 nt, Measles virus
gcgguguaccugcacag

SEQ ID NO: 3085142 - RNA, 17 nt, Measles virus
gggcucaaauugcucag

SEQ ID NO: 3085143 - RNA, 15 nt, Measles virus
cagacccagcaccca

SEQ ID NO: 3085144 - RNA, 17 nt, Measles virus
auguugcugcagggggc

SEQ ID NO: 3085145 - RNA, 18 nt, Measles virus
cauuguuauaaaaaacuu

SEQ ID NO: 3085146 - RNA, 13 nt, Measles virus
agaagacaaagag

SEQ ID NO: 3085147 - RNA, 20 nt, Measles virus
uagggaguacgacuucagag

SEQ ID NO: 3085148 - RNA, 15 nt, Measles virus
ggcauugcacuucac

SEQ ID NO: 3085149 - RNA, 19 nt, Measles virus
ccaggggccgacagccagc

SEQ ID NO: 3085150 - RNA, 17 nt, Measles virus
agggacaucaaaauccu

SEQ ID NO: 3085151 - RNA, 16 nt, Measles virus
auccucccaagggaac

SEQ ID NO: 3085152 - RNA, 23 nt, Measles virus
agugguauaccacugugcccaag

SEQ ID NO: 3085153 - RNA, 17 nt, Measles virus
accgcauccccacagcu

SEQ ID NO: 3085154 - RNA, 22 nt, Measles virus
acccagccaccgacaauccaag

SEQ ID NO: 3085155 - RNA, 21 nt, Measles virus
auagaagacaaagagucaaca

SEQ ID NO: 3085156 - RNA, 21 nt, Measles virus
ccgauccggcgggcagccacu

SEQ ID NO: 3085157 - RNA, 19 nt, Measles virus
acccucucaggaggagacg

SEQ ID NO: 3085158 - RNA, 11 nt, Measles virus
uccaaauugua

SEQ ID NO: 3085159 - RNA, 19 nt, Measles virus
uccucgugggacccccgag

SEQ ID NO: 3085160 - RNA, 13 nt, Measles virus
auguuuacagccc

SEQ ID NO: 3085161 - RNA, 16 nt, Measles virus
aguacuguuaacucuc

SEQ ID NO: 3085162 - RNA, 17 nt, Measles virus
cuccaggcaucaagcac

SEQ ID NO: 3085163 - RNA, 11 nt, Measles virus
ucagcuuccag

SEQ ID NO: 3085164 - RNA, 13 nt, Measles virus
aaaauaucagcau

SEQ ID NO: 3085165 - RNA, 13 nt, Measles virus
ccacagcugcuca

SEQ ID NO: 3085166 - RNA, 17 nt, Measles virus
agccgcucauuuucuua

SEQ ID NO: 3085167 - RNA, 22 nt, Measles virus
uccagaccacccugggccacca

SEQ ID NO: 3085168 - RNA, 15 nt, Measles virus
ggcuggugccccagg

SEQ ID NO: 3085169 - RNA, 22 nt, Measles virus
gucaauucucaaacaugucgcu

SEQ ID NO: 3085170 - RNA, 17 nt, Measles virus
uaccugcaacugaggga

SEQ ID NO: 3085171 - RNA, 15 nt, Measles virus
ucaugggucucaagg

SEQ ID NO: 3085172 - RNA, 12 nt, Measles virus
cccagcuuuguc

SEQ ID NO: 3085173 - RNA, 15 nt, Measles virus
ccaccgcauccagca

SEQ ID NO: 3085174 - RNA, 19 nt, Measles virus
agaugucgaacucaauccc

SEQ ID NO: 3085175 - RNA, 22 nt, Measles virus
uaaccacugcuuuacugaaaua

SEQ ID NO: 3085176 - RNA, 20 nt, Measles virus
aagcaguaacggcugcugaa

SEQ ID NO: 3085177 - RNA, 13 nt, Measles virus
gguguaucaaccc

SEQ ID NO: 3085178 - RNA, 22 nt, Measles virus
cgacuggagccgauggcagaag

SEQ ID NO: 3085179 - RNA, 13 nt, Measles virus
guuccucaagaau

SEQ ID NO: 3085180 - RNA, 14 nt, Measles virus
cuggggaaugcaau

SEQ ID NO: 3085181 - RNA, 19 nt, Measles virus
ucuucacugguaguucagu

SEQ ID NO: 3085182 - RNA, 20 nt, Measles virus
ccugaaacccaucauaggca

SEQ ID NO: 3085183 - RNA, 14 nt, Measles virus
cccgaaccagcacc

SEQ ID NO: 3085184 - RNA, 19 nt, Measles virus
augccuucuacaaagacaa

SEQ ID NO: 3085185 - RNA, 13 nt, Measles virus
ccugccaacccca

SEQ ID NO: 3085186 - RNA, 20 nt, Measles virus
ucagagauucacugaccuag

SEQ ID NO: 3085187 - RNA, 15 nt, Measles virus
uauucccagcuuugu

SEQ ID NO: 3085188 - RNA, 21 nt, Measles virus
cuuaucucgaauuuugaugag

SEQ ID NO: 3085189 - RNA, 22 nt, Measles virus
gaggaacuccucaaagaggcca

SEQ ID NO: 3085190 - RNA, 15 nt, Measles virus
ccaagcgagaggcca

SEQ ID NO: 3085191 - RNA, 22 nt, Measles virus
ccugaucuuacagggacaucaa

SEQ ID NO: 3085192 - RNA, 13 nt, Measles virus
ggaccgagccacc

SEQ ID NO: 3085193 - RNA, 15 nt, Measles virus
ggagccgauggcaga

SEQ ID NO: 3085194 - RNA, 14 nt, Measles virus
acaugcuuccagca

SEQ ID NO: 3085195 - RNA, 17 nt, Measles virus
aucccaaucugcguccu

SEQ ID NO: 3085196 - RNA, 21 nt, Measles virus
ucucaaagggaaacugcucag

SEQ ID NO: 3085197 - RNA, 20 nt, Measles virus
cgaggaagccauggcagcau

SEQ ID NO: 3085198 - RNA, 17 nt, Measles virus
caaggacgugcugacac

SEQ ID NO: 3085199 - RNA, 11 nt, Measles virus
aggcaggcagu

SEQ ID NO: 3085200 - RNA, 20 nt, Measles virus
aacagccuuggccaaaauac

SEQ ID NO: 3085201 - RNA, 18 nt, Measles virus
caaccucuucacuguucc

SEQ ID NO: 3085202 - RNA, 14 nt, Measles virus
agcacccucucagg

SEQ ID NO: 3085203 - RNA, 16 nt, Measles virus
ggcaggcuggugcccc

SEQ ID NO: 3085204 - RNA, 20 nt, Measles virus
agaucucaaagaaagucaca

SEQ ID NO: 3085205 - RNA, 19 nt, Measles virus
cuggccgaaguucucaaga

SEQ ID NO: 3085206 - RNA, 22 nt, Measles virus
ccauccaagucgggagcaggag

SEQ ID NO: 3085207 - RNA, 18 nt, Measles virus
agcuaggugucuggaaau

SEQ ID NO: 3085208 - RNA, 20 nt, Measles virus
uguaucaacccgccagagag

SEQ ID NO: 3085209 - RNA, 14 nt, Measles virus
ggaagagucagaua

SEQ ID NO: 3085210 - RNA, 18 nt, Measles virus
ggauaccgagauucaagg

SEQ ID NO: 3085211 - RNA, 19 nt, Measles virus
aguuccagaggacagcugc

SEQ ID NO: 3085212 - RNA, 19 nt, Measles virus
ucacaugaugucacccaga

SEQ ID NO: 3085213 - RNA, 12 nt, Measles virus
augacagccaga

SEQ ID NO: 3085214 - RNA, 15 nt, Measles virus
gacauacaucugaca

SEQ ID NO: 3085215 - RNA, 14 nt, Measles virus
uacaaaaccaacca

SEQ ID NO: 3085216 - RNA, 18 nt, Measles virus
cagaacccagaccccggc

SEQ ID NO: 3085217 - RNA, 18 nt, Measles virus
ccucucaucucacagagg

SEQ ID NO: 3085218 - RNA, 15 nt, Measles virus
ccacagcucccggga

SEQ ID NO: 3085219 - RNA, 22 nt, Measles virus
auaacaguagaacucagaggug

SEQ ID NO: 3085220 - RNA, 20 nt, Measles virus
caaaacagccuuggccaaaa

SEQ ID NO: 3085221 - RNA, 18 nt, Measles virus
auaggaaggaugaaugcu

SEQ ID NO: 3085222 - RNA, 16 nt, Measles virus
cacgucgacacagagu

SEQ ID NO: 3085223 - RNA, 13 nt, Measles virus
cugaagaacucau

SEQ ID NO: 3085224 - RNA, 15 nt, Measles virus
augcaaugacccaga

SEQ ID NO: 3085225 - RNA, 13 nt, Measles virus
agagagcagagga

SEQ ID NO: 3085226 - RNA, 17 nt, Measles virus
ugcguccuccucguggg

SEQ ID NO: 3085227 - RNA, 17 nt, Measles virus
ugagggaggacaucaag

SEQ ID NO: 3085228 - RNA, 17 nt, Measles virus
ccaaacccgccggcccc

SEQ ID NO: 3085229 - RNA, 20 nt, Measles virus
agagguguuaucgcugacaa

SEQ ID NO: 3085230 - RNA, 19 nt, Measles virus
uggagacaugcuuccagca

SEQ ID NO: 3085231 - RNA, 18 nt, Measles virus
cccuaggcguugccacag

SEQ ID NO: 3085232 - RNA, 17 nt, Measles virus
caugcuuccagcaggcg

SEQ ID NO: 3085233 - RNA, 21 nt, Measles virus
ugcccaauauaacucuccuca

SEQ ID NO: 3085234 - RNA, 19 nt, Measles virus
uacgauccucccaagggaa

SEQ ID NO: 3085235 - RNA, 20 nt, Measles virus
gccaaccaaccauccacucc

SEQ ID NO: 3085236 - RNA, 16 nt, Measles virus
gaaugcuuuauguaca

SEQ ID NO: 3085237 - RNA, 15 nt, Measles virus
cccugggggaccccc

SEQ ID NO: 3085238 - RNA, 17 nt, Measles virus
caguaacggcugcugaa

SEQ ID NO: 3085239 - RNA, 23 nt, Measles virus
gcuccgaacacagaccaccaacc

SEQ ID NO: 3085240 - RNA, 15 nt, Measles virus
gccaccaccagccau

SEQ ID NO: 3085241 - RNA, 11 nt, Measles virus
ucaucaagcaa

SEQ ID NO: 3085242 - RNA, 22 nt, Measles virus
uccagcaggcguguaaggguaa

SEQ ID NO: 3085243 - RNA, 19 nt, Measles virus
cauaaugacagccagaagg

SEQ ID NO: 3085244 - RNA, 20 nt, Measles virus
auuugcaauauauuaaagaa

SEQ ID NO: 3085245 - RNA, 20 nt, Measles virus
ccaaucugcguccuccucgu

SEQ ID NO: 3085246 - RNA, 19 nt, Measles virus
cuccaucgugcagccaucu

SEQ ID NO: 3085247 - RNA, 18 nt, Measles virus
uggccgucgaggaagcca

SEQ ID NO: 3085248 - RNA, 22 nt, Measles virus
ccaaucaguuccuagcugucuc

SEQ ID NO: 3085249 - RNA, 17 nt, Measles virus
auuaagaagcagaucaa

SEQ ID NO: 3085250 - RNA, 17 nt, Measles virus
agauccacgagcuccug

SEQ ID NO: 3085251 - RNA, 18 nt, Measles virus
aacccgcgcaccccagcc

SEQ ID NO: 3085252 - RNA, 13 nt, Measles virus
augucgcuguccc

SEQ ID NO: 3085253 - RNA, 19 nt, Measles virus
caacauguauauuaccuga

SEQ ID NO: 3085254 - RNA, 15 nt, Measles virus
cccagccaccgacaa

SEQ ID NO: 3085255 - RNA, 19 nt, Measles virus
uccuccucgugggaccccc

SEQ ID NO: 3085256 - RNA, 21 nt, Measles virus
acagccagaaggcccggacaa

SEQ ID NO: 3085257 - RNA, 16 nt, Measles virus
cgcccccaccccccga

SEQ ID NO: 3085258 - RNA, 17 nt, Measles virus
aggcacaccaacccccg

SEQ ID NO: 3085259 - RNA, 17 nt, Measles virus
cccaacgaccccacugc

SEQ ID NO: 3085260 - RNA, 20 nt, Measles virus
ucagcauauccacccuggaa

SEQ ID NO: 3085261 - RNA, 22 nt, Measles virus
gccgaaguucucaagaagcccg

SEQ ID NO: 3085262 - RNA, 19 nt, Measles virus
guugaacuccggaacccua

SEQ ID NO: 3085263 - RNA, 18 nt, Measles virus
ucagacaagcagggcagg

SEQ ID NO: 3085264 - RNA, 14 nt, Measles virus
uaaagaaaacuuug

SEQ ID NO: 3085265 - RNA, 17 nt, Measles virus
gaccaagcgagaggcca

SEQ ID NO: 3085266 - RNA, 16 nt, Measles virus
agccucagcaccaauc

SEQ ID NO: 3085267 - RNA, 15 nt, Measles virus
aguuccuagcugucu

SEQ ID NO: 3085268 - RNA, 17 nt, Measles virus
cuugaucggguugcuag

SEQ ID NO: 3085269 - RNA, 18 nt, Measles virus
ugagcuuaaaaucaaaau

SEQ ID NO: 3085270 - RNA, 18 nt, Measles virus
guuccuagcugucucaaa

SEQ ID NO: 3085271 - RNA, 18 nt, Measles virus
gugcuugcggacucagaa

SEQ ID NO: 3085272 - RNA, 18 nt, Measles virus
gccagcacuuccgagaca

SEQ ID NO: 3085273 - RNA, 16 nt, Measles virus
gguucagggcuucuga

SEQ ID NO: 3085274 - RNA, 16 nt, Measles virus
caguagggccagcacu

SEQ ID NO: 3085275 - RNA, 13 nt, Measles virus
aguaucccacagc

SEQ ID NO: 3085276 - RNA, 14 nt, Measles virus
cagagauucacuga

SEQ ID NO: 3085277 - RNA, 11 nt, Measles virus
cuucagagauc

SEQ ID NO: 3085278 - RNA, 23 nt, Measles virus
ccacucaacccgaaccagcaccc

SEQ ID NO: 3085279 - RNA, 21 nt, Measles virus
ccguuauggacucgcuaucug

SEQ ID NO: 3085280 - RNA, 14 nt, Measles virus
aguuguccuggcag

SEQ ID NO: 3085281 - RNA, 14 nt, Measles virus
cugagucugacagu

SEQ ID NO: 3085282 - RNA, 15 nt, Measles virus
caucgacaaugcaga

SEQ ID NO: 3085283 - RNA, 22 nt, Measles virus
guaguuaggcauuauuugcaau

SEQ ID NO: 3085284 - RNA, 23 nt, Measles virus
caccaggcggcccaagcacagaa

SEQ ID NO: 3085285 - RNA, 19 nt, Measles virus
agccaccgacaauccaaga

SEQ ID NO: 3085286 - RNA, 21 nt, Measles virus
ucugagcuugaucggguugcu

SEQ ID NO: 3085287 - RNA, 14 nt, Measles virus
cugucuuacagccu

SEQ ID NO: 3085288 - RNA, 19 nt, Measles virus
cugcccuagguaguuaggc

SEQ ID NO: 3085289 - RNA, 23 nt, Measles virus
uuaugacucguuccagccaucaa

SEQ ID NO: 3085290 - RNA, 16 nt, Measles virus
gguuacucuggaggag

SEQ ID NO: 3085291 - RNA, 13 nt, Measles virus
cacagcugcucag

SEQ ID NO: 3085292 - RNA, 20 nt, Measles virus
caaggccaccaccagccauc

SEQ ID NO: 3085293 - RNA, 15 nt, Measles virus
cauacaucugacagg

SEQ ID NO: 3085294 - RNA, 19 nt, Measles virus
ccccucauaaugacagcca

SEQ ID NO: 3085295 - RNA, 18 nt, Measles virus
ggaauccccucaagaaau

SEQ ID NO: 3085296 - RNA, 14 nt, Measles virus
cgacagccagcauc

SEQ ID NO: 3085297 - RNA, 20 nt, Measles virus
gaccaaaacggguuuucuga

SEQ ID NO: 3085298 - RNA, 16 nt, Measles virus
agucaauuaagaagca

SEQ ID NO: 3085299 - RNA, 16 nt, Measles virus
gaggugcuuuccuuaa

SEQ ID NO: 3085300 - RNA, 19 nt, Measles virus
uccacacagccgccagcca

SEQ ID NO: 3085301 - RNA, 18 nt, Measles virus
caacgagaccgaauaaau

SEQ ID NO: 3085302 - RNA, 16 nt, Measles virus
auuauguuuacagccc

SEQ ID NO: 3085303 - RNA, 18 nt, Measles virus
gcaaguguggacaccagg

SEQ ID NO: 3085304 - RNA, 20 nt, Measles virus
ugcggagauauccauccagg

SEQ ID NO: 3085305 - RNA, 13 nt, Measles virus
cgaauaaaugccu

SEQ ID NO: 3085306 - RNA, 17 nt, Measles virus
ugcaacccaaugugcuc

SEQ ID NO: 3085307 - RNA, 15 nt, Measles virus
acauccuaagggaag

SEQ ID NO: 3085308 - RNA, 18 nt, Measles virus
gaccacccugggccacca

SEQ ID NO: 3085309 - RNA, 16 nt, Measles virus
ccagaaggcccggaca

SEQ ID NO: 3085310 - RNA, 15 nt, Measles virus
ucugcguccuccucg

SEQ ID NO: 3085311 - RNA, 16 nt, Measles virus
gcaaccaccgcaucca

SEQ ID NO: 3085312 - RNA, 18 nt, Measles virus
agucccaaccucuucacu

SEQ ID NO: 3085313 - RNA, 18 nt, Measles virus
uacugggcaucuuagaga

SEQ ID NO: 3085314 - RNA, 22 nt, Measles virus
cgagauucaagguuagucccaa

SEQ ID NO: 3085315 - RNA, 19 nt, Measles virus
uuauuugcaauauauuaaa

SEQ ID NO: 3085316 - RNA, 15 nt, Measles virus
cauaucacucacucu

SEQ ID NO: 3085317 - RNA, 13 nt, Measles virus
auauuaaagaaaa

SEQ ID NO: 3085318 - RNA, 13 nt, Measles virus
cacuuaaugcaau

SEQ ID NO: 3085319 - RNA, 17 nt, Measles virus
aggaccagaacaacauc

SEQ ID NO: 3085320 - RNA, 23 nt, Measles virus
ugacuaucccgccaaugaagaac

SEQ ID NO: 3085321 - RNA, 13 nt, Measles virus
cauacuugccaua

SEQ ID NO: 3085322 - RNA, 18 nt, Measles virus
agugaaccgaucacauga

SEQ ID NO: 3085323 - RNA, 19 nt, Measles virus
auccagccggcuagaggag

SEQ ID NO: 3085324 - RNA, 11 nt, Measles virus
gagcucagccg

SEQ ID NO: 3085325 - RNA, 14 nt, Measles virus
aacccagaccccgg

SEQ ID NO: 3085326 - RNA, 20 nt, Measles virus
gaaaauacgaaguuucuauu

SEQ ID NO: 3085327 - RNA, 15 nt, Measles virus
gaccuuguugcuaua

SEQ ID NO: 3085328 - RNA, 18 nt, Measles virus
agcacccucucaggagga

SEQ ID NO: 3085329 - RNA, 23 nt, Measles virus
acucaauuccccacccccaaagg

SEQ ID NO: 3085330 - RNA, 17 nt, Measles virus
gaaauucaucucugaca

SEQ ID NO: 3085331 - RNA, 18 nt, Measles virus
ugcugccgaucacugccc

SEQ ID NO: 3085332 - RNA, 19 nt, Measles virus
acugagaugaggucaguga

SEQ ID NO: 3085333 - RNA, 18 nt, Measles virus
cagccaucaguuccucaa

SEQ ID NO: 3085334 - RNA, 13 nt, Measles virus
caagucuccucuu

SEQ ID NO: 3085335 - RNA, 15 nt, Measles virus
agccauggcagcaug

SEQ ID NO: 3085336 - RNA, 22 nt, Measles virus
uagggcucaaauugcucagaua

SEQ ID NO: 3085337 - RNA, 16 nt, Measles virus
caggggucagggaaag

SEQ ID NO: 3085338 - RNA, 16 nt, Measles virus
uccggguuugggggcu

SEQ ID NO: 3085339 - RNA, 17 nt, Measles virus
acaaggaagauccguga

SEQ ID NO: 3085340 - RNA, 14 nt, Measles virus
caccaccagccauc

SEQ ID NO: 3085341 - RNA, 14 nt, Measles virus
cugcaacugaggga

SEQ ID NO: 3085342 - RNA, 12 nt, Measles virus
guccucugcucc

SEQ ID NO: 3085343 - RNA, 14 nt, Measles virus
gacucguuccagcc

SEQ ID NO: 3085344 - RNA, 19 nt, Measles virus
aggcuccgaauugagggag

SEQ ID NO: 3085345 - RNA, 22 nt, Measles virus
gccuucuacaaagacaacccac

SEQ ID NO: 3085346 - RNA, 13 nt, Measles virus
caaaggagccaac

SEQ ID NO: 3085347 - RNA, 17 nt, Measles virus
cgaauuuugaugaguca

SEQ ID NO: 3085348 - RNA, 19 nt, Measles virus
gauaucaaaggagccaacg

SEQ ID NO: 3085349 - RNA, 19 nt, Measles virus
auguguauuggcugacuau

SEQ ID NO: 3085350 - RNA, 19 nt, Measles virus
ucuucucgaagggaccaaa

SEQ ID NO: 3085351 - RNA, 16 nt, Measles virus
ggguugaacaugcugu

SEQ ID NO: 3085352 - RNA, 22 nt, Measles virus
cagaccacccugggccaccagc

SEQ ID NO: 3085353 - RNA, 19 nt, Measles virus
gacaccucagagauucacu

SEQ ID NO: 3085354 - RNA, 20 nt, Measles virus
cccgauccggcgggcagcca

SEQ ID NO: 3085355 - RNA, 22 nt, Measles virus
uaucgcugacaaucaagcaaaa

SEQ ID NO: 3085356 - RNA, 17 nt, Measles virus
cuggugccgucacuucu

SEQ ID NO: 3085357 - RNA, 20 nt, Measles virus
gagugggcaccauugaagga

SEQ ID NO: 3085358 - RNA, 14 nt, Measles virus
uuauaaacaaugug

SEQ ID NO: 3085359 - RNA, 20 nt, Measles virus
cccgaccagacccagcaccc

SEQ ID NO: 3085360 - RNA, 16 nt, Measles virus
aaugaugaccaaggac

SEQ ID NO: 3085361 - RNA, 18 nt, Measles virus
auaaaugccuucuacaaa

SEQ ID NO: 3085362 - RNA, 12 nt, Measles virus
acucuggaggag

SEQ ID NO: 3085363 - RNA, 15 nt, Measles virus
cuggaggccagggca

SEQ ID NO: 3085364 - RNA, 12 nt, Measles virus
acucuccaaaca

SEQ ID NO: 3085365 - RNA, 13 nt, Measles virus
aagggagaaguug

SEQ ID NO: 3085366 - RNA, 17 nt, Measles virus
ccaagcgagaggccagc

SEQ ID NO: 3085367 - RNA, 22 nt, Measles virus
guacagcagggcucaaugaaaa

SEQ ID NO: 3085368 - RNA, 19 nt, Measles virus
aguggacacccgaaucugg

SEQ ID NO: 3085369 - RNA, 14 nt, Measles virus
uacccgaugagucc

SEQ ID NO: 3085370 - RNA, 18 nt, Measles virus
cccagcacccagccaccg

SEQ ID NO: 3085371 - RNA, 15 nt, Measles virus
caucucacagaggug

SEQ ID NO: 3085372 - RNA, 16 nt, Measles virus
agcaguaaagggucag

SEQ ID NO: 3085373 - RNA, 16 nt, Measles virus
acucucaauguuccuc

SEQ ID NO: 3085374 - RNA, 13 nt, Measles virus
ggccgagcccauc

SEQ ID NO: 3085375 - RNA, 22 nt, Measles virus
gagcccaucggcucacuggccg

SEQ ID NO: 3085376 - RNA, 15 nt, Measles virus
ucaucgacaaugcag

SEQ ID NO: 3085377 - RNA, 23 nt, Measles virus
ccuuagacagauccucucccccc

SEQ ID NO: 3085378 - RNA, 18 nt, Measles virus
ccacccugggccaccagc

SEQ ID NO: 3085379 - RNA, 13 nt, Measles virus
caugccucucagc

SEQ ID NO: 3085380 - RNA, 19 nt, Measles virus
gccauaggaggagacacac

SEQ ID NO: 3085381 - RNA, 23 nt, Measles virus
auggacucgcuaucugucaacca

SEQ ID NO: 3085382 - RNA, 16 nt, Measles virus
ugacaggggagauuuu

SEQ ID NO: 3085383 - RNA, 21 nt, Measles virus
caaccagaucuuauacccuga

SEQ ID NO: 3085384 - RNA, 20 nt, Measles virus
cggaccaguuccagaggaca

SEQ ID NO: 3085385 - RNA, 15 nt, Measles virus
ccaggcaucaagcac

SEQ ID NO: 3085386 - RNA, 17 nt, Measles virus
augagacucugaugaaa

SEQ ID NO: 3085387 - RNA, 21 nt, Measles virus
agcgagaggccagccagcagc

SEQ ID NO: 3085388 - RNA, 13 nt, Measles virus
agccucagcacca

SEQ ID NO: 3085389 - RNA, 22 nt, Measles virus
caucagggccaggugcaccugc

SEQ ID NO: 3085390 - RNA, 24 nt, Measles virus
uacaaugugucaucuauagucacu

SEQ ID NO: 3085391 - RNA, 13 nt, Measles virus
agauccacagcaa

SEQ ID NO: 3085392 - RNA, 20 nt, Measles virus
aguggagccuaccuccauga

SEQ ID NO: 3085393 - RNA, 19 nt, Measles virus
cacuuaaugcaaugaccca

SEQ ID NO: 3085394 - RNA, 19 nt, Measles virus
cugggccaccagcucccag

SEQ ID NO: 3085395 - RNA, 18 nt, Measles virus
ggcaguuuugcagccauc

SEQ ID NO: 3085396 - RNA, 22 nt, Measles virus
aucccagaauaaugaagaaggg

SEQ ID NO: 3085397 - RNA, 17 nt, Measles virus
cccacuaacccuccuca

SEQ ID NO: 3085398 - RNA, 13 nt, Measles virus
agauuuggcuguu

SEQ ID NO: 3085399 - RNA, 22 nt, Measles virus
agccugaaagaaaaggagauca

SEQ ID NO: 3085400 - RNA, 18 nt, Measles virus
gcaaccgaaccagagucc

SEQ ID NO: 3085401 - RNA, 20 nt, Measles virus
auucgcagcccucugucaca

SEQ ID NO: 3085402 - RNA, 16 nt, Measles virus
cucaaauugcucagau

SEQ ID NO: 3085403 - RNA, 17 nt, Measles virus
ggacagcugcugaagga

SEQ ID NO: 3085404 - RNA, 14 nt, Measles virus
ccagaaucaagacu

SEQ ID NO: 3085405 - RNA, 14 nt, Measles virus
aacccuccucacac

SEQ ID NO: 3085406 - RNA, 14 nt, Measles virus
ccaucaccccgcaa

SEQ ID NO: 3085407 - RNA, 20 nt, Measles virus
ccagagggagcccccaacca

SEQ ID NO: 3085408 - RNA, 17 nt, Measles virus
cuaaucugagcaguaaa

SEQ ID NO: 3085409 - RNA, 18 nt, Measles virus
uguuaucgcugacaauca

SEQ ID NO: 3085410 - RNA, 15 nt, Measles virus
cucguuccagccauc

SEQ ID NO: 3085411 - RNA, 22 nt, Measles virus
acuccuuagacagauccucucc

SEQ ID NO: 3085412 - RNA, 18 nt, Measles virus
caguucgggucucagcaa

SEQ ID NO: 3085413 - RNA, 21 nt, Measles virus
auuaagaagcagaucaacagg

SEQ ID NO: 3085414 - RNA, 15 nt, Measles virus
cccaguagggccagc

SEQ ID NO: 3085415 - RNA, 15 nt, Measles virus
ccaugccucucagca

SEQ ID NO: 3085416 - RNA, 23 nt, Measles virus
acaaguugguaugucaagaccag

SEQ ID NO: 3085417 - RNA, 11 nt, Measles virus
cggccagaagc

SEQ ID NO: 3085418 - RNA, 20 nt, Measles virus
gaaccaauuagagaugcacu

SEQ ID NO: 3085419 - RNA, 14 nt, Measles virus
ucuauucccagcuu

SEQ ID NO: 3085420 - RNA, 23 nt, Measles virus
auccaggcaguuuugcagccauc

SEQ ID NO: 3085421 - RNA, 19 nt, Measles virus
ccucauaaugacagccaga

SEQ ID NO: 3085422 - RNA, 23 nt, Measles virus
guuugaaguagggguuaucagaa

SEQ ID NO: 3085423 - RNA, 21 nt, Measles virus
cgcauccccacagcucccggg

SEQ ID NO: 3085424 - RNA, 11 nt, Measles virus
caugcuuccag

SEQ ID NO: 3085425 - RNA, 16 nt, Measles virus
acgcuuacagccugga

SEQ ID NO: 3085426 - RNA, 13 nt, Measles virus
auuaaugcccaau

SEQ ID NO: 3085427 - RNA, 19 nt, Measles virus
cccgauaguuaccaauaag

SEQ ID NO: 3085428 - RNA, 17 nt, Measles virus
aaacuuagggugcaaga

SEQ ID NO: 3085429 - RNA, 18 nt, Measles virus
guugggaaugucaucaag

SEQ ID NO: 3085430 - RNA, 18 nt, Measles virus
ccagcaggcguguaaggg

SEQ ID NO: 3085431 - RNA, 22 nt, Measles virus
caugaugucacccagacaucag

SEQ ID NO: 3085432 - RNA, 15 nt, Measles virus
ugaagugggccugag

SEQ ID NO: 3085433 - RNA, 14 nt, Measles virus
gaccccggcccgcg

SEQ ID NO: 3085434 - RNA, 15 nt, Measles virus
ugccucucagcaauu

SEQ ID NO: 3085435 - RNA, 15 nt, Measles virus
accgcauccagcauc

SEQ ID NO: 3085436 - RNA, 14 nt, Measles virus
uaaucaacacauug

SEQ ID NO: 3085437 - RNA, 15 nt, Measles virus
cugaaaaugucagga

SEQ ID NO: 3085438 - RNA, 20 nt, Measles virus
cagccaucuacaccgcagag

SEQ ID NO: 3085439 - RNA, 15 nt, Measles virus
agcaaagugauugcc

SEQ ID NO: 3085440 - RNA, 18 nt, Measles virus
cucagauaacagccggca

SEQ ID NO: 3085441 - RNA, 17 nt, Measles virus
uacaacaacaccccacu

SEQ ID NO: 3085442 - RNA, 21 nt, Measles virus
cacaacccgcgcaccccagcc

SEQ ID NO: 3085443 - RNA, 16 nt, Measles virus
ccagcacccagccacc

SEQ ID NO: 3085444 - RNA, 14 nt, Measles virus
uggaggccagggca

SEQ ID NO: 3085445 - RNA, 13 nt, Measles virus
ggccaccaccagc

SEQ ID NO: 3085446 - RNA, 15 nt, Measles virus
caguaucccacagcc

SEQ ID NO: 3085447 - RNA, 15 nt, Measles virus
caccagcucccagac

SEQ ID NO: 3085448 - RNA, 17 nt, Measles virus
aaggugucagcuuccag

SEQ ID NO: 3085449 - RNA, 17 nt, Measles virus
ucccgaccugaaaccca

SEQ ID NO: 3085450 - RNA, 15 nt, Measles virus
ugacaccacucuuca

SEQ ID NO: 3085451 - RNA, 14 nt, Measles virus
aacugaugacauac

SEQ ID NO: 3085452 - RNA, 16 nt, Measles virus
aucaguaucccacagc

SEQ ID NO: 3085453 - RNA, 18 nt, Measles virus
cgagcaucaggucaagga

SEQ ID NO: 3085454 - RNA, 21 nt, Measles virus
uccggaacccuaauccugccc

SEQ ID NO: 3085455 - RNA, 14 nt, Measles virus
ccagagagaaucaa

SEQ ID NO: 3085456 - RNA, 15 nt, Measles virus
caagcgagaggccag

SEQ ID NO: 3085457 - RNA, 18 nt, Measles virus
ugcauccgggcucucaag

SEQ ID NO: 3085458 - RNA, 19 nt, Measles virus
acccgaugaguccucugcu

SEQ ID NO: 3085459 - RNA, 22 nt, Measles virus
cccgauccggcgggcagccacu

SEQ ID NO: 3085460 - RNA, 18 nt, Measles virus
ugaaaauacgaaguuucu

SEQ ID NO: 3085461 - RNA, 16 nt, Measles virus
aaaauacgaaguuucu

SEQ ID NO: 3085462 - RNA, 22 nt, Measles virus
caaaaaggaaaggccacaaccc

SEQ ID NO: 3085463 - RNA, 13 nt, Measles virus
acacaugagcagu

SEQ ID NO: 3085464 - RNA, 15 nt, Measles virus
aaggacaccucucaa

SEQ ID NO: 3085465 - RNA, 12 nt, Measles virus
cggaccaagcga

SEQ ID NO: 3085466 - RNA, 14 nt, Measles virus
agaucucaaagaaa

SEQ ID NO: 3085467 - RNA, 14 nt, Measles virus
accagacccagcac

SEQ ID NO: 3085468 - RNA, 19 nt, Measles virus
caagacaucaaaacagccu

SEQ ID NO: 3085469 - RNA, 18 nt, Measles virus
uauauuaaagaaaacuuu

SEQ ID NO: 3085470 - RNA, 15 nt, Measles virus
cccggugcccacagg

SEQ ID NO: 3085471 - RNA, 15 nt, Measles virus
cuuaccugccaaccc

SEQ ID NO: 3085472 - RNA, 22 nt, Measles virus
auuagacuccaucgugcagcca

SEQ ID NO: 3085473 - RNA, 18 nt, Measles virus
agcaccgccuaaaaaacg

SEQ ID NO: 3085474 - RNA, 13 nt, Measles virus
accacugcuuuac

SEQ ID NO: 3085475 - RNA, 15 nt, Measles virus
acuguuaacucucca

SEQ ID NO: 3085476 - RNA, 18 nt, Measles virus
auguggaaguugggaaug

SEQ ID NO: 3085477 - RNA, 19 nt, Measles virus
gacucggccaucaccccgc

SEQ ID NO: 3085478 - RNA, 21 nt, Measles virus
gagguguuaucgcugacaauc

SEQ ID NO: 3085479 - RNA, 17 nt, Measles virus
uugccacagcugcucag

SEQ ID NO: 3085480 - RNA, 15 nt, Measles virus
gaaccgaucacauga

SEQ ID NO: 3085481 - RNA, 20 nt, Measles virus
cugaugacucuccuugauga

SEQ ID NO: 3085482 - RNA, 16 nt, Measles virus
gcacacccaccccaca

SEQ ID NO: 3085483 - RNA, 15 nt, Measles virus
ccacccugggccacc

SEQ ID NO: 3085484 - RNA, 15 nt, Measles virus
gaggccagccagcag

SEQ ID NO: 3085485 - RNA, 19 nt, Measles virus
gcccccccggugcccacag

SEQ ID NO: 3085486 - RNA, 19 nt, Measles virus
caccugcaaggaagaggag

SEQ ID NO: 3085487 - RNA, 16 nt, Measles virus
accagacccagcaccc

SEQ ID NO: 3085488 - RNA, 12 nt, Measles virus
gaaccagcaccc

SEQ ID NO: 3085489 - RNA, 18 nt, Measles virus
ggcggcccaagcacagaa

SEQ ID NO: 3085490 - RNA, 19 nt, Measles virus
ugcugcucuccaaagggaa

SEQ ID NO: 3085491 - RNA, 12 nt, Measles virus
gccgauggcaga

SEQ ID NO: 3085492 - RNA, 14 nt, Measles virus
cagaacaacauccg

SEQ ID NO: 3085493 - RNA, 14 nt, Measles virus
gaauacaggagacu

SEQ ID NO: 3085494 - RNA, 19 nt, Measles virus
uagagaugcacuuaaugca

SEQ ID NO: 3085495 - RNA, 12 nt, Measles virus
agaacucaugaa

SEQ ID NO: 3085496 - RNA, 18 nt, Measles virus
ugaaagaaaaggagauca

SEQ ID NO: 3085497 - RNA, 21 nt, Measles virus
ccccgauccggcgggcagcca

SEQ ID NO: 3085498 - RNA, 15 nt, Measles virus
cuggcugucucagga

SEQ ID NO: 3085499 - RNA, 20 nt, Measles virus
caaaauugcuucaggauucg

SEQ ID NO: 3085500 - RNA, 17 nt, Measles virus
gcucaaauugcucagau

SEQ ID NO: 3085501 - RNA, 15 nt, Measles virus
ccucucaggaggaga

SEQ ID NO: 3085502 - RNA, 13 nt, Measles virus
ggcaccauugaag

SEQ ID NO: 3085503 - RNA, 16 nt, Measles virus
auagaccuuauguuuu

SEQ ID NO: 3085504 - RNA, 15 nt, Measles virus
cacgucgacacagag

SEQ ID NO: 3085505 - RNA, 22 nt, Measles virus
ucaggauuuauuuaacauagaa

SEQ ID NO: 3085506 - RNA, 23 nt, Measles virus
auuagaagcacaggcaaaaugag

SEQ ID NO: 3085507 - RNA, 17 nt, Measles virus
gcaacuggaaggccccu

SEQ ID NO: 3085508 - RNA, 14 nt, Measles virus
acguacagcagggc

SEQ ID NO: 3085509 - RNA, 15 nt, Measles virus
ugccacagcugcuca

SEQ ID NO: 3085510 - RNA, 22 nt, Measles virus
guucaaccugucuuacagccug

SEQ ID NO: 3085511 - RNA, 19 nt, Measles virus
ugugucagaacaucaagca

SEQ ID NO: 3085512 - RNA, 20 nt, Measles virus
cccgcgcaccccagccccga

SEQ ID NO: 3085513 - RNA, 14 nt, Measles virus
aucuaaucucaaac

SEQ ID NO: 3085514 - RNA, 12 nt, Measles virus
aggcccccaggg

SEQ ID NO: 3085515 - RNA, 18 nt, Measles virus
uaaucaagacccugacaa

SEQ ID NO: 3085516 - RNA, 16 nt, Measles virus
acuggguuacaguguu

SEQ ID NO: 3085517 - RNA, 19 nt, Measles virus
ucauuauuuggccccagcu

SEQ ID NO: 3085518 - RNA, 22 nt, Measles virus
caaucugcguccuccucguggg

SEQ ID NO: 3085519 - RNA, 20 nt, Measles virus
auuauuaacuugggaguuua

SEQ ID NO: 3085520 - RNA, 16 nt, Measles virus
gacagguggugcaacc

SEQ ID NO: 3085521 - RNA, 19 nt, Measles virus
caaggcgauuggcccuggg

SEQ ID NO: 3085522 - RNA, 17 nt, Measles virus
caaaaaaaggcccccag

SEQ ID NO: 3085523 - RNA, 19 nt, Measles virus
auuugcaauauauuaaaga

SEQ ID NO: 3085524 - RNA, 15 nt, Measles virus
gacccagcacccagc

SEQ ID NO: 3085525 - RNA, 14 nt, Measles virus
uuaaagaaaacuuu

SEQ ID NO: 3085526 - RNA, 16 nt, Measles virus
gacccagcacccagcc

SEQ ID NO: 3085527 - RNA, 16 nt, Measles virus
aacuuugaaaauacga

SEQ ID NO: 3085528 - RNA, 21 nt, Measles virus
agacuccaucgugcagccauc

SEQ ID NO: 3085529 - RNA, 16 nt, Measles virus
gauaaucagaagauaa

SEQ ID NO: 3085530 - RNA, 14 nt, Measles virus
uauucccagcuuug

SEQ ID NO: 3085531 - RNA, 15 nt, Measles virus
cacagccgccagcca

SEQ ID NO: 3085532 - RNA, 22 nt, Measles virus
uggcugucucaggaguccccaa

SEQ ID NO: 3085533 - RNA, 17 nt, Measles virus
acuccggaacccuaauc

SEQ ID NO: 3085534 - RNA, 11 nt, Measles virus
uugccacagcu

SEQ ID NO: 3085535 - RNA, 21 nt, Measles virus
gucccucacgcuuacagccug

SEQ ID NO: 3085536 - RNA, 19 nt, Measles virus
uacaaccuaaauccauuau

SEQ ID NO: 3085537 - RNA, 14 nt, Measles virus
cauuggugaugaag

SEQ ID NO: 3085538 - RNA, 16 nt, Measles virus
ucaaggacgugcugac

SEQ ID NO: 3085539 - RNA, 22 nt, Measles virus
ggcaguucgggucucagcaaac

SEQ ID NO: 3085540 - RNA, 20 nt, Measles virus
ccccgaccagacccagcacc

SEQ ID NO: 3085541 - RNA, 21 nt, Measles virus
auuucagcaacugcauggugg

SEQ ID NO: 3085542 - RNA, 16 nt, Measles virus
uaguaagaauccaggc

SEQ ID NO: 3085543 - RNA, 14 nt, Measles virus
cacgcuuacagccu

SEQ ID NO: 3085544 - RNA, 15 nt, Measles virus
gcagugcccagcaau

SEQ ID NO: 3085545 - RNA, 13 nt, Measles virus
gcuauccuggagu

SEQ ID NO: 3085546 - RNA, 15 nt, Measles virus
cccagcaauacccga

SEQ ID NO: 3085547 - RNA, 20 nt, Measles virus
gaggacagcugcugaaggaa

SEQ ID NO: 3085548 - RNA, 13 nt, Measles virus
acaacccacaucc

SEQ ID NO: 3085549 - RNA, 17 nt, Measles virus
uccugaaacuccaaucc

SEQ ID NO: 3085550 - RNA, 17 nt, Measles virus
acuggagccgauggcag

SEQ ID NO: 3085551 - RNA, 17 nt, Measles virus
ucuauucccagcuuugu

SEQ ID NO: 3085552 - RNA, 17 nt, Measles virus
uuaggcauuauuugcaa

SEQ ID NO: 3085553 - RNA, 17 nt, Measles virus
cgggaacuucaggagaa

SEQ ID NO: 3085554 - RNA, 16 nt, Measles virus
ucaagacucauccagu

SEQ ID NO: 3085555 - RNA, 13 nt, Measles virus
cacagaccaccaa

SEQ ID NO: 3085556 - RNA, 13 nt, Measles virus
cauccgcggucag

SEQ ID NO: 3085557 - RNA, 17 nt, Measles virus
cacagccgccagccaac

SEQ ID NO: 3085558 - RNA, 13 nt, Measles virus
caaguaggagaca

SEQ ID NO: 3085559 - RNA, 17 nt, Measles virus
cagccccgacacaaggc

SEQ ID NO: 3085560 - RNA, 17 nt, Measles virus
ugggauggugggcaugg

SEQ ID NO: 3085561 - RNA, 16 nt, Measles virus
ugaaacacagauuucc

SEQ ID NO: 3085562 - RNA, 20 nt, Measles virus
caggcaguucgggucucagc

SEQ ID NO: 3085563 - RNA, 20 nt, Measles virus
cccuaggcguugccacagcu

SEQ ID NO: 3085564 - RNA, 16 nt, Measles virus
aaccagaguccagacc

SEQ ID NO: 3085565 - RNA, 14 nt, Measles virus
ccgagcacuggccg

SEQ ID NO: 3085566 - RNA, 16 nt, Measles virus
ugcaagaucauccaca

SEQ ID NO: 3085567 - RNA, 17 nt, Measles virus
gaccgcagugcccagca

SEQ ID NO: 3085568 - RNA, 15 nt, Measles virus
ccagacuugaagcag

SEQ ID NO: 3085569 - RNA, 18 nt, Measles virus
guuucuauucccagcuuu

SEQ ID NO: 3085570 - RNA, 21 nt, Measles virus
acuggaaaucauuugcuggag

SEQ ID NO: 3085571 - RNA, 21 nt, Measles virus
cgaggaagccauggcagcaug

SEQ ID NO: 3085572 - RNA, 17 nt, Measles virus
aggugacccaaccgcag

SEQ ID NO: 3085573 - RNA, 11 nt, Measles virus
gcgaaccugau

SEQ ID NO: 3085574 - RNA, 15 nt, Measles virus
ggauaacaggauucc

SEQ ID NO: 3085575 - RNA, 17 nt, Measles virus
aaaaaacggauucucca

SEQ ID NO: 3085576 - RNA, 15 nt, Measles virus
cuguuaacucuccaa

SEQ ID NO: 3085577 - RNA, 18 nt, Measles virus
cuagcugucucaaaggga

SEQ ID NO: 3085578 - RNA, 23 nt, Measles virus
ccaggcaguuuugcagccaucag

SEQ ID NO: 3085579 - RNA, 12 nt, Measles virus
ucugucaaccag

SEQ ID NO: 3085580 - RNA, 18 nt, Measles virus
cagcaaguguggacacca

SEQ ID NO: 3085581 - RNA, 15 nt, Measles virus
uaaagggggucccaa

SEQ ID NO: 3085582 - RNA, 18 nt, Measles virus
ucagaucggucaaugcag

SEQ ID NO: 3085583 - RNA, 22 nt, Measles virus
ucaagacugagaugaggucagu

SEQ ID NO: 3085584 - RNA, 23 nt, Measles virus
cugcguccuccucgugggacccc

SEQ ID NO: 3085585 - RNA, 16 nt, Measles virus
uaaugacagccagaag

SEQ ID NO: 3085586 - RNA, 17 nt, Measles virus
ggaaccuaauagccaau

SEQ ID NO: 3085587 - RNA, 15 nt, Measles virus
ugaacucaacucuac

SEQ ID NO: 3085588 - RNA, 22 nt, Measles virus
agcaagacucuccaugcacaac

SEQ ID NO: 3085589 - RNA, 20 nt, Measles virus
caggcauacccacuagugug

SEQ ID NO: 3085590 - RNA, 13 nt, Measles virus
agauuucccacaa

SEQ ID NO: 3085591 - RNA, 11 nt, Measles virus
gugcccacagg

SEQ ID NO: 3085592 - RNA, 22 nt, Measles virus
ggagaugauauuggcuguucag

SEQ ID NO: 3085593 - RNA, 20 nt, Measles virus
aacaaguugguaugucaaga

SEQ ID NO: 3085594 - RNA, 19 nt, Measles virus
cgaggaagccauggcagca

SEQ ID NO: 3085595 - RNA, 12 nt, Measles virus
uccaaagggaau

SEQ ID NO: 3085596 - RNA, 15 nt, Measles virus
guaccugcacagaau

SEQ ID NO: 3085597 - RNA, 23 nt, Measles virus
cagccccgauccggcgggcagcc

SEQ ID NO: 3085598 - RNA, 18 nt, Measles virus
aaccaaccacaacaaugu

SEQ ID NO: 3085599 - RNA, 23 nt, Measles virus
cccgaugaguccucugcuccaag

SEQ ID NO: 3085600 - RNA, 12 nt, Measles virus
cuucaaugcaaa

SEQ ID NO: 3085601 - RNA, 14 nt, Measles virus
aggcauuauuugca

SEQ ID NO: 3085602 - RNA, 16 nt, Measles virus
ggcagaagagcaggca

SEQ ID NO: 3085603 - RNA, 24 nt, Measles virus
guucagaguguagcuucaaguagg

SEQ ID NO: 3085604 - RNA, 20 nt, Measles virus
augccucuuagccuggacag

SEQ ID NO: 3085605 - RNA, 19 nt, Measles virus
ccaaaauacacgaggauaa

SEQ ID NO: 3085606 - RNA, 17 nt, Measles virus
aaauacgaaguuucuau

SEQ ID NO: 3085607 - RNA, 17 nt, Measles virus
cacucaauuccccaccc

SEQ ID NO: 3085608 - RNA, 13 nt, Measles virus
cugggccaccagc

SEQ ID NO: 3085609 - RNA, 22 nt, Measles virus
cccagaaucaagacucauccag

SEQ ID NO: 3085610 - RNA, 12 nt, Measles virus
cuggaggccagg

SEQ ID NO: 3085611 - RNA, 14 nt, Measles virus
ccugaggacaccuc

SEQ ID NO: 3085612 - RNA, 16 nt, Measles virus
gugaaauagacaucag

SEQ ID NO: 3085613 - RNA, 17 nt, Measles virus
caagcgaccgaggugac

SEQ ID NO: 3085614 - RNA, 19 nt, Measles virus
ccuaucaggggucagggaa

SEQ ID NO: 3085615 - RNA, 21 nt, Measles virus
cacccaagagcgaucccuggg

SEQ ID NO: 3085616 - RNA, 15 nt, Measles virus
uaggcauuauuugca

SEQ ID NO: 3085617 - RNA, 18 nt, Measles virus
ggucaauucucaaacaug

SEQ ID NO: 3085618 - RNA, 18 nt, Measles virus
uucuauucccagcuuugu

SEQ ID NO: 3085619 - RNA, 20 nt, Measles virus
acccugggccaccagcuccc

SEQ ID NO: 3085620 - RNA, 23 nt, Measles virus
cacucccacgacuggagccgaug

SEQ ID NO: 3085621 - RNA, 13 nt, Measles virus
aaucggccagaag

SEQ ID NO: 3085622 - RNA, 15 nt, Measles virus
ugucagcuuccagcu

SEQ ID NO: 3085623 - RNA, 16 nt, Measles virus
uaucaaugaagaccuu

SEQ ID NO: 3085624 - RNA, 13 nt, Measles virus
gcgagaggccagc

SEQ ID NO: 3085625 - RNA, 18 nt, Measles virus
guccagaccacccugggc

SEQ ID NO: 3085626 - RNA, 13 nt, Measles virus
gcgcuuggaggag

SEQ ID NO: 3085627 - RNA, 21 nt, Measles virus
cagaguccagaccacccuggg

SEQ ID NO: 3085628 - RNA, 14 nt, Measles virus
ugacaaucaagcaa

SEQ ID NO: 3085629 - RNA, 22 nt, Measles virus
augcacaacucggguucaagaa

SEQ ID NO: 3085630 - RNA, 16 nt, Measles virus
cacaaugacagagauc

SEQ ID NO: 3085631 - RNA, 22 nt, Measles virus
aucaguuccuagcugucucaaa

SEQ ID NO: 3085632 - RNA, 21 nt, Measles virus
cagccccgacacaaggccacc

SEQ ID NO: 3085633 - RNA, 22 nt, Measles virus
ugucaggaaauacaugaaucag

SEQ ID NO: 3085634 - RNA, 14 nt, Measles virus
agcccucugucaca

SEQ ID NO: 3085635 - RNA, 16 nt, Measles virus
gacuuacaaaaugagg

SEQ ID NO: 3085636 - RNA, 12 nt, Measles virus
gccccccccaaa

SEQ ID NO: 3085637 - RNA, 21 nt, Measles virus
agugcguugauaacuggaaau

SEQ ID NO: 3085638 - RNA, 22 nt, Measles virus
ucacugaccuagugaaauucau

SEQ ID NO: 3085639 - RNA, 23 nt, Measles virus
gaucugacaauguaccuaaagga

SEQ ID NO: 3085640 - RNA, 15 nt, Measles virus
caucaauccucugca

SEQ ID NO: 3085641 - RNA, 13 nt, Measles virus
acaugcuuccagc

SEQ ID NO: 3085642 - RNA, 15 nt, Measles virus
auccaacuuaucaaa

SEQ ID NO: 3085643 - RNA, 13 nt, Measles virus
ucaggagucccca

SEQ ID NO: 3085644 - RNA, 19 nt, Measles virus
aaaggugucagcuuccagc

SEQ ID NO: 3085645 - RNA, 19 nt, Measles virus
ccccaaaaaaaggccccca

SEQ ID NO: 3085646 - RNA, 21 nt, Measles virus
cucgaucgagcaucaggucaa

SEQ ID NO: 3085647 - RNA, 14 nt, Measles virus
ccaccaccagccau

SEQ ID NO: 3085648 - RNA, 14 nt, Measles virus
cugcagaaggaggg

SEQ ID NO: 3085649 - RNA, 18 nt, Measles virus
uauguuuugcuggcuguu

SEQ ID NO: 3085650 - RNA, 18 nt, Measles virus
caguaucccacagccucu

SEQ ID NO: 3085651 - RNA, 13 nt, Measles virus
aggaugccaagga

SEQ ID NO: 3085652 - RNA, 14 nt, Measles virus
ugauuauaaacaau

SEQ ID NO: 3085653 - RNA, 12 nt, Measles virus
auauuaaagaaa

SEQ ID NO: 3085654 - RNA, 16 nt, Measles virus
accugcaacugaggga

SEQ ID NO: 3085655 - RNA, 18 nt, Measles virus
accuacgauacuuccagg

SEQ ID NO: 3085656 - RNA, 23 nt, Measles virus
aucgcugaaaaucuaaucucaaa

SEQ ID NO: 3085657 - RNA, 19 nt, Measles virus
gcgaccgaggugacccaac

SEQ ID NO: 3085658 - RNA, 21 nt, Measles virus
gacaccacucuucaagaucau

SEQ ID NO: 3085659 - RNA, 16 nt, Measles virus
cugcucagggcccacu

SEQ ID NO: 3085660 - RNA, 23 nt, Measles virus
caugcugugguuuauuauguuua

SEQ ID NO: 3085661 - RNA, 15 nt, Measles virus
gcaaugacccagaau

SEQ ID NO: 3085662 - RNA, 23 nt, Measles virus
cagggcuucugauguugaaacug

SEQ ID NO: 3085663 - RNA, 18 nt, Measles virus
cucaacuuaccugccaac

SEQ ID NO: 3085664 - RNA, 21 nt, Measles virus
aaugcccaauauaacucuccu

SEQ ID NO: 3085665 - RNA, 16 nt, Measles virus
cugaaaaugucaggaa

SEQ ID NO: 3085666 - RNA, 20 nt, Measles virus
cagaccacccugggccacca

SEQ ID NO: 3085667 - RNA, 15 nt, Measles virus
aucaguaucccacag

SEQ ID NO: 3085668 - RNA, 15 nt, Measles virus
ucaguaucccacagc

SEQ ID NO: 3085669 - RNA, 15 nt, Measles virus
aaagaaaacuuugaa

SEQ ID NO: 3085670 - RNA, 15 nt, Measles virus
caggaccgagccacc

SEQ ID NO: 3085671 - RNA, 13 nt, Measles virus
ucaaggagaaaau

SEQ ID NO: 3085672 - RNA, 15 nt, Measles virus
cauguuucugcuggg

SEQ ID NO: 3085673 - RNA, 11 nt, Measles virus
caaaggagaca

SEQ ID NO: 3085674 - RNA, 21 nt, Measles virus
gggagauccacgagcuccuga

SEQ ID NO: 3085675 - RNA, 21 nt, Measles virus
ugcugcucuccaaagggaaug

SEQ ID NO: 3085676 - RNA, 14 nt, Measles virus
acccaccccacaca

SEQ ID NO: 3085677 - RNA, 13 nt, Measles virus
agccaugcuggag

SEQ ID NO: 3085678 - RNA, 17 nt, Measles virus
uagguaguuaggcauua

SEQ ID NO: 3085679 - RNA, 14 nt, Measles virus
cuuaucaaauugua

SEQ ID NO: 3085680 - RNA, 12 nt, Measles virus
cagcugcucaga

SEQ ID NO: 3085681 - RNA, 17 nt, Measles virus
cuaucaggggucaggga

SEQ ID NO: 3085682 - RNA, 17 nt, Measles virus
caagaaaucuccaggca

SEQ ID NO: 3085683 - RNA, 23 nt, Measles virus
agguaguuaggcauuauuugcaa

SEQ ID NO: 3085684 - RNA, 14 nt, Measles virus
caccacucuucaag

SEQ ID NO: 3085685 - RNA, 19 nt, Measles virus
ugauuauaaacaaugugga

SEQ ID NO: 3085686 - RNA, 12 nt, Measles virus
ucugacaaugua

SEQ ID NO: 3085687 - RNA, 18 nt, Measles virus
cuggagccgauggcagaa

SEQ ID NO: 3085688 - RNA, 21 nt, Measles virus
gccacaacccgcgcaccccag

SEQ ID NO: 3085689 - RNA, 17 nt, Measles virus
aucauguuuaugaucac

SEQ ID NO: 3085690 - RNA, 18 nt, Measles virus
acacagauuucccacaag

SEQ ID NO: 3085691 - RNA, 21 nt, Measles virus
agcaacuggaaggccccuccc

SEQ ID NO: 3085692 - RNA, 20 nt, Measles virus
caaaaaggaaaggccacaac

SEQ ID NO: 3085693 - RNA, 17 nt, Measles virus
gacaggaccgagccacc

SEQ ID NO: 3085694 - RNA, 15 nt, Measles virus
ugggaaggaucccaa

SEQ ID NO: 3085695 - RNA, 17 nt, Measles virus
aucaguaucccacagcc

SEQ ID NO: 3085696 - RNA, 17 nt, Measles virus
auaggaagugcaagcua

SEQ ID NO: 3085697 - RNA, 17 nt, Measles virus
ccacuaacccuccucac

SEQ ID NO: 3085698 - RNA, 15 nt, Measles virus
ccagccagcagccga

SEQ ID NO: 3085699 - RNA, 12 nt, Measles virus
uaguuaggcauu

SEQ ID NO: 3085700 - RNA, 13 nt, Measles virus
caugcuuccagca

SEQ ID NO: 3085701 - RNA, 22 nt, Measles virus
ccaaccgacaugcgauccuggg

SEQ ID NO: 3085702 - RNA, 16 nt, Measles virus
caagauccuaacauac

SEQ ID NO: 3085703 - RNA, 21 nt, Measles virus
caccaggcggcccaagcacag

SEQ ID NO: 3085704 - RNA, 23 nt, Measles virus
agacaucagaauuaagaaaaacg

SEQ ID NO: 3085705 - RNA, 18 nt, Measles virus
aagggaccaaaagaucaa

SEQ ID NO: 3085706 - RNA, 12 nt, Measles virus
auaacuggaaau

SEQ ID NO: 3085707 - RNA, 13 nt, Measles virus
aucccacagccuc

SEQ ID NO: 3085708 - RNA, 22 nt, Measles virus
caguaucccacagccucuccaa

SEQ ID NO: 3085709 - RNA, 16 nt, Measles virus
aggugauaggaaggau

SEQ ID NO: 3085710 - RNA, 19 nt, Measles virus
accaccgcauccagcauca

SEQ ID NO: 3085711 - RNA, 12 nt, Measles virus
cucguuccagcc

SEQ ID NO: 3085712 - RNA, 18 nt, Measles virus
aggacaccucucaagcau

SEQ ID NO: 3085713 - RNA, 15 nt, Measles virus
guuccagaggacagc

SEQ ID NO: 3085714 - RNA, 23 nt, Measles virus
uaaugacagccagaaggcccgga

SEQ ID NO: 3085715 - RNA, 19 nt, Measles virus
cugucucaaagggaaacug

SEQ ID NO: 3085716 - RNA, 11 nt, Measles virus
aaaggccccca

SEQ ID NO: 3085717 - RNA, 15 nt, Measles virus
ccgaaaaccagaggg

SEQ ID NO: 3085718 - RNA, 18 nt, Measles virus
cugcucagggcccacuac

SEQ ID NO: 3085719 - RNA, 21 nt, Measles virus
ugagcuccuaaaaaagggaaa

SEQ ID NO: 3085720 - RNA, 20 nt, Measles virus
gagacaugcuuccagcaggc

SEQ ID NO: 3085721 - RNA, 22 nt, Measles virus
ccaaugguuugagcccuuucug

SEQ ID NO: 3085722 - RNA, 13 nt, Measles virus
agcagaugcaaga

SEQ ID NO: 3085723 - RNA, 23 nt, Measles virus
acacaaggccaccaccagccauc

SEQ ID NO: 3085724 - RNA, 21 nt, Measles virus
agaucgcagaauacaggagac

SEQ ID NO: 3085725 - RNA, 16 nt, Measles virus
ccagggaauguacggg

SEQ ID NO: 3085726 - RNA, 15 nt, Measles virus
acccgccggcccccc

SEQ ID NO: 3085727 - RNA, 17 nt, Measles virus
cagcaucaagcccaccu

SEQ ID NO: 3085728 - RNA, 21 nt, Measles virus
agucccucacgcuuacagccu

SEQ ID NO: 3085729 - RNA, 18 nt, Measles virus
ugaugaagguacuuauca

SEQ ID NO: 3085730 - RNA, 14 nt, Measles virus
ugcugaacucucaa

SEQ ID NO: 3085731 - RNA, 14 nt, Measles virus
ucaaggccgagccc

SEQ ID NO: 3085732 - RNA, 15 nt, Measles virus
gaacagccccgacac

SEQ ID NO: 3085733 - RNA, 16 nt, Measles virus
cgagaggccagccagc

SEQ ID NO: 3085734 - RNA, 14 nt, Measles virus
cccguugccagccg

SEQ ID NO: 3085735 - RNA, 23 nt, Measles virus
gaguccucugcuccaagaaugcc

SEQ ID NO: 3085736 - RNA, 18 nt, Measles virus
gcagaucaacaggcaaaa

SEQ ID NO: 3085737 - RNA, 18 nt, Measles virus
caggaccgagccaccugc

SEQ ID NO: 3085738 - RNA, 17 nt, Measles virus
caaccgcauccccacag

SEQ ID NO: 3085739 - RNA, 13 nt, Measles virus
cccgaaccagcac

SEQ ID NO: 3085740 - RNA, 21 nt, Measles virus
ccacauccuaagggaaguagg

SEQ ID NO: 3085741 - RNA, 12 nt, Measles virus
aauacaggagac

SEQ ID NO: 3085742 - RNA, 21 nt, Measles virus
ccaugcugaacucucaagcca

SEQ ID NO: 3085743 - RNA, 21 nt, Measles virus
gacacaaggccaccaccagcc

SEQ ID NO: 3085744 - RNA, 17 nt, Measles virus
cucgacagaacccagac

SEQ ID NO: 3085745 - RNA, 19 nt, Measles virus
ccaggacaggaccgagcca

SEQ ID NO: 3085746 - RNA, 23 nt, Measles virus
aaggcacuccacacucuggcugu

SEQ ID NO: 3085747 - RNA, 19 nt, Measles virus
ccaauauaacucuccucaa

SEQ ID NO: 3085748 - RNA, 22 nt, Measles virus
gacccccgaggaccaaccccga

SEQ ID NO: 3085749 - RNA, 13 nt, Measles virus
caccucucaagca

SEQ ID NO: 3085750 - RNA, 14 nt, Measles virus
aaagaucucaaaga

SEQ ID NO: 3085751 - RNA, 14 nt, Measles virus
gaaccagcacccaa

SEQ ID NO: 3085752 - RNA, 20 nt, Measles virus
cacagacgcgagauuggccu

SEQ ID NO: 3085753 - RNA, 12 nt, Measles virus
auaccuaccugc

SEQ ID NO: 3085754 - RNA, 23 nt, Measles virus
caacucggguucaagaagaccuu

SEQ ID NO: 3085755 - RNA, 12 nt, Measles virus
cggcccccccgg

SEQ ID NO: 3085756 - RNA, 17 nt, Measles virus
aucccugggggaccccc

SEQ ID NO: 3085757 - RNA, 18 nt, Measles virus
cagauguggcugcugaag

SEQ ID NO: 3085758 - RNA, 13 nt, Measles virus
guucaagaagacc

SEQ ID NO: 3085759 - RNA, 21 nt, Measles virus
aauacgaaguuucuauuccca

SEQ ID NO: 3085760 - RNA, 22 nt, Measles virus
cuuacagggacaucaaaauccu

SEQ ID NO: 3085761 - RNA, 16 nt, Measles virus
cccgaaccagcaccca

SEQ ID NO: 3085762 - RNA, 19 nt, Measles virus
cacggaccaagcgagaggc

SEQ ID NO: 3085763 - RNA, 22 nt, Measles virus
ggacaaugggauggccaaggau

SEQ ID NO: 3085764 - RNA, 20 nt, Measles virus
cauugcacuucaccagucca

SEQ ID NO: 3085765 - RNA, 23 nt, Measles virus
gccgucgaggaagccauggcagc

SEQ ID NO: 3085766 - RNA, 15 nt, Measles virus
gaaauacaugaauca

SEQ ID NO: 3085767 - RNA, 12 nt, Measles virus
cugggggacccc

SEQ ID NO: 3085768 - RNA, 22 nt, Measles virus
ugacccucccccugcaugcugc

SEQ ID NO: 3085769 - RNA, 15 nt, Measles virus
cauaaugacagccag

SEQ ID NO: 3085770 - RNA, 18 nt, Measles virus
cugaaaaucuaaucucaa

SEQ ID NO: 3085771 - RNA, 14 nt, Measles virus
agaacaucaagcac

SEQ ID NO: 3085772 - RNA, 18 nt, Measles virus
gaaagguccuaacaacag

SEQ ID NO: 3085773 - RNA, 15 nt, Measles virus
ccgcagugcccagca

SEQ ID NO: 3085774 - RNA, 18 nt, Measles virus
ggacagcgauccccuagg

SEQ ID NO: 3085775 - RNA, 17 nt, Measles virus
cagaguccagaccaccc

SEQ ID NO: 3085776 - RNA, 19 nt, Measles virus
augcucaagcuucagguga

SEQ ID NO: 3085777 - RNA, 15 nt, Measles virus
aagcagggcaggaga

SEQ ID NO: 3085778 - RNA, 17 nt, Measles virus
agauccgugagcuccua

SEQ ID NO: 3085779 - RNA, 18 nt, Measles virus
caaccgcauccccacagc

SEQ ID NO: 3085780 - RNA, 22 nt, Measles virus
caugccaagugaucgcugaaaa

SEQ ID NO: 3085781 - RNA, 17 nt, Measles virus
acaugggacaaaaaacu

SEQ ID NO: 3085782 - RNA, 19 nt, Measles virus
cccagcuuacgggacccca

SEQ ID NO: 3085783 - RNA, 22 nt, Measles virus
guguucuacaacaacaccccac

SEQ ID NO: 3085784 - RNA, 18 nt, Measles virus
gcugcugaagaacucaug

SEQ ID NO: 3085785 - RNA, 12 nt, Measles virus
accgaaccagag

SEQ ID NO: 3085786 - RNA, 23 nt, Measles virus
cagcaauuggaucaacugaaggc

SEQ ID NO: 3085787 - RNA, 20 nt, Measles virus
cgaccagacccagcacccag

SEQ ID NO: 3085788 - RNA, 23 nt, Measles virus
cuggucaggaucuccaauauguu

SEQ ID NO: 3085789 - RNA, 13 nt, Measles virus
agcgagaggccag

SEQ ID NO: 3085790 - RNA, 19 nt, Measles virus
gcaguucgggucucagcaa

SEQ ID NO: 3085791 - RNA, 19 nt, Measles virus
gacagcaaguguggacacc

SEQ ID NO: 3085792 - RNA, 17 nt, Measles virus
caggaccgagccaccug

SEQ ID NO: 3085793 - RNA, 19 nt, Measles virus
cgaccagacccagcaccca

SEQ ID NO: 3085794 - RNA, 20 nt, Measles virus
gacuccuuagacagauccuc

SEQ ID NO: 3085795 - RNA, 21 nt, Measles virus
uuaagucgagguuacaaugug

SEQ ID NO: 3085796 - RNA, 22 nt, Measles virus
auuacaaguggaaugcuucaca

SEQ ID NO: 3085797 - RNA, 12 nt, Measles virus
gaaagucacagg

SEQ ID NO: 3085798 - RNA, 21 nt, Measles virus
ccacaacccgcgcaccccagc

SEQ ID NO: 3085799 - RNA, 13 nt, Measles virus
ccgacgcuguccg

SEQ ID NO: 3085800 - RNA, 17 nt, Measles virus
cgcugacaaucaagcaa

SEQ ID NO: 3085801 - RNA, 21 nt, Measles virus
caacccgaaccagcacccaag

SEQ ID NO: 3085802 - RNA, 16 nt, Measles virus
cugaggacaccucaga

SEQ ID NO: 3085803 - RNA, 15 nt, Measles virus
cacccagccaccgac

SEQ ID NO: 3085804 - RNA, 22 nt, Measles virus
aagacaucaguaucccacagcc

SEQ ID NO: 3085805 - RNA, 16 nt, Measles virus
auuauugcaaaaugaa

SEQ ID NO: 3085806 - RNA, 14 nt, Measles virus
ccacccuggaagga

SEQ ID NO: 3085807 - RNA, 20 nt, Measles virus
uccgauguccaagacaucaa

SEQ ID NO: 3085808 - RNA, 23 nt, Measles virus
gcacagaacagccccgacacaag

SEQ ID NO: 3085809 - RNA, 15 nt, Measles virus
ccaucgugcagccau

SEQ ID NO: 3085810 - RNA, 11 nt, Measles virus
gcacacccacc

SEQ ID NO: 3085811 - RNA, 18 nt, Measles virus
cucaaucccgaccugaaa

SEQ ID NO: 3085812 - RNA, 22 nt, Measles virus
ucaagaagcccguugccagccg

SEQ ID NO: 3085813 - RNA, 21 nt, Measles virus
caaaacggguuuucugaugaa

SEQ ID NO: 3085814 - RNA, 16 nt, Measles virus
caaagaaagucacagg

SEQ ID NO: 3085815 - RNA, 16 nt, Measles virus
cagagggagcccccaa

SEQ ID NO: 3085816 - RNA, 17 nt, Measles virus
gcgauccuggguccccc

SEQ ID NO: 3085817 - RNA, 16 nt, Measles virus
cuacuggaggccaggg

SEQ ID NO: 3085818 - RNA, 17 nt, Measles virus
acucaacucuacuggag

SEQ ID NO: 3085819 - RNA, 22 nt, Measles virus
cccaagcacagaacagccccga

SEQ ID NO: 3085820 - RNA, 23 nt, Measles virus
ggccacaacccgcgcaccccagc

SEQ ID NO: 3085821 - RNA, 18 nt, Measles virus
gcuggugccccaggucag

SEQ ID NO: 3085822 - RNA, 20 nt, Measles virus
caguaucccacagccucucc

SEQ ID NO: 3085823 - RNA, 20 nt, Measles virus
agggcucaaauugcucagau

SEQ ID NO: 3085824 - RNA, 13 nt, Measles virus
uauccauccaggc

SEQ ID NO: 3085825 - RNA, 21 nt, Measles virus
uccacucccacgacuggagcc

SEQ ID NO: 3085826 - RNA, 24 nt, Measles virus
gcuuuaccucucaucucacagagg

SEQ ID NO: 3085827 - RNA, 16 nt, Measles virus
cgauccucccaaggga

SEQ ID NO: 3085828 - RNA, 21 nt, Measles virus
gcgaugacgacgcugaaacuu

SEQ ID NO: 3085829 - RNA, 17 nt, Measles virus
ucuacuggaggccaggg

SEQ ID NO: 3085830 - RNA, 14 nt, Measles virus
ccaccggcuagagg

SEQ ID NO: 3085831 - RNA, 19 nt, Measles virus
cccgaaaacgaccccccuc

SEQ ID NO: 3085832 - RNA, 16 nt, Measles virus
ucgcucugauccucua

SEQ ID NO: 3085833 - RNA, 16 nt, Measles virus
acacacgguucaggga

SEQ ID NO: 3085834 - RNA, 23 nt, Measles virus
cuaaguuggaggaugccaaggaa

SEQ ID NO: 3085835 - RNA, 14 nt, Measles virus
caaugaagaccuua

SEQ ID NO: 3085836 - RNA, 19 nt, Measles virus
ccugaggacaccucagaga

SEQ ID NO: 3085837 - RNA, 21 nt, Measles virus
ucaaaacagccuuggccaaaa

SEQ ID NO: 3085838 - RNA, 19 nt, Measles virus
caacccgaaccagcaccca

SEQ ID NO: 3085839 - RNA, 21 nt, Measles virus
cagauagggcugccagugaac

SEQ ID NO: 3085840 - RNA, 12 nt, Measles virus
gaaucccagaau

SEQ ID NO: 3085841 - RNA, 11 nt, Measles virus
caaaaaagccc

SEQ ID NO: 3085842 - RNA, 19 nt, Measles virus
accagaucuuauacccuga

SEQ ID NO: 3085843 - RNA, 13 nt, Measles virus
auccuaagggaag

SEQ ID NO: 3085844 - RNA, 16 nt, Measles virus
cuacaccgcagagauc

SEQ ID NO: 3085845 - RNA, 20 nt, Measles virus
caguaaugauuucagcaacu

SEQ ID NO: 3085846 - RNA, 21 nt, Measles virus
caucgcgaggaagcacaccca

SEQ ID NO: 3085847 - RNA, 13 nt, Measles virus
ggagaucaaggaa

SEQ ID NO: 3085848 - RNA, 13 nt, Measles virus
guagaacucagag

SEQ ID NO: 3085849 - RNA, 22 nt, Measles virus
ucagauacuauacagaaauccu

SEQ ID NO: 3085850 - RNA, 18 nt, Measles virus
agcgagaggccagccagc

SEQ ID NO: 3085851 - RNA, 14 nt, Measles virus
ccagaguccagacc

SEQ ID NO: 3085852 - RNA, 15 nt, Measles virus
agcuuccagcucguc

SEQ ID NO: 3085853 - RNA, 14 nt, Measles virus
uaucacaagggaac

SEQ ID NO: 3085854 - RNA, 18 nt, Measles virus
cauaucacucacucuggg

SEQ ID NO: 3085855 - RNA, 16 nt, Measles virus
cagccuuggccaaaau

SEQ ID NO: 3085856 - RNA, 15 nt, Measles virus
acuccacggaccaag

SEQ ID NO: 3085857 - RNA, 16 nt, Measles virus
acgguucagggaugga

SEQ ID NO: 3085858 - RNA, 14 nt, Measles virus
cucugucacaggga

SEQ ID NO: 3085859 - RNA, 22 nt, Measles virus
augacaaguugcgaauggagac

SEQ ID NO: 3085860 - RNA, 11 nt, Measles virus
guuucuauucc

SEQ ID NO: 3085861 - RNA, 18 nt, Measles virus
gauccauaagagccucag

SEQ ID NO: 3085862 - RNA, 14 nt, Measles virus
aaauacgaaguuuc

SEQ ID NO: 3085863 - RNA, 19 nt, Measles virus
cggaagcguuaccugauga

SEQ ID NO: 3085864 - RNA, 20 nt, Measles virus
acuggaggccagggcaacca

SEQ ID NO: 3085865 - RNA, 14 nt, Measles virus
cauguuucugagcu

SEQ ID NO: 3085866 - RNA, 20 nt, Measles virus
gacugagaugaggucaguga

SEQ ID NO: 3085867 - RNA, 21 nt, Measles virus
agaaucaaauuggauuaugau

SEQ ID NO: 3085868 - RNA, 22 nt, Measles virus
gcguugccacagcugcucagau

SEQ ID NO: 3085869 - RNA, 22 nt, Measles virus
uacaaagacaacccacauccua

SEQ ID NO: 3085870 - RNA, 19 nt, Measles virus
caccaggcggcccaagcac

SEQ ID NO: 3085871 - RNA, 22 nt, Measles virus
cacuggccgaaguucucaagaa

SEQ ID NO: 3085872 - RNA, 13 nt, Measles virus
accgcuggacacc

SEQ ID NO: 3085873 - RNA, 18 nt, Measles virus
aaaggaacccccagcaac

SEQ ID NO: 3085874 - RNA, 16 nt, Measles virus
cauucgggucccugcc

SEQ ID NO: 3085875 - RNA, 13 nt, Measles virus
uggcugcugaaga

SEQ ID NO: 3085876 - RNA, 13 nt, Measles virus
cuaacccuccuca

SEQ ID NO: 3085877 - RNA, 23 nt, Measles virus
cucaaagggaaacugcucagggc

SEQ ID NO: 3085878 - RNA, 21 nt, Measles virus
gcagccaucaguuccucaaga

SEQ ID NO: 3085879 - RNA, 17 nt, Measles virus
ccaguuccagaggacag

SEQ ID NO: 3085880 - RNA, 21 nt, Measles virus
aaucgcagauagggcugccag

SEQ ID NO: 3085881 - RNA, 18 nt, Measles virus
ggagucaucggaccagau

SEQ ID NO: 3085882 - RNA, 13 nt, Measles virus
ccccacagcuccc

SEQ ID NO: 3085883 - RNA, 15 nt, Measles virus
aucacaagggaaccu

SEQ ID NO: 3085884 - RNA, 13 nt, Measles virus
cauguggaaacug

SEQ ID NO: 3085885 - RNA, 15 nt, Measles virus
uugcaauauauuaaa

SEQ ID NO: 3085886 - RNA, 17 nt, Measles virus
ccaccgcauccagcauc

SEQ ID NO: 3085887 - RNA, 18 nt, Measles virus
caaauuggauuaugauca

SEQ ID NO: 3085888 - RNA, 13 nt, Measles virus
ccucaagaaaucu

SEQ ID NO: 3085889 - RNA, 22 nt, Measles virus
caacuggaaggccccucccccc

SEQ ID NO: 3085890 - RNA, 22 nt, Measles virus
uggacacccgaaucugguacca

SEQ ID NO: 3085891 - RNA, 13 nt, Measles virus
ccagccagcagcc

SEQ ID NO: 3085892 - RNA, 21 nt, Measles virus
gccccgacacaaggccaccac

SEQ ID NO: 3085893 - RNA, 18 nt, Measles virus
aguuccagaggacagcug

SEQ ID NO: 3085894 - RNA, 20 nt, Measles virus
caaccgcauccccacagcuc

SEQ ID NO: 3085895 - RNA, 15 nt, Measles virus
aagaaccuagccuua

SEQ ID NO: 3085896 - RNA, 18 nt, Measles virus
acuaugacaucccaggga

SEQ ID NO: 3085897 - RNA, 19 nt, Measles virus
agauucaagguuaguccca

SEQ ID NO: 3085898 - RNA, 20 nt, Measles virus
cagccccgacacaaggccac

SEQ ID NO: 3085899 - RNA, 14 nt, Measles virus
agcccaccugaaau

SEQ ID NO: 3085900 - RNA, 16 nt, Measles virus
cccgacacaaggccac

SEQ ID NO: 3085901 - RNA, 22 nt, Measles virus
ggccacaacccgcgcaccccag

SEQ ID NO: 3085902 - RNA, 20 nt, Measles virus
aucuuauacccugaaguuca

SEQ ID NO: 3085903 - RNA, 23 nt, Measles virus
caaccuacgauacuuccaggguu

SEQ ID NO: 3085904 - RNA, 15 nt, Measles virus
agggaaacugcucag

SEQ ID NO: 3085905 - RNA, 15 nt, Measles virus
acgcaagaaccccac

SEQ ID NO: 3085906 - RNA, 17 nt, Measles virus
caacgaucuugccaagu

SEQ ID NO: 3085907 - RNA, 14 nt, Measles virus
gagccucagcacca

SEQ ID NO: 3085908 - RNA, 17 nt, Measles virus
gggcaccauugaaggau

SEQ ID NO: 3085909 - RNA, 13 nt, Measles virus
uagggauccccgc

SEQ ID NO: 3085910 - RNA, 16 nt, Measles virus
gccacagcugcucaga

SEQ ID NO: 3085911 - RNA, 23 nt, Measles virus
uaucaacggaugauccagugaua

SEQ ID NO: 3085912 - RNA, 14 nt, Measles virus
aaucugaaaacagc

SEQ ID NO: 3085913 - RNA, 23 nt, Measles virus
ccugaaacuccaauccagaggca

SEQ ID NO: 3085914 - RNA, 20 nt, Measles virus
acccugacaagauccuaaca

SEQ ID NO: 3085915 - RNA, 20 nt, Measles virus
uccaggcaguuuugcagcca

SEQ ID NO: 3085916 - RNA, 15 nt, Measles virus
gccaucaccccgcaa

SEQ ID NO: 3085917 - RNA, 13 nt, Measles virus
uacauugcugccg

SEQ ID NO: 3085918 - RNA, 23 nt, Measles virus
ugagaugaggucagugauuaaau

SEQ ID NO: 3085919 - RNA, 17 nt, Measles virus
ggcucaaauugcucaga

SEQ ID NO: 3085920 - RNA, 15 nt, Measles virus
cuuagggccaaggaa

SEQ ID NO: 3085921 - RNA, 15 nt, Measles virus
agauguuuuccuuaa

SEQ ID NO: 3085922 - RNA, 19 nt, Measles virus
augacucguuccagccauc

SEQ ID NO: 3085923 - RNA, 18 nt, Measles virus
ggaaacuacuaaucaggc

SEQ ID NO: 3085924 - RNA, 15 nt, Measles virus
gaaacugcucagggc

SEQ ID NO: 3085925 - RNA, 23 nt, Measles virus
caaucaguuccuagcugucucaa

SEQ ID NO: 3085926 - RNA, 12 nt, Measles virus
caguagggccag

SEQ ID NO: 3085927 - RNA, 22 nt, Measles virus
ccauuccuggacuugggaagga

SEQ ID NO: 3085928 - RNA, 19 nt, Measles virus
ucccccggucuccuccucu

SEQ ID NO: 3085929 - RNA, 16 nt, Measles virus
agagucauagauccug

SEQ ID NO: 3085930 - RNA, 20 nt, Measles virus
cgcggcaccgcgcccccacc

SEQ ID NO: 3085931 - RNA, 11 nt, Measles virus
uggcugcugaa

SEQ ID NO: 3085932 - RNA, 19 nt, Measles virus
uccaagacuacaucaauaa

SEQ ID NO: 3085933 - RNA, 15 nt, Measles virus
ucgaagggaccaaaa

SEQ ID NO: 3085934 - RNA, 14 nt, Measles virus
caggccgagcacug

SEQ ID NO: 3085935 - RNA, 21 nt, Measles virus
guaggauaguuauuaacagag

SEQ ID NO: 3085936 - RNA, 18 nt, Measles virus
cccaacgcaagaacccca

SEQ ID NO: 3085937 - RNA, 23 nt, Measles virus
ugcccaaguauguugcaacccaa

SEQ ID NO: 3085938 - RNA, 17 nt, Measles virus
cgcuggacaccccgcag

SEQ ID NO: 3085939 - RNA, 17 nt, Measles virus
ccucgugggacccccga

SEQ ID NO: 3085940 - RNA, 22 nt, Measles virus
cgacagcaaguguggacaccag

SEQ ID NO: 3085941 - RNA, 21 nt, Measles virus
cagcugcacagucacucggga

SEQ ID NO: 3085942 - RNA, 12 nt, Measles virus
acaucuuaugau

SEQ ID NO: 3085943 - RNA, 22 nt, Measles virus
cucugggauggugggcauggga

SEQ ID NO: 3085944 - RNA, 23 nt, Measles virus
cucaagaaaucuccaggcaucaa

SEQ ID NO: 3085945 - RNA, 20 nt, Measles virus
guuccuagcugucucaaagg

SEQ ID NO: 3085946 - RNA, 16 nt, Measles virus
augccucuuagccugg

SEQ ID NO: 3085947 - RNA, 15 nt, Measles virus
aaggaagauccguga

SEQ ID NO: 3085948 - RNA, 18 nt, Measles virus
aaugagcaagacucucca

SEQ ID NO: 3085949 - RNA, 23 nt, Measles virus
cacucaauuccccacccccaaag

SEQ ID NO: 3085950 - RNA, 12 nt, Measles virus
cgaccccacugc

SEQ ID NO: 3085951 - RNA, 18 nt, Measles virus
uccuccucuucucgaagg

SEQ ID NO: 3085952 - RNA, 15 nt, Measles virus
gauggcagaagagca

SEQ ID NO: 3085953 - RNA, 21 nt, Measles virus
agauuucccacaagucuccuc

SEQ ID NO: 3085954 - RNA, 13 nt, Measles virus
caggaucuccaau

SEQ ID NO: 3085955 - RNA, 22 nt, Measles virus
ccaccaaccgcauccccacagc

SEQ ID NO: 3085956 - RNA, 16 nt, Measles virus
gcgauuggcccuggga

SEQ ID NO: 3085957 - RNA, 14 nt, Measles virus
acaguagaacucag

SEQ ID NO: 3085958 - RNA, 21 nt, Measles virus
cgaacucaaucccgaccugaa

SEQ ID NO: 3085959 - RNA, 18 nt, Measles virus
cuccaucgugcagccauc

SEQ ID NO: 3085960 - RNA, 19 nt, Measles virus
caccccccgaaaaccagag

SEQ ID NO: 3085961 - RNA, 19 nt, Measles virus
cuugggaaaacucucaaug

SEQ ID NO: 3085962 - RNA, 16 nt, Measles virus
aucggcucacuggccg

SEQ ID NO: 3085963 - RNA, 14 nt, Measles virus
aauucgcagcccuc

SEQ ID NO: 3085964 - RNA, 22 nt, Measles virus
gcauggucagaaauaucagaca

SEQ ID NO: 3085965 - RNA, 17 nt, Measles virus
ugaagugggccugagga

SEQ ID NO: 3085966 - RNA, 16 nt, Measles virus
caacuccagggaauga

SEQ ID NO: 3085967 - RNA, 12 nt, Measles virus
auagacaucaga

SEQ ID NO: 3085968 - RNA, 21 nt, Measles virus
cagaaggaggggagauccacg

SEQ ID NO: 3085969 - RNA, 17 nt, Measles virus
ccaccagcucccagacu

SEQ ID NO: 3085970 - RNA, 19 nt, Measles virus
aggagacuacugagaacag

SEQ ID NO: 3085971 - RNA, 19 nt, Measles virus
agaccgcagugcccagcaa

SEQ ID NO: 3085972 - RNA, 20 nt, Measles virus
ggaucuccaauauguuuugg

SEQ ID NO: 3085973 - RNA, 12 nt, Measles virus
ccgacagccagc

SEQ ID NO: 3085974 - RNA, 12 nt, Measles virus
aagcacacccac

SEQ ID NO: 3085975 - RNA, 20 nt, Measles virus
cgaggacugccaugccccaa

SEQ ID NO: 3085976 - RNA, 20 nt, Measles virus
ccucauaaugacagccagaa

SEQ ID NO: 3085977 - RNA, 22 nt, Measles virus
gucccaaccucuucacuguucc

SEQ ID NO: 3085978 - RNA, 17 nt, Measles virus
agacggggggccccccc

SEQ ID NO: 3085979 - RNA, 19 nt, Measles virus
auucagaucggucaaugca

SEQ ID NO: 3085980 - RNA, 20 nt, Measles virus
cuccggaacccuaauccugc

SEQ ID NO: 3085981 - RNA, 16 nt, Measles virus
cccaguagggccagca

SEQ ID NO: 3085982 - RNA, 17 nt, Measles virus
aucaauccaccacaucc

SEQ ID NO: 3085983 - RNA, 20 nt, Measles virus
aaggucgcucugauccucua

SEQ ID NO: 3085984 - RNA, 14 nt, Measles virus
cacgucgacacaga

SEQ ID NO: 3085985 - RNA, 17 nt, Measles virus
acaguagaacucagagg

SEQ ID NO: 3085986 - RNA, 18 nt, Measles virus
ggccgaaguucucaagaa

SEQ ID NO: 3085987 - RNA, 18 nt, Measles virus
aguaggagacacaagaga

SEQ ID NO: 3085988 - RNA, 16 nt, Measles virus
ucauaaugacagccag

SEQ ID NO: 3085989 - RNA, 19 nt, Measles virus
augccucuuagccuggaca

SEQ ID NO: 3085990 - RNA, 18 nt, Measles virus
cgguguaccugcacagaa

SEQ ID NO: 3085991 - RNA, 13 nt, Measles virus
ucgaucgcuccga

SEQ ID NO: 3085992 - RNA, 15 nt, Measles virus
cucugauccucuaca

SEQ ID NO: 3085993 - RNA, 22 nt, Measles virus
ucacuggccgucgaggaagcca

SEQ ID NO: 3085994 - RNA, 18 nt, Measles virus
gugaaauagacaucagaa

SEQ ID NO: 3085995 - RNA, 14 nt, Measles virus
cuccgaacacagac

SEQ ID NO: 3085996 - RNA, 13 nt, Measles virus
caucgacaaugca

SEQ ID NO: 3085997 - RNA, 20 nt, Measles virus
ucauaaugacagccagaagg

SEQ ID NO: 3085998 - RNA, 20 nt, Measles virus
ccucggaaccaucagggcca

SEQ ID NO: 3085999 - RNA, 16 nt, Measles virus
cuccaauccagaggca

SEQ ID NO: 3086000 - RNA, 14 nt, Measles virus
ccccaguagggcca

SEQ ID NO: 3086001 - RNA, 12 nt, Measles virus
aauucuaccugg

SEQ ID NO: 3086002 - RNA, 14 nt, Measles virus
gaucggucaaugca

SEQ ID NO: 3086003 - RNA, 16 nt, Measles virus
agauccauaagagccu

SEQ ID NO: 3086004 - RNA, 18 nt, Measles virus
caauauauuaaagaaaac

SEQ ID NO: 3086005 - RNA, 16 nt, Measles virus
ccgaacacagaccacc

SEQ ID NO: 3086006 - RNA, 15 nt, Measles virus
uccagaggacagcug

SEQ ID NO: 3086007 - RNA, 14 nt, Measles virus
cgacaacacggaca

SEQ ID NO: 3086008 - RNA, 17 nt, Measles virus
cuccacacucuggcugu

SEQ ID NO: 3086009 - RNA, 16 nt, Measles virus
aggcguugccacagcu

SEQ ID NO: 3086010 - RNA, 17 nt, Measles virus
cgcagugcccagcaaua

SEQ ID NO: 3086011 - RNA, 12 nt, Measles virus
caucaagcaccg

SEQ ID NO: 3086012 - RNA, 14 nt, Measles virus
acagagaucuacga

SEQ ID NO: 3086013 - RNA, 16 nt, Measles virus
ucaagguuagucccaa

SEQ ID NO: 3086014 - RNA, 17 nt, Measles virus
ccccaggggccgacagc

SEQ ID NO: 3086015 - RNA, 15 nt, Measles virus
gaccacccugggcca

SEQ ID NO: 3086016 - RNA, 16 nt, Measles virus
cuaggcguugccacag

SEQ ID NO: 3086017 - RNA, 18 nt, Measles virus
aacccuaauccugcccua

SEQ ID NO: 3086018 - RNA, 14 nt, Measles virus
gggugcaagaucau

SEQ ID NO: 3086019 - RNA, 15 nt, Measles virus
ucaaacucaguucca

SEQ ID NO: 3086020 - RNA, 15 nt, Measles virus
uccuaaaaaagggaa

SEQ ID NO: 3086021 - RNA, 17 nt, Measles virus
auuugcaauauauuaaa

SEQ ID NO: 3086022 - RNA, 18 nt, Measles virus
aguuucuauucccagcuu

SEQ ID NO: 3086023 - RNA, 22 nt, Measles virus
gcguccuccucgugggaccccc

SEQ ID NO: 3086024 - RNA, 18 nt, Measles virus
guuacaguguuaucaugu

SEQ ID NO: 3086025 - RNA, 19 nt, Measles virus
augggagucagcugcacag

SEQ ID NO: 3086026 - RNA, 18 nt, Measles virus
gcccagcaauacccgaaa

SEQ ID NO: 3086027 - RNA, 23 nt, Measles virus
ccuagguaguuaggcauuauuug

SEQ ID NO: 3086028 - RNA, 17 nt, Measles virus
uauucccagcuuugucu

SEQ ID NO: 3086029 - RNA, 17 nt, Measles virus
caacuuaccugccaacc

SEQ ID NO: 3086030 - RNA, 13 nt, Measles virus
acccugacaagau

SEQ ID NO: 3086031 - RNA, 18 nt, Measles virus
gacccuacacugugucag

SEQ ID NO: 3086032 - RNA, 13 nt, Measles virus
aaacuuugaaaau

SEQ ID NO: 3086033 - RNA, 20 nt, Measles virus
ucggcaugggacaucaaagg

SEQ ID NO: 3086034 - RNA, 16 nt, Measles virus
cagagaucucacuugg

SEQ ID NO: 3086035 - RNA, 13 nt, Measles virus
ucuauucccagcu

SEQ ID NO: 3086036 - RNA, 18 nt, Measles virus
uagcugucucaaagggaa

SEQ ID NO: 3086037 - RNA, 18 nt, Measles virus
gaucccugggggaccccc

SEQ ID NO: 3086038 - RNA, 21 nt, Measles virus
gguuacucuggaggagcagau

SEQ ID NO: 3086039 - RNA, 15 nt, Measles virus
ucagaacaucaagca

SEQ ID NO: 3086040 - RNA, 15 nt, Measles virus
aggaacccccagcaa

SEQ ID NO: 3086041 - RNA, 18 nt, Measles virus
cacuggccgucgaggaag

SEQ ID NO: 3086042 - RNA, 15 nt, Measles virus
agccuaaucugagca

SEQ ID NO: 3086043 - RNA, 16 nt, Measles virus
uuuaaucggccagaag

SEQ ID NO: 3086044 - RNA, 17 nt, Measles virus
agauuacauuuucauaa

SEQ ID NO: 3086045 - RNA, 18 nt, Measles virus
agaucaacaggcaaaaua

SEQ ID NO: 3086046 - RNA, 15 nt, Measles virus
gcgagaggccagcca

SEQ ID NO: 3086047 - RNA, 18 nt, Measles virus
gggaguacgacuucagag

SEQ ID NO: 3086048 - RNA, 16 nt, Measles virus
cuccaucgugcagcca

SEQ ID NO: 3086049 - RNA, 12 nt, Measles virus
ccaauauguuuu

SEQ ID NO: 3086050 - RNA, 17 nt, Measles virus
uaacaaaaagggagaac

SEQ ID NO: 3086051 - RNA, 17 nt, Measles virus
agguccacacagccgcc

SEQ ID NO: 3086052 - RNA, 13 nt, Measles virus
caagaagaccuua

SEQ ID NO: 3086053 - RNA, 16 nt, Measles virus
cgaccagacccagcac

SEQ ID NO: 3086054 - RNA, 19 nt, Measles virus
ccccacuaacccuccucac

SEQ ID NO: 3086055 - RNA, 15 nt, Measles virus
ugcacuuaaugcaau

SEQ ID NO: 3086056 - RNA, 19 nt, Measles virus
cccuaggcguugccacagc

SEQ ID NO: 3086057 - RNA, 21 nt, Measles virus
ucccgggaaaggaacccccag

SEQ ID NO: 3086058 - RNA, 16 nt, Measles virus
gcagugcccagcaaua

SEQ ID NO: 3086059 - RNA, 17 nt, Measles virus
cacgcuuacagccugga

SEQ ID NO: 3086060 - RNA, 17 nt, Measles virus
ccgagaucccagaauaa

SEQ ID NO: 3086061 - RNA, 16 nt, Measles virus
uccccacccccaaagg

SEQ ID NO: 3086062 - RNA, 12 nt, Measles virus
auccagcaucaa

SEQ ID NO: 3086063 - RNA, 19 nt, Measles virus
agggcucaaauugcucaga

SEQ ID NO: 3086064 - RNA, 17 nt, Measles virus
caagcgagaggccagcc

SEQ ID NO: 3086065 - RNA, 17 nt, Measles virus
gagauauccauccaggc

SEQ ID NO: 3086066 - RNA, 22 nt, Measles virus
gaccaagcgagaggccagccag

SEQ ID NO: 3086067 - RNA, 12 nt, Measles virus
agacccugacaa

SEQ ID NO: 3086068 - RNA, 16 nt, Measles virus
agaaaacuuugaaaau

SEQ ID NO: 3086069 - RNA, 13 nt, Measles virus
ccagaaggcccgg

SEQ ID NO: 3086070 - RNA, 17 nt, Measles virus
cuccuaaaaaagggaaa

SEQ ID NO: 3086071 - RNA, 17 nt, Measles virus
ucuccgauguccaagac

SEQ ID NO: 3086072 - RNA, 19 nt, Measles virus
agauguuuuccuuaaugau

SEQ ID NO: 3086073 - RNA, 18 nt, Measles virus
agaguugucacaacugag

SEQ ID NO: 3086074 - RNA, 22 nt, Measles virus
guacgacuucagagaucucacu

SEQ ID NO: 3086075 - RNA, 21 nt, Measles virus
cgcagcccucugucacaggga

SEQ ID NO: 3086076 - RNA, 23 nt, Measles virus
ugcuggggguuguugaggacagc

SEQ ID NO: 3086077 - RNA, 19 nt, Measles virus
ccaggcaucaagcacuggg

SEQ ID NO: 3086078 - RNA, 17 nt, Measles virus
gacaacacggacagaug

SEQ ID NO: 3086079 - RNA, 16 nt, Measles virus
cgagcauucggguccc

SEQ ID NO: 3086080 - RNA, 16 nt, Measles virus
aaucugguggacauau

SEQ ID NO: 3086081 - RNA, 22 nt, Measles virus
aauucgcuguacuccaaaguca

SEQ ID NO: 3086082 - RNA, 17 nt, Measles virus
gguucagggcuucugau

SEQ ID NO: 3086083 - RNA, 22 nt, Measles virus
agucagauacauguggaaacug

SEQ ID NO: 3086084 - RNA, 19 nt, Measles virus
augaagguacuuaucauga

SEQ ID NO: 3086085 - RNA, 15 nt, Measles virus
ggugaacucaacucu

SEQ ID NO: 3086086 - RNA, 13 nt, Measles virus
ucucaagcaucau

SEQ ID NO: 3086087 - RNA, 15 nt, Measles virus
uccgggcucucaagg

SEQ ID NO: 3086088 - RNA, 23 nt, Measles virus
ugggcaugggagucagcugcaca

SEQ ID NO: 3086089 - RNA, 19 nt, Measles virus
uagcugucucaaagggaaa

SEQ ID NO: 3086090 - RNA, 15 nt, Measles virus
acuuagggccaagga

SEQ ID NO: 3086091 - RNA, 23 nt, Measles virus
ccccaggggccgacagccagcau

SEQ ID NO: 3086092 - RNA, 18 nt, Measles virus
cugcacagucacucggga

SEQ ID NO: 3086093 - RNA, 22 nt, Measles virus
uaccaccuacagugauggcagg

SEQ ID NO: 3086094 - RNA, 14 nt, Measles virus
uguaaucaacacau

SEQ ID NO: 3086095 - RNA, 22 nt, Measles virus
ccaaccccgaaggucgcuccga

SEQ ID NO: 3086096 - RNA, 16 nt, Measles virus
ccagcagccgacagca

SEQ ID NO: 3086097 - RNA, 13 nt, Measles virus
cucucaucucaca

SEQ ID NO: 3086098 - RNA, 16 nt, Measles virus
caccccccgaaaacca

SEQ ID NO: 3086099 - RNA, 15 nt, Measles virus
aucggucaaugcagu

SEQ ID NO: 3086100 - RNA, 16 nt, Measles virus
cucaagcuucagguga

SEQ ID NO: 3086101 - RNA, 12 nt, Measles virus
cugcacucggga

SEQ ID NO: 3086102 - RNA, 13 nt, Measles virus
uuaguacaaccua

SEQ ID NO: 3086103 - RNA, 23 nt, Measles virus
caaccgacaugcgauccuggguc

SEQ ID NO: 3086104 - RNA, 13 nt, Measles virus
cucacucugggau

SEQ ID NO: 3086105 - RNA, 14 nt, Measles virus
acagaacagccccg

SEQ ID NO: 3086106 - RNA, 14 nt, Measles virus
gccaaccccaugcc

SEQ ID NO: 3086107 - RNA, 20 nt, Measles virus
caaccugucuuacagccuga

SEQ ID NO: 3086108 - RNA, 20 nt, Measles virus
auacgaaguuucuauuccca

SEQ ID NO: 3086109 - RNA, 18 nt, Measles virus
cuacacugugucagaaca

SEQ ID NO: 3086110 - RNA, 14 nt, Measles virus
aaauucgcagcccu

SEQ ID NO: 3086111 - RNA, 17 nt, Measles virus
uguggacaccaggcggc

SEQ ID NO: 3086112 - RNA, 20 nt, Measles virus
gccuacccuccaucauuguu

SEQ ID NO: 3086113 - RNA, 19 nt, Measles virus
ccagaagacuccacggacc

SEQ ID NO: 3086114 - RNA, 19 nt, Measles virus
caguaacggcugcugaaaa

SEQ ID NO: 3086115 - RNA, 15 nt, Measles virus
aagaucauuggugau

SEQ ID NO: 3086116 - RNA, 14 nt, Measles virus
cuccaaacacccac

SEQ ID NO: 3086117 - RNA, 16 nt, Measles virus
gaagcccaguccacac

SEQ ID NO: 3086118 - RNA, 23 nt, Measles virus
uccaggcaguuuugcagccauca

SEQ ID NO: 3086119 - RNA, 17 nt, Measles virus
cccaguagggccagcac

SEQ ID NO: 3086120 - RNA, 15 nt, Measles virus
caaucaaggaagcag

SEQ ID NO: 3086121 - RNA, 16 nt, Measles virus
gauccucuccccccgg

SEQ ID NO: 3086122 - RNA, 21 nt, Measles virus
acacugugucagaacaucaag

SEQ ID NO: 3086123 - RNA, 18 nt, Measles virus
gugucaucuauagucacu

SEQ ID NO: 3086124 - RNA, 21 nt, Measles virus
cucaaagggaaacugcucagg

SEQ ID NO: 3086125 - RNA, 17 nt, Measles virus
gcaaccgaaccagaguc

SEQ ID NO: 3086126 - RNA, 19 nt, Measles virus
gguugcuagccauugcagg

SEQ ID NO: 3086127 - RNA, 15 nt, Measles virus
ccaaugccugaggga

SEQ ID NO: 3086128 - RNA, 12 nt, Measles virus
caauucucaaac

SEQ ID NO: 3086129 - RNA, 20 nt, Measles virus
gaggggagguuaaugacaga

SEQ ID NO: 3086130 - RNA, 20 nt, Measles virus
aagggaaccgggucacggag

SEQ ID NO: 3086131 - RNA, 20 nt, Measles virus
gauuauaaacaauguggaag

SEQ ID NO: 3086132 - RNA, 20 nt, Measles virus
uuggagucaucggaccagau

SEQ ID NO: 3086133 - RNA, 20 nt, Measles virus
gaccggggaucugcucccau

SEQ ID NO: 3086134 - RNA, 18 nt, Measles virus
cucuucgucaucaagcaa

SEQ ID NO: 3086135 - RNA, 20 nt, Measles virus
aggcccggacaaaaaagccc

SEQ ID NO: 3086136 - RNA, 23 nt, Measles virus
auccagugauagauaggcuuuac

SEQ ID NO: 3086137 - RNA, 17 nt, Measles virus
gcacuccacacucuggc

SEQ ID NO: 3086138 - RNA, 22 nt, Measles virus
ccaagcgagaggccagccagca

SEQ ID NO: 3086139 - RNA, 23 nt, Measles virus
caggcaguuuugcagccaucagu

SEQ ID NO: 3086140 - RNA, 19 nt, Measles virus
caaaguucuguagaccgca

SEQ ID NO: 3086141 - RNA, 21 nt, Measles virus
ccaagcgagaggccagccagc

SEQ ID NO: 3086142 - RNA, 16 nt, Measles virus
gccaaggaugagcacg

SEQ ID NO: 3086143 - RNA, 15 nt, Measles virus
cuuauguuuugcugg

SEQ ID NO: 3086144 - RNA, 22 nt, Measles virus
aaccagagggagcccccaacca

SEQ ID NO: 3086145 - RNA, 19 nt, Measles virus
cagcccucugucacaggga

SEQ ID NO: 3086146 - RNA, 15 nt, Measles virus
ccaccagcucccaga

SEQ ID NO: 3086147 - RNA, 22 nt, Measles virus
caaaacggguuuucugaugaag

SEQ ID NO: 3086148 - RNA, 13 nt, Measles virus
cgaccccccucau

SEQ ID NO: 3086149 - RNA, 13 nt, Measles virus
aacuuugaaaaua

SEQ ID NO: 3086150 - RNA, 13 nt, Measles virus
aggacagcugcug

SEQ ID NO: 3086151 - RNA, 16 nt, Measles virus
aagccauggcagcaug

SEQ ID NO: 3086152 - RNA, 18 nt, Measles virus
cacuugcugcucuccaaa

SEQ ID NO: 3086153 - RNA, 14 nt, Measles virus
caccgcauccagca

SEQ ID NO: 3086154 - RNA, 17 nt, Measles virus
cagccgccagccaacca

SEQ ID NO: 3086155 - RNA, 17 nt, Measles virus
uuaauauguugcugcag

SEQ ID NO: 3086156 - RNA, 22 nt, Measles virus
cagaugucgaacucaaucccga

SEQ ID NO: 3086157 - RNA, 17 nt, Measles virus
gccgacagccagcaucg

SEQ ID NO: 3086158 - RNA, 21 nt, Measles virus
cccaggggccgacagccagca

SEQ ID NO: 3086159 - RNA, 14 nt, Measles virus
ggaucaacugaagg

SEQ ID NO: 3086160 - RNA, 16 nt, Measles virus
acccuggaaggacacc

SEQ ID NO: 3086161 - RNA, 17 nt, Measles virus
uccacacucuggcuguc

SEQ ID NO: 3086162 - RNA, 14 nt, Measles virus
ggacguagggacaa

SEQ ID NO: 3086163 - RNA, 23 nt, Measles virus
uuaaucaagacccugacaagauc

SEQ ID NO: 3086164 - RNA, 16 nt, Measles virus
cacagguaggcacacc

SEQ ID NO: 3086165 - RNA, 22 nt, Measles virus
ccgaggugacccaaccgcaggc

SEQ ID NO: 3086166 - RNA, 22 nt, Measles virus
ugccagccgacaacuccaggga

SEQ ID NO: 3086167 - RNA, 20 nt, Measles virus
aucagaagauaaucuccaag

SEQ ID NO: 3086168 - RNA, 14 nt, Measles virus
cagaguccagacca

SEQ ID NO: 3086169 - RNA, 21 nt, Measles virus
caagcacagaacagccccgac

SEQ ID NO: 3086170 - RNA, 21 nt, Measles virus
cuuagguguaaucaacacauu

SEQ ID NO: 3086171 - RNA, 12 nt, Measles virus
cugcaugcugca

SEQ ID NO: 3086172 - RNA, 14 nt, Measles virus
caagcgagaggcca

SEQ ID NO: 3086173 - RNA, 21 nt, Measles virus
acucaacccgaaccagcaccc

SEQ ID NO: 3086174 - RNA, 17 nt, Measles virus
ucaaggacgugcugaca

SEQ ID NO: 3086175 - RNA, 19 nt, Measles virus
ccacaacccgcgcacccca

SEQ ID NO: 3086176 - RNA, 20 nt, Measles virus
aaaugccuucuacaaagaca

SEQ ID NO: 3086177 - RNA, 16 nt, Measles virus
gacaucaaaauccuau

SEQ ID NO: 3086178 - RNA, 16 nt, Measles virus
ugcucuccaaagggaa

SEQ ID NO: 3086179 - RNA, 15 nt, Measles virus
aagacccugacaaga

SEQ ID NO: 3086180 - RNA, 16 nt, Measles virus
auaucagcauauccac

SEQ ID NO: 3086181 - RNA, 21 nt, Measles virus
gcucccagacucggccaucac

SEQ ID NO: 3086182 - RNA, 17 nt, Measles virus
auaguaagaauccaggc

SEQ ID NO: 3086183 - RNA, 16 nt, Measles virus
caugacccugaguuca

SEQ ID NO: 3086184 - RNA, 18 nt, Measles virus
ucgcagcccucugucaca

SEQ ID NO: 3086185 - RNA, 14 nt, Measles virus
ggcugcugaagaac

SEQ ID NO: 3086186 - RNA, 17 nt, Measles virus
aucaguaaggagucuca

SEQ ID NO: 3086187 - RNA, 17 nt, Measles virus
aggugcaccugcgggga

SEQ ID NO: 3086188 - RNA, 17 nt, Measles virus
gcaggcuggugccccag

SEQ ID NO: 3086189 - RNA, 15 nt, Measles virus
ugcaucaauccucug

SEQ ID NO: 3086190 - RNA, 14 nt, Measles virus
agauaacagccggc

SEQ ID NO: 3086191 - RNA, 16 nt, Measles virus
aaucagccuaaaguca

SEQ ID NO: 3086192 - RNA, 23 nt, Measles virus
agguuuuccaaugccugagggac

SEQ ID NO: 3086193 - RNA, 22 nt, Measles virus
ugcccacagguaggcacaccaa

SEQ ID NO: 3086194 - RNA, 16 nt, Measles virus
ccugucuuacagccug

SEQ ID NO: 3086195 - RNA, 21 nt, Measles virus
uccauaagagccucagcacca

SEQ ID NO: 3086196 - RNA, 20 nt, Measles virus
ucugacaaaauuaaauuccu

SEQ ID NO: 3086197 - RNA, 12 nt, Measles virus
gcccccaccccc

SEQ ID NO: 3086198 - RNA, 14 nt, Measles virus
uguagccaugcugg

SEQ ID NO: 3086199 - RNA, 14 nt, Measles virus
agccgacaacucca

SEQ ID NO: 3086200 - RNA, 19 nt, Measles virus
ucaaagggaaacugcucag

SEQ ID NO: 3086201 - RNA, 15 nt, Measles virus
acagcagggcucaau

SEQ ID NO: 3086202 - RNA, 19 nt, Measles virus
acuccaucgugcagccauc

SEQ ID NO: 3086203 - RNA, 18 nt, Measles virus
aacaaguugguaugucaa

SEQ ID NO: 3086204 - RNA, 17 nt, Measles virus
ucacuguuccaaucaag

SEQ ID NO: 3086205 - RNA, 16 nt, Measles virus
cgaaccgcacaagcga

SEQ ID NO: 3086206 - RNA, 18 nt, Measles virus
caaguauuuuaaggacaa

SEQ ID NO: 3086207 - RNA, 15 nt, Measles virus
accgcgcccccaccc

SEQ ID NO: 3086208 - RNA, 15 nt, Measles virus
ggcuccgaauugagg

SEQ ID NO: 3086209 - RNA, 16 nt, Measles virus
cuagguaguuaggcau

SEQ ID NO: 3086210 - RNA, 12 nt, Measles virus
ccgagcacuggc

SEQ ID NO: 3086211 - RNA, 23 nt, Measles virus
ucaagcaaaaugggcugucccga

SEQ ID NO: 3086212 - RNA, 19 nt, Measles virus
uauuuaacauagaagacaa

SEQ ID NO: 3086213 - RNA, 14 nt, Measles virus
caccaggcggccca

SEQ ID NO: 3086214 - RNA, 15 nt, Measles virus
ccgaccagacccagc

SEQ ID NO: 3086215 - RNA, 21 nt, Measles virus
uagggaguacgacuucagaga

SEQ ID NO: 3086216 - RNA, 21 nt, Measles virus
aagauaguagcuauccuggag

SEQ ID NO: 3086217 - RNA, 13 nt, Measles virus
caugccagagggg

SEQ ID NO: 3086218 - RNA, 11 nt, Measles virus
cgacagccagc

SEQ ID NO: 3086219 - RNA, 16 nt, Measles virus
cagcuuacgggacccc

SEQ ID NO: 3086220 - RNA, 15 nt, Measles virus
acccuaauccugccc

SEQ ID NO: 3086221 - RNA, 21 nt, Measles virus
gacaccucagagauucacuga

SEQ ID NO: 3086222 - RNA, 13 nt, Measles virus
auuuaacauagaa

SEQ ID NO: 3086223 - RNA, 23 nt, Measles virus
cuuaccugccaaccccaugccag

SEQ ID NO: 3086224 - RNA, 14 nt, Measles virus
cuacuggaggccag

SEQ ID NO: 3086225 - RNA, 16 nt, Measles virus
gcaauauauuaaagaa

SEQ ID NO: 3086226 - RNA, 17 nt, Measles virus
cccacuacaaucagagg

SEQ ID NO: 3086227 - RNA, 22 nt, Measles virus
gccgucggguuuguuccugaca

SEQ ID NO: 3086228 - RNA, 19 nt, Measles virus
caauauauuaaagaaaacu

SEQ ID NO: 3086229 - RNA, 14 nt, Measles virus
ccaggucagaguca

SEQ ID NO: 3086230 - RNA, 23 nt, Measles virus
ccaaucugcguccuccucguggg

SEQ ID NO: 3086231 - RNA, 23 nt, Measles virus
agcccguugccagccgacaacuc

SEQ ID NO: 3086232 - RNA, 23 nt, Measles virus
cgaccacggcaaccgaaccagag

SEQ ID NO: 3086233 - RNA, 21 nt, Measles virus
cagcaacuggaaggccccucc

SEQ ID NO: 3086234 - RNA, 13 nt, Measles virus
gcguugccacagc

SEQ ID NO: 3086235 - RNA, 18 nt, Measles virus
gcccacuacaaucagagg

SEQ ID NO: 3086236 - RNA, 22 nt, Measles virus
ccucacgcuuacagccuggagg

SEQ ID NO: 3086237 - RNA, 19 nt, Measles virus
gagucagauacauguggaa

SEQ ID NO: 3086238 - RNA, 16 nt, Measles virus
ucacagggaagauucu

SEQ ID NO: 3086239 - RNA, 21 nt, Measles virus
gagaugauauuggcuguucag

SEQ ID NO: 3086240 - RNA, 20 nt, Measles virus
ccaccuacagugauggcagg

SEQ ID NO: 3086241 - RNA, 15 nt, Measles virus
gacaugcuuccagca

SEQ ID NO: 3086242 - RNA, 18 nt, Measles virus
agcaaguguggacaccag

SEQ ID NO: 3086243 - RNA, 23 nt, Measles virus
acagccuuggccaaaauacacga

SEQ ID NO: 3086244 - RNA, 13 nt, Measles virus
uagcuauccugga

SEQ ID NO: 3086245 - RNA, 22 nt, Measles virus
ccccgacacaaggccaccacca

SEQ ID NO: 3086246 - RNA, 19 nt, Measles virus
ggagccaacgaucuugcca

SEQ ID NO: 3086247 - RNA, 20 nt, Measles virus
ccaagcgagaggccagccag

SEQ ID NO: 3086248 - RNA, 20 nt, Measles virus
ccaggcaguuuugcagccau

SEQ ID NO: 3086249 - RNA, 16 nt, Measles virus
ugguaguucaguugag

SEQ ID NO: 3086250 - RNA, 15 nt, Measles virus
ugaguccucugcucc

SEQ ID NO: 3086251 - RNA, 13 nt, Measles virus
caacaccccacua

SEQ ID NO: 3086252 - RNA, 12 nt, Measles virus
guuaauugaagc

SEQ ID NO: 3086253 - RNA, 22 nt, Measles virus
gaucugacaauguaccuaaagg

SEQ ID NO: 3086254 - RNA, 19 nt, Measles virus
acaucaguaucccacagcc

SEQ ID NO: 3086255 - RNA, 24 nt, Measles virus
aagaaaacuuugaaaauacgaagu

SEQ ID NO: 3086256 - RNA, 16 nt, Measles virus
ggaagccauggcagca

SEQ ID NO: 3086257 - RNA, 17 nt, Measles virus
agccccgacacaaggcc

SEQ ID NO: 3086258 - RNA, 22 nt, Measles virus
ccggcccccccggugcccacag

SEQ ID NO: 3086259 - RNA, 14 nt, Measles virus
acugaaauacauga

SEQ ID NO: 3086260 - RNA, 14 nt, Measles virus
gauaacaggauucc

SEQ ID NO: 3086261 - RNA, 23 nt, Measles virus
ugaagugggccugaggacaccuc

SEQ ID NO: 3086262 - RNA, 20 nt, Measles virus
uagacuccaucgugcagcca

SEQ ID NO: 3086263 - RNA, 16 nt, Measles virus
aagcaucaugauugcc

SEQ ID NO: 3086264 - RNA, 13 nt, Measles virus
aaugacagccaga

SEQ ID NO: 3086265 - RNA, 15 nt, Measles virus
uuggccaccccugac

SEQ ID NO: 3086266 - RNA, 21 nt, Measles virus
auccgugagcuccuaaaaaag

SEQ ID NO: 3086267 - RNA, 18 nt, Measles virus
aucuuacagggacaucaa

SEQ ID NO: 3086268 - RNA, 20 nt, Measles virus
ggguuacaguguuaucaugu

SEQ ID NO: 3086269 - RNA, 16 nt, Measles virus
aaguucucaagaagcc

SEQ ID NO: 3086270 - RNA, 19 nt, Measles virus
cugguaauucuaccugguc

SEQ ID NO: 3086271 - RNA, 16 nt, Measles virus
agcguuaccugaugac

SEQ ID NO: 3086272 - RNA, 14 nt, Measles virus
uccaccacauccga

SEQ ID NO: 3086273 - RNA, 23 nt, Measles virus
caagucccccggucuccuccucu

SEQ ID NO: 3086274 - RNA, 15 nt, Measles virus
ucuauucccagcuuu

SEQ ID NO: 3086275 - RNA, 19 nt, Measles virus
ccaggcggcccaagcacag

SEQ ID NO: 3086276 - RNA, 15 nt, Measles virus
aaagucauuguguau

SEQ ID NO: 3086277 - RNA, 18 nt, Measles virus
gaccgaauaaaugccuuc

SEQ ID NO: 3086278 - RNA, 13 nt, Measles virus
ucagggccaggug

SEQ ID NO: 3086279 - RNA, 16 nt, Measles virus
cauuagaagcacaggc

SEQ ID NO: 3086280 - RNA, 18 nt, Measles virus
caaucugcguccuccucg

SEQ ID NO: 3086281 - RNA, 23 nt, Measles virus
gcccacagguaggcacaccaacc

SEQ ID NO: 3086282 - RNA, 15 nt, Measles virus
ccgcuggacaccccg

SEQ ID NO: 3086283 - RNA, 14 nt, Measles virus
uaaaucacaaaccc

SEQ ID NO: 3086284 - RNA, 11 nt, Measles virus
ccuccagaaga

SEQ ID NO: 3086285 - RNA, 21 nt, Measles virus
cgcuggacaccccgcagaggu

SEQ ID NO: 3086286 - RNA, 13 nt, Measles virus
uacaaaaugaggg

SEQ ID NO: 3086287 - RNA, 23 nt, Measles virus
ccaagcgagaggccagccagcag

SEQ ID NO: 3086288 - RNA, 14 nt, Measles virus
ggucaaugcagugg

SEQ ID NO: 3086289 - RNA, 22 nt, Measles virus
gccccgacacaaggccaccacc

SEQ ID NO: 3086290 - RNA, 13 nt, Measles virus
acaucaaaacagc

SEQ ID NO: 3086291 - RNA, 19 nt, Measles virus
cagggccaggugcaccugc

SEQ ID NO: 3086292 - RNA, 17 nt, Measles virus
cacgucgacacagaguc

SEQ ID NO: 3086293 - RNA, 20 nt, Measles virus
aaccaugccucucagcaauu

SEQ ID NO: 3086294 - RNA, 12 nt, Measles virus
gccgacagccag

SEQ ID NO: 3086295 - RNA, 15 nt, Measles virus
auagcacccucucag

SEQ ID NO: 3086296 - RNA, 17 nt, Measles virus
gguguaccugcacagaa

SEQ ID NO: 3086297 - RNA, 17 nt, Measles virus
ccgcauccccacagcuc

SEQ ID NO: 3086298 - RNA, 22 nt, Measles virus
ugcccaauauaacucuccucaa

SEQ ID NO: 3086299 - RNA, 13 nt, Measles virus
acagugauggcag

SEQ ID NO: 3086300 - RNA, 17 nt, Measles virus
gcccccaccccccgaaa

SEQ ID NO: 3086301 - RNA, 23 nt, Measles virus
ggcaccgcgcccccaccccccga

SEQ ID NO: 3086302 - RNA, 17 nt, Measles virus
accagagggagccccca

SEQ ID NO: 3086303 - RNA, 21 nt, Measles virus
cccagaccccggcccgcggca

SEQ ID NO: 3086304 - RNA, 18 nt, Measles virus
caccgacaauccaagacg

SEQ ID NO: 3086305 - RNA, 22 nt, Measles virus
agaaucccgagugggcaccauu

SEQ ID NO: 3086306 - RNA, 19 nt, Measles virus
ggaagcacacccaccccac

SEQ ID NO: 3086307 - RNA, 21 nt, Measles virus
cccggacaaaaaagcccccuc

SEQ ID NO: 3086308 - RNA, 14 nt, Measles virus
cagcuuugucuggu

SEQ ID NO: 3086309 - RNA, 16 nt, Measles virus
ccccuagggccuccaa

SEQ ID NO: 3086310 - RNA, 20 nt, Measles virus
gacaguugagcuuaaaauca

SEQ ID NO: 3086311 - RNA, 24 nt, Measles virus
guauuacaccguucccagaagaau

SEQ ID NO: 3086312 - RNA, 18 nt, Measles virus
cgaaguuucuauucccag

SEQ ID NO: 3086313 - RNA, 16 nt, Measles virus
accaguuccagaggac

SEQ ID NO: 3086314 - RNA, 21 nt, Measles virus
cuaccuccaugacccugaguu

SEQ ID NO: 3086315 - RNA, 14 nt, Measles virus
cucugcuccaagaa

SEQ ID NO: 3086316 - RNA, 18 nt, Measles virus
gacaccgggaaucccaga

SEQ ID NO: 3086317 - RNA, 18 nt, Measles virus
guccucugcuccaagaau

SEQ ID NO: 3086318 - RNA, 10 nt, Measles virus
cucuccucaa

SEQ ID NO: 3086319 - RNA, 21 nt, Measles virus
cugaaaaugucaggaaauaca

SEQ ID NO: 3086320 - RNA, 20 nt, Measles virus
gaccacccugggccaccagc

SEQ ID NO: 3086321 - RNA, 14 nt, Measles virus
acacaaggccacca

SEQ ID NO: 3086322 - RNA, 18 nt, Measles virus
gcuagccauugcaggcau

SEQ ID NO: 3086323 - RNA, 13 nt, Measles virus
gcucaagcuucag

SEQ ID NO: 3086324 - RNA, 15 nt, Measles virus
aaggacgugcugaca

SEQ ID NO: 3086325 - RNA, 20 nt, Measles virus
gcaccaaucuagauguaacu

SEQ ID NO: 3086326 - RNA, 18 nt, Measles virus
auugcuaaguuggaggau

SEQ ID NO: 3086327 - RNA, 23 nt, Measles virus
cacugcccgguggucgaggugaa

SEQ ID NO: 3086328 - RNA, 15 nt, Measles virus
gagaggccagccagc

SEQ ID NO: 3086329 - RNA, 15 nt, Measles virus
ccagcagccgacagc

SEQ ID NO: 3086330 - RNA, 14 nt, Measles virus
acagcugcucagau

SEQ ID NO: 3086331 - RNA, 19 nt, Measles virus
accugcaaggaagaggagg

SEQ ID NO: 3086332 - RNA, 14 nt, Measles virus
acgacuucagagau

SEQ ID NO: 3086333 - RNA, 23 nt, Measles virus
gaucuggagaaagcgaugacgac

SEQ ID NO: 3086334 - RNA, 15 nt, Measles virus
cucugucacagggaa

SEQ ID NO: 3086335 - RNA, 14 nt, Measles virus
ucauccacaauguc

SEQ ID NO: 3086336 - RNA, 17 nt, Measles virus
ggaagaggaggcaggca

SEQ ID NO: 3086337 - RNA, 17 nt, Measles virus
uguaaggucgcucugau

SEQ ID NO: 3086338 - RNA, 17 nt, Measles virus
cuagguaguuaggcauu

SEQ ID NO: 3086339 - RNA, 17 nt, Measles virus
aaucccgaccugaaacc

SEQ ID NO: 3086340 - RNA, 12 nt, Measles virus
cacaugagcagu

SEQ ID NO: 3086341 - RNA, 15 nt, Measles virus
cuccaauccagaggc

SEQ ID NO: 3086342 - RNA, 17 nt, Measles virus
cacagccucuccaaguc

SEQ ID NO: 3086343 - RNA, 16 nt, Measles virus
acaugcuuccagcagg

SEQ ID NO: 3086344 - RNA, 15 nt, Measles virus
cauccugauugcagu

SEQ ID NO: 3086345 - RNA, 16 nt, Measles virus
ggacagcugcugaagg

SEQ ID NO: 3086346 - RNA, 21 nt, Measles virus
aauccagccggcuagaggagg

SEQ ID NO: 3086347 - RNA, 15 nt, Measles virus
ggugccccaggucag

SEQ ID NO: 3086348 - RNA, 17 nt, Measles virus
gacuccuuagacagauc

SEQ ID NO: 3086349 - RNA, 20 nt, Measles virus
uauccaaauuguaaucagga

SEQ ID NO: 3086350 - RNA, 18 nt, Measles virus
aaccgcauccccacagcu

SEQ ID NO: 3086351 - RNA, 10 nt, Measles virus
aaaccagagg

SEQ ID NO: 3086352 - RNA, 13 nt, Measles virus
gcauccccacagc

SEQ ID NO: 3086353 - RNA, 23 nt, Measles virus
uuccuagcugucucaaagggaaa

SEQ ID NO: 3086354 - RNA, 17 nt, Measles virus
ucuggagaaagcgauga

SEQ ID NO: 3086355 - RNA, 13 nt, Measles virus
uuaugaucacagc

SEQ ID NO: 3086356 - RNA, 13 nt, Measles virus
aaggccccucccc

SEQ ID NO: 3086357 - RNA, 20 nt, Measles virus
ggaguacgacuucagagauc

SEQ ID NO: 3086358 - RNA, 22 nt, Measles virus
cagggcaaccaaucaguuccua

SEQ ID NO: 3086359 - RNA, 20 nt, Measles virus
ucagcaacugcaugguggcu

SEQ ID NO: 3086360 - RNA, 22 nt, Measles virus
caauauauuaaagaaaacuuug

SEQ ID NO: 3086361 - RNA, 14 nt, Measles virus
ucaaauuguagcca

SEQ ID NO: 3086362 - RNA, 13 nt, Measles virus
gccgacagccagc

SEQ ID NO: 3086363 - RNA, 16 nt, Measles virus
cuccggcuucccucug

SEQ ID NO: 3086364 - RNA, 22 nt, Measles virus
gcaucuuagagagcagaggaau

SEQ ID NO: 3086365 - RNA, 17 nt, Measles virus
cagccagcagccgacag

SEQ ID NO: 3086366 - RNA, 15 nt, Measles virus
uuaaagaaaacuuug

SEQ ID NO: 3086367 - RNA, 19 nt, Measles virus
cagauacuauacagaaauc

SEQ ID NO: 3086368 - RNA, 20 nt, Measles virus
accgcauccccacagcuccc

SEQ ID NO: 3086369 - RNA, 15 nt, Measles virus
gcagccaaaaugccu

SEQ ID NO: 3086370 - RNA, 17 nt, Measles virus
accgaaccagaguccag

SEQ ID NO: 3086371 - RNA, 21 nt, Measles virus
cgaauaaaugccuucuacaaa

SEQ ID NO: 3086372 - RNA, 14 nt, Measles virus
cucuggcugucuca

SEQ ID NO: 3086373 - RNA, 24 nt, Measles virus
accaguccaugcugaacucucaag

SEQ ID NO: 3086374 - RNA, 23 nt, Measles virus
ucuuacagggacaucaaaauccu

SEQ ID NO: 3086375 - RNA, 18 nt, Measles virus
gucacuaugacaucccag

SEQ ID NO: 3086376 - RNA, 17 nt, Measles virus
gagacgaugaaucugaa

SEQ ID NO: 3086377 - RNA, 16 nt, Measles virus
agagcaagccuggaaa

SEQ ID NO: 3086378 - RNA, 17 nt, Measles virus
acccacauccuaaggga

SEQ ID NO: 3086379 - RNA, 23 nt, Measles virus
acccacugauggauaucaaugaa

SEQ ID NO: 3086380 - RNA, 21 nt, Measles virus
gcagcccucugucacagggaa

SEQ ID NO: 3086381 - RNA, 18 nt, Measles virus
cccaggggccgacagcca

SEQ ID NO: 3086382 - RNA, 18 nt, Measles virus
agaucucaaagaaaguca

SEQ ID NO: 3086383 - RNA, 20 nt, Measles virus
ucacuaugacaucccaggga

SEQ ID NO: 3086384 - RNA, 14 nt, Measles virus
ucacacacgguuca

SEQ ID NO: 3086385 - RNA, 22 nt, Measles virus
gacuaucccgccaaugaagaac

SEQ ID NO: 3086386 - RNA, 23 nt, Measles virus
cacugugucagaacaucaagcac

SEQ ID NO: 3086387 - RNA, 14 nt, Measles virus
gcugaugaagauaa

SEQ ID NO: 3086388 - RNA, 18 nt, Measles virus
ucaagaaaucuccaggca

SEQ ID NO: 3086389 - RNA, 16 nt, Measles virus
agggaaacugcucagg

SEQ ID NO: 3086390 - RNA, 15 nt, Measles virus
uauaacucuccucaa

SEQ ID NO: 3086391 - RNA, 17 nt, Measles virus
uggaggaugccaaggaa

SEQ ID NO: 3086392 - RNA, 16 nt, Measles virus
accaaccauccacucc

SEQ ID NO: 3086393 - RNA, 20 nt, Measles virus
uccaugcugaacucucaagc

SEQ ID NO: 3086394 - RNA, 23 nt, Measles virus
caccccgcaaaaaggaaaggcca

SEQ ID NO: 3086395 - RNA, 22 nt, Measles virus
uucuauucccagcuuugucugg

SEQ ID NO: 3086396 - RNA, 12 nt, Measles virus
agaauaaugaag

SEQ ID NO: 3086397 - RNA, 15 nt, Measles virus
cacuaacccuccuca

SEQ ID NO: 3086398 - RNA, 18 nt, Measles virus
caacccgcgcaccccagc

SEQ ID NO: 3086399 - RNA, 19 nt, Measles virus
aagaaaacuuugaaaauac

SEQ ID NO: 3086400 - RNA, 17 nt, Measles virus
aaugccgcacugauaca

SEQ ID NO: 3086401 - RNA, 14 nt, Measles virus
ucacucgggaagau

SEQ ID NO: 3086402 - RNA, 17 nt, Measles virus
uugguagauccacagca

SEQ ID NO: 3086403 - RNA, 12 nt, Measles virus
caugccagaggg

SEQ ID NO: 3086404 - RNA, 21 nt, Measles virus
cggaccaagcgagaggccagc

SEQ ID NO: 3086405 - RNA, 24 nt, Measles virus
uauacaaaaccaaccacaacaaug

SEQ ID NO: 3086406 - RNA, 17 nt, Measles virus
aggggugguagggauag

SEQ ID NO: 3086407 - RNA, 21 nt, Measles virus
auacaggagacuacugagaac

SEQ ID NO: 3086408 - RNA, 16 nt, Measles virus
ugcagaacuucuagga

SEQ ID NO: 3086409 - RNA, 17 nt, Measles virus
cagacaacccaggacag

SEQ ID NO: 3086410 - RNA, 17 nt, Measles virus
cucaacccgaaccagca

SEQ ID NO: 3086411 - RNA, 22 nt, Measles virus
cuuaggaguuauccggcccacu

SEQ ID NO: 3086412 - RNA, 14 nt, Measles virus
ccagcacccagcca

SEQ ID NO: 3086413 - RNA, 20 nt, Measles virus
aguuucuauucccagcuuug

SEQ ID NO: 3086414 - RNA, 19 nt, Measles virus
ucagacaacccaggacagg

SEQ ID NO: 3086415 - RNA, 21 nt, Measles virus
caacauccgccuacccuccau

SEQ ID NO: 3086416 - RNA, 15 nt, Measles virus
gccuaaucugagcag

SEQ ID NO: 3086417 - RNA, 20 nt, Measles virus
auccacgagcuccugaaacu

SEQ ID NO: 3086418 - RNA, 13 nt, Measles virus
aggccgagcacug

SEQ ID NO: 3086419 - RNA, 17 nt, Measles virus
gcugacucuaucauggu

SEQ ID NO: 3086420 - RNA, 13 nt, Measles virus
acaaugggauggc

SEQ ID NO: 3086421 - RNA, 23 nt, Measles virus
ccagccaaccaaccauccacucc

SEQ ID NO: 3086422 - RNA, 21 nt, Measles virus
gacaccgggaaucccagaauc

SEQ ID NO: 3086423 - RNA, 18 nt, Measles virus
acauccugauugcagugu

SEQ ID NO: 3086424 - RNA, 18 nt, Measles virus
ggaccagauauugaggag

SEQ ID NO: 3086425 - RNA, 21 nt, Measles virus
gaucacacacgguucagggau

SEQ ID NO: 3086426 - RNA, 18 nt, Measles virus
agcaaaaugggcuguccc

SEQ ID NO: 3086427 - RNA, 17 nt, Measles virus
gcuucaaguaggagaca

SEQ ID NO: 3086428 - RNA, 17 nt, Measles virus
ccaugcugaacucucaa

SEQ ID NO: 3086429 - RNA, 16 nt, Measles virus
ccgcccccgaacccca

SEQ ID NO: 3086430 - RNA, 22 nt, Measles virus
caacccgaaccagcacccaaga

SEQ ID NO: 3086431 - RNA, 14 nt, Measles virus
aggaugccaaggaa

SEQ ID NO: 3086432 - RNA, 13 nt, Measles virus
aaccccacaaccg

SEQ ID NO: 3086433 - RNA, 22 nt, Measles virus
cuugaccaaaacggguuuucug

SEQ ID NO: 3086434 - RNA, 13 nt, Measles virus
aggacaucaagga

SEQ ID NO: 3086435 - RNA, 20 nt, Measles virus
caacucuacuggaggccagg

SEQ ID NO: 3086436 - RNA, 22 nt, Measles virus
ucagggcccacuacaaucagag

SEQ ID NO: 3086437 - RNA, 13 nt, Measles virus
aaagaucucaaag

SEQ ID NO: 3086438 - RNA, 13 nt, Measles virus
cuaauccugcccu

SEQ ID NO: 3086439 - RNA, 16 nt, Measles virus
cggcuaucgugacagg

SEQ ID NO: 3086440 - RNA, 20 nt, Measles virus
cacagucacucgggaagaug

SEQ ID NO: 3086441 - RNA, 16 nt, Measles virus
uagggugcaagaucau

SEQ ID NO: 3086442 - RNA, 21 nt, Measles virus
ucagggcccacuacaaucaga

SEQ ID NO: 3086443 - RNA, 19 nt, Measles virus
caagcaaaaugggcugucc

SEQ ID NO: 3086444 - RNA, 12 nt, Measles virus
agacccagcacc

SEQ ID NO: 3086445 - RNA, 18 nt, Measles virus
gcccccccggugcccaca

SEQ ID NO: 3086446 - RNA, 16 nt, Measles virus
aaacuuugaaaauacg

SEQ ID NO: 3086447 - RNA, 17 nt, Measles virus
aggacaggaccgagcca

SEQ ID NO: 3086448 - RNA, 11 nt, Measles virus
cagauccucuc

SEQ ID NO: 3086449 - RNA, 19 nt, Measles virus
gaugcugacucuaucaugg

SEQ ID NO: 3086450 - RNA, 17 nt, Measles virus
cuaucccgccaaugaag

SEQ ID NO: 3086451 - RNA, 22 nt, Measles virus
uccggaacccuaauccugcccu

SEQ ID NO: 3086452 - RNA, 16 nt, Measles virus
caccagaugcugauga

SEQ ID NO: 3086453 - RNA, 21 nt, Measles virus
cguugauaacuggaaaucauu

SEQ ID NO: 3086454 - RNA, 17 nt, Measles virus
ggagauauccauccagg

SEQ ID NO: 3086455 - RNA, 22 nt, Measles virus
ucaagcaaccaccgcauccagc

SEQ ID NO: 3086456 - RNA, 22 nt, Measles virus
accacccugggccaccagcucc

SEQ ID NO: 3086457 - RNA, 22 nt, Measles virus
cggcccccccggugcccacagg

SEQ ID NO: 3086458 - RNA, 20 nt, Measles virus
cucuucucgaagggaccaaa

SEQ ID NO: 3086459 - RNA, 13 nt, Measles virus
agucagugauaag

SEQ ID NO: 3086460 - RNA, 18 nt, Measles virus
gccaccaccagccauccc

SEQ ID NO: 3086461 - RNA, 19 nt, Measles virus
cacaauccggaaugcucaa

SEQ ID NO: 3086462 - RNA, 16 nt, Measles virus
gucagggaucuggaga

SEQ ID NO: 3086463 - RNA, 19 nt, Measles virus
agcuugggaaaacucucaa

SEQ ID NO: 3086464 - RNA, 16 nt, Measles virus
ccgaggaacuccucaa

SEQ ID NO: 3086465 - RNA, 22 nt, Measles virus
cgaugaaucugaaaacagcgau

SEQ ID NO: 3086466 - RNA, 16 nt, Measles virus
gcuuuauguacauguu

SEQ ID NO: 3086467 - RNA, 15 nt, Measles virus
ccagcacccaagagc

SEQ ID NO: 3086468 - RNA, 20 nt, Measles virus
ccuuaaccacugcuuuacug

SEQ ID NO: 3086469 - RNA, 22 nt, Measles virus
aagucccccggucuccuccucu

SEQ ID NO: 3086470 - RNA, 20 nt, Measles virus
uuaacucuccaaacacccac

SEQ ID NO: 3086471 - RNA, 14 nt, Measles virus
gccaccaccagcca

SEQ ID NO: 3086472 - RNA, 22 nt, Measles virus
gugauugccuccuaaguuccac

SEQ ID NO: 3086473 - RNA, 16 nt, Measles virus
gaaugucaucaagucc

SEQ ID NO: 3086474 - RNA, 15 nt, Measles virus
ccuucuacaaagaca

SEQ ID NO: 3086475 - RNA, 22 nt, Measles virus
aucccaaucugcguccuccucg

SEQ ID NO: 3086476 - RNA, 12 nt, Measles virus
gccaggugcacc

SEQ ID NO: 3086477 - RNA, 19 nt, Measles virus
gcuccgaacacagaccacc

SEQ ID NO: 3086478 - RNA, 16 nt, Measles virus
ugccaaccccaugcca

SEQ ID NO: 3086479 - RNA, 21 nt, Measles virus
ggcguugccacagcugcucag

SEQ ID NO: 3086480 - RNA, 14 nt, Measles virus
auuuugagcaacca

SEQ ID NO: 3086481 - RNA, 16 nt, Measles virus
acucagaggugcuuuc

SEQ ID NO: 3086482 - RNA, 17 nt, Measles virus
augccucuuagccugga

SEQ ID NO: 3086483 - RNA, 12 nt, Measles virus
gccauggcagca

SEQ ID NO: 3086484 - RNA, 17 nt, Measles virus
aaaaugagggcaugcca

SEQ ID NO: 3086485 - RNA, 13 nt, Measles virus
auuuuaaggacaa

SEQ ID NO: 3086486 - RNA, 13 nt, Measles virus
gaagccauggcag

SEQ ID NO: 3086487 - RNA, 23 nt, Measles virus
caccaaccgcauccccacagcuc

SEQ ID NO: 3086488 - RNA, 14 nt, Measles virus
caccugcaaggaag

SEQ ID NO: 3086489 - RNA, 16 nt, Measles virus
acucccacgacuggag

SEQ ID NO: 3086490 - RNA, 15 nt, Measles virus
ggccgucgaggaagc

SEQ ID NO: 3086491 - RNA, 22 nt, Measles virus
uccaaagggaaugggauucagu

SEQ ID NO: 3086492 - RNA, 21 nt, Measles virus
aaaggugucagcuuccagcuc

SEQ ID NO: 3086493 - RNA, 15 nt, Measles virus
cccagcacccagcca

SEQ ID NO: 3086494 - RNA, 21 nt, Measles virus
caucuuagagagcagaggaau

SEQ ID NO: 3086495 - RNA, 18 nt, Measles virus
caaagggaaacugcucag

SEQ ID NO: 3086496 - RNA, 20 nt, Measles virus
aaguugggaaugucaucaag

SEQ ID NO: 3086497 - RNA, 16 nt, Measles virus
caggguguccaagacu

SEQ ID NO: 3086498 - RNA, 21 nt, Measles virus
ggguuguugaggacagcgauc

SEQ ID NO: 3086499 - RNA, 12 nt, Measles virus
ugcgauccuggg

SEQ ID NO: 3086500 - RNA, 16 nt, Measles virus
ccucugucacagggaa

SEQ ID NO: 3086501 - RNA, 23 nt, Measles virus
uccacacucuggcugucucagga

SEQ ID NO: 3086502 - RNA, 14 nt, Measles virus
auccacccuggaag

SEQ ID NO: 3086503 - RNA, 16 nt, Measles virus
uaguagcuauccugga

SEQ ID NO: 3086504 - RNA, 16 nt, Measles virus
aucaggggucagggaa

SEQ ID NO: 3086505 - RNA, 19 nt, Measles virus
gacaaacuauuuugagcaa

SEQ ID NO: 3086506 - RNA, 19 nt, Measles virus
cugccauauucauggcagu

SEQ ID NO: 3086507 - RNA, 16 nt, Measles virus
cugcaaggaagaggag

SEQ ID NO: 3086508 - RNA, 22 nt, Measles virus
ccgagcccaucggcucacuggc

SEQ ID NO: 3086509 - RNA, 14 nt, Measles virus
ucaugccagagggg

SEQ ID NO: 3086510 - RNA, 15 nt, Measles virus
gcaagccuggaaacu

SEQ ID NO: 3086511 - RNA, 20 nt, Measles virus
aggaaccagguccacacagc

SEQ ID NO: 3086512 - RNA, 11 nt, Measles virus
agaagaaugcu

SEQ ID NO: 3086513 - RNA, 15 nt, Measles virus
cacagagguguuauc

SEQ ID NO: 3086514 - RNA, 22 nt, Measles virus
gccuccggggguccaccaaguc

SEQ ID NO: 3086515 - RNA, 13 nt, Measles virus
acugcagaaggag

SEQ ID NO: 3086516 - RNA, 18 nt, Measles virus
gccccgacacaaggccac

SEQ ID NO: 3086517 - RNA, 14 nt, Measles virus
uaacggcugcugaa

SEQ ID NO: 3086518 - RNA, 14 nt, Measles virus
cuaacccuccucac

SEQ ID NO: 3086519 - RNA, 24 nt, Measles virus
ccaaucaguuccuagcugucucaa

SEQ ID NO: 3086520 - RNA, 22 nt, Measles virus
acaacccaggacaggaccgagc

SEQ ID NO: 3086521 - RNA, 16 nt, Measles virus
cccacagccucuccaa

SEQ ID NO: 3086522 - RNA, 18 nt, Measles virus
agggucagaguugucaca

SEQ ID NO: 3086523 - RNA, 21 nt, Measles virus
ucucaaacaugucgcuguccc

SEQ ID NO: 3086524 - RNA, 19 nt, Measles virus
ggccugaggacaccucaga

SEQ ID NO: 3086525 - RNA, 21 nt, Measles virus
ccaauauaacucuccucaaua

SEQ ID NO: 3086526 - RNA, 20 nt, Measles virus
cccucaagaaaucuccaggc

SEQ ID NO: 3086527 - RNA, 23 nt, Measles virus
gagauccauaagagccucagcac

SEQ ID NO: 3086528 - RNA, 17 nt, Measles virus
gaggggacugugugcag

SEQ ID NO: 3086529 - RNA, 13 nt, Measles virus
aauacgaaguuuc

SEQ ID NO: 3086530 - RNA, 15 nt, Measles virus
cgaaaaccagaggga

SEQ ID NO: 3086531 - RNA, 18 nt, Measles virus
accugucuuacagccuga

SEQ ID NO: 3086532 - RNA, 21 nt, Measles virus
cuagauuacauuuucauaacu

SEQ ID NO: 3086533 - RNA, 18 nt, Measles virus
aaccgaucacaugauguc

SEQ ID NO: 3086534 - RNA, 20 nt, Measles virus
aggagacuacugagaacagu

SEQ ID NO: 3086535 - RNA, 15 nt, Measles virus
aggagaaagaagagu

SEQ ID NO: 3086536 - RNA, 20 nt, Measles virus
gaaacugcagaaggagggga

SEQ ID NO: 3086537 - RNA, 20 nt, Measles virus
ucaagcuucaggugaagggu

SEQ ID NO: 3086538 - RNA, 20 nt, Measles virus
uaacucuccucaauaacugc

SEQ ID NO: 3086539 - RNA, 20 nt, Measles virus
gauggcagaagagcaggcac

SEQ ID NO: 3086540 - RNA, 20 nt, Measles virus
guggcugcugaagaacucau

SEQ ID NO: 3086541 - RNA, 12 nt, Measles virus
uagccaugcugg

SEQ ID NO: 3086542 - RNA, 16 nt, Measles virus
gugaacucaacucuac

SEQ ID NO: 3086543 - RNA, 22 nt, Measles virus
gaagcagaucaacaggcaaaau

SEQ ID NO: 3086544 - RNA, 20 nt, Measles virus
ccugucauuauuuggcccca

SEQ ID NO: 3086545 - RNA, 18 nt, Measles virus
ccucccccugcaugcugc

SEQ ID NO: 3086546 - RNA, 20 nt, Measles virus
cccacucucauauuccauau

SEQ ID NO: 3086547 - RNA, 20 nt, Measles virus
ccauuauaaaaaacuuagga

SEQ ID NO: 3086548 - RNA, 19 nt, Measles virus
caauccagaggcaacaacu

SEQ ID NO: 3086549 - RNA, 20 nt, Measles virus
caauauauuaaagaaaacuu

SEQ ID NO: 3086550 - RNA, 20 nt, Measles virus
auagaagacaaagagucaac

SEQ ID NO: 3086551 - RNA, 23 nt, Measles virus
aggcggcccaagcacagaacagc

SEQ ID NO: 3086552 - RNA, 13 nt, Measles virus
aauacaugauguu

SEQ ID NO: 3086553 - RNA, 16 nt, Measles virus
caaacucaguuccaau

SEQ ID NO: 3086554 - RNA, 22 nt, Measles virus
cauuguuauaaaaaacuuagga

SEQ ID NO: 3086555 - RNA, 22 nt, Measles virus
ccaaccucuucacuguuccaau

SEQ ID NO: 3086556 - RNA, 20 nt, Measles virus
cuaaguuccacaaugacaga

SEQ ID NO: 3086557 - RNA, 14 nt, Measles virus
acuuaucaugaguu

SEQ ID NO: 3086558 - RNA, 17 nt, Measles virus
gauguaacuaacucgau

SEQ ID NO: 3086559 - RNA, 14 nt, Measles virus
ccgguguuccauau

SEQ ID NO: 3086560 - RNA, 12 nt, Measles virus
agcugcucagau

SEQ ID NO: 3086561 - RNA, 18 nt, Measles virus
agggucgaucgcuccgau

SEQ ID NO: 3086562 - RNA, 20 nt, Measles virus
agggcucaaauugcucagau

SEQ ID NO: 3086563 - RNA, 13 nt, Measles virus
gccuuggccaaaa

SEQ ID NO: 3086564 - RNA, 22 nt, Measles virus
cuuccaggguugaacaugcugu

SEQ ID NO: 3086565 - RNA, 19 nt, Human
auuagcauuugucaacaaa

SEQ ID NO: 3086566 - RNA, 22 nt, Human
aacuucuccccugguagaaaga

SEQ ID NO: 3086567 - RNA, 16 nt, Human
ucacagccacuuggga

SEQ ID NO: 3086568 - RNA, 17 nt, Human
ucaagcaagauuucaga

SEQ ID NO: 3086569 - RNA, 19 nt, Human
ugauauguugguagauucu

SEQ ID NO: 3086570 - RNA, 22 nt, Human
uuuaugggucagaguuccgacu

SEQ ID NO: 3086571 - RNA, 19 nt, Human
uugcacaaaccaauuaaac

SEQ ID NO: 3086572 - RNA, 19 nt, Human
auuuacccuucuuuucuga

SEQ ID NO: 3086573 - RNA, 21 nt, Human
agcaaaaccaaauauuccaga

SEQ ID NO: 3086574 - RNA, 17 nt, Human
aauagaaauggggaacu

SEQ ID NO: 3086575 - RNA, 17 nt, Human
acuauugcuugcacaaa

SEQ ID NO: 3086576 - RNA, 11 nt, Human
cccuucuuuuu

SEQ ID NO: 3086577 - RNA, 20 nt, Human
cuaagcacgggccauaugaa

SEQ ID NO: 3086578 - RNA, 23 nt, Human
cuaagcacgggccauaugaauaa

SEQ ID NO: 3086579 - RNA, 12 nt, Human
gugggcuaagca

SEQ ID NO: 3086580 - RNA, 15 nt, Human
uaagccaugggagac

SEQ ID NO: 3086581 - RNA, 19 nt, Human
ugacucuuggcacagcaug

SEQ ID NO: 3086582 - RNA, 14 nt, Human
ugacucuuggcaca

SEQ ID NO: 3086583 - RNA, 20 nt, Human
acugauguaugaggaauuuc

SEQ ID NO: 3086584 - RNA, 18 nt, Human
agaagaugaaugagcaaa

SEQ ID NO: 3086585 - RNA, 22 nt, Human
cuaagaaagcccuuaggaagaa

SEQ ID NO: 3086586 - RNA, 21 nt, Human
gaagggcuuggacucaagcaa

SEQ ID NO: 3086587 - RNA, 14 nt, Human
uccagagacuggga

SEQ ID NO: 3086588 - RNA, 17 nt, Human
ucagaaucucucuucuu

SEQ ID NO: 3086589 - RNA, 16 nt, Human
agcauuugucaacaaa

SEQ ID NO: 3086590 - RNA, 20 nt, Human
uuuacccuucuuuucugacu

SEQ ID NO: 3086591 - RNA, 17 nt, Human
caaauauuccagagacu

SEQ ID NO: 3086592 - RNA, 13 nt, Human
caaauauuccaga

SEQ ID NO: 3086593 - RNA, 15 nt, Human
uagaaagaagaugaa

SEQ ID NO: 3086594 - RNA, 13 nt, Human
uccccuucacucc

SEQ ID NO: 3086595 - RNA, 14 nt, Human
cuauuuuucagaau

SEQ ID NO: 3086596 - RNA, 12 nt, Human
caagauuucaga

SEQ ID NO: 3086597 - RNA, 14 nt, Human
auugcuugcacaaa

SEQ ID NO: 3086598 - RNA, 15 nt, Human
cuuaggaagaauuuu

SEQ ID NO: 3086599 - RNA, 14 nt, Human
aacuuggaaauagu

SEQ ID NO: 3086600 - RNA, 15 nt, Human
aagcaagauuucaga

SEQ ID NO: 3086601 - RNA, 16 nt, Human
aagcaagauuucagau

SEQ ID NO: 3086602 - RNA, 16 nt, Human
aaccaaauauuccaga

SEQ ID NO: 3086603 - RNA, 19 nt, Human
uaaacccaguaguggugac

SEQ ID NO: 3086604 - RNA, 14 nt, Human
uccacagugacucc

SEQ ID NO: 3086605 - RNA, 19 nt, Human
agaccuaacgagaaauaga

SEQ ID NO: 3086606 - RNA, 15 nt, Human
agaaagaagaugaau

SEQ ID NO: 3086607 - RNA, 21 nt, Human
agaacucaugacggaagaguu

SEQ ID NO: 3086608 - RNA, 15 nt, Human
auuugucaacaaagu

SEQ ID NO: 3086609 - RNA, 13 nt, Human
auuugucaacaaa

SEQ ID NO: 3086610 - RNA, 18 nt, Human
aucaguagccagcaucug

SEQ ID NO: 3086611 - RNA, 19 nt, Human
auguaugaggaauuucugu

SEQ ID NO: 3086612 - RNA, 18 nt, Human
acuauuuuucagaaucuc

SEQ ID NO: 3086613 - RNA, 14 nt, Human
acuauuuuucagaa

SEQ ID NO: 3086614 - RNA, 19 nt, Human
aaagcccuuaggaagaauu

SEQ ID NO: 3086615 - RNA, 19 nt, Human
cuggcaguggaacuaagaa

SEQ ID NO: 3086616 - RNA, 21 nt, Human
gagccagcagccuggcucucc

SEQ ID NO: 3086617 - RNA, 16 nt, Human
gugagcuccuaagcca

SEQ ID NO: 3086618 - RNA, 12 nt, Human
uaugaauaacau

SEQ ID NO: 3086619 - RNA, 15 nt, Human
uauugcuugcacaaa

SEQ ID NO: 3086620 - RNA, 22 nt, Human
uauugcagcgauuaauaacagg

SEQ ID NO: 3086621 - RNA, 18 nt, Human
uauguugguagauucuaa

SEQ ID NO: 3086622 - RNA, 19 nt, Human
uuauugcagcgauuaauaa

SEQ ID NO: 3086623 - RNA, 19 nt, Human
uugcagcgauuaauaacag

SEQ ID NO: 3086624 - RNA, 18 nt, Human
uugcagcgauuaauaaca

SEQ ID NO: 3086625 - RNA, 17 nt, Human
cgacugccaucuuggac

SEQ ID NO: 3086626 - RNA, 23 nt, Human
ccgcaggauuugggcucuuggaa

SEQ ID NO: 3086627 - RNA, 15 nt, Human
auuucagauuuguga

SEQ ID NO: 3086628 - RNA, 19 nt, Human
aagaaagcccuuaggaaga

SEQ ID NO: 3086629 - RNA, 14 nt, Human
guucuucaucuaag

SEQ ID NO: 3086630 - RNA, 14 nt, Human
aauccuggggaaca

SEQ ID NO: 3086631 - RNA, 21 nt, Human
aauccuggggaacauagaacu

SEQ ID NO: 3086632 - RNA, 18 nt, Human
uaacauggugugcuucuu

SEQ ID NO: 3086633 - RNA, 12 nt, Human
aauauuccagag

SEQ ID NO: 3086634 - RNA, 12 nt, Human
acccuucuuuuc

SEQ ID NO: 3086635 - RNA, 22 nt, Human
agaaagcccuuaggaagaauuu

SEQ ID NO: 3086636 - RNA, 20 nt, Human
agaaagcccuuaggaagaau

SEQ ID NO: 3086637 - RNA, 14 nt, Human
agcaagauuucaga

SEQ ID NO: 3086638 - RNA, 19 nt, Human
ugaccugccaggcacacug

SEQ ID NO: 3086639 - RNA, 16 nt, Human
ugaccugccaggcaca

SEQ ID NO: 3086640 - RNA, 19 nt, Human
ugacuauuuuucagaaucu

SEQ ID NO: 3086641 - RNA, 15 nt, Human
agucuuuuccaugaa

SEQ ID NO: 3086642 - RNA, 13 nt, Human
agucuuuuccaug

SEQ ID NO: 3086643 - RNA, 22 nt, Human
aggccaacccaaaauaagcagg

SEQ ID NO: 3086644 - RNA, 20 nt, Human
agggacucaucauuuccauu

SEQ ID NO: 3086645 - RNA, 15 nt, Human
aucucucuucuuuuc

SEQ ID NO: 3086646 - RNA, 22 nt, Human
cauuuacccuucuuuucugacu

SEQ ID NO: 3086647 - RNA, 21 nt, Human
ucagggagugggcuaagcacg

SEQ ID NO: 3086648 - RNA, 21 nt, Human
uauugcuugcacaaaccaauu

SEQ ID NO: 3086649 - RNA, 23 nt, Human
agcagccuggcucucccagccag

SEQ ID NO: 3086650 - RNA, 19 nt, Human
agcaggcgugaccugccag

SEQ ID NO: 3086651 - RNA, 23 nt, Human
caucaccuccccccccccgccac

SEQ ID NO: 3086652 - RNA, 15 nt, Molluscum contagiosum virus
aggcacgaggcagcc

SEQ ID NO: 3086653 - RNA, 14 nt, Molluscum contagiosum virus
guguccacgacacu

SEQ ID NO: 3086654 - RNA, 18 nt, Molluscum contagiosum virus
guugcgagccagccaggc

SEQ ID NO: 3086655 - RNA, 16 nt, Molluscum contagiosum virus
cgcccuggagcgcagu

SEQ ID NO: 3086656 - RNA, 17 nt, Molluscum contagiosum virus
acgugcacguggcgcac

SEQ ID NO: 3086657 - RNA, 24 nt, Molluscum contagiosum virus
ccuacgaggugcugcgccacgugc

SEQ ID NO: 3086658 - RNA, 22 nt, Molluscum contagiosum virus
gcaucccugcgcaccugcacga

SEQ ID NO: 3086659 - RNA, 14 nt, Molluscum contagiosum virus
ggcgcgcgcgcugc

SEQ ID NO: 3086660 - RNA, 14 nt, Molluscum contagiosum virus
gccccgacgccagc

SEQ ID NO: 3086661 - RNA, 12 nt, Molluscum contagiosum virus
cauccgcgcgcu

SEQ ID NO: 3086662 - RNA, 15 nt, Molluscum contagiosum virus
gcgcgcgccggaacu

SEQ ID NO: 3086663 - RNA, 16 nt, Molluscum contagiosum virus
aggcugcugccgcgcg

SEQ ID NO: 3086664 - RNA, 19 nt, Molluscum contagiosum virus
ccguccaguaagcgacagg

SEQ ID NO: 3086665 - RNA, 16 nt, Molluscum contagiosum virus
cuuccugcuggcgcgc

SEQ ID NO: 3086666 - RNA, 18 nt, Molluscum contagiosum virus
gcagugccaagguucugg

SEQ ID NO: 3086667 - RNA, 23 nt, Molluscum contagiosum virus
agauuggaggaggaagcaggucu

SEQ ID NO: 3086668 - RNA, 16 nt, Molluscum contagiosum virus
ggcagcagcgugcaua

SEQ ID NO: 3086669 - RNA, 11 nt, Molluscum contagiosum virus
ucccagcaccg

SEQ ID NO: 3086670 - RNA, 20 nt, Molluscum contagiosum virus
ucagcggcggccccugccuu

SEQ ID NO: 3086671 - RNA, 12 nt, Molluscum contagiosum virus
ugcguggacagc

SEQ ID NO: 3086672 - RNA, 13 nt, Molluscum contagiosum virus
acgacgagcacua

SEQ ID NO: 3086673 - RNA, 17 nt, Molluscum contagiosum virus
cguccacgcaggacugg

SEQ ID NO: 3086674 - RNA, 19 nt, Molluscum contagiosum virus
cgugaccauggacacgcug

SEQ ID NO: 3086675 - RNA, 21 nt, Molluscum contagiosum virus
ucucuccccuucagaggacuu

SEQ ID NO: 3086676 - RNA, 15 nt, Molluscum contagiosum virus
gacuagccugugccc

SEQ ID NO: 3086677 - RNA, 13 nt, Molluscum contagiosum virus
cgcgcagacgcgg

SEQ ID NO: 3086678 - RNA, 18 nt, Molluscum contagiosum virus
guacggugccguccccgc

SEQ ID NO: 3086679 - RNA, 14 nt, Molluscum contagiosum virus
cuucgaccucugcu

SEQ ID NO: 3086680 - RNA, 23 nt, Molluscum contagiosum virus
ucgacuuacggacgcccuccucg

SEQ ID NO: 3086681 - RNA, 17 nt, Molluscum contagiosum virus
gcgcaacgcgggccagg

SEQ ID NO: 3086682 - RNA, 20 nt, Molluscum contagiosum virus
uucgaccucugcuucacgcu

SEQ ID NO: 3086683 - RNA, 20 nt, Molluscum contagiosum virus
cccuuccgaguucuggccgc

SEQ ID NO: 3086684 - RNA, 18 nt, Molluscum contagiosum virus
gcccaccagcagccaggc

SEQ ID NO: 3086685 - RNA, 15 nt, Molluscum contagiosum virus
gacgggaacgagguc

SEQ ID NO: 3086686 - RNA, 15 nt, Molluscum contagiosum virus
ucauacuccugcugg

SEQ ID NO: 3086687 - RNA, 17 nt, Molluscum contagiosum virus
aggaucacggcucugcg

SEQ ID NO: 3086688 - RNA, 21 nt, Molluscum contagiosum virus
cacguggugguuggcgugcuc

SEQ ID NO: 3086689 - RNA, 17 nt, Molluscum contagiosum virus
ggccgcuccagagccgc

SEQ ID NO: 3086690 - RNA, 12 nt, Molluscum contagiosum virus
caccgaggagcc

SEQ ID NO: 3086691 - RNA, 20 nt, Molluscum contagiosum virus
gaggacgccggcaagccgag

SEQ ID NO: 3086692 - RNA, 17 nt, Molluscum contagiosum virus
gcggggccggcuuugcg

SEQ ID NO: 3086693 - RNA, 17 nt, Molluscum contagiosum virus
cuuuccggccuguaaau

SEQ ID NO: 3086694 - RNA, 19 nt, Molluscum contagiosum virus
ggugcgccugcacuacugc

SEQ ID NO: 3086695 - RNA, 18 nt, Molluscum contagiosum virus
agcguccggcaugcgcgc

SEQ ID NO: 3086696 - RNA, 17 nt, Molluscum contagiosum virus
acugcagcgagcucgcg

SEQ ID NO: 3086697 - RNA, 13 nt, Molluscum contagiosum virus
gcgccgcugcugg

SEQ ID NO: 3086698 - RNA, 14 nt, Molluscum contagiosum virus
gcaugguggugaga

SEQ ID NO: 3086699 - RNA, 14 nt, Molluscum contagiosum virus
gcgcaccagcugca

SEQ ID NO: 3086700 - RNA, 16 nt, Molluscum contagiosum virus
gccuucugcaagcugc

SEQ ID NO: 3086701 - RNA, 12 nt, Molluscum contagiosum virus
cgugcaggucga

SEQ ID NO: 3086702 - RNA, 17 nt, Molluscum contagiosum virus
uaccugcgacagcugcu

SEQ ID NO: 3086703 - RNA, 20 nt, Molluscum contagiosum virus
gcgcugcuggugcucgccug

SEQ ID NO: 3086704 - RNA, 19 nt, Molluscum contagiosum virus
ccgugcaccucccugugaa

SEQ ID NO: 3086705 - RNA, 23 nt, Molluscum contagiosum virus
ggcgugcgcagcagcucggggcu

SEQ ID NO: 3086706 - RNA, 17 nt, Molluscum contagiosum virus
gcuccuucucagggcuu

SEQ ID NO: 3086707 - RNA, 17 nt, Molluscum contagiosum virus
ccugccagcagagcugc

SEQ ID NO: 3086708 - RNA, 21 nt, Molluscum contagiosum virus
ggugcagccgcugcugcugca

SEQ ID NO: 3086709 - RNA, 14 nt, Molluscum contagiosum virus
gcugagcgggguac

SEQ ID NO: 3086710 - RNA, 20 nt, Molluscum contagiosum virus
ccucgagcgccgugcaguug

SEQ ID NO: 3086711 - RNA, 19 nt, Molluscum contagiosum virus
gcacugccacgcggagcuc

SEQ ID NO: 3086712 - RNA, 15 nt, Molluscum contagiosum virus
cgagagcuacagcau

SEQ ID NO: 3086713 - RNA, 21 nt, Molluscum contagiosum virus
gcaaucgcgugcuugcugcgc

SEQ ID NO: 3086714 - RNA, 22 nt, Molluscum contagiosum virus
accggcagcgcgauugcuggag

SEQ ID NO: 3086715 - RNA, 18 nt, Molluscum contagiosum virus
gacgcgugcauggcacgc

SEQ ID NO: 3086716 - RNA, 22 nt, Molluscum contagiosum virus
gacgggccccuguuggccccgc

SEQ ID NO: 3086717 - RNA, 21 nt, Molluscum contagiosum virus
ggccagcacaagccguccgcc

SEQ ID NO: 3086718 - RNA, 16 nt, Molluscum contagiosum virus
uggcgcccggcgccga

SEQ ID NO: 3086719 - RNA, 18 nt, Molluscum contagiosum virus
ccaccagcagccaggcua

SEQ ID NO: 3086720 - RNA, 12 nt, Molluscum contagiosum virus
caggcacuccag

SEQ ID NO: 3086721 - RNA, 15 nt, Molluscum contagiosum virus
acauaguaccaugac

SEQ ID NO: 3086722 - RNA, 23 nt, Molluscum contagiosum virus
ggcagcggcaaaggcccgcgagc

SEQ ID NO: 3086723 - RNA, 15 nt, Molluscum contagiosum virus
ggcuuugacaugcac

SEQ ID NO: 3086724 - RNA, 18 nt, Molluscum contagiosum virus
uagcgcgcgugugcaugg

SEQ ID NO: 3086725 - RNA, 14 nt, Molluscum contagiosum virus
uacgaaaguacuuu

SEQ ID NO: 3086726 - RNA, 10 nt, Molluscum contagiosum virus
gcacaccccg

SEQ ID NO: 3086727 - RNA, 14 nt, Molluscum contagiosum virus
ccccacugugccag

SEQ ID NO: 3086728 - RNA, 16 nt, Molluscum contagiosum virus
uacgagagcgcaugcc

SEQ ID NO: 3086729 - RNA, 18 nt, Molluscum contagiosum virus
cuagcaccgcaugggccc

SEQ ID NO: 3086730 - RNA, 18 nt, Molluscum contagiosum virus
cauagcgccacgagcagu

SEQ ID NO: 3086731 - RNA, 14 nt, Molluscum contagiosum virus
caaaagcacagcag

SEQ ID NO: 3086732 - RNA, 22 nt, Molluscum contagiosum virus
cgcuguuuggaauugugcugcu

SEQ ID NO: 3086733 - RNA, 13 nt, Molluscum contagiosum virus
cggccuccagcag

SEQ ID NO: 3086734 - RNA, 18 nt, Molluscum contagiosum virus
gcgcacacccacacgugc

SEQ ID NO: 3086735 - RNA, 18 nt, Molluscum contagiosum virus
aaagcuaugcgcagcugc

SEQ ID NO: 3086736 - RNA, 16 nt, Molluscum contagiosum virus
cgcuagccgccgcugc

SEQ ID NO: 3086737 - RNA, 18 nt, Molluscum contagiosum virus
cucguggaucgcgcgcac

SEQ ID NO: 3086738 - RNA, 22 nt, Molluscum contagiosum virus
gugcauugcgucuuacugcugc

SEQ ID NO: 3086739 - RNA, 20 nt, Molluscum contagiosum virus
ucgccuucuugcuggcgcuc

SEQ ID NO: 3086740 - RNA, 21 nt, Molluscum contagiosum virus
acccgcggcucucgcggcccu

SEQ ID NO: 3086741 - RNA, 16 nt, Molluscum contagiosum virus
ccagcggcgccgcagc

SEQ ID NO: 3086742 - RNA, 22 nt, Molluscum contagiosum virus
ucuacgccagcgacgcgacgcc

SEQ ID NO: 3086743 - RNA, 12 nt, Molluscum contagiosum virus
guucuccaggaa

SEQ ID NO: 3086744 - RNA, 18 nt, Molluscum contagiosum virus
uccucgacaaugagcacu

SEQ ID NO: 3086745 - RNA, 22 nt, Molluscum contagiosum virus
cucaaggacuaccagcucuucg

SEQ ID NO: 3086746 - RNA, 17 nt, Molluscum contagiosum virus
cgaugugacaacaugug

SEQ ID NO: 3086747 - RNA, 12 nt, Molluscum contagiosum virus
cggagcuggccg

SEQ ID NO: 3086748 - RNA, 16 nt, Molluscum contagiosum virus
cagcacgggcggaagc

SEQ ID NO: 3086749 - RNA, 16 nt, Molluscum contagiosum virus
cgcgcaugacagccau

SEQ ID NO: 3086750 - RNA, 23 nt, Molluscum contagiosum virus
cgggaauaccggagacaccagcu

SEQ ID NO: 3086751 - RNA, 23 nt, Molluscum contagiosum virus
gcauccugaugacggcagacggc

SEQ ID NO: 3086752 - RNA, 20 nt, Molluscum contagiosum virus
gcugcacgccgccagcgacg

SEQ ID NO: 3086753 - RNA, 14 nt, Molluscum contagiosum virus
cacgaguuucuuca

SEQ ID NO: 3086754 - RNA, 16 nt, Molluscum contagiosum virus
gccgacggcacgggca

SEQ ID NO: 3086755 - RNA, 16 nt, Molluscum contagiosum virus
gccgcgugcgccgccg

SEQ ID NO: 3086756 - RNA, 17 nt, Molluscum contagiosum virus
ucgagggcgaggccaag

SEQ ID NO: 3086757 - RNA, 16 nt, Molluscum contagiosum virus
ccccgaaaggcacccg

SEQ ID NO: 3086758 - RNA, 14 nt, Molluscum contagiosum virus
ucgggccggcgcgc

SEQ ID NO: 3086759 - RNA, 23 nt, Molluscum contagiosum virus
ccugcugaagaaggagcccuugc

SEQ ID NO: 3086760 - RNA, 20 nt, Molluscum contagiosum virus
ccucgugcucggcgugaucu

SEQ ID NO: 3086761 - RNA, 19 nt, Molluscum contagiosum virus
aagcuggaggcugccccuc

SEQ ID NO: 3086762 - RNA, 20 nt, Molluscum contagiosum virus
ucuggcguacucgugucaca

SEQ ID NO: 3086763 - RNA, 18 nt, Molluscum contagiosum virus
cgcaaccgcgugcgugca

SEQ ID NO: 3086764 - RNA, 20 nt, Molluscum contagiosum virus
ccacgagcguguccaggugc

SEQ ID NO: 3086765 - RNA, 22 nt, Molluscum contagiosum virus
gacacgagggccuuggcggcgc

SEQ ID NO: 3086766 - RNA, 18 nt, Molluscum contagiosum virus
gagaagagggucgugcag

SEQ ID NO: 3086767 - RNA, 13 nt, Molluscum contagiosum virus
cggcgcaacgcca

SEQ ID NO: 3086768 - RNA, 17 nt, Molluscum contagiosum virus
cggcagcucugcagcgc

SEQ ID NO: 3086769 - RNA, 21 nt, Molluscum contagiosum virus
cgcuagcagggcggcgccugc

SEQ ID NO: 3086770 - RNA, 21 nt, Molluscum contagiosum virus
caucgagcugcagagcgugcu

SEQ ID NO: 3086771 - RNA, 15 nt, Molluscum contagiosum virus
gcaccgcaugggccc

SEQ ID NO: 3086772 - RNA, 16 nt, Molluscum contagiosum virus
cguggaggaaacaccc

SEQ ID NO: 3086773 - RNA, 19 nt, Molluscum contagiosum virus
cucgcggaagaauuccuuc

SEQ ID NO: 3086774 - RNA, 13 nt, Molluscum contagiosum virus
gcgcccaccagca

SEQ ID NO: 3086775 - RNA, 20 nt, Molluscum contagiosum virus
cacgguguccacgaugaacg

SEQ ID NO: 3086776 - RNA, 19 nt, Molluscum contagiosum virus
cguccgugcgcagggcaau

SEQ ID NO: 3086777 - RNA, 18 nt, Molluscum contagiosum virus
ucuuuccccuccuagccc

SEQ ID NO: 3086778 - RNA, 20 nt, Molluscum contagiosum virus
cugugucgcgcgagcaaaga

SEQ ID NO: 3086779 - RNA, 19 nt, Molluscum contagiosum virus
ccucuuggcaaaggcaggg

SEQ ID NO: 3086780 - RNA, 16 nt, Molluscum contagiosum virus
gcaauggcgcgcagcu

SEQ ID NO: 3086781 - RNA, 24 nt, Molluscum contagiosum virus
gacaacucauagcgccacgagcag

SEQ ID NO: 3086782 - RNA, 21 nt, Molluscum contagiosum virus
caagcgagaucccuccgagac

SEQ ID NO: 3086783 - RNA, 20 nt, Molluscum contagiosum virus
guucccggugcugcugccaa

SEQ ID NO: 3086784 - RNA, 20 nt, Molluscum contagiosum virus
guggcgcgcgagcugcugcg

SEQ ID NO: 3086785 - RNA, 12 nt, Molluscum contagiosum virus
cucauccaccug

SEQ ID NO: 3086786 - RNA, 12 nt, Molluscum contagiosum virus
acugcagcagcu

SEQ ID NO: 3086787 - RNA, 15 nt, Molluscum contagiosum virus
ccugcaccugcugga

SEQ ID NO: 3086788 - RNA, 20 nt, Molluscum contagiosum virus
gcguccguaagucgaagagg

SEQ ID NO: 3086789 - RNA, 14 nt, Molluscum contagiosum virus
gcacgugcugcugc

SEQ ID NO: 3086790 - RNA, 23 nt, Molluscum contagiosum virus
cuggaguuuaaugacgcgcacgc

SEQ ID NO: 3086791 - RNA, 18 nt, Molluscum contagiosum virus
gucuuaugcauccugaug

SEQ ID NO: 3086792 - RNA, 16 nt, Molluscum contagiosum virus
cuaccugaagcuggac

SEQ ID NO: 3086793 - RNA, 20 nt, Molluscum contagiosum virus
ccuuuguucuuagcagcgcc

SEQ ID NO: 3086794 - RNA, 17 nt, Molluscum contagiosum virus
ccugugccucuugugag

SEQ ID NO: 3086795 - RNA, 23 nt, Molluscum contagiosum virus
gcgcgcccaccagcagccaggcu

SEQ ID NO: 3086796 - RNA, 16 nt, Molluscum contagiosum virus
cgacaacgacagagcc

SEQ ID NO: 3086797 - RNA, 17 nt, Molluscum contagiosum virus
ucaagcaggcaugcaag

SEQ ID NO: 3086798 - RNA, 22 nt, Molluscum contagiosum virus
gcagcgcgacuagccugugccc

SEQ ID NO: 3086799 - RNA, 21 nt, Molluscum contagiosum virus
gcaaccucacucacaugugcu

SEQ ID NO: 3086800 - RNA, 17 nt, Molluscum contagiosum virus
cgacgcgugcauggcac

SEQ ID NO: 3086801 - RNA, 14 nt, Molluscum contagiosum virus
uggcuucuccaccu

SEQ ID NO: 3086802 - RNA, 22 nt, Molluscum contagiosum virus
gccguagugcucaucgugcccg

SEQ ID NO: 3086803 - RNA, 20 nt, Molluscum contagiosum virus
gcggaugugcuagcugcgug

SEQ ID NO: 3086804 - RNA, 14 nt, Molluscum contagiosum virus
cgcgagcaugccgc

SEQ ID NO: 3086805 - RNA, 21 nt, Molluscum contagiosum virus
gcgcccuuugcggcacgggcu

SEQ ID NO: 3086806 - RNA, 22 nt, Molluscum contagiosum virus
guccgcacgaggagccccgcgg

SEQ ID NO: 3086807 - RNA, 13 nt, Molluscum contagiosum virus
guacacgcugacg

SEQ ID NO: 3086808 - RNA, 14 nt, Molluscum contagiosum virus
cacgcgcaaggccg

SEQ ID NO: 3086809 - RNA, 18 nt, Molluscum contagiosum virus
ccgagcgcgcgcgcugcu

SEQ ID NO: 3086810 - RNA, 19 nt, Molluscum contagiosum virus
ccggcaucgcgcugcuggu

SEQ ID NO: 3086811 - RNA, 17 nt, Molluscum contagiosum virus
ggcgcggucgcccgccg

SEQ ID NO: 3086812 - RNA, 16 nt, Molluscum contagiosum virus
agucuuccuggggcug

SEQ ID NO: 3086813 - RNA, 16 nt, Molluscum contagiosum virus
gcaccuggucgagcac

SEQ ID NO: 3086814 - RNA, 24 nt, Molluscum contagiosum virus
cgucgggaaguguugccgccggcc

SEQ ID NO: 3086815 - RNA, 14 nt, Molluscum contagiosum virus
cacgcaaacaaaac

SEQ ID NO: 3086816 - RNA, 16 nt, Molluscum contagiosum virus
guacucgcguccgcgc

SEQ ID NO: 3086817 - RNA, 22 nt, Molluscum contagiosum virus
gaguuugcaaguucgcugcugg

SEQ ID NO: 3086818 - RNA, 21 nt, Molluscum contagiosum virus
cugucaucaccccgcugggcc

SEQ ID NO: 3086819 - RNA, 23 nt, Molluscum contagiosum virus
gcgccgcggcgguugcccgccug

SEQ ID NO: 3086820 - RNA, 17 nt, Molluscum contagiosum virus
cgucgaagaccaccagc

SEQ ID NO: 3086821 - RNA, 15 nt, Molluscum contagiosum virus
gggagaagaugcugc

SEQ ID NO: 3086822 - RNA, 22 nt, Molluscum contagiosum virus
gcccugcucaugcgcaagcagc

SEQ ID NO: 3086823 - RNA, 17 nt, Molluscum contagiosum virus
gcgcaauacugcgggcu

SEQ ID NO: 3086824 - RNA, 16 nt, Molluscum contagiosum virus
guccgucacggacagc

SEQ ID NO: 3086825 - RNA, 23 nt, Molluscum contagiosum virus
cccgcggcguucccgcucaaccu

SEQ ID NO: 3086826 - RNA, 12 nt, Molluscum contagiosum virus
ccugcgcgugcg

SEQ ID NO: 3086827 - RNA, 12 nt, Molluscum contagiosum virus
cagcuccuccac

SEQ ID NO: 3086828 - RNA, 16 nt, Molluscum contagiosum virus
aggcacaccccuguaa

SEQ ID NO: 3086829 - RNA, 16 nt, Molluscum contagiosum virus
cgcgccgcgggccgcc

SEQ ID NO: 3086830 - RNA, 14 nt, Molluscum contagiosum virus
cgcacgggccugcg

SEQ ID NO: 3086831 - RNA, 20 nt, Molluscum contagiosum virus
ccucuccaucaucgagcugc

SEQ ID NO: 3086832 - RNA, 16 nt, Molluscum contagiosum virus
ugccuggcagugccgg

SEQ ID NO: 3086833 - RNA, 20 nt, Molluscum contagiosum virus
gcuacguuccgcgcggggac

SEQ ID NO: 3086834 - RNA, 14 nt, Molluscum contagiosum virus
cggacgugcacgca

SEQ ID NO: 3086835 - RNA, 14 nt, Molluscum contagiosum virus
gccgcacgugcugc

SEQ ID NO: 3086836 - RNA, 15 nt, Molluscum contagiosum virus
ccgagucacgcccca

SEQ ID NO: 3086837 - RNA, 15 nt, Molluscum contagiosum virus
gccaacgccagcugu

SEQ ID NO: 3086838 - RNA, 23 nt, Molluscum contagiosum virus
cgagugcucccgaggcgcgcucu

SEQ ID NO: 3086839 - RNA, 13 nt, Molluscum contagiosum virus
cggccugcccugc

SEQ ID NO: 3086840 - RNA, 19 nt, Molluscum contagiosum virus
cgaagacgucguagcgcuc

SEQ ID NO: 3086841 - RNA, 22 nt, Molluscum contagiosum virus
aggccuggccuucuaccacagg

SEQ ID NO: 3086842 - RNA, 13 nt, Molluscum contagiosum virus
gcagcuucugcuc

SEQ ID NO: 3086843 - RNA, 14 nt, Molluscum contagiosum virus
gccugucucgcaag

SEQ ID NO: 3086844 - RNA, 22 nt, Molluscum contagiosum virus
cgcccggcaccgcggcgggugc

SEQ ID NO: 3086845 - RNA, 19 nt, Molluscum contagiosum virus
cgacaaggaaaggcaccca

SEQ ID NO: 3086846 - RNA, 14 nt, Molluscum contagiosum virus
ugcaugcccagcau

SEQ ID NO: 3086847 - RNA, 13 nt, Molluscum contagiosum virus
ucgcgcgugcgca

SEQ ID NO: 3086848 - RNA, 13 nt, Molluscum contagiosum virus
cacgcgcgggcau

SEQ ID NO: 3086849 - RNA, 14 nt, Molluscum contagiosum virus
gcaagcccagcagc

SEQ ID NO: 3086850 - RNA, 20 nt, Molluscum contagiosum virus
guguacgacgugcugcugca

SEQ ID NO: 3086851 - RNA, 22 nt, Molluscum contagiosum virus
cgcgacgcaaaagaggccugcu

SEQ ID NO: 3086852 - RNA, 20 nt, Molluscum contagiosum virus
cccugcuugcccgcgccgca

SEQ ID NO: 3086853 - RNA, 16 nt, Molluscum contagiosum virus
ucgcagcagugccagc

SEQ ID NO: 3086854 - RNA, 19 nt, Molluscum contagiosum virus
ccgcgcucacugcagcagc

SEQ ID NO: 3086855 - RNA, 16 nt, Molluscum contagiosum virus
ugggcccgccuccggg

SEQ ID NO: 3086856 - RNA, 17 nt, Molluscum contagiosum virus
cuggacggugcuggugc

SEQ ID NO: 3086857 - RNA, 23 nt, Molluscum contagiosum virus
cagacgcgcguccgcaggcguca

SEQ ID NO: 3086858 - RNA, 16 nt, Molluscum contagiosum virus
aaugaaccggcaagcu

SEQ ID NO: 3086859 - RNA, 18 nt, Molluscum contagiosum virus
gcgcgagcagcugcugcg

SEQ ID NO: 3086860 - RNA, 21 nt, Molluscum contagiosum virus
guagcgcgucucugcgcagag

SEQ ID NO: 3086861 - RNA, 11 nt, Molluscum contagiosum virus
gcuagcucugc

SEQ ID NO: 3086862 - RNA, 20 nt, Molluscum contagiosum virus
aaaggcaccccgaaggaaag

SEQ ID NO: 3086863 - RNA, 14 nt, Molluscum contagiosum virus
ggcccaggccaugg

SEQ ID NO: 3086864 - RNA, 16 nt, Molluscum contagiosum virus
cucgcggugcagcugc

SEQ ID NO: 3086865 - RNA, 21 nt, Molluscum contagiosum virus
ccuucguguucgcggacggcg

SEQ ID NO: 3086866 - RNA, 20 nt, Molluscum contagiosum virus
cggaggcacgggcucgaucu

SEQ ID NO: 3086867 - RNA, 13 nt, Molluscum contagiosum virus
cgucuuacugcug

SEQ ID NO: 3086868 - RNA, 16 nt, Molluscum contagiosum virus
cgccaugcuggcgggc

SEQ ID NO: 3086869 - RNA, 22 nt, Molluscum contagiosum virus
cuaaagucgcgcgugcgcagca

SEQ ID NO: 3086870 - RNA, 22 nt, Molluscum contagiosum virus
ccagcuuggugcgcucgagcuc

SEQ ID NO: 3086871 - RNA, 16 nt, Molluscum contagiosum virus
agcgcucgcccagcuc

SEQ ID NO: 3086872 - RNA, 14 nt, Molluscum contagiosum virus
gcgcucaggaccag

SEQ ID NO: 3086873 - RNA, 17 nt, Molluscum contagiosum virus
gcacauccgcuaccugg

SEQ ID NO: 3086874 - RNA, 21 nt, Molluscum contagiosum virus
gacaagcuagacuggagcacg

SEQ ID NO: 3086875 - RNA, 16 nt, Molluscum contagiosum virus
ucuuaugcauccugau

SEQ ID NO: 3086876 - RNA, 17 nt, Molluscum contagiosum virus
gcucauggacaugcucg

SEQ ID NO: 3086877 - RNA, 11 nt, Molluscum contagiosum virus
ugaacaagcug

SEQ ID NO: 3086878 - RNA, 13 nt, Molluscum contagiosum virus
cugguucaugcug

SEQ ID NO: 3086879 - RNA, 21 nt, Molluscum contagiosum virus
agucacgaccgacccaucgga

SEQ ID NO: 3086880 - RNA, 17 nt, Molluscum contagiosum virus
cgcgcuauucucguggc

SEQ ID NO: 3086881 - RNA, 20 nt, Molluscum contagiosum virus
cauugcgucuuacugcugca

SEQ ID NO: 3086882 - RNA, 18 nt, Molluscum contagiosum virus
acgcacagggcugcgugg

SEQ ID NO: 3086883 - RNA, 22 nt, Molluscum contagiosum virus
ccuaccggcagcaugcucacgu

SEQ ID NO: 3086884 - RNA, 14 nt, Molluscum contagiosum virus
gcaucugcgagcgc

SEQ ID NO: 3086885 - RNA, 23 nt, Molluscum contagiosum virus
cgacgccagcgcgcccaccagca

SEQ ID NO: 3086886 - RNA, 19 nt, Molluscum contagiosum virus
auuucguugagaccgccgc

SEQ ID NO: 3086887 - RNA, 12 nt, Molluscum contagiosum virus
gccgaugccuau

SEQ ID NO: 3086888 - RNA, 12 nt, Molluscum contagiosum virus
aagcggugcagc

SEQ ID NO: 3086889 - RNA, 19 nt, Molluscum contagiosum virus
gccuggucacagacacgcu

SEQ ID NO: 3086890 - RNA, 18 nt, Molluscum contagiosum virus
cgcgaaacuggacugagc

SEQ ID NO: 3086891 - RNA, 17 nt, Molluscum contagiosum virus
cugaauaaucucgagca

SEQ ID NO: 3086892 - RNA, 21 nt, Molluscum contagiosum virus
gccccgcgcgcccgcugcgcg

SEQ ID NO: 3086893 - RNA, 18 nt, Molluscum contagiosum virus
gcacuauggacgcuugcu

SEQ ID NO: 3086894 - RNA, 17 nt, Molluscum contagiosum virus
cgcacagccccugcugc

SEQ ID NO: 3086895 - RNA, 22 nt, Molluscum contagiosum virus
gcgguggucuccgcgggcagcc

SEQ ID NO: 3086896 - RNA, 12 nt, Molluscum contagiosum virus
ugcucauccucc

SEQ ID NO: 3086897 - RNA, 18 nt, Molluscum contagiosum virus
gucuccccuugggcucug

SEQ ID NO: 3086898 - RNA, 15 nt, Molluscum contagiosum virus
ccacggcgagcugcc

SEQ ID NO: 3086899 - RNA, 16 nt, Molluscum contagiosum virus
cgcgugucgcggagca

SEQ ID NO: 3086900 - RNA, 14 nt, Molluscum contagiosum virus
guuccacuccugug

SEQ ID NO: 3086901 - RNA, 23 nt, Molluscum contagiosum virus
cuguccaaggugaacgaccucaa

SEQ ID NO: 3086902 - RNA, 14 nt, Molluscum contagiosum virus
gagcggagcuggcc

SEQ ID NO: 3086903 - RNA, 18 nt, Molluscum contagiosum virus
cggccaaccgccugcucu

SEQ ID NO: 3086904 - RNA, 23 nt, Molluscum contagiosum virus
gccugccagcgccagccugcugg

SEQ ID NO: 3086905 - RNA, 19 nt, Molluscum contagiosum virus
gaccgacccaucggagaag

SEQ ID NO: 3086906 - RNA, 19 nt, Molluscum contagiosum virus
gacgccauuuucgugcgcg

SEQ ID NO: 3086907 - RNA, 21 nt, Molluscum contagiosum virus
ccggggcgcgcgcugcgcacg

SEQ ID NO: 3086908 - RNA, 20 nt, Molluscum contagiosum virus
ggaagcaacgacaaggaaag

SEQ ID NO: 3086909 - RNA, 15 nt, Molluscum contagiosum virus
cccgcacgcaccgcg

SEQ ID NO: 3086910 - RNA, 21 nt, Molluscum contagiosum virus
gcaagcgccgccaugcugcgc

SEQ ID NO: 3086911 - RNA, 16 nt, Molluscum contagiosum virus
cugcccccgccaugcc

SEQ ID NO: 3086912 - RNA, 19 nt, Molluscum contagiosum virus
cgccggugcgugcccagca

SEQ ID NO: 3086913 - RNA, 15 nt, Molluscum contagiosum virus
cagagccugcugcuc

SEQ ID NO: 3086914 - RNA, 17 nt, Molluscum contagiosum virus
gggaccgcccuugugga

SEQ ID NO: 3086915 - RNA, 17 nt, Molluscum contagiosum virus
caaacugugcuccugag

SEQ ID NO: 3086916 - RNA, 13 nt, Molluscum contagiosum virus
agcgucaguguug

SEQ ID NO: 3086917 - RNA, 15 nt, Molluscum contagiosum virus
uacuuccugcagcug

SEQ ID NO: 3086918 - RNA, 24 nt, Molluscum contagiosum virus
ggcacagucugggagguguccggg

SEQ ID NO: 3086919 - RNA, 18 nt, Molluscum contagiosum virus
cgagcgcugccgcuucgu

SEQ ID NO: 3086920 - RNA, 18 nt, Molluscum contagiosum virus
gcggagaugacgggcacg

SEQ ID NO: 3086921 - RNA, 22 nt, Molluscum contagiosum virus
gcgcacgaagcggcggacagca

SEQ ID NO: 3086922 - RNA, 23 nt, Molluscum contagiosum virus
aaugacgcgcacgccagccugga

SEQ ID NO: 3086923 - RNA, 19 nt, Molluscum contagiosum virus
ccuagacacgagcgcggca

SEQ ID NO: 3086924 - RNA, 18 nt, Molluscum contagiosum virus
cggauagccccucgagca

SEQ ID NO: 3086925 - RNA, 20 nt, Molluscum contagiosum virus
gcgcgagacgcugcugcaca

SEQ ID NO: 3086926 - RNA, 22 nt, Molluscum contagiosum virus
cggcgcccgcgugcacccuccg

SEQ ID NO: 3086927 - RNA, 22 nt, Molluscum contagiosum virus
cuuuuccgcgaaguccugggcg

SEQ ID NO: 3086928 - RNA, 22 nt, Molluscum contagiosum virus
gagcagcugcugcgcuucgccg

SEQ ID NO: 3086929 - RNA, 24 nt, Molluscum contagiosum virus
acuccuuccggagacaccagcucc

SEQ ID NO: 3086930 - RNA, 12 nt, Molluscum contagiosum virus
cuaggcgcggcg

SEQ ID NO: 3086931 - RNA, 19 nt, Molluscum contagiosum virus
gaugccguuuucuccgugc

SEQ ID NO: 3086932 - RNA, 19 nt, Molluscum contagiosum virus
gacaugucguaccuggugg

SEQ ID NO: 3086933 - RNA, 21 nt, Molluscum contagiosum virus
gagacugcuacgucgcggcgc

SEQ ID NO: 3086934 - RNA, 17 nt, Molluscum contagiosum virus
cuguuugccacggccgc

SEQ ID NO: 3086935 - RNA, 18 nt, Molluscum contagiosum virus
cgacuuuguccugagccu

SEQ ID NO: 3086936 - RNA, 14 nt, Molluscum contagiosum virus
cagagaaaggcacc

SEQ ID NO: 3086937 - RNA, 18 nt, Molluscum contagiosum virus
gcaggcucuaagcgcacg

SEQ ID NO: 3086938 - RNA, 21 nt, Molluscum contagiosum virus
cacacuugcgcguucgcaaag

SEQ ID NO: 3086939 - RNA, 22 nt, Molluscum contagiosum virus
ucgcccaucaucgccagcauca

SEQ ID NO: 3086940 - RNA, 20 nt, Molluscum contagiosum virus
gcgcgacuuggggcucgccg

SEQ ID NO: 3086941 - RNA, 13 nt, Molluscum contagiosum virus
cgcgcgcugcgcg

SEQ ID NO: 3086942 - RNA, 18 nt, Molluscum contagiosum virus
cggaugucacgcagaagu

SEQ ID NO: 3086943 - RNA, 12 nt, Molluscum contagiosum virus
cagagcacgaga

SEQ ID NO: 3086944 - RNA, 22 nt, Molluscum contagiosum virus
gccuacgcgcgcguaacagcgc

SEQ ID NO: 3086945 - RNA, 17 nt, Molluscum contagiosum virus
cuuguucucggagaaca

SEQ ID NO: 3086946 - RNA, 14 nt, Molluscum contagiosum virus
ccgcacguggaguc

SEQ ID NO: 3086947 - RNA, 14 nt, Molluscum contagiosum virus
uggcggugagcgcc

SEQ ID NO: 3086948 - RNA, 20 nt, Molluscum contagiosum virus
gacgcgugcaagcccagcag

SEQ ID NO: 3086949 - RNA, 22 nt, Molluscum contagiosum virus
acgagcaggcgcagcgcggccu

SEQ ID NO: 3086950 - RNA, 18 nt, Molluscum contagiosum virus
gcgcacucgggugcccgg

SEQ ID NO: 3086951 - RNA, 23 nt, Molluscum contagiosum virus
guguaguuaaaugacggagccgc

SEQ ID NO: 3086952 - RNA, 13 nt, Molluscum contagiosum virus
gccuggcggcagc

SEQ ID NO: 3086953 - RNA, 17 nt, Molluscum contagiosum virus
cgugcacuagcacgggc

SEQ ID NO: 3086954 - RNA, 15 nt, Molluscum contagiosum virus
ggcgcgcagcucgcc

SEQ ID NO: 3086955 - RNA, 16 nt, Molluscum contagiosum virus
gucgacguggagccug

SEQ ID NO: 3086956 - RNA, 15 nt, Molluscum contagiosum virus
cagcgcgcagaagcc

SEQ ID NO: 3086957 - RNA, 13 nt, Molluscum contagiosum virus
cgagcaggcgcag

SEQ ID NO: 3086958 - RNA, 17 nt, Molluscum contagiosum virus
cuccgacgugcugcgca

SEQ ID NO: 3086959 - RNA, 14 nt, Molluscum contagiosum virus
uccgcgggcgcgcg

SEQ ID NO: 3086960 - RNA, 20 nt, Molluscum contagiosum virus
gucucgaacucgugcgccgc

SEQ ID NO: 3086961 - RNA, 18 nt, Molluscum contagiosum virus
aagaggccggcacaagcc

SEQ ID NO: 3086962 - RNA, 23 nt, Molluscum contagiosum virus
aguccccgguucaaauccugguu

SEQ ID NO: 3086963 - RNA, 20 nt, Molluscum contagiosum virus
auaaucggucagacuuucug

SEQ ID NO: 3086964 - RNA, 18 nt, Molluscum contagiosum virus
ccgugccgccggcgccgc

SEQ ID NO: 3086965 - RNA, 19 nt, Molluscum contagiosum virus
ucuuccagcacugcgccaa

SEQ ID NO: 3086966 - RNA, 20 nt, Molluscum contagiosum virus
caugcucaagcaccugcgcu

SEQ ID NO: 3086967 - RNA, 15 nt, Molluscum contagiosum virus
ggcggcaagcccgga

SEQ ID NO: 3086968 - RNA, 22 nt, Molluscum contagiosum virus
ggccgugcucacggacucgccg

SEQ ID NO: 3086969 - RNA, 14 nt, Molluscum contagiosum virus
cgagugcuggagca

SEQ ID NO: 3086970 - RNA, 13 nt, Molluscum contagiosum virus
gugccucugccag

SEQ ID NO: 3086971 - RNA, 13 nt, Molluscum contagiosum virus
cgagccagccagg

SEQ ID NO: 3086972 - RNA, 19 nt, Molluscum contagiosum virus
aucgucgcggccguggcac

SEQ ID NO: 3086973 - RNA, 17 nt, Molluscum contagiosum virus
acaaggaaaggcaccca

SEQ ID NO: 3086974 - RNA, 19 nt, Molluscum contagiosum virus
ccucgagcacgccuccaag

SEQ ID NO: 3086975 - RNA, 20 nt, Molluscum contagiosum virus
ggagguacugccgccaggaa

SEQ ID NO: 3086976 - RNA, 18 nt, Molluscum contagiosum virus
gacgaaggcaagcucccg

SEQ ID NO: 3086977 - RNA, 19 nt, Molluscum contagiosum virus
cugcucgcacccgcgccgc

SEQ ID NO: 3086978 - RNA, 23 nt, Molluscum contagiosum virus
gucaagaugcugguucugcgcug

SEQ ID NO: 3086979 - RNA, 13 nt, Molluscum contagiosum virus
gcgcauccucucc

SEQ ID NO: 3086980 - RNA, 14 nt, Molluscum contagiosum virus
agcccaaggagcug

SEQ ID NO: 3086981 - RNA, 17 nt, Molluscum contagiosum virus
gccugccagcagagcug

SEQ ID NO: 3086982 - RNA, 16 nt, Molluscum contagiosum virus
gacagagugccuggcg

SEQ ID NO: 3086983 - RNA, 21 nt, Molluscum contagiosum virus
cgagcucgcgcgccagcacgc

SEQ ID NO: 3086984 - RNA, 12 nt, Molluscum contagiosum virus
uguccugagccu

SEQ ID NO: 3086985 - RNA, 16 nt, Molluscum contagiosum virus
gcaguucgagcugcug

SEQ ID NO: 3086986 - RNA, 13 nt, Molluscum contagiosum virus
gaaacaugugucu

SEQ ID NO: 3086987 - RNA, 14 nt, Molluscum contagiosum virus
cgaguacugcugcg

SEQ ID NO: 3086988 - RNA, 19 nt, Molluscum contagiosum virus
cucauuguucggaggcugc

SEQ ID NO: 3086989 - RNA, 11 nt, Molluscum contagiosum virus
guggcugugcg

SEQ ID NO: 3086990 - RNA, 22 nt, Molluscum contagiosum virus
gcgcaagaugacgacgggagag

SEQ ID NO: 3086991 - RNA, 22 nt, Molluscum contagiosum virus
ccccgagggcgcgaccggcgug

SEQ ID NO: 3086992 - RNA, 19 nt, Molluscum contagiosum virus
cugcaggaccugcuggugg

SEQ ID NO: 3086993 - RNA, 18 nt, Molluscum contagiosum virus
cgccggcgcggcgagccg

SEQ ID NO: 3086994 - RNA, 14 nt, Molluscum contagiosum virus
ccagcacugcgcca

SEQ ID NO: 3086995 - RNA, 23 nt, Molluscum contagiosum virus
gcacgucgaagaccaccagcacc

SEQ ID NO: 3086996 - RNA, 17 nt, Molluscum contagiosum virus
ucgagaagaccuguucu

SEQ ID NO: 3086997 - RNA, 16 nt, Molluscum contagiosum virus
uaccggagacaccagc

SEQ ID NO: 3086998 - RNA, 11 nt, Molluscum contagiosum virus
gacggcaggcc

SEQ ID NO: 3086999 - RNA, 20 nt, Molluscum contagiosum virus
gagaccgucaaccugcugcc

SEQ ID NO: 3087000 - RNA, 14 nt, Molluscum contagiosum virus
gcaccagcgcgcag

SEQ ID NO: 3087001 - RNA, 17 nt, Molluscum contagiosum virus
gacgaagcgcucgcucg

SEQ ID NO: 3087002 - RNA, 17 nt, Molluscum contagiosum virus
ggcacgcgagcgcgagu

SEQ ID NO: 3087003 - RNA, 18 nt, Molluscum contagiosum virus
cggcaguguccugguucu

SEQ ID NO: 3087004 - RNA, 12 nt, Molluscum contagiosum virus
ggcagaagcuca

SEQ ID NO: 3087005 - RNA, 16 nt, Molluscum contagiosum virus
accgcaagcucauggu

SEQ ID NO: 3087006 - RNA, 19 nt, Molluscum contagiosum virus
aucgacauggucgcauccg

SEQ ID NO: 3087007 - RNA, 13 nt, Molluscum contagiosum virus
gcgcggcagcagc

SEQ ID NO: 3087008 - RNA, 18 nt, Molluscum contagiosum virus
cucugggcgucgcacagu

SEQ ID NO: 3087009 - RNA, 15 nt, Molluscum contagiosum virus
gcucugcagcgccgc

SEQ ID NO: 3087010 - RNA, 20 nt, Molluscum contagiosum virus
cucggaggggcuccgggccc

SEQ ID NO: 3087011 - RNA, 15 nt, Molluscum contagiosum virus
cuucucgaacuccag

SEQ ID NO: 3087012 - RNA, 15 nt, Molluscum contagiosum virus
ucaagaaggcgcugg

SEQ ID NO: 3087013 - RNA, 17 nt, Molluscum contagiosum virus
gacccagaagcgagagc

SEQ ID NO: 3087014 - RNA, 15 nt, Molluscum contagiosum virus
gucucgaugugacaa

SEQ ID NO: 3087015 - RNA, 19 nt, Molluscum contagiosum virus
auggcaggugcgcaacugc

SEQ ID NO: 3087016 - RNA, 14 nt, Molluscum contagiosum virus
gacggcuaaagaga

SEQ ID NO: 3087017 - RNA, 22 nt, Molluscum contagiosum virus
uaugcgaagcgucgagccccug

SEQ ID NO: 3087018 - RNA, 19 nt, Molluscum contagiosum virus
acgagccgcugcuccugcu

SEQ ID NO: 3087019 - RNA, 18 nt, Molluscum contagiosum virus
ucgugcugggccugccgc

SEQ ID NO: 3087020 - RNA, 18 nt, Molluscum contagiosum virus
cgccugccgcgagcacug

SEQ ID NO: 3087021 - RNA, 21 nt, Molluscum contagiosum virus
cacguggagucacgaccgacc

SEQ ID NO: 3087022 - RNA, 16 nt, Molluscum contagiosum virus
ccuuggugcucauccu

SEQ ID NO: 3087023 - RNA, 17 nt, Molluscum contagiosum virus
gggagccagccucucuc

SEQ ID NO: 3087024 - RNA, 16 nt, Molluscum contagiosum virus
acgaaaucgcaaagca

SEQ ID NO: 3087025 - RNA, 13 nt, Molluscum contagiosum virus
cgcggaacuggac

SEQ ID NO: 3087026 - RNA, 23 nt, Molluscum contagiosum virus
agcccgggcccgugcccgagccc

SEQ ID NO: 3087027 - RNA, 15 nt, Molluscum contagiosum virus
guccgagcuguucaa

SEQ ID NO: 3087028 - RNA, 16 nt, Molluscum contagiosum virus
gcgaccagcugguccu

SEQ ID NO: 3087029 - RNA, 13 nt, Molluscum contagiosum virus
acagcagccgcag

SEQ ID NO: 3087030 - RNA, 14 nt, Molluscum contagiosum virus
cccugcgggcgcuc

SEQ ID NO: 3087031 - RNA, 14 nt, Molluscum contagiosum virus
cuggccucugccug

SEQ ID NO: 3087032 - RNA, 12 nt, Molluscum contagiosum virus
gagcggcacggg

SEQ ID NO: 3087033 - RNA, 18 nt, Molluscum contagiosum virus
cgcgacguccuagagcag

SEQ ID NO: 3087034 - RNA, 22 nt, Molluscum contagiosum virus
gcucgucaaugcgcacgugcuc

SEQ ID NO: 3087035 - RNA, 14 nt, Molluscum contagiosum virus
gcgcgcgcgcgcag

SEQ ID NO: 3087036 - RNA, 20 nt, Molluscum contagiosum virus
ucuucgacaacaugcucgug

SEQ ID NO: 3087037 - RNA, 15 nt, Molluscum contagiosum virus
accuguuaaauggac

SEQ ID NO: 3087038 - RNA, 23 nt, Molluscum contagiosum virus
gcacaacuugggcccgccuccgg

SEQ ID NO: 3087039 - RNA, 16 nt, Molluscum contagiosum virus
gcgcuuguccucuugg

SEQ ID NO: 3087040 - RNA, 21 nt, Molluscum contagiosum virus
uguuucgcaugcacagccgcu

SEQ ID NO: 3087041 - RNA, 15 nt, Molluscum contagiosum virus
ccagccacgaagagu

SEQ ID NO: 3087042 - RNA, 21 nt, Molluscum contagiosum virus
cgcaucagagaagugcuccgc

SEQ ID NO: 3087043 - RNA, 19 nt, Molluscum contagiosum virus
gccguguacgucuuuccca

SEQ ID NO: 3087044 - RNA, 17 nt, Molluscum contagiosum virus
ucgcucagccccagcag

SEQ ID NO: 3087045 - RNA, 23 nt, Molluscum contagiosum virus
uguccgcggacgcgggccugucc

SEQ ID NO: 3087046 - RNA, 14 nt, Molluscum contagiosum virus
cagccgcugcugcu

SEQ ID NO: 3087047 - RNA, 17 nt, Molluscum contagiosum virus
cgugcguuccgggcccg

SEQ ID NO: 3087048 - RNA, 16 nt, Molluscum contagiosum virus
caagucaccgcuccgc

SEQ ID NO: 3087049 - RNA, 15 nt, Molluscum contagiosum virus
ccgggccugcggcgg

SEQ ID NO: 3087050 - RNA, 23 nt, Molluscum contagiosum virus
accauccagccgucgccgcgccc

SEQ ID NO: 3087051 - RNA, 17 nt, Molluscum contagiosum virus
gagggaugcacacacuc

SEQ ID NO: 3087052 - RNA, 16 nt, Molluscum contagiosum virus
gacggcaguguccugg

SEQ ID NO: 3087053 - RNA, 17 nt, Molluscum contagiosum virus
ccaucggagaagugcuc

SEQ ID NO: 3087054 - RNA, 12 nt, Molluscum contagiosum virus
gcgccgcuuccu

SEQ ID NO: 3087055 - RNA, 15 nt, Molluscum contagiosum virus
gccgcgcugcuggcc

SEQ ID NO: 3087056 - RNA, 14 nt, Molluscum contagiosum virus
ggccuccggagaag

SEQ ID NO: 3087057 - RNA, 13 nt, Molluscum contagiosum virus
aacuuuuccugcg

SEQ ID NO: 3087058 - RNA, 22 nt, Molluscum contagiosum virus
cacuuccugcuagaaugcgugu

SEQ ID NO: 3087059 - RNA, 14 nt, Molluscum contagiosum virus
ggcagugcuugagc

SEQ ID NO: 3087060 - RNA, 13 nt, Molluscum contagiosum virus
acugccuggucac

SEQ ID NO: 3087061 - RNA, 17 nt, Molluscum contagiosum virus
ucccccgccaggaacga

SEQ ID NO: 3087062 - RNA, 21 nt, Molluscum contagiosum virus
gagcgagugcgcgugcgccug

SEQ ID NO: 3087063 - RNA, 16 nt, Molluscum contagiosum virus
cuaccuggugcugggg

SEQ ID NO: 3087064 - RNA, 16 nt, Molluscum contagiosum virus
guccagcggcugcccg

SEQ ID NO: 3087065 - RNA, 11 nt, Molluscum contagiosum virus
aacaaggccaa

SEQ ID NO: 3087066 - RNA, 18 nt, Molluscum contagiosum virus
gugcgguacaugcugucc

SEQ ID NO: 3087067 - RNA, 15 nt, Molluscum contagiosum virus
cgacgccagcgcgcc

SEQ ID NO: 3087068 - RNA, 19 nt, Molluscum contagiosum virus
gcucauggcgcgcaaccag

SEQ ID NO: 3087069 - RNA, 20 nt, Molluscum contagiosum virus
cggcgcggaucugcgcacac

SEQ ID NO: 3087070 - RNA, 22 nt, Molluscum contagiosum virus
ugccgcucggaggcuugccccg

SEQ ID NO: 3087071 - RNA, 15 nt, Molluscum contagiosum virus
gagcuugcgcacgcc

SEQ ID NO: 3087072 - RNA, 15 nt, Molluscum contagiosum virus
cucccgggcucuguc

SEQ ID NO: 3087073 - RNA, 15 nt, Molluscum contagiosum virus
gucgcgacggagaug

SEQ ID NO: 3087074 - RNA, 15 nt, Molluscum contagiosum virus
gcaucuucugccagg

SEQ ID NO: 3087075 - RNA, 16 nt, Molluscum contagiosum virus
cccaugcucgagccug

SEQ ID NO: 3087076 - RNA, 18 nt, Molluscum contagiosum virus
accccgaaggaaaggccc

SEQ ID NO: 3087077 - RNA, 13 nt, Molluscum contagiosum virus
cgugccagcucau

SEQ ID NO: 3087078 - RNA, 13 nt, Molluscum contagiosum virus
accugcugccgag

SEQ ID NO: 3087079 - RNA, 16 nt, Molluscum contagiosum virus
ggcaccugcaggaaag

SEQ ID NO: 3087080 - RNA, 21 nt, Molluscum contagiosum virus
ucaacgcgcgugcguacgugc

SEQ ID NO: 3087081 - RNA, 22 nt, Molluscum contagiosum virus
gcacggugaucaugagcgugga

SEQ ID NO: 3087082 - RNA, 19 nt, Molluscum contagiosum virus
gcacgucuucgccgugugc

SEQ ID NO: 3087083 - RNA, 19 nt, Molluscum contagiosum virus
gcgcgacaugcugcccgcg

SEQ ID NO: 3087084 - RNA, 20 nt, Molluscum contagiosum virus
gcuucggaacgcucuucgca

SEQ ID NO: 3087085 - RNA, 17 nt, Molluscum contagiosum virus
ccgcaucggcgccgccc

SEQ ID NO: 3087086 - RNA, 22 nt, Molluscum contagiosum virus
agcuccagcauagaacacagcu

SEQ ID NO: 3087087 - RNA, 17 nt, Molluscum contagiosum virus
gacugucgacagagaag

SEQ ID NO: 3087088 - RNA, 19 nt, Molluscum contagiosum virus
cgcucucgggcaugcacuu

SEQ ID NO: 3087089 - RNA, 14 nt, Molluscum contagiosum virus
gcgugcgccgugcg

SEQ ID NO: 3087090 - RNA, 22 nt, Molluscum contagiosum virus
gcguacucgugucacaauggca

SEQ ID NO: 3087091 - RNA, 19 nt, Molluscum contagiosum virus
gccgcagaacacgggggcu

SEQ ID NO: 3087092 - RNA, 12 nt, Molluscum contagiosum virus
gcagcugcugcg

SEQ ID NO: 3087093 - RNA, 16 nt, Molluscum contagiosum virus
gaacguuggcccgcaa

SEQ ID NO: 3087094 - RNA, 15 nt, Molluscum contagiosum virus
cuccaagaagaggcc

SEQ ID NO: 3087095 - RNA, 13 nt, Molluscum contagiosum virus
ggcgcgcgagcac

SEQ ID NO: 3087096 - RNA, 17 nt, Molluscum contagiosum virus
gcgggccuguaccugcg

SEQ ID NO: 3087097 - RNA, 15 nt, Molluscum contagiosum virus
auggaugcuggaugg

SEQ ID NO: 3087098 - RNA, 18 nt, Molluscum contagiosum virus
ccgcaaacacugucucug

SEQ ID NO: 3087099 - RNA, 22 nt, Molluscum contagiosum virus
gccgcaugcaccuacgcgccga

SEQ ID NO: 3087100 - RNA, 13 nt, Molluscum contagiosum virus
ucccgacagcaga

SEQ ID NO: 3087101 - RNA, 12 nt, Molluscum contagiosum virus
gcgcgcuucuca

SEQ ID NO: 3087102 - RNA, 18 nt, Molluscum contagiosum virus
cugccgcuugaaggacgc

SEQ ID NO: 3087103 - RNA, 15 nt, Molluscum contagiosum virus
cagcggaugcagaac

SEQ ID NO: 3087104 - RNA, 14 nt, Molluscum contagiosum virus
aggcugcucccucu

SEQ ID NO: 3087105 - RNA, 17 nt, Molluscum contagiosum virus
augagguacuccacgcc

SEQ ID NO: 3087106 - RNA, 17 nt, Molluscum contagiosum virus
augcugugcggcacgcc

SEQ ID NO: 3087107 - RNA, 18 nt, Molluscum contagiosum virus
aucuugguggugaccgag

SEQ ID NO: 3087108 - RNA, 14 nt, Molluscum contagiosum virus
cagcggcgccgcag

SEQ ID NO: 3087109 - RNA, 15 nt, Molluscum contagiosum virus
ucacgcccucucgag

SEQ ID NO: 3087110 - RNA, 22 nt, Molluscum contagiosum virus
ccgugacagagugccuggcgcg

SEQ ID NO: 3087111 - RNA, 16 nt, Molluscum contagiosum virus
cgggcacccagcccug

SEQ ID NO: 3087112 - RNA, 15 nt, Molluscum contagiosum virus
cgggaagcacagucc

SEQ ID NO: 3087113 - RNA, 15 nt, Molluscum contagiosum virus
acacucgcggcaagu

SEQ ID NO: 3087114 - RNA, 20 nt, Molluscum contagiosum virus
agccgccuggccgaacugcu

SEQ ID NO: 3087115 - RNA, 14 nt, Molluscum contagiosum virus
ugcgcgucugugcg

SEQ ID NO: 3087116 - RNA, 20 nt, Molluscum contagiosum virus
cacaacuugggcccgccucc

SEQ ID NO: 3087117 - RNA, 18 nt, Molluscum contagiosum virus
agucaaugacacgagccc

SEQ ID NO: 3087118 - RNA, 20 nt, Molluscum contagiosum virus
agccagucucgcgcuuccag

SEQ ID NO: 3087119 - RNA, 20 nt, Molluscum contagiosum virus
gcugcuagagaaccugugcg

SEQ ID NO: 3087120 - RNA, 19 nt, Molluscum contagiosum virus
gugcccaugcucgagccug

SEQ ID NO: 3087121 - RNA, 15 nt, Molluscum contagiosum virus
cggaggcggagcugc

SEQ ID NO: 3087122 - RNA, 20 nt, Molluscum contagiosum virus
gggcgcgaccuuagcgaggu

SEQ ID NO: 3087123 - RNA, 21 nt, Molluscum contagiosum virus
cugcccuuuagcguggcgcgc

SEQ ID NO: 3087124 - RNA, 17 nt, Molluscum contagiosum virus
caauggcgcgcgagcac

SEQ ID NO: 3087125 - RNA, 23 nt, Molluscum contagiosum virus
cucuccgucagggaugccagugc

SEQ ID NO: 3087126 - RNA, 16 nt, Molluscum contagiosum virus
gacguacgagcaggcg

SEQ ID NO: 3087127 - RNA, 15 nt, Molluscum contagiosum virus
gcgccgggccgcggu

SEQ ID NO: 3087128 - RNA, 16 nt, Molluscum contagiosum virus
ugugcccaguuauucu

SEQ ID NO: 3087129 - RNA, 13 nt, Molluscum contagiosum virus
cucaccgcgcaca

SEQ ID NO: 3087130 - RNA, 16 nt, Molluscum contagiosum virus
gcacgagcugcugcgc

SEQ ID NO: 3087131 - RNA, 18 nt, Molluscum contagiosum virus
acagcauccccaacaucc

SEQ ID NO: 3087132 - RNA, 13 nt, Molluscum contagiosum virus
uggcggagguggc

SEQ ID NO: 3087133 - RNA, 19 nt, Molluscum contagiosum virus
gcuccgcggaggccaagca

SEQ ID NO: 3087134 - RNA, 20 nt, Molluscum contagiosum virus
ccagcgcgcccucgcgcgcg

SEQ ID NO: 3087135 - RNA, 15 nt, Molluscum contagiosum virus
uagcaacuugcucua

SEQ ID NO: 3087136 - RNA, 13 nt, Molluscum contagiosum virus
cacaugcagcugc

SEQ ID NO: 3087137 - RNA, 18 nt, Molluscum contagiosum virus
cccgcuaugaacagcgcg

SEQ ID NO: 3087138 - RNA, 22 nt, Molluscum contagiosum virus
ugaggaggccaacgccagcugu

SEQ ID NO: 3087139 - RNA, 19 nt, Molluscum contagiosum virus
agcauuccuuguccuggca

SEQ ID NO: 3087140 - RNA, 22 nt, Molluscum contagiosum virus
gaagcgcucgcucgcgcgcagc

SEQ ID NO: 3087141 - RNA, 22 nt, Molluscum contagiosum virus
agcaccgcgccccacugugcca

SEQ ID NO: 3087142 - RNA, 22 nt, Molluscum contagiosum virus
gcacgcucuacggcgugcugug

SEQ ID NO: 3087143 - RNA, 18 nt, Molluscum contagiosum virus
acaugccuuucuuccaga

SEQ ID NO: 3087144 - RNA, 16 nt, Molluscum contagiosum virus
ccggagacaccagcuc

SEQ ID NO: 3087145 - RNA, 16 nt, Molluscum contagiosum virus
ccuacagcgcgcugca

SEQ ID NO: 3087146 - RNA, 13 nt, Molluscum contagiosum virus
gccagagucgccg

SEQ ID NO: 3087147 - RNA, 20 nt, Molluscum contagiosum virus
gcccgacuuuucgcgccgcg

SEQ ID NO: 3087148 - RNA, 17 nt, Molluscum contagiosum virus
accgguuccgugcgcuc

SEQ ID NO: 3087149 - RNA, 23 nt, Molluscum contagiosum virus
guccgcggacgcgggccuguccg

SEQ ID NO: 3087150 - RNA, 18 nt, Molluscum contagiosum virus
cuggccaucgagcuuccc

SEQ ID NO: 3087151 - RNA, 18 nt, Molluscum contagiosum virus
ccuccgguacguacagug

SEQ ID NO: 3087152 - RNA, 17 nt, Molluscum contagiosum virus
gccagccugcuggcacc

SEQ ID NO: 3087153 - RNA, 23 nt, Molluscum contagiosum virus
acauccugccacaccagcuggcu

SEQ ID NO: 3087154 - RNA, 16 nt, Molluscum contagiosum virus
aggaaaggcaccccga

SEQ ID NO: 3087155 - RNA, 15 nt, Molluscum contagiosum virus
gucaguacaugcccg

SEQ ID NO: 3087156 - RNA, 17 nt, Molluscum contagiosum virus
cuagcgagcgcccgugc

SEQ ID NO: 3087157 - RNA, 23 nt, Molluscum contagiosum virus
aaaaggccggguuuuuucccaug

SEQ ID NO: 3087158 - RNA, 16 nt, Molluscum contagiosum virus
gaacacggacacuugg

SEQ ID NO: 3087159 - RNA, 22 nt, Molluscum contagiosum virus
cggugucgguaccugcaggcuc

SEQ ID NO: 3087160 - RNA, 13 nt, Molluscum contagiosum virus
cggcuaaagagag

SEQ ID NO: 3087161 - RNA, 19 nt, Molluscum contagiosum virus
gcaagucaccgcuccgcag

SEQ ID NO: 3087162 - RNA, 18 nt, Molluscum contagiosum virus
ggcgacaacgacagagcc

SEQ ID NO: 3087163 - RNA, 16 nt, Molluscum contagiosum virus
acucaacaagcugcug

SEQ ID NO: 3087164 - RNA, 20 nt, Molluscum contagiosum virus
ccggcgcaucagagaagugc

SEQ ID NO: 3087165 - RNA, 21 nt, Molluscum contagiosum virus
cgccgcgggcgcagagccugc

SEQ ID NO: 3087166 - RNA, 14 nt, Molluscum contagiosum virus
cacgcccgcgcugc

SEQ ID NO: 3087167 - RNA, 14 nt, Molluscum contagiosum virus
gagggagccucgcu

SEQ ID NO: 3087168 - RNA, 19 nt, Molluscum contagiosum virus
auaccaugcucucgcugcu

SEQ ID NO: 3087169 - RNA, 18 nt, Molluscum contagiosum virus
agggaugcgcacacuugc

SEQ ID NO: 3087170 - RNA, 18 nt, Molluscum contagiosum virus
cguccucaagcgcccucg

SEQ ID NO: 3087171 - RNA, 18 nt, Molluscum contagiosum virus
gaagcuugcucagcagcu

SEQ ID NO: 3087172 - RNA, 21 nt, Molluscum contagiosum virus
gaucugcucgcagucgucgcc

SEQ ID NO: 3087173 - RNA, 13 nt, Molluscum contagiosum virus
auccgcuaccugg

SEQ ID NO: 3087174 - RNA, 18 nt, Molluscum contagiosum virus
ugcaguuucuccucgaag

SEQ ID NO: 3087175 - RNA, 14 nt, Molluscum contagiosum virus
gacacgagggccuu

SEQ ID NO: 3087176 - RNA, 14 nt, Molluscum contagiosum virus
agccgccgcugccg

SEQ ID NO: 3087177 - RNA, 13 nt, Molluscum contagiosum virus
cccgggcccgagc

SEQ ID NO: 3087178 - RNA, 21 nt, Molluscum contagiosum virus
gccucugccugcaaggagguc

SEQ ID NO: 3087179 - RNA, 22 nt, Molluscum contagiosum virus
gucaagaacaauuacuccagcg

SEQ ID NO: 3087180 - RNA, 14 nt, Molluscum contagiosum virus
cgccgaagagccgc

SEQ ID NO: 3087181 - RNA, 13 nt, Molluscum contagiosum virus
cgcaggcucgucg

SEQ ID NO: 3087182 - RNA, 20 nt, Molluscum contagiosum virus
cagcuccagcauggcgccac

SEQ ID NO: 3087183 - RNA, 15 nt, Molluscum contagiosum virus
cuccuccggggcgca

SEQ ID NO: 3087184 - RNA, 14 nt, Molluscum contagiosum virus
acaagggcagcuca

SEQ ID NO: 3087185 - RNA, 17 nt, Molluscum contagiosum virus
gcuccauggagcgccuu

SEQ ID NO: 3087186 - RNA, 16 nt, Molluscum contagiosum virus
acugucgcgcagcugc

SEQ ID NO: 3087187 - RNA, 13 nt, Molluscum contagiosum virus
uggcccccgccuu

SEQ ID NO: 3087188 - RNA, 17 nt, Molluscum contagiosum virus
cguggcgcgcgagcugc

SEQ ID NO: 3087189 - RNA, 19 nt, Molluscum contagiosum virus
cggagcugugccgcagcaa

SEQ ID NO: 3087190 - RNA, 15 nt, Molluscum contagiosum virus
gcuccagggcucaag

SEQ ID NO: 3087191 - RNA, 18 nt, Molluscum contagiosum virus
cgcacacgaucucgggug

SEQ ID NO: 3087192 - RNA, 24 nt, Molluscum contagiosum virus
cugcgugcgauugccccugggcuu

SEQ ID NO: 3087193 - RNA, 20 nt, Molluscum contagiosum virus
gcccgagcgcguccaugagc

SEQ ID NO: 3087194 - RNA, 18 nt, Molluscum contagiosum virus
gccccacugugccagcag

SEQ ID NO: 3087195 - RNA, 23 nt, Molluscum contagiosum virus
cgcgaguugcgucucccgcggcc

SEQ ID NO: 3087196 - RNA, 16 nt, Molluscum contagiosum virus
cugcacugcagcgagc

SEQ ID NO: 3087197 - RNA, 15 nt, Molluscum contagiosum virus
gccgacaugcgcacg

SEQ ID NO: 3087198 - RNA, 13 nt, Molluscum contagiosum virus
ggacuucucuguc

SEQ ID NO: 3087199 - RNA, 14 nt, Molluscum contagiosum virus
cgcuuguccucuug

SEQ ID NO: 3087200 - RNA, 17 nt, Molluscum contagiosum virus
ccaagaagaggccagca

SEQ ID NO: 3087201 - RNA, 12 nt, Molluscum contagiosum virus
gcggccgccauc

SEQ ID NO: 3087202 - RNA, 19 nt, Molluscum contagiosum virus
cacuugccgggcgacggcg

SEQ ID NO: 3087203 - RNA, 19 nt, Molluscum contagiosum virus
cagccgcugcgccgccagc

SEQ ID NO: 3087204 - RNA, 19 nt, Molluscum contagiosum virus
ugcgagucucuguaacaag

SEQ ID NO: 3087205 - RNA, 23 nt, Molluscum contagiosum virus
cgaagguuuugugccgagcggca

SEQ ID NO: 3087206 - RNA, 15 nt, Molluscum contagiosum virus
cgcggcggcagcuac

SEQ ID NO: 3087207 - RNA, 17 nt, Molluscum contagiosum virus
aaggcacccgcaggaaa

SEQ ID NO: 3087208 - RNA, 22 nt, Molluscum contagiosum virus
ugaacaaauacaguggcugugc

SEQ ID NO: 3087209 - RNA, 11 nt, Molluscum contagiosum virus
cacgcggccau

SEQ ID NO: 3087210 - RNA, 13 nt, Molluscum contagiosum virus
ccgucgcccggca

SEQ ID NO: 3087211 - RNA, 14 nt, Molluscum contagiosum virus
caaacgugcaugca

SEQ ID NO: 3087212 - RNA, 13 nt, Molluscum contagiosum virus
auuucacaagugg

SEQ ID NO: 3087213 - RNA, 10 nt, Molluscum contagiosum virus
caagcugccc

SEQ ID NO: 3087214 - RNA, 17 nt, Molluscum contagiosum virus
aguuccagcagcgccag

SEQ ID NO: 3087215 - RNA, 15 nt, Molluscum contagiosum virus
cgagacucuggaagc

SEQ ID NO: 3087216 - RNA, 23 nt, Molluscum contagiosum virus
gaugcgguccgacucggugcuca

SEQ ID NO: 3087217 - RNA, 18 nt, Molluscum contagiosum virus
gagaaccgccgucaacau

SEQ ID NO: 3087218 - RNA, 17 nt, Molluscum contagiosum virus
gacuacgcgcugcuaga

SEQ ID NO: 3087219 - RNA, 13 nt, Molluscum contagiosum virus
cgaagcaaaagcg

SEQ ID NO: 3087220 - RNA, 20 nt, Molluscum contagiosum virus
gaggccggccgugcagagca

SEQ ID NO: 3087221 - RNA, 23 nt, Molluscum contagiosum virus
acagcaugaacucgcugcugcuc

SEQ ID NO: 3087222 - RNA, 21 nt, Molluscum contagiosum virus
cacgcgggacgcgugccuggc

SEQ ID NO: 3087223 - RNA, 16 nt, Molluscum contagiosum virus
cucgcgcgcagcacac

SEQ ID NO: 3087224 - RNA, 15 nt, Molluscum contagiosum virus
gcgcgcugcgccgcu

SEQ ID NO: 3087225 - RNA, 14 nt, Molluscum contagiosum virus
gcgcuggaugcugc

SEQ ID NO: 3087226 - RNA, 17 nt, Molluscum contagiosum virus
gccccgacgccagcgcg

SEQ ID NO: 3087227 - RNA, 18 nt, Molluscum contagiosum virus
gcccucaggggcucuccu

SEQ ID NO: 3087228 - RNA, 21 nt, Molluscum contagiosum virus
ggaugcuggugucgagcucgc

SEQ ID NO: 3087229 - RNA, 21 nt, Molluscum contagiosum virus
cggaauuugcggcgcgggcaa

SEQ ID NO: 3087230 - RNA, 17 nt, Molluscum contagiosum virus
uggaggaggaagcaggu

SEQ ID NO: 3087231 - RNA, 22 nt, Molluscum contagiosum virus
ccgcgcaccgcguugccgcccg

SEQ ID NO: 3087232 - RNA, 21 nt, Molluscum contagiosum virus
gacgugaucguuccuggccaa

SEQ ID NO: 3087233 - RNA, 21 nt, Molluscum contagiosum virus
ccugcacuucggacaccucac

SEQ ID NO: 3087234 - RNA, 23 nt, Molluscum contagiosum virus
cggcaccacgugcgcuggcccac

SEQ ID NO: 3087235 - RNA, 23 nt, Molluscum contagiosum virus
gacacgaggucacucgcuacugc

SEQ ID NO: 3087236 - RNA, 16 nt, Molluscum contagiosum virus
gagaucccuccgagac

SEQ ID NO: 3087237 - RNA, 14 nt, Molluscum contagiosum virus
agcaucccugccac

SEQ ID NO: 3087238 - RNA, 23 nt, Molluscum contagiosum virus
guccaucggugggcucgcgcuuu

SEQ ID NO: 3087239 - RNA, 15 nt, Molluscum contagiosum virus
gcccuccucgaccug

SEQ ID NO: 3087240 - RNA, 20 nt, Molluscum contagiosum virus
cgcggaugccacgcagcugg

SEQ ID NO: 3087241 - RNA, 23 nt, Molluscum contagiosum virus
cgccaguuccacuccugugagca

SEQ ID NO: 3087242 - RNA, 16 nt, Molluscum contagiosum virus
acuggaagaacaggcc

SEQ ID NO: 3087243 - RNA, 13 nt, Molluscum contagiosum virus
uacgagcagcugc

SEQ ID NO: 3087244 - RNA, 11 nt, Molluscum contagiosum virus
acugccgccgc

SEQ ID NO: 3087245 - RNA, 18 nt, Molluscum contagiosum virus
cucgagacccacaauggu

SEQ ID NO: 3087246 - RNA, 16 nt, Molluscum contagiosum virus
ucucgagacgcugccu

SEQ ID NO: 3087247 - RNA, 21 nt, Molluscum contagiosum virus
gccaaagucuuccuggggcug

SEQ ID NO: 3087248 - RNA, 19 nt, Molluscum contagiosum virus
gcgggcacgugcugcugcg

SEQ ID NO: 3087249 - RNA, 15 nt, Molluscum contagiosum virus
gacgcgaugacacgc

SEQ ID NO: 3087250 - RNA, 22 nt, Molluscum contagiosum virus
cgcgcaagugugcgcaucccuc

SEQ ID NO: 3087251 - RNA, 16 nt, Molluscum contagiosum virus
ugcuggacgcgcacgc

SEQ ID NO: 3087252 - RNA, 18 nt, Molluscum contagiosum virus
acggccuucgcgcugccc

SEQ ID NO: 3087253 - RNA, 16 nt, Molluscum contagiosum virus
gccgugacgcugcggc

SEQ ID NO: 3087254 - RNA, 17 nt, Molluscum contagiosum virus
cuccugagaagcaaugc

SEQ ID NO: 3087255 - RNA, 22 nt, Molluscum contagiosum virus
aggcacccaccaggaacaggga

SEQ ID NO: 3087256 - RNA, 23 nt, Molluscum contagiosum virus
aguacuucuacgggaagcugcac

SEQ ID NO: 3087257 - RNA, 13 nt, Molluscum contagiosum virus
cgacaugcugccc

SEQ ID NO: 3087258 - RNA, 22 nt, Molluscum contagiosum virus
ggcgcgguccgcguuggcagcg

SEQ ID NO: 3087259 - RNA, 15 nt, Molluscum contagiosum virus
gcgcgaccgcaccga

SEQ ID NO: 3087260 - RNA, 16 nt, Molluscum contagiosum virus
ccgcgcgcgcagcgcg

SEQ ID NO: 3087261 - RNA, 17 nt, Molluscum contagiosum virus
cucaacuguugccugga

SEQ ID NO: 3087262 - RNA, 18 nt, Molluscum contagiosum virus
gcacaucucucagggcag

SEQ ID NO: 3087263 - RNA, 18 nt, Molluscum contagiosum virus
cgagcgcgcgccugcugg

SEQ ID NO: 3087264 - RNA, 23 nt, Molluscum contagiosum virus
gccucgcggacgagaaugacuua

SEQ ID NO: 3087265 - RNA, 13 nt, Molluscum contagiosum virus
cgcggggcaagcg

SEQ ID NO: 3087266 - RNA, 22 nt, Molluscum contagiosum virus
auggacgugcugcuggcccugc

SEQ ID NO: 3087267 - RNA, 22 nt, Molluscum contagiosum virus
ggucuugccgaagccgcaggcc

SEQ ID NO: 3087268 - RNA, 21 nt, Molluscum contagiosum virus
cugcucgacgggcgcagccac

SEQ ID NO: 3087269 - RNA, 18 nt, Molluscum contagiosum virus
acagcgggcgcugcucgc

SEQ ID NO: 3087270 - RNA, 16 nt, Molluscum contagiosum virus
caaggccguccccgga

SEQ ID NO: 3087271 - RNA, 11 nt, Molluscum contagiosum virus
ggcacccuggc

SEQ ID NO: 3087272 - RNA, 22 nt, Molluscum contagiosum virus
cagacaugucguaccugguggc

SEQ ID NO: 3087273 - RNA, 22 nt, Molluscum contagiosum virus
ccgugguacacguagaggaagu

SEQ ID NO: 3087274 - RNA, 16 nt, Molluscum contagiosum virus
cacgcguacgaagagc

SEQ ID NO: 3087275 - RNA, 14 nt, Molluscum contagiosum virus
gcacgcgggcgccg

SEQ ID NO: 3087276 - RNA, 17 nt, Molluscum contagiosum virus
gccuuggcgcccgugcc

SEQ ID NO: 3087277 - RNA, 15 nt, Molluscum contagiosum virus
ggagcaacgcgaccu

SEQ ID NO: 3087278 - RNA, 21 nt, Molluscum contagiosum virus
gggcggcgucgcgcgcgaccu

SEQ ID NO: 3087279 - RNA, 16 nt, Molluscum contagiosum virus
cggcgcgaagcaggcg

SEQ ID NO: 3087280 - RNA, 16 nt, Molluscum contagiosum virus
acaaggaaaggcaccu

SEQ ID NO: 3087281 - RNA, 20 nt, Molluscum contagiosum virus
cggagagcuccggcugcucc

SEQ ID NO: 3087282 - RNA, 21 nt, Molluscum contagiosum virus
aguccagcgcgcucgaggcgc

SEQ ID NO: 3087283 - RNA, 15 nt, Molluscum contagiosum virus
aacauggugcuggcc

SEQ ID NO: 3087284 - RNA, 16 nt, Molluscum contagiosum virus
guggcuugcgggacag

SEQ ID NO: 3087285 - RNA, 21 nt, Molluscum contagiosum virus
uggagucacgaccgacccauc

SEQ ID NO: 3087286 - RNA, 20 nt, Molluscum contagiosum virus
cgcacacgaaucgcucgcgg

SEQ ID NO: 3087287 - RNA, 23 nt, Molluscum contagiosum virus
gcgggccaggcacuggcccugcu

SEQ ID NO: 3087288 - RNA, 20 nt, Molluscum contagiosum virus
cuagccgugaacgaggcugc

SEQ ID NO: 3087289 - RNA, 23 nt, Molluscum contagiosum virus
cuuccuggaguaccggcucaaga

SEQ ID NO: 3087290 - RNA, 15 nt, Molluscum contagiosum virus
cucuccgaagaagaa

SEQ ID NO: 3087291 - RNA, 14 nt, Molluscum contagiosum virus
gcgacaugcugccc

SEQ ID NO: 3087292 - RNA, 15 nt, Molluscum contagiosum virus
cugcuggcagacaca

SEQ ID NO: 3087293 - RNA, 16 nt, Molluscum contagiosum virus
aagcgcccgugaugca

SEQ ID NO: 3087294 - RNA, 22 nt, Molluscum contagiosum virus
gcuaccugcgcaagcucagccu

SEQ ID NO: 3087295 - RNA, 14 nt, Molluscum contagiosum virus
ugcgugcccagcag

SEQ ID NO: 3087296 - RNA, 15 nt, Molluscum contagiosum virus
gaccacgcuggcacg

SEQ ID NO: 3087297 - RNA, 15 nt, Molluscum contagiosum virus
gcaccugcacgagcc

SEQ ID NO: 3087298 - RNA, 18 nt, Molluscum contagiosum virus
ggcgucgugcaccuggag

SEQ ID NO: 3087299 - RNA, 22 nt, Molluscum contagiosum virus
gcgcugaaggcauaccugugcc

SEQ ID NO: 3087300 - RNA, 14 nt, Molluscum contagiosum virus
ccaccggcagcgca

SEQ ID NO: 3087301 - RNA, 13 nt, Molluscum contagiosum virus
guguuggccaggc

SEQ ID NO: 3087302 - RNA, 14 nt, Molluscum contagiosum virus
agacuugugcccau

SEQ ID NO: 3087303 - RNA, 13 nt, Molluscum contagiosum virus
ccguccuugcucu

SEQ ID NO: 3087304 - RNA, 14 nt, Molluscum contagiosum virus
cuggcggggcuggc

SEQ ID NO: 3087305 - RNA, 17 nt, Molluscum contagiosum virus
ggcaguagcagcgccgg

SEQ ID NO: 3087306 - RNA, 20 nt, Molluscum contagiosum virus
cacucguggcaacaacauga

SEQ ID NO: 3087307 - RNA, 23 nt, Molluscum contagiosum virus
aggccucagccgagcgccgccag

SEQ ID NO: 3087308 - RNA, 19 nt, Molluscum contagiosum virus
gagcccgggcccgagcccg

SEQ ID NO: 3087309 - RNA, 19 nt, Molluscum contagiosum virus
ccaccgucuccccccuguc

SEQ ID NO: 3087310 - RNA, 22 nt, Molluscum contagiosum virus
ugagcaggucggccagcagcuc

SEQ ID NO: 3087311 - RNA, 14 nt, Molluscum contagiosum virus
gacuagccugugcc

SEQ ID NO: 3087312 - RNA, 24 nt, Molluscum contagiosum virus
ugccagcgccagccugcuggcacc

SEQ ID NO: 3087313 - RNA, 20 nt, Molluscum contagiosum virus
cagguagcgcgccgcaaagc

SEQ ID NO: 3087314 - RNA, 17 nt, Molluscum contagiosum virus
cgauacccuuggcagca

SEQ ID NO: 3087315 - RNA, 18 nt, Molluscum contagiosum virus
gacggugcugcgcacgga

SEQ ID NO: 3087316 - RNA, 15 nt, Molluscum contagiosum virus
ccucgcuccgcagca

SEQ ID NO: 3087317 - RNA, 16 nt, Molluscum contagiosum virus
ccagcgcgcagaagcc

SEQ ID NO: 3087318 - RNA, 15 nt, Molluscum contagiosum virus
agccaaccccgagcc

SEQ ID NO: 3087319 - RNA, 16 nt, Molluscum contagiosum virus
gcggcuaagcucugcg

SEQ ID NO: 3087320 - RNA, 20 nt, Molluscum contagiosum virus
ccucgacaaugagcacuugc

SEQ ID NO: 3087321 - RNA, 17 nt, Molluscum contagiosum virus
cuagugccgagcucgcc

SEQ ID NO: 3087322 - RNA, 20 nt, Molluscum contagiosum virus
ccagcaugugcgagcgcagc

SEQ ID NO: 3087323 - RNA, 16 nt, Molluscum contagiosum virus
ggcgcgcgccagcagc

SEQ ID NO: 3087324 - RNA, 23 nt, Molluscum contagiosum virus
ugcucaccgccgagauggagcuc

SEQ ID NO: 3087325 - RNA, 22 nt, Molluscum contagiosum virus
cgccugcucucgcgcgccagca

SEQ ID NO: 3087326 - RNA, 19 nt, Molluscum contagiosum virus
cagcuacgaucgcgcucag

SEQ ID NO: 3087327 - RNA, 13 nt, Molluscum contagiosum virus
cgcgggcccgugc

SEQ ID NO: 3087328 - RNA, 19 nt, Molluscum contagiosum virus
ggagcgcuucuagcucgcg

SEQ ID NO: 3087329 - RNA, 20 nt, Molluscum contagiosum virus
cugcucgacgggcgcagcca

SEQ ID NO: 3087330 - RNA, 21 nt, Molluscum contagiosum virus
gacuagaugcguccuaugcau

SEQ ID NO: 3087331 - RNA, 14 nt, Molluscum contagiosum virus
cgacgcgcgcggca

SEQ ID NO: 3087332 - RNA, 12 nt, Molluscum contagiosum virus
ggcaggcgcugc

SEQ ID NO: 3087333 - RNA, 22 nt, Molluscum contagiosum virus
cgaggccugcguggacagcauc

SEQ ID NO: 3087334 - RNA, 15 nt, Molluscum contagiosum virus
cgucaaccugcugcc

SEQ ID NO: 3087335 - RNA, 14 nt, Molluscum contagiosum virus
gugcugugccuagg

SEQ ID NO: 3087336 - RNA, 18 nt, Molluscum contagiosum virus
cacgcuguugcugcugcc

SEQ ID NO: 3087337 - RNA, 18 nt, Molluscum contagiosum virus
acacgcuguugcugcugc

SEQ ID NO: 3087338 - RNA, 14 nt, Molluscum contagiosum virus
cucguccggcgcuc

SEQ ID NO: 3087339 - RNA, 15 nt, Molluscum contagiosum virus
agugcggccagcacc

SEQ ID NO: 3087340 - RNA, 18 nt, Molluscum contagiosum virus
gcggcgcuacuggccgcg

SEQ ID NO: 3087341 - RNA, 18 nt, Molluscum contagiosum virus
cgagugugugcaucccuc

SEQ ID NO: 3087342 - RNA, 13 nt, Molluscum contagiosum virus
aagcgcgucugca

SEQ ID NO: 3087343 - RNA, 13 nt, Molluscum contagiosum virus
agcagagccggga

SEQ ID NO: 3087344 - RNA, 21 nt, Molluscum contagiosum virus
caaccauggcgcgcucuuuug

SEQ ID NO: 3087345 - RNA, 15 nt, Molluscum contagiosum virus
gggcggaagcuccug

SEQ ID NO: 3087346 - RNA, 13 nt, Molluscum contagiosum virus
cuccaggaacgcg

SEQ ID NO: 3087347 - RNA, 16 nt, Molluscum contagiosum virus
gccgcaaacacugucu

SEQ ID NO: 3087348 - RNA, 19 nt, Molluscum contagiosum virus
gcccgugcuggagggcacg

SEQ ID NO: 3087349 - RNA, 13 nt, Molluscum contagiosum virus
ucuaguucccaug

SEQ ID NO: 3087350 - RNA, 13 nt, Molluscum contagiosum virus
cuuccgcggcgug

SEQ ID NO: 3087351 - RNA, 21 nt, Molluscum contagiosum virus
gggucgugcaggucgaggagg

SEQ ID NO: 3087352 - RNA, 13 nt, Molluscum contagiosum virus
ucucugcgccgcg

SEQ ID NO: 3087353 - RNA, 12 nt, Molluscum contagiosum virus
cagcagccucgu

SEQ ID NO: 3087354 - RNA, 20 nt, Molluscum contagiosum virus
ugucggcacaucucucaggg

SEQ ID NO: 3087355 - RNA, 15 nt, Molluscum contagiosum virus
gucucugcgcagagc

SEQ ID NO: 3087356 - RNA, 19 nt, Molluscum contagiosum virus
cgagcgccgcucgcacggc

SEQ ID NO: 3087357 - RNA, 13 nt, Molluscum contagiosum virus
ugcugcgagagca

SEQ ID NO: 3087358 - RNA, 12 nt, Molluscum contagiosum virus
gcagugcuugcu

SEQ ID NO: 3087359 - RNA, 18 nt, Molluscum contagiosum virus
uggcacggccggcgccgc

SEQ ID NO: 3087360 - RNA, 19 nt, Molluscum contagiosum virus
guacuccuugaagggcaca

SEQ ID NO: 3087361 - RNA, 22 nt, Molluscum contagiosum virus
ccgcggcacugggugcccgagc

SEQ ID NO: 3087362 - RNA, 18 nt, Molluscum contagiosum virus
aucaacaucuacaaggag

SEQ ID NO: 3087363 - RNA, 21 nt, Molluscum contagiosum virus
cccgaguacuacuacacuguc

SEQ ID NO: 3087364 - RNA, 22 nt, Molluscum contagiosum virus
cauggccuguaguagcagcuuc

SEQ ID NO: 3087365 - RNA, 21 nt, Molluscum contagiosum virus
ggcaacgcugccgcuggcgcu

SEQ ID NO: 3087366 - RNA, 20 nt, Molluscum contagiosum virus
cguaaagcuggccgaggucu

SEQ ID NO: 3087367 - RNA, 16 nt, Molluscum contagiosum virus
ggcaaagccugcugcg

SEQ ID NO: 3087368 - RNA, 15 nt, Molluscum contagiosum virus
aucgcgcugcuggug

SEQ ID NO: 3087369 - RNA, 13 nt, Molluscum contagiosum virus
uccugcgcuccga

SEQ ID NO: 3087370 - RNA, 18 nt, Molluscum contagiosum virus
caguucgagcugcugcgc

SEQ ID NO: 3087371 - RNA, 20 nt, Molluscum contagiosum virus
caaccccgcgcugcgcggcg

SEQ ID NO: 3087372 - RNA, 21 nt, Molluscum contagiosum virus
ccuucgacguugacgagcgcg

SEQ ID NO: 3087373 - RNA, 23 nt, Molluscum contagiosum virus
cgagacugagugcugagccacaa

SEQ ID NO: 3087374 - RNA, 14 nt, Molluscum contagiosum virus
cagacuucuccaag

SEQ ID NO: 3087375 - RNA, 15 nt, Molluscum contagiosum virus
ggaaggggugauggc

SEQ ID NO: 3087376 - RNA, 14 nt, Molluscum contagiosum virus
ccugcuggcgugcg

SEQ ID NO: 3087377 - RNA, 20 nt, Molluscum contagiosum virus
cuccgcggacgcgcccugga

SEQ ID NO: 3087378 - RNA, 23 nt, Molluscum contagiosum virus
ggcgagucucccguggcgcgccg

SEQ ID NO: 3087379 - RNA, 19 nt, Molluscum contagiosum virus
accgcugcuucguaaagcu

SEQ ID NO: 3087380 - RNA, 15 nt, Molluscum contagiosum virus
cggugcccgccaaga

SEQ ID NO: 3087381 - RNA, 20 nt, Molluscum contagiosum virus
ggcgcucgcagcacaugcag

SEQ ID NO: 3087382 - RNA, 23 nt, Molluscum contagiosum virus
ccaaggucgagcugacucggaca

SEQ ID NO: 3087383 - RNA, 21 nt, Molluscum contagiosum virus
cgaagaguggcucacagccgu

SEQ ID NO: 3087384 - RNA, 14 nt, Molluscum contagiosum virus
gacuaccugcugcu

SEQ ID NO: 3087385 - RNA, 21 nt, Molluscum contagiosum virus
gcgucuuccugcugccgggag

SEQ ID NO: 3087386 - RNA, 22 nt, Molluscum contagiosum virus
acucgcgcgcgccgggccgcgg

SEQ ID NO: 3087387 - RNA, 16 nt, Molluscum contagiosum virus
gcacgcugcgcacggg

SEQ ID NO: 3087388 - RNA, 20 nt, Molluscum contagiosum virus
agcacuucucgccgcaccac

SEQ ID NO: 3087389 - RNA, 19 nt, Molluscum contagiosum virus
gcugcugcggcugcuggag

SEQ ID NO: 3087390 - RNA, 23 nt, Molluscum contagiosum virus
ccaggaacgaggaaaggcacacc

SEQ ID NO: 3087391 - RNA, 15 nt, Molluscum contagiosum virus
caggagaacuacaaa

SEQ ID NO: 3087392 - RNA, 20 nt, Molluscum contagiosum virus
cugcugguggugcuggagcg

SEQ ID NO: 3087393 - RNA, 19 nt, Molluscum contagiosum virus
caugcgcaagcgcuaugcu

SEQ ID NO: 3087394 - RNA, 16 nt, Molluscum contagiosum virus
cacgggggcugccggc

SEQ ID NO: 3087395 - RNA, 14 nt, Molluscum contagiosum virus
gccgcgcaccugga

SEQ ID NO: 3087396 - RNA, 18 nt, Molluscum contagiosum virus
cgcugcucgugcugcucu

SEQ ID NO: 3087397 - RNA, 14 nt, Molluscum contagiosum virus
cugggaaagggcug

SEQ ID NO: 3087398 - RNA, 17 nt, Molluscum contagiosum virus
gcaucggcggcagcgcc

SEQ ID NO: 3087399 - RNA, 17 nt, Molluscum contagiosum virus
gcuggugcucgccugca

SEQ ID NO: 3087400 - RNA, 16 nt, Molluscum contagiosum virus
caccccuguaacaagg

SEQ ID NO: 3087401 - RNA, 23 nt, Molluscum contagiosum virus
auguucuucgcagaggacagcuc

SEQ ID NO: 3087402 - RNA, 20 nt, Molluscum contagiosum virus
caguaacgguaccuggcuug

SEQ ID NO: 3087403 - RNA, 13 nt, Molluscum contagiosum virus
caccagcagccag

SEQ ID NO: 3087404 - RNA, 21 nt, Molluscum contagiosum virus
ccgcguggcaagggcuccuuc

SEQ ID NO: 3087405 - RNA, 17 nt, Molluscum contagiosum virus
gcgcucuggagccuccc

SEQ ID NO: 3087406 - RNA, 15 nt, Molluscum contagiosum virus
ggaaaaggcacaccc

SEQ ID NO: 3087407 - RNA, 17 nt, Molluscum contagiosum virus
cuggcgcguccguucac

SEQ ID NO: 3087408 - RNA, 21 nt, Molluscum contagiosum virus
uccgagaaugggagggggaca

SEQ ID NO: 3087409 - RNA, 16 nt, Molluscum contagiosum virus
gcuggagggcacgcug

SEQ ID NO: 3087410 - RNA, 14 nt, Molluscum contagiosum virus
ugugccuaggagga

SEQ ID NO: 3087411 - RNA, 13 nt, Molluscum contagiosum virus
aguuccacuccug

SEQ ID NO: 3087412 - RNA, 16 nt, Molluscum contagiosum virus
cucgacgggcgcagcc

SEQ ID NO: 3087413 - RNA, 15 nt, Molluscum contagiosum virus
aagcacaguccagcc

SEQ ID NO: 3087414 - RNA, 19 nt, Molluscum contagiosum virus
gccugcguggacagcaucc

SEQ ID NO: 3087415 - RNA, 14 nt, Molluscum contagiosum virus
caccagcaccagca

SEQ ID NO: 3087416 - RNA, 20 nt, Molluscum contagiosum virus
agcguggcgcgcgagcugcu

SEQ ID NO: 3087417 - RNA, 14 nt, Molluscum contagiosum virus
caacauccaaacca

SEQ ID NO: 3087418 - RNA, 19 nt, Molluscum contagiosum virus
acggucguccuggagccua

SEQ ID NO: 3087419 - RNA, 17 nt, Molluscum contagiosum virus
gcuggaccccgagcugc

SEQ ID NO: 3087420 - RNA, 18 nt, Molluscum contagiosum virus
ggaaaacuguaggggagg

SEQ ID NO: 3087421 - RNA, 16 nt, Molluscum contagiosum virus
gcugcugguucugcuc

SEQ ID NO: 3087422 - RNA, 13 nt, Molluscum contagiosum virus
gccgggggaacac

SEQ ID NO: 3087423 - RNA, 23 nt, Molluscum contagiosum virus
gugcgcaucccugcgcaccugca

SEQ ID NO: 3087424 - RNA, 15 nt, Molluscum contagiosum virus
gccaggccgcgccgg

SEQ ID NO: 3087425 - RNA, 17 nt, Molluscum contagiosum virus
gaccgacccaucggaga

SEQ ID NO: 3087426 - RNA, 17 nt, Molluscum contagiosum virus
cgacagcauccuggagu

SEQ ID NO: 3087427 - RNA, 19 nt, Molluscum contagiosum virus
cccgcgcacgagcugcugc

SEQ ID NO: 3087428 - RNA, 19 nt, Molluscum contagiosum virus
acgcgugcugcgcggcgcc

SEQ ID NO: 3087429 - RNA, 17 nt, Molluscum contagiosum virus
gcgugcucacgcugccc

SEQ ID NO: 3087430 - RNA, 14 nt, Molluscum contagiosum virus
gcuccgcagcagga

SEQ ID NO: 3087431 - RNA, 20 nt, Molluscum contagiosum virus
ccgcggcgugcagggcgugc

SEQ ID NO: 3087432 - RNA, 21 nt, Molluscum contagiosum virus
ggcgccaccggcagugcuugc

SEQ ID NO: 3087433 - RNA, 18 nt, Molluscum contagiosum virus
ggcgguguaugcucgucg

SEQ ID NO: 3087434 - RNA, 20 nt, Molluscum contagiosum virus
ccgagcaauugcugggcaca

SEQ ID NO: 3087435 - RNA, 14 nt, Molluscum contagiosum virus
cucugcgcagagcg

SEQ ID NO: 3087436 - RNA, 14 nt, Molluscum contagiosum virus
cucgcccagcucga

SEQ ID NO: 3087437 - RNA, 22 nt, Molluscum contagiosum virus
cucgugucacaauggcacuagc

SEQ ID NO: 3087438 - RNA, 18 nt, Molluscum contagiosum virus
cucaacgcgauggcgcag

SEQ ID NO: 3087439 - RNA, 15 nt, Molluscum contagiosum virus
gacugcugcccccgc

SEQ ID NO: 3087440 - RNA, 17 nt, Molluscum contagiosum virus
guccugcgcgguggcuu

SEQ ID NO: 3087441 - RNA, 17 nt, Molluscum contagiosum virus
aucugcgcuccacgccc

SEQ ID NO: 3087442 - RNA, 19 nt, Molluscum contagiosum virus
agggcgaccggagagggga

SEQ ID NO: 3087443 - RNA, 16 nt, Molluscum contagiosum virus
aguaccgcgcgcacgc

SEQ ID NO: 3087444 - RNA, 22 nt, Molluscum contagiosum virus
agcagcaccgcacgccagcagc

SEQ ID NO: 3087445 - RNA, 20 nt, Molluscum contagiosum virus
caacguaguacugcagcagc

SEQ ID NO: 3087446 - RNA, 15 nt, Molluscum contagiosum virus
gcaagagccgccggg

SEQ ID NO: 3087447 - RNA, 18 nt, Molluscum contagiosum virus
ccggcguguggcucuucu

SEQ ID NO: 3087448 - RNA, 17 nt, Molluscum contagiosum virus
cgcgacaugccucgcgg

SEQ ID NO: 3087449 - RNA, 23 nt, Molluscum contagiosum virus
cugggccaucgaaacucugcacg

SEQ ID NO: 3087450 - RNA, 15 nt, Molluscum contagiosum virus
ucacggcgcucgccu

SEQ ID NO: 3087451 - RNA, 18 nt, Molluscum contagiosum virus
aaacgcuggcgagcaaga

SEQ ID NO: 3087452 - RNA, 22 nt, Molluscum contagiosum virus
cggggccuguucggcaugcagc

SEQ ID NO: 3087453 - RNA, 14 nt, Molluscum contagiosum virus
cgcacgugcugcgc

SEQ ID NO: 3087454 - RNA, 22 nt, Molluscum contagiosum virus
gcaccggcaacagcgcgacgcc

SEQ ID NO: 3087455 - RNA, 12 nt, Molluscum contagiosum virus
cccguugcugcg

SEQ ID NO: 3087456 - RNA, 23 nt, Molluscum contagiosum virus
ucgcuguccuuccgacccggcuc

SEQ ID NO: 3087457 - RNA, 14 nt, Molluscum contagiosum virus
gaagcagcagacca

SEQ ID NO: 3087458 - RNA, 18 nt, Molluscum contagiosum virus
gagaagugaaaauaaaga

SEQ ID NO: 3087459 - RNA, 17 nt, Molluscum contagiosum virus
ggcagcucaagcugcuc

SEQ ID NO: 3087460 - RNA, 18 nt, Molluscum contagiosum virus
cgaaggccgguccugacu

SEQ ID NO: 3087461 - RNA, 15 nt, Molluscum contagiosum virus
cgggggcgcuucccc

SEQ ID NO: 3087462 - RNA, 14 nt, Molluscum contagiosum virus
gcgccggcucugcc

SEQ ID NO: 3087463 - RNA, 16 nt, Molluscum contagiosum virus
agcgcgcgacugucuu

SEQ ID NO: 3087464 - RNA, 22 nt, Molluscum contagiosum virus
cgccgcgggccgccgggccugc

SEQ ID NO: 3087465 - RNA, 19 nt, Molluscum contagiosum virus
auccucaccuuccugggcg

SEQ ID NO: 3087466 - RNA, 12 nt, Molluscum contagiosum virus
gccugcgagcag

SEQ ID NO: 3087467 - RNA, 14 nt, Molluscum contagiosum virus
ccgacggcacgggc

SEQ ID NO: 3087468 - RNA, 14 nt, Molluscum contagiosum virus
cgcgcggcagcagc

SEQ ID NO: 3087469 - RNA, 12 nt, Molluscum contagiosum virus
ugcgcgagcagc

SEQ ID NO: 3087470 - RNA, 15 nt, Molluscum contagiosum virus
caccagcagccaggc

SEQ ID NO: 3087471 - RNA, 17 nt, Molluscum contagiosum virus
cuuccccguccuugcuc

SEQ ID NO: 3087472 - RNA, 13 nt, Molluscum contagiosum virus
cgcacggagcaca

SEQ ID NO: 3087473 - RNA, 15 nt, Molluscum contagiosum virus
cggccgcggaccacg

SEQ ID NO: 3087474 - RNA, 16 nt, Molluscum contagiosum virus
ccuucugcaagcugcc

SEQ ID NO: 3087475 - RNA, 14 nt, Molluscum contagiosum virus
cagcagccgcagcc

SEQ ID NO: 3087476 - RNA, 15 nt, Molluscum contagiosum virus
ugcucgcacccgcgc

SEQ ID NO: 3087477 - RNA, 18 nt, Molluscum contagiosum virus
ccgagcccgggcccgugc

SEQ ID NO: 3087478 - RNA, 22 nt, Molluscum contagiosum virus
cgcaguaccaguaccugcugcc

SEQ ID NO: 3087479 - RNA, 14 nt, Molluscum contagiosum virus
ccagcugcaaacau

SEQ ID NO: 3087480 - RNA, 13 nt, Molluscum contagiosum virus
ccuggugcugcgc

SEQ ID NO: 3087481 - RNA, 19 nt, Molluscum contagiosum virus
uggaucgcgcgcaccugca

SEQ ID NO: 3087482 - RNA, 23 nt, Molluscum contagiosum virus
cuggcaccgggcgccgcggcugc

SEQ ID NO: 3087483 - RNA, 11 nt, Molluscum contagiosum virus
gugccacugcc

SEQ ID NO: 3087484 - RNA, 19 nt, Molluscum contagiosum virus
ccuggccgaacugcucugc

SEQ ID NO: 3087485 - RNA, 16 nt, Molluscum contagiosum virus
uuggcgagcgcugccg

SEQ ID NO: 3087486 - RNA, 21 nt, Molluscum contagiosum virus
gcacagccccugcugcucgcg

SEQ ID NO: 3087487 - RNA, 23 nt, Molluscum contagiosum virus
cugcugcgcuccaugcugccgga

SEQ ID NO: 3087488 - RNA, 20 nt, Molluscum contagiosum virus
cacucgcgaacuacgagcgc

SEQ ID NO: 3087489 - RNA, 18 nt, Molluscum contagiosum virus
uggcgagcuagugcacac

SEQ ID NO: 3087490 - RNA, 22 nt, Molluscum contagiosum virus
guacuacuuccgcaacgagguc

SEQ ID NO: 3087491 - RNA, 16 nt, Molluscum contagiosum virus
gccagcuuggugcgcu

SEQ ID NO: 3087492 - RNA, 16 nt, Molluscum contagiosum virus
cggaagcuccugcugg

SEQ ID NO: 3087493 - RNA, 23 nt, Molluscum contagiosum virus
ucugcgagcgccugcgagcagcc

SEQ ID NO: 3087494 - RNA, 15 nt, Molluscum contagiosum virus
ucuugguugccaggc

SEQ ID NO: 3087495 - RNA, 20 nt, Molluscum contagiosum virus
gucuucuuguugugcuuuga

SEQ ID NO: 3087496 - RNA, 19 nt, Molluscum contagiosum virus
gcgcgcccggcgcccgcag

SEQ ID NO: 3087497 - RNA, 20 nt, Molluscum contagiosum virus
cgagcagcggggacucuccc

SEQ ID NO: 3087498 - RNA, 13 nt, Molluscum contagiosum virus
ccaggugcugggc

SEQ ID NO: 3087499 - RNA, 12 nt, Molluscum contagiosum virus
cgcuugccccuc

SEQ ID NO: 3087500 - RNA, 23 nt, Molluscum contagiosum virus
gaaucgcucgcggugcagcugcc

SEQ ID NO: 3087501 - RNA, 22 nt, Molluscum contagiosum virus
cagcgcuugcgcgccaacuccu

SEQ ID NO: 3087502 - RNA, 19 nt, Molluscum contagiosum virus
gggcacauggacggcgccu

SEQ ID NO: 3087503 - RNA, 18 nt, Molluscum contagiosum virus
ccgagcggcaagccgugc

SEQ ID NO: 3087504 - RNA, 17 nt, Molluscum contagiosum virus
gcucggagucggagaaa

SEQ ID NO: 3087505 - RNA, 19 nt, Molluscum contagiosum virus
gaggugggaaugcccgcaa

SEQ ID NO: 3087506 - RNA, 19 nt, Molluscum contagiosum virus
gacagucagcggcgugcug

SEQ ID NO: 3087507 - RNA, 20 nt, Molluscum contagiosum virus
ccuccaagaagaggccagca

SEQ ID NO: 3087508 - RNA, 21 nt, Molluscum contagiosum virus
ccuggggaaccgcugcuucgu

SEQ ID NO: 3087509 - RNA, 22 nt, Molluscum contagiosum virus
caagugcgucgacguggagccu

SEQ ID NO: 3087510 - RNA, 17 nt, Molluscum contagiosum virus
ccggcgcccgcagcgcg

SEQ ID NO: 3087511 - RNA, 21 nt, Molluscum contagiosum virus
gaccuuggcgcgccgcugccc

SEQ ID NO: 3087512 - RNA, 12 nt, Molluscum contagiosum virus
ccagccgcagcc

SEQ ID NO: 3087513 - RNA, 14 nt, Molluscum contagiosum virus
cgggccgccgcccg

SEQ ID NO: 3087514 - RNA, 23 nt, Molluscum contagiosum virus
ucgagcaccucaacuguugccug

SEQ ID NO: 3087515 - RNA, 21 nt, Molluscum contagiosum virus
ccuccuugauuucgcgcagca

SEQ ID NO: 3087516 - RNA, 14 nt, Molluscum contagiosum virus
aguuagaaaugcuu

SEQ ID NO: 3087517 - RNA, 13 nt, Molluscum contagiosum virus
cugcggugucaac

SEQ ID NO: 3087518 - RNA, 17 nt, Molluscum contagiosum virus
gguuccugcgcuccgac

SEQ ID NO: 3087519 - RNA, 20 nt, Molluscum contagiosum virus
cacgagcugacgcagacgca

SEQ ID NO: 3087520 - RNA, 15 nt, Molluscum contagiosum virus
cuagcgcugcucuac

SEQ ID NO: 3087521 - RNA, 13 nt, Molluscum contagiosum virus
gcaagcgcccgcg

SEQ ID NO: 3087522 - RNA, 16 nt, Molluscum contagiosum virus
guagcagcgccggcag

SEQ ID NO: 3087523 - RNA, 21 nt, Molluscum contagiosum virus
cuuccccguccuugcucuggc

SEQ ID NO: 3087524 - RNA, 17 nt, Molluscum contagiosum virus
gcaagaagcgaaacacg

SEQ ID NO: 3087525 - RNA, 19 nt, Molluscum contagiosum virus
gagcgggcaaugggcacgc

SEQ ID NO: 3087526 - RNA, 13 nt, Molluscum contagiosum virus
aguccagcuucuc

SEQ ID NO: 3087527 - RNA, 13 nt, Molluscum contagiosum virus
aagcccagcagcg

SEQ ID NO: 3087528 - RNA, 16 nt, Molluscum contagiosum virus
aucgagaugcgccgca

SEQ ID NO: 3087529 - RNA, 15 nt, Molluscum contagiosum virus
acggcacgcugagca

SEQ ID NO: 3087530 - RNA, 23 nt, Molluscum contagiosum virus
gcgcgugacacaccgcguggaca

SEQ ID NO: 3087531 - RNA, 12 nt, Molluscum contagiosum virus
cgaccccaagaa

SEQ ID NO: 3087532 - RNA, 15 nt, Molluscum contagiosum virus
agacgugcugcgcgc

SEQ ID NO: 3087533 - RNA, 19 nt, Molluscum contagiosum virus
cgcgagaugcgcggacaga

SEQ ID NO: 3087534 - RNA, 17 nt, Molluscum contagiosum virus
gcucgcgcgcacgcgca

SEQ ID NO: 3087535 - RNA, 22 nt, Molluscum contagiosum virus
ccaacgacuagcgugcgcagca

SEQ ID NO: 3087536 - RNA, 15 nt, Molluscum contagiosum virus
cauggaccgcgucaa

SEQ ID NO: 3087537 - RNA, 15 nt, Molluscum contagiosum virus
gcucgacgggcgcag

SEQ ID NO: 3087538 - RNA, 15 nt, Molluscum contagiosum virus
cgggaaacugcugcc

SEQ ID NO: 3087539 - RNA, 23 nt, Molluscum contagiosum virus
cucgaggucgugcaggccgugcu

SEQ ID NO: 3087540 - RNA, 13 nt, Molluscum contagiosum virus
cgcggucgggccc

SEQ ID NO: 3087541 - RNA, 17 nt, Molluscum contagiosum virus
cacggcacccgccagcu

SEQ ID NO: 3087542 - RNA, 22 nt, Molluscum contagiosum virus
aggaaaggccccccgcaacaag

SEQ ID NO: 3087543 - RNA, 20 nt, Molluscum contagiosum virus
ucuugaaaugauugguucuu

SEQ ID NO: 3087544 - RNA, 21 nt, Molluscum contagiosum virus
cggcggagaugacgggcacgc

SEQ ID NO: 3087545 - RNA, 21 nt, Molluscum contagiosum virus
caagaagaggccagcacaagc

SEQ ID NO: 3087546 - RNA, 22 nt, Molluscum contagiosum virus
caaccaguacuucaucuucaag

SEQ ID NO: 3087547 - RNA, 20 nt, Molluscum contagiosum virus
gcggcacaugcagcugcagg

SEQ ID NO: 3087548 - RNA, 13 nt, Molluscum contagiosum virus
gcggccacucucc

SEQ ID NO: 3087549 - RNA, 21 nt, Molluscum contagiosum virus
cccggcggcccgcggcgcgcc

SEQ ID NO: 3087550 - RNA, 20 nt, Molluscum contagiosum virus
gcaaauuccguccccucucc

SEQ ID NO: 3087551 - RNA, 18 nt, Molluscum contagiosum virus
ugcagcugccgcagagcc

SEQ ID NO: 3087552 - RNA, 14 nt, Molluscum contagiosum virus
uacucaacaagcug

SEQ ID NO: 3087553 - RNA, 15 nt, Molluscum contagiosum virus
ggaacaaagaggcaa

SEQ ID NO: 3087554 - RNA, 15 nt, Molluscum contagiosum virus
cgugaccauggacac

SEQ ID NO: 3087555 - RNA, 18 nt, Molluscum contagiosum virus
gucgacgagugcgccgcg

SEQ ID NO: 3087556 - RNA, 18 nt, Molluscum contagiosum virus
cucuaggagcuccgugcu

SEQ ID NO: 3087557 - RNA, 23 nt, Molluscum contagiosum virus
uggccguagucuggccgggcucg

SEQ ID NO: 3087558 - RNA, 17 nt, Molluscum contagiosum virus
gacgagccccgcgccgg

SEQ ID NO: 3087559 - RNA, 16 nt, Molluscum contagiosum virus
gacaaggaaaggcacc

SEQ ID NO: 3087560 - RNA, 17 nt, Molluscum contagiosum virus
ccgccucgagcacgccu

SEQ ID NO: 3087561 - RNA, 23 nt, Molluscum contagiosum virus
uggcggccugcccugcucaugcg

SEQ ID NO: 3087562 - RNA, 14 nt, Molluscum contagiosum virus
cggcgccgacagcg

SEQ ID NO: 3087563 - RNA, 16 nt, Molluscum contagiosum virus
guggauuucggcgcgc

SEQ ID NO: 3087564 - RNA, 20 nt, Molluscum contagiosum virus
cacuugcgcgcgugccugug

SEQ ID NO: 3087565 - RNA, 23 nt, Molluscum contagiosum virus
gcccggcguuggcuuucugugcg

SEQ ID NO: 3087566 - RNA, 18 nt, Molluscum contagiosum virus
cgaagaccaccagcacca

SEQ ID NO: 3087567 - RNA, 17 nt, Molluscum contagiosum virus
gcagcuucuuggagccc

SEQ ID NO: 3087568 - RNA, 22 nt, Molluscum contagiosum virus
gugccugcgcaacgcgggccag

SEQ ID NO: 3087569 - RNA, 15 nt, Molluscum contagiosum virus
gccgaggcgcugccg

SEQ ID NO: 3087570 - RNA, 15 nt, Molluscum contagiosum virus
acgcgauggcgcagc

SEQ ID NO: 3087571 - RNA, 18 nt, Molluscum contagiosum virus
ccgugcaguugagagcag

SEQ ID NO: 3087572 - RNA, 21 nt, Molluscum contagiosum virus
ggccaugaucauggcgccgcu

SEQ ID NO: 3087573 - RNA, 17 nt, Molluscum contagiosum virus
cagaagacggaguccuc

SEQ ID NO: 3087574 - RNA, 12 nt, Molluscum contagiosum virus
caagagccaugu

SEQ ID NO: 3087575 - RNA, 13 nt, Molluscum contagiosum virus
cauucgcuggugc

SEQ ID NO: 3087576 - RNA, 14 nt, Molluscum contagiosum virus
cgcagugcucgcac

SEQ ID NO: 3087577 - RNA, 15 nt, Molluscum contagiosum virus
caugcgcagugccuu

SEQ ID NO: 3087578 - RNA, 24 nt, Molluscum contagiosum virus
gccgggcuugcucccucgcgcgca

SEQ ID NO: 3087579 - RNA, 17 nt, Molluscum contagiosum virus
cgugcugcgccgccugc

SEQ ID NO: 3087580 - RNA, 20 nt, Molluscum contagiosum virus
cagagcgccagcgccuccgc

SEQ ID NO: 3087581 - RNA, 23 nt, Molluscum contagiosum virus
uacgagccgcugcuccugcucug

SEQ ID NO: 3087582 - RNA, 17 nt, Molluscum contagiosum virus
augcagugcaccagcac

SEQ ID NO: 3087583 - RNA, 23 nt, Molluscum contagiosum virus
ccucugcgcggcccgcgggcugc

SEQ ID NO: 3087584 - RNA, 22 nt, Molluscum contagiosum virus
uccugguaguugcagcccacca

SEQ ID NO: 3087585 - RNA, 18 nt, Molluscum contagiosum virus
caccuggcgagcgcucug

SEQ ID NO: 3087586 - RNA, 18 nt, Molluscum contagiosum virus
ggagucacgaccgaccca

SEQ ID NO: 3087587 - RNA, 14 nt, Molluscum contagiosum virus
auuuuuugccccgc

SEQ ID NO: 3087588 - RNA, 15 nt, Molluscum contagiosum virus
augcucaagcacugc

SEQ ID NO: 3087589 - RNA, 18 nt, Molluscum contagiosum virus
gccgcgcgccgcugcucg

SEQ ID NO: 3087590 - RNA, 12 nt, Molluscum contagiosum virus
ccgcgcuucugc

SEQ ID NO: 3087591 - RNA, 22 nt, Molluscum contagiosum virus
ccgucagggaugccagugcagu

SEQ ID NO: 3087592 - RNA, 21 nt, Molluscum contagiosum virus
cagagaaaucccaagagccau

SEQ ID NO: 3087593 - RNA, 17 nt, Molluscum contagiosum virus
ucaagcacggcuuccgg

SEQ ID NO: 3087594 - RNA, 17 nt, Molluscum contagiosum virus
ggcaccccgcaggaaag

SEQ ID NO: 3087595 - RNA, 20 nt, Molluscum contagiosum virus
acuugcgcguucgcaaagac

SEQ ID NO: 3087596 - RNA, 15 nt, Molluscum contagiosum virus
ggcgcacgcggcucu

SEQ ID NO: 3087597 - RNA, 13 nt, Molluscum contagiosum virus
ugcuuccuccucc

SEQ ID NO: 3087598 - RNA, 18 nt, Molluscum contagiosum virus
gcugcaauaacaacgacc

SEQ ID NO: 3087599 - RNA, 21 nt, Molluscum contagiosum virus
cgcgcgcccgcugcgcgcucu

SEQ ID NO: 3087600 - RNA, 13 nt, Molluscum contagiosum virus
ugcgcgugugcag

SEQ ID NO: 3087601 - RNA, 14 nt, Molluscum contagiosum virus
cgucaccaccgcuu

SEQ ID NO: 3087602 - RNA, 12 nt, Molluscum contagiosum virus
gcgggccaggca

SEQ ID NO: 3087603 - RNA, 19 nt, Molluscum contagiosum virus
ggcaacugccugcgcuagu

SEQ ID NO: 3087604 - RNA, 22 nt, Molluscum contagiosum virus
gaucuccacgucgaucagcucc

SEQ ID NO: 3087605 - RNA, 21 nt, Molluscum contagiosum virus
cgcagucgccuuccugcgccc

SEQ ID NO: 3087606 - RNA, 20 nt, Molluscum contagiosum virus
uuccgagcucgcaaacacaa

SEQ ID NO: 3087607 - RNA, 19 nt, Molluscum contagiosum virus
cacgcuggucacgcgcuuc

SEQ ID NO: 3087608 - RNA, 20 nt, Molluscum contagiosum virus
cagcaggugcacgugcugca

SEQ ID NO: 3087609 - RNA, 13 nt, Molluscum contagiosum virus
cucgccggcgaga

SEQ ID NO: 3087610 - RNA, 15 nt, Molluscum contagiosum virus
cgaccagcugguccu

SEQ ID NO: 3087611 - RNA, 23 nt, Molluscum contagiosum virus
ugcuuugcgcgcguaugcgaaca

SEQ ID NO: 3087612 - RNA, 16 nt, Molluscum contagiosum virus
ccacggguaccgugcg

SEQ ID NO: 3087613 - RNA, 21 nt, Molluscum contagiosum virus
gacuccaaggaggucccuagc

SEQ ID NO: 3087614 - RNA, 16 nt, Molluscum contagiosum virus
gacgucaaccgggcuc

SEQ ID NO: 3087615 - RNA, 11 nt, Molluscum contagiosum virus
aacgacagacc

SEQ ID NO: 3087616 - RNA, 15 nt, Molluscum contagiosum virus
guuggucuccuccuu

SEQ ID NO: 3087617 - RNA, 13 nt, Molluscum contagiosum virus
cggugcugcugcc

SEQ ID NO: 3087618 - RNA, 13 nt, Molluscum contagiosum virus
cgugggcagcuuc

SEQ ID NO: 3087619 - RNA, 13 nt, Molluscum contagiosum virus
ucccgcgcuccga

SEQ ID NO: 3087620 - RNA, 13 nt, Molluscum contagiosum virus
gcagcgccggcag

SEQ ID NO: 3087621 - RNA, 17 nt, Molluscum contagiosum virus
gcuugcagacaaggaga

SEQ ID NO: 3087622 - RNA, 22 nt, Molluscum contagiosum virus
cuguccgcggaugcaggcacug

SEQ ID NO: 3087623 - RNA, 14 nt, Molluscum contagiosum virus
gccuagccugcagu

SEQ ID NO: 3087624 - RNA, 19 nt, Molluscum contagiosum virus
ggcgaguccccgagcagcg

SEQ ID NO: 3087625 - RNA, 20 nt, Molluscum contagiosum virus
cggaguccucgacaaugagc

SEQ ID NO: 3087626 - RNA, 17 nt, Molluscum contagiosum virus
gggcucgugcuggagca

SEQ ID NO: 3087627 - RNA, 17 nt, Molluscum contagiosum virus
uguccacaaaaccaaaa

SEQ ID NO: 3087628 - RNA, 21 nt, Molluscum contagiosum virus
gaacgagagacacgcacacuc

SEQ ID NO: 3087629 - RNA, 17 nt, Molluscum contagiosum virus
uuaacuaagcuaaaaga

SEQ ID NO: 3087630 - RNA, 16 nt, Molluscum contagiosum virus
gccuggcaugcuugag

SEQ ID NO: 3087631 - RNA, 17 nt, Molluscum contagiosum virus
gcccgagcgcgcgugcg

SEQ ID NO: 3087632 - RNA, 13 nt, Molluscum contagiosum virus
ggccugcacggcu

SEQ ID NO: 3087633 - RNA, 20 nt, Molluscum contagiosum virus
ccugcgauacccuuggcagc

SEQ ID NO: 3087634 - RNA, 16 nt, Molluscum contagiosum virus
caggcgcgccauggcg

SEQ ID NO: 3087635 - RNA, 14 nt, Molluscum contagiosum virus
gcgcgcgccuugca

SEQ ID NO: 3087636 - RNA, 16 nt, Molluscum contagiosum virus
ucggaggcggagcugc

SEQ ID NO: 3087637 - RNA, 21 nt, Molluscum contagiosum virus
acucgcugcugcucuuccagg

SEQ ID NO: 3087638 - RNA, 14 nt, Molluscum contagiosum virus
gcaugcgcgccgcg

SEQ ID NO: 3087639 - RNA, 23 nt, Molluscum contagiosum virus
aaccucugagcgagcgcaguugu

SEQ ID NO: 3087640 - RNA, 16 nt, Molluscum contagiosum virus
cuggcggggcuggcag

SEQ ID NO: 3087641 - RNA, 22 nt, Molluscum contagiosum virus
gcuccggcugcuccucgagcgc

SEQ ID NO: 3087642 - RNA, 16 nt, Molluscum contagiosum virus
cgcgcgcuaggggugc

SEQ ID NO: 3087643 - RNA, 17 nt, Molluscum contagiosum virus
cgccagcuguagcagga

SEQ ID NO: 3087644 - RNA, 15 nt, Molluscum contagiosum virus
cacgcgagcaauggc

SEQ ID NO: 3087645 - RNA, 19 nt, Molluscum contagiosum virus
cugacccucgcggcucugg

SEQ ID NO: 3087646 - RNA, 22 nt, Molluscum contagiosum virus
gucccgcuaaagaucgugcgcu

SEQ ID NO: 3087647 - RNA, 18 nt, Molluscum contagiosum virus
aggauuuaaauggcgcgc

SEQ ID NO: 3087648 - RNA, 20 nt, Molluscum contagiosum virus
cuuugugcgaccugcugcga

SEQ ID NO: 3087649 - RNA, 15 nt, Molluscum contagiosum virus
acgugcuccgugugc

SEQ ID NO: 3087650 - RNA, 14 nt, Molluscum contagiosum virus
agccccugcugcuc

SEQ ID NO: 3087651 - RNA, 16 nt, Molluscum contagiosum virus
gugcuggugcugguca

SEQ ID NO: 3087652 - RNA, 16 nt, Molluscum contagiosum virus
cgcucggcacugcugg

SEQ ID NO: 3087653 - RNA, 12 nt, Molluscum contagiosum virus
aacgagggaugc

SEQ ID NO: 3087654 - RNA, 13 nt, Molluscum contagiosum virus
ccgcgcugcuggc

SEQ ID NO: 3087655 - RNA, 21 nt, Molluscum contagiosum virus
gcccgacuuuucgcgccgcgg

SEQ ID NO: 3087656 - RNA, 18 nt, Molluscum contagiosum virus
acuaagcuaaaagagcug

SEQ ID NO: 3087657 - RNA, 18 nt, Molluscum contagiosum virus
gcaacgcgggccaggcac

SEQ ID NO: 3087658 - RNA, 16 nt, Molluscum contagiosum virus
gacgccgauguccugc

SEQ ID NO: 3087659 - RNA, 15 nt, Molluscum contagiosum virus
gguccaccagcugcc

SEQ ID NO: 3087660 - RNA, 12 nt, Molluscum contagiosum virus
uaacaucugcua

SEQ ID NO: 3087661 - RNA, 20 nt, Molluscum contagiosum virus
accuuucuuccgacgggccc

SEQ ID NO: 3087662 - RNA, 22 nt, Molluscum contagiosum virus
cauggacgugcugcuggcccug

SEQ ID NO: 3087663 - RNA, 21 nt, Molluscum contagiosum virus
acucgucgagcacgaagacgu

SEQ ID NO: 3087664 - RNA, 18 nt, Molluscum contagiosum virus
gcccgcgugcacccuccg

SEQ ID NO: 3087665 - RNA, 21 nt, Molluscum contagiosum virus
ccaugucgcgcaucaccgagc

SEQ ID NO: 3087666 - RNA, 13 nt, Molluscum contagiosum virus
cgggcucgagcuc

SEQ ID NO: 3087667 - RNA, 16 nt, Molluscum contagiosum virus
ugggagcuuuccuugc

SEQ ID NO: 3087668 - RNA, 22 nt, Molluscum contagiosum virus
cugcacgggcacgccgugggca

SEQ ID NO: 3087669 - RNA, 12 nt, Molluscum contagiosum virus
cgccccuucccg

SEQ ID NO: 3087670 - RNA, 14 nt, Molluscum contagiosum virus
uuccguccccucuc

SEQ ID NO: 3087671 - RNA, 15 nt, Molluscum contagiosum virus
gcucguugcgcagcc

SEQ ID NO: 3087672 - RNA, 21 nt, Molluscum contagiosum virus
cgggcgcagagccugcugcuc

SEQ ID NO: 3087673 - RNA, 12 nt, Molluscum contagiosum virus
accagcagccag

SEQ ID NO: 3087674 - RNA, 17 nt, Molluscum contagiosum virus
ccuacgcuaccugaagc

SEQ ID NO: 3087675 - RNA, 22 nt, Molluscum contagiosum virus
acgagccgcugcuccugcucug

SEQ ID NO: 3087676 - RNA, 18 nt, Molluscum contagiosum virus
cgccggggcgcgcgcugc

SEQ ID NO: 3087677 - RNA, 17 nt, Molluscum contagiosum virus
gcaccgcguggcgcgcg

SEQ ID NO: 3087678 - RNA, 16 nt, Molluscum contagiosum virus
uuccugaacaagcugc

SEQ ID NO: 3087679 - RNA, 21 nt, Molluscum contagiosum virus
cgaggccaaccuccugcaccu

SEQ ID NO: 3087680 - RNA, 19 nt, Molluscum contagiosum virus
gaggaaagcgcacacuugc

SEQ ID NO: 3087681 - RNA, 16 nt, Molluscum contagiosum virus
gcagcaggaugcuggu

SEQ ID NO: 3087682 - RNA, 20 nt, Molluscum contagiosum virus
gcacgauggggcgcucgggc

SEQ ID NO: 3087683 - RNA, 18 nt, Molluscum contagiosum virus
aggccaacgccagcugua

SEQ ID NO: 3087684 - RNA, 16 nt, Molluscum contagiosum virus
ugccagcgccucugcg

SEQ ID NO: 3087685 - RNA, 23 nt, Molluscum contagiosum virus
accagugccgacgugugccgcuc

SEQ ID NO: 3087686 - RNA, 16 nt, Molluscum contagiosum virus
cuaccacgagcacugc

SEQ ID NO: 3087687 - RNA, 13 nt, Molluscum contagiosum virus
gccgccgggccug

SEQ ID NO: 3087688 - RNA, 17 nt, Molluscum contagiosum virus
gcugcuggcccugcuag

SEQ ID NO: 3087689 - RNA, 19 nt, Molluscum contagiosum virus
ggaaacacucgauggcgag

SEQ ID NO: 3087690 - RNA, 13 nt, Molluscum contagiosum virus
cuagcgugugccg

SEQ ID NO: 3087691 - RNA, 20 nt, Molluscum contagiosum virus
agguggcaugcgcccucacg

SEQ ID NO: 3087692 - RNA, 14 nt, Molluscum contagiosum virus
accucgcugcugag

SEQ ID NO: 3087693 - RNA, 21 nt, Molluscum contagiosum virus
cacugacgguacucaugcugc

SEQ ID NO: 3087694 - RNA, 15 nt, Molluscum contagiosum virus
caagaacaaccagac

SEQ ID NO: 3087695 - RNA, 15 nt, Molluscum contagiosum virus
gugcguacccuggca

SEQ ID NO: 3087696 - RNA, 12 nt, Molluscum contagiosum virus
gacucggugcuc

SEQ ID NO: 3087697 - RNA, 15 nt, Molluscum contagiosum virus
cccucgcgcgcagcu

SEQ ID NO: 3087698 - RNA, 16 nt, Molluscum contagiosum virus
cccuggcugcugcgcg

SEQ ID NO: 3087699 - RNA, 20 nt, Molluscum contagiosum virus
gcugcgcgacaugcugcccg

SEQ ID NO: 3087700 - RNA, 13 nt, Molluscum contagiosum virus
cuggaugcugcuc

SEQ ID NO: 3087701 - RNA, 19 nt, Molluscum contagiosum virus
guguccgcgggcgcgcgcc

SEQ ID NO: 3087702 - RNA, 20 nt, Molluscum contagiosum virus
gacaggcgcgcaagugcgug

SEQ ID NO: 3087703 - RNA, 18 nt, Molluscum contagiosum virus
ugcacgccgccagcgacg

SEQ ID NO: 3087704 - RNA, 16 nt, Molluscum contagiosum virus
cccgcgucgcgcgccg

SEQ ID NO: 3087705 - RNA, 22 nt, Molluscum contagiosum virus
gagcucgacugcguugucuccu

SEQ ID NO: 3087706 - RNA, 22 nt, Molluscum contagiosum virus
cgcuugcuuccaggcgccgcac

SEQ ID NO: 3087707 - RNA, 17 nt, Molluscum contagiosum virus
gccuugagcgcgccgcg

SEQ ID NO: 3087708 - RNA, 17 nt, Molluscum contagiosum virus
aaaucccaagagccaug

SEQ ID NO: 3087709 - RNA, 16 nt, Molluscum contagiosum virus
gaacgaggcugcugcc

SEQ ID NO: 3087710 - RNA, 15 nt, Molluscum contagiosum virus
ccgcgcugcuccgug

SEQ ID NO: 3087711 - RNA, 23 nt, Molluscum contagiosum virus
cgaacgacgguaaacucuugcac

SEQ ID NO: 3087712 - RNA, 19 nt, Molluscum contagiosum virus
cgaaguuggucaacaacac

SEQ ID NO: 3087713 - RNA, 20 nt, Molluscum contagiosum virus
cugguggugcuggagcggca

SEQ ID NO: 3087714 - RNA, 10 nt, Molluscum contagiosum virus
gcauugagcu

SEQ ID NO: 3087715 - RNA, 17 nt, Molluscum contagiosum virus
gcauggcggcggccacg

SEQ ID NO: 3087716 - RNA, 14 nt, Molluscum contagiosum virus
cgcugagcgcagca

SEQ ID NO: 3087717 - RNA, 20 nt, Molluscum contagiosum virus
gcgggcccgccuuuguggac

SEQ ID NO: 3087718 - RNA, 19 nt, Molluscum contagiosum virus
cccgagcacguuccaaaag

SEQ ID NO: 3087719 - RNA, 16 nt, Molluscum contagiosum virus
gcagccucaaccugaa

SEQ ID NO: 3087720 - RNA, 18 nt, Molluscum contagiosum virus
cccuggcagccgagccgg

SEQ ID NO: 3087721 - RNA, 21 nt, Molluscum contagiosum virus
gacucgcgucugcaaggccug

SEQ ID NO: 3087722 - RNA, 22 nt, Molluscum contagiosum virus
ggccaucgagcuucccgagguc

SEQ ID NO: 3087723 - RNA, 15 nt, Molluscum contagiosum virus
uggcacccuggcugc

SEQ ID NO: 3087724 - RNA, 22 nt, Molluscum contagiosum virus
cucgaugccaacagacuugucc

SEQ ID NO: 3087725 - RNA, 15 nt, Molluscum contagiosum virus
uggacagcaucccca

SEQ ID NO: 3087726 - RNA, 17 nt, Molluscum contagiosum virus
agcacugcgcgcgcggc

SEQ ID NO: 3087727 - RNA, 17 nt, Molluscum contagiosum virus
ccggaggaaggacagug

SEQ ID NO: 3087728 - RNA, 22 nt, Molluscum contagiosum virus
ccaagaacaagcucgaggcgcu

SEQ ID NO: 3087729 - RNA, 16 nt, Molluscum contagiosum virus
ucgagacccacaaugg

SEQ ID NO: 3087730 - RNA, 17 nt, Molluscum contagiosum virus
ccgcgcccgcgcgcuuu

SEQ ID NO: 3087731 - RNA, 13 nt, Molluscum contagiosum virus
cgugggcagccgc

SEQ ID NO: 3087732 - RNA, 14 nt, Molluscum contagiosum virus
cggagcagauucgg

SEQ ID NO: 3087733 - RNA, 18 nt, Molluscum contagiosum virus
uuacggacgcccuccucg

SEQ ID NO: 3087734 - RNA, 15 nt, Molluscum contagiosum virus
cuaugcccagccuga

SEQ ID NO: 3087735 - RNA, 16 nt, Molluscum contagiosum virus
gcacugcuggcgcgcg

SEQ ID NO: 3087736 - RNA, 16 nt, Molluscum contagiosum virus
cuugcgcgcgcccucg

SEQ ID NO: 3087737 - RNA, 14 nt, Molluscum contagiosum virus
cgcgcugcuucccg

SEQ ID NO: 3087738 - RNA, 20 nt, Molluscum contagiosum virus
cacaagcaguaccugcuaac

SEQ ID NO: 3087739 - RNA, 18 nt, Molluscum contagiosum virus
ugcagcugcgcgagccgc

SEQ ID NO: 3087740 - RNA, 18 nt, Molluscum contagiosum virus
gaaacuggacugagccgc

SEQ ID NO: 3087741 - RNA, 18 nt, Molluscum contagiosum virus
guccgguguccacgacac

SEQ ID NO: 3087742 - RNA, 13 nt, Molluscum contagiosum virus
caccaccagcacg

SEQ ID NO: 3087743 - RNA, 20 nt, Molluscum contagiosum virus
cgcugcuagagaaccugugc

SEQ ID NO: 3087744 - RNA, 19 nt, Molluscum contagiosum virus
cucagcgccgcgugcaugc

SEQ ID NO: 3087745 - RNA, 14 nt, Molluscum contagiosum virus
uaggacaugacugc

SEQ ID NO: 3087746 - RNA, 19 nt, Molluscum contagiosum virus
gauucccaucgacgagguc

SEQ ID NO: 3087747 - RNA, 15 nt, Molluscum contagiosum virus
ggcgcgcgcgcgccg

SEQ ID NO: 3087748 - RNA, 15 nt, Molluscum contagiosum virus
ggccggcgcgccgcg

SEQ ID NO: 3087749 - RNA, 19 nt, Molluscum contagiosum virus
acuccgaggcagguuccgg

SEQ ID NO: 3087750 - RNA, 21 nt, Molluscum contagiosum virus
gaaacgcacagccccugcugc

SEQ ID NO: 3087751 - RNA, 16 nt, Molluscum contagiosum virus
cguguacguaauccau

SEQ ID NO: 3087752 - RNA, 16 nt, Molluscum contagiosum virus
gcgcuagccccagcac

SEQ ID NO: 3087753 - RNA, 18 nt, Molluscum contagiosum virus
gugccgacgugugccgcu

SEQ ID NO: 3087754 - RNA, 13 nt, Molluscum contagiosum virus
accgcgugcgugc

SEQ ID NO: 3087755 - RNA, 17 nt, Molluscum contagiosum virus
uugacgcccggugccug

SEQ ID NO: 3087756 - RNA, 20 nt, Molluscum contagiosum virus
uuuucccgaggcguccagcg

SEQ ID NO: 3087757 - RNA, 15 nt, Molluscum contagiosum virus
ccuguaacaaggaaa

SEQ ID NO: 3087758 - RNA, 19 nt, Molluscum contagiosum virus
cucaacuguugccuggagg

SEQ ID NO: 3087759 - RNA, 14 nt, Molluscum contagiosum virus
cccgcccagcgugg

SEQ ID NO: 3087760 - RNA, 22 nt, Molluscum contagiosum virus
cguguccgacgccgccaaugcu

SEQ ID NO: 3087761 - RNA, 22 nt, Molluscum contagiosum virus
ugcucgcgccugaaccugggcg

SEQ ID NO: 3087762 - RNA, 21 nt, Molluscum contagiosum virus
ccugcaucgcgccgcccgggc

SEQ ID NO: 3087763 - RNA, 14 nt, Molluscum contagiosum virus
cgcacaaccacagc

SEQ ID NO: 3087764 - RNA, 20 nt, Molluscum contagiosum virus
acaaggagggagagcugccc

SEQ ID NO: 3087765 - RNA, 15 nt, Molluscum contagiosum virus
ccggccgugcagagc

SEQ ID NO: 3087766 - RNA, 20 nt, Molluscum contagiosum virus
gagcugggauaacaggcgug

SEQ ID NO: 3087767 - RNA, 19 nt, Molluscum contagiosum virus
gacccgcgaacgagggaug

SEQ ID NO: 3087768 - RNA, 18 nt, Molluscum contagiosum virus
gggagcauguccgacucc

SEQ ID NO: 3087769 - RNA, 18 nt, Molluscum contagiosum virus
gcgccagaacauugccac

SEQ ID NO: 3087770 - RNA, 17 nt, Molluscum contagiosum virus
cccggaaagcagcaaac

SEQ ID NO: 3087771 - RNA, 17 nt, Molluscum contagiosum virus
gcccgacucgcagcuca

SEQ ID NO: 3087772 - RNA, 23 nt, Molluscum contagiosum virus
acgaggccuacgugcugcgcacg

SEQ ID NO: 3087773 - RNA, 19 nt, Molluscum contagiosum virus
agcucgacacugugcuggc

SEQ ID NO: 3087774 - RNA, 12 nt, Molluscum contagiosum virus
gucaggcaaaag

SEQ ID NO: 3087775 - RNA, 22 nt, Molluscum contagiosum virus
gcccggaagcuugcucagcagc

SEQ ID NO: 3087776 - RNA, 18 nt, Molluscum contagiosum virus
ggcaugcaaggcggacgc

SEQ ID NO: 3087777 - RNA, 13 nt, Molluscum contagiosum virus
cagccgcgcggca

SEQ ID NO: 3087778 - RNA, 22 nt, Molluscum contagiosum virus
ugcugguucugcgcugccagcu

SEQ ID NO: 3087779 - RNA, 20 nt, Molluscum contagiosum virus
aggucggccagcagcuccug

SEQ ID NO: 3087780 - RNA, 19 nt, Molluscum contagiosum virus
acacguugcagcagcacag

SEQ ID NO: 3087781 - RNA, 17 nt, Molluscum contagiosum virus
caccagcgugcccuucu

SEQ ID NO: 3087782 - RNA, 14 nt, Molluscum contagiosum virus
cggcauccugauga

SEQ ID NO: 3087783 - RNA, 15 nt, Molluscum contagiosum virus
cgcgccgcgcgcuua

SEQ ID NO: 3087784 - RNA, 15 nt, Molluscum contagiosum virus
cuccugccgucgccc

SEQ ID NO: 3087785 - RNA, 22 nt, Molluscum contagiosum virus
agugccacguacuugcugguug

SEQ ID NO: 3087786 - RNA, 18 nt, Molluscum contagiosum virus
agcacggccgccaccgcg

SEQ ID NO: 3087787 - RNA, 20 nt, Molluscum contagiosum virus
acaugcgugcuagcccgcac

SEQ ID NO: 3087788 - RNA, 16 nt, Molluscum contagiosum virus
ucgacagagaaguccc

SEQ ID NO: 3087789 - RNA, 16 nt, Molluscum contagiosum virus
uggcgcgcuccaugua

SEQ ID NO: 3087790 - RNA, 22 nt, Molluscum contagiosum virus
cggcagcacgggcggaagcucc

SEQ ID NO: 3087791 - RNA, 23 nt, Molluscum contagiosum virus
gcacggcaagacgacacgagggc

SEQ ID NO: 3087792 - RNA, 14 nt, Molluscum contagiosum virus
aaagagcugcugcg

SEQ ID NO: 3087793 - RNA, 19 nt, Molluscum contagiosum virus
agagcccggacacguagcc

SEQ ID NO: 3087794 - RNA, 14 nt, Molluscum contagiosum virus
ggccgugcccgccg

SEQ ID NO: 3087795 - RNA, 16 nt, Molluscum contagiosum virus
gguaugcgaggccugc

SEQ ID NO: 3087796 - RNA, 22 nt, Molluscum contagiosum virus
gcuucucuucaugaaauacuuc

SEQ ID NO: 3087797 - RNA, 12 nt, Molluscum contagiosum virus
gcaggcucuggc

SEQ ID NO: 3087798 - RNA, 18 nt, Molluscum contagiosum virus
cugcaucuuuuuuaugca

SEQ ID NO: 3087799 - RNA, 17 nt, Molluscum contagiosum virus
ccgggcucuuccggccc

SEQ ID NO: 3087800 - RNA, 16 nt, Molluscum contagiosum virus
ccucgcgcgcagcuuu

SEQ ID NO: 3087801 - RNA, 17 nt, Molluscum contagiosum virus
ugcccgccaagagcugg

SEQ ID NO: 3087802 - RNA, 21 nt, Molluscum contagiosum virus
ccgcgcggcuuggcgcccuuc

SEQ ID NO: 3087803 - RNA, 14 nt, Molluscum contagiosum virus
ucuugcgugccuuc

SEQ ID NO: 3087804 - RNA, 18 nt, Molluscum contagiosum virus
ggguggcuugcugcagua

SEQ ID NO: 3087805 - RNA, 22 nt, Molluscum contagiosum virus
gcgauggaaggcgaccagcugg

SEQ ID NO: 3087806 - RNA, 20 nt, Molluscum contagiosum virus
ggcucgcgcacuacucgucu

SEQ ID NO: 3087807 - RNA, 16 nt, Molluscum contagiosum virus
ugaucaccgaggagcc

SEQ ID NO: 3087808 - RNA, 15 nt, Molluscum contagiosum virus
cugcagcagcuggcc

SEQ ID NO: 3087809 - RNA, 12 nt, Molluscum contagiosum virus
ugcuaacaacau

SEQ ID NO: 3087810 - RNA, 20 nt, Molluscum contagiosum virus
uggugugccagcggcgccgc

SEQ ID NO: 3087811 - RNA, 23 nt, Molluscum contagiosum virus
gaccugggcgucgugcaccugga

SEQ ID NO: 3087812 - RNA, 22 nt, Molluscum contagiosum virus
ccauguccuuucagacagcgga

SEQ ID NO: 3087813 - RNA, 15 nt, Molluscum contagiosum virus
ccagccgcugcgccg

SEQ ID NO: 3087814 - RNA, 22 nt, Molluscum contagiosum virus
ucuugacgcccauuaaauggcc

SEQ ID NO: 3087815 - RNA, 21 nt, Molluscum contagiosum virus
gcgucgugcuccacgcgcagc

SEQ ID NO: 3087816 - RNA, 11 nt, Molluscum contagiosum virus
ucagcaaggag

SEQ ID NO: 3087817 - RNA, 18 nt, Molluscum contagiosum virus
ugggcgugcggcgcaccu

SEQ ID NO: 3087818 - RNA, 20 nt, Molluscum contagiosum virus
ggcgcugucgcgcaggcucu

SEQ ID NO: 3087819 - RNA, 20 nt, Molluscum contagiosum virus
gcgggaccgcccuuguggac

SEQ ID NO: 3087820 - RNA, 16 nt, Molluscum contagiosum virus
gcuccgagacugcuac

SEQ ID NO: 3087821 - RNA, 13 nt, Molluscum contagiosum virus
gcacgccagcagc

SEQ ID NO: 3087822 - RNA, 20 nt, Molluscum contagiosum virus
acgcucgcgcgcaugcucgc

SEQ ID NO: 3087823 - RNA, 14 nt, Molluscum contagiosum virus
ggcguggccaggcc

SEQ ID NO: 3087824 - RNA, 20 nt, Molluscum contagiosum virus
guauccaagaggccgucaca

SEQ ID NO: 3087825 - RNA, 14 nt, Molluscum contagiosum virus
cguggcgcugggcg

SEQ ID NO: 3087826 - RNA, 14 nt, Molluscum contagiosum virus
ggcgcgacugcacg

SEQ ID NO: 3087827 - RNA, 12 nt, Molluscum contagiosum virus
gcucaggccagc

SEQ ID NO: 3087828 - RNA, 19 nt, Molluscum contagiosum virus
gcagcggcaaaggcccgcg

SEQ ID NO: 3087829 - RNA, 19 nt, Molluscum contagiosum virus
gggaagcacguagcucgcg

SEQ ID NO: 3087830 - RNA, 15 nt, Molluscum contagiosum virus
cggugcucgccccuc

SEQ ID NO: 3087831 - RNA, 15 nt, Molluscum contagiosum virus
ccucuuuugcgucgc

SEQ ID NO: 3087832 - RNA, 22 nt, Molluscum contagiosum virus
gugccgcugcgcuggaugcugc

SEQ ID NO: 3087833 - RNA, 22 nt, Molluscum contagiosum virus
cccuaagggcccgcuggcggcg

SEQ ID NO: 3087834 - RNA, 14 nt, Molluscum contagiosum virus
ggccgugcagagca

SEQ ID NO: 3087835 - RNA, 16 nt, Molluscum contagiosum virus
uuggcuaugaggaggc

SEQ ID NO: 3087836 - RNA, 14 nt, Molluscum contagiosum virus
cggcagcagccucg

SEQ ID NO: 3087837 - RNA, 14 nt, Molluscum contagiosum virus
cagcaccaucacgu

SEQ ID NO: 3087838 - RNA, 19 nt, Molluscum contagiosum virus
cggguguugaccaaagguc

SEQ ID NO: 3087839 - RNA, 12 nt, Molluscum contagiosum virus
cucggcgcacac

SEQ ID NO: 3087840 - RNA, 14 nt, Molluscum contagiosum virus
gccgccggcgccgc

SEQ ID NO: 3087841 - RNA, 14 nt, Molluscum contagiosum virus
gcccgcggcgcgcc

SEQ ID NO: 3087842 - RNA, 14 nt, Molluscum contagiosum virus
cugcgcgccgcgcc

SEQ ID NO: 3087843 - RNA, 14 nt, Molluscum contagiosum virus
gccggcgcggcgag

SEQ ID NO: 3087844 - RNA, 19 nt, Molluscum contagiosum virus
gacggucguccuggagccu

SEQ ID NO: 3087845 - RNA, 14 nt, Molluscum contagiosum virus
guagcuagcucugc

SEQ ID NO: 3087846 - RNA, 14 nt, Molluscum contagiosum virus
gcgcggcagccgca

SEQ ID NO: 3087847 - RNA, 19 nt, Molluscum contagiosum virus
ucggggcccucggcgcgcc

SEQ ID NO: 3087848 - RNA, 15 nt, Molluscum contagiosum virus
cugccgugcgggcgc

SEQ ID NO: 3087849 - RNA, 14 nt, Molluscum contagiosum virus
caggccaggugcag

SEQ ID NO: 3087850 - RNA, 20 nt, Molluscum contagiosum virus
cgcgcaagucaccgcuccgc

SEQ ID NO: 3087851 - RNA, 19 nt, Molluscum contagiosum virus
agucacgaccgacccaucg

SEQ ID NO: 3087852 - RNA, 15 nt, Molluscum contagiosum virus
gggcgcacgcuuguc

SEQ ID NO: 3087853 - RNA, 14 nt, Molluscum contagiosum virus
cucgcgcgccagca

SEQ ID NO: 3087854 - RNA, 20 nt, Molluscum contagiosum virus
agucuuccuggggcuggaca

SEQ ID NO: 3087855 - RNA, 20 nt, Molluscum contagiosum virus
cuccacgcccgagggcgggc

SEQ ID NO: 3087856 - RNA, 16 nt, Molluscum contagiosum virus
cagccgcugcgccgcc

SEQ ID NO: 3087857 - RNA, 18 nt, Molluscum contagiosum virus
cugccuagguccacauuu

SEQ ID NO: 3087858 - RNA, 15 nt, Molluscum contagiosum virus
cucgcuggcuccgcu

SEQ ID NO: 3087859 - RNA, 19 nt, Molluscum contagiosum virus
guacucaacgcgauggcgc

SEQ ID NO: 3087860 - RNA, 16 nt, Molluscum contagiosum virus
ggcgcccuuccuggag

SEQ ID NO: 3087861 - RNA, 21 nt, Molluscum contagiosum virus
ggugcucguggaaaagcaggg

SEQ ID NO: 3087862 - RNA, 14 nt, Molluscum contagiosum virus
ggcgcucgccccuu

SEQ ID NO: 3087863 - RNA, 20 nt, Molluscum contagiosum virus
cucccgccgcgugcccgucu

SEQ ID NO: 3087864 - RNA, 20 nt, Molluscum contagiosum virus
uccacgcugcguucgagcug

SEQ ID NO: 3087865 - RNA, 14 nt, Molluscum contagiosum virus
cgcgccgcgcuggc

SEQ ID NO: 3087866 - RNA, 21 nt, Molluscum contagiosum virus
agaagagggucgugcaggucg

SEQ ID NO: 3087867 - RNA, 18 nt, Molluscum contagiosum virus
ccagcagguagcuggcag

SEQ ID NO: 3087868 - RNA, 17 nt, Molluscum contagiosum virus
gaacagcuucacgauga

SEQ ID NO: 3087869 - RNA, 18 nt, Molluscum contagiosum virus
cgcucggcgcgcgccgcg

SEQ ID NO: 3087870 - RNA, 21 nt, Molluscum contagiosum virus
gacggaggucuacaacgagcu

SEQ ID NO: 3087871 - RNA, 16 nt, Molluscum contagiosum virus
uaacaaggaaaaggca

SEQ ID NO: 3087872 - RNA, 21 nt, Molluscum contagiosum virus
caggcacgacgccgacaccgg

SEQ ID NO: 3087873 - RNA, 23 nt, Molluscum contagiosum virus
gacacgcugcgcgugcugggccc

SEQ ID NO: 3087874 - RNA, 15 nt, Molluscum contagiosum virus
cggaggcugcucccu

SEQ ID NO: 3087875 - RNA, 20 nt, Molluscum contagiosum virus
gcggccaaccgccugcucuc

SEQ ID NO: 3087876 - RNA, 17 nt, Molluscum contagiosum virus
gcuugccgcuugagcag

SEQ ID NO: 3087877 - RNA, 15 nt, Molluscum contagiosum virus
acgagcagugccgcc

SEQ ID NO: 3087878 - RNA, 22 nt, Molluscum contagiosum virus
aggccggcaagcucaagcccgg

SEQ ID NO: 3087879 - RNA, 19 nt, Molluscum contagiosum virus
cagccugacggcagcaagc

SEQ ID NO: 3087880 - RNA, 22 nt, Molluscum contagiosum virus
cgccgcaccucaccgcgcacau

SEQ ID NO: 3087881 - RNA, 14 nt, Molluscum contagiosum virus
cuggcuccgcugga

SEQ ID NO: 3087882 - RNA, 20 nt, Molluscum contagiosum virus
gccccgcgcguugcugcccg

SEQ ID NO: 3087883 - RNA, 15 nt, Molluscum contagiosum virus
accagcagccaggcu

SEQ ID NO: 3087884 - RNA, 22 nt, Molluscum contagiosum virus
gccagcgauugcccgcgcgcgg

SEQ ID NO: 3087885 - RNA, 19 nt, Molluscum contagiosum virus
gccgcgugcuggcggggcu

SEQ ID NO: 3087886 - RNA, 20 nt, Molluscum contagiosum virus
cagcgcuagccccagcacca

SEQ ID NO: 3087887 - RNA, 22 nt, Molluscum contagiosum virus
ccugcguggacagcaucccugc

SEQ ID NO: 3087888 - RNA, 15 nt, Molluscum contagiosum virus
gacaccagcuccgcc

SEQ ID NO: 3087889 - RNA, 19 nt, Molluscum contagiosum virus
accagcucuucguggccaa

SEQ ID NO: 3087890 - RNA, 23 nt, Molluscum contagiosum virus
gcuggagcagacguacgagcagg

SEQ ID NO: 3087891 - RNA, 15 nt, Molluscum contagiosum virus
cucauccucccugcg

SEQ ID NO: 3087892 - RNA, 16 nt, Molluscum contagiosum virus
ucaaccgcaaggaaaa

SEQ ID NO: 3087893 - RNA, 13 nt, Molluscum contagiosum virus
ugcgcacgcugac

SEQ ID NO: 3087894 - RNA, 22 nt, Molluscum contagiosum virus
ugcgcacggaccucaaggaggc

SEQ ID NO: 3087895 - RNA, 21 nt, Molluscum contagiosum virus
gcguauucgcgucuugaaaug

SEQ ID NO: 3087896 - RNA, 17 nt, Molluscum contagiosum virus
gaagcagugcucgggag

SEQ ID NO: 3087897 - RNA, 19 nt, Molluscum contagiosum virus
gcucggcguggugcuggcc

SEQ ID NO: 3087898 - RNA, 16 nt, Molluscum contagiosum virus
gcacuccgcgcaccgc

SEQ ID NO: 3087899 - RNA, 12 nt, Molluscum contagiosum virus
accuacaugagu

SEQ ID NO: 3087900 - RNA, 16 nt, Molluscum contagiosum virus
gacgcggccgcggagg

SEQ ID NO: 3087901 - RNA, 16 nt, Molluscum contagiosum virus
cuaaaagagcugcugc

SEQ ID NO: 3087902 - RNA, 21 nt, Molluscum contagiosum virus
gcagcgugcgcaccagcugca

SEQ ID NO: 3087903 - RNA, 22 nt, Molluscum contagiosum virus
cgcccguaaagaagcggugcag

SEQ ID NO: 3087904 - RNA, 20 nt, Molluscum contagiosum virus
acucgcuggccucugccugc

SEQ ID NO: 3087905 - RNA, 13 nt, Molluscum contagiosum virus
cgcgcacugcucg

SEQ ID NO: 3087906 - RNA, 14 nt, Molluscum contagiosum virus
cagugccagcagcc

SEQ ID NO: 3087907 - RNA, 13 nt, Molluscum contagiosum virus
gccgcgugcuggc

SEQ ID NO: 3087908 - RNA, 16 nt, Molluscum contagiosum virus
aucugcgcgugcuguc

SEQ ID NO: 3087909 - RNA, 13 nt, Molluscum contagiosum virus
ugcgcggggcagg

SEQ ID NO: 3087910 - RNA, 14 nt, Molluscum contagiosum virus
gcgcgccugcuggc

SEQ ID NO: 3087911 - RNA, 15 nt, Molluscum contagiosum virus
gcgagcucaaggaca

SEQ ID NO: 3087912 - RNA, 12 nt, Molluscum contagiosum virus
uggccucugcca

SEQ ID NO: 3087913 - RNA, 15 nt, Molluscum contagiosum virus
gcacgagggcacagg

SEQ ID NO: 3087914 - RNA, 21 nt, Molluscum contagiosum virus
cgagcucuccgaagagcagaa

SEQ ID NO: 3087915 - RNA, 19 nt, Molluscum contagiosum virus
gaacccgcauugggccuug

SEQ ID NO: 3087916 - RNA, 21 nt, Molluscum contagiosum virus
ugcuggcggggcuggcagaag

SEQ ID NO: 3087917 - RNA, 20 nt, Molluscum contagiosum virus
cugccguuuuacacagggcu

SEQ ID NO: 3087918 - RNA, 12 nt, Molluscum contagiosum virus
gccuacgugcug

SEQ ID NO: 3087919 - RNA, 19 nt, Molluscum contagiosum virus
ugugcgacucgucgagcac

SEQ ID NO: 3087920 - RNA, 17 nt, Molluscum contagiosum virus
gcagguuccggugucag

SEQ ID NO: 3087921 - RNA, 17 nt, Molluscum contagiosum virus
gcgagauucuggcgcgc

SEQ ID NO: 3087922 - RNA, 15 nt, Molluscum contagiosum virus
ccggccccgcgaacg

SEQ ID NO: 3087923 - RNA, 20 nt, Molluscum contagiosum virus
cgugaggaggcggcacugcu

SEQ ID NO: 3087924 - RNA, 21 nt, Molluscum contagiosum virus
cgcagcagugccagcagccgc

SEQ ID NO: 3087925 - RNA, 23 nt, Molluscum contagiosum virus
ccugcaaacgcgaaacuggacug

SEQ ID NO: 3087926 - RNA, 23 nt, Molluscum contagiosum virus
ucuuacggagcuacaaaacugaa

SEQ ID NO: 3087927 - RNA, 14 nt, Molluscum contagiosum virus
gacgcuagcugugc

SEQ ID NO: 3087928 - RNA, 17 nt, Molluscum contagiosum virus
cggguccgucuuugcgg

SEQ ID NO: 3087929 - RNA, 16 nt, Molluscum contagiosum virus
gcacgcgcgagcaugc

SEQ ID NO: 3087930 - RNA, 14 nt, Molluscum contagiosum virus
caccaccagcacgc

SEQ ID NO: 3087931 - RNA, 23 nt, Molluscum contagiosum virus
auucucguggcguugcugcugcg

SEQ ID NO: 3087932 - RNA, 20 nt, Molluscum contagiosum virus
gcuccagcauggcgccacac

SEQ ID NO: 3087933 - RNA, 16 nt, Molluscum contagiosum virus
aagcgcucgcggcucg

SEQ ID NO: 3087934 - RNA, 15 nt, Molluscum contagiosum virus
gcaccagcgcgcaga

SEQ ID NO: 3087935 - RNA, 14 nt, Molluscum contagiosum virus
aguaccgcgcgcac

SEQ ID NO: 3087936 - RNA, 14 nt, Molluscum contagiosum virus
ccugcgcuagugaa

SEQ ID NO: 3087937 - RNA, 14 nt, Molluscum contagiosum virus
uacaucgacaagca

SEQ ID NO: 3087938 - RNA, 16 nt, Molluscum contagiosum virus
cggcgggaagggguga

SEQ ID NO: 3087939 - RNA, 18 nt, Molluscum contagiosum virus
uccaggcgccgcaccuca

SEQ ID NO: 3087940 - RNA, 18 nt, Molluscum contagiosum virus
uggcaugcgugcuucacg

SEQ ID NO: 3087941 - RNA, 21 nt, Molluscum contagiosum virus
gccgagcgugaccagugcgug

SEQ ID NO: 3087942 - RNA, 14 nt, Molluscum contagiosum virus
guuuccgcgccucc

SEQ ID NO: 3087943 - RNA, 20 nt, Molluscum contagiosum virus
gccacgaagaacgcggcgug

SEQ ID NO: 3087944 - RNA, 12 nt, Molluscum contagiosum virus
cgcaagcagcuc

SEQ ID NO: 3087945 - RNA, 16 nt, Molluscum contagiosum virus
cagcgcgccaccacca

SEQ ID NO: 3087946 - RNA, 16 nt, Molluscum contagiosum virus
ggcugcugccgcgcgu

SEQ ID NO: 3087947 - RNA, 16 nt, Molluscum contagiosum virus
cucaacaagcugcugg

SEQ ID NO: 3087948 - RNA, 14 nt, Molluscum contagiosum virus
cauggcgccgcugc

SEQ ID NO: 3087949 - RNA, 21 nt, Molluscum contagiosum virus
ucuacgccgcgcaccuggagu

SEQ ID NO: 3087950 - RNA, 12 nt, Molluscum contagiosum virus
ucggccagcagc

SEQ ID NO: 3087951 - RNA, 21 nt, Molluscum contagiosum virus
gcgugugcgcgagcugaggca

SEQ ID NO: 3087952 - RNA, 15 nt, Molluscum contagiosum virus
guacugcugcaggca

SEQ ID NO: 3087953 - RNA, 22 nt, Molluscum contagiosum virus
gcaacguugcgcguucagcgca

SEQ ID NO: 3087954 - RNA, 19 nt, Molluscum contagiosum virus
gccugcccgugugcgggca

SEQ ID NO: 3087955 - RNA, 15 nt, Molluscum contagiosum virus
cucggcacugcuggc

SEQ ID NO: 3087956 - RNA, 15 nt, Molluscum contagiosum virus
gguucgcgcccugcg

SEQ ID NO: 3087957 - RNA, 18 nt, Molluscum contagiosum virus
ccguguaccgccgcggcc

SEQ ID NO: 3087958 - RNA, 18 nt, Molluscum contagiosum virus
gcgcgcccaccagcagcc

SEQ ID NO: 3087959 - RNA, 20 nt, Molluscum contagiosum virus
cuucguaaagcuggccgagg

SEQ ID NO: 3087960 - RNA, 19 nt, Molluscum contagiosum virus
cguggucgagggcgaggcc

SEQ ID NO: 3087961 - RNA, 19 nt, Molluscum contagiosum virus
ucaagauccaagcgcaaca

SEQ ID NO: 3087962 - RNA, 19 nt, Molluscum contagiosum virus
cguggccuaccugcaggag

SEQ ID NO: 3087963 - RNA, 14 nt, Molluscum contagiosum virus
ucggcguggccagg

SEQ ID NO: 3087964 - RNA, 22 nt, Molluscum contagiosum virus
agcccgcugcgcauggccacgc

SEQ ID NO: 3087965 - RNA, 22 nt, Molluscum contagiosum virus
uccccgguucaaauccugguuc

SEQ ID NO: 3087966 - RNA, 22 nt, Molluscum contagiosum virus
gcagaaacagccgugcuccgag

SEQ ID NO: 3087967 - RNA, 23 nt, Molluscum contagiosum virus
guaacaaggaaaaggcacacccc

SEQ ID NO: 3087968 - RNA, 20 nt, Molluscum contagiosum virus
aaacgcgaaacuggacugag

SEQ ID NO: 3087969 - RNA, 16 nt, Molluscum contagiosum virus
auacgccuagccugca

SEQ ID NO: 3087970 - RNA, 18 nt, Molluscum contagiosum virus
ugcgcuugcucacgcugc

SEQ ID NO: 3087971 - RNA, 15 nt, Molluscum contagiosum virus
cuguucggcaugcag

SEQ ID NO: 3087972 - RNA, 14 nt, Molluscum contagiosum virus
ccuugaagggcaca

SEQ ID NO: 3087973 - RNA, 15 nt, Molluscum contagiosum virus
gcgccggcucugccu

SEQ ID NO: 3087974 - RNA, 21 nt, Molluscum contagiosum virus
agcggccuguucuuccagugg

SEQ ID NO: 3087975 - RNA, 15 nt, Molluscum contagiosum virus
gcucggcacugcugg

SEQ ID NO: 3087976 - RNA, 19 nt, Molluscum contagiosum virus
agaagugugccugcugcgc

SEQ ID NO: 3087977 - RNA, 23 nt, Molluscum contagiosum virus
aaguacuuuccucuucggcgucc

SEQ ID NO: 3087978 - RNA, 13 nt, Molluscum contagiosum virus
aguucuuggugga

SEQ ID NO: 3087979 - RNA, 12 nt, Molluscum contagiosum virus
uugcacauuaaa

SEQ ID NO: 3087980 - RNA, 19 nt, Molluscum contagiosum virus
caaccacucuuucacgcug

SEQ ID NO: 3087981 - RNA, 21 nt, Molluscum contagiosum virus
ccgcagaacacgggggcugcc

SEQ ID NO: 3087982 - RNA, 22 nt, Molluscum contagiosum virus
ugcaccugcuggaacgcuuggc

SEQ ID NO: 3087983 - RNA, 12 nt, Molluscum contagiosum virus
gcucgcgccgcc

SEQ ID NO: 3087984 - RNA, 23 nt, Molluscum contagiosum virus
gaaacgcacagccccugcugcuc

SEQ ID NO: 3087985 - RNA, 22 nt, Molluscum contagiosum virus
cuucggcgcaacgcuggccgcc

SEQ ID NO: 3087986 - RNA, 20 nt, Molluscum contagiosum virus
cgagcugcgugugccggugc

SEQ ID NO: 3087987 - RNA, 21 nt, Molluscum contagiosum virus
ucgccggcaucgcgcugcugg

SEQ ID NO: 3087988 - RNA, 18 nt, Molluscum contagiosum virus
gccuucugcaagcugccc

SEQ ID NO: 3087989 - RNA, 19 nt, Molluscum contagiosum virus
gcuaccugaagcuggacgu

SEQ ID NO: 3087990 - RNA, 18 nt, Molluscum contagiosum virus
ggcaccccgaaaggcacc

SEQ ID NO: 3087991 - RNA, 20 nt, Molluscum contagiosum virus
cgaaguuggucaacaacacg

SEQ ID NO: 3087992 - RNA, 16 nt, Molluscum contagiosum virus
cgggcacgugcugcug

SEQ ID NO: 3087993 - RNA, 14 nt, Molluscum contagiosum virus
cauccucuaccgcc

SEQ ID NO: 3087994 - RNA, 16 nt, Molluscum contagiosum virus
gcacacgagugcccgc

SEQ ID NO: 3087995 - RNA, 18 nt, Molluscum contagiosum virus
cucguacucguugccgug

SEQ ID NO: 3087996 - RNA, 13 nt, Molluscum contagiosum virus
gacaaggagggag

SEQ ID NO: 3087997 - RNA, 15 nt, Molluscum contagiosum virus
gcgcgacuuggggcu

SEQ ID NO: 3087998 - RNA, 21 nt, Molluscum contagiosum virus
aggucuuccauugcauggaca

SEQ ID NO: 3087999 - RNA, 19 nt, Molluscum contagiosum virus
cggagcaggacgacgacac

SEQ ID NO: 3088000 - RNA, 22 nt, Molluscum contagiosum virus
uugcugucccaagacucugccg

SEQ ID NO: 3088001 - RNA, 20 nt, Molluscum contagiosum virus
gcagccgcagcccacgugcc

SEQ ID NO: 3088002 - RNA, 22 nt, Molluscum contagiosum virus
cgcaaaaaacgaaaagccagac

SEQ ID NO: 3088003 - RNA, 22 nt, Molluscum contagiosum virus
gcacgugugcaggaacugcccg

SEQ ID NO: 3088004 - RNA, 18 nt, Molluscum contagiosum virus
gcgcggacagccuagaaa

SEQ ID NO: 3088005 - RNA, 12 nt, Molluscum contagiosum virus
cccgcaggaaag

SEQ ID NO: 3088006 - RNA, 14 nt, Molluscum contagiosum virus
gcgguggugcuggg

SEQ ID NO: 3088007 - RNA, 13 nt, Molluscum contagiosum virus
ccgcgcgcacgcg

SEQ ID NO: 3088008 - RNA, 12 nt, Molluscum contagiosum virus
cggggccgcacg

SEQ ID NO: 3088009 - RNA, 18 nt, Molluscum contagiosum virus
cacaccugugcccugucc

SEQ ID NO: 3088010 - RNA, 20 nt, Molluscum contagiosum virus
ccggcgcggcgagccgcgcg

SEQ ID NO: 3088011 - RNA, 21 nt, Molluscum contagiosum virus
ggcgacgacagcgacgagauc

SEQ ID NO: 3088012 - RNA, 17 nt, Molluscum contagiosum virus
ugcucgucgccgggccc

SEQ ID NO: 3088013 - RNA, 21 nt, Molluscum contagiosum virus
gagcaccgaacaaaugcagag

SEQ ID NO: 3088014 - RNA, 12 nt, Molluscum contagiosum virus
gacguagagcag

SEQ ID NO: 3088015 - RNA, 20 nt, Molluscum contagiosum virus
uccgggcagauagcaaccuc

SEQ ID NO: 3088016 - RNA, 22 nt, Molluscum contagiosum virus
acuguaggggagggcggcaagc

SEQ ID NO: 3088017 - RNA, 14 nt, Molluscum contagiosum virus
gcucaagcugcuca

SEQ ID NO: 3088018 - RNA, 21 nt, Molluscum contagiosum virus
caccgcaugggcccuggcggc

SEQ ID NO: 3088019 - RNA, 20 nt, Molluscum contagiosum virus
cgcagcgggcuacucgagca

SEQ ID NO: 3088020 - RNA, 15 nt, Molluscum contagiosum virus
cgcgcgagcugcugc

SEQ ID NO: 3088021 - RNA, 12 nt, Molluscum contagiosum virus
gcccccgugcug

SEQ ID NO: 3088022 - RNA, 23 nt, Molluscum contagiosum virus
cacgcgacgacgcacgcuugccu

SEQ ID NO: 3088023 - RNA, 19 nt, Molluscum contagiosum virus
gcgccgucucgcggaagaa

SEQ ID NO: 3088024 - RNA, 18 nt, Molluscum contagiosum virus
accccgagguucuccaga

SEQ ID NO: 3088025 - RNA, 12 nt, Molluscum contagiosum virus
aacaagcugcug

SEQ ID NO: 3088026 - RNA, 18 nt, Molluscum contagiosum virus
acuacaaggugcuguccu

SEQ ID NO: 3088027 - RNA, 20 nt, Molluscum contagiosum virus
gccugcaagaggcgcugucg

SEQ ID NO: 3088028 - RNA, 16 nt, Molluscum contagiosum virus
gcaacgucgcacuggc

SEQ ID NO: 3088029 - RNA, 14 nt, Molluscum contagiosum virus
acgggaacgagguc

SEQ ID NO: 3088030 - RNA, 21 nt, Molluscum contagiosum virus
gggcgcgguagcucgugccug

SEQ ID NO: 3088031 - RNA, 22 nt, Molluscum contagiosum virus
cacuugcgcgcgugccuguggc

SEQ ID NO: 3088032 - RNA, 14 nt, Molluscum contagiosum virus
gcggcgcgcagcuc

SEQ ID NO: 3088033 - RNA, 18 nt, Molluscum contagiosum virus
cgaggcguccagcggcug

SEQ ID NO: 3088034 - RNA, 15 nt, Molluscum contagiosum virus
caacgacaaggaaag

SEQ ID NO: 3088035 - RNA, 15 nt, Molluscum contagiosum virus
acagcuugcugcugu

SEQ ID NO: 3088036 - RNA, 14 nt, Molluscum contagiosum virus
acaacgugcugcuc

SEQ ID NO: 3088037 - RNA, 13 nt, Molluscum contagiosum virus
cggcgcacgcaca

SEQ ID NO: 3088038 - RNA, 21 nt, Molluscum contagiosum virus
aacgcgacgauggccacgcag

SEQ ID NO: 3088039 - RNA, 17 nt, Molluscum contagiosum virus
agcacugccugccgccu

SEQ ID NO: 3088040 - RNA, 19 nt, Molluscum contagiosum virus
cuggaggcaaucuguccag

SEQ ID NO: 3088041 - RNA, 23 nt, Molluscum contagiosum virus
ugccccaugcccgaccacgugcc

SEQ ID NO: 3088042 - RNA, 18 nt, Molluscum contagiosum virus
cgccaguacgcaugcgcg

SEQ ID NO: 3088043 - RNA, 19 nt, Molluscum contagiosum virus
ugguccaccagcugccgcu

SEQ ID NO: 3088044 - RNA, 22 nt, Molluscum contagiosum virus
gcggcuagcaccgcaugggccc

SEQ ID NO: 3088045 - RNA, 23 nt, Molluscum contagiosum virus
accgcguccgcuaccgcagccac

SEQ ID NO: 3088046 - RNA, 14 nt, Molluscum contagiosum virus
cagcaagcagcgcg

SEQ ID NO: 3088047 - RNA, 12 nt, Molluscum contagiosum virus
cgcaacgagguc

SEQ ID NO: 3088048 - RNA, 21 nt, Molluscum contagiosum virus
caagugcacaccagacaaagu

SEQ ID NO: 3088049 - RNA, 22 nt, Molluscum contagiosum virus
cgcugcagcuaggauccugcuc

SEQ ID NO: 3088050 - RNA, 15 nt, Molluscum contagiosum virus
ccgcuaccagcucgc

SEQ ID NO: 3088051 - RNA, 12 nt, Molluscum contagiosum virus
gcacauugcugc

SEQ ID NO: 3088052 - RNA, 22 nt, Molluscum contagiosum virus
agggccugcgggcggcacacac

SEQ ID NO: 3088053 - RNA, 19 nt, Molluscum contagiosum virus
gcgcucgcucgcgcgcagc

SEQ ID NO: 3088054 - RNA, 13 nt, Molluscum contagiosum virus
ucaacaagcugcu

SEQ ID NO: 3088055 - RNA, 18 nt, Molluscum contagiosum virus
gaugccuuucaggggucu

SEQ ID NO: 3088056 - RNA, 15 nt, Molluscum contagiosum virus
gacgcgcggcggcgc

SEQ ID NO: 3088057 - RNA, 15 nt, Molluscum contagiosum virus
gaaguccucucuccc

SEQ ID NO: 3088058 - RNA, 16 nt, Molluscum contagiosum virus
cgugccucugccagcc

SEQ ID NO: 3088059 - RNA, 13 nt, Molluscum contagiosum virus
gagccucuggaag

SEQ ID NO: 3088060 - RNA, 17 nt, Molluscum contagiosum virus
gcgcuucugccugcucc

SEQ ID NO: 3088061 - RNA, 15 nt, Molluscum contagiosum virus
gcaagggcuccuucu

SEQ ID NO: 3088062 - RNA, 22 nt, Molluscum contagiosum virus
gaaguccucucuccccuucaga

SEQ ID NO: 3088063 - RNA, 22 nt, Molluscum contagiosum virus
cagcauccuggaguuuaaugac

SEQ ID NO: 3088064 - RNA, 19 nt, Molluscum contagiosum virus
cuccgacgugcugcgcaac

SEQ ID NO: 3088065 - RNA, 15 nt, Molluscum contagiosum virus
caguaccgugucaaa

SEQ ID NO: 3088066 - RNA, 19 nt, Molluscum contagiosum virus
cgggguacaggcgcggcag

SEQ ID NO: 3088067 - RNA, 15 nt, Molluscum contagiosum virus
cggagcgcacgaagc

SEQ ID NO: 3088068 - RNA, 21 nt, Molluscum contagiosum virus
accuggucguugucgggaaug

SEQ ID NO: 3088069 - RNA, 19 nt, Molluscum contagiosum virus
cugcuuccgcaccuggucg

SEQ ID NO: 3088070 - RNA, 14 nt, Molluscum contagiosum virus
uguaacaaggaaaa

SEQ ID NO: 3088071 - RNA, 14 nt, Molluscum contagiosum virus
cccgcgauuuacuu

SEQ ID NO: 3088072 - RNA, 15 nt, Molluscum contagiosum virus
guggccaaggucucg

SEQ ID NO: 3088073 - RNA, 22 nt, Molluscum contagiosum virus
ucaacgcgauggcgcagcuccu

SEQ ID NO: 3088074 - RNA, 17 nt, Molluscum contagiosum virus
ggccucguccuggaggg

SEQ ID NO: 3088075 - RNA, 16 nt, Molluscum contagiosum virus
cugccauggcagcucg

SEQ ID NO: 3088076 - RNA, 18 nt, Molluscum contagiosum virus
cgccuguaccugcucggg

SEQ ID NO: 3088077 - RNA, 15 nt, Molluscum contagiosum virus
gcgccagccugcugg

SEQ ID NO: 3088078 - RNA, 16 nt, Molluscum contagiosum virus
uggcauccggcacgca

SEQ ID NO: 3088079 - RNA, 13 nt, Molluscum contagiosum virus
cacugccugccgc

SEQ ID NO: 3088080 - RNA, 19 nt, Molluscum contagiosum virus
ggcacccgcaacaaggaaa

SEQ ID NO: 3088081 - RNA, 13 nt, Molluscum contagiosum virus
caaggcgcacgag

SEQ ID NO: 3088082 - RNA, 22 nt, Molluscum contagiosum virus
gccgggccugcggcggcgcacg

SEQ ID NO: 3088083 - RNA, 14 nt, Molluscum contagiosum virus
gcuggccucugcca

SEQ ID NO: 3088084 - RNA, 15 nt, Molluscum contagiosum virus
gccagcuugagcaca

SEQ ID NO: 3088085 - RNA, 22 nt, Molluscum contagiosum virus
gcucggcccgcggacgcgcagc

SEQ ID NO: 3088086 - RNA, 17 nt, Molluscum contagiosum virus
gcacugcucgcgcacgc

SEQ ID NO: 3088087 - RNA, 15 nt, Molluscum contagiosum virus
cggggcaggcagugc

SEQ ID NO: 3088088 - RNA, 17 nt, Molluscum contagiosum virus
cgugcggcggcgcgugc

SEQ ID NO: 3088089 - RNA, 18 nt, Molluscum contagiosum virus
ccuggcggcgcuggagac

SEQ ID NO: 3088090 - RNA, 16 nt, Molluscum contagiosum virus
cguccggcgcucgccu

SEQ ID NO: 3088091 - RNA, 14 nt, Molluscum contagiosum virus
gcgucuccgcgagu

SEQ ID NO: 3088092 - RNA, 17 nt, Molluscum contagiosum virus
cagcucggggcugucag

SEQ ID NO: 3088093 - RNA, 22 nt, Molluscum contagiosum virus
cccaagagccauguuuccugcg

SEQ ID NO: 3088094 - RNA, 21 nt, Molluscum contagiosum virus
cuggcagugccgggcgccggc

SEQ ID NO: 3088095 - RNA, 17 nt, Molluscum contagiosum virus
ggcccgcgcgugaagga

SEQ ID NO: 3088096 - RNA, 14 nt, Molluscum contagiosum virus
aucggcacugcuca

SEQ ID NO: 3088097 - RNA, 19 nt, Molluscum contagiosum virus
gugacucggccgcggggcg

SEQ ID NO: 3088098 - RNA, 23 nt, Molluscum contagiosum virus
gaagggcgcggacgccuucuucc

SEQ ID NO: 3088099 - RNA, 18 nt, Molluscum contagiosum virus
ggcgcuagugcagaugag

SEQ ID NO: 3088100 - RNA, 18 nt, Molluscum contagiosum virus
ccgcgagcacuggcuggc

SEQ ID NO: 3088101 - RNA, 21 nt, Molluscum contagiosum virus
cgcgcgcaagucgcgcgcugc

SEQ ID NO: 3088102 - RNA, 15 nt, Molluscum contagiosum virus
uacaucggacuggcg

SEQ ID NO: 3088103 - RNA, 21 nt, Molluscum contagiosum virus
cccaucggagaagugcuccgc

SEQ ID NO: 3088104 - RNA, 21 nt, Molluscum contagiosum virus
cgccgaaacacggccuccagc

SEQ ID NO: 3088105 - RNA, 21 nt, Molluscum contagiosum virus
gcgugccgcggcacugggugc

SEQ ID NO: 3088106 - RNA, 20 nt, Molluscum contagiosum virus
guccgcuccuucucagggcu

SEQ ID NO: 3088107 - RNA, 18 nt, Molluscum contagiosum virus
agcaagucugcgcaggac

SEQ ID NO: 3088108 - RNA, 21 nt, Molluscum contagiosum virus
ucaagacauuucuccuccggg

SEQ ID NO: 3088109 - RNA, 19 nt, Molluscum contagiosum virus
gcgcaagccgcguaccacc

SEQ ID NO: 3088110 - RNA, 14 nt, Molluscum contagiosum virus
guccugaacagcau

SEQ ID NO: 3088111 - RNA, 19 nt, Molluscum contagiosum virus
caggcucgucguggacgcu

SEQ ID NO: 3088112 - RNA, 20 nt, Molluscum contagiosum virus
augaaccacuucgucaagca

SEQ ID NO: 3088113 - RNA, 22 nt, Molluscum contagiosum virus
gcggugcggcgcacgcugcugu

SEQ ID NO: 3088114 - RNA, 18 nt, Molluscum contagiosum virus
cacauuccucggcgcaca

SEQ ID NO: 3088115 - RNA, 13 nt, Molluscum contagiosum virus
acgcgggccaggc

SEQ ID NO: 3088116 - RNA, 24 nt, Molluscum contagiosum virus
acaaccacucuuucacgcugcacg

SEQ ID NO: 3088117 - RNA, 18 nt, Molluscum contagiosum virus
augcgucccagcagcugc

SEQ ID NO: 3088118 - RNA, 20 nt, Molluscum contagiosum virus
aucgcucgcggugcagcugc

SEQ ID NO: 3088119 - RNA, 13 nt, Molluscum contagiosum virus
ucgcgggcgccgc

SEQ ID NO: 3088120 - RNA, 20 nt, Molluscum contagiosum virus
augacuaugcgucuuccugc

SEQ ID NO: 3088121 - RNA, 16 nt, Molluscum contagiosum virus
gccgaugccuaugccg

SEQ ID NO: 3088122 - RNA, 19 nt, Molluscum contagiosum virus
cgccgccucgcgcgcacug

SEQ ID NO: 3088123 - RNA, 14 nt, Molluscum contagiosum virus
cuuagccacugugc

SEQ ID NO: 3088124 - RNA, 15 nt, Molluscum contagiosum virus
gauccacgcgugcug

SEQ ID NO: 3088125 - RNA, 18 nt, Molluscum contagiosum virus
ugcgcgggaugcuggacg

SEQ ID NO: 3088126 - RNA, 17 nt, Molluscum contagiosum virus
ugcagagcgugcugguc

SEQ ID NO: 3088127 - RNA, 21 nt, Molluscum contagiosum virus
gcucuguugcguuggcgccag

SEQ ID NO: 3088128 - RNA, 20 nt, Molluscum contagiosum virus
uccgcgacguccuagagcag

SEQ ID NO: 3088129 - RNA, 16 nt, Molluscum contagiosum virus
ggcacccuggcugcug

SEQ ID NO: 3088130 - RNA, 14 nt, Molluscum contagiosum virus
ccgcgugcucugcu

SEQ ID NO: 3088131 - RNA, 20 nt, Molluscum contagiosum virus
cgagcaguccgccucgagca

SEQ ID NO: 3088132 - RNA, 21 nt, Molluscum contagiosum virus
gcugucaacagugcgugccag

SEQ ID NO: 3088133 - RNA, 12 nt, Molluscum contagiosum virus
ccaucuccuugu

SEQ ID NO: 3088134 - RNA, 18 nt, Molluscum contagiosum virus
uuuugcacagugugccga

SEQ ID NO: 3088135 - RNA, 20 nt, Molluscum contagiosum virus
cuuacugcagcagcuccagc

SEQ ID NO: 3088136 - RNA, 13 nt, Molluscum contagiosum virus
ccgcugcuggaac

SEQ ID NO: 3088137 - RNA, 14 nt, Molluscum contagiosum virus
gucgcgcgccacaa

SEQ ID NO: 3088138 - RNA, 21 nt, Molluscum contagiosum virus
ccgccucgagcacgccuccaa

SEQ ID NO: 3088139 - RNA, 14 nt, Molluscum contagiosum virus
gcggcgggguccuc

SEQ ID NO: 3088140 - RNA, 15 nt, Molluscum contagiosum virus
gccacuguugcuucc

SEQ ID NO: 3088141 - RNA, 23 nt, Molluscum contagiosum virus
cgccaacuucgucucgagcuucc

SEQ ID NO: 3088142 - RNA, 22 nt, Molluscum contagiosum virus
ucgcgggcgcgcgcggagagga

SEQ ID NO: 3088143 - RNA, 16 nt, Molluscum contagiosum virus
gcguugugcggggcuc

SEQ ID NO: 3088144 - RNA, 17 nt, Molluscum contagiosum virus
acgccuuccugcuggcg

SEQ ID NO: 3088145 - RNA, 13 nt, Molluscum contagiosum virus
gcgcggugagccg

SEQ ID NO: 3088146 - RNA, 12 nt, Molluscum contagiosum virus
acaccuccugcu

SEQ ID NO: 3088147 - RNA, 22 nt, Molluscum contagiosum virus
cggagcgccuucugcaagcugc

SEQ ID NO: 3088148 - RNA, 15 nt, Molluscum contagiosum virus
caaugaggagaggaa

SEQ ID NO: 3088149 - RNA, 13 nt, Molluscum contagiosum virus
gcuggacggugcu

SEQ ID NO: 3088150 - RNA, 14 nt, Molluscum contagiosum virus
caguugagagcagc

SEQ ID NO: 3088151 - RNA, 14 nt, Molluscum contagiosum virus
cccgcaagccacac

SEQ ID NO: 3088152 - RNA, 22 nt, Molluscum contagiosum virus
cgucuuaacucagcgggcagac

SEQ ID NO: 3088153 - RNA, 19 nt, Molluscum contagiosum virus
gccgucgacgcugacggcc

SEQ ID NO: 3088154 - RNA, 13 nt, Molluscum contagiosum virus
gcugcgcgccgcg

SEQ ID NO: 3088155 - RNA, 15 nt, Molluscum contagiosum virus
cgcacgagcugcugc

SEQ ID NO: 3088156 - RNA, 16 nt, Molluscum contagiosum virus
gaggaaaggcacaccc

SEQ ID NO: 3088157 - RNA, 13 nt, Molluscum contagiosum virus
gauccgggcgcug

SEQ ID NO: 3088158 - RNA, 21 nt, Molluscum contagiosum virus
cggcagcuggagcugccgcug

SEQ ID NO: 3088159 - RNA, 14 nt, Molluscum contagiosum virus
aagucgaagagggu

SEQ ID NO: 3088160 - RNA, 20 nt, Molluscum contagiosum virus
gcagcuggcgggcgugccca

SEQ ID NO: 3088161 - RNA, 15 nt, Molluscum contagiosum virus
gacgcgaacugcccg

SEQ ID NO: 3088162 - RNA, 19 nt, Molluscum contagiosum virus
cccgcuggcggcgcacgcg

SEQ ID NO: 3088163 - RNA, 14 nt, Molluscum contagiosum virus
acugcagcagcccc

SEQ ID NO: 3088164 - RNA, 14 nt, Molluscum contagiosum virus
cugcaggcagaagc

SEQ ID NO: 3088165 - RNA, 18 nt, Molluscum contagiosum virus
guccccgcgcucacugca

SEQ ID NO: 3088166 - RNA, 14 nt, Molluscum contagiosum virus
gucuuccagcacug

SEQ ID NO: 3088167 - RNA, 14 nt, Molluscum contagiosum virus
gggcacaagcuuuc

SEQ ID NO: 3088168 - RNA, 17 nt, Molluscum contagiosum virus
guucguccgcucgugcc

SEQ ID NO: 3088169 - RNA, 14 nt, Molluscum contagiosum virus
uggcacgcgagcaa

SEQ ID NO: 3088170 - RNA, 22 nt, Molluscum contagiosum virus
ccgaauggugcgguacaugcug

SEQ ID NO: 3088171 - RNA, 18 nt, Molluscum contagiosum virus
gacgcuuucguccgccgc

SEQ ID NO: 3088172 - RNA, 20 nt, Molluscum contagiosum virus
gucggagcaggacgacgaca

SEQ ID NO: 3088173 - RNA, 13 nt, Molluscum contagiosum virus
gccgaugcagugc

SEQ ID NO: 3088174 - RNA, 14 nt, Molluscum contagiosum virus
ggcgcggcgagccg

SEQ ID NO: 3088175 - RNA, 17 nt, Molluscum contagiosum virus
cggagagccgccuuugc

SEQ ID NO: 3088176 - RNA, 20 nt, Molluscum contagiosum virus
gcgccacgugcgcaucccug

SEQ ID NO: 3088177 - RNA, 21 nt, Molluscum contagiosum virus
uggugcugcgcgacaugcugc

SEQ ID NO: 3088178 - RNA, 18 nt, Molluscum contagiosum virus
gccacuggaagaacaggc

SEQ ID NO: 3088179 - RNA, 19 nt, Molluscum contagiosum virus
gcgcuagccgccgcugccg

SEQ ID NO: 3088180 - RNA, 17 nt, Molluscum contagiosum virus
cacgccaagcgcuugcu

SEQ ID NO: 3088181 - RNA, 13 nt, Molluscum contagiosum virus
acgaggugcugcg

SEQ ID NO: 3088182 - RNA, 13 nt, Molluscum contagiosum virus
gcgcuugcucacg

SEQ ID NO: 3088183 - RNA, 23 nt, Molluscum contagiosum virus
cgguggucuccgcgggcagccgc

SEQ ID NO: 3088184 - RNA, 12 nt, Molluscum contagiosum virus
cagguugcucgc

SEQ ID NO: 3088185 - RNA, 20 nt, Molluscum contagiosum virus
cgccguuggccaccuggaaa

SEQ ID NO: 3088186 - RNA, 15 nt, Molluscum contagiosum virus
acggcgagcgccgcu

SEQ ID NO: 3088187 - RNA, 16 nt, Molluscum contagiosum virus
guuccagcuccggcuu

SEQ ID NO: 3088188 - RNA, 16 nt, Molluscum contagiosum virus
cauggaccgcgucaag

SEQ ID NO: 3088189 - RNA, 15 nt, Molluscum contagiosum virus
cugacggcagcaagc

SEQ ID NO: 3088190 - RNA, 21 nt, Molluscum contagiosum virus
cucccgcggccgccacuguug

SEQ ID NO: 3088191 - RNA, 17 nt, Molluscum contagiosum virus
gaccugggcgucgugca

SEQ ID NO: 3088192 - RNA, 22 nt, Molluscum contagiosum virus
gcggaccgucagccucugugcg

SEQ ID NO: 3088193 - RNA, 22 nt, Molluscum contagiosum virus
gcagcauuuuggugggcacgca

SEQ ID NO: 3088194 - RNA, 13 nt, Molluscum contagiosum virus
uuguccugagccu

SEQ ID NO: 3088195 - RNA, 16 nt, Molluscum contagiosum virus
uggucaagauccaagc

SEQ ID NO: 3088196 - RNA, 12 nt, Molluscum contagiosum virus
ugcguuuccagg

SEQ ID NO: 3088197 - RNA, 18 nt, Molluscum contagiosum virus
ggcgugcagggcgugcuu

SEQ ID NO: 3088198 - RNA, 13 nt, Molluscum contagiosum virus
ucggcguacgugc

SEQ ID NO: 3088199 - RNA, 18 nt, Molluscum contagiosum virus
cucugcgcagguagcggc

SEQ ID NO: 3088200 - RNA, 15 nt, Molluscum contagiosum virus
gcacaagggcagcuc

SEQ ID NO: 3088201 - RNA, 14 nt, Molluscum contagiosum virus
cagcggcaggcggc

SEQ ID NO: 3088202 - RNA, 21 nt, Molluscum contagiosum virus
ccagcggauaugcgccugugc

SEQ ID NO: 3088203 - RNA, 12 nt, Molluscum contagiosum virus
cgcugagcgcag

SEQ ID NO: 3088204 - RNA, 20 nt, Molluscum contagiosum virus
cgcccaccagcagccaggcu

SEQ ID NO: 3088205 - RNA, 13 nt, Molluscum contagiosum virus
gucaccgcuccgc

SEQ ID NO: 3088206 - RNA, 17 nt, Molluscum contagiosum virus
cguugcagcagcacagg

SEQ ID NO: 3088207 - RNA, 13 nt, Molluscum contagiosum virus
gucugcaagcgug

SEQ ID NO: 3088208 - RNA, 18 nt, Molluscum contagiosum virus
ggagacgucguggauggc

SEQ ID NO: 3088209 - RNA, 22 nt, Molluscum contagiosum virus
ugccuggagggcagugccaagg

SEQ ID NO: 3088210 - RNA, 15 nt, Molluscum contagiosum virus
agaggacagcuccuu

SEQ ID NO: 3088211 - RNA, 21 nt, Molluscum contagiosum virus
cgcggccaugcuccugaucug

SEQ ID NO: 3088212 - RNA, 12 nt, Molluscum contagiosum virus
agacuuccuugc

SEQ ID NO: 3088213 - RNA, 17 nt, Molluscum contagiosum virus
guguucggggccgcgag

SEQ ID NO: 3088214 - RNA, 14 nt, Molluscum contagiosum virus
ggcagcaacugcac

SEQ ID NO: 3088215 - RNA, 16 nt, Molluscum contagiosum virus
ggagcuuuccuugcgc

SEQ ID NO: 3088216 - RNA, 17 nt, Molluscum contagiosum virus
cggaagacaaggcugcg

SEQ ID NO: 3088217 - RNA, 17 nt, Molluscum contagiosum virus
guuuucacgcaaggaag

SEQ ID NO: 3088218 - RNA, 18 nt, Molluscum contagiosum virus
uggaggcaaucuguccag

SEQ ID NO: 3088219 - RNA, 16 nt, Molluscum contagiosum virus
gcccgagggcgggcac

SEQ ID NO: 3088220 - RNA, 21 nt, Molluscum contagiosum virus
gugcuggacacucgcggcaag

SEQ ID NO: 3088221 - RNA, 18 nt, Molluscum contagiosum virus
cgagaccacgcgcgcugc

SEQ ID NO: 3088222 - RNA, 14 nt, Molluscum contagiosum virus
cuaccgcgcgcgca

SEQ ID NO: 3088223 - RNA, 20 nt, Molluscum contagiosum virus
gcugucccaagacucugccg

SEQ ID NO: 3088224 - RNA, 21 nt, Molluscum contagiosum virus
uccgcgacuaccugcugcuga

SEQ ID NO: 3088225 - RNA, 14 nt, Molluscum contagiosum virus
uccuggcaauccug

SEQ ID NO: 3088226 - RNA, 22 nt, Molluscum contagiosum virus
gugaccauggacacgcugcgcg

SEQ ID NO: 3088227 - RNA, 23 nt, Molluscum contagiosum virus
caugaacucgcugcugcucuucc

SEQ ID NO: 3088228 - RNA, 20 nt, Molluscum contagiosum virus
cugguuugcgcucucagagc

SEQ ID NO: 3088229 - RNA, 13 nt, Molluscum contagiosum virus
uccgcaacguggc

SEQ ID NO: 3088230 - RNA, 17 nt, Molluscum contagiosum virus
cuuccggaggcagcgcu

SEQ ID NO: 3088231 - RNA, 17 nt, Molluscum contagiosum virus
ugccgacgugugccgcu

SEQ ID NO: 3088232 - RNA, 16 nt, Molluscum contagiosum virus
agcgccagccugcugg

SEQ ID NO: 3088233 - RNA, 21 nt, Molluscum contagiosum virus
cgauuaucguggacgagcaga

SEQ ID NO: 3088234 - RNA, 14 nt, Molluscum contagiosum virus
aucaugagccaguc

SEQ ID NO: 3088235 - RNA, 18 nt, Molluscum contagiosum virus
cgauacaaaacaugcugu

SEQ ID NO: 3088236 - RNA, 16 nt, Molluscum contagiosum virus
gcagcaagcagccgca

SEQ ID NO: 3088237 - RNA, 14 nt, Molluscum contagiosum virus
cgcggcgcgccgcc

SEQ ID NO: 3088238 - RNA, 16 nt, Molluscum contagiosum virus
ucgcgagcguuucugc

SEQ ID NO: 3088239 - RNA, 20 nt, Molluscum contagiosum virus
agcagcgugcauagugggcu

SEQ ID NO: 3088240 - RNA, 20 nt, Molluscum contagiosum virus
agguacccgcaaccccgcgc

SEQ ID NO: 3088241 - RNA, 16 nt, Molluscum contagiosum virus
acuuuuccugcgucgc

SEQ ID NO: 3088242 - RNA, 20 nt, Molluscum contagiosum virus
ggcguccgcacgaggagccc

SEQ ID NO: 3088243 - RNA, 15 nt, Molluscum contagiosum virus
gaccgcgcacgcagc

SEQ ID NO: 3088244 - RNA, 16 nt, Molluscum contagiosum virus
aguaccggccaaggca

SEQ ID NO: 3088245 - RNA, 21 nt, Molluscum contagiosum virus
cgccaauaucacgccgguggc

SEQ ID NO: 3088246 - RNA, 15 nt, Molluscum contagiosum virus
acacccgugcccgcu

SEQ ID NO: 3088247 - RNA, 21 nt, Molluscum contagiosum virus
auucucggacagugccuccgc

SEQ ID NO: 3088248 - RNA, 20 nt, Molluscum contagiosum virus
acagcaugaacucgcugcug

SEQ ID NO: 3088249 - RNA, 23 nt, Molluscum contagiosum virus
gugcucuuggcguucgcagugcc

SEQ ID NO: 3088250 - RNA, 14 nt, Molluscum contagiosum virus
guggcggcucugcc

SEQ ID NO: 3088251 - RNA, 14 nt, Molluscum contagiosum virus
guccggcgcucgcc

SEQ ID NO: 3088252 - RNA, 19 nt, Molluscum contagiosum virus
acagcaggagcacgccugg

SEQ ID NO: 3088253 - RNA, 14 nt, Molluscum contagiosum virus
cagugccgcucgcu

SEQ ID NO: 3088254 - RNA, 18 nt, Molluscum contagiosum virus
ggcgaacaccccgagcug

SEQ ID NO: 3088255 - RNA, 12 nt, Molluscum contagiosum virus
auguuguuugaa

SEQ ID NO: 3088256 - RNA, 19 nt, Molluscum contagiosum virus
ccgcggcacaugcagcugc

SEQ ID NO: 3088257 - RNA, 15 nt, Molluscum contagiosum virus
cgucccagcagcugc

SEQ ID NO: 3088258 - RNA, 15 nt, Molluscum contagiosum virus
ucaaccugcugccuc

SEQ ID NO: 3088259 - RNA, 17 nt, Molluscum contagiosum virus
caagugcacgcggcgcg

SEQ ID NO: 3088260 - RNA, 21 nt, Molluscum contagiosum virus
ccuccguguccgacgccgcca

SEQ ID NO: 3088261 - RNA, 21 nt, Molluscum contagiosum virus
gcgcagcuucucugcgaucgc

SEQ ID NO: 3088262 - RNA, 15 nt, Molluscum contagiosum virus
ggcaugcgcgcagug

SEQ ID NO: 3088263 - RNA, 19 nt, Molluscum contagiosum virus
caaggagaugggcacggca

SEQ ID NO: 3088264 - RNA, 13 nt, Molluscum contagiosum virus
gcgacagcugcug

SEQ ID NO: 3088265 - RNA, 22 nt, Molluscum contagiosum virus
guguggcuugcgggacagagcu

SEQ ID NO: 3088266 - RNA, 13 nt, Molluscum contagiosum virus
cgccucgcauucu

SEQ ID NO: 3088267 - RNA, 14 nt, Molluscum contagiosum virus
uggagcgcgcggac

SEQ ID NO: 3088268 - RNA, 15 nt, Molluscum contagiosum virus
ccacgagcagugccg

SEQ ID NO: 3088269 - RNA, 16 nt, Molluscum contagiosum virus
ugccugcugcgcuucu

SEQ ID NO: 3088270 - RNA, 15 nt, Molluscum contagiosum virus
gcaugcgcgcgcagc

SEQ ID NO: 3088271 - RNA, 12 nt, Molluscum contagiosum virus
cuggcaccugcg

SEQ ID NO: 3088272 - RNA, 15 nt, Molluscum contagiosum virus
gggccgcgguggccg

SEQ ID NO: 3088273 - RNA, 17 nt, Molluscum contagiosum virus
gacagccugcaccgagu

SEQ ID NO: 3088274 - RNA, 20 nt, Molluscum contagiosum virus
ucaacgugggcaccugcauc

SEQ ID NO: 3088275 - RNA, 22 nt, Molluscum contagiosum virus
ggggcugucgcuggaggauucu

SEQ ID NO: 3088276 - RNA, 19 nt, Molluscum contagiosum virus
agucguacacgcagagcca

SEQ ID NO: 3088277 - RNA, 13 nt, Molluscum contagiosum virus
aguaccagcucgc

SEQ ID NO: 3088278 - RNA, 14 nt, Molluscum contagiosum virus
gccgcaagcacacg

SEQ ID NO: 3088279 - RNA, 13 nt, Molluscum contagiosum virus
caacgugcugcuc

SEQ ID NO: 3088280 - RNA, 18 nt, Molluscum contagiosum virus
agcgcgcccaccagcagc

SEQ ID NO: 3088281 - RNA, 17 nt, Molluscum contagiosum virus
uuccacgucuccaacaa

SEQ ID NO: 3088282 - RNA, 18 nt, Molluscum contagiosum virus
aggcgcugucgcgcaggc

SEQ ID NO: 3088283 - RNA, 16 nt, Molluscum contagiosum virus
caaguucgcugcuggc

SEQ ID NO: 3088284 - RNA, 12 nt, Molluscum contagiosum virus
cgcgggccaggc

SEQ ID NO: 3088285 - RNA, 16 nt, Molluscum contagiosum virus
aaggcauaccugugcc

SEQ ID NO: 3088286 - RNA, 23 nt, Molluscum contagiosum virus
cagcaaacugugcuccugaggaa

SEQ ID NO: 3088287 - RNA, 23 nt, Molluscum contagiosum virus
cucugcacgggcacgccgugggc

SEQ ID NO: 3088288 - RNA, 13 nt, Molluscum contagiosum virus
cggcgggugccgc

SEQ ID NO: 3088289 - RNA, 19 nt, Molluscum contagiosum virus
uggccgcgauucugcucuu

SEQ ID NO: 3088290 - RNA, 14 nt, Molluscum contagiosum virus
ggcgcagcaggaug

SEQ ID NO: 3088291 - RNA, 19 nt, Molluscum contagiosum virus
cgcugcgccgcuuccuggc

SEQ ID NO: 3088292 - RNA, 22 nt, Molluscum contagiosum virus
gcccgcggcacaugcagcugca

SEQ ID NO: 3088293 - RNA, 17 nt, Molluscum contagiosum virus
cgcuucgggcucagcaa

SEQ ID NO: 3088294 - RNA, 15 nt, Molluscum contagiosum virus
gcgcgcacggcagcg

SEQ ID NO: 3088295 - RNA, 23 nt, Molluscum contagiosum virus
uccacgcaggacuggcaccugcg

SEQ ID NO: 3088296 - RNA, 18 nt, Molluscum contagiosum virus
cacgcuggucacgcgcuu

SEQ ID NO: 3088297 - RNA, 16 nt, Molluscum contagiosum virus
cguugccgcgcgcugc

SEQ ID NO: 3088298 - RNA, 13 nt, Molluscum contagiosum virus
ccgaggaggugcu

SEQ ID NO: 3088299 - RNA, 21 nt, Molluscum contagiosum virus
caugccaacgcaccggcaggg

SEQ ID NO: 3088300 - RNA, 19 nt, Molluscum contagiosum virus
ugcaacaggagcauuccuu

SEQ ID NO: 3088301 - RNA, 19 nt, Molluscum contagiosum virus
uucccggcugccgcugccu

SEQ ID NO: 3088302 - RNA, 15 nt, Molluscum contagiosum virus
cgccagccuggcggc

SEQ ID NO: 3088303 - RNA, 21 nt, Molluscum contagiosum virus
caugcgcgccgcgcugcuggc

SEQ ID NO: 3088304 - RNA, 14 nt, Molluscum contagiosum virus
gugcgugcccagca

SEQ ID NO: 3088305 - RNA, 18 nt, Molluscum contagiosum virus
gagccgggggaacacgcu

SEQ ID NO: 3088306 - RNA, 17 nt, Molluscum contagiosum virus
gagacuaccggcaguag

SEQ ID NO: 3088307 - RNA, 20 nt, Molluscum contagiosum virus
ggaaaggcacccaccaggaa

SEQ ID NO: 3088308 - RNA, 12 nt, Molluscum contagiosum virus
gcgaacugcccg

SEQ ID NO: 3088309 - RNA, 14 nt, Molluscum contagiosum virus
ccugcucgggcugc

SEQ ID NO: 3088310 - RNA, 15 nt, Molluscum contagiosum virus
cuacaaaacugaaaa

SEQ ID NO: 3088311 - RNA, 20 nt, Molluscum contagiosum virus
uacuucaucuucaagccgca

SEQ ID NO: 3088312 - RNA, 19 nt, Molluscum contagiosum virus
ggcggcgcacgcggcucug

SEQ ID NO: 3088313 - RNA, 13 nt, Molluscum contagiosum virus
gcgcggacagccu

SEQ ID NO: 3088314 - RNA, 23 nt, Molluscum contagiosum virus
accgccgcggccgcgagacgcag

SEQ ID NO: 3088315 - RNA, 18 nt, Molluscum contagiosum virus
cgugcugcgcgcccaggc

SEQ ID NO: 3088316 - RNA, 13 nt, Molluscum contagiosum virus
cugcacgagcugc

SEQ ID NO: 3088317 - RNA, 16 nt, Molluscum contagiosum virus
guccggcccgaagccg

SEQ ID NO: 3088318 - RNA, 21 nt, Molluscum contagiosum virus
ugcgggagccaugaaagaaaa

SEQ ID NO: 3088319 - RNA, 15 nt, Molluscum contagiosum virus
agcacagcaggagca

SEQ ID NO: 3088320 - RNA, 21 nt, Molluscum contagiosum virus
gcgggacgcgugccuggcuug

SEQ ID NO: 3088321 - RNA, 16 nt, Molluscum contagiosum virus
gacaucuacagccgcc

SEQ ID NO: 3088322 - RNA, 17 nt, Molluscum contagiosum virus
cuggacuuccugcugcg

SEQ ID NO: 3088323 - RNA, 16 nt, Molluscum contagiosum virus
cgaguacgcucuccau

SEQ ID NO: 3088324 - RNA, 17 nt, Molluscum contagiosum virus
cguggcgccgcugcugg

SEQ ID NO: 3088325 - RNA, 22 nt, Molluscum contagiosum virus
ucaccgggauggucucgcugcu

SEQ ID NO: 3088326 - RNA, 21 nt, Molluscum contagiosum virus
ggcguguuccggcagcgccgc

SEQ ID NO: 3088327 - RNA, 15 nt, Molluscum contagiosum virus
ggcacccuggcugcu

SEQ ID NO: 3088328 - RNA, 15 nt, Molluscum contagiosum virus
ggcucguacugcugc

SEQ ID NO: 3088329 - RNA, 20 nt, Molluscum contagiosum virus
gacuguguucccggcugccg

SEQ ID NO: 3088330 - RNA, 21 nt, Molluscum contagiosum virus
cucguacugcugcaggcaaag

SEQ ID NO: 3088331 - RNA, 17 nt, Molluscum contagiosum virus
cagcgcgcucgaggcgc

SEQ ID NO: 3088332 - RNA, 16 nt, Molluscum contagiosum virus
cagugccgcucgcugu

SEQ ID NO: 3088333 - RNA, 14 nt, Molluscum contagiosum virus
gcacguuccaaaag

SEQ ID NO: 3088334 - RNA, 22 nt, Molluscum contagiosum virus
cuaggacuagcauuccuucaca

SEQ ID NO: 3088335 - RNA, 17 nt, Molluscum contagiosum virus
gucgccgcgggcuggga

SEQ ID NO: 3088336 - RNA, 14 nt, Molluscum contagiosum virus
cucgcguccgcauc

SEQ ID NO: 3088337 - RNA, 21 nt, Molluscum contagiosum virus
gcucaccgcgcagaagccaac

SEQ ID NO: 3088338 - RNA, 18 nt, Molluscum contagiosum virus
ggaguccucgacaaugag

SEQ ID NO: 3088339 - RNA, 16 nt, Molluscum contagiosum virus
gcuccuagcgcgcgug

SEQ ID NO: 3088340 - RNA, 16 nt, Molluscum contagiosum virus
gggccgcgagcgcggg

SEQ ID NO: 3088341 - RNA, 15 nt, Molluscum contagiosum virus
cgcugcucuggagca

SEQ ID NO: 3088342 - RNA, 22 nt, Molluscum contagiosum virus
ccugucaucaccccgcugggcc

SEQ ID NO: 3088343 - RNA, 16 nt, Molluscum contagiosum virus
uccaggugcugggcga

SEQ ID NO: 3088344 - RNA, 14 nt, Molluscum contagiosum virus
gcgcaucagagaag

SEQ ID NO: 3088345 - RNA, 15 nt, Molluscum contagiosum virus
uccgcguacagcgcg

SEQ ID NO: 3088346 - RNA, 15 nt, Molluscum contagiosum virus
ucuucauggacgucg

SEQ ID NO: 3088347 - RNA, 17 nt, Molluscum contagiosum virus
ugcgcgcccaggcgcgc

SEQ ID NO: 3088348 - RNA, 12 nt, Molluscum contagiosum virus
ucgcgcgccgcg

SEQ ID NO: 3088349 - RNA, 13 nt, Molluscum contagiosum virus
gugcucagcacgc

SEQ ID NO: 3088350 - RNA, 13 nt, Molluscum contagiosum virus
cucugcccucaga

SEQ ID NO: 3088351 - RNA, 16 nt, Molluscum contagiosum virus
agugacagacuaggca

SEQ ID NO: 3088352 - RNA, 16 nt, Molluscum contagiosum virus
uccgaccgugcccugg

SEQ ID NO: 3088353 - RNA, 14 nt, Molluscum contagiosum virus
cguggccagcuuca

SEQ ID NO: 3088354 - RNA, 19 nt, Molluscum contagiosum virus
auccucgccgaacggcaga

SEQ ID NO: 3088355 - RNA, 13 nt, Molluscum contagiosum virus
aaugcgcaaggcc

SEQ ID NO: 3088356 - RNA, 18 nt, Molluscum contagiosum virus
gcgggcacggcuaccacg

SEQ ID NO: 3088357 - RNA, 17 nt, Molluscum contagiosum virus
cgagcgcgcgugcucgc

SEQ ID NO: 3088358 - RNA, 18 nt, Molluscum contagiosum virus
gagaaagaagugugccug

SEQ ID NO: 3088359 - RNA, 14 nt, Molluscum contagiosum virus
aucucugcccucag

SEQ ID NO: 3088360 - RNA, 15 nt, Molluscum contagiosum virus
gaucggacucagcau

SEQ ID NO: 3088361 - RNA, 20 nt, Molluscum contagiosum virus
gccugccgcgcaugcuggag

SEQ ID NO: 3088362 - RNA, 13 nt, Molluscum contagiosum virus
cacgccgcccgag

SEQ ID NO: 3088363 - RNA, 16 nt, Molluscum contagiosum virus
cggcguggugcuggcc

SEQ ID NO: 3088364 - RNA, 17 nt, Molluscum contagiosum virus
gcaguguuucgacgccg

SEQ ID NO: 3088365 - RNA, 17 nt, Molluscum contagiosum virus
ucgauggacgccagcuu

SEQ ID NO: 3088366 - RNA, 23 nt, Molluscum contagiosum virus
acaugugcgugcaccucaagaag

SEQ ID NO: 3088367 - RNA, 17 nt, Molluscum contagiosum virus
ccgcgguggccgcgccg

SEQ ID NO: 3088368 - RNA, 19 nt, Molluscum contagiosum virus
ugaggggcaguguuccugg

SEQ ID NO: 3088369 - RNA, 16 nt, Molluscum contagiosum virus
ucacggcgcucgccuc

SEQ ID NO: 3088370 - RNA, 21 nt, Molluscum contagiosum virus
gccaccgcgcgguccgccagu

SEQ ID NO: 3088371 - RNA, 13 nt, Molluscum contagiosum virus
cccgcgggccgcc

SEQ ID NO: 3088372 - RNA, 18 nt, Molluscum contagiosum virus
ucgguagccaggcgccgg

SEQ ID NO: 3088373 - RNA, 15 nt, Molluscum contagiosum virus
cagugcgugccaggc

SEQ ID NO: 3088374 - RNA, 19 nt, Molluscum contagiosum virus
ccagcuaagccggagcagc

SEQ ID NO: 3088375 - RNA, 18 nt, Molluscum contagiosum virus
acgugcagcggcgccacg

SEQ ID NO: 3088376 - RNA, 18 nt, Molluscum contagiosum virus
caguccgcggcgcgccgg

SEQ ID NO: 3088377 - RNA, 14 nt, Molluscum contagiosum virus
caguguugugaagu

SEQ ID NO: 3088378 - RNA, 12 nt, Molluscum contagiosum virus
cgacaaggaaag

SEQ ID NO: 3088379 - RNA, 16 nt, Molluscum contagiosum virus
ucugucccgcaagcca

SEQ ID NO: 3088380 - RNA, 20 nt, Molluscum contagiosum virus
ccagugcuuugucgcaaccc

SEQ ID NO: 3088381 - RNA, 21 nt, Molluscum contagiosum virus
gucucccaggaagacgugcug

SEQ ID NO: 3088382 - RNA, 22 nt, Molluscum contagiosum virus
cugcacgcgcacuugccuggcg

SEQ ID NO: 3088383 - RNA, 20 nt, Molluscum contagiosum virus
cgauggcguggcggauguca

SEQ ID NO: 3088384 - RNA, 24 nt, Molluscum contagiosum virus
ucgcguaccaagccgugacgcugc

SEQ ID NO: 3088385 - RNA, 17 nt, Molluscum contagiosum virus
uacggacggcgcacgca

SEQ ID NO: 3088386 - RNA, 23 nt, Molluscum contagiosum virus
gugcgccucggacuucgacgcgc

SEQ ID NO: 3088387 - RNA, 15 nt, Molluscum contagiosum virus
cgggcgcggcaccag

SEQ ID NO: 3088388 - RNA, 14 nt, Molluscum contagiosum virus
cggccguggcgugc

SEQ ID NO: 3088389 - RNA, 18 nt, Molluscum contagiosum virus
accacgagcguguccagg

SEQ ID NO: 3088390 - RNA, 14 nt, Molluscum contagiosum virus
cagcccccucuugg

SEQ ID NO: 3088391 - RNA, 16 nt, Molluscum contagiosum virus
cggugcgugcccagca

SEQ ID NO: 3088392 - RNA, 20 nt, Molluscum contagiosum virus
ugacaggcgcgcaagugcgu

SEQ ID NO: 3088393 - RNA, 22 nt, Molluscum contagiosum virus
gucacugcuagugcuggccgcc

SEQ ID NO: 3088394 - RNA, 18 nt, Molluscum contagiosum virus
cccgcggccgccacuguu

SEQ ID NO: 3088395 - RNA, 21 nt, Molluscum contagiosum virus
cgcugcgcgcucuggagccuc

SEQ ID NO: 3088396 - RNA, 19 nt, Molluscum contagiosum virus
guccgacuccaaggagguc

SEQ ID NO: 3088397 - RNA, 19 nt, Molluscum contagiosum virus
cguaaagagcguccagccg

SEQ ID NO: 3088398 - RNA, 19 nt, Molluscum contagiosum virus
cgcucgugccgccugcgcg

SEQ ID NO: 3088399 - RNA, 17 nt, Molluscum contagiosum virus
gagcugcugcccgccuu

SEQ ID NO: 3088400 - RNA, 17 nt, Molluscum contagiosum virus
gcgucgcgcgccgugcc

SEQ ID NO: 3088401 - RNA, 16 nt, Molluscum contagiosum virus
gccgcugccugugccc

SEQ ID NO: 3088402 - RNA, 18 nt, Molluscum contagiosum virus
ccgcggacgcgggccugu

SEQ ID NO: 3088403 - RNA, 16 nt, Molluscum contagiosum virus
cgagcgcgugucuacc

SEQ ID NO: 3088404 - RNA, 23 nt, Molluscum contagiosum virus
acaaugaggagaggaaccaggau

SEQ ID NO: 3088405 - RNA, 17 nt, Molluscum contagiosum virus
gcgauggcgccugcuuc

SEQ ID NO: 3088406 - RNA, 13 nt, Molluscum contagiosum virus
aaagucaucugcc

SEQ ID NO: 3088407 - RNA, 18 nt, Molluscum contagiosum virus
gcaaagacggacccgcga

SEQ ID NO: 3088408 - RNA, 15 nt, Molluscum contagiosum virus
acgcgcagugcggcc

SEQ ID NO: 3088409 - RNA, 23 nt, Molluscum contagiosum virus
cuggucaagaaggcgcuggugga

SEQ ID NO: 3088410 - RNA, 15 nt, Molluscum contagiosum virus
cgcgcgcagcacacc

SEQ ID NO: 3088411 - RNA, 16 nt, Molluscum contagiosum virus
gccgcacgcugcugcg

SEQ ID NO: 3088412 - RNA, 20 nt, Molluscum contagiosum virus
ccgaggcguccagcggcugc

SEQ ID NO: 3088413 - RNA, 16 nt, Molluscum contagiosum virus
agacuggagcacggac

SEQ ID NO: 3088414 - RNA, 16 nt, Molluscum contagiosum virus
gcaucgcgcugcuggu

SEQ ID NO: 3088415 - RNA, 16 nt, Molluscum contagiosum virus
gcugguggugcuggag

SEQ ID NO: 3088416 - RNA, 20 nt, Molluscum contagiosum virus
gcugagcuagugccgagcuc

SEQ ID NO: 3088417 - RNA, 20 nt, Molluscum contagiosum virus
gacaccgcgacccagaagcg

SEQ ID NO: 3088418 - RNA, 21 nt, Molluscum contagiosum virus
cacucuuucacgcugcacgag

SEQ ID NO: 3088419 - RNA, 22 nt, Molluscum contagiosum virus
gaacgacaccgcgacccagaag

SEQ ID NO: 3088420 - RNA, 15 nt, Molluscum contagiosum virus
gcugguggugcugga

SEQ ID NO: 3088421 - RNA, 14 nt, Molluscum contagiosum virus
ccacugugccagca

SEQ ID NO: 3088422 - RNA, 21 nt, Molluscum contagiosum virus
cgagagcggagaaaaggaagc

SEQ ID NO: 3088423 - RNA, 22 nt, Molluscum contagiosum virus
uccuucgaagaggucucucaaa

SEQ ID NO: 3088424 - RNA, 13 nt, Molluscum contagiosum virus
gaaacuggacuga

SEQ ID NO: 3088425 - RNA, 12 nt, Molluscum contagiosum virus
accucaccgcgc

SEQ ID NO: 3088426 - RNA, 21 nt, Molluscum contagiosum virus
aggaaaggcacccaccaggaa

SEQ ID NO: 3088427 - RNA, 12 nt, Molluscum contagiosum virus
gacgaggagcug

SEQ ID NO: 3088428 - RNA, 13 nt, Molluscum contagiosum virus
ggcgcgcccagcg

SEQ ID NO: 3088429 - RNA, 15 nt, Molluscum contagiosum virus
ugcaguugagagcag

SEQ ID NO: 3088430 - RNA, 17 nt, Molluscum contagiosum virus
aucaccccgcugggccg

SEQ ID NO: 3088431 - RNA, 22 nt, Molluscum contagiosum virus
caacauccugccacaccagcug

SEQ ID NO: 3088432 - RNA, 18 nt, Molluscum contagiosum virus
cagacccgaaagcugccc

SEQ ID NO: 3088433 - RNA, 17 nt, Molluscum contagiosum virus
cuuggcguucgcagugc

SEQ ID NO: 3088434 - RNA, 14 nt, Molluscum contagiosum virus
ggucgugcgagacu

SEQ ID NO: 3088435 - RNA, 23 nt, Molluscum contagiosum virus
ccuggaacgcgagacgggcacgc

SEQ ID NO: 3088436 - RNA, 17 nt, Molluscum contagiosum virus
gccguccgccucgagca

SEQ ID NO: 3088437 - RNA, 13 nt, Molluscum contagiosum virus
acgagcugcugua

SEQ ID NO: 3088438 - RNA, 22 nt, Molluscum contagiosum virus
cggcguggccaggccgcgccgg

SEQ ID NO: 3088439 - RNA, 16 nt, Molluscum contagiosum virus
gcgucgcgcaggcgcc

SEQ ID NO: 3088440 - RNA, 13 nt, Molluscum contagiosum virus
cucgcugcugcuc

SEQ ID NO: 3088441 - RNA, 23 nt, Molluscum contagiosum virus
caggccgggcgcgguagcucgug

SEQ ID NO: 3088442 - RNA, 18 nt, Molluscum contagiosum virus
gcguguugaacucgagca

SEQ ID NO: 3088443 - RNA, 19 nt, Molluscum contagiosum virus
cgccggcauccggccgagg

SEQ ID NO: 3088444 - RNA, 21 nt, Molluscum contagiosum virus
ucaaggacaucuacagccgcc

SEQ ID NO: 3088445 - RNA, 17 nt, Molluscum contagiosum virus
guacuucuacgagcagc

SEQ ID NO: 3088446 - RNA, 15 nt, Molluscum contagiosum virus
cuccagaaucgcuuu

SEQ ID NO: 3088447 - RNA, 13 nt, Molluscum contagiosum virus
cgcgcgccagcua

SEQ ID NO: 3088448 - RNA, 21 nt, Molluscum contagiosum virus
gcaccccgaaggaaaggcccc

SEQ ID NO: 3088449 - RNA, 21 nt, Molluscum contagiosum virus
uggacuuuggcgugaccaugg

SEQ ID NO: 3088450 - RNA, 13 nt, Molluscum contagiosum virus
gcacgugcugcug

SEQ ID NO: 3088451 - RNA, 17 nt, Molluscum contagiosum virus
cuuucguggucaucaag

SEQ ID NO: 3088452 - RNA, 13 nt, Molluscum contagiosum virus
cguuggcuuucug

SEQ ID NO: 3088453 - RNA, 12 nt, Molluscum contagiosum virus
gaaguugccgca

SEQ ID NO: 3088454 - RNA, 21 nt, Molluscum contagiosum virus
aacucgcgugccuuguucuga

SEQ ID NO: 3088455 - RNA, 21 nt, Molluscum contagiosum virus
gcucuaccuggugcuggggcu

SEQ ID NO: 3088456 - RNA, 20 nt, Molluscum contagiosum virus
aacacgcuguugcugcugcc

SEQ ID NO: 3088457 - RNA, 17 nt, Molluscum contagiosum virus
gcgcaccgcgggcugga

SEQ ID NO: 3088458 - RNA, 21 nt, Molluscum contagiosum virus
ccgagcgugggcgagcgcacg

SEQ ID NO: 3088459 - RNA, 16 nt, Molluscum contagiosum virus
ugcgagccagccaggc

SEQ ID NO: 3088460 - RNA, 21 nt, Molluscum contagiosum virus
aauaccggagacaccagcucc

SEQ ID NO: 3088461 - RNA, 21 nt, Molluscum contagiosum virus
uggcgccugcgcgcggcagug

SEQ ID NO: 3088462 - RNA, 14 nt, Molluscum contagiosum virus
cgaccugcacgacc

SEQ ID NO: 3088463 - RNA, 14 nt, Molluscum contagiosum virus
cugcggugucaacu

SEQ ID NO: 3088464 - RNA, 18 nt, Molluscum contagiosum virus
aacgcggugagugcgcgc

SEQ ID NO: 3088465 - RNA, 14 nt, Molluscum contagiosum virus
cgcgcgccgcgggc

SEQ ID NO: 3088466 - RNA, 22 nt, Molluscum contagiosum virus
ccaugaacaacauggugcuggc

SEQ ID NO: 3088467 - RNA, 22 nt, Molluscum contagiosum virus
gcugcgcgcggggagcucugcg

SEQ ID NO: 3088468 - RNA, 18 nt, Molluscum contagiosum virus
cugcuggcagacacagac

SEQ ID NO: 3088469 - RNA, 12 nt, Molluscum contagiosum virus
ccgugcaccucc

SEQ ID NO: 3088470 - RNA, 14 nt, Molluscum contagiosum virus
gccggcggcgcaag

SEQ ID NO: 3088471 - RNA, 17 nt, Molluscum contagiosum virus
caacgcugccgcuggcg

SEQ ID NO: 3088472 - RNA, 18 nt, Molluscum contagiosum virus
agccagcucgcagccucc

SEQ ID NO: 3088473 - RNA, 14 nt, Molluscum contagiosum virus
cgcgcugccagcgg

SEQ ID NO: 3088474 - RNA, 13 nt, Molluscum contagiosum virus
cagugcggccagc

SEQ ID NO: 3088475 - RNA, 18 nt, Molluscum contagiosum virus
gcacgcuguccaggcgcu

SEQ ID NO: 3088476 - RNA, 22 nt, Molluscum contagiosum virus
gcccgagcaggacgugcacgug

SEQ ID NO: 3088477 - RNA, 17 nt, Molluscum contagiosum virus
aaaacacaaaaauaagu

SEQ ID NO: 3088478 - RNA, 14 nt, Molluscum contagiosum virus
gguaccugcaggcu

SEQ ID NO: 3088479 - RNA, 21 nt, Molluscum contagiosum virus
gagauggaggcccaggccaug

SEQ ID NO: 3088480 - RNA, 16 nt, Molluscum contagiosum virus
gugcuggcggggcugg

SEQ ID NO: 3088481 - RNA, 22 nt, Molluscum contagiosum virus
cucgaggucgugcaggccgugc

SEQ ID NO: 3088482 - RNA, 19 nt, Molluscum contagiosum virus
gaucguuccuggccaagga

SEQ ID NO: 3088483 - RNA, 23 nt, Molluscum contagiosum virus
cgaagagcacgaugcccagcagc

SEQ ID NO: 3088484 - RNA, 19 nt, Molluscum contagiosum virus
gaaaggcacccaccaggaa

SEQ ID NO: 3088485 - RNA, 22 nt, Molluscum contagiosum virus
uguacgggcgugcgcagcagcu

SEQ ID NO: 3088486 - RNA, 21 nt, Molluscum contagiosum virus
ccugcaggaaaggcacccgca

SEQ ID NO: 3088487 - RNA, 14 nt, Molluscum contagiosum virus
acgcgcugcuagag

SEQ ID NO: 3088488 - RNA, 22 nt, Molluscum contagiosum virus
cguggcuaugagcggcacggga

SEQ ID NO: 3088489 - RNA, 20 nt, Molluscum contagiosum virus
ccgccugccgcgagcacugg

SEQ ID NO: 3088490 - RNA, 16 nt, Molluscum contagiosum virus
cgcgcgccagcagcgc

SEQ ID NO: 3088491 - RNA, 14 nt, Molluscum contagiosum virus
gagcccgccgggca

SEQ ID NO: 3088492 - RNA, 20 nt, Molluscum contagiosum virus
ccagcucggguuccagcucc

SEQ ID NO: 3088493 - RNA, 15 nt, Molluscum contagiosum virus
accgaucccggccgc

SEQ ID NO: 3088494 - RNA, 17 nt, Molluscum contagiosum virus
gccuccgagcgcgcgug

SEQ ID NO: 3088495 - RNA, 22 nt, Molluscum contagiosum virus
gucaccaccgcuucgugucugu

SEQ ID NO: 3088496 - RNA, 16 nt, Molluscum contagiosum virus
acgcccucgccugcga

SEQ ID NO: 3088497 - RNA, 13 nt, Molluscum contagiosum virus
ugucgagacaggc

SEQ ID NO: 3088498 - RNA, 15 nt, Molluscum contagiosum virus
gcgcccgacgagcuu

SEQ ID NO: 3088499 - RNA, 22 nt, Molluscum contagiosum virus
aacgcaaggugugcgcgcugca

SEQ ID NO: 3088500 - RNA, 15 nt, Molluscum contagiosum virus
gccccgggcccgcau

SEQ ID NO: 3088501 - RNA, 16 nt, Molluscum contagiosum virus
ugaccgcuucgagugc

SEQ ID NO: 3088502 - RNA, 13 nt, Molluscum contagiosum virus
gcgcggcggcagc

SEQ ID NO: 3088503 - RNA, 17 nt, Molluscum contagiosum virus
cugcgcuucgccgcgcg

SEQ ID NO: 3088504 - RNA, 14 nt, Molluscum contagiosum virus
ccgcccccaggugg

SEQ ID NO: 3088505 - RNA, 19 nt, Molluscum contagiosum virus
auugggugguggccacagc

SEQ ID NO: 3088506 - RNA, 20 nt, Molluscum contagiosum virus
gcucgguuggcggcgccgcg

SEQ ID NO: 3088507 - RNA, 22 nt, Molluscum contagiosum virus
cacaaagagcacggacagcacc

SEQ ID NO: 3088508 - RNA, 14 nt, Molluscum contagiosum virus
cggacggcuuuguc

SEQ ID NO: 3088509 - RNA, 15 nt, Molluscum contagiosum virus
cagcaccgcgccgcg

SEQ ID NO: 3088510 - RNA, 20 nt, Molluscum contagiosum virus
ccgcgugcacccuccgcaca

SEQ ID NO: 3088511 - RNA, 18 nt, Molluscum contagiosum virus
uaccgacguuuucuuugc

SEQ ID NO: 3088512 - RNA, 19 nt, Molluscum contagiosum virus
caaggcaugcgcgcagugc

SEQ ID NO: 3088513 - RNA, 15 nt, Molluscum contagiosum virus
ggccgccgggccugc

SEQ ID NO: 3088514 - RNA, 21 nt, Molluscum contagiosum virus
cagacgcagcgcgagcugugc

SEQ ID NO: 3088515 - RNA, 13 nt, Molluscum contagiosum virus
uaugucuccccuu

SEQ ID NO: 3088516 - RNA, 16 nt, Molluscum contagiosum virus
ccugagaaggagcgga

SEQ ID NO: 3088517 - RNA, 15 nt, Molluscum contagiosum virus
uccagugaaaugacg

SEQ ID NO: 3088518 - RNA, 14 nt, Molluscum contagiosum virus
acucgcugccagag

SEQ ID NO: 3088519 - RNA, 12 nt, Molluscum contagiosum virus
gcugccccccuc

SEQ ID NO: 3088520 - RNA, 15 nt, Molluscum contagiosum virus
acggcggugcccgcc

SEQ ID NO: 3088521 - RNA, 22 nt, Molluscum contagiosum virus
ccggcagcgacuacgcgcugcu

SEQ ID NO: 3088522 - RNA, 16 nt, Molluscum contagiosum virus
guucgcgcgugcugga

SEQ ID NO: 3088523 - RNA, 22 nt, Molluscum contagiosum virus
cgcggcgggcgaaagcgccgcg

SEQ ID NO: 3088524 - RNA, 13 nt, Molluscum contagiosum virus
gcugcuggagcua

SEQ ID NO: 3088525 - RNA, 17 nt, Molluscum contagiosum virus
aggaagcaggucuuggg

SEQ ID NO: 3088526 - RNA, 16 nt, Molluscum contagiosum virus
uccgcacgaggagccc

SEQ ID NO: 3088527 - RNA, 14 nt, Molluscum contagiosum virus
cuuccggcagcgcg

SEQ ID NO: 3088528 - RNA, 20 nt, Molluscum contagiosum virus
gcaugcucgcgcucucgguc

SEQ ID NO: 3088529 - RNA, 22 nt, Molluscum contagiosum virus
guuccacgaccgcaagugcacg

SEQ ID NO: 3088530 - RNA, 22 nt, Molluscum contagiosum virus
gcagcauucccggcgcgcgcgg

SEQ ID NO: 3088531 - RNA, 14 nt, Molluscum contagiosum virus
caugcccggccucg

SEQ ID NO: 3088532 - RNA, 23 nt, Molluscum contagiosum virus
gcacggacaugagcuugcgcacg

SEQ ID NO: 3088533 - RNA, 16 nt, Molluscum contagiosum virus
gcgcuccacgcccgag

SEQ ID NO: 3088534 - RNA, 14 nt, Molluscum contagiosum virus
gccagaagugaaau

SEQ ID NO: 3088535 - RNA, 22 nt, Molluscum contagiosum virus
accuacgcuaccugaagcugga

SEQ ID NO: 3088536 - RNA, 14 nt, Molluscum contagiosum virus
cuucccgaggacgc

SEQ ID NO: 3088537 - RNA, 20 nt, Molluscum contagiosum virus
ccgcggaugcaggcacugcc

SEQ ID NO: 3088538 - RNA, 17 nt, Molluscum contagiosum virus
cgcguaaaagacuggcu

SEQ ID NO: 3088539 - RNA, 14 nt, Molluscum contagiosum virus
ccaccagcaccagc

SEQ ID NO: 3088540 - RNA, 19 nt, Molluscum contagiosum virus
guccuacacgccgcuggag

SEQ ID NO: 3088541 - RNA, 19 nt, Molluscum contagiosum virus
ugcucccucgcgcgcagcu

SEQ ID NO: 3088542 - RNA, 11 nt, Molluscum contagiosum virus
agugccgccgc

SEQ ID NO: 3088543 - RNA, 22 nt, Molluscum contagiosum virus
aacuugcucuacuggcggcgcc

SEQ ID NO: 3088544 - RNA, 17 nt, Molluscum contagiosum virus
cucggcguccgcagcgg

SEQ ID NO: 3088545 - RNA, 15 nt, Molluscum contagiosum virus
cugaagaaggagccc

SEQ ID NO: 3088546 - RNA, 21 nt, Molluscum contagiosum virus
caggcgucgcgcacagaaagc

SEQ ID NO: 3088547 - RNA, 18 nt, Molluscum contagiosum virus
agcgcgugcgcaggagca

SEQ ID NO: 3088548 - RNA, 18 nt, Molluscum contagiosum virus
ggccgcggcgcggcggaa

SEQ ID NO: 3088549 - RNA, 17 nt, Molluscum contagiosum virus
gacucgagccccagaag

SEQ ID NO: 3088550 - RNA, 15 nt, Molluscum contagiosum virus
gacgagagggcgcgc

SEQ ID NO: 3088551 - RNA, 16 nt, Molluscum contagiosum virus
cgcgugcugggccccu

SEQ ID NO: 3088552 - RNA, 21 nt, Molluscum contagiosum virus
gcauuccgagccgccggucuc

SEQ ID NO: 3088553 - RNA, 16 nt, Molluscum contagiosum virus
accugguucaugcugg

SEQ ID NO: 3088554 - RNA, 16 nt, Molluscum contagiosum virus
caaggaucucugcccu

SEQ ID NO: 3088555 - RNA, 15 nt, Molluscum contagiosum virus
cuuccuuugcucuac

SEQ ID NO: 3088556 - RNA, 14 nt, Molluscum contagiosum virus
ucauucgcuggugc

SEQ ID NO: 3088557 - RNA, 14 nt, Molluscum contagiosum virus
cucgguggugcgcc

SEQ ID NO: 3088558 - RNA, 22 nt, Molluscum contagiosum virus
gcccgccuacggggcugcuccg

SEQ ID NO: 3088559 - RNA, 22 nt, Molluscum contagiosum virus
acggcgcgcgcgcuagccgccg

SEQ ID NO: 3088560 - RNA, 22 nt, Molluscum contagiosum virus
gcaggaaaggcaccccgcagga

SEQ ID NO: 3088561 - RNA, 23 nt, Molluscum contagiosum virus
cgcucgaggaccucgcgcgccgc

SEQ ID NO: 3088562 - RNA, 13 nt, Molluscum contagiosum virus
ccgcggagggagg

SEQ ID NO: 3088563 - RNA, 15 nt, Molluscum contagiosum virus
caacacgcuguugcu

SEQ ID NO: 3088564 - RNA, 16 nt, Molluscum contagiosum virus
cugcugcgcagcaucc

SEQ ID NO: 3088565 - RNA, 20 nt, Molluscum contagiosum virus
cgaugguggcgcugcugccc

SEQ ID NO: 3088566 - RNA, 19 nt, Molluscum contagiosum virus
ugccccgcgcguugcugcc

SEQ ID NO: 3088567 - RNA, 18 nt, Molluscum contagiosum virus
gccuucuccucgcucugc

SEQ ID NO: 3088568 - RNA, 16 nt, Molluscum contagiosum virus
acggacgcccuccucg

SEQ ID NO: 3088569 - RNA, 17 nt, Molluscum contagiosum virus
agcauuagcgccaaggc

SEQ ID NO: 3088570 - RNA, 19 nt, Molluscum contagiosum virus
gggcucugccaccaugcgc

SEQ ID NO: 3088571 - RNA, 16 nt, Molluscum contagiosum virus
caacgagcagcccgug

SEQ ID NO: 3088572 - RNA, 11 nt, Molluscum contagiosum virus
gaucucugccc

SEQ ID NO: 3088573 - RNA, 23 nt, Molluscum contagiosum virus
ccucgagcaggucaucgggcugc

SEQ ID NO: 3088574 - RNA, 15 nt, Molluscum contagiosum virus
acccgugcgcgcgcu

SEQ ID NO: 3088575 - RNA, 14 nt, Molluscum contagiosum virus
accagcucgcgccg

SEQ ID NO: 3088576 - RNA, 22 nt, Molluscum contagiosum virus
agcgcccgugcuugcgcacgga

SEQ ID NO: 3088577 - RNA, 18 nt, Molluscum contagiosum virus
cgaugguggcgcugcugc

SEQ ID NO: 3088578 - RNA, 19 nt, Molluscum contagiosum virus
gccaggaaaacggaaacag

SEQ ID NO: 3088579 - RNA, 15 nt, Molluscum contagiosum virus
cgaguucgagggcaa

SEQ ID NO: 3088580 - RNA, 17 nt, Molluscum contagiosum virus
uguccacgacacuggcg

SEQ ID NO: 3088581 - RNA, 19 nt, Molluscum contagiosum virus
cacggacucgagccccaga

SEQ ID NO: 3088582 - RNA, 13 nt, Molluscum contagiosum virus
aacagcagcuggc

SEQ ID NO: 3088583 - RNA, 22 nt, Molluscum contagiosum virus
ggcacaccccuguaacaaggaa

SEQ ID NO: 3088584 - RNA, 21 nt, Molluscum contagiosum virus
cagauguucucgccaguggcc

SEQ ID NO: 3088585 - RNA, 22 nt, Molluscum contagiosum virus
gcguugccggcgaaccgacugc

SEQ ID NO: 3088586 - RNA, 23 nt, Molluscum contagiosum virus
ugugccgccgcacuauggacgcu

SEQ ID NO: 3088587 - RNA, 12 nt, Molluscum contagiosum virus
gcucaccgccga

SEQ ID NO: 3088588 - RNA, 13 nt, Molluscum contagiosum virus
aaguccaccuucu

SEQ ID NO: 3088589 - RNA, 14 nt, Molluscum contagiosum virus
gaccagcugguccu

SEQ ID NO: 3088590 - RNA, 14 nt, Molluscum contagiosum virus
cgcgugccgggcuu

SEQ ID NO: 3088591 - RNA, 17 nt, Molluscum contagiosum virus
gcacaguucacggcgcu

SEQ ID NO: 3088592 - RNA, 13 nt, Molluscum contagiosum virus
caccacaacugaa

SEQ ID NO: 3088593 - RNA, 17 nt, Molluscum contagiosum virus
cguggacaacagcacga

SEQ ID NO: 3088594 - RNA, 23 nt, Molluscum contagiosum virus
ucgaugacagcaucgggcugucg

SEQ ID NO: 3088595 - RNA, 16 nt, Molluscum contagiosum virus
ccagcagcuccuggua

SEQ ID NO: 3088596 - RNA, 19 nt, Molluscum contagiosum virus
uacugcagcagcuccucca

SEQ ID NO: 3088597 - RNA, 14 nt, Molluscum contagiosum virus
cgcagucccagcac

SEQ ID NO: 3088598 - RNA, 13 nt, Molluscum contagiosum virus
cacgacccucuuc

SEQ ID NO: 3088599 - RNA, 22 nt, Molluscum contagiosum virus
uuuccugucaucaccccgcugg

SEQ ID NO: 3088600 - RNA, 15 nt, Molluscum contagiosum virus
cggcacccgccagcu

SEQ ID NO: 3088601 - RNA, 16 nt, Molluscum contagiosum virus
cgagcacguuccaaaa

SEQ ID NO: 3088602 - RNA, 19 nt, Molluscum contagiosum virus
gcgugaccauggacacgcu

SEQ ID NO: 3088603 - RNA, 20 nt, Molluscum contagiosum virus
cgcgugccgggcuugcuccc

SEQ ID NO: 3088604 - RNA, 14 nt, Molluscum contagiosum virus
gaggagcucgacuc

SEQ ID NO: 3088605 - RNA, 15 nt, Molluscum contagiosum virus
uggaccugcgccagc

SEQ ID NO: 3088606 - RNA, 20 nt, Molluscum contagiosum virus
ggcgccaaguccgagcaagc

SEQ ID NO: 3088607 - RNA, 12 nt, Molluscum contagiosum virus
cgcgcugcuggu

SEQ ID NO: 3088608 - RNA, 20 nt, Molluscum contagiosum virus
uccacauuacgcucguggaa

SEQ ID NO: 3088609 - RNA, 16 nt, Molluscum contagiosum virus
gcuucacgugcuugcc

SEQ ID NO: 3088610 - RNA, 19 nt, Molluscum contagiosum virus
cgcgugcaagcccagcagc

SEQ ID NO: 3088611 - RNA, 20 nt, Molluscum contagiosum virus
ccagcuucaucaagcacggc

SEQ ID NO: 3088612 - RNA, 18 nt, Molluscum contagiosum virus
cgcacgcgcgcuuagcac

SEQ ID NO: 3088613 - RNA, 14 nt, Molluscum contagiosum virus
ggcaccugcaggaa

SEQ ID NO: 3088614 - RNA, 12 nt, Molluscum contagiosum virus
gagccgccgggg

SEQ ID NO: 3088615 - RNA, 13 nt, Molluscum contagiosum virus
ggcaagggcuccu

SEQ ID NO: 3088616 - RNA, 15 nt, Molluscum contagiosum virus
ccaggcacuggcccu

SEQ ID NO: 3088617 - RNA, 14 nt, Molluscum contagiosum virus
ucccugcauacacu

SEQ ID NO: 3088618 - RNA, 21 nt, Molluscum contagiosum virus
cgcgacgccguccgcgcagcc

SEQ ID NO: 3088619 - RNA, 14 nt, Molluscum contagiosum virus
gccgccagccacga

SEQ ID NO: 3088620 - RNA, 20 nt, Molluscum contagiosum virus
gcggccgagucacgccccag

SEQ ID NO: 3088621 - RNA, 18 nt, Molluscum contagiosum virus
aggcacccgcaacaagga

SEQ ID NO: 3088622 - RNA, 17 nt, Molluscum contagiosum virus
cacauugcgaggcaccg

SEQ ID NO: 3088623 - RNA, 18 nt, Molluscum contagiosum virus
ccuugaugccgugguaca

SEQ ID NO: 3088624 - RNA, 14 nt, Molluscum contagiosum virus
cacgucggcccgag

SEQ ID NO: 3088625 - RNA, 19 nt, Molluscum contagiosum virus
acuucccgacgucuucccc

SEQ ID NO: 3088626 - RNA, 18 nt, Molluscum contagiosum virus
ggcguguuccggcagcgc

SEQ ID NO: 3088627 - RNA, 16 nt, Molluscum contagiosum virus
accaccagcaccagca

SEQ ID NO: 3088628 - RNA, 14 nt, Molluscum contagiosum virus
accucuacacgcac

SEQ ID NO: 3088629 - RNA, 16 nt, Molluscum contagiosum virus
uucccgggcacuguaa

SEQ ID NO: 3088630 - RNA, 15 nt, Molluscum contagiosum virus
cuacaucgacaagca

SEQ ID NO: 3088631 - RNA, 21 nt, Molluscum contagiosum virus
gcgcuuccucuacaccagcug

SEQ ID NO: 3088632 - RNA, 15 nt, Molluscum contagiosum virus
ucuucaccugcauug

SEQ ID NO: 3088633 - RNA, 14 nt, Molluscum contagiosum virus
gccaugaggacagc

SEQ ID NO: 3088634 - RNA, 17 nt, Molluscum contagiosum virus
ccgagagcaugcugucu

SEQ ID NO: 3088635 - RNA, 22 nt, Molluscum contagiosum virus
ucaagcacggcuuccggcacca

SEQ ID NO: 3088636 - RNA, 15 nt, Molluscum contagiosum virus
cucacaucugucccu

SEQ ID NO: 3088637 - RNA, 23 nt, Molluscum contagiosum virus
ggcucaccgcgcagaagccaaca

SEQ ID NO: 3088638 - RNA, 18 nt, Molluscum contagiosum virus
ugcgcauuggcagcgcuu

SEQ ID NO: 3088639 - RNA, 15 nt, Molluscum contagiosum virus
aacauugccacgcaa

SEQ ID NO: 3088640 - RNA, 18 nt, Molluscum contagiosum virus
ccgcuggacgccucggga

SEQ ID NO: 3088641 - RNA, 17 nt, Molluscum contagiosum virus
cggcaguccgagcuguu

SEQ ID NO: 3088642 - RNA, 18 nt, Molluscum contagiosum virus
guuuacgcucggcugccg

SEQ ID NO: 3088643 - RNA, 17 nt, Molluscum contagiosum virus
ccguccucgcucgugcu

SEQ ID NO: 3088644 - RNA, 16 nt, Molluscum contagiosum virus
cgugcgcgagacuugu

SEQ ID NO: 3088645 - RNA, 16 nt, Molluscum contagiosum virus
ggcgcgcgcugcgcac

SEQ ID NO: 3088646 - RNA, 17 nt, Molluscum contagiosum virus
guaugcccacugggaac

SEQ ID NO: 3088647 - RNA, 19 nt, Molluscum contagiosum virus
uagcggacgaagcugugca

SEQ ID NO: 3088648 - RNA, 21 nt, Molluscum contagiosum virus
cccaggaagacgugcugcgcg

SEQ ID NO: 3088649 - RNA, 18 nt, Molluscum contagiosum virus
cccgacuuuucgcgccgc

SEQ ID NO: 3088650 - RNA, 21 nt, Molluscum contagiosum virus
uagacagugcggcgcggcugc

SEQ ID NO: 3088651 - RNA, 18 nt, Molluscum contagiosum virus
cagcggggacucucccgu

SEQ ID NO: 3088652 - RNA, 20 nt, Molluscum contagiosum virus
agaacccguauuuccagcgu

SEQ ID NO: 3088653 - RNA, 19 nt, Molluscum contagiosum virus
cgcggcuaccacgggcccg

SEQ ID NO: 3088654 - RNA, 22 nt, Molluscum contagiosum virus
cuugagcacacgguagagcugc

SEQ ID NO: 3088655 - RNA, 20 nt, Molluscum contagiosum virus
cgcucggaggggcuccgggc

SEQ ID NO: 3088656 - RNA, 21 nt, Molluscum contagiosum virus
cggcgccgacagcgcgcgcac

SEQ ID NO: 3088657 - RNA, 15 nt, Molluscum contagiosum virus
aucaccccgcagcuc

SEQ ID NO: 3088658 - RNA, 17 nt, Molluscum contagiosum virus
accccaagaagaacguc

SEQ ID NO: 3088659 - RNA, 20 nt, Molluscum contagiosum virus
ccgagcccgcggcgcgcagc

SEQ ID NO: 3088660 - RNA, 18 nt, Molluscum contagiosum virus
gguucagguagcgcgccg

SEQ ID NO: 3088661 - RNA, 18 nt, Molluscum contagiosum virus
ugcgccagcgccuguccg

SEQ ID NO: 3088662 - RNA, 19 nt, Molluscum contagiosum virus
ggcacaucucucagggcag

SEQ ID NO: 3088663 - RNA, 16 nt, Molluscum contagiosum virus
cuggcgcgcgcgcugc

SEQ ID NO: 3088664 - RNA, 16 nt, Molluscum contagiosum virus
ugcgcuucggcuccca

SEQ ID NO: 3088665 - RNA, 21 nt, Molluscum contagiosum virus
cucagcgcuucgacuuccagc

SEQ ID NO: 3088666 - RNA, 23 nt, Molluscum contagiosum virus
gccgucgcccggcaggcucccgc

SEQ ID NO: 3088667 - RNA, 14 nt, Molluscum contagiosum virus
cuaggccucagccg

SEQ ID NO: 3088668 - RNA, 22 nt, Molluscum contagiosum virus
gauucggaggcggagcugcccg

SEQ ID NO: 3088669 - RNA, 15 nt, Molluscum contagiosum virus
ccugucaagacgggc

SEQ ID NO: 3088670 - RNA, 19 nt, Molluscum contagiosum virus
gccgaguaccgcgcgcacg

SEQ ID NO: 3088671 - RNA, 14 nt, Molluscum contagiosum virus
ccugucgugcaaug

SEQ ID NO: 3088672 - RNA, 13 nt, Molluscum contagiosum virus
cagagccugcugc

SEQ ID NO: 3088673 - RNA, 15 nt, Molluscum contagiosum virus
gcagcucaagacgcu

SEQ ID NO: 3088674 - RNA, 15 nt, Molluscum contagiosum virus
gccucugccucgugc

SEQ ID NO: 3088675 - RNA, 16 nt, Molluscum contagiosum virus
gucucccgcggccgcc

SEQ ID NO: 3088676 - RNA, 14 nt, Molluscum contagiosum virus
cguggaggagccgc

SEQ ID NO: 3088677 - RNA, 14 nt, Molluscum contagiosum virus
cugacgcgcagugc

SEQ ID NO: 3088678 - RNA, 17 nt, Molluscum contagiosum virus
ggcaagaggggagccag

SEQ ID NO: 3088679 - RNA, 13 nt, Molluscum contagiosum virus
gcuggaggauucu

SEQ ID NO: 3088680 - RNA, 21 nt, Molluscum contagiosum virus
gugccgcugcgcggagcucgc

SEQ ID NO: 3088681 - RNA, 15 nt, Molluscum contagiosum virus
cagccgcacggcgcc

SEQ ID NO: 3088682 - RNA, 21 nt, Molluscum contagiosum virus
ggacgcgugcaagcccagcag

SEQ ID NO: 3088683 - RNA, 13 nt, Molluscum contagiosum virus
gaaaacuuguggc

SEQ ID NO: 3088684 - RNA, 14 nt, Molluscum contagiosum virus
caauacugcgggcu

SEQ ID NO: 3088685 - RNA, 18 nt, Molluscum contagiosum virus
acugccugccgccucgga

SEQ ID NO: 3088686 - RNA, 17 nt, Molluscum contagiosum virus
cgcugcccgcgcacaac

SEQ ID NO: 3088687 - RNA, 22 nt, Molluscum contagiosum virus
gguccgcuccuucucagggcuu

SEQ ID NO: 3088688 - RNA, 19 nt, Molluscum contagiosum virus
ccgcgcccgccagcauggc

SEQ ID NO: 3088689 - RNA, 23 nt, Molluscum contagiosum virus
gcacgugccccgcgcgugcaguu

SEQ ID NO: 3088690 - RNA, 15 nt, Molluscum contagiosum virus
acgccguguaccgcc

SEQ ID NO: 3088691 - RNA, 15 nt, Molluscum contagiosum virus
ccugcugccucccaa

SEQ ID NO: 3088692 - RNA, 21 nt, Molluscum contagiosum virus
gcuuggccggaacgccgugcg

SEQ ID NO: 3088693 - RNA, 13 nt, Molluscum contagiosum virus
ugcacgugcagcg

SEQ ID NO: 3088694 - RNA, 21 nt, Molluscum contagiosum virus
gcacccuucugaggggcagug

SEQ ID NO: 3088695 - RNA, 18 nt, Molluscum contagiosum virus
gcucgcggugcagcugcc

SEQ ID NO: 3088696 - RNA, 12 nt, Molluscum contagiosum virus
cucccgcccagc

SEQ ID NO: 3088697 - RNA, 19 nt, Molluscum contagiosum virus
ucucguggcguugcugcug

SEQ ID NO: 3088698 - RNA, 20 nt, Molluscum contagiosum virus
cucugacccgcgccuacucc

SEQ ID NO: 3088699 - RNA, 13 nt, Molluscum contagiosum virus
cugcgcgcacugc

SEQ ID NO: 3088700 - RNA, 14 nt, Molluscum contagiosum virus
cgggagaguggccg

SEQ ID NO: 3088701 - RNA, 23 nt, Molluscum contagiosum virus
guacgacgugcugcugcagaacu

SEQ ID NO: 3088702 - RNA, 17 nt, Molluscum contagiosum virus
gcgccgcgcgcgccggg

SEQ ID NO: 3088703 - RNA, 15 nt, Molluscum contagiosum virus
ccucgcgcgcacugc

SEQ ID NO: 3088704 - RNA, 13 nt, Molluscum contagiosum virus
cugugccgcagca

SEQ ID NO: 3088705 - RNA, 13 nt, Molluscum contagiosum virus
gccguaguccggc

SEQ ID NO: 3088706 - RNA, 14 nt, Molluscum contagiosum virus
agugugccugcugc

SEQ ID NO: 3088707 - RNA, 19 nt, Molluscum contagiosum virus
cacgccaagcgcuugcucu

SEQ ID NO: 3088708 - RNA, 19 nt, Molluscum contagiosum virus
gcauguccuuggcggugcg

SEQ ID NO: 3088709 - RNA, 23 nt, Molluscum contagiosum virus
gcuggacuuccugcugcgcagca

SEQ ID NO: 3088710 - RNA, 15 nt, Molluscum contagiosum virus
cgcgagcugcugcgc

SEQ ID NO: 3088711 - RNA, 22 nt, Molluscum contagiosum virus
cgcgaacgaggagggcagccuc

SEQ ID NO: 3088712 - RNA, 17 nt, Molluscum contagiosum virus
cccaccagcagccaggc

SEQ ID NO: 3088713 - RNA, 20 nt, Molluscum contagiosum virus
gcucgcgcaaguccagcgcg

SEQ ID NO: 3088714 - RNA, 23 nt, Molluscum contagiosum virus
ugcgcggcccgcgggcugcaaga

SEQ ID NO: 3088715 - RNA, 21 nt, Molluscum contagiosum virus
aaaagcaaguaccagccgcug

SEQ ID NO: 3088716 - RNA, 21 nt, Molluscum contagiosum virus
aaggcaccccgaaggaaaggc

SEQ ID NO: 3088717 - RNA, 18 nt, Molluscum contagiosum virus
gucgcgagugugcgcgcc

SEQ ID NO: 3088718 - RNA, 13 nt, Molluscum contagiosum virus
cccagcuucagca

SEQ ID NO: 3088719 - RNA, 13 nt, Molluscum contagiosum virus
cacccgcaggaaa

SEQ ID NO: 3088720 - RNA, 22 nt, Molluscum contagiosum virus
cagcguagcggacgaagcugug

SEQ ID NO: 3088721 - RNA, 19 nt, Molluscum contagiosum virus
ccgccgcgcaaaagcacag

SEQ ID NO: 3088722 - RNA, 17 nt, Molluscum contagiosum virus
agcaaugcgcaaggccg

SEQ ID NO: 3088723 - RNA, 19 nt, Molluscum contagiosum virus
gcacuugccgggcgacggc

SEQ ID NO: 3088724 - RNA, 15 nt, Molluscum contagiosum virus
gaccccgagcugcgg

SEQ ID NO: 3088725 - RNA, 15 nt, Molluscum contagiosum virus
gccgcguagccgccg

SEQ ID NO: 3088726 - RNA, 20 nt, Molluscum contagiosum virus
ccugcucgggcugcgcggcg

SEQ ID NO: 3088727 - RNA, 18 nt, Molluscum contagiosum virus
ccgcggccgagucacgcc

SEQ ID NO: 3088728 - RNA, 21 nt, Molluscum contagiosum virus
ccgagcaacucgcgagagaca

SEQ ID NO: 3088729 - RNA, 20 nt, Molluscum contagiosum virus
cuuccccgcacaagggcagc

SEQ ID NO: 3088730 - RNA, 15 nt, Molluscum contagiosum virus
gucucgcgcuuccag

SEQ ID NO: 3088731 - RNA, 17 nt, Molluscum contagiosum virus
caagaggacgagcugcu

SEQ ID NO: 3088732 - RNA, 13 nt, Molluscum contagiosum virus
ggaacgcgccgcg

SEQ ID NO: 3088733 - RNA, 16 nt, Molluscum contagiosum virus
gcguucacggacucga

SEQ ID NO: 3088734 - RNA, 16 nt, Molluscum contagiosum virus
ggaggcgcuagugcag

SEQ ID NO: 3088735 - RNA, 21 nt, Molluscum contagiosum virus
agcgccuguaccccgaacggc

SEQ ID NO: 3088736 - RNA, 15 nt, Molluscum contagiosum virus
gcgugcaugcccagc

SEQ ID NO: 3088737 - RNA, 15 nt, Molluscum contagiosum virus
cucgugcccgcacac

SEQ ID NO: 3088738 - RNA, 17 nt, Molluscum contagiosum virus
agcgccgcucgcacggc

SEQ ID NO: 3088739 - RNA, 15 nt, Molluscum contagiosum virus
cacugcguacacaug

SEQ ID NO: 3088740 - RNA, 16 nt, Molluscum contagiosum virus
gugcgccugcagccug

SEQ ID NO: 3088741 - RNA, 19 nt, Molluscum contagiosum virus
cgaagaccaccagcaccag

SEQ ID NO: 3088742 - RNA, 13 nt, Molluscum contagiosum virus
agaguugcgcgag

SEQ ID NO: 3088743 - RNA, 19 nt, Molluscum contagiosum virus
acuugcgcguucgcaaaga

SEQ ID NO: 3088744 - RNA, 15 nt, Molluscum contagiosum virus
cccgcaaccccgcgc

SEQ ID NO: 3088745 - RNA, 20 nt, Molluscum contagiosum virus
caccuuggcgcugcacaguu

SEQ ID NO: 3088746 - RNA, 21 nt, Molluscum contagiosum virus
cugucgccgcgggcugggaaa

SEQ ID NO: 3088747 - RNA, 19 nt, Molluscum contagiosum virus
cucuggagcggccacucuc

SEQ ID NO: 3088748 - RNA, 17 nt, Molluscum contagiosum virus
cagcgggcgcugcucgc

SEQ ID NO: 3088749 - RNA, 17 nt, Molluscum contagiosum virus
cuccaggaacgcgccgc

SEQ ID NO: 3088750 - RNA, 14 nt, Molluscum contagiosum virus
gcgagcgcucugca

SEQ ID NO: 3088751 - RNA, 16 nt, Molluscum contagiosum virus
uuccugcugcgcagca

SEQ ID NO: 3088752 - RNA, 17 nt, Molluscum contagiosum virus
cacguggaaucacggcc

SEQ ID NO: 3088753 - RNA, 24 nt, Molluscum contagiosum virus
ugaccgcuucgagugcucccgagg

SEQ ID NO: 3088754 - RNA, 17 nt, Molluscum contagiosum virus
cggccgccggcgccugu

SEQ ID NO: 3088755 - RNA, 22 nt, Molluscum contagiosum virus
cagcaugaacucgcugcugcuc

SEQ ID NO: 3088756 - RNA, 17 nt, Molluscum contagiosum virus
ggagguuggaagcacgc

SEQ ID NO: 3088757 - RNA, 23 nt, Molluscum contagiosum virus
auauggcgcgccgaguacugcug

SEQ ID NO: 3088758 - RNA, 19 nt, Molluscum contagiosum virus
ugcucuacgcaacacggcg

SEQ ID NO: 3088759 - RNA, 21 nt, Molluscum contagiosum virus
agucuuccuggggcuggacag

SEQ ID NO: 3088760 - RNA, 18 nt, Molluscum contagiosum virus
ggcagcuggagcugccgc

SEQ ID NO: 3088761 - RNA, 15 nt, Molluscum contagiosum virus
cacguggaccugauu

SEQ ID NO: 3088762 - RNA, 14 nt, Molluscum contagiosum virus
ucucggcggccgga

SEQ ID NO: 3088763 - RNA, 18 nt, Molluscum contagiosum virus
cggcacuguguccccuga

SEQ ID NO: 3088764 - RNA, 18 nt, Molluscum contagiosum virus
gacgcgcgagugugcgug

SEQ ID NO: 3088765 - RNA, 12 nt, Molluscum contagiosum virus
cggacagugccu

SEQ ID NO: 3088766 - RNA, 12 nt, Molluscum contagiosum virus
ggugaggagcuc

SEQ ID NO: 3088767 - RNA, 18 nt, Molluscum contagiosum virus
gcaaguucgcugcuggca

SEQ ID NO: 3088768 - RNA, 23 nt, Molluscum contagiosum virus
cuugcagacaaggagaugggcac

SEQ ID NO: 3088769 - RNA, 16 nt, Molluscum contagiosum virus
cagcagcgcgaagcuc

SEQ ID NO: 3088770 - RNA, 21 nt, Molluscum contagiosum virus
gcgcgccucucgaggccggca

SEQ ID NO: 3088771 - RNA, 16 nt, Molluscum contagiosum virus
acggucuuccaggucu

SEQ ID NO: 3088772 - RNA, 18 nt, Molluscum contagiosum virus
uucaguguuuuaauuuuc

SEQ ID NO: 3088773 - RNA, 22 nt, Molluscum contagiosum virus
caccccgaaaggcacccgcagg

SEQ ID NO: 3088774 - RNA, 21 nt, Molluscum contagiosum virus
cggcgcguccucggccagagc

SEQ ID NO: 3088775 - RNA, 13 nt, Molluscum contagiosum virus
cauggccacgccc

SEQ ID NO: 3088776 - RNA, 15 nt, Molluscum contagiosum virus
aaggacuaccagcuc

SEQ ID NO: 3088777 - RNA, 16 nt, Molluscum contagiosum virus
uggccuguaguagcag

SEQ ID NO: 3088778 - RNA, 19 nt, Molluscum contagiosum virus
gcaggccccgcaccagugc

SEQ ID NO: 3088779 - RNA, 15 nt, Molluscum contagiosum virus
gccggacagcucagc

SEQ ID NO: 3088780 - RNA, 18 nt, Molluscum contagiosum virus
cccgcgcagcgccacgcc

SEQ ID NO: 3088781 - RNA, 21 nt, Molluscum contagiosum virus
agguuggggcggcggggcugc

SEQ ID NO: 3088782 - RNA, 16 nt, Molluscum contagiosum virus
cggcacccgccagcuu

SEQ ID NO: 3088783 - RNA, 16 nt, Molluscum contagiosum virus
cgugcguuccgggccc

SEQ ID NO: 3088784 - RNA, 21 nt, Molluscum contagiosum virus
cucugcgcgagcagcugcugc

SEQ ID NO: 3088785 - RNA, 20 nt, Molluscum contagiosum virus
cacgggcucgaucugcgccu

SEQ ID NO: 3088786 - RNA, 18 nt, Molluscum contagiosum virus
gagcucacgccggaccag

SEQ ID NO: 3088787 - RNA, 15 nt, Molluscum contagiosum virus
aggagggcagccuca

SEQ ID NO: 3088788 - RNA, 15 nt, Molluscum contagiosum virus
aacagcgcaagcuga

SEQ ID NO: 3088789 - RNA, 14 nt, Molluscum contagiosum virus
ccaccagcagccag

SEQ ID NO: 3088790 - RNA, 16 nt, Molluscum contagiosum virus
ccggcaucgcgcugcu

SEQ ID NO: 3088791 - RNA, 11 nt, Molluscum contagiosum virus
aagcacugccu

SEQ ID NO: 3088792 - RNA, 20 nt, Molluscum contagiosum virus
cuacugcgcgcacugcucgc

SEQ ID NO: 3088793 - RNA, 16 nt, Molluscum contagiosum virus
cugcugcucgaagccu

SEQ ID NO: 3088794 - RNA, 21 nt, Molluscum contagiosum virus
ggucaacggcacagucuggga

SEQ ID NO: 3088795 - RNA, 21 nt, Molluscum contagiosum virus
cgcgcgcuauucaaagcugug

SEQ ID NO: 3088796 - RNA, 17 nt, Molluscum contagiosum virus
ccugcgacagcugcugc

SEQ ID NO: 3088797 - RNA, 21 nt, Molluscum contagiosum virus
ggcgggaagaaacucaggaag

SEQ ID NO: 3088798 - RNA, 17 nt, Molluscum contagiosum virus
ccuggcguccgcacgca

SEQ ID NO: 3088799 - RNA, 19 nt, Molluscum contagiosum virus
ccagaaaacaggcacuucg

SEQ ID NO: 3088800 - RNA, 14 nt, Molluscum contagiosum virus
ccaggugcugggcg

SEQ ID NO: 3088801 - RNA, 18 nt, Molluscum contagiosum virus
gcuggcccugcuagugcg

SEQ ID NO: 3088802 - RNA, 16 nt, Molluscum contagiosum virus
ucgcggcgcuacuggc

SEQ ID NO: 3088803 - RNA, 19 nt, Molluscum contagiosum virus
gcgcgccgugccuggcagu

SEQ ID NO: 3088804 - RNA, 14 nt, Molluscum contagiosum virus
gcgcgcaggcucgc

SEQ ID NO: 3088805 - RNA, 17 nt, Molluscum contagiosum virus
cuggcacuugcgcagcc

SEQ ID NO: 3088806 - RNA, 23 nt, Molluscum contagiosum virus
agacauauguucuucgacaacau

SEQ ID NO: 3088807 - RNA, 23 nt, Molluscum contagiosum virus
cgcgcguugccugagaagcugua

SEQ ID NO: 3088808 - RNA, 18 nt, Molluscum contagiosum virus
cccucgugguugcgcagc

SEQ ID NO: 3088809 - RNA, 15 nt, Molluscum contagiosum virus
cgcuccuucucaggg

SEQ ID NO: 3088810 - RNA, 19 nt, Molluscum contagiosum virus
aaacauguagcgcgcgccg

SEQ ID NO: 3088811 - RNA, 20 nt, Molluscum contagiosum virus
gcaugugcgcaccgcgggcu

SEQ ID NO: 3088812 - RNA, 23 nt, Molluscum contagiosum virus
guacgcaugcgcgguccuguccg

SEQ ID NO: 3088813 - RNA, 24 nt, Molluscum contagiosum virus
gcgccuaccgcgcgggaggcgucc

SEQ ID NO: 3088814 - RNA, 19 nt, Molluscum contagiosum virus
gaaacuggacugagccgca

SEQ ID NO: 3088815 - RNA, 12 nt, Molluscum contagiosum virus
ccgguccugacu

SEQ ID NO: 3088816 - RNA, 12 nt, Molluscum contagiosum virus
gcgcugcugccc

SEQ ID NO: 3088817 - RNA, 12 nt, Molluscum contagiosum virus
ggccaggccgcg

SEQ ID NO: 3088818 - RNA, 21 nt, Molluscum contagiosum virus
cugcugcagaacugccugguc

SEQ ID NO: 3088819 - RNA, 11 nt, Molluscum contagiosum virus
gaccugcuggu

SEQ ID NO: 3088820 - RNA, 21 nt, Molluscum contagiosum virus
ggcgcgcgucgagggcgccgg

SEQ ID NO: 3088821 - RNA, 18 nt, Molluscum contagiosum virus
accgcaugggcccuggcg

SEQ ID NO: 3088822 - RNA, 13 nt, Molluscum contagiosum virus
cugccauggcagc

SEQ ID NO: 3088823 - RNA, 16 nt, Molluscum contagiosum virus
cacaucggcacugcuc

SEQ ID NO: 3088824 - RNA, 23 nt, Molluscum contagiosum virus
gcaggcgucgcgcacagaaagcc

SEQ ID NO: 3088825 - RNA, 13 nt, Molluscum contagiosum virus
gcgcugcugguuc

SEQ ID NO: 3088826 - RNA, 20 nt, Molluscum contagiosum virus
cagagguaaucccgagcuuc

SEQ ID NO: 3088827 - RNA, 20 nt, Molluscum contagiosum virus
gucaggccggucgcggaaga

SEQ ID NO: 3088828 - RNA, 20 nt, Molluscum contagiosum virus
cagcucggaggcgcagacgu

SEQ ID NO: 3088829 - RNA, 21 nt, Molluscum contagiosum virus
cgccagcuaagccggagcagc

SEQ ID NO: 3088830 - RNA, 13 nt, Molluscum contagiosum virus
cugcguugucucc

SEQ ID NO: 3088831 - RNA, 17 nt, Molluscum contagiosum virus
aggcguaugcgccaagc

SEQ ID NO: 3088832 - RNA, 15 nt, Molluscum contagiosum virus
agcgacgagcagcug

SEQ ID NO: 3088833 - RNA, 14 nt, Molluscum contagiosum virus
cuccugaggaagca

SEQ ID NO: 3088834 - RNA, 13 nt, Molluscum contagiosum virus
ccccgcugggccg

SEQ ID NO: 3088835 - RNA, 15 nt, Molluscum contagiosum virus
cgcggcaacagcacg

SEQ ID NO: 3088836 - RNA, 18 nt, Molluscum contagiosum virus
ggagcgcacgaagcggcg

SEQ ID NO: 3088837 - RNA, 22 nt, Molluscum contagiosum virus
ggcaaguuccuggugugccagc

SEQ ID NO: 3088838 - RNA, 14 nt, Molluscum contagiosum virus
cugccucgugccuu

SEQ ID NO: 3088839 - RNA, 14 nt, Molluscum contagiosum virus
ucggcuucugcugc

SEQ ID NO: 3088840 - RNA, 18 nt, Molluscum contagiosum virus
accaccagguacuccuug

SEQ ID NO: 3088841 - RNA, 14 nt, Molluscum contagiosum virus
gacuggcaccugcg

SEQ ID NO: 3088842 - RNA, 20 nt, Molluscum contagiosum virus
cccggacagagccccguuca

SEQ ID NO: 3088843 - RNA, 19 nt, Molluscum contagiosum virus
augccgcgugcucugcucc

SEQ ID NO: 3088844 - RNA, 16 nt, Molluscum contagiosum virus
cccgcggcgcgccgca

SEQ ID NO: 3088845 - RNA, 18 nt, Molluscum contagiosum virus
gcccgguuuuccggggac

SEQ ID NO: 3088846 - RNA, 15 nt, Molluscum contagiosum virus
cacgcucucgcuggc

SEQ ID NO: 3088847 - RNA, 18 nt, Molluscum contagiosum virus
gcacgccagguguuccug

SEQ ID NO: 3088848 - RNA, 15 nt, Molluscum contagiosum virus
cugguucugcucgca

SEQ ID NO: 3088849 - RNA, 21 nt, Molluscum contagiosum virus
gcggaugccacgcagcuggcg

SEQ ID NO: 3088850 - RNA, 12 nt, Molluscum contagiosum virus
caugggcccugg

SEQ ID NO: 3088851 - RNA, 20 nt, Molluscum contagiosum virus
gacgagaccacgguccuggg

SEQ ID NO: 3088852 - RNA, 23 nt, Molluscum contagiosum virus
cgcguccacaaagacggggccgc

SEQ ID NO: 3088853 - RNA, 15 nt, Molluscum contagiosum virus
gaucgcgcucuuccc

SEQ ID NO: 3088854 - RNA, 15 nt, Molluscum contagiosum virus
cuagacaaggggcca

SEQ ID NO: 3088855 - RNA, 17 nt, Molluscum contagiosum virus
ccggccucgccuccggg

SEQ ID NO: 3088856 - RNA, 19 nt, Molluscum contagiosum virus
ucagcggcggccccugccu

SEQ ID NO: 3088857 - RNA, 17 nt, Molluscum contagiosum virus
gcgggcaagcagggccu

SEQ ID NO: 3088858 - RNA, 13 nt, Molluscum contagiosum virus
gaugcuggggcuc

SEQ ID NO: 3088859 - RNA, 16 nt, Molluscum contagiosum virus
cgugcgcgggcacgcc

SEQ ID NO: 3088860 - RNA, 16 nt, Molluscum contagiosum virus
gugaaguccucucucc

SEQ ID NO: 3088861 - RNA, 17 nt, Molluscum contagiosum virus
ggcggcccgcggcgcgc

SEQ ID NO: 3088862 - RNA, 21 nt, Molluscum contagiosum virus
gccggguguugaccaaagguc

SEQ ID NO: 3088863 - RNA, 19 nt, Molluscum contagiosum virus
caugaggcggcgcaggugc

SEQ ID NO: 3088864 - RNA, 20 nt, Molluscum contagiosum virus
ccauggagcgcccgcugcuc

SEQ ID NO: 3088865 - RNA, 21 nt, Molluscum contagiosum virus
cuacguguccgcauccgccuu

SEQ ID NO: 3088866 - RNA, 15 nt, Molluscum contagiosum virus
gcggccguggcacug

SEQ ID NO: 3088867 - RNA, 13 nt, Molluscum contagiosum virus
uugcgagccagcc

SEQ ID NO: 3088868 - RNA, 22 nt, Molluscum contagiosum virus
cgagcacggccgccaccgcgcg

SEQ ID NO: 3088869 - RNA, 22 nt, Molluscum contagiosum virus
aagcguuuucgucauggagcag

SEQ ID NO: 3088870 - RNA, 16 nt, Molluscum contagiosum virus
uggacgcacagggcug

SEQ ID NO: 3088871 - RNA, 20 nt, Molluscum contagiosum virus
ggcgcgccgaguacugcugc

SEQ ID NO: 3088872 - RNA, 19 nt, Molluscum contagiosum virus
aagauacuuccgguguccc

SEQ ID NO: 3088873 - RNA, 22 nt, Molluscum contagiosum virus
ccuucgcuugucgugcuuccug

SEQ ID NO: 3088874 - RNA, 16 nt, Molluscum contagiosum virus
gcggggcccucgagca

SEQ ID NO: 3088875 - RNA, 16 nt, Molluscum contagiosum virus
gacgugcugcugcaga

SEQ ID NO: 3088876 - RNA, 14 nt, Molluscum contagiosum virus
ccgcgcgugcaguu

SEQ ID NO: 3088877 - RNA, 17 nt, Molluscum contagiosum virus
ggucgcccuccgccgua

SEQ ID NO: 3088878 - RNA, 15 nt, Molluscum contagiosum virus
ggacagcucagcagg

SEQ ID NO: 3088879 - RNA, 15 nt, Molluscum contagiosum virus
gccgugacgcugcgg

SEQ ID NO: 3088880 - RNA, 19 nt, Molluscum contagiosum virus
gcugccaauaccaggccac

SEQ ID NO: 3088881 - RNA, 15 nt, Molluscum contagiosum virus
caaaggcaggggccg

SEQ ID NO: 3088882 - RNA, 16 nt, Molluscum contagiosum virus
gcacgaugcccagcag

SEQ ID NO: 3088883 - RNA, 12 nt, Molluscum contagiosum virus
cuccgcgcggcg

SEQ ID NO: 3088884 - RNA, 15 nt, Molluscum contagiosum virus
ucacaugugcugccg

SEQ ID NO: 3088885 - RNA, 24 nt, Molluscum contagiosum virus
ugcuucggcggcugugcccgcggc

SEQ ID NO: 3088886 - RNA, 13 nt, Molluscum contagiosum virus
cuucugccugccc

SEQ ID NO: 3088887 - RNA, 24 nt, Molluscum contagiosum virus
ugugaugauuugauggcugcucau

SEQ ID NO: 3088888 - RNA, 13 nt, Molluscum contagiosum virus
uugccgaggaggu

SEQ ID NO: 3088889 - RNA, 18 nt, Molluscum contagiosum virus
cccgcggcgugcccgucu

SEQ ID NO: 3088890 - RNA, 14 nt, Molluscum contagiosum virus
gcgagcacgccugc

SEQ ID NO: 3088891 - RNA, 19 nt, Molluscum contagiosum virus
ggcucugugcggacaugcc

SEQ ID NO: 3088892 - RNA, 13 nt, Molluscum contagiosum virus
gcggcaggcgcug

SEQ ID NO: 3088893 - RNA, 20 nt, Molluscum contagiosum virus
gaccucccgcccagcguggc

SEQ ID NO: 3088894 - RNA, 22 nt, Molluscum contagiosum virus
auggcucccgcacgcaccgcga

SEQ ID NO: 3088895 - RNA, 20 nt, Molluscum contagiosum virus
guucugcaucuucugccagg

SEQ ID NO: 3088896 - RNA, 15 nt, Molluscum contagiosum virus
gcucacggcugugga

SEQ ID NO: 3088897 - RNA, 16 nt, Molluscum contagiosum virus
ccugucgugcaauggc

SEQ ID NO: 3088898 - RNA, 20 nt, Molluscum contagiosum virus
cuucgcagaggacagcuccu

SEQ ID NO: 3088899 - RNA, 13 nt, Molluscum contagiosum virus
guccagcccgcgg

SEQ ID NO: 3088900 - RNA, 16 nt, Molluscum contagiosum virus
ucgcuggccucugccu

SEQ ID NO: 3088901 - RNA, 20 nt, Molluscum contagiosum virus
auggagcgcccgcugcucua

SEQ ID NO: 3088902 - RNA, 13 nt, Molluscum contagiosum virus
agacgagggaugc

SEQ ID NO: 3088903 - RNA, 13 nt, Molluscum contagiosum virus
cgcgcggacagcc

SEQ ID NO: 3088904 - RNA, 13 nt, Molluscum contagiosum virus
caucuccuugucu

SEQ ID NO: 3088905 - RNA, 17 nt, Molluscum contagiosum virus
gagcacaacgaacaugu

SEQ ID NO: 3088906 - RNA, 17 nt, Molluscum contagiosum virus
gccagccaucgugcgcg

SEQ ID NO: 3088907 - RNA, 14 nt, Molluscum contagiosum virus
uuccacgcuugcac

SEQ ID NO: 3088908 - RNA, 12 nt, Molluscum contagiosum virus
uguugaccaaag

SEQ ID NO: 3088909 - RNA, 16 nt, Molluscum contagiosum virus
gacggaggucugcuuu

SEQ ID NO: 3088910 - RNA, 19 nt, Molluscum contagiosum virus
gcuacgcgagcacugcgcg

SEQ ID NO: 3088911 - RNA, 16 nt, Molluscum contagiosum virus
ucgggcuagcaagcac

SEQ ID NO: 3088912 - RNA, 16 nt, Molluscum contagiosum virus
gcacaacaagaagacg

SEQ ID NO: 3088913 - RNA, 21 nt, Molluscum contagiosum virus
gcugcgccaggaaaggcagga

SEQ ID NO: 3088914 - RNA, 22 nt, Molluscum contagiosum virus
caucugccucguggaacaaaga

SEQ ID NO: 3088915 - RNA, 22 nt, Molluscum contagiosum virus
augagaauaaaauagcagagca

SEQ ID NO: 3088916 - RNA, 12 nt, Molluscum contagiosum virus
ugugagcaagcu

SEQ ID NO: 3088917 - RNA, 16 nt, Molluscum contagiosum virus
uggaagccgccagcca

SEQ ID NO: 3088918 - RNA, 16 nt, Molluscum contagiosum virus
gcgcagacgcggugga

SEQ ID NO: 3088919 - RNA, 13 nt, Molluscum contagiosum virus
aggcggccguguc

SEQ ID NO: 3088920 - RNA, 23 nt, Molluscum contagiosum virus
acgcgccagugcgugcacugucu

SEQ ID NO: 3088921 - RNA, 22 nt, Molluscum contagiosum virus
gccucggacggaggucugcuuu

SEQ ID NO: 3088922 - RNA, 19 nt, Molluscum contagiosum virus
auugcgucuuacugcugca

SEQ ID NO: 3088923 - RNA, 16 nt, Molluscum contagiosum virus
cacgcccgcgucccga

SEQ ID NO: 3088924 - RNA, 12 nt, Molluscum contagiosum virus
ucggggcuguca

SEQ ID NO: 3088925 - RNA, 13 nt, Molluscum contagiosum virus
ccagcggcugccc

SEQ ID NO: 3088926 - RNA, 14 nt, Molluscum contagiosum virus
cgugcuagcccgca

SEQ ID NO: 3088927 - RNA, 16 nt, Molluscum contagiosum virus
cgagggcgaguccccg

SEQ ID NO: 3088928 - RNA, 18 nt, Molluscum contagiosum virus
aggccggagacguaccca

SEQ ID NO: 3088929 - RNA, 18 nt, Molluscum contagiosum virus
gugccgggcuugcucccu

SEQ ID NO: 3088930 - RNA, 19 nt, Molluscum contagiosum virus
gccgcgcccgcggcgcacg

SEQ ID NO: 3088931 - RNA, 21 nt, Molluscum contagiosum virus
gugcucugugcgcgcagacgu

SEQ ID NO: 3088932 - RNA, 17 nt, Molluscum contagiosum virus
accgcguggacaacagc

SEQ ID NO: 3088933 - RNA, 17 nt, Molluscum contagiosum virus
cucgcgcucuacgccag

SEQ ID NO: 3088934 - RNA, 14 nt, Molluscum contagiosum virus
guggcgcaccugcu

SEQ ID NO: 3088935 - RNA, 13 nt, Molluscum contagiosum virus
ggcgugacagguc

SEQ ID NO: 3088936 - RNA, 20 nt, Molluscum contagiosum virus
ggccuguucggcaugcagcg

SEQ ID NO: 3088937 - RNA, 21 nt, Molluscum contagiosum virus
caaguacaacccaaacauguc

SEQ ID NO: 3088938 - RNA, 23 nt, Molluscum contagiosum virus
caccgggauggucucgcugcugg

SEQ ID NO: 3088939 - RNA, 20 nt, Molluscum contagiosum virus
caucaagcacggcuuccggc

SEQ ID NO: 3088940 - RNA, 19 nt, Molluscum contagiosum virus
gaggaacuagugcugcugg

SEQ ID NO: 3088941 - RNA, 17 nt, Molluscum contagiosum virus
ccgcgauucugcucuuu

SEQ ID NO: 3088942 - RNA, 12 nt, Molluscum contagiosum virus
gcaccugcagga

SEQ ID NO: 3088943 - RNA, 13 nt, Molluscum contagiosum virus
gcucgaggcgacg

SEQ ID NO: 3088944 - RNA, 22 nt, Molluscum contagiosum virus
ccgagcaacucgcgagagacac

SEQ ID NO: 3088945 - RNA, 17 nt, Molluscum contagiosum virus
gcucggaggcuugcccc

SEQ ID NO: 3088946 - RNA, 14 nt, Molluscum contagiosum virus
aucucugcgccgcg

SEQ ID NO: 3088947 - RNA, 14 nt, Molluscum contagiosum virus
accaccgcuggggc

SEQ ID NO: 3088948 - RNA, 16 nt, Molluscum contagiosum virus
cgcagcgcgagcugug

SEQ ID NO: 3088949 - RNA, 13 nt, Molluscum contagiosum virus
cgcuugaaggacg

SEQ ID NO: 3088950 - RNA, 20 nt, Molluscum contagiosum virus
cuucccgcugagcgcagcac

SEQ ID NO: 3088951 - RNA, 21 nt, Molluscum contagiosum virus
ugccaccaugcgcacagcacu

SEQ ID NO: 3088952 - RNA, 18 nt, Molluscum contagiosum virus
cuagccuccuugucuucc

SEQ ID NO: 3088953 - RNA, 20 nt, Molluscum contagiosum virus
acgccgaccauuuccugcga

SEQ ID NO: 3088954 - RNA, 22 nt, Molluscum contagiosum virus
uugcugggcacaagcuuucuca

SEQ ID NO: 3088955 - RNA, 12 nt, Molluscum contagiosum virus
gaagaggucucu

SEQ ID NO: 3088956 - RNA, 21 nt, Molluscum contagiosum virus
cgggcauguccuuggcggugc

SEQ ID NO: 3088957 - RNA, 18 nt, Molluscum contagiosum virus
cacggcacccgccagcuu

SEQ ID NO: 3088958 - RNA, 12 nt, Molluscum contagiosum virus
cgaccugcugcg

SEQ ID NO: 3088959 - RNA, 16 nt, Molluscum contagiosum virus
cguggacgaggccaac

SEQ ID NO: 3088960 - RNA, 15 nt, Molluscum contagiosum virus
cugcauccuggggaa

SEQ ID NO: 3088961 - RNA, 23 nt, Molluscum contagiosum virus
aggaguagcgugcgccugcagcc

SEQ ID NO: 3088962 - RNA, 15 nt, Molluscum contagiosum virus
augcccgcaaugcaa

SEQ ID NO: 3088963 - RNA, 17 nt, Molluscum contagiosum virus
cuggccgaggucuucca

SEQ ID NO: 3088964 - RNA, 16 nt, Molluscum contagiosum virus
uuggacgagcugcuuc

SEQ ID NO: 3088965 - RNA, 15 nt, Molluscum contagiosum virus
ggcggaaguggugcc

SEQ ID NO: 3088966 - RNA, 21 nt, Molluscum contagiosum virus
agagcacugcgcgucugugcg

SEQ ID NO: 3088967 - RNA, 21 nt, Molluscum contagiosum virus
gcugcccccgccaugccaacg

SEQ ID NO: 3088968 - RNA, 22 nt, Molluscum contagiosum virus
gagcaaugcgagcaaggcgcgc

SEQ ID NO: 3088969 - RNA, 13 nt, Molluscum contagiosum virus
cgguccuguccgc

SEQ ID NO: 3088970 - RNA, 14 nt, Molluscum contagiosum virus
aaguaccagccgcu

SEQ ID NO: 3088971 - RNA, 19 nt, Molluscum contagiosum virus
cgcaacacggcggugcccg

SEQ ID NO: 3088972 - RNA, 16 nt, Molluscum contagiosum virus
cucgcgcaucugccgc

SEQ ID NO: 3088973 - RNA, 13 nt, Molluscum contagiosum virus
gccccugcugcuc

SEQ ID NO: 3088974 - RNA, 14 nt, Molluscum contagiosum virus
cucgcgagcgccac

SEQ ID NO: 3088975 - RNA, 18 nt, Molluscum contagiosum virus
gugccuggcagugccggg

SEQ ID NO: 3088976 - RNA, 15 nt, Molluscum contagiosum virus
accagcucgcgcagu

SEQ ID NO: 3088977 - RNA, 14 nt, Molluscum contagiosum virus
cauggcgccacacc

SEQ ID NO: 3088978 - RNA, 23 nt, Molluscum contagiosum virus
gagcacgacuacggcgagcccau

SEQ ID NO: 3088979 - RNA, 16 nt, Molluscum contagiosum virus
cagaucgcgagaggag

SEQ ID NO: 3088980 - RNA, 11 nt, Molluscum contagiosum virus
guugccaggca

SEQ ID NO: 3088981 - RNA, 14 nt, Molluscum contagiosum virus
cggaagcuccugcu

SEQ ID NO: 3088982 - RNA, 22 nt, Molluscum contagiosum virus
ccucgcaagcugagcgcgcugc

SEQ ID NO: 3088983 - RNA, 22 nt, Molluscum contagiosum virus
ccucgucgaucauguccacagc

SEQ ID NO: 3088984 - RNA, 21 nt, Molluscum contagiosum virus
cugcacgugcagcggcgccac

SEQ ID NO: 3088985 - RNA, 19 nt, Molluscum contagiosum virus
caggaaaggcaccccgcag

SEQ ID NO: 3088986 - RNA, 18 nt, Molluscum contagiosum virus
cgauacccuuggcagcaa

SEQ ID NO: 3088987 - RNA, 16 nt, Molluscum contagiosum virus
gcucgcacggcgacuc

SEQ ID NO: 3088988 - RNA, 16 nt, Molluscum contagiosum virus
cgaacaccuccugcuu

SEQ ID NO: 3088989 - RNA, 14 nt, Molluscum contagiosum virus
acgagcaguccgcc

SEQ ID NO: 3088990 - RNA, 16 nt, Molluscum contagiosum virus
gcaccgagcaagcugg

SEQ ID NO: 3088991 - RNA, 20 nt, Molluscum contagiosum virus
cuguaaauggaccacaagca

SEQ ID NO: 3088992 - RNA, 17 nt, Molluscum contagiosum virus
cagcggcaaaggcccgc

SEQ ID NO: 3088993 - RNA, 23 nt, Molluscum contagiosum virus
gcgugucgguaugcgaggccugc

SEQ ID NO: 3088994 - RNA, 22 nt, Molluscum contagiosum virus
ggguaguugcgagccagccagg

SEQ ID NO: 3088995 - RNA, 23 nt, Molluscum contagiosum virus
cgaggccaaccuccugcaccugc

SEQ ID NO: 3088996 - RNA, 22 nt, Molluscum contagiosum virus
cccugauguuccgcgugagagc

SEQ ID NO: 3088997 - RNA, 19 nt, Molluscum contagiosum virus
uucguggagcccgugcugg

SEQ ID NO: 3088998 - RNA, 15 nt, Molluscum contagiosum virus
ugcaagcccagcagc

SEQ ID NO: 3088999 - RNA, 19 nt, Molluscum contagiosum virus
ucaacgcgcgcgugcuguc

SEQ ID NO: 3089000 - RNA, 22 nt, Molluscum contagiosum virus
cacaagggcagcucaagcugcu

SEQ ID NO: 3089001 - RNA, 17 nt, Molluscum contagiosum virus
uacuucgucaagcagcg

SEQ ID NO: 3089002 - RNA, 15 nt, Molluscum contagiosum virus
cgcaacacugcagaa

SEQ ID NO: 3089003 - RNA, 13 nt, Molluscum contagiosum virus
aagacaacacucg

SEQ ID NO: 3089004 - RNA, 19 nt, Molluscum contagiosum virus
augcccgcaaugcaagccc

SEQ ID NO: 3089005 - RNA, 16 nt, Molluscum contagiosum virus
gagcgcguccaugagc

SEQ ID NO: 3089006 - RNA, 18 nt, Molluscum contagiosum virus
agccgcguagcuagcucu

SEQ ID NO: 3089007 - RNA, 15 nt, Molluscum contagiosum virus
gaggaacuagugcug

SEQ ID NO: 3089008 - RNA, 17 nt, Molluscum contagiosum virus
cgccgauguccugcgga

SEQ ID NO: 3089009 - RNA, 20 nt, Molluscum contagiosum virus
ccugucaucaccccgcuggg

SEQ ID NO: 3089010 - RNA, 13 nt, Molluscum contagiosum virus
cccgaacugcugg

SEQ ID NO: 3089011 - RNA, 23 nt, Molluscum contagiosum virus
cugggcgguugccugcacaagca

SEQ ID NO: 3089012 - RNA, 23 nt, Molluscum contagiosum virus
ucaccaucaacaucuacaaggag

SEQ ID NO: 3089013 - RNA, 17 nt, Molluscum contagiosum virus
cucggacggaggucugc

SEQ ID NO: 3089014 - RNA, 23 nt, Molluscum contagiosum virus
gacgccccaaaagugaagaucaa

SEQ ID NO: 3089015 - RNA, 18 nt, Molluscum contagiosum virus
cggagaacaugcucgcca

SEQ ID NO: 3089016 - RNA, 16 nt, Molluscum contagiosum virus
cggacaagacaacacu

SEQ ID NO: 3089017 - RNA, 12 nt, Molluscum contagiosum virus
cgagcugccaug

SEQ ID NO: 3089018 - RNA, 16 nt, Molluscum contagiosum virus
ucgcgcgugcgcagca

SEQ ID NO: 3089019 - RNA, 14 nt, Molluscum contagiosum virus
agugcugcugggcg

SEQ ID NO: 3089020 - RNA, 22 nt, Molluscum contagiosum virus
gcgcccaccagcagccaggcua

SEQ ID NO: 3089021 - RNA, 22 nt, Molluscum contagiosum virus
gcuuuuugccgcucacagcuuc

SEQ ID NO: 3089022 - RNA, 19 nt, Molluscum contagiosum virus
acgaacauguccaaggagc

SEQ ID NO: 3089023 - RNA, 18 nt, Molluscum contagiosum virus
agcgcgccucucgaggcc

SEQ ID NO: 3089024 - RNA, 13 nt, Molluscum contagiosum virus
cggcugcugccug

SEQ ID NO: 3089025 - RNA, 21 nt, Molluscum contagiosum virus
gccuggccgaacugcucugcg

SEQ ID NO: 3089026 - RNA, 16 nt, Molluscum contagiosum virus
cguacgagcaggcgca

SEQ ID NO: 3089027 - RNA, 14 nt, Molluscum contagiosum virus
caagcggugcagcu

SEQ ID NO: 3089028 - RNA, 11 nt, Molluscum contagiosum virus
caacuuccaca

SEQ ID NO: 3089029 - RNA, 13 nt, Molluscum contagiosum virus
ugcguuccgggcc

SEQ ID NO: 3089030 - RNA, 17 nt, Molluscum contagiosum virus
acgcuguugcugcugcc

SEQ ID NO: 3089031 - RNA, 15 nt, Molluscum contagiosum virus
gcuccggcugcuccu

SEQ ID NO: 3089032 - RNA, 21 nt, Molluscum contagiosum virus
gugcuggucaacagcuacacc

SEQ ID NO: 3089033 - RNA, 21 nt, Molluscum contagiosum virus
ucguuccacgauggaacggcg

SEQ ID NO: 3089034 - RNA, 17 nt, Molluscum contagiosum virus
ccgagcaauugcugggc

SEQ ID NO: 3089035 - RNA, 14 nt, Molluscum contagiosum virus
cguccccucuccgg

SEQ ID NO: 3089036 - RNA, 17 nt, Molluscum contagiosum virus
cgugcugcccguggugg

SEQ ID NO: 3089037 - RNA, 22 nt, Molluscum contagiosum virus
gcgcacgcgggacgcgugccug

SEQ ID NO: 3089038 - RNA, 11 nt, Molluscum contagiosum virus
gaagcuuucag

SEQ ID NO: 3089039 - RNA, 15 nt, Molluscum contagiosum virus
ccgcgcccucgcucg

SEQ ID NO: 3089040 - RNA, 23 nt, Molluscum contagiosum virus
cuccuacacauuccucggcgcac

SEQ ID NO: 3089041 - RNA, 19 nt, Molluscum contagiosum virus
gacacaaggaucucugccc

SEQ ID NO: 3089042 - RNA, 23 nt, Molluscum contagiosum virus
ugccgcgccuugagcgcgccgcg

SEQ ID NO: 3089043 - RNA, 23 nt, Molluscum contagiosum virus
ccgcuggaccccgagcugcggcg

SEQ ID NO: 3089044 - RNA, 14 nt, Molluscum contagiosum virus
cugugcgagccagu

SEQ ID NO: 3089045 - RNA, 23 nt, Molluscum contagiosum virus
cgagcaggucaucgggcugcagc

SEQ ID NO: 3089046 - RNA, 21 nt, Molluscum contagiosum virus
acaaacacgcgcgcgcgaagg

SEQ ID NO: 3089047 - RNA, 13 nt, Molluscum contagiosum virus
cagccaugugucu

SEQ ID NO: 3089048 - RNA, 15 nt, Molluscum contagiosum virus
cggucucggcagcag

SEQ ID NO: 3089049 - RNA, 23 nt, Molluscum contagiosum virus
cucgagcuuccucaaggcgcacg

SEQ ID NO: 3089050 - RNA, 15 nt, Molluscum contagiosum virus
gccgcgugcucugcu

SEQ ID NO: 3089051 - RNA, 22 nt, Molluscum contagiosum virus
ggcgugcgccgugcgucucucu

SEQ ID NO: 3089052 - RNA, 12 nt, Molluscum contagiosum virus
ccgccugcaugu

SEQ ID NO: 3089053 - RNA, 14 nt, Molluscum contagiosum virus
gcuaccugaagcug

SEQ ID NO: 3089054 - RNA, 17 nt, Molluscum contagiosum virus
cacgggcgggacagaca

SEQ ID NO: 3089055 - RNA, 17 nt, Molluscum contagiosum virus
gaggaacuagugcugcu

SEQ ID NO: 3089056 - RNA, 16 nt, Molluscum contagiosum virus
ugcguggacagcaucc

SEQ ID NO: 3089057 - RNA, 19 nt, Molluscum contagiosum virus
cacgaacgacagcgccgcc

SEQ ID NO: 3089058 - RNA, 23 nt, Molluscum contagiosum virus
aggaacgaggaaaggcacacccc

SEQ ID NO: 3089059 - RNA, 19 nt, Molluscum contagiosum virus
agaucaaccgcaaggaaaa

SEQ ID NO: 3089060 - RNA, 19 nt, Molluscum contagiosum virus
gcgcugcgccgcuuccugg

SEQ ID NO: 3089061 - RNA, 12 nt, Molluscum contagiosum virus
uccuuguccugg

SEQ ID NO: 3089062 - RNA, 18 nt, Molluscum contagiosum virus
uucaugugcgagaacugg

SEQ ID NO: 3089063 - RNA, 14 nt, Molluscum contagiosum virus
cuacuacacugucg

SEQ ID NO: 3089064 - RNA, 17 nt, Molluscum contagiosum virus
aacagagaaaggcaccc

SEQ ID NO: 3089065 - RNA, 21 nt, Molluscum contagiosum virus
ugccgcucgcaagaguucaaa

SEQ ID NO: 3089066 - RNA, 21 nt, Molluscum contagiosum virus
cccgaggucaagggugugggc

SEQ ID NO: 3089067 - RNA, 22 nt, Molluscum contagiosum virus
aaagacgagcugugcgagccag

SEQ ID NO: 3089068 - RNA, 21 nt, Molluscum contagiosum virus
gcccgcgcugcgcaagcgcua

SEQ ID NO: 3089069 - RNA, 14 nt, Molluscum contagiosum virus
gcgagccagccagg

SEQ ID NO: 3089070 - RNA, 22 nt, Molluscum contagiosum virus
gaucuuugcuguggaaaacugu

SEQ ID NO: 3089071 - RNA, 23 nt, Molluscum contagiosum virus
agggcagaacaguaacugcugca

SEQ ID NO: 3089072 - RNA, 14 nt, Molluscum contagiosum virus
gacgagcugcuucg

SEQ ID NO: 3089073 - RNA, 22 nt, Molluscum contagiosum virus
gagcacguuccaaaagacagag

SEQ ID NO: 3089074 - RNA, 13 nt, Molluscum contagiosum virus
acgagcugcugcc

SEQ ID NO: 3089075 - RNA, 13 nt, Molluscum contagiosum virus
cucgccgcacgcg

SEQ ID NO: 3089076 - RNA, 20 nt, Molluscum contagiosum virus
caccugcaggaaaggcaccc

SEQ ID NO: 3089077 - RNA, 12 nt, Molluscum contagiosum virus
cacgacucucaa

SEQ ID NO: 3089078 - RNA, 14 nt, Molluscum contagiosum virus
ucaccaccaccucc

SEQ ID NO: 3089079 - RNA, 18 nt, Molluscum contagiosum virus
ccccgguucccggugcug

SEQ ID NO: 3089080 - RNA, 15 nt, Molluscum contagiosum virus
cgcggagaccaccgc

SEQ ID NO: 3089081 - RNA, 20 nt, Molluscum contagiosum virus
caagcaccgccugcugcagc

SEQ ID NO: 3089082 - RNA, 18 nt, Molluscum contagiosum virus
ggcuuuauuuccggcucc

SEQ ID NO: 3089083 - RNA, 14 nt, Molluscum contagiosum virus
cacuuccgcgcgcu

SEQ ID NO: 3089084 - RNA, 20 nt, Molluscum contagiosum virus
uucucgcagcguuccaggaa

SEQ ID NO: 3089085 - RNA, 15 nt, Molluscum contagiosum virus
cugucgugcaauggc

SEQ ID NO: 3089086 - RNA, 18 nt, Molluscum contagiosum virus
accucgagaagaccuguu

SEQ ID NO: 3089087 - RNA, 17 nt, Molluscum contagiosum virus
gugcgucucccaggaag

SEQ ID NO: 3089088 - RNA, 19 nt, Molluscum contagiosum virus
gaagcaagacccagcaagg

SEQ ID NO: 3089089 - RNA, 19 nt, Molluscum contagiosum virus
cuccggucgcccuccgccg

SEQ ID NO: 3089090 - RNA, 18 nt, Molluscum contagiosum virus
ugaggaggcggcacugcu

SEQ ID NO: 3089091 - RNA, 17 nt, Molluscum contagiosum virus
guuccacuacaagcagc

SEQ ID NO: 3089092 - RNA, 24 nt, Molluscum contagiosum virus
gcagcaccgcacgccagcagcaga

SEQ ID NO: 3089093 - RNA, 23 nt, Molluscum contagiosum virus
acauggacgugcugcuggcccug

SEQ ID NO: 3089094 - RNA, 17 nt, Molluscum contagiosum virus
cgcccgugcuugcgcac

SEQ ID NO: 3089095 - RNA, 19 nt, Molluscum contagiosum virus
gcaccgccugcugcagcuc

SEQ ID NO: 3089096 - RNA, 23 nt, Molluscum contagiosum virus
ucaugagccagucucgcgcuucc

SEQ ID NO: 3089097 - RNA, 17 nt, Molluscum contagiosum virus
cagcgagcucaaggaca

SEQ ID NO: 3089098 - RNA, 22 nt, Molluscum contagiosum virus
cccaccagcagccaggcuaggc

SEQ ID NO: 3089099 - RNA, 19 nt, Molluscum contagiosum virus
cgcggcccgcgggcugcaa

SEQ ID NO: 3089100 - RNA, 12 nt, Molluscum contagiosum virus
cgugacggugcu

SEQ ID NO: 3089101 - RNA, 16 nt, Molluscum contagiosum virus
cgcauuggcagcgcuu

SEQ ID NO: 3089102 - RNA, 14 nt, Molluscum contagiosum virus
gaggucuagccgug

SEQ ID NO: 3089103 - RNA, 18 nt, Molluscum contagiosum virus
agaaggagcccuugccac

SEQ ID NO: 3089104 - RNA, 19 nt, Molluscum contagiosum virus
gaacgcgccgcggaugucc

SEQ ID NO: 3089105 - RNA, 23 nt, Molluscum contagiosum virus
ccuagagcuggcaccgggcgccg

SEQ ID NO: 3089106 - RNA, 15 nt, Molluscum contagiosum virus
gccuguaccugcucg

SEQ ID NO: 3089107 - RNA, 22 nt, Molluscum contagiosum virus
cccucgagcaaugcgagcaagg

SEQ ID NO: 3089108 - RNA, 17 nt, Molluscum contagiosum virus
cugcugcggcugcugga

SEQ ID NO: 3089109 - RNA, 22 nt, Molluscum contagiosum virus
gcuugcuucggcggcugugccc

SEQ ID NO: 3089110 - RNA, 21 nt, Molluscum contagiosum virus
cucgcugcugcucuuccagga

SEQ ID NO: 3089111 - RNA, 20 nt, Molluscum contagiosum virus
ggccacgcacucgcuggccu

SEQ ID NO: 3089112 - RNA, 14 nt, Molluscum contagiosum virus
acgccgcuggagca

SEQ ID NO: 3089113 - RNA, 21 nt, Molluscum contagiosum virus
cucguguguccgcacgcacac

SEQ ID NO: 3089114 - RNA, 20 nt, Molluscum contagiosum virus
acgucuuccccaagaccugc

SEQ ID NO: 3089115 - RNA, 22 nt, Molluscum contagiosum virus
cgcgaaagaggaaagcgcacac

SEQ ID NO: 3089116 - RNA, 12 nt, Molluscum contagiosum virus
gcuaugcuuugc

SEQ ID NO: 3089117 - RNA, 18 nt, Molluscum contagiosum virus
ccaacacguuuucuuuca

SEQ ID NO: 3089118 - RNA, 16 nt, Molluscum contagiosum virus
cuuaacucagcgggca

SEQ ID NO: 3089119 - RNA, 16 nt, Molluscum contagiosum virus
ugcuacgcgagcacug

SEQ ID NO: 3089120 - RNA, 20 nt, Molluscum contagiosum virus
cgcgaccuacuccuggccaa

SEQ ID NO: 3089121 - RNA, 19 nt, Molluscum contagiosum virus
gcagaccaagaagcccgag

SEQ ID NO: 3089122 - RNA, 23 nt, Molluscum contagiosum virus
caagcacgcaacgucgcacuggc

SEQ ID NO: 3089123 - RNA, 20 nt, Molluscum contagiosum virus
acuaccgcaaccagcugcug

SEQ ID NO: 3089124 - RNA, 16 nt, Molluscum contagiosum virus
cacaaagcccuccuga

SEQ ID NO: 3089125 - RNA, 11 nt, Molluscum contagiosum virus
ugcgcgccgcg

SEQ ID NO: 3089126 - RNA, 19 nt, Molluscum contagiosum virus
agucacacuacgcuggcuc

SEQ ID NO: 3089127 - RNA, 17 nt, Molluscum contagiosum virus
gcgcuuguagccgcgac

SEQ ID NO: 3089128 - RNA, 14 nt, Molluscum contagiosum virus
guuacggagaccug

SEQ ID NO: 3089129 - RNA, 23 nt, Molluscum contagiosum virus
ugcgcaccgcgggcuggacugug

SEQ ID NO: 3089130 - RNA, 16 nt, Molluscum contagiosum virus
cucaagcacugccuca

SEQ ID NO: 3089131 - RNA, 21 nt, Molluscum contagiosum virus
cacgcucauacuccugcuggc

SEQ ID NO: 3089132 - RNA, 14 nt, Molluscum contagiosum virus
ucacugcagcagcc

SEQ ID NO: 3089133 - RNA, 22 nt, Molluscum contagiosum virus
aggcgcggucgcccgccgagcu

SEQ ID NO: 3089134 - RNA, 16 nt, Molluscum contagiosum virus
acuugcgcgccuguca

SEQ ID NO: 3089135 - RNA, 22 nt, Molluscum contagiosum virus
acaacuccggcgucgaaacacu

SEQ ID NO: 3089136 - RNA, 11 nt, Molluscum contagiosum virus
uugcacgugcg

SEQ ID NO: 3089137 - RNA, 18 nt, Molluscum contagiosum virus
uggaggcgcuagugcaga

SEQ ID NO: 3089138 - RNA, 20 nt, Molluscum contagiosum virus
ggccugcugaagaaggagcc

SEQ ID NO: 3089139 - RNA, 21 nt, Molluscum contagiosum virus
ccgcgcuggcgcgcgcgcugc

SEQ ID NO: 3089140 - RNA, 20 nt, Molluscum contagiosum virus
cgccagcgacgagcagcugc

SEQ ID NO: 3089141 - RNA, 23 nt, Molluscum contagiosum virus
ucgcgaucugcgugacccucuuc

SEQ ID NO: 3089142 - RNA, 17 nt, Molluscum contagiosum virus
agccuuuuggcggcgca

SEQ ID NO: 3089143 - RNA, 14 nt, Molluscum contagiosum virus
cggccgugcagagc

SEQ ID NO: 3089144 - RNA, 14 nt, Molluscum contagiosum virus
cgagcgccagccug

SEQ ID NO: 3089145 - RNA, 15 nt, Molluscum contagiosum virus
gccagcuccgcgcgg

SEQ ID NO: 3089146 - RNA, 12 nt, Molluscum contagiosum virus
accgggcucucg

SEQ ID NO: 3089147 - RNA, 22 nt, Molluscum contagiosum virus
ucgccagcaucaagggcaaggg

SEQ ID NO: 3089148 - RNA, 22 nt, Molluscum contagiosum virus
uguucccggcugccgcugccug

SEQ ID NO: 3089149 - RNA, 17 nt, Molluscum contagiosum virus
cggcgcgugcugagcua

SEQ ID NO: 3089150 - RNA, 21 nt, Molluscum contagiosum virus
gacccgccggugcuugggcuc

SEQ ID NO: 3089151 - RNA, 20 nt, Molluscum contagiosum virus
gacgcugcaagacggaagac

SEQ ID NO: 3089152 - RNA, 13 nt, Molluscum contagiosum virus
cucgggcugcgcg

SEQ ID NO: 3089153 - RNA, 17 nt, Molluscum contagiosum virus
gcgcuguauucggcgua

SEQ ID NO: 3089154 - RNA, 15 nt, Molluscum contagiosum virus
ggcgcguugcucccg

SEQ ID NO: 3089155 - RNA, 16 nt, Molluscum contagiosum virus
ugaaaauaaagaggcu

SEQ ID NO: 3089156 - RNA, 21 nt, Molluscum contagiosum virus
cgcguccgcaucggcgccgcc

SEQ ID NO: 3089157 - RNA, 17 nt, Molluscum contagiosum virus
cuggcgcgguccagccg

SEQ ID NO: 3089158 - RNA, 14 nt, Molluscum contagiosum virus
gaggacuaccuggc

SEQ ID NO: 3089159 - RNA, 12 nt, Molluscum contagiosum virus
uccggcagcugg

SEQ ID NO: 3089160 - RNA, 12 nt, Molluscum contagiosum virus
acagagcccgcg

SEQ ID NO: 3089161 - RNA, 16 nt, Molluscum contagiosum virus
gcacgcgcgggcgcag

SEQ ID NO: 3089162 - RNA, 15 nt, Molluscum contagiosum virus
agcugugcaagagcu

SEQ ID NO: 3089163 - RNA, 13 nt, Molluscum contagiosum virus
cugagcgcgcugc

SEQ ID NO: 3089164 - RNA, 14 nt, Molluscum contagiosum virus
cggccgcguugcag

SEQ ID NO: 3089165 - RNA, 20 nt, Molluscum contagiosum virus
uccgcacuuuaaaaggccgg

SEQ ID NO: 3089166 - RNA, 14 nt, Molluscum contagiosum virus
ucggcguuggccac

SEQ ID NO: 3089167 - RNA, 23 nt, Molluscum contagiosum virus
gugggugaggagcucgacucgag

SEQ ID NO: 3089168 - RNA, 20 nt, Molluscum contagiosum virus
gcgcucuacgagacucugga

SEQ ID NO: 3089169 - RNA, 13 nt, Molluscum contagiosum virus
cacccgcgccgcg

SEQ ID NO: 3089170 - RNA, 20 nt, Molluscum contagiosum virus
ggagcguccacgacgagccu

SEQ ID NO: 3089171 - RNA, 17 nt, Molluscum contagiosum virus
ccgcaggaaaggcaccc

SEQ ID NO: 3089172 - RNA, 22 nt, Molluscum contagiosum virus
ugcgcuuagaccuuuacgucgc

SEQ ID NO: 3089173 - RNA, 23 nt, Molluscum contagiosum virus
aguucucgggcucgggcaggucg

SEQ ID NO: 3089174 - RNA, 14 nt, Molluscum contagiosum virus
cgcggaugcgaccg

SEQ ID NO: 3089175 - RNA, 18 nt, Molluscum contagiosum virus
caugcucucgcugcugcc

SEQ ID NO: 3089176 - RNA, 21 nt, Molluscum contagiosum virus
acuacauggacgugcugcugg

SEQ ID NO: 3089177 - RNA, 17 nt, Molluscum contagiosum virus
cuggcgcgugcgagcag

SEQ ID NO: 3089178 - RNA, 17 nt, Molluscum contagiosum virus
cuucgucaagcagcgcg

SEQ ID NO: 3089179 - RNA, 16 nt, Molluscum contagiosum virus
cugcaccgagugcugg

SEQ ID NO: 3089180 - RNA, 13 nt, Molluscum contagiosum virus
cuccugagaagca

SEQ ID NO: 3089181 - RNA, 10 nt, Molluscum contagiosum virus
gccugcacug

SEQ ID NO: 3089182 - RNA, 14 nt, Molluscum contagiosum virus
acacgucuugcaga

SEQ ID NO: 3089183 - RNA, 18 nt, Molluscum contagiosum virus
cucuuccccgcgggccgc

SEQ ID NO: 3089184 - RNA, 15 nt, Molluscum contagiosum virus
ccaguaccugcugcc

SEQ ID NO: 3089185 - RNA, 16 nt, Molluscum contagiosum virus
cugcauacacuuccug

SEQ ID NO: 3089186 - RNA, 21 nt, Molluscum contagiosum virus
ggcacggcacccgccagcuuu

SEQ ID NO: 3089187 - RNA, 23 nt, Molluscum contagiosum virus
ccauggcgagcuagugcacaccg

SEQ ID NO: 3089188 - RNA, 18 nt, Molluscum contagiosum virus
cuggcgagcgcucugcau

SEQ ID NO: 3089189 - RNA, 16 nt, Molluscum contagiosum virus
ggcgcgcagcucgccg

SEQ ID NO: 3089190 - RNA, 13 nt, Molluscum contagiosum virus
gacagcuugcugc

SEQ ID NO: 3089191 - RNA, 15 nt, Molluscum contagiosum virus
ugcgcagcauccucg

SEQ ID NO: 3089192 - RNA, 20 nt, Molluscum contagiosum virus
cgaggccugcguggacagca

SEQ ID NO: 3089193 - RNA, 23 nt, Molluscum contagiosum virus
ggcccuuuucuaggccucagccg

SEQ ID NO: 3089194 - RNA, 20 nt, Molluscum contagiosum virus
uggaacggcgacuuguagug

SEQ ID NO: 3089195 - RNA, 24 nt, Molluscum contagiosum virus
ccgcaguaccaguaccugcugccg

SEQ ID NO: 3089196 - RNA, 16 nt, Molluscum contagiosum virus
gacgcucaacgugggc

SEQ ID NO: 3089197 - RNA, 13 nt, Molluscum contagiosum virus
cgcgcgugcaguu

SEQ ID NO: 3089198 - RNA, 20 nt, Molluscum contagiosum virus
gacuaccuggcggcgcugga

SEQ ID NO: 3089199 - RNA, 18 nt, Molluscum contagiosum virus
gcagcugccgcagagccg

SEQ ID NO: 3089200 - RNA, 17 nt, Molluscum contagiosum virus
cccaggcgcgcgcucag

SEQ ID NO: 3089201 - RNA, 16 nt, Molluscum contagiosum virus
cacacacuugcucucu

SEQ ID NO: 3089202 - RNA, 21 nt, Molluscum contagiosum virus
ccgcgcccaagaagaagcagc

SEQ ID NO: 3089203 - RNA, 21 nt, Molluscum contagiosum virus
agcggugcagcuacugcgugc

SEQ ID NO: 3089204 - RNA, 19 nt, Molluscum contagiosum virus
gccgggcgucuccgcgcgg

SEQ ID NO: 3089205 - RNA, 23 nt, Molluscum contagiosum virus
agggcguccguaagucgaagagg

SEQ ID NO: 3089206 - RNA, 13 nt, Molluscum contagiosum virus
gagcugcagagcg

SEQ ID NO: 3089207 - RNA, 15 nt, Molluscum contagiosum virus
cugcuggcggggaaa

SEQ ID NO: 3089208 - RNA, 14 nt, Molluscum contagiosum virus
auacacuuccugcu

SEQ ID NO: 3089209 - RNA, 21 nt, Molluscum contagiosum virus
ggcgccgacaacgugcugcuc

SEQ ID NO: 3089210 - RNA, 18 nt, Molluscum contagiosum virus
cuaccuggugcuggggcu

SEQ ID NO: 3089211 - RNA, 19 nt, Molluscum contagiosum virus
gauucacuuucgucgccuc

SEQ ID NO: 3089212 - RNA, 14 nt, Molluscum contagiosum virus
ggcaugggcaagga

SEQ ID NO: 3089213 - RNA, 13 nt, Molluscum contagiosum virus
gagccagccaggc

SEQ ID NO: 3089214 - RNA, 13 nt, Molluscum contagiosum virus
cgcaggccaggug

SEQ ID NO: 3089215 - RNA, 19 nt, Molluscum contagiosum virus
cggagagcuccggcugcuc

SEQ ID NO: 3089216 - RNA, 15 nt, Molluscum contagiosum virus
cgcacaagggcagcu

SEQ ID NO: 3089217 - RNA, 18 nt, Molluscum contagiosum virus
ugcggaugugcuagcugc

SEQ ID NO: 3089218 - RNA, 20 nt, Molluscum contagiosum virus
gacuccaucugcgcgacgcc

SEQ ID NO: 3089219 - RNA, 14 nt, Molluscum contagiosum virus
cugcuggagcuagc

SEQ ID NO: 3089220 - RNA, 18 nt, Molluscum contagiosum virus
ugcaggucgaggagggcg

SEQ ID NO: 3089221 - RNA, 20 nt, Molluscum contagiosum virus
ccggcccgacacacuccugu

SEQ ID NO: 3089222 - RNA, 20 nt, Molluscum contagiosum virus
uccgcucgugccacugccgc

SEQ ID NO: 3089223 - RNA, 16 nt, Molluscum contagiosum virus
cucuucggggacggcg

SEQ ID NO: 3089224 - RNA, 12 nt, Molluscum contagiosum virus
gaccagcucuug

SEQ ID NO: 3089225 - RNA, 22 nt, Molluscum contagiosum virus
cccuuucgcggauucccauucc

SEQ ID NO: 3089226 - RNA, 14 nt, Molluscum contagiosum virus
ccagcuccgccggg

SEQ ID NO: 3089227 - RNA, 15 nt, Molluscum contagiosum virus
guucuggacgugucc

SEQ ID NO: 3089228 - RNA, 16 nt, Molluscum contagiosum virus
ucuacgagacucugga

SEQ ID NO: 3089229 - RNA, 13 nt, Molluscum contagiosum virus
auagugggcuugc

SEQ ID NO: 3089230 - RNA, 20 nt, Molluscum contagiosum virus
cgacuagcgugcgcagcauu

SEQ ID NO: 3089231 - RNA, 17 nt, Molluscum contagiosum virus
gaagcccgucggggcag

SEQ ID NO: 3089232 - RNA, 18 nt, Molluscum contagiosum virus
cgugacggugcugcgcac

SEQ ID NO: 3089233 - RNA, 22 nt, Molluscum contagiosum virus
ugaggcagugcuugagcaucuc

SEQ ID NO: 3089234 - RNA, 18 nt, Molluscum contagiosum virus
gcucgcacccgcgccgcg

SEQ ID NO: 3089235 - RNA, 22 nt, Molluscum contagiosum virus
ugcucaaggacuaccagcucuu

SEQ ID NO: 3089236 - RNA, 17 nt, Molluscum contagiosum virus
cucacucacaugugcug

SEQ ID NO: 3089237 - RNA, 18 nt, Molluscum contagiosum virus
cgcggcacaugcagcugc

SEQ ID NO: 3089238 - RNA, 15 nt, Molluscum contagiosum virus
cacuucggacaccuc

SEQ ID NO: 3089239 - RNA, 16 nt, Molluscum contagiosum virus
acagccccugcugcuc

SEQ ID NO: 3089240 - RNA, 17 nt, Molluscum contagiosum virus
cgcugcgccgcuuccug

SEQ ID NO: 3089241 - RNA, 23 nt, Molluscum contagiosum virus
guugccaguagcgaaugcagugc

SEQ ID NO: 3089242 - RNA, 20 nt, Molluscum contagiosum virus
gcaccucaacuguugccugg

SEQ ID NO: 3089243 - RNA, 17 nt, Molluscum contagiosum virus
ucucgggugugugccug

SEQ ID NO: 3089244 - RNA, 15 nt, Molluscum contagiosum virus
ugcccggacagagcc

SEQ ID NO: 3089245 - RNA, 18 nt, Molluscum contagiosum virus
aguguugucguccuuggc

SEQ ID NO: 3089246 - RNA, 19 nt, Molluscum contagiosum virus
ucuucguggcgcugggcgc

SEQ ID NO: 3089247 - RNA, 21 nt, Molluscum contagiosum virus
cugcugcccgcgcagcgccac

SEQ ID NO: 3089248 - RNA, 23 nt, Molluscum contagiosum virus
cgcagcacaaacucgcagaacug

SEQ ID NO: 3089249 - RNA, 11 nt, Molluscum contagiosum virus
aagcagcucgg

SEQ ID NO: 3089250 - RNA, 13 nt, Molluscum contagiosum virus
ggaaggagcuggg

SEQ ID NO: 3089251 - RNA, 17 nt, Molluscum contagiosum virus
gggcccugugccucuug

SEQ ID NO: 3089252 - RNA, 17 nt, Molluscum contagiosum virus
acucaacaagcugcugg

SEQ ID NO: 3089253 - RNA, 15 nt, Molluscum contagiosum virus
cccgaacugcugggc

SEQ ID NO: 3089254 - RNA, 13 nt, Molluscum contagiosum virus
ggauggccacggg

SEQ ID NO: 3089255 - RNA, 20 nt, Molluscum contagiosum virus
ugcaggccccuacacgcaac

SEQ ID NO: 3089256 - RNA, 21 nt, Molluscum contagiosum virus
gauccuccggaugaacagcuu

SEQ ID NO: 3089257 - RNA, 20 nt, Molluscum contagiosum virus
agcuccgcgcaugccagacc

SEQ ID NO: 3089258 - RNA, 14 nt, Molluscum contagiosum virus
gcucgagcuccgag

SEQ ID NO: 3089259 - RNA, 15 nt, Molluscum contagiosum virus
ucucagggugguuug

SEQ ID NO: 3089260 - RNA, 20 nt, Molluscum contagiosum virus
acaagauggcgcagcacuuc

SEQ ID NO: 3089261 - RNA, 12 nt, Molluscum contagiosum virus
acccugauaugc

SEQ ID NO: 3089262 - RNA, 16 nt, Molluscum contagiosum virus
caccgcaugggcccug

SEQ ID NO: 3089263 - RNA, 17 nt, Molluscum contagiosum virus
gagccuuuuggcggcgc

SEQ ID NO: 3089264 - RNA, 15 nt, Molluscum contagiosum virus
ccugggcaggccgcc

SEQ ID NO: 3089265 - RNA, 19 nt, Molluscum contagiosum virus
cauagcccaugcgcagugc

SEQ ID NO: 3089266 - RNA, 23 nt, Molluscum contagiosum virus
cuugaaggacgcguucuccagga

SEQ ID NO: 3089267 - RNA, 18 nt, Molluscum contagiosum virus
gccaugccaacgcaccgg

SEQ ID NO: 3089268 - RNA, 18 nt, Molluscum contagiosum virus
ggugagugcgcgcacgaa

SEQ ID NO: 3089269 - RNA, 19 nt, Molluscum contagiosum virus
cucgaagccuucgcagaga

SEQ ID NO: 3089270 - RNA, 16 nt, Molluscum contagiosum virus
uccaggaucacgaugu

SEQ ID NO: 3089271 - RNA, 19 nt, Molluscum contagiosum virus
accgcgcgcacgcggcgcu

SEQ ID NO: 3089272 - RNA, 23 nt, Molluscum contagiosum virus
ggcuccgaaccccucgugcuggg

SEQ ID NO: 3089273 - RNA, 15 nt, Molluscum contagiosum virus
acuacgcgcugcuag

SEQ ID NO: 3089274 - RNA, 14 nt, Molluscum contagiosum virus
acugcuacgucgcg

SEQ ID NO: 3089275 - RNA, 22 nt, Molluscum contagiosum virus
gagacuugugcccauguccuuu

SEQ ID NO: 3089276 - RNA, 16 nt, Molluscum contagiosum virus
cgaucgcgcucaggac

SEQ ID NO: 3089277 - RNA, 16 nt, Molluscum contagiosum virus
cucagcgggcagacag

SEQ ID NO: 3089278 - RNA, 21 nt, Molluscum contagiosum virus
cgagacuucuccgaccgugcc

SEQ ID NO: 3089279 - RNA, 14 nt, Molluscum contagiosum virus
guucugaauaaucu

SEQ ID NO: 3089280 - RNA, 19 nt, Molluscum contagiosum virus
ucguucgcgggcccgccuu

SEQ ID NO: 3089281 - RNA, 19 nt, Molluscum contagiosum virus
ccucgcgagggcucguccu

SEQ ID NO: 3089282 - RNA, 19 nt, Molluscum contagiosum virus
cuccacgcugcguucgagc

SEQ ID NO: 3089283 - RNA, 15 nt, Molluscum contagiosum virus
cauacuccugcuggc

SEQ ID NO: 3089284 - RNA, 22 nt, Molluscum contagiosum virus
acacagaaguugccgcaggaac

SEQ ID NO: 3089285 - RNA, 14 nt, Molluscum contagiosum virus
gcuccgcggaggcc

SEQ ID NO: 3089286 - RNA, 16 nt, Molluscum contagiosum virus
gaggagugaagggugu

SEQ ID NO: 3089287 - RNA, 13 nt, Molluscum contagiosum virus
ccccgccagcacc

SEQ ID NO: 3089288 - RNA, 18 nt, Molluscum contagiosum virus
gccacucuccuucagugu

SEQ ID NO: 3089289 - RNA, 12 nt, Molluscum contagiosum virus
agaagaggccag

SEQ ID NO: 3089290 - RNA, 17 nt, Molluscum contagiosum virus
ucuucguggcgcugggc

SEQ ID NO: 3089291 - RNA, 14 nt, Molluscum contagiosum virus
ggggagggcggcaa

SEQ ID NO: 3089292 - RNA, 18 nt, Molluscum contagiosum virus
cacccgcaacaaggaaag

SEQ ID NO: 3089293 - RNA, 23 nt, Molluscum contagiosum virus
caaggugcuguccuucugguucc

SEQ ID NO: 3089294 - RNA, 19 nt, Molluscum contagiosum virus
ggcaguggcgugacagguc

SEQ ID NO: 3089295 - RNA, 20 nt, Molluscum contagiosum virus
ggcuccuacaucgacaagca

SEQ ID NO: 3089296 - RNA, 19 nt, Molluscum contagiosum virus
gccggccccgcgaacgaga

SEQ ID NO: 3089297 - RNA, 22 nt, Molluscum contagiosum virus
cgcagcaaagggcggccgcagc

SEQ ID NO: 3089298 - RNA, 16 nt, Molluscum contagiosum virus
ccaaccuccugcaccu

SEQ ID NO: 3089299 - RNA, 14 nt, Molluscum contagiosum virus
cucggacuuggccc

SEQ ID NO: 3089300 - RNA, 16 nt, Molluscum contagiosum virus
ucagcgggcagacagg

SEQ ID NO: 3089301 - RNA, 14 nt, Molluscum contagiosum virus
gcauuaaacaacac

SEQ ID NO: 3089302 - RNA, 21 nt, Molluscum contagiosum virus
gaaagauauacaccaggcgcg

SEQ ID NO: 3089303 - RNA, 19 nt, Molluscum contagiosum virus
cgacggucacgcaagcuuu

SEQ ID NO: 3089304 - RNA, 17 nt, Molluscum contagiosum virus
ucgcgcgcgcucugccg

SEQ ID NO: 3089305 - RNA, 23 nt, Molluscum contagiosum virus
uguaaugugcuggucaagaacau

SEQ ID NO: 3089306 - RNA, 13 nt, Molluscum contagiosum virus
cucacagccgugg

SEQ ID NO: 3089307 - RNA, 21 nt, Molluscum contagiosum virus
agcgccggcgaccagcucuug

SEQ ID NO: 3089308 - RNA, 15 nt, Molluscum contagiosum virus
gcaaccgcgcccgcg

SEQ ID NO: 3089309 - RNA, 21 nt, Molluscum contagiosum virus
gcccgugcccgaguuugcccg

SEQ ID NO: 3089310 - RNA, 18 nt, Molluscum contagiosum virus
gacaugcacacgcaccgc

SEQ ID NO: 3089311 - RNA, 18 nt, Molluscum contagiosum virus
ggcguccggcgcucgccc

SEQ ID NO: 3089312 - RNA, 21 nt, Molluscum contagiosum virus
cgggaauaccggagacaccag

SEQ ID NO: 3089313 - RNA, 15 nt, Molluscum contagiosum virus
aaacugugcuccuga

SEQ ID NO: 3089314 - RNA, 15 nt, Molluscum contagiosum virus
ucaaauauugugcau

SEQ ID NO: 3089315 - RNA, 17 nt, Molluscum contagiosum virus
cucccucgcgcgcaugu

SEQ ID NO: 3089316 - RNA, 14 nt, Molluscum contagiosum virus
gccgccggugcgug

SEQ ID NO: 3089317 - RNA, 21 nt, Molluscum contagiosum virus
ccgaguacuacuacacugucg

SEQ ID NO: 3089318 - RNA, 18 nt, Molluscum contagiosum virus
ugcgcaggagcagucucu

SEQ ID NO: 3089319 - RNA, 17 nt, Molluscum contagiosum virus
ugccgcgagcacuggcu

SEQ ID NO: 3089320 - RNA, 17 nt, Molluscum contagiosum virus
uccaagaagaggccagc

SEQ ID NO: 3089321 - RNA, 13 nt, Molluscum contagiosum virus
ugugcuacugcac

SEQ ID NO: 3089322 - RNA, 15 nt, Molluscum contagiosum virus
cagacuuucugcagu

SEQ ID NO: 3089323 - RNA, 21 nt, Molluscum contagiosum virus
gagggcgaguccccgagcagc

SEQ ID NO: 3089324 - RNA, 15 nt, Molluscum contagiosum virus
guaguacggcacgga

SEQ ID NO: 3089325 - RNA, 18 nt, Molluscum contagiosum virus
agcggcuuuucgccggag

SEQ ID NO: 3089326 - RNA, 16 nt, Molluscum contagiosum virus
cgagcaggcgcagcgc

SEQ ID NO: 3089327 - RNA, 23 nt, Molluscum contagiosum virus
acuucacggcguucaccuuggcg

SEQ ID NO: 3089328 - RNA, 14 nt, Molluscum contagiosum virus
ggugaaaauccagg

SEQ ID NO: 3089329 - RNA, 21 nt, Molluscum contagiosum virus
uaccugcgacagcugcugcuc

SEQ ID NO: 3089330 - RNA, 20 nt, Molluscum contagiosum virus
cuuccgcggcgugcagggcg

SEQ ID NO: 3089331 - RNA, 14 nt, Molluscum contagiosum virus
gcacgagcugcugc

SEQ ID NO: 3089332 - RNA, 14 nt, Molluscum contagiosum virus
gaaaggcacccgca

SEQ ID NO: 3089333 - RNA, 22 nt, Molluscum contagiosum virus
acgccgcguucuucguggcgcu

SEQ ID NO: 3089334 - RNA, 21 nt, Molluscum contagiosum virus
agagacgcugccggcaacgcu

SEQ ID NO: 3089335 - RNA, 18 nt, Molluscum contagiosum virus
acguccccgaacugcugg

SEQ ID NO: 3089336 - RNA, 20 nt, Molluscum contagiosum virus
ccucgugggauaggcacaca

SEQ ID NO: 3089337 - RNA, 16 nt, Molluscum contagiosum virus
cgcacagucuugcgca

SEQ ID NO: 3089338 - RNA, 15 nt, Molluscum contagiosum virus
agacaccagcuccgc

SEQ ID NO: 3089339 - RNA, 21 nt, Molluscum contagiosum virus
ggccguucgcgcgccaguacg

SEQ ID NO: 3089340 - RNA, 21 nt, Molluscum contagiosum virus
ucagagaaaucccaagagcca

SEQ ID NO: 3089341 - RNA, 11 nt, Molluscum contagiosum virus
gaaaacugcau

SEQ ID NO: 3089342 - RNA, 21 nt, Molluscum contagiosum virus
gccgagcgggcaaugggcacg

SEQ ID NO: 3089343 - RNA, 12 nt, Molluscum contagiosum virus
uugcgaggcacc

SEQ ID NO: 3089344 - RNA, 23 nt, Molluscum contagiosum virus
aagcgccggcgaccagcucuugg

SEQ ID NO: 3089345 - RNA, 17 nt, Molluscum contagiosum virus
gcgcuguaccggcucag

SEQ ID NO: 3089346 - RNA, 12 nt, Molluscum contagiosum virus
cgucgucaagga

SEQ ID NO: 3089347 - RNA, 15 nt, Molluscum contagiosum virus
gagagcgugagcagg

SEQ ID NO: 3089348 - RNA, 14 nt, Molluscum contagiosum virus
gcgcacggcuaggc

SEQ ID NO: 3089349 - RNA, 20 nt, Molluscum contagiosum virus
gcugcgucacaagcaccgcc

SEQ ID NO: 3089350 - RNA, 14 nt, Molluscum contagiosum virus
cccucgucgcgcuu

SEQ ID NO: 3089351 - RNA, 17 nt, Molluscum contagiosum virus
cuucaccugcauugagc

SEQ ID NO: 3089352 - RNA, 13 nt, Molluscum contagiosum virus
agagaaaggcacc

SEQ ID NO: 3089353 - RNA, 19 nt, Molluscum contagiosum virus
ggagucacgaccgacccau

SEQ ID NO: 3089354 - RNA, 23 nt, Molluscum contagiosum virus
cgaagccuucgcagagaccguca

SEQ ID NO: 3089355 - RNA, 20 nt, Molluscum contagiosum virus
augcggcguacgcgcaggga

SEQ ID NO: 3089356 - RNA, 20 nt, Molluscum contagiosum virus
ggcacgggaaggcucucaac

SEQ ID NO: 3089357 - RNA, 22 nt, Molluscum contagiosum virus
guccacgaacgacagcgccgcc

SEQ ID NO: 3089358 - RNA, 13 nt, Molluscum contagiosum virus
ccaccagcagcca

SEQ ID NO: 3089359 - RNA, 21 nt, Molluscum contagiosum virus
gacuacaccuggcgagcgcuc

SEQ ID NO: 3089360 - RNA, 14 nt, Molluscum contagiosum virus
ggccuugggcacuu

SEQ ID NO: 3089361 - RNA, 14 nt, Molluscum contagiosum virus
cucgucgcugcgga

SEQ ID NO: 3089362 - RNA, 22 nt, Molluscum contagiosum virus
cgcacugccacgcggagcucgc

SEQ ID NO: 3089363 - RNA, 14 nt, Molluscum contagiosum virus
caggccgcggcagc

SEQ ID NO: 3089364 - RNA, 13 nt, Molluscum contagiosum virus
cgcgccgggccgc

SEQ ID NO: 3089365 - RNA, 13 nt, Molluscum contagiosum virus
gcguccgcgcagc

SEQ ID NO: 3089366 - RNA, 16 nt, Molluscum contagiosum virus
ggcgccuguuuccgcu

SEQ ID NO: 3089367 - RNA, 18 nt, Molluscum contagiosum virus
gcgggacgcgugccuggc

SEQ ID NO: 3089368 - RNA, 13 nt, Molluscum contagiosum virus
ugcaggaaaggca

SEQ ID NO: 3089369 - RNA, 22 nt, Molluscum contagiosum virus
uggccaaggucucgagcuccag

SEQ ID NO: 3089370 - RNA, 22 nt, Molluscum contagiosum virus
gcaaaagcgcucgcggcucggc

SEQ ID NO: 3089371 - RNA, 20 nt, Molluscum contagiosum virus
ggcguaugcgccaagccugc

SEQ ID NO: 3089372 - RNA, 22 nt, Molluscum contagiosum virus
acuucacggcguucaccuuggc

SEQ ID NO: 3089373 - RNA, 17 nt, Molluscum contagiosum virus
cucucggccauggaggc

SEQ ID NO: 3089374 - RNA, 17 nt, Molluscum contagiosum virus
ccgggaaaaucaggucc

SEQ ID NO: 3089375 - RNA, 13 nt, Molluscum contagiosum virus
cgugcagcggcgc

SEQ ID NO: 3089376 - RNA, 17 nt, Molluscum contagiosum virus
agcaccgcaugggcccu

SEQ ID NO: 3089377 - RNA, 13 nt, Molluscum contagiosum virus
ccgcgcugcuccg

SEQ ID NO: 3089378 - RNA, 23 nt, Molluscum contagiosum virus
accccgagcuggugauccuggau

SEQ ID NO: 3089379 - RNA, 23 nt, Molluscum contagiosum virus
ggcaaagaguugcgcgagaacuc

SEQ ID NO: 3089380 - RNA, 14 nt, Molluscum contagiosum virus
gacgcccggugccu

SEQ ID NO: 3089381 - RNA, 18 nt, Molluscum contagiosum virus
cucgagcgcgcgccugcu

SEQ ID NO: 3089382 - RNA, 21 nt, Molluscum contagiosum virus
uugcucggggcugucgcugga

SEQ ID NO: 3089383 - RNA, 16 nt, Molluscum contagiosum virus
cccguccuugcucugg

SEQ ID NO: 3089384 - RNA, 15 nt, Molluscum contagiosum virus
ggccugcugaagaag

SEQ ID NO: 3089385 - RNA, 19 nt, Molluscum contagiosum virus
aucucgccggcuguaaaug

SEQ ID NO: 3089386 - RNA, 16 nt, Molluscum contagiosum virus
ccgcggcgcgcagcuc

SEQ ID NO: 3089387 - RNA, 17 nt, Molluscum contagiosum virus
gaacgauuuuacgcaca

SEQ ID NO: 3089388 - RNA, 21 nt, Molluscum contagiosum virus
cguuucugccggaguaaauga

SEQ ID NO: 3089389 - RNA, 13 nt, Molluscum contagiosum virus
ggccacgcucgcg

SEQ ID NO: 3089390 - RNA, 13 nt, Molluscum contagiosum virus
guugccaggcaca

SEQ ID NO: 3089391 - RNA, 23 nt, Molluscum contagiosum virus
gcacgcgaugagcgucucggugc

SEQ ID NO: 3089392 - RNA, 17 nt, Molluscum contagiosum virus
cccgcggcgugcccguc

SEQ ID NO: 3089393 - RNA, 18 nt, Molluscum contagiosum virus
ggcgcuugggcacugcua

SEQ ID NO: 3089394 - RNA, 22 nt, Molluscum contagiosum virus
acugggcuucaaguuccuggag

SEQ ID NO: 3089395 - RNA, 15 nt, Molluscum contagiosum virus
gcuggugugcacuga

SEQ ID NO: 3089396 - RNA, 20 nt, Molluscum contagiosum virus
ucuuccccgcgggccgccgc

SEQ ID NO: 3089397 - RNA, 21 nt, Molluscum contagiosum virus
gcgagaccaucccggugauga

SEQ ID NO: 3089398 - RNA, 21 nt, Molluscum contagiosum virus
cccgcgcaagagccgccgggg

SEQ ID NO: 3089399 - RNA, 17 nt, Molluscum contagiosum virus
uaccgggucgcggggcc

SEQ ID NO: 3089400 - RNA, 23 nt, Molluscum contagiosum virus
ggagcgacauagcgcaccagcug

SEQ ID NO: 3089401 - RNA, 17 nt, Molluscum contagiosum virus
gcuaccugguggagcac

SEQ ID NO: 3089402 - RNA, 21 nt, Molluscum contagiosum virus
cugguacgcgcgcgcgcucac

SEQ ID NO: 3089403 - RNA, 23 nt, Molluscum contagiosum virus
cgcacacuugcgcguccgcaaag

SEQ ID NO: 3089404 - RNA, 17 nt, Molluscum contagiosum virus
caccucugcgcggcccg

SEQ ID NO: 3089405 - RNA, 20 nt, Molluscum contagiosum virus
ccucgggaaaacgcgcggca

SEQ ID NO: 3089406 - RNA, 23 nt, Molluscum contagiosum virus
cgagcacgccuccaagaagaggc

SEQ ID NO: 3089407 - RNA, 17 nt, Molluscum contagiosum virus
gacuagccugugcccug

SEQ ID NO: 3089408 - RNA, 18 nt, Molluscum contagiosum virus
gcauccucgccgaacggc

SEQ ID NO: 3089409 - RNA, 22 nt, Molluscum contagiosum virus
ccucgacgaggccuacagcgcg

SEQ ID NO: 3089410 - RNA, 16 nt, Molluscum contagiosum virus
cucugcacgggcacgc

SEQ ID NO: 3089411 - RNA, 18 nt, Molluscum contagiosum virus
gagcgggguacaggcgcg

SEQ ID NO: 3089412 - RNA, 20 nt, Molluscum contagiosum virus
uggcgccguuggccaccugg

SEQ ID NO: 3089413 - RNA, 20 nt, Molluscum contagiosum virus
cacgcaaaugcgcgcgaacg

SEQ ID NO: 3089414 - RNA, 19 nt, Molluscum contagiosum virus
cugcgcagggacgcgcuuu

SEQ ID NO: 3089415 - RNA, 17 nt, Molluscum contagiosum virus
cgccacugccacggcug

SEQ ID NO: 3089416 - RNA, 21 nt, Molluscum contagiosum virus
uguucgcgcuucugccccguc

SEQ ID NO: 3089417 - RNA, 21 nt, Molluscum contagiosum virus
ccgcgcguacgcugcucgaga

SEQ ID NO: 3089418 - RNA, 21 nt, Molluscum contagiosum virus
guuugcgggcgcaggcccgcc

SEQ ID NO: 3089419 - RNA, 18 nt, Molluscum contagiosum virus
cgugggcucggacuuggc

SEQ ID NO: 3089420 - RNA, 16 nt, Molluscum contagiosum virus
cgugggcgccgcggcg

SEQ ID NO: 3089421 - RNA, 17 nt, Molluscum contagiosum virus
gcgggcgcaggcccgcc

SEQ ID NO: 3089422 - RNA, 13 nt, Molluscum contagiosum virus
ccaagaacaauac

SEQ ID NO: 3089423 - RNA, 13 nt, Molluscum contagiosum virus
gccugcgcgagca

SEQ ID NO: 3089424 - RNA, 19 nt, Molluscum contagiosum virus
gcugucgcgcagcagcuac

SEQ ID NO: 3089425 - RNA, 22 nt, Molluscum contagiosum virus
gaaugacuuagccacugugcug

SEQ ID NO: 3089426 - RNA, 22 nt, Molluscum contagiosum virus
gcgcugcacaguucacggcgcu

SEQ ID NO: 3089427 - RNA, 14 nt, Molluscum contagiosum virus
ucggagcgcagcug

SEQ ID NO: 3089428 - RNA, 16 nt, Molluscum contagiosum virus
acgccgaagagccgcg

SEQ ID NO: 3089429 - RNA, 15 nt, Molluscum contagiosum virus
gccugcucuccgcgg

SEQ ID NO: 3089430 - RNA, 13 nt, Molluscum contagiosum virus
gcuggcggggaaa

SEQ ID NO: 3089431 - RNA, 16 nt, Molluscum contagiosum virus
ccucaggggcucuccu

SEQ ID NO: 3089432 - RNA, 23 nt, Molluscum contagiosum virus
ccgcgccgaaacacggccuccag

SEQ ID NO: 3089433 - RNA, 17 nt, Molluscum contagiosum virus
gacgcaaaagaggccug

SEQ ID NO: 3089434 - RNA, 14 nt, Molluscum contagiosum virus
gccacgcggagcuc

SEQ ID NO: 3089435 - RNA, 14 nt, Molluscum contagiosum virus
uggucaacagcuac

SEQ ID NO: 3089436 - RNA, 21 nt, Molluscum contagiosum virus
aucucgcccagcaccuggaac

SEQ ID NO: 3089437 - RNA, 18 nt, Molluscum contagiosum virus
cugcucuccgcgggaaga

SEQ ID NO: 3089438 - RNA, 11 nt, Molluscum contagiosum virus
acaacuuuucc

SEQ ID NO: 3089439 - RNA, 23 nt, Molluscum contagiosum virus
agcgucgcgcgccgugccuggca

SEQ ID NO: 3089440 - RNA, 14 nt, Molluscum contagiosum virus
uagcaaggcgccgc

SEQ ID NO: 3089441 - RNA, 19 nt, Molluscum contagiosum virus
cgcugaguuacguggccgc

SEQ ID NO: 3089442 - RNA, 18 nt, Molluscum contagiosum virus
agagggucgugcaggucg

SEQ ID NO: 3089443 - RNA, 13 nt, Molluscum contagiosum virus
cugcugcugcaaa

SEQ ID NO: 3089444 - RNA, 17 nt, Molluscum contagiosum virus
ggcguccggcgcucgcc

SEQ ID NO: 3089445 - RNA, 18 nt, Molluscum contagiosum virus
agcccgcgcgcgagcugg

SEQ ID NO: 3089446 - RNA, 16 nt, Molluscum contagiosum virus
ccucucuccccuucag

SEQ ID NO: 3089447 - RNA, 23 nt, Molluscum contagiosum virus
cggaaagauauacaccaggcgcg

SEQ ID NO: 3089448 - RNA, 18 nt, Molluscum contagiosum virus
uacagcaugcgugcaaca

SEQ ID NO: 3089449 - RNA, 14 nt, Molluscum contagiosum virus
caacgaguacgagc

SEQ ID NO: 3089450 - RNA, 17 nt, Molluscum contagiosum virus
guggugcucguggaaaa

SEQ ID NO: 3089451 - RNA, 16 nt, Molluscum contagiosum virus
gaacaagaagcgcuuc

SEQ ID NO: 3089452 - RNA, 19 nt, Molluscum contagiosum virus
cacuggaagaacaggccgc

SEQ ID NO: 3089453 - RNA, 12 nt, Molluscum contagiosum virus
cgcugcuggcag

SEQ ID NO: 3089454 - RNA, 18 nt, Molluscum contagiosum virus
uugcagcccaccagcagg

SEQ ID NO: 3089455 - RNA, 15 nt, Molluscum contagiosum virus
cugguuccucuccuc

SEQ ID NO: 3089456 - RNA, 22 nt, Molluscum contagiosum virus
aucaacgcgcgcgugcuguccu

SEQ ID NO: 3089457 - RNA, 19 nt, Molluscum contagiosum virus
ccccguucacuugcgcgcg

SEQ ID NO: 3089458 - RNA, 13 nt, Molluscum contagiosum virus
ccagacgcagagc

SEQ ID NO: 3089459 - RNA, 12 nt, Molluscum contagiosum virus
gagacaccagcu

SEQ ID NO: 3089460 - RNA, 19 nt, Molluscum contagiosum virus
cccagaaaacgcacugucg

SEQ ID NO: 3089461 - RNA, 24 nt, Molluscum contagiosum virus
agccucaucgugagccuggucgag

SEQ ID NO: 3089462 - RNA, 15 nt, Molluscum contagiosum virus
ccaucgaaacucugc

SEQ ID NO: 3089463 - RNA, 20 nt, Molluscum contagiosum virus
gcugcuccccgccagcacca

SEQ ID NO: 3089464 - RNA, 15 nt, Molluscum contagiosum virus
gccccgcgccagcag

SEQ ID NO: 3089465 - RNA, 22 nt, Molluscum contagiosum virus
ugcccauguccuuucagacagc

SEQ ID NO: 3089466 - RNA, 18 nt, Molluscum contagiosum virus
aagcgcgaguacaagcuc

SEQ ID NO: 3089467 - RNA, 19 nt, Molluscum contagiosum virus
cguuccaaaagacagaggc

SEQ ID NO: 3089468 - RNA, 15 nt, Molluscum contagiosum virus
ucgcgcgccugccgc

SEQ ID NO: 3089469 - RNA, 20 nt, Molluscum contagiosum virus
auccuguucgcgcugcucgc

SEQ ID NO: 3089470 - RNA, 20 nt, Molluscum contagiosum virus
cucucggagaaguggccggc

SEQ ID NO: 3089471 - RNA, 14 nt, Molluscum contagiosum virus
cgcgcgcugcucug

SEQ ID NO: 3089472 - RNA, 18 nt, Molluscum contagiosum virus
cgcuggacuuccugcugc

SEQ ID NO: 3089473 - RNA, 21 nt, Molluscum contagiosum virus
ugcccaugcucgagccugcca

SEQ ID NO: 3089474 - RNA, 17 nt, Molluscum contagiosum virus
ggccugcggcaggaagc

SEQ ID NO: 3089475 - RNA, 17 nt, Molluscum contagiosum virus
uguucaccauccagccg

SEQ ID NO: 3089476 - RNA, 13 nt, Molluscum contagiosum virus
ucgaccugcacga

SEQ ID NO: 3089477 - RNA, 19 nt, Molluscum contagiosum virus
cacucgauggacgccagcu

SEQ ID NO: 3089478 - RNA, 17 nt, Molluscum contagiosum virus
guagcgguugaccagcu

SEQ ID NO: 3089479 - RNA, 18 nt, Molluscum contagiosum virus
cgccgcgcgagugccagc

SEQ ID NO: 3089480 - RNA, 23 nt, Molluscum contagiosum virus
agcaacgcgaccuacgaggugcu

SEQ ID NO: 3089481 - RNA, 14 nt, Molluscum contagiosum virus
gccaaaaggcucag

SEQ ID NO: 3089482 - RNA, 13 nt, Molluscum contagiosum virus
acuugcugcggag

SEQ ID NO: 3089483 - RNA, 21 nt, Molluscum contagiosum virus
ccgccccuaaauaugaaccac

SEQ ID NO: 3089484 - RNA, 13 nt, Molluscum contagiosum virus
acgugcugcugca

SEQ ID NO: 3089485 - RNA, 16 nt, Molluscum contagiosum virus
ccgucggggcagggaa

SEQ ID NO: 3089486 - RNA, 19 nt, Molluscum contagiosum virus
cuacuucgaggccggcaag

SEQ ID NO: 3089487 - RNA, 19 nt, Molluscum contagiosum virus
cgaggugcgcgcaacacug

SEQ ID NO: 3089488 - RNA, 19 nt, Molluscum contagiosum virus
guggcgccgaugcagugcg

SEQ ID NO: 3089489 - RNA, 22 nt, Molluscum contagiosum virus
uuuucuggcgcguaaggcggcg

SEQ ID NO: 3089490 - RNA, 18 nt, Molluscum contagiosum virus
ugcaaauugaaaaaacau

SEQ ID NO: 3089491 - RNA, 17 nt, Molluscum contagiosum virus
ccaggaacaucugcaac

SEQ ID NO: 3089492 - RNA, 18 nt, Molluscum contagiosum virus
uggagcaccuggaacgcg

SEQ ID NO: 3089493 - RNA, 18 nt, Molluscum contagiosum virus
gagcugugccgcagcaac

SEQ ID NO: 3089494 - RNA, 14 nt, Molluscum contagiosum virus
gaagcggugcagcg

SEQ ID NO: 3089495 - RNA, 16 nt, Molluscum contagiosum virus
ggcccgagcagaagga

SEQ ID NO: 3089496 - RNA, 18 nt, Molluscum contagiosum virus
ucaggaacaaggccaaag

SEQ ID NO: 3089497 - RNA, 23 nt, Molluscum contagiosum virus
acgcgggccaggcacuggcccug

SEQ ID NO: 3089498 - RNA, 19 nt, Molluscum contagiosum virus
gcacggcuaccacgagcac

SEQ ID NO: 3089499 - RNA, 15 nt, Molluscum contagiosum virus
ccgggcgcugcaccg

SEQ ID NO: 3089500 - RNA, 22 nt, Molluscum contagiosum virus
gcauccugaugacggcagacgg

SEQ ID NO: 3089501 - RNA, 17 nt, Molluscum contagiosum virus
augcacuuucaacucuc

SEQ ID NO: 3089502 - RNA, 21 nt, Molluscum contagiosum virus
ggcacccgccgcggugccggg

SEQ ID NO: 3089503 - RNA, 15 nt, Molluscum contagiosum virus
agacgcuagcugugc

SEQ ID NO: 3089504 - RNA, 20 nt, Molluscum contagiosum virus
aacucuccgacgugcugcgc

SEQ ID NO: 3089505 - RNA, 13 nt, Molluscum contagiosum virus
uugccugagaagc

SEQ ID NO: 3089506 - RNA, 14 nt, Molluscum contagiosum virus
aagacuugccgucu

SEQ ID NO: 3089507 - RNA, 16 nt, Molluscum contagiosum virus
gagggaugcacacacu

SEQ ID NO: 3089508 - RNA, 20 nt, Molluscum contagiosum virus
gcgcccacggcggcacccgc

SEQ ID NO: 3089509 - RNA, 20 nt, Molluscum contagiosum virus
gccaagguuugcgggcgcag

SEQ ID NO: 3089510 - RNA, 19 nt, Molluscum contagiosum virus
ugcagcugcgcgagccgcu

SEQ ID NO: 3089511 - RNA, 18 nt, Molluscum contagiosum virus
guacgucuuucccagaag

SEQ ID NO: 3089512 - RNA, 17 nt, Molluscum contagiosum virus
cucgcagacgcagcgcg

SEQ ID NO: 3089513 - RNA, 20 nt, Molluscum contagiosum virus
gcuggcguugccgagcgagc

SEQ ID NO: 3089514 - RNA, 17 nt, Molluscum contagiosum virus
ccaggcacacgcagugc

SEQ ID NO: 3089515 - RNA, 20 nt, Molluscum contagiosum virus
cggaagucggcguggccagg

SEQ ID NO: 3089516 - RNA, 11 nt, Molluscum contagiosum virus
cgucucgagcu

SEQ ID NO: 3089517 - RNA, 18 nt, Molluscum contagiosum virus
cguggaucgcgcgcaccu

SEQ ID NO: 3089518 - RNA, 15 nt, Molluscum contagiosum virus
gcgaacgagggacac

SEQ ID NO: 3089519 - RNA, 14 nt, Molluscum contagiosum virus
guugcgguggugca

SEQ ID NO: 3089520 - RNA, 22 nt, Molluscum contagiosum virus
gccauggaggcgcuagugcaga

SEQ ID NO: 3089521 - RNA, 15 nt, Molluscum contagiosum virus
ugcacguggcgcaca

SEQ ID NO: 3089522 - RNA, 18 nt, Molluscum contagiosum virus
gcgggccaugucugugcg

SEQ ID NO: 3089523 - RNA, 12 nt, Molluscum contagiosum virus
uugcgcagagcu

SEQ ID NO: 3089524 - RNA, 19 nt, Molluscum contagiosum virus
accuacaugaguuucuggu

SEQ ID NO: 3089525 - RNA, 19 nt, Molluscum contagiosum virus
aggcucgucguggacgcuc

SEQ ID NO: 3089526 - RNA, 16 nt, Molluscum contagiosum virus
guccgcacgcacacga

SEQ ID NO: 3089527 - RNA, 19 nt, Molluscum contagiosum virus
gguggcgcgcgagcugcug

SEQ ID NO: 3089528 - RNA, 13 nt, Molluscum contagiosum virus
cgcgcgcagcaca

SEQ ID NO: 3089529 - RNA, 22 nt, Molluscum contagiosum virus
cagccacggccgcgcugguggc

SEQ ID NO: 3089530 - RNA, 13 nt, Molluscum contagiosum virus
gugcucaggccag

SEQ ID NO: 3089531 - RNA, 24 nt, Molluscum contagiosum virus
cuucacggcguucaccuuggcgcu

SEQ ID NO: 3089532 - RNA, 16 nt, Molluscum contagiosum virus
gugcuggagcagggcu

SEQ ID NO: 3089533 - RNA, 13 nt, Molluscum contagiosum virus
cuuguugugggcu

SEQ ID NO: 3089534 - RNA, 19 nt, Molluscum contagiosum virus
ggcucguacugcugcaggc

SEQ ID NO: 3089535 - RNA, 20 nt, Molluscum contagiosum virus
ucuccaucaucgagcugcag

SEQ ID NO: 3089536 - RNA, 17 nt, Molluscum contagiosum virus
gcagugcggccagcacc

SEQ ID NO: 3089537 - RNA, 18 nt, Molluscum contagiosum virus
ccgcugcuccugcucugu

SEQ ID NO: 3089538 - RNA, 20 nt, Molluscum contagiosum virus
cucgggcuagcaagcacgcc

SEQ ID NO: 3089539 - RNA, 17 nt, Molluscum contagiosum virus
ccagagccuucucggug

SEQ ID NO: 3089540 - RNA, 17 nt, Molluscum contagiosum virus
agcgcggggguguugcu

SEQ ID NO: 3089541 - RNA, 15 nt, Molluscum contagiosum virus
acugcgcgcacugcu

SEQ ID NO: 3089542 - RNA, 15 nt, Molluscum contagiosum virus
gacgcuagcugugcg

SEQ ID NO: 3089543 - RNA, 20 nt, Molluscum contagiosum virus
caggucaucgggcugcagcc

SEQ ID NO: 3089544 - RNA, 14 nt, Molluscum contagiosum virus
gcacuacugcucca

SEQ ID NO: 3089545 - RNA, 17 nt, Molluscum contagiosum virus
gaagucgcuagaggaga

SEQ ID NO: 3089546 - RNA, 13 nt, Molluscum contagiosum virus
cgcugcgcgccgc

SEQ ID NO: 3089547 - RNA, 16 nt, Molluscum contagiosum virus
cuucugcugcacacac

SEQ ID NO: 3089548 - RNA, 17 nt, Molluscum contagiosum virus
ccggugcgugcccagca

SEQ ID NO: 3089549 - RNA, 14 nt, Molluscum contagiosum virus
gcagucacgacugu

SEQ ID NO: 3089550 - RNA, 12 nt, Molluscum contagiosum virus
agcgcuaccuga

SEQ ID NO: 3089551 - RNA, 12 nt, Molluscum contagiosum virus
uccuggccaagg

SEQ ID NO: 3089552 - RNA, 17 nt, Molluscum contagiosum virus
gcugcugcccggcagcg

SEQ ID NO: 3089553 - RNA, 22 nt, Molluscum contagiosum virus
gcucguugcgcagccgguacuc

SEQ ID NO: 3089554 - RNA, 13 nt, Molluscum contagiosum virus
cugccgcagagcc

SEQ ID NO: 3089555 - RNA, 19 nt, Molluscum contagiosum virus
agggcgugcuugccuggaa

SEQ ID NO: 3089556 - RNA, 22 nt, Molluscum contagiosum virus
cccggcgaacaccccgagcugg

SEQ ID NO: 3089557 - RNA, 14 nt, Molluscum contagiosum virus
agcgaguugagcag

SEQ ID NO: 3089558 - RNA, 15 nt, Molluscum contagiosum virus
cuacauggacgugcu

SEQ ID NO: 3089559 - RNA, 21 nt, Molluscum contagiosum virus
gcucacgcugcccgcgccgcc

SEQ ID NO: 3089560 - RNA, 23 nt, Molluscum contagiosum virus
cuuagcuuccgucugcugcucga

SEQ ID NO: 3089561 - RNA, 16 nt, Molluscum contagiosum virus
caccgcuccgcagccg

SEQ ID NO: 3089562 - RNA, 13 nt, Molluscum contagiosum virus
gagccauguuucc

SEQ ID NO: 3089563 - RNA, 17 nt, Molluscum contagiosum virus
gaacacgggggcugccg

SEQ ID NO: 3089564 - RNA, 14 nt, Molluscum contagiosum virus
cacguccaggccgc

SEQ ID NO: 3089565 - RNA, 16 nt, Molluscum contagiosum virus
gaucgcgguggcaggc

SEQ ID NO: 3089566 - RNA, 20 nt, Molluscum contagiosum virus
gagcuucgucuucaccugca

SEQ ID NO: 3089567 - RNA, 17 nt, Molluscum contagiosum virus
gccggcacccgugcgcg

SEQ ID NO: 3089568 - RNA, 18 nt, Molluscum contagiosum virus
acggcgcucgccucuggg

SEQ ID NO: 3089569 - RNA, 22 nt, Molluscum contagiosum virus
ucucgcagacgcagcgcgagcu

SEQ ID NO: 3089570 - RNA, 17 nt, Molluscum contagiosum virus
ccaugcuccugaucugc

SEQ ID NO: 3089571 - RNA, 15 nt, Molluscum contagiosum virus
cgcgcgccgucggcc

SEQ ID NO: 3089572 - RNA, 22 nt, Molluscum contagiosum virus
gcggcacacacuugcacgcgca

SEQ ID NO: 3089573 - RNA, 21 nt, Molluscum contagiosum virus
gcgcgcgacuuuguccugagc

SEQ ID NO: 3089574 - RNA, 20 nt, Molluscum contagiosum virus
gccuccgaacaaugaggaga

SEQ ID NO: 3089575 - RNA, 22 nt, Molluscum contagiosum virus
caucucgcacacugcagcacgu

SEQ ID NO: 3089576 - RNA, 20 nt, Molluscum contagiosum virus
uuagcuuccgucugcugcuc

SEQ ID NO: 3089577 - RNA, 22 nt, Molluscum contagiosum virus
gccguguccuacacgccgcugg

SEQ ID NO: 3089578 - RNA, 22 nt, Molluscum contagiosum virus
ugcacaugcccgugcaccuccc

SEQ ID NO: 3089579 - RNA, 23 nt, Molluscum contagiosum virus
guagcgagcaggcgcaggccgcg

SEQ ID NO: 3089580 - RNA, 12 nt, Molluscum contagiosum virus
gugcgugcugcg

SEQ ID NO: 3089581 - RNA, 22 nt, Molluscum contagiosum virus
agcugggcucggaguccgcgcc

SEQ ID NO: 3089582 - RNA, 23 nt, Molluscum contagiosum virus
uacuuguugugcacgcuguccag

SEQ ID NO: 3089583 - RNA, 17 nt, Molluscum contagiosum virus
cggcuuggacagcaagc

SEQ ID NO: 3089584 - RNA, 12 nt, Molluscum contagiosum virus
gaggcggcacug

SEQ ID NO: 3089585 - RNA, 23 nt, Molluscum contagiosum virus
acgaguucugcaucuucugccag

SEQ ID NO: 3089586 - RNA, 21 nt, Molluscum contagiosum virus
ugacgcgcacgccagccugga

SEQ ID NO: 3089587 - RNA, 22 nt, Molluscum contagiosum virus
gacgcgggcguguccgcgggcg

SEQ ID NO: 3089588 - RNA, 21 nt, Molluscum contagiosum virus
ggaacggcucaccgcgcagaa

SEQ ID NO: 3089589 - RNA, 20 nt, Molluscum contagiosum virus
cagcagucaguuccgcggcg

SEQ ID NO: 3089590 - RNA, 13 nt, Molluscum contagiosum virus
cacgcacgcgcuc

SEQ ID NO: 3089591 - RNA, 14 nt, Molluscum contagiosum virus
agcagcgcuagccc

SEQ ID NO: 3089592 - RNA, 17 nt, Molluscum contagiosum virus
ugcgcguucgcaaagac

SEQ ID NO: 3089593 - RNA, 13 nt, Molluscum contagiosum virus
gcuugcagacaag

SEQ ID NO: 3089594 - RNA, 15 nt, Molluscum contagiosum virus
cggggcgcgcgcugc

SEQ ID NO: 3089595 - RNA, 16 nt, Molluscum contagiosum virus
gccggcucugccuccg

SEQ ID NO: 3089596 - RNA, 20 nt, Molluscum contagiosum virus
cgaggcguccagcggcugcc

SEQ ID NO: 3089597 - RNA, 21 nt, Molluscum contagiosum virus
aacuccggcgucgaaacacug

SEQ ID NO: 3089598 - RNA, 15 nt, Molluscum contagiosum virus
gcucgguagccaggc

SEQ ID NO: 3089599 - RNA, 15 nt, Molluscum contagiosum virus
agaucgacugcgccu

SEQ ID NO: 3089600 - RNA, 11 nt, Molluscum contagiosum virus
ugccagcagca

SEQ ID NO: 3089601 - RNA, 14 nt, Molluscum contagiosum virus
cuagcccagcacgc

SEQ ID NO: 3089602 - RNA, 18 nt, Molluscum contagiosum virus
gcaacaaggaaaggcacc

SEQ ID NO: 3089603 - RNA, 21 nt, Molluscum contagiosum virus
gagcaggcgcagcgcggccug

SEQ ID NO: 3089604 - RNA, 13 nt, Molluscum contagiosum virus
gagacucuggaag

SEQ ID NO: 3089605 - RNA, 21 nt, Molluscum contagiosum virus
cugcucgcgugcgugcugcgc

SEQ ID NO: 3089606 - RNA, 16 nt, Molluscum contagiosum virus
agcacguccucgguca

SEQ ID NO: 3089607 - RNA, 14 nt, Molluscum contagiosum virus
cuugucgagacagg

SEQ ID NO: 3089608 - RNA, 14 nt, Molluscum contagiosum virus
ggcggcacccgccg

SEQ ID NO: 3089609 - RNA, 19 nt, Molluscum contagiosum virus
cgggcacgccgcagcgcug

SEQ ID NO: 3089610 - RNA, 23 nt, Molluscum contagiosum virus
acccuuggcagcaacugcacagg

SEQ ID NO: 3089611 - RNA, 22 nt, Molluscum contagiosum virus
cgaggccuacgugcugcgcacg

SEQ ID NO: 3089612 - RNA, 13 nt, Molluscum contagiosum virus
gcagcgcgcgcag

SEQ ID NO: 3089613 - RNA, 15 nt, Molluscum contagiosum virus
gcacaugcagcugca

SEQ ID NO: 3089614 - RNA, 16 nt, Molluscum contagiosum virus
gucggccagcagcucc

SEQ ID NO: 3089615 - RNA, 18 nt, Molluscum contagiosum virus
accauggcgcgcucuuuu

SEQ ID NO: 3089616 - RNA, 21 nt, Molluscum contagiosum virus
gggauugaccucgcgacggga

SEQ ID NO: 3089617 - RNA, 16 nt, Molluscum contagiosum virus
gcaaacgcugacggcg

SEQ ID NO: 3089618 - RNA, 20 nt, Molluscum contagiosum virus
uggagaacggcgugcgagug

SEQ ID NO: 3089619 - RNA, 16 nt, Molluscum contagiosum virus
agcuguccgagccgga

SEQ ID NO: 3089620 - RNA, 15 nt, Molluscum contagiosum virus
gcccgugcgccugcc

SEQ ID NO: 3089621 - RNA, 12 nt, Molluscum contagiosum virus
acuccuguccuc

SEQ ID NO: 3089622 - RNA, 16 nt, Molluscum contagiosum virus
ggaagcugcacgugca

SEQ ID NO: 3089623 - RNA, 22 nt, Molluscum contagiosum virus
gcgggcccgugcucaggccagc

SEQ ID NO: 3089624 - RNA, 15 nt, Molluscum contagiosum virus
gcuuuaguccaugcc

SEQ ID NO: 3089625 - RNA, 18 nt, Molluscum contagiosum virus
cgugcacucgagaagagg

SEQ ID NO: 3089626 - RNA, 20 nt, Molluscum contagiosum virus
gccgcgugcgcgcgguacuc

SEQ ID NO: 3089627 - RNA, 23 nt, Molluscum contagiosum virus
acaucuacuuccugccuguggga

SEQ ID NO: 3089628 - RNA, 18 nt, Molluscum contagiosum virus
ccugcaccgagugcuggc

SEQ ID NO: 3089629 - RNA, 15 nt, Molluscum contagiosum virus
cccacugugccagca

SEQ ID NO: 3089630 - RNA, 20 nt, Molluscum contagiosum virus
cgauugcguguuggcuucug

SEQ ID NO: 3089631 - RNA, 19 nt, Molluscum contagiosum virus
acgugaccucgcugcugag

SEQ ID NO: 3089632 - RNA, 22 nt, Molluscum contagiosum virus
cugcagaaacagccgugcuccg

SEQ ID NO: 3089633 - RNA, 15 nt, Molluscum contagiosum virus
gcagcgcuggagcug

SEQ ID NO: 3089634 - RNA, 21 nt, Molluscum contagiosum virus
ggaggcgcuaccucgcgggag

SEQ ID NO: 3089635 - RNA, 15 nt, Molluscum contagiosum virus
caguccgagcuguuc

SEQ ID NO: 3089636 - RNA, 14 nt, Molluscum contagiosum virus
acagcagccgcagc

SEQ ID NO: 3089637 - RNA, 14 nt, Molluscum contagiosum virus
gcccacuuccguga

SEQ ID NO: 3089638 - RNA, 17 nt, Molluscum contagiosum virus
ggcccaggccauggagc

SEQ ID NO: 3089639 - RNA, 14 nt, Molluscum contagiosum virus
acgccagccuggag

SEQ ID NO: 3089640 - RNA, 18 nt, Molluscum contagiosum virus
cguggcguugcugcugcg

SEQ ID NO: 3089641 - RNA, 19 nt, Molluscum contagiosum virus
ggcguguuccggcagcgcc

SEQ ID NO: 3089642 - RNA, 19 nt, Molluscum contagiosum virus
uccacgucgaucagcuccg

SEQ ID NO: 3089643 - RNA, 21 nt, Molluscum contagiosum virus
ccucgugcugggccugccgca

SEQ ID NO: 3089644 - RNA, 21 nt, Molluscum contagiosum virus
cagaggauucuugcacgggca

SEQ ID NO: 3089645 - RNA, 19 nt, Molluscum contagiosum virus
uugagugguacuaccucuu

SEQ ID NO: 3089646 - RNA, 21 nt, Molluscum contagiosum virus
cgagacggaaauguuguuuga

SEQ ID NO: 3089647 - RNA, 14 nt, Molluscum contagiosum virus
cggcacgagcaguc

SEQ ID NO: 3089648 - RNA, 19 nt, Molluscum contagiosum virus
gcguugcucccgucgagca

SEQ ID NO: 3089649 - RNA, 22 nt, Molluscum contagiosum virus
cgcacggugugcuacugcacug

SEQ ID NO: 3089650 - RNA, 14 nt, Molluscum contagiosum virus
gcgccugcacacgc

SEQ ID NO: 3089651 - RNA, 23 nt, Molluscum contagiosum virus
cgacgggcucugugcggacaugc

SEQ ID NO: 3089652 - RNA, 18 nt, Molluscum contagiosum virus
uagacugucgacagagaa

SEQ ID NO: 3089653 - RNA, 18 nt, Molluscum contagiosum virus
ccuucgccaaugacggcg

SEQ ID NO: 3089654 - RNA, 19 nt, Molluscum contagiosum virus
ucuccgcucucgagcucac

SEQ ID NO: 3089655 - RNA, 23 nt, Molluscum contagiosum virus
cugcggacgcgggccgcgcgcac

SEQ ID NO: 3089656 - RNA, 16 nt, Molluscum contagiosum virus
ugucgccgcgggcugg

SEQ ID NO: 3089657 - RNA, 18 nt, Molluscum contagiosum virus
cggaugccacgcagcugg

SEQ ID NO: 3089658 - RNA, 14 nt, Molluscum contagiosum virus
ugguugcuugcaug

SEQ ID NO: 3089659 - RNA, 21 nt, Molluscum contagiosum virus
gcugggaaagggcugcuugcg

SEQ ID NO: 3089660 - RNA, 12 nt, Molluscum contagiosum virus
accuaggcacuc

SEQ ID NO: 3089661 - RNA, 20 nt, Molluscum contagiosum virus
uccuguagcaaggggucugc

SEQ ID NO: 3089662 - RNA, 15 nt, Molluscum contagiosum virus
accuacuccuggcca

SEQ ID NO: 3089663 - RNA, 17 nt, Molluscum contagiosum virus
ccgacccggcucgcuca

SEQ ID NO: 3089664 - RNA, 17 nt, Molluscum contagiosum virus
cugauaguaccacugug

SEQ ID NO: 3089665 - RNA, 12 nt, Molluscum contagiosum virus
acucaggaagcg

SEQ ID NO: 3089666 - RNA, 22 nt, Molluscum contagiosum virus
cgggcacgcucauacuccugcu

SEQ ID NO: 3089667 - RNA, 23 nt, Molluscum contagiosum virus
ggcgacgcguacguguccaugca

SEQ ID NO: 3089668 - RNA, 13 nt, Molluscum contagiosum virus
cccgcaccagugc

SEQ ID NO: 3089669 - RNA, 22 nt, Molluscum contagiosum virus
uuuccuggcucgcgagugugca

SEQ ID NO: 3089670 - RNA, 14 nt, Molluscum contagiosum virus
accagcagccaggc

SEQ ID NO: 3089671 - RNA, 17 nt, Molluscum contagiosum virus
ccucgcguagcagcgcc

SEQ ID NO: 3089672 - RNA, 14 nt, Molluscum contagiosum virus
agcagcccgcaggc

SEQ ID NO: 3089673 - RNA, 17 nt, Molluscum contagiosum virus
ucgccuucuugcuggcg

SEQ ID NO: 3089674 - RNA, 23 nt, Molluscum contagiosum virus
gcgugccagcguacggcccgaag

SEQ ID NO: 3089675 - RNA, 20 nt, Molluscum contagiosum virus
caacuccgagcgcgcgcgcu

SEQ ID NO: 3089676 - RNA, 15 nt, Molluscum contagiosum virus
aagaccauggggcua

SEQ ID NO: 3089677 - RNA, 14 nt, Molluscum contagiosum virus
ccuagcuccagcgu

SEQ ID NO: 3089678 - RNA, 17 nt, Molluscum contagiosum virus
cgcggaugcaggcacug

SEQ ID NO: 3089679 - RNA, 13 nt, Molluscum contagiosum virus
ugcaaggagguca

SEQ ID NO: 3089680 - RNA, 23 nt, Molluscum contagiosum virus
uucugcuugcggcacacaugcua

SEQ ID NO: 3089681 - RNA, 24 nt, Molluscum contagiosum virus
cgucuuaacucagcgggcagacag

SEQ ID NO: 3089682 - RNA, 22 nt, Molluscum contagiosum virus
gaucccuucgcguccacgggua

SEQ ID NO: 3089683 - RNA, 18 nt, Molluscum contagiosum virus
ucaccuuggcgcugcaca

SEQ ID NO: 3089684 - RNA, 16 nt, Molluscum contagiosum virus
ugcguuuccagggcag

SEQ ID NO: 3089685 - RNA, 20 nt, Molluscum contagiosum virus
agucacugcuagugcuggcc

SEQ ID NO: 3089686 - RNA, 17 nt, Molluscum contagiosum virus
gcacacgagugcccgcg

SEQ ID NO: 3089687 - RNA, 15 nt, Molluscum contagiosum virus
gcucgugcuggagca

SEQ ID NO: 3089688 - RNA, 15 nt, Molluscum contagiosum virus
agcgcgugcccgcag

SEQ ID NO: 3089689 - RNA, 11 nt, Molluscum contagiosum virus
gcgacacuugc

SEQ ID NO: 3089690 - RNA, 12 nt, Molluscum contagiosum virus
cccguguacaac

SEQ ID NO: 3089691 - RNA, 15 nt, Molluscum contagiosum virus
caugaacucgcugcu

SEQ ID NO: 3089692 - RNA, 18 nt, Molluscum contagiosum virus
acucggacacguugcagc

SEQ ID NO: 3089693 - RNA, 12 nt, Molluscum contagiosum virus
cuccgcacgugg

SEQ ID NO: 3089694 - RNA, 11 nt, Molluscum contagiosum virus
cacgcgccgcg

SEQ ID NO: 3089695 - RNA, 18 nt, Molluscum contagiosum virus
cggcgcgugagcgccuac

SEQ ID NO: 3089696 - RNA, 23 nt, Molluscum contagiosum virus
cggcccccuuacgcuacagcagc

SEQ ID NO: 3089697 - RNA, 21 nt, Molluscum contagiosum virus
gccuucgcguuccggcggcug

SEQ ID NO: 3089698 - RNA, 20 nt, Molluscum contagiosum virus
cggcgcaacgagcagcccgu

SEQ ID NO: 3089699 - RNA, 22 nt, Molluscum contagiosum virus
aggacuagcauuccuucacaca

SEQ ID NO: 3089700 - RNA, 19 nt, Molluscum contagiosum virus
cgacgugcugcugcagaac

SEQ ID NO: 3089701 - RNA, 18 nt, Molluscum contagiosum virus
cgcaguacccgagcugug

SEQ ID NO: 3089702 - RNA, 19 nt, Molluscum contagiosum virus
cgagcgcccucagucacgu

SEQ ID NO: 3089703 - RNA, 20 nt, Molluscum contagiosum virus
ccgagcgugaccagugcgug

SEQ ID NO: 3089704 - RNA, 15 nt, Molluscum contagiosum virus
cuuagccacugugcu

SEQ ID NO: 3089705 - RNA, 19 nt, Molluscum contagiosum virus
ucaacuacaaggugcuguc

SEQ ID NO: 3089706 - RNA, 17 nt, Molluscum contagiosum virus
cgcugcgcgcucuggag

SEQ ID NO: 3089707 - RNA, 20 nt, Molluscum contagiosum virus
uaccacgagcacugccugcc

SEQ ID NO: 3089708 - RNA, 12 nt, Molluscum contagiosum virus
gggcgcugcucg

SEQ ID NO: 3089709 - RNA, 12 nt, Molluscum contagiosum virus
cgccuuuccccg

SEQ ID NO: 3089710 - RNA, 23 nt, Molluscum contagiosum virus
agcggcgccacgagcgccgcgac

SEQ ID NO: 3089711 - RNA, 17 nt, Molluscum contagiosum virus
cagcaacugcacaggga

SEQ ID NO: 3089712 - RNA, 15 nt, Molluscum contagiosum virus
gcuaugcgcagcugc

SEQ ID NO: 3089713 - RNA, 23 nt, Molluscum contagiosum virus
ugcucuacuggcggcgcccguga

SEQ ID NO: 3089714 - RNA, 20 nt, Molluscum contagiosum virus
cgaggacuuccgcgcgcucu

SEQ ID NO: 3089715 - RNA, 14 nt, Molluscum contagiosum virus
cggggaggagcucu

SEQ ID NO: 3089716 - RNA, 23 nt, Molluscum contagiosum virus
cacgccuuggcaauggcgcgcag

SEQ ID NO: 3089717 - RNA, 14 nt, Molluscum contagiosum virus
acacauuccucggc

SEQ ID NO: 3089718 - RNA, 19 nt, Molluscum contagiosum virus
cagagaaaggcacccacca

SEQ ID NO: 3089719 - RNA, 21 nt, Molluscum contagiosum virus
aacaaggaaaggcacccgcag

SEQ ID NO: 3089720 - RNA, 19 nt, Molluscum contagiosum virus
caacuacaaggugcugucc

SEQ ID NO: 3089721 - RNA, 14 nt, Molluscum contagiosum virus
cguaagccaccgcg

SEQ ID NO: 3089722 - RNA, 17 nt, Molluscum contagiosum virus
gccgccgacgccuuccu

SEQ ID NO: 3089723 - RNA, 19 nt, Molluscum contagiosum virus
gcuucuggcaaacgcacug

SEQ ID NO: 3089724 - RNA, 13 nt, Molluscum contagiosum virus
gagagacaacaaa

SEQ ID NO: 3089725 - RNA, 18 nt, Molluscum contagiosum virus
cagugcucgcacacgugc

SEQ ID NO: 3089726 - RNA, 17 nt, Molluscum contagiosum virus
ucgagcuucggacgagc

SEQ ID NO: 3089727 - RNA, 20 nt, Molluscum contagiosum virus
ggaggccgucuucgccggca

SEQ ID NO: 3089728 - RNA, 16 nt, Molluscum contagiosum virus
gcaggaugcuggggcu

SEQ ID NO: 3089729 - RNA, 16 nt, Molluscum contagiosum virus
ugugcgagaacuggcg

SEQ ID NO: 3089730 - RNA, 20 nt, Molluscum contagiosum virus
ugcccggccucgccuccggg

SEQ ID NO: 3089731 - RNA, 16 nt, Molluscum contagiosum virus
gcagugcggaugugcu

SEQ ID NO: 3089732 - RNA, 14 nt, Molluscum contagiosum virus
ccggcguuggcuuu

SEQ ID NO: 3089733 - RNA, 19 nt, Molluscum contagiosum virus
cgggcccgcguggcaaggg

SEQ ID NO: 3089734 - RNA, 19 nt, Molluscum contagiosum virus
cgcacgguagcuagcucug

SEQ ID NO: 3089735 - RNA, 17 nt, Molluscum contagiosum virus
gccgggaauaccggaga

SEQ ID NO: 3089736 - RNA, 15 nt, Molluscum contagiosum virus
gacgccgagcccgag

SEQ ID NO: 3089737 - RNA, 18 nt, Molluscum contagiosum virus
ccaguggccagcgcgcgg

SEQ ID NO: 3089738 - RNA, 13 nt, Molluscum contagiosum virus
gcgcugaaggcau

SEQ ID NO: 3089739 - RNA, 16 nt, Molluscum contagiosum virus
ugacgguacucaugcu

SEQ ID NO: 3089740 - RNA, 18 nt, Molluscum contagiosum virus
gacguggacguggauacc

SEQ ID NO: 3089741 - RNA, 17 nt, Molluscum contagiosum virus
acgaggugcgcgcaaca

SEQ ID NO: 3089742 - RNA, 22 nt, Molluscum contagiosum virus
gagcggaccccggugggggcaa

SEQ ID NO: 3089743 - RNA, 18 nt, Molluscum contagiosum virus
cauguacauagcccccua

SEQ ID NO: 3089744 - RNA, 13 nt, Molluscum contagiosum virus
acgacaaggaaag

SEQ ID NO: 3089745 - RNA, 17 nt, Molluscum contagiosum virus
uccgacccgugcugcuu

SEQ ID NO: 3089746 - RNA, 23 nt, Molluscum contagiosum virus
gaacgccggcgcggggcucgucc

SEQ ID NO: 3089747 - RNA, 22 nt, Molluscum contagiosum virus
ccgagucguacacgcagagcca

SEQ ID NO: 3089748 - RNA, 18 nt, Molluscum contagiosum virus
uagcagcgccugcacgca

SEQ ID NO: 3089749 - RNA, 14 nt, Molluscum contagiosum virus
cucccguggcgcgc

SEQ ID NO: 3089750 - RNA, 13 nt, Molluscum contagiosum virus
cacauugcgaggc

SEQ ID NO: 3089751 - RNA, 22 nt, Molluscum contagiosum virus
cacgcugcguuuccagggcagu

SEQ ID NO: 3089752 - RNA, 13 nt, Molluscum contagiosum virus
agcgguugaccag

SEQ ID NO: 3089753 - RNA, 20 nt, Molluscum contagiosum virus
cgcguccucagguugcucgc

SEQ ID NO: 3089754 - RNA, 18 nt, Molluscum contagiosum virus
gcguucgcgcgugcugga

SEQ ID NO: 3089755 - RNA, 15 nt, Molluscum contagiosum virus
acgaccacgugcagg

SEQ ID NO: 3089756 - RNA, 14 nt, Molluscum contagiosum virus
cacccgcaacaagg

SEQ ID NO: 3089757 - RNA, 18 nt, Molluscum contagiosum virus
ccggagacaccagcuccg

SEQ ID NO: 3089758 - RNA, 17 nt, Molluscum contagiosum virus
gugcgccucgcaggcga

SEQ ID NO: 3089759 - RNA, 14 nt, Molluscum contagiosum virus
gucaucggagagcc

SEQ ID NO: 3089760 - RNA, 18 nt, Molluscum contagiosum virus
cucgagagggagcagccu

SEQ ID NO: 3089761 - RNA, 15 nt, Molluscum contagiosum virus
acgcgcccuggagcg

SEQ ID NO: 3089762 - RNA, 18 nt, Molluscum contagiosum virus
ugccuggagggcagugcc

SEQ ID NO: 3089763 - RNA, 15 nt, Molluscum contagiosum virus
cucgagcgcgcugga

SEQ ID NO: 3089764 - RNA, 12 nt, Molluscum contagiosum virus
ccgagcggggac

SEQ ID NO: 3089765 - RNA, 15 nt, Molluscum contagiosum virus
cuucuaccacagguu

SEQ ID NO: 3089766 - RNA, 16 nt, Molluscum contagiosum virus
cgaggccggcacgagc

SEQ ID NO: 3089767 - RNA, 14 nt, Molluscum contagiosum virus
guccaucggugggc

SEQ ID NO: 3089768 - RNA, 17 nt, Molluscum contagiosum virus
cagcacaggccccagca

SEQ ID NO: 3089769 - RNA, 14 nt, Molluscum contagiosum virus
gauaaaagcacagu

SEQ ID NO: 3089770 - RNA, 20 nt, Molluscum contagiosum virus
acagagaaaggcacccacca

SEQ ID NO: 3089771 - RNA, 18 nt, Molluscum contagiosum virus
gcaccggcgcucacugcg

SEQ ID NO: 3089772 - RNA, 22 nt, Molluscum contagiosum virus
gccagccucaucgugagccugg

SEQ ID NO: 3089773 - RNA, 19 nt, Molluscum contagiosum virus
acaugcuguccaccuccuc

SEQ ID NO: 3089774 - RNA, 23 nt, Molluscum contagiosum virus
gcauggacauccucaccuuccug

SEQ ID NO: 3089775 - RNA, 17 nt, Molluscum contagiosum virus
auaaaugaaccugggca

SEQ ID NO: 3089776 - RNA, 15 nt, Molluscum contagiosum virus
ccacgugccagaguc

SEQ ID NO: 3089777 - RNA, 23 nt, Molluscum contagiosum virus
ccggugcugcggcgcgugccgcu

SEQ ID NO: 3089778 - RNA, 21 nt, Molluscum contagiosum virus
aauacggugcagccgcugcug

SEQ ID NO: 3089779 - RNA, 19 nt, Molluscum contagiosum virus
gacggcaccguaccgcgcc

SEQ ID NO: 3089780 - RNA, 13 nt, Molluscum contagiosum virus
gcagcgugucaag

SEQ ID NO: 3089781 - RNA, 13 nt, Molluscum contagiosum virus
cagcucaagcugc

SEQ ID NO: 3089782 - RNA, 16 nt, Molluscum contagiosum virus
ccaugaggacagcuug

SEQ ID NO: 3089783 - RNA, 17 nt, Molluscum contagiosum virus
ucagggcuucuggcaaa

SEQ ID NO: 3089784 - RNA, 18 nt, Molluscum contagiosum virus
ggucgcgcgcgcucugcc

SEQ ID NO: 3089785 - RNA, 14 nt, Molluscum contagiosum virus
aucuucgugcugaa

SEQ ID NO: 3089786 - RNA, 16 nt, Molluscum contagiosum virus
gcgcacgugcgcgccg

SEQ ID NO: 3089787 - RNA, 16 nt, Molluscum contagiosum virus
ggcgccgcggcugccu

SEQ ID NO: 3089788 - RNA, 17 nt, Molluscum contagiosum virus
gccuucuucgugcugug

SEQ ID NO: 3089789 - RNA, 18 nt, Molluscum contagiosum virus
ccugucggcacaucucuc

SEQ ID NO: 3089790 - RNA, 16 nt, Molluscum contagiosum virus
gcuucgucuucaccug

SEQ ID NO: 3089791 - RNA, 21 nt, Molluscum contagiosum virus
gcagagcuccccgcgcgcagc

SEQ ID NO: 3089792 - RNA, 23 nt, Molluscum contagiosum virus
gcucgagccugccagcgccagcc

SEQ ID NO: 3089793 - RNA, 16 nt, Molluscum contagiosum virus
aaugcgucccagcagc

SEQ ID NO: 3089794 - RNA, 20 nt, Molluscum contagiosum virus
agcacggcuuccggcaccac

SEQ ID NO: 3089795 - RNA, 14 nt, Molluscum contagiosum virus
cacgagcacugccu

SEQ ID NO: 3089796 - RNA, 23 nt, Molluscum contagiosum virus
gcagcagcucggggcugucagag

SEQ ID NO: 3089797 - RNA, 21 nt, Molluscum contagiosum virus
cugcucucggcagcgucgcgg

SEQ ID NO: 3089798 - RNA, 18 nt, Molluscum contagiosum virus
gcuuuuguuacucucaga

SEQ ID NO: 3089799 - RNA, 21 nt, Molluscum contagiosum virus
uugucgagacaggccggggcc

SEQ ID NO: 3089800 - RNA, 17 nt, Molluscum contagiosum virus
caugcgcaagcagcucg

SEQ ID NO: 3089801 - RNA, 20 nt, Molluscum contagiosum virus
acuugucaggccggccgugg

SEQ ID NO: 3089802 - RNA, 21 nt, Molluscum contagiosum virus
ucacgacuguguucccggcug

SEQ ID NO: 3089803 - RNA, 16 nt, Molluscum contagiosum virus
gcuccgacgcgguggu

SEQ ID NO: 3089804 - RNA, 18 nt, Molluscum contagiosum virus
ggccauggagcgcccgcu

SEQ ID NO: 3089805 - RNA, 15 nt, Molluscum contagiosum virus
cagaaacucuccgac

SEQ ID NO: 3089806 - RNA, 19 nt, Molluscum contagiosum virus
acagacauggcccgcgcgg

SEQ ID NO: 3089807 - RNA, 16 nt, Molluscum contagiosum virus
ugcucuaccuggugcu

SEQ ID NO: 3089808 - RNA, 19 nt, Molluscum contagiosum virus
uccgcgagcuaaucagcgc

SEQ ID NO: 3089809 - RNA, 21 nt, Molluscum contagiosum virus
agcacggcuugccgcucggca

SEQ ID NO: 3089810 - RNA, 16 nt, Molluscum contagiosum virus
cacuccagcgcgcccu

SEQ ID NO: 3089811 - RNA, 15 nt, Molluscum contagiosum virus
cccgugucgggcugc

SEQ ID NO: 3089812 - RNA, 17 nt, Molluscum contagiosum virus
aagcacggaaacacucg

SEQ ID NO: 3089813 - RNA, 23 nt, Molluscum contagiosum virus
gcaccucccugugaacgcaccgc

SEQ ID NO: 3089814 - RNA, 15 nt, Molluscum contagiosum virus
cucucgagcacuucc

SEQ ID NO: 3089815 - RNA, 18 nt, Molluscum contagiosum virus
cuccugaggaagcaagac

SEQ ID NO: 3089816 - RNA, 17 nt, Molluscum contagiosum virus
gaacaccacacgcgcgg

SEQ ID NO: 3089817 - RNA, 13 nt, Molluscum contagiosum virus
gacgugcugcugg

SEQ ID NO: 3089818 - RNA, 12 nt, Molluscum contagiosum virus
aaaugcgcugcu

SEQ ID NO: 3089819 - RNA, 14 nt, Molluscum contagiosum virus
gucuccuccugaug

SEQ ID NO: 3089820 - RNA, 20 nt, Molluscum contagiosum virus
acuacugcuccauggagcgc

SEQ ID NO: 3089821 - RNA, 11 nt, Molluscum contagiosum virus
aacagcuucac

SEQ ID NO: 3089822 - RNA, 18 nt, Molluscum contagiosum virus
cuccaggaacgcgccgcg

SEQ ID NO: 3089823 - RNA, 11 nt, Molluscum contagiosum virus
ggucccuagcc

SEQ ID NO: 3089824 - RNA, 21 nt, Molluscum contagiosum virus
gcagccccguaggcgggccug

SEQ ID NO: 3089825 - RNA, 17 nt, Molluscum contagiosum virus
cgggcccgugcccgagc

SEQ ID NO: 3089826 - RNA, 14 nt, Molluscum contagiosum virus
uccucucuccccuu

SEQ ID NO: 3089827 - RNA, 17 nt, Molluscum contagiosum virus
ucaacggcacagucugg

SEQ ID NO: 3089828 - RNA, 18 nt, Molluscum contagiosum virus
gcacugcgcgucugugcg

SEQ ID NO: 3089829 - RNA, 14 nt, Molluscum contagiosum virus
gcacgccagccugg

SEQ ID NO: 3089830 - RNA, 22 nt, Molluscum contagiosum virus
accgagcaagcuggaggcugcc

SEQ ID NO: 3089831 - RNA, 17 nt, Molluscum contagiosum virus
ugccuuucaggggucug

SEQ ID NO: 3089832 - RNA, 16 nt, Molluscum contagiosum virus
ggcacgcagcucuucc

SEQ ID NO: 3089833 - RNA, 18 nt, Molluscum contagiosum virus
cuuacgcuacagcagccg

SEQ ID NO: 3089834 - RNA, 13 nt, Molluscum contagiosum virus
caugcggagcugg

SEQ ID NO: 3089835 - RNA, 21 nt, Molluscum contagiosum virus
gugccuggcguccgcacgcac

SEQ ID NO: 3089836 - RNA, 14 nt, Molluscum contagiosum virus
augaggcugcucuc

SEQ ID NO: 3089837 - RNA, 17 nt, Molluscum contagiosum virus
gauuccgucccccgcgg

SEQ ID NO: 3089838 - RNA, 19 nt, Molluscum contagiosum virus
gcccucgcgcgcgcgcggc

SEQ ID NO: 3089839 - RNA, 21 nt, Molluscum contagiosum virus
cagcagguucgugcgcaugaa

SEQ ID NO: 3089840 - RNA, 22 nt, Molluscum contagiosum virus
ugcgcaugguggcgauccuguc

SEQ ID NO: 3089841 - RNA, 21 nt, Molluscum contagiosum virus
ucuugguggacagccuuugug

SEQ ID NO: 3089842 - RNA, 18 nt, Molluscum contagiosum virus
ggcguccggugcucgccc

SEQ ID NO: 3089843 - RNA, 18 nt, Molluscum contagiosum virus
ggcguccggcgcucgccu

SEQ ID NO: 3089844 - RNA, 18 nt, Molluscum contagiosum virus
gcgcggcagcagccucgu

SEQ ID NO: 3089845 - RNA, 13 nt, Molluscum contagiosum virus
ccggcugcuccuc

SEQ ID NO: 3089846 - RNA, 15 nt, Molluscum contagiosum virus
cuggacugugcuucc

SEQ ID NO: 3089847 - RNA, 13 nt, Molluscum contagiosum virus
gccugugcccugg

SEQ ID NO: 3089848 - RNA, 21 nt, Molluscum contagiosum virus
aaagcacagcaggagcacgcc

SEQ ID NO: 3089849 - RNA, 16 nt, Molluscum contagiosum virus
ggcgccauugcucgcg

SEQ ID NO: 3089850 - RNA, 17 nt, Molluscum contagiosum virus
cgcgacuaccugcugcu

SEQ ID NO: 3089851 - RNA, 20 nt, Molluscum contagiosum virus
gagcugcugcccgccuucga

SEQ ID NO: 3089852 - RNA, 17 nt, Molluscum contagiosum virus
ggcgagcuagugcacac

SEQ ID NO: 3089853 - RNA, 12 nt, Molluscum contagiosum virus
cacaccagcugg

SEQ ID NO: 3089854 - RNA, 12 nt, Molluscum contagiosum virus
gcgccucucgag

SEQ ID NO: 3089855 - RNA, 13 nt, Molluscum contagiosum virus
ggcgcgggcgcgc

SEQ ID NO: 3089856 - RNA, 14 nt, Molluscum contagiosum virus
guggcgcugggcgc

SEQ ID NO: 3089857 - RNA, 15 nt, Molluscum contagiosum virus
uccucccugcgggcg

SEQ ID NO: 3089858 - RNA, 20 nt, Molluscum contagiosum virus
gcgcgagauucuggcgcgcg

SEQ ID NO: 3089859 - RNA, 16 nt, Molluscum contagiosum virus
ccggcagcgacuacgc

SEQ ID NO: 3089860 - RNA, 14 nt, Molluscum contagiosum virus
ggcggcgcuggaga

SEQ ID NO: 3089861 - RNA, 21 nt, Molluscum contagiosum virus
augccuuuccgagcucgcaaa

SEQ ID NO: 3089862 - RNA, 14 nt, Molluscum contagiosum virus
ggcgcccgcggaca

SEQ ID NO: 3089863 - RNA, 15 nt, Molluscum contagiosum virus
cgcuggccucugcca

SEQ ID NO: 3089864 - RNA, 20 nt, Molluscum contagiosum virus
cgaucgcgucacguccucaa

SEQ ID NO: 3089865 - RNA, 23 nt, Molluscum contagiosum virus
gaggacgccggcaagccgagcca

SEQ ID NO: 3089866 - RNA, 14 nt, Molluscum contagiosum virus
cgcgagugugcaug

SEQ ID NO: 3089867 - RNA, 16 nt, Molluscum contagiosum virus
acccguggccgagccg

SEQ ID NO: 3089868 - RNA, 17 nt, Molluscum contagiosum virus
gccggcacgagcagucc

SEQ ID NO: 3089869 - RNA, 13 nt, Molluscum contagiosum virus
cucacggcugugg

SEQ ID NO: 3089870 - RNA, 13 nt, Molluscum contagiosum virus
gcucuccaugcgc

SEQ ID NO: 3089871 - RNA, 15 nt, Molluscum contagiosum virus
acgcacgcgcgggca

SEQ ID NO: 3089872 - RNA, 16 nt, Molluscum contagiosum virus
aucccaagagccaugu

SEQ ID NO: 3089873 - RNA, 14 nt, Molluscum contagiosum virus
gauggcgcagcucc

SEQ ID NO: 3089874 - RNA, 20 nt, Molluscum contagiosum virus
gccgaccauuuccugcgagu

SEQ ID NO: 3089875 - RNA, 19 nt, Molluscum contagiosum virus
gagaugcgguccgacucgg

SEQ ID NO: 3089876 - RNA, 17 nt, Molluscum contagiosum virus
gccacggcugcaagcac

SEQ ID NO: 3089877 - RNA, 18 nt, Molluscum contagiosum virus
gcacgauguacuccacca

SEQ ID NO: 3089878 - RNA, 17 nt, Molluscum contagiosum virus
gacggccguuuuuggga

SEQ ID NO: 3089879 - RNA, 17 nt, Molluscum contagiosum virus
gagaggaaaggcgcacc

SEQ ID NO: 3089880 - RNA, 18 nt, Molluscum contagiosum virus
uuuccuugccuucucgaa

SEQ ID NO: 3089881 - RNA, 16 nt, Molluscum contagiosum virus
gcguggcgcaccugcu

SEQ ID NO: 3089882 - RNA, 20 nt, Molluscum contagiosum virus
cuggcccugcuugacgcgag

SEQ ID NO: 3089883 - RNA, 20 nt, Molluscum contagiosum virus
ggccgcgcucgucggcggca

SEQ ID NO: 3089884 - RNA, 21 nt, Molluscum contagiosum virus
cucagcaggcuguguuccagc

SEQ ID NO: 3089885 - RNA, 19 nt, Molluscum contagiosum virus
caccgaggagccgcgcuuc

SEQ ID NO: 3089886 - RNA, 15 nt, Molluscum contagiosum virus
cacguugcagcagca

SEQ ID NO: 3089887 - RNA, 17 nt, Molluscum contagiosum virus
gccgugugaucaagagc

SEQ ID NO: 3089888 - RNA, 15 nt, Molluscum contagiosum virus
agacaggccggggcc

SEQ ID NO: 3089889 - RNA, 18 nt, Molluscum contagiosum virus
agcaagacccagcaaggc

SEQ ID NO: 3089890 - RNA, 14 nt, Molluscum contagiosum virus
uccaagaagaggcc

SEQ ID NO: 3089891 - RNA, 22 nt, Molluscum contagiosum virus
ccugcgacagcugcugcucgca

SEQ ID NO: 3089892 - RNA, 16 nt, Molluscum contagiosum virus
cccagcagcugcuccg

SEQ ID NO: 3089893 - RNA, 17 nt, Molluscum contagiosum virus
caacguaguacugcagc

SEQ ID NO: 3089894 - RNA, 13 nt, Molluscum contagiosum virus
guggcgcugcugc

SEQ ID NO: 3089895 - RNA, 15 nt, Molluscum contagiosum virus
cgcgaccuccgcucu

SEQ ID NO: 3089896 - RNA, 21 nt, Molluscum contagiosum virus
gcgccggaaagaagggcucgc

SEQ ID NO: 3089897 - RNA, 17 nt, Molluscum contagiosum virus
agccgcaaccucuuccg

SEQ ID NO: 3089898 - RNA, 15 nt, Molluscum contagiosum virus
cuuggcagcaacugc

SEQ ID NO: 3089899 - RNA, 23 nt, Molluscum contagiosum virus
acgcgaaguuccugcauuucaug

SEQ ID NO: 3089900 - RNA, 19 nt, Molluscum contagiosum virus
gacggcugguguuaccggg

SEQ ID NO: 3089901 - RNA, 16 nt, Molluscum contagiosum virus
gcucguggacagccug

SEQ ID NO: 3089902 - RNA, 21 nt, Molluscum contagiosum virus
cuguccgcgggcgcgggccug

SEQ ID NO: 3089903 - RNA, 21 nt, Molluscum contagiosum virus
gucgcgcaucaccgagcgaga

SEQ ID NO: 3089904 - RNA, 22 nt, Molluscum contagiosum virus
ggcaagaccaucaucgcgcugc

SEQ ID NO: 3089905 - RNA, 17 nt, Molluscum contagiosum virus
agcccgcggcgcacggu

SEQ ID NO: 3089906 - RNA, 15 nt, Molluscum contagiosum virus
agaccaccagcacca

SEQ ID NO: 3089907 - RNA, 15 nt, Molluscum contagiosum virus
gcgagugcggccacc

SEQ ID NO: 3089908 - RNA, 15 nt, Molluscum contagiosum virus
ugccugucucgcaag

SEQ ID NO: 3089909 - RNA, 14 nt, Molluscum contagiosum virus
gcaaugggcacgcu

SEQ ID NO: 3089910 - RNA, 15 nt, Molluscum contagiosum virus
acgccuuccugcugg

SEQ ID NO: 3089911 - RNA, 17 nt, Molluscum contagiosum virus
gcgcuugggcacugcua

SEQ ID NO: 3089912 - RNA, 20 nt, Molluscum contagiosum virus
guggaggcgacuggcgacac

SEQ ID NO: 3089913 - RNA, 16 nt, Molluscum contagiosum virus
aacacgcaaucgcgcg

SEQ ID NO: 3089914 - RNA, 18 nt, Molluscum contagiosum virus
auguccggcgcuggagaa

SEQ ID NO: 3089915 - RNA, 13 nt, Molluscum contagiosum virus
caaccgggcucuc

SEQ ID NO: 3089916 - RNA, 13 nt, Molluscum contagiosum virus
agcucagcaggcu

SEQ ID NO: 3089917 - RNA, 20 nt, Molluscum contagiosum virus
guagggugccgaggcgcugc

SEQ ID NO: 3089918 - RNA, 20 nt, Molluscum contagiosum virus
ugccgcggacgccggcgccc

SEQ ID NO: 3089919 - RNA, 20 nt, Molluscum contagiosum virus
cuuagcuuccgucugcugcu

SEQ ID NO: 3089920 - RNA, 15 nt, Molluscum contagiosum virus
gugcccgccaagagc

SEQ ID NO: 3089921 - RNA, 21 nt, Molluscum contagiosum virus
agccuucuucgugcugugccu

SEQ ID NO: 3089922 - RNA, 18 nt, Molluscum contagiosum virus
gaacccgcauugggccuu

SEQ ID NO: 3089923 - RNA, 17 nt, Molluscum contagiosum virus
cuacacauuccucggcg

SEQ ID NO: 3089924 - RNA, 19 nt, Molluscum contagiosum virus
gcggacgcgggccuguccg

SEQ ID NO: 3089925 - RNA, 21 nt, Molluscum contagiosum virus
aauggccuugcgagcgcugcc

SEQ ID NO: 3089926 - RNA, 22 nt, Molluscum contagiosum virus
uucgccggcaucgcgcugcugg

SEQ ID NO: 3089927 - RNA, 12 nt, Molluscum contagiosum virus
auggcugcucuc

SEQ ID NO: 3089928 - RNA, 12 nt, Molluscum contagiosum virus
cgcgcgagcgga

SEQ ID NO: 3089929 - RNA, 16 nt, Molluscum contagiosum virus
gccgcaggccaggugc

SEQ ID NO: 3089930 - RNA, 13 nt, Molluscum contagiosum virus
gccgagguggcac

SEQ ID NO: 3089931 - RNA, 13 nt, Molluscum contagiosum virus
aggcgcaggccgc

SEQ ID NO: 3089932 - RNA, 12 nt, Molluscum contagiosum virus
gcaacugccugc

SEQ ID NO: 3089933 - RNA, 12 nt, Molluscum contagiosum virus
cggagcugugcc

SEQ ID NO: 3089934 - RNA, 20 nt, Molluscum contagiosum virus
gaacagagaaaggcacccac

SEQ ID NO: 3089935 - RNA, 22 nt, Molluscum contagiosum virus
gacuaugcgucuuccugcugcc

SEQ ID NO: 3089936 - RNA, 15 nt, Molluscum contagiosum virus
guucugcgcugccag

SEQ ID NO: 3089937 - RNA, 14 nt, Molluscum contagiosum virus
gaagagucgcgccu

SEQ ID NO: 3089938 - RNA, 17 nt, Molluscum contagiosum virus
cagcguggagcaccugg

SEQ ID NO: 3089939 - RNA, 20 nt, Molluscum contagiosum virus
gcugcgcauggccacgcccg

SEQ ID NO: 3089940 - RNA, 13 nt, Molluscum contagiosum virus
uggcaaacaggca

SEQ ID NO: 3089941 - RNA, 20 nt, Molluscum contagiosum virus
gcccggacacguagcccagg

SEQ ID NO: 3089942 - RNA, 18 nt, Molluscum contagiosum virus
cgggcguggggagcugga

SEQ ID NO: 3089943 - RNA, 19 nt, Molluscum contagiosum virus
ggcgacaacgacagagccc

SEQ ID NO: 3089944 - RNA, 17 nt, Molluscum contagiosum virus
ggccagcagcuccuggu

SEQ ID NO: 3089945 - RNA, 17 nt, Molluscum contagiosum virus
augguggcgcugcugcc

SEQ ID NO: 3089946 - RNA, 16 nt, Molluscum contagiosum virus
agcaugcgugcaacag

SEQ ID NO: 3089947 - RNA, 16 nt, Molluscum contagiosum virus
cugcgcucgccugcuu

SEQ ID NO: 3089948 - RNA, 22 nt, Molluscum contagiosum virus
cgagaucacggcgugcgcgaga

SEQ ID NO: 3089949 - RNA, 20 nt, Molluscum contagiosum virus
gcgcugcgcgcgcucgcgca

SEQ ID NO: 3089950 - RNA, 23 nt, Molluscum contagiosum virus
ccgacgggccccuguuggccccg

SEQ ID NO: 3089951 - RNA, 15 nt, Molluscum contagiosum virus
cuucgggccgcugcc

SEQ ID NO: 3089952 - RNA, 16 nt, Molluscum contagiosum virus
cuccucgagcgccgcc

SEQ ID NO: 3089953 - RNA, 16 nt, Molluscum contagiosum virus
uccuugcgcuuguccu

SEQ ID NO: 3089954 - RNA, 17 nt, Molluscum contagiosum virus
ggcgacgagggcgccaa

SEQ ID NO: 3089955 - RNA, 20 nt, Molluscum contagiosum virus
uaccggagacaccagcuccg

SEQ ID NO: 3089956 - RNA, 18 nt, Molluscum contagiosum virus
ggacgccagcuugagcac

SEQ ID NO: 3089957 - RNA, 13 nt, Molluscum contagiosum virus
gucgacagagaag

SEQ ID NO: 3089958 - RNA, 18 nt, Molluscum contagiosum virus
cggucaacggcacagucu

SEQ ID NO: 3089959 - RNA, 14 nt, Molluscum contagiosum virus
caggaccugcuggu

SEQ ID NO: 3089960 - RNA, 22 nt, Molluscum contagiosum virus
gcaugaaaggcaccugcggcuc

SEQ ID NO: 3089961 - RNA, 17 nt, Molluscum contagiosum virus
cagacgugcacaaagcc

SEQ ID NO: 3089962 - RNA, 16 nt, Molluscum contagiosum virus
agcuccgccgggaaua

SEQ ID NO: 3089963 - RNA, 15 nt, Molluscum contagiosum virus
caagaagcggcccug

SEQ ID NO: 3089964 - RNA, 23 nt, Molluscum contagiosum virus
caaggaaaggcacccgcaggaaa

SEQ ID NO: 3089965 - RNA, 23 nt, Molluscum contagiosum virus
cgccgguggcgcgcgagcugcug

SEQ ID NO: 3089966 - RNA, 18 nt, Molluscum contagiosum virus
uucgcagaggacagcucc

SEQ ID NO: 3089967 - RNA, 21 nt, Molluscum contagiosum virus
ccucgaagcgagagguugggg

SEQ ID NO: 3089968 - RNA, 23 nt, Molluscum contagiosum virus
ugccugcgcaacgcgggccaggc

SEQ ID NO: 3089969 - RNA, 22 nt, Molluscum contagiosum virus
ugcuccccgaaauggcccccgc

SEQ ID NO: 3089970 - RNA, 12 nt, Molluscum contagiosum virus
acuggacugagc

SEQ ID NO: 3089971 - RNA, 19 nt, Molluscum contagiosum virus
cgaccucuuuccgcgcuuu

SEQ ID NO: 3089972 - RNA, 22 nt, Molluscum contagiosum virus
uccgggcacguccgccucggaa

SEQ ID NO: 3089973 - RNA, 14 nt, Molluscum contagiosum virus
cucgcgcgcacgcg

SEQ ID NO: 3089974 - RNA, 18 nt, Molluscum contagiosum virus
cuaccacgagcacugccu

SEQ ID NO: 3089975 - RNA, 16 nt, Molluscum contagiosum virus
acgcugcgcgugcugg

SEQ ID NO: 3089976 - RNA, 21 nt, Molluscum contagiosum virus
uccacaaagcccuccugagaa

SEQ ID NO: 3089977 - RNA, 18 nt, Molluscum contagiosum virus
gccacgcagaucaggagc

SEQ ID NO: 3089978 - RNA, 19 nt, Molluscum contagiosum virus
accagcuggacggugcugg

SEQ ID NO: 3089979 - RNA, 16 nt, Molluscum contagiosum virus
ggcucgugcuggagca

SEQ ID NO: 3089980 - RNA, 15 nt, Molluscum contagiosum virus
uagcgguguugcugu

SEQ ID NO: 3089981 - RNA, 21 nt, Molluscum contagiosum virus
agcucugauuacauccugccc

SEQ ID NO: 3089982 - RNA, 16 nt, Molluscum contagiosum virus
gcucgcgcgccagcac

SEQ ID NO: 3089983 - RNA, 21 nt, Molluscum contagiosum virus
ugaccuucaccaucaacaucu

SEQ ID NO: 3089984 - RNA, 18 nt, Molluscum contagiosum virus
cugcugggcguggcgcac

SEQ ID NO: 3089985 - RNA, 23 nt, Molluscum contagiosum virus
ggagcgagugcgcgugcgccugc

SEQ ID NO: 3089986 - RNA, 17 nt, Molluscum contagiosum virus
caugcggcaggcgcugc

SEQ ID NO: 3089987 - RNA, 19 nt, Molluscum contagiosum virus
agauggucacgcgcaaggc

SEQ ID NO: 3089988 - RNA, 18 nt, Molluscum contagiosum virus
cgggcacgugcugcugcg

SEQ ID NO: 3089989 - RNA, 13 nt, Molluscum contagiosum virus
gccggcugcccug

SEQ ID NO: 3089990 - RNA, 18 nt, Molluscum contagiosum virus
gcagguugaagcucucgc

SEQ ID NO: 3089991 - RNA, 19 nt, Molluscum contagiosum virus
cagccgagcgccgccagcu

SEQ ID NO: 3089992 - RNA, 12 nt, Molluscum contagiosum virus
ggcauggagggc

SEQ ID NO: 3089993 - RNA, 16 nt, Molluscum contagiosum virus
gccgcggcgcccacgg

SEQ ID NO: 3089994 - RNA, 19 nt, Molluscum contagiosum virus
gcacgaccacgugcaggau

SEQ ID NO: 3089995 - RNA, 22 nt, Molluscum contagiosum virus
cggcgcucgccuuuccccggcg

SEQ ID NO: 3089996 - RNA, 14 nt, Molluscum contagiosum virus
cguagagcagcgcu

SEQ ID NO: 3089997 - RNA, 16 nt, Molluscum contagiosum virus
ggcgcaacgcuggccg

SEQ ID NO: 3089998 - RNA, 18 nt, Molluscum contagiosum virus
aauggggcaaacgcugac

SEQ ID NO: 3089999 - RNA, 15 nt, Molluscum contagiosum virus
agccagccaggcgcc

SEQ ID NO: 3090000 - RNA, 22 nt, Molluscum contagiosum virus
ugguguacgaaaguacuuuugc

SEQ ID NO: 3090001 - RNA, 16 nt, Molluscum contagiosum virus
ggccugcguggacagc

SEQ ID NO: 3090002 - RNA, 13 nt, Molluscum contagiosum virus
acgucuuucucga

SEQ ID NO: 3090003 - RNA, 12 nt, Molluscum contagiosum virus
ccgaccaccagg

SEQ ID NO: 3090004 - RNA, 18 nt, Molluscum contagiosum virus
ccgugucgggcugcaucu

SEQ ID NO: 3090005 - RNA, 15 nt, Molluscum contagiosum virus
uggccagccucaucg

SEQ ID NO: 3090006 - RNA, 16 nt, Molluscum contagiosum virus
cgcucgccucugggcg

SEQ ID NO: 3090007 - RNA, 23 nt, Molluscum contagiosum virus
gcugcgcgaguaccugggcaggc

SEQ ID NO: 3090008 - RNA, 22 nt, Molluscum contagiosum virus
gcccagaacaugucgagaccuu

SEQ ID NO: 3090009 - RNA, 16 nt, Molluscum contagiosum virus
acgggcucgugcugga

SEQ ID NO: 3090010 - RNA, 23 nt, Molluscum contagiosum virus
cugcggguaguugcgagccagcc

SEQ ID NO: 3090011 - RNA, 21 nt, Molluscum contagiosum virus
ccgccagcgacgagcagcugc

SEQ ID NO: 3090012 - RNA, 14 nt, Molluscum contagiosum virus
gcggcggagacuga

SEQ ID NO: 3090013 - RNA, 20 nt, Molluscum contagiosum virus
aguccgucacggacagcagc

SEQ ID NO: 3090014 - RNA, 14 nt, Molluscum contagiosum virus
aucgccagcaucaa

SEQ ID NO: 3090015 - RNA, 14 nt, Molluscum contagiosum virus
accccgaaaggcac

SEQ ID NO: 3090016 - RNA, 21 nt, Molluscum contagiosum virus
ugagcgggguacaggcgcggc

SEQ ID NO: 3090017 - RNA, 17 nt, Molluscum contagiosum virus
uaccugguggagcacuu

SEQ ID NO: 3090018 - RNA, 12 nt, Molluscum contagiosum virus
uaccugcugcug

SEQ ID NO: 3090019 - RNA, 23 nt, Molluscum contagiosum virus
ccgcaggaaagguacccgcagga

SEQ ID NO: 3090020 - RNA, 18 nt, Molluscum contagiosum virus
cuggagcuggcugggcac

SEQ ID NO: 3090021 - RNA, 22 nt, Molluscum contagiosum virus
gccggcgggcgcgugcucacgc

SEQ ID NO: 3090022 - RNA, 15 nt, Molluscum contagiosum virus
gacacugugcuggcg

SEQ ID NO: 3090023 - RNA, 13 nt, Molluscum contagiosum virus
ccgagcuguucaa

SEQ ID NO: 3090024 - RNA, 22 nt, Molluscum contagiosum virus
acgcucgcgcuguauucggcgu

SEQ ID NO: 3090025 - RNA, 13 nt, Molluscum contagiosum virus
cgcaggccgcgcc

SEQ ID NO: 3090026 - RNA, 14 nt, Molluscum contagiosum virus
cuggccggcucgcu

SEQ ID NO: 3090027 - RNA, 20 nt, Molluscum contagiosum virus
cuuggcaauggcgcgcagcu

SEQ ID NO: 3090028 - RNA, 19 nt, Molluscum contagiosum virus
gcgcacgcgagcacgccug

SEQ ID NO: 3090029 - RNA, 19 nt, Molluscum contagiosum virus
gacaaggaaaggcacccac

SEQ ID NO: 3090030 - RNA, 21 nt, Molluscum contagiosum virus
gcugcgcgacgucgucaagga

SEQ ID NO: 3090031 - RNA, 13 nt, Molluscum contagiosum virus
cgugcaagcccag

SEQ ID NO: 3090032 - RNA, 18 nt, Molluscum contagiosum virus
gcccgagcccggccagac

SEQ ID NO: 3090033 - RNA, 23 nt, Molluscum contagiosum virus
ugccagcgggaaacugcugcccg

SEQ ID NO: 3090034 - RNA, 20 nt, Molluscum contagiosum virus
ucuccacgucgaucagcucc

SEQ ID NO: 3090035 - RNA, 14 nt, Molluscum contagiosum virus
acgagcagcugcug

SEQ ID NO: 3090036 - RNA, 21 nt, Molluscum contagiosum virus
gccuucguggagcccgugcug

SEQ ID NO: 3090037 - RNA, 21 nt, Molluscum contagiosum virus
ccgaagccgcaggccaggugc

SEQ ID NO: 3090038 - RNA, 17 nt, Molluscum contagiosum virus
cagcuccagcauggcgc

SEQ ID NO: 3090039 - RNA, 23 nt, Molluscum contagiosum virus
cucccaggaagacgugcugcgcg

SEQ ID NO: 3090040 - RNA, 21 nt, Molluscum contagiosum virus
caggcggugggcgccgcggcc

SEQ ID NO: 3090041 - RNA, 21 nt, Molluscum contagiosum virus
ccaccugagccucuggaagga

SEQ ID NO: 3090042 - RNA, 17 nt, Molluscum contagiosum virus
gacuacuacguggugcg

SEQ ID NO: 3090043 - RNA, 17 nt, Molluscum contagiosum virus
ggaaacgcuggcgagca

SEQ ID NO: 3090044 - RNA, 22 nt, Molluscum contagiosum virus
gcgcggcgcguccucggccaga

SEQ ID NO: 3090045 - RNA, 13 nt, Molluscum contagiosum virus
gcucgcgugcgug

SEQ ID NO: 3090046 - RNA, 20 nt, Molluscum contagiosum virus
ggcaggagccucuguccugc

SEQ ID NO: 3090047 - RNA, 20 nt, Molluscum contagiosum virus
gcacgcugcguuuccagggc

SEQ ID NO: 3090048 - RNA, 20 nt, Molluscum contagiosum virus
cgcgcgccgguagggugccg

SEQ ID NO: 3090049 - RNA, 14 nt, Molluscum contagiosum virus
gccaugcuccugau

SEQ ID NO: 3090050 - RNA, 18 nt, Molluscum contagiosum virus
gcuggcgcacuggggcga

SEQ ID NO: 3090051 - RNA, 16 nt, Molluscum contagiosum virus
cgcgucgcgcgccgca

SEQ ID NO: 3090052 - RNA, 23 nt, Molluscum contagiosum virus
cagcugcaggaccugcugguggu

SEQ ID NO: 3090053 - RNA, 15 nt, Molluscum contagiosum virus
gcucgcgcacgcgca

SEQ ID NO: 3090054 - RNA, 19 nt, Molluscum contagiosum virus
ucgcgcuuccggcggcucc

SEQ ID NO: 3090055 - RNA, 19 nt, Molluscum contagiosum virus
gacgaugguggcgcugcug

SEQ ID NO: 3090056 - RNA, 18 nt, Molluscum contagiosum virus
gcagaucgcgagaggaga

SEQ ID NO: 3090057 - RNA, 22 nt, Molluscum contagiosum virus
uccggcggcuggaccugcgcca

SEQ ID NO: 3090058 - RNA, 17 nt, Molluscum contagiosum virus
caugcgcgccgcgcugc

SEQ ID NO: 3090059 - RNA, 18 nt, Molluscum contagiosum virus
cagcagaggaguagcgug

SEQ ID NO: 3090060 - RNA, 15 nt, Molluscum contagiosum virus
cucggguuccagcuc

SEQ ID NO: 3090061 - RNA, 17 nt, Molluscum contagiosum virus
ggccaggcacuggcccu

SEQ ID NO: 3090062 - RNA, 16 nt, Molluscum contagiosum virus
gaggcgcuagugcaga

SEQ ID NO: 3090063 - RNA, 18 nt, Molluscum contagiosum virus
caaguucgcugcuggcag

SEQ ID NO: 3090064 - RNA, 23 nt, Molluscum contagiosum virus
agagcuccccgcgcgcagcgcgu

SEQ ID NO: 3090065 - RNA, 17 nt, Molluscum contagiosum virus
gggcuccuucuucagca

SEQ ID NO: 3090066 - RNA, 16 nt, Molluscum contagiosum virus
cgcaaagacggacccg

SEQ ID NO: 3090067 - RNA, 21 nt, Molluscum contagiosum virus
cuccgcggaggccaagcaaac

SEQ ID NO: 3090068 - RNA, 14 nt, Molluscum contagiosum virus
ggcgcccgugccgc

SEQ ID NO: 3090069 - RNA, 18 nt, Molluscum contagiosum virus
gacacgcugcgcgugcug

SEQ ID NO: 3090070 - RNA, 19 nt, Molluscum contagiosum virus
augcgcgggaugcuggacg

SEQ ID NO: 3090071 - RNA, 13 nt, Molluscum contagiosum virus
cucgugcugcucu

SEQ ID NO: 3090072 - RNA, 18 nt, Molluscum contagiosum virus
gugcaguggcuacuggag

SEQ ID NO: 3090073 - RNA, 18 nt, Molluscum contagiosum virus
ggcuguuguacuggagac

SEQ ID NO: 3090074 - RNA, 19 nt, Molluscum contagiosum virus
gccuuucgaguccccagac

SEQ ID NO: 3090075 - RNA, 18 nt, Molluscum contagiosum virus
gggaaagaugaagcucuc

SEQ ID NO: 3090076 - RNA, 22 nt, Molluscum contagiosum virus
cggacgcgggccgcgcgcacaa

SEQ ID NO: 3090077 - RNA, 20 nt, Molluscum contagiosum virus
ccgggccccugucgcgcacg

SEQ ID NO: 3090078 - RNA, 14 nt, Molluscum contagiosum virus
uggacgcuccgagc

SEQ ID NO: 3090079 - RNA, 22 nt, Molluscum contagiosum virus
gccccguaggcgggccugcgcc

SEQ ID NO: 3090080 - RNA, 15 nt, Molluscum contagiosum virus
cgccagugcuuuguc

SEQ ID NO: 3090081 - RNA, 13 nt, Molluscum contagiosum virus
caccugcggcugc

SEQ ID NO: 3090082 - RNA, 16 nt, Molluscum contagiosum virus
uccgagcggcugcucg

SEQ ID NO: 3090083 - RNA, 23 nt, Molluscum contagiosum virus
gcaccagcaccggcguguggcuc

SEQ ID NO: 3090084 - RNA, 18 nt, Molluscum contagiosum virus
acgauaaauggaccucaa

SEQ ID NO: 3090085 - RNA, 17 nt, Molluscum contagiosum virus
cgggcacgugcugcugc

SEQ ID NO: 3090086 - RNA, 14 nt, Molluscum contagiosum virus
gagcgcaugccggg

SEQ ID NO: 3090087 - RNA, 23 nt, Molluscum contagiosum virus
ggacagccaugaggacagcuugc

SEQ ID NO: 3090088 - RNA, 14 nt, Molluscum contagiosum virus
agcccgugcuggag

SEQ ID NO: 3090089 - RNA, 20 nt, Molluscum contagiosum virus
gcgcgagcggagcgggcacg

SEQ ID NO: 3090090 - RNA, 20 nt, Molluscum contagiosum virus
cgcaaggcaugcgcgcagug

SEQ ID NO: 3090091 - RNA, 19 nt, Molluscum contagiosum virus
ccuggugugccagcggcgc

SEQ ID NO: 3090092 - RNA, 17 nt, Molluscum contagiosum virus
ccaguaagcgacagguc

SEQ ID NO: 3090093 - RNA, 16 nt, Molluscum contagiosum virus
gugcgugccaggcgua

SEQ ID NO: 3090094 - RNA, 14 nt, Molluscum contagiosum virus
gagcguugucuuga

SEQ ID NO: 3090095 - RNA, 13 nt, Molluscum contagiosum virus
ucgugcuggagca

SEQ ID NO: 3090096 - RNA, 20 nt, Molluscum contagiosum virus
ccccgcgcgcccgcugcgcg

SEQ ID NO: 3090097 - RNA, 12 nt, Molluscum contagiosum virus
gcacgaggagcc

SEQ ID NO: 3090098 - RNA, 20 nt, Molluscum contagiosum virus
cucgacugcguugucuccuc

SEQ ID NO: 3090099 - RNA, 19 nt, Molluscum contagiosum virus
aucccacguacgagcagcu

SEQ ID NO: 3090100 - RNA, 19 nt, Molluscum contagiosum virus
ugccagcgggaaacugcug

SEQ ID NO: 3090101 - RNA, 16 nt, Molluscum contagiosum virus
gccgcccaagggcgua

SEQ ID NO: 3090102 - RNA, 21 nt, Molluscum contagiosum virus
caggucaucgggcugcagccc

SEQ ID NO: 3090103 - RNA, 17 nt, Molluscum contagiosum virus
acagcuccccgcgcaag

SEQ ID NO: 3090104 - RNA, 14 nt, Molluscum contagiosum virus
cgccgccagcuccg

SEQ ID NO: 3090105 - RNA, 21 nt, Molluscum contagiosum virus
cuucccgcugagcgcagcaca

SEQ ID NO: 3090106 - RNA, 23 nt, Molluscum contagiosum virus
agcagcgcgacuagccugugccc

SEQ ID NO: 3090107 - RNA, 22 nt, Molluscum contagiosum virus
cacuucucgagaccucgcgcuu

SEQ ID NO: 3090108 - RNA, 16 nt, Molluscum contagiosum virus
gaccugucgugcaaug

SEQ ID NO: 3090109 - RNA, 21 nt, Molluscum contagiosum virus
ugucgagaccuuccuccaggg

SEQ ID NO: 3090110 - RNA, 23 nt, Molluscum contagiosum virus
ccgcgccccacugugccagcagc

SEQ ID NO: 3090111 - RNA, 14 nt, Molluscum contagiosum virus
ccuucugccugccc

SEQ ID NO: 3090112 - RNA, 20 nt, Molluscum contagiosum virus
cagcucaagacgcugcuggc

SEQ ID NO: 3090113 - RNA, 23 nt, Molluscum contagiosum virus
cgggaagcugcacgugcagcggc

SEQ ID NO: 3090114 - RNA, 15 nt, Molluscum contagiosum virus
gaugcaggcacugcc

SEQ ID NO: 3090115 - RNA, 18 nt, Molluscum contagiosum virus
gagcgacauagcgcacca

SEQ ID NO: 3090116 - RNA, 14 nt, Molluscum contagiosum virus
cacgagcugcugcg

SEQ ID NO: 3090117 - RNA, 15 nt, Molluscum contagiosum virus
acacgcacuggcgcu

SEQ ID NO: 3090118 - RNA, 14 nt, Molluscum contagiosum virus
caccauccugcgcu

SEQ ID NO: 3090119 - RNA, 22 nt, Molluscum contagiosum virus
ccagcugcaaacauugccuggc

SEQ ID NO: 3090120 - RNA, 19 nt, Molluscum contagiosum virus
gccucagccgagcgccgcc

SEQ ID NO: 3090121 - RNA, 14 nt, Molluscum contagiosum virus
gcgcuuccgcgagu

SEQ ID NO: 3090122 - RNA, 17 nt, Molluscum contagiosum virus
gacggugcugcgcacgg

SEQ ID NO: 3090123 - RNA, 23 nt, Molluscum contagiosum virus
guuuccguguccgguacugcugc

SEQ ID NO: 3090124 - RNA, 15 nt, Molluscum contagiosum virus
gcguaucggagucag

SEQ ID NO: 3090125 - RNA, 20 nt, Molluscum contagiosum virus
gcccccgcaaaagaugaaaa

SEQ ID NO: 3090126 - RNA, 17 nt, Molluscum contagiosum virus
acccgagggcgugcgcu

SEQ ID NO: 3090127 - RNA, 17 nt, Molluscum contagiosum virus
aucccugcgcaccugca

SEQ ID NO: 3090128 - RNA, 23 nt, Molluscum contagiosum virus
aacaaguuccccgugagcgcgcu

SEQ ID NO: 3090129 - RNA, 13 nt, Molluscum contagiosum virus
cagcagcgugcau

SEQ ID NO: 3090130 - RNA, 18 nt, Molluscum contagiosum virus
cgcgugcuugcugcgcug

SEQ ID NO: 3090131 - RNA, 13 nt, Molluscum contagiosum virus
ugaugcuuuuguu

SEQ ID NO: 3090132 - RNA, 16 nt, Molluscum contagiosum virus
ggcacccgcaggaaag

SEQ ID NO: 3090133 - RNA, 15 nt, Molluscum contagiosum virus
ccgugcuugcgcacg

SEQ ID NO: 3090134 - RNA, 16 nt, Molluscum contagiosum virus
ucaagaacaauuacuc

SEQ ID NO: 3090135 - RNA, 14 nt, Molluscum contagiosum virus
cacacgcagugcca

SEQ ID NO: 3090136 - RNA, 20 nt, Molluscum contagiosum virus
ggacgcccuccucgaccugc

SEQ ID NO: 3090137 - RNA, 20 nt, Molluscum contagiosum virus
uccaaggaggucccuagccu

SEQ ID NO: 3090138 - RNA, 15 nt, Molluscum contagiosum virus
gagggcgcgcuggag

SEQ ID NO: 3090139 - RNA, 21 nt, Molluscum contagiosum virus
guacgcgugcgcuggcgcgcg

SEQ ID NO: 3090140 - RNA, 15 nt, Molluscum contagiosum virus
guucccauguaggag

SEQ ID NO: 3090141 - RNA, 17 nt, Molluscum contagiosum virus
ugccgcgcgcugcucug

SEQ ID NO: 3090142 - RNA, 16 nt, Molluscum contagiosum virus
gccccugccuuugcca

SEQ ID NO: 3090143 - RNA, 16 nt, Molluscum contagiosum virus
cugagcaagcucaaga

SEQ ID NO: 3090144 - RNA, 22 nt, Molluscum contagiosum virus
cgauggccacgcagaucaggag

SEQ ID NO: 3090145 - RNA, 12 nt, Molluscum contagiosum virus
cgcgagcugcua

SEQ ID NO: 3090146 - RNA, 18 nt, Molluscum contagiosum virus
gcugcggcugcuggagcu

SEQ ID NO: 3090147 - RNA, 23 nt, Molluscum contagiosum virus
gccuucuucgugcugugccuagg

SEQ ID NO: 3090148 - RNA, 14 nt, Molluscum contagiosum virus
cagaacguggucaa

SEQ ID NO: 3090149 - RNA, 13 nt, Molluscum contagiosum virus
aggacgagcugcu

SEQ ID NO: 3090150 - RNA, 22 nt, Molluscum contagiosum virus
cguaaaagugagagauaaaguc

SEQ ID NO: 3090151 - RNA, 21 nt, Molluscum contagiosum virus
uggcgccgcugcuggaacagg

SEQ ID NO: 3090152 - RNA, 22 nt, Molluscum contagiosum virus
aagcuggccgaggucuuccaca

SEQ ID NO: 3090153 - RNA, 21 nt, Molluscum contagiosum virus
gcgcgccgguagggugccgag

SEQ ID NO: 3090154 - RNA, 17 nt, Molluscum contagiosum virus
cgcggcuuggcgcccuu

SEQ ID NO: 3090155 - RNA, 20 nt, Molluscum contagiosum virus
acgacguacgagugcuggag

SEQ ID NO: 3090156 - RNA, 21 nt, Molluscum contagiosum virus
auugagccggacuuguaguuc

SEQ ID NO: 3090157 - RNA, 16 nt, Molluscum contagiosum virus
ucgcucgcucagcccc

SEQ ID NO: 3090158 - RNA, 21 nt, Molluscum contagiosum virus
cgugcucuuucccugccccga

SEQ ID NO: 3090159 - RNA, 17 nt, Molluscum contagiosum virus
gaguccacugccaaagc

SEQ ID NO: 3090160 - RNA, 13 nt, Molluscum contagiosum virus
agaggaaaggcgc

SEQ ID NO: 3090161 - RNA, 21 nt, Molluscum contagiosum virus
ccaucggaacuagcccuagcc

SEQ ID NO: 3090162 - RNA, 17 nt, Molluscum contagiosum virus
auggccggcaacuggcu

SEQ ID NO: 3090163 - RNA, 15 nt, Molluscum contagiosum virus
agcgcgcugcacacc

SEQ ID NO: 3090164 - RNA, 19 nt, Molluscum contagiosum virus
cgagcagauucacgagcuc

SEQ ID NO: 3090165 - RNA, 15 nt, Molluscum contagiosum virus
ccugucggagcagga

SEQ ID NO: 3090166 - RNA, 19 nt, Molluscum contagiosum virus
ggcgcaaccgcgugcgugc

SEQ ID NO: 3090167 - RNA, 10 nt, Molluscum contagiosum virus
uggacugugc

SEQ ID NO: 3090168 - RNA, 23 nt, Molluscum contagiosum virus
gccccucgugugucggcccggag

SEQ ID NO: 3090169 - RNA, 16 nt, Molluscum contagiosum virus
cgcgcgcagcaggugc

SEQ ID NO: 3090170 - RNA, 13 nt, Molluscum contagiosum virus
gccgcaaacacug

SEQ ID NO: 3090171 - RNA, 17 nt, Molluscum contagiosum virus
guuuguggcgacacgga

SEQ ID NO: 3090172 - RNA, 18 nt, Molluscum contagiosum virus
caccagcgcgcagaagcc

SEQ ID NO: 3090173 - RNA, 19 nt, Molluscum contagiosum virus
cagccguggaguccaugcc

SEQ ID NO: 3090174 - RNA, 16 nt, Molluscum contagiosum virus
ggcucgcgagugugca

SEQ ID NO: 3090175 - RNA, 14 nt, Molluscum contagiosum virus
ugguaguugcagcc

SEQ ID NO: 3090176 - RNA, 13 nt, Molluscum contagiosum virus
uccacggacaugg

SEQ ID NO: 3090177 - RNA, 22 nt, Molluscum contagiosum virus
gucgccggacagcucagcaggc

SEQ ID NO: 3090178 - RNA, 15 nt, Molluscum contagiosum virus
ggcccgcgcucgccg

SEQ ID NO: 3090179 - RNA, 15 nt, Molluscum contagiosum virus
ggccgacggcacggg

SEQ ID NO: 3090180 - RNA, 18 nt, Molluscum contagiosum virus
cccacgagcgccagccug

SEQ ID NO: 3090181 - RNA, 18 nt, Molluscum contagiosum virus
guuggcacccuucugagg

SEQ ID NO: 3090182 - RNA, 13 nt, Molluscum contagiosum virus
gcucguccccgug

SEQ ID NO: 3090183 - RNA, 21 nt, Molluscum contagiosum virus
gcugugcgcuacguggcgcga

SEQ ID NO: 3090184 - RNA, 14 nt, Molluscum contagiosum virus
agacgagcugugcg

SEQ ID NO: 3090185 - RNA, 21 nt, Molluscum contagiosum virus
cgcagccuccgugcgccaguc

SEQ ID NO: 3090186 - RNA, 15 nt, Molluscum contagiosum virus
cgugcugcugcagaa

SEQ ID NO: 3090187 - RNA, 13 nt, Molluscum contagiosum virus
uugaaaggcagaa

SEQ ID NO: 3090188 - RNA, 18 nt, Molluscum contagiosum virus
cgguagcguggagcuggu

SEQ ID NO: 3090189 - RNA, 13 nt, Molluscum contagiosum virus
acccagcaaggcc

SEQ ID NO: 3090190 - RNA, 20 nt, Molluscum contagiosum virus
cucuguagcaucugcgacac

SEQ ID NO: 3090191 - RNA, 18 nt, Molluscum contagiosum virus
gcgcuccgagcggcugcu

SEQ ID NO: 3090192 - RNA, 15 nt, Molluscum contagiosum virus
acgcgcucguccgcc

SEQ ID NO: 3090193 - RNA, 22 nt, Molluscum contagiosum virus
gaaggcauaccagauguucucg

SEQ ID NO: 3090194 - RNA, 14 nt, Molluscum contagiosum virus
acaaccacagcucu

SEQ ID NO: 3090195 - RNA, 18 nt, Molluscum contagiosum virus
agugccgcucgcuguccu

SEQ ID NO: 3090196 - RNA, 14 nt, Molluscum contagiosum virus
uacacuuccugcua

SEQ ID NO: 3090197 - RNA, 19 nt, Molluscum contagiosum virus
ccgccguacccggggagaa

SEQ ID NO: 3090198 - RNA, 17 nt, Molluscum contagiosum virus
caaauuccucgagaggg

SEQ ID NO: 3090199 - RNA, 18 nt, Molluscum contagiosum virus
agaggugcgugccccucg

SEQ ID NO: 3090200 - RNA, 18 nt, Molluscum contagiosum virus
caaagaucgcgguggcag

SEQ ID NO: 3090201 - RNA, 16 nt, Molluscum contagiosum virus
agcuggugauccugga

SEQ ID NO: 3090202 - RNA, 18 nt, Molluscum contagiosum virus
augcgcgggaugcuggac

SEQ ID NO: 3090203 - RNA, 23 nt, Molluscum contagiosum virus
gaggagauggaacugcagcagcu

SEQ ID NO: 3090204 - RNA, 17 nt, Molluscum contagiosum virus
cguggggagcuggagcg

SEQ ID NO: 3090205 - RNA, 22 nt, Molluscum contagiosum virus
cucgagcgcgcgccugcuggcg

SEQ ID NO: 3090206 - RNA, 19 nt, Molluscum contagiosum virus
gacgcguacauccgcgagc

SEQ ID NO: 3090207 - RNA, 17 nt, Molluscum contagiosum virus
gccgcgaaagcgucgug

SEQ ID NO: 3090208 - RNA, 20 nt, Molluscum contagiosum virus
acaccauccugcgcuuugcc

SEQ ID NO: 3090209 - RNA, 19 nt, Molluscum contagiosum virus
cagcgacgagcagcugcuu

SEQ ID NO: 3090210 - RNA, 24 nt, Molluscum contagiosum virus
cuugcucgaaguagccuccguagc

SEQ ID NO: 3090211 - RNA, 19 nt, Molluscum contagiosum virus
cugcuagagaaccugugcg

SEQ ID NO: 3090212 - RNA, 15 nt, Molluscum contagiosum virus
cagcucugcagcgcc

SEQ ID NO: 3090213 - RNA, 20 nt, Molluscum contagiosum virus
caagggcggucccgcgaacg

SEQ ID NO: 3090214 - RNA, 22 nt, Molluscum contagiosum virus
acgcagaccacggcgcgccgcc

SEQ ID NO: 3090215 - RNA, 12 nt, Molluscum contagiosum virus
agccagccaggc

SEQ ID NO: 3090216 - RNA, 20 nt, Molluscum contagiosum virus
ugcccgcggagaccaccgcu

SEQ ID NO: 3090217 - RNA, 22 nt, Molluscum contagiosum virus
ggcgcaucucgauucacaucuu

SEQ ID NO: 3090218 - RNA, 16 nt, Molluscum contagiosum virus
cggagcgcuagcaggg

SEQ ID NO: 3090219 - RNA, 22 nt, Molluscum contagiosum virus
cggggaugaacgcgcugcgcca

SEQ ID NO: 3090220 - RNA, 14 nt, Molluscum contagiosum virus
gaggcccaggccau

SEQ ID NO: 3090221 - RNA, 17 nt, Molluscum contagiosum virus
gcaccgcacgccagcag

SEQ ID NO: 3090222 - RNA, 23 nt, Molluscum contagiosum virus
cauuacccccccuucugucccaa

SEQ ID NO: 3090223 - RNA, 15 nt, Molluscum contagiosum virus
ugcgcggacagagcc

SEQ ID NO: 3090224 - RNA, 16 nt, Molluscum contagiosum virus
ggacugggaacccgug

SEQ ID NO: 3090225 - RNA, 17 nt, Molluscum contagiosum virus
ccggacgugcacgcacg

SEQ ID NO: 3090226 - RNA, 15 nt, Molluscum contagiosum virus
cucugcguguacgac

SEQ ID NO: 3090227 - RNA, 12 nt, Molluscum contagiosum virus
ccgaaagcugcc

SEQ ID NO: 3090228 - RNA, 14 nt, Molluscum contagiosum virus
guacuucuacggga

SEQ ID NO: 3090229 - RNA, 17 nt, Molluscum contagiosum virus
cugguuccucuccucau

SEQ ID NO: 3090230 - RNA, 18 nt, Molluscum contagiosum virus
ggugcuggugcuggucaa

SEQ ID NO: 3090231 - RNA, 16 nt, Molluscum contagiosum virus
cacuacaagcagccgc

SEQ ID NO: 3090232 - RNA, 16 nt, Molluscum contagiosum virus
cggcgcggcgagccgc

SEQ ID NO: 3090233 - RNA, 14 nt, Molluscum contagiosum virus
cgcaacaaggaaag

SEQ ID NO: 3090234 - RNA, 23 nt, Molluscum contagiosum virus
gggaacgaggaaaggcaccccga

SEQ ID NO: 3090235 - RNA, 22 nt, Molluscum contagiosum virus
ugccagaagcccugagaaggag

SEQ ID NO: 3090236 - RNA, 14 nt, Molluscum contagiosum virus
uaugcgaggccugc

SEQ ID NO: 3090237 - RNA, 21 nt, Molluscum contagiosum virus
ccagcucggguuccagcuccg

SEQ ID NO: 3090238 - RNA, 20 nt, Molluscum contagiosum virus
cucguggcguugcugcugcg

SEQ ID NO: 3090239 - RNA, 22 nt, Molluscum contagiosum virus
gccuggcggccaaccgccugcu

SEQ ID NO: 3090240 - RNA, 21 nt, Molluscum contagiosum virus
gguccgacaccagcggcaggc

SEQ ID NO: 3090241 - RNA, 14 nt, Molluscum contagiosum virus
gcagcuccagcaug

SEQ ID NO: 3090242 - RNA, 15 nt, Molluscum contagiosum virus
acguagagcagcgcu

SEQ ID NO: 3090243 - RNA, 11 nt, Molluscum contagiosum virus
ggcgcgccgcg

SEQ ID NO: 3090244 - RNA, 17 nt, Molluscum contagiosum virus
cacggacgagcccuucg

SEQ ID NO: 3090245 - RNA, 12 nt, Molluscum contagiosum virus
gugcgccuucgu

SEQ ID NO: 3090246 - RNA, 13 nt, Molluscum contagiosum virus
cacguagaggaag

SEQ ID NO: 3090247 - RNA, 21 nt, Molluscum contagiosum virus
aggcgaccagcugguccugaa

SEQ ID NO: 3090248 - RNA, 13 nt, Molluscum contagiosum virus
gcgcgugcugcug

SEQ ID NO: 3090249 - RNA, 14 nt, Molluscum contagiosum virus
ggccucguccugga

SEQ ID NO: 3090250 - RNA, 21 nt, Molluscum contagiosum virus
gccuccguuucccgcggcgug

SEQ ID NO: 3090251 - RNA, 23 nt, Molluscum contagiosum virus
ggcggagacgucuucgcgagcgu

SEQ ID NO: 3090252 - RNA, 14 nt, Molluscum contagiosum virus
gugacacgagccgu

SEQ ID NO: 3090253 - RNA, 15 nt, Molluscum contagiosum virus
cgccgcgcgcgccgg

SEQ ID NO: 3090254 - RNA, 14 nt, Molluscum contagiosum virus
cgcggugcagcugc

SEQ ID NO: 3090255 - RNA, 16 nt, Molluscum contagiosum virus
aagagcguccagccgc

SEQ ID NO: 3090256 - RNA, 17 nt, Molluscum contagiosum virus
caagcacgagcugcugc

SEQ ID NO: 3090257 - RNA, 20 nt, Molluscum contagiosum virus
ggcgcgugccgcugcgcgga

SEQ ID NO: 3090258 - RNA, 13 nt, Molluscum contagiosum virus
gccugugcuggcg

SEQ ID NO: 3090259 - RNA, 18 nt, Molluscum contagiosum virus
guggucgccuacgaggug

SEQ ID NO: 3090260 - RNA, 13 nt, Molluscum contagiosum virus
ggccgccgugugc

SEQ ID NO: 3090261 - RNA, 24 nt, Molluscum contagiosum virus
gcuaccgcgacggcgugcuggcca

SEQ ID NO: 3090262 - RNA, 13 nt, Molluscum contagiosum virus
gcugacgcgcagu

SEQ ID NO: 3090263 - RNA, 23 nt, Molluscum contagiosum virus
gcuuugaggaacuagugcugcug

SEQ ID NO: 3090264 - RNA, 12 nt, Molluscum contagiosum virus
uggccgagccgc

SEQ ID NO: 3090265 - RNA, 18 nt, Molluscum contagiosum virus
cgaacaaaaaacaacucu

SEQ ID NO: 3090266 - RNA, 23 nt, Molluscum contagiosum virus
gcacaagccguccgccucgagca

SEQ ID NO: 3090267 - RNA, 16 nt, Molluscum contagiosum virus
agcugcaccggcgcga

SEQ ID NO: 3090268 - RNA, 18 nt, Molluscum contagiosum virus
cucgggugugugccugcu

SEQ ID NO: 3090269 - RNA, 14 nt, Molluscum contagiosum virus
cgccgggccccugu

SEQ ID NO: 3090270 - RNA, 14 nt, Molluscum contagiosum virus
ccgcgaaggagaga

SEQ ID NO: 3090271 - RNA, 20 nt, Molluscum contagiosum virus
uuccacuacaagcagccgca

SEQ ID NO: 3090272 - RNA, 19 nt, Molluscum contagiosum virus
ccacguacgagcagcugcu

SEQ ID NO: 3090273 - RNA, 18 nt, Molluscum contagiosum virus
gugucgagcucgcgcgcc

SEQ ID NO: 3090274 - RNA, 20 nt, Molluscum contagiosum virus
cgaggaccggcgcaacgagc

SEQ ID NO: 3090275 - RNA, 12 nt, Molluscum contagiosum virus
agagcagugccg

SEQ ID NO: 3090276 - RNA, 12 nt, Molluscum contagiosum virus
gagcagcugcug

SEQ ID NO: 3090277 - RNA, 20 nt, Molluscum contagiosum virus
ggcucuggagcggccacucu

SEQ ID NO: 3090278 - RNA, 19 nt, Molluscum contagiosum virus
cacggacucgccgcgcgcc

SEQ ID NO: 3090279 - RNA, 18 nt, Molluscum contagiosum virus
gggcagcuucugcucgcg

SEQ ID NO: 3090280 - RNA, 18 nt, Molluscum contagiosum virus
gcgcaacgagcagcccgu

SEQ ID NO: 3090281 - RNA, 16 nt, Molluscum contagiosum virus
gcguacagcgcgcgug

SEQ ID NO: 3090282 - RNA, 15 nt, Molluscum contagiosum virus
ccgcgcugcuggcca

SEQ ID NO: 3090283 - RNA, 19 nt, Molluscum contagiosum virus
aacguagacagugcggcgc

SEQ ID NO: 3090284 - RNA, 19 nt, Molluscum contagiosum virus
ucucgcuggcuccgcugga

SEQ ID NO: 3090285 - RNA, 23 nt, Molluscum contagiosum virus
ccugugcgccaacaaccacucuu

SEQ ID NO: 3090286 - RNA, 23 nt, Molluscum contagiosum virus
ggcugccguuuuacacagggcuu

SEQ ID NO: 3090287 - RNA, 13 nt, Molluscum contagiosum virus
cacugcagcagcc

SEQ ID NO: 3090288 - RNA, 13 nt, Molluscum contagiosum virus
cagcuugcugcug

SEQ ID NO: 3090289 - RNA, 14 nt, Molluscum contagiosum virus
gccaucgagcuucc

SEQ ID NO: 3090290 - RNA, 23 nt, Molluscum contagiosum virus
cgugcucgguagcguggagcugg

SEQ ID NO: 3090291 - RNA, 21 nt, Molluscum contagiosum virus
gcgcaccgcguugccgcccgc

SEQ ID NO: 3090292 - RNA, 12 nt, Molluscum contagiosum virus
ugcucgccccuc

SEQ ID NO: 3090293 - RNA, 20 nt, Molluscum contagiosum virus
gcucgccuccuugcccgagg

SEQ ID NO: 3090294 - RNA, 13 nt, Molluscum contagiosum virus
cucucgaggcgga

SEQ ID NO: 3090295 - RNA, 17 nt, Molluscum contagiosum virus
cgacgccaucaggaaug

SEQ ID NO: 3090296 - RNA, 23 nt, Molluscum contagiosum virus
cacgacggaacguuggcccgcaa

SEQ ID NO: 3090297 - RNA, 19 nt, Molluscum contagiosum virus
gcucaagacgcugcuggcg

SEQ ID NO: 3090298 - RNA, 17 nt, Molluscum contagiosum virus
gcucuucgagacgcugc

SEQ ID NO: 3090299 - RNA, 20 nt, Molluscum contagiosum virus
cagccgugagcucccgcgcc

SEQ ID NO: 3090300 - RNA, 17 nt, Molluscum contagiosum virus
gaaaacgcgcggcagca

SEQ ID NO: 3090301 - RNA, 16 nt, Molluscum contagiosum virus
guuccggcagcgccgc

SEQ ID NO: 3090302 - RNA, 20 nt, Molluscum contagiosum virus
acggugcagccgcugcugcu

SEQ ID NO: 3090303 - RNA, 20 nt, Molluscum contagiosum virus
ggaggaucgcuacgugcgca

SEQ ID NO: 3090304 - RNA, 13 nt, Molluscum contagiosum virus
gcacgcgcacggg

SEQ ID NO: 3090305 - RNA, 12 nt, Molluscum contagiosum virus
uuguccaaugcu

SEQ ID NO: 3090306 - RNA, 20 nt, Molluscum contagiosum virus
ccucugcgagcgccugcgag

SEQ ID NO: 3090307 - RNA, 13 nt, Molluscum contagiosum virus
gcgcgagcagcug

SEQ ID NO: 3090308 - RNA, 17 nt, Molluscum contagiosum virus
uccugcgcccauuccug

SEQ ID NO: 3090309 - RNA, 18 nt, Molluscum contagiosum virus
gcgcuguauaguccccgg

SEQ ID NO: 3090310 - RNA, 23 nt, Molluscum contagiosum virus
ucacggcgacaacgacagagccc

SEQ ID NO: 3090311 - RNA, 16 nt, Molluscum contagiosum virus
ggccaugucugugcgc

SEQ ID NO: 3090312 - RNA, 14 nt, Molluscum contagiosum virus
cggcacgcugagca

SEQ ID NO: 3090313 - RNA, 15 nt, Molluscum contagiosum virus
ggaauaccggagaca

SEQ ID NO: 3090314 - RNA, 24 nt, Molluscum contagiosum virus
gcgcgaccaguacaucaccgccau

SEQ ID NO: 3090315 - RNA, 16 nt, Molluscum contagiosum virus
ccgcagcccgagcgcg

SEQ ID NO: 3090316 - RNA, 22 nt, Molluscum contagiosum virus
guguccacgaugaacggcuccu

SEQ ID NO: 3090317 - RNA, 16 nt, Molluscum contagiosum virus
gcgaccuacuccuggc

SEQ ID NO: 3090318 - RNA, 17 nt, Molluscum contagiosum virus
ggaaaaaucccccgcca

SEQ ID NO: 3090319 - RNA, 17 nt, Molluscum contagiosum virus
cagcaggugcacgugcu

SEQ ID NO: 3090320 - RNA, 14 nt, Molluscum contagiosum virus
aggcaaagcggggc

SEQ ID NO: 3090321 - RNA, 22 nt, Molluscum contagiosum virus
cacaguucacggcgcucgccuc

SEQ ID NO: 3090322 - RNA, 18 nt, Molluscum contagiosum virus
acguggacaagucacugc

SEQ ID NO: 3090323 - RNA, 13 nt, Molluscum contagiosum virus
gcagcuggagcug

SEQ ID NO: 3090324 - RNA, 24 nt, Molluscum contagiosum virus
uuucaaugcaguaugugaacacga

SEQ ID NO: 3090325 - RNA, 21 nt, Molluscum contagiosum virus
gacggggagcauguccgacuc

SEQ ID NO: 3090326 - RNA, 18 nt, Molluscum contagiosum virus
ugaaacaguaggacaugu

SEQ ID NO: 3090327 - RNA, 20 nt, Molluscum contagiosum virus
acgcgcacgggccugcgcgc

SEQ ID NO: 3090328 - RNA, 17 nt, Molluscum contagiosum virus
gcgcuggaugcugcucg

SEQ ID NO: 3090329 - RNA, 16 nt, Molluscum contagiosum virus
cggcagccgcagaugc

SEQ ID NO: 3090330 - RNA, 21 nt, Molluscum contagiosum virus
cccugucgcgcacgagcgcgg

SEQ ID NO: 3090331 - RNA, 23 nt, Molluscum contagiosum virus
uccaagaagacggcgcgcgcgcu

SEQ ID NO: 3090332 - RNA, 19 nt, Molluscum contagiosum virus
cugcgcgaguaccugggca

SEQ ID NO: 3090333 - RNA, 14 nt, Molluscum contagiosum virus
caccugcaggaaag

SEQ ID NO: 3090334 - RNA, 16 nt, Molluscum contagiosum virus
gucgugcaggccgugc

SEQ ID NO: 3090335 - RNA, 18 nt, Molluscum contagiosum virus
acgcgcacuugccuggcg

SEQ ID NO: 3090336 - RNA, 19 nt, Molluscum contagiosum virus
agaggccggcacaagccgu

SEQ ID NO: 3090337 - RNA, 15 nt, Molluscum contagiosum virus
cauuuucucuggaga

SEQ ID NO: 3090338 - RNA, 20 nt, Molluscum contagiosum virus
acuauguucuucgcagagga

SEQ ID NO: 3090339 - RNA, 15 nt, Molluscum contagiosum virus
gcccacgugccagcu

SEQ ID NO: 3090340 - RNA, 23 nt, Molluscum contagiosum virus
gcugaaggcauaccugugccagc

SEQ ID NO: 3090341 - RNA, 19 nt, Molluscum contagiosum virus
cgucgcggagggcgaggcc

SEQ ID NO: 3090342 - RNA, 13 nt, Molluscum contagiosum virus
auagcagagcacg

SEQ ID NO: 3090343 - RNA, 20 nt, Molluscum contagiosum virus
ccagauuagcaacugcccca

SEQ ID NO: 3090344 - RNA, 21 nt, Molluscum contagiosum virus
aguagcagcuucuuggagccc

SEQ ID NO: 3090345 - RNA, 16 nt, Molluscum contagiosum virus
acacgcgcggcggaga

SEQ ID NO: 3090346 - RNA, 18 nt, Molluscum contagiosum virus
caagaggggagccagccu

SEQ ID NO: 3090347 - RNA, 23 nt, Molluscum contagiosum virus
gacgcggccgcggagggaggcuc

SEQ ID NO: 3090348 - RNA, 15 nt, Molluscum contagiosum virus
acgagcagcugcugc

SEQ ID NO: 3090349 - RNA, 16 nt, Molluscum contagiosum virus
ggcgccaaccgcgagc

SEQ ID NO: 3090350 - RNA, 23 nt, Molluscum contagiosum virus
caggaaaggucgggcccgagcag

SEQ ID NO: 3090351 - RNA, 13 nt, Molluscum contagiosum virus
cagcuccugguag

SEQ ID NO: 3090352 - RNA, 21 nt, Molluscum contagiosum virus
gccucucucguggggaggaca

SEQ ID NO: 3090353 - RNA, 18 nt, Molluscum contagiosum virus
ccagcguggccagcuuca

SEQ ID NO: 3090354 - RNA, 18 nt, Molluscum contagiosum virus
cacgcgcaaggccgcgcc

SEQ ID NO: 3090355 - RNA, 15 nt, Molluscum contagiosum virus
gacuacgcacuggcg

SEQ ID NO: 3090356 - RNA, 21 nt, Molluscum contagiosum virus
gacuaccuggcggcgcuggag

SEQ ID NO: 3090357 - RNA, 22 nt, Molluscum contagiosum virus
cgugcuagcccgcaccugcgcc

SEQ ID NO: 3090358 - RNA, 15 nt, Molluscum contagiosum virus
cacuguaaucgucac

SEQ ID NO: 3090359 - RNA, 14 nt, Molluscum contagiosum virus
cccagcguggccag

SEQ ID NO: 3090360 - RNA, 22 nt, Molluscum contagiosum virus
ugacacgaguacgccagaauug

SEQ ID NO: 3090361 - RNA, 14 nt, Molluscum contagiosum virus
ggaagacgugcugc

SEQ ID NO: 3090362 - RNA, 17 nt, Molluscum contagiosum virus
accucgcgcgccgccgc

SEQ ID NO: 3090363 - RNA, 22 nt, Molluscum contagiosum virus
caggcggucuuccagcacugcg

SEQ ID NO: 3090364 - RNA, 13 nt, Molluscum contagiosum virus
acguaaagacggc

SEQ ID NO: 3090365 - RNA, 14 nt, Molluscum contagiosum virus
cggagcgcagcugc

SEQ ID NO: 3090366 - RNA, 17 nt, Molluscum contagiosum virus
ggugcagccgcugcugc

SEQ ID NO: 3090367 - RNA, 17 nt, Molluscum contagiosum virus
guuucugccgcgccucc

SEQ ID NO: 3090368 - RNA, 21 nt, Molluscum contagiosum virus
ugcccggccucgccuccgggc

SEQ ID NO: 3090369 - RNA, 16 nt, Molluscum contagiosum virus
ccgcgcaaaagcacag

SEQ ID NO: 3090370 - RNA, 23 nt, Molluscum contagiosum virus
aggaagcuggcgcgguccagccg

SEQ ID NO: 3090371 - RNA, 19 nt, Molluscum contagiosum virus
ccagcugccgcuugaagga

SEQ ID NO: 3090372 - RNA, 14 nt, Molluscum contagiosum virus
gcagucccagcacc

SEQ ID NO: 3090373 - RNA, 22 nt, Molluscum contagiosum virus
gaguggcguccgcacgaggagc

SEQ ID NO: 3090374 - RNA, 16 nt, Molluscum contagiosum virus
cguggcguugcugcug

SEQ ID NO: 3090375 - RNA, 21 nt, Molluscum contagiosum virus
gggcagccgcuggacgccucg

SEQ ID NO: 3090376 - RNA, 23 nt, Molluscum contagiosum virus
ggcgagcgcacgucuacgacauc

SEQ ID NO: 3090377 - RNA, 20 nt, Molluscum contagiosum virus
ugagcaggucggccagcagc

SEQ ID NO: 3090378 - RNA, 23 nt, Molluscum contagiosum virus
acgcuaaagucgcgcgugcgcag

SEQ ID NO: 3090379 - RNA, 19 nt, Molluscum contagiosum virus
aggagcuguccgagccgga

SEQ ID NO: 3090380 - RNA, 16 nt, Molluscum contagiosum virus
augggcucgggcaaga

SEQ ID NO: 3090381 - RNA, 23 nt, Molluscum contagiosum virus
ccguccgccucgagcacgccucc

SEQ ID NO: 3090382 - RNA, 12 nt, Molluscum contagiosum virus
accugcugcgag

SEQ ID NO: 3090383 - RNA, 12 nt, Molluscum contagiosum virus
aacgugcugcuc

SEQ ID NO: 3090384 - RNA, 14 nt, Molluscum contagiosum virus
gcuugccccucgug

SEQ ID NO: 3090385 - RNA, 17 nt, Molluscum contagiosum virus
acgcaggaugcuggggc

SEQ ID NO: 3090386 - RNA, 12 nt, Molluscum contagiosum virus
cagcccacgcug

SEQ ID NO: 3090387 - RNA, 23 nt, Molluscum contagiosum virus
caugcucgagccugccagcgcca

SEQ ID NO: 3090388 - RNA, 15 nt, Molluscum contagiosum virus
ucggcguggccaggc

SEQ ID NO: 3090389 - RNA, 14 nt, Molluscum contagiosum virus
gauaggacaugacu

SEQ ID NO: 3090390 - RNA, 10 nt, Molluscum contagiosum virus
cuacaaggug

SEQ ID NO: 3090391 - RNA, 14 nt, Molluscum contagiosum virus
cgcgcugcuggugc

SEQ ID NO: 3090392 - RNA, 18 nt, Molluscum contagiosum virus
caaguagguugcgucccg

SEQ ID NO: 3090393 - RNA, 13 nt, Molluscum contagiosum virus
cugagaggaccuc

SEQ ID NO: 3090394 - RNA, 16 nt, Molluscum contagiosum virus
ccgccgcgugcccguc

SEQ ID NO: 3090395 - RNA, 14 nt, Molluscum contagiosum virus
gaagugcuccgcac

SEQ ID NO: 3090396 - RNA, 16 nt, Molluscum contagiosum virus
ugcgcgccaagaacaa

SEQ ID NO: 3090397 - RNA, 13 nt, Molluscum contagiosum virus
gcgcaagugcgug

SEQ ID NO: 3090398 - RNA, 17 nt, Molluscum contagiosum virus
gaccgcagacaaagaca

SEQ ID NO: 3090399 - RNA, 12 nt, Molluscum contagiosum virus
cgggcgugcgca

SEQ ID NO: 3090400 - RNA, 21 nt, Molluscum contagiosum virus
ggacgagcugcuucgcgacca

SEQ ID NO: 3090401 - RNA, 22 nt, Molluscum contagiosum virus
cugggccccuacguggucaugg

SEQ ID NO: 3090402 - RNA, 17 nt, Molluscum contagiosum virus
cgcgagggcgcgcugga

SEQ ID NO: 3090403 - RNA, 13 nt, Molluscum contagiosum virus
aguagcgagcagg

SEQ ID NO: 3090404 - RNA, 15 nt, Molluscum contagiosum virus
ggcgcgcgccagcag

SEQ ID NO: 3090405 - RNA, 13 nt, Molluscum contagiosum virus
gguggcaggcgcg

SEQ ID NO: 3090406 - RNA, 18 nt, Molluscum contagiosum virus
gguccaccugcgacgccu

SEQ ID NO: 3090407 - RNA, 14 nt, Molluscum contagiosum virus
ggccgcacucgccg

SEQ ID NO: 3090408 - RNA, 14 nt, Molluscum contagiosum virus
cugcgcaagcucag

SEQ ID NO: 3090409 - RNA, 16 nt, Molluscum contagiosum virus
cagagccugcugcucu

SEQ ID NO: 3090410 - RNA, 14 nt, Molluscum contagiosum virus
gguacucaugcugc

SEQ ID NO: 3090411 - RNA, 14 nt, Molluscum contagiosum virus
cagcaugcgugcaa

SEQ ID NO: 3090412 - RNA, 14 nt, Molluscum contagiosum virus
ggaggcaagcgggc

SEQ ID NO: 3090413 - RNA, 14 nt, Molluscum contagiosum virus
cacgggaaggcucu

SEQ ID NO: 3090414 - RNA, 23 nt, Molluscum contagiosum virus
cgagcacccccgcugcacgcucu

SEQ ID NO: 3090415 - RNA, 21 nt, Molluscum contagiosum virus
gcaaagaaugcaugcggagcu

SEQ ID NO: 3090416 - RNA, 22 nt, Molluscum contagiosum virus
accgcgagcgcaugcgcgccgc

SEQ ID NO: 3090417 - RNA, 18 nt, Molluscum contagiosum virus
caagucaccgcuccgcag

SEQ ID NO: 3090418 - RNA, 15 nt, Molluscum contagiosum virus
ggcacgcacaaaguu

SEQ ID NO: 3090419 - RNA, 14 nt, Molluscum contagiosum virus
accacgugcgcugg

SEQ ID NO: 3090420 - RNA, 16 nt, Molluscum contagiosum virus
ugcucaagcaccugcg

SEQ ID NO: 3090421 - RNA, 16 nt, Molluscum contagiosum virus
uggacuucaggauggc

SEQ ID NO: 3090422 - RNA, 13 nt, Molluscum contagiosum virus
cugcaagccagcc

SEQ ID NO: 3090423 - RNA, 17 nt, Molluscum contagiosum virus
cuucggcggcugugccc

SEQ ID NO: 3090424 - RNA, 20 nt, Molluscum contagiosum virus
acucuucccguuccugggca

SEQ ID NO: 3090425 - RNA, 17 nt, Molluscum contagiosum virus
cgggugcccggacagag

SEQ ID NO: 3090426 - RNA, 20 nt, Molluscum contagiosum virus
gaugcgguccgacucggugc

SEQ ID NO: 3090427 - RNA, 21 nt, Molluscum contagiosum virus
cacauaguggcuuguugucga

SEQ ID NO: 3090428 - RNA, 15 nt, Molluscum contagiosum virus
cguccuugcucuggc

SEQ ID NO: 3090429 - RNA, 15 nt, Molluscum contagiosum virus
cuacgggaagcugca

SEQ ID NO: 3090430 - RNA, 16 nt, Molluscum contagiosum virus
uggcaccgggcgccgc

SEQ ID NO: 3090431 - RNA, 19 nt, Molluscum contagiosum virus
cuggaguaccggcucaaga

SEQ ID NO: 3090432 - RNA, 18 nt, Molluscum contagiosum virus
gccugcaaggaggucaag

SEQ ID NO: 3090433 - RNA, 15 nt, Molluscum contagiosum virus
ucgacguugacgagc

SEQ ID NO: 3090434 - RNA, 20 nt, Molluscum contagiosum virus
gcguaagagcgugaacauac

SEQ ID NO: 3090435 - RNA, 22 nt, Molluscum contagiosum virus
ucgcugcuccccgccagcacca

SEQ ID NO: 3090436 - RNA, 20 nt, Molluscum contagiosum virus
cucggcacugcuggcgcgcg

SEQ ID NO: 3090437 - RNA, 12 nt, Molluscum contagiosum virus
cgcggcagugcu

SEQ ID NO: 3090438 - RNA, 21 nt, Molluscum contagiosum virus
cagcgcgcccaccagcagcca

SEQ ID NO: 3090439 - RNA, 17 nt, Molluscum contagiosum virus
cuacagcagccgcagcc

SEQ ID NO: 3090440 - RNA, 17 nt, Molluscum contagiosum virus
ggcggggaucuugcgug

SEQ ID NO: 3090441 - RNA, 18 nt, Molluscum contagiosum virus
ggcgcgcgcgcuggcgug

SEQ ID NO: 3090442 - RNA, 18 nt, Molluscum contagiosum virus
cgucgcccggcaggcucc

SEQ ID NO: 3090443 - RNA, 23 nt, Molluscum contagiosum virus
cacaagggcagcucaagcugcuc

SEQ ID NO: 3090444 - RNA, 13 nt, Molluscum contagiosum virus
cgcggcaguggcc

SEQ ID NO: 3090445 - RNA, 15 nt, Molluscum contagiosum virus
gcgcgcgcucugccg

SEQ ID NO: 3090446 - RNA, 12 nt, Molluscum contagiosum virus
cgcugccagaga

SEQ ID NO: 3090447 - RNA, 13 nt, Molluscum contagiosum virus
agauggcugcucu

SEQ ID NO: 3090448 - RNA, 19 nt, Molluscum contagiosum virus
cuuggcgcccuuccuggag

SEQ ID NO: 3090449 - RNA, 21 nt, Molluscum contagiosum virus
aggacgacgacacagcccugg

SEQ ID NO: 3090450 - RNA, 22 nt, Molluscum contagiosum virus
caugacugcggacgggaagcuu

SEQ ID NO: 3090451 - RNA, 19 nt, Molluscum contagiosum virus
aggagcucuucgacagcgu

SEQ ID NO: 3090452 - RNA, 14 nt, Molluscum contagiosum virus
ugcguaaugcuggc

SEQ ID NO: 3090453 - RNA, 22 nt, Molluscum contagiosum virus
cgcgggcgccggcguccgcggc

SEQ ID NO: 3090454 - RNA, 12 nt, Molluscum contagiosum virus
cguuccuggcca

SEQ ID NO: 3090455 - RNA, 23 nt, Molluscum contagiosum virus
gcacgagcaguccgccucgagca

SEQ ID NO: 3090456 - RNA, 22 nt, Molluscum contagiosum virus
agcgccgccucgcgcgcacugc

SEQ ID NO: 3090457 - RNA, 18 nt, Molluscum contagiosum virus
gcagcgccagcuuggugc

SEQ ID NO: 3090458 - RNA, 21 nt, Molluscum contagiosum virus
gcucuacggcgugcugugccu

SEQ ID NO: 3090459 - RNA, 12 nt, Molluscum contagiosum virus
gagguggccaag

SEQ ID NO: 3090460 - RNA, 20 nt, Molluscum contagiosum virus
ggcucgcgugccccgggaag

SEQ ID NO: 3090461 - RNA, 20 nt, Molluscum contagiosum virus
cgcaaugcagugcaccagca

SEQ ID NO: 3090462 - RNA, 19 nt, Molluscum contagiosum virus
cucuacgccgcgcaccugg

SEQ ID NO: 3090463 - RNA, 14 nt, Molluscum contagiosum virus
ggucaccacgaucu

SEQ ID NO: 3090464 - RNA, 19 nt, Molluscum contagiosum virus
uucacgcccgcaaugcagu

SEQ ID NO: 3090465 - RNA, 20 nt, Molluscum contagiosum virus
uccucggcgcacacuccucg

SEQ ID NO: 3090466 - RNA, 22 nt, Molluscum contagiosum virus
ucguggggaggacaaaacugaa

SEQ ID NO: 3090467 - RNA, 19 nt, Molluscum contagiosum virus
agagcuuacuagacuggcu

SEQ ID NO: 3090468 - RNA, 18 nt, Molluscum contagiosum virus
caauggacacgcacuggc

SEQ ID NO: 3090469 - RNA, 21 nt, Molluscum contagiosum virus
ggcgcgcgcgcuagccgccgc

SEQ ID NO: 3090470 - RNA, 17 nt, Molluscum contagiosum virus
uucuucaaguaccuguc

SEQ ID NO: 3090471 - RNA, 13 nt, Molluscum contagiosum virus
acccucuucgacu

SEQ ID NO: 3090472 - RNA, 15 nt, Molluscum contagiosum virus
caacgcgggccaggc

SEQ ID NO: 3090473 - RNA, 22 nt, Molluscum contagiosum virus
accuuggcgcugcacaguucac

SEQ ID NO: 3090474 - RNA, 18 nt, Molluscum contagiosum virus
cguacgcacgugccgugc

SEQ ID NO: 3090475 - RNA, 16 nt, Molluscum contagiosum virus
gcacccgcaacaagga

SEQ ID NO: 3090476 - RNA, 22 nt, Molluscum contagiosum virus
cgcacuugccgggcgacggcgg

SEQ ID NO: 3090477 - RNA, 17 nt, Molluscum contagiosum virus
caggcacuggcccugcu

SEQ ID NO: 3090478 - RNA, 16 nt, Molluscum contagiosum virus
cucccgcccagcgugg

SEQ ID NO: 3090479 - RNA, 18 nt, Molluscum contagiosum virus
cggagaucaggcagcugc

SEQ ID NO: 3090480 - RNA, 13 nt, Molluscum contagiosum virus
agcugcugcgcua

SEQ ID NO: 3090481 - RNA, 21 nt, Molluscum contagiosum virus
gggcgggaagaaggugcucag

SEQ ID NO: 3090482 - RNA, 20 nt, Molluscum contagiosum virus
acuugcgcguccacaaaggc

SEQ ID NO: 3090483 - RNA, 18 nt, Molluscum contagiosum virus
agugguccaccagcugcc

SEQ ID NO: 3090484 - RNA, 23 nt, Molluscum contagiosum virus
gcgggcucuuccaccggcagcgc

SEQ ID NO: 3090485 - RNA, 22 nt, Molluscum contagiosum virus
ucucacgcgcuaccgcaagcuc

SEQ ID NO: 3090486 - RNA, 23 nt, Molluscum contagiosum virus
agcucugucccgcaagccacaca

SEQ ID NO: 3090487 - RNA, 19 nt, Molluscum contagiosum virus
gcgcgccgcagaacacggg

SEQ ID NO: 3090488 - RNA, 19 nt, Molluscum contagiosum virus
cuccgacuaccuaggcacu

SEQ ID NO: 3090489 - RNA, 13 nt, Molluscum contagiosum virus
ccgcccgcgcuuc

SEQ ID NO: 3090490 - RNA, 20 nt, Molluscum contagiosum virus
guacuccuugaagggcacaa

SEQ ID NO: 3090491 - RNA, 19 nt, Molluscum contagiosum virus
auggugcgguacaugcugu

SEQ ID NO: 3090492 - RNA, 16 nt, Molluscum contagiosum virus
gaaaggcacccgcagg

SEQ ID NO: 3090493 - RNA, 18 nt, Molluscum contagiosum virus
acgccuccaagaagaggc

SEQ ID NO: 3090494 - RNA, 15 nt, Molluscum contagiosum virus
ggacacuggagguga

SEQ ID NO: 3090495 - RNA, 18 nt, Molluscum contagiosum virus
acguccuugucgaacgac

SEQ ID NO: 3090496 - RNA, 22 nt, Molluscum contagiosum virus
cagaaggcguaugcgccaagcc

SEQ ID NO: 3090497 - RNA, 17 nt, Molluscum contagiosum virus
accugcaggaaaggcac

SEQ ID NO: 3090498 - RNA, 15 nt, Molluscum contagiosum virus
ggcuucgccgccgga

SEQ ID NO: 3090499 - RNA, 16 nt, Molluscum contagiosum virus
ugcgcagcguccggca

SEQ ID NO: 3090500 - RNA, 19 nt, Molluscum contagiosum virus
cacaccccuguaacaagga

SEQ ID NO: 3090501 - RNA, 20 nt, Molluscum contagiosum virus
uccaagaacaauacaaacaa

SEQ ID NO: 3090502 - RNA, 19 nt, Molluscum contagiosum virus
gugcacgcacgcgcgggca

SEQ ID NO: 3090503 - RNA, 17 nt, Molluscum contagiosum virus
uccaagaacgagaagag

SEQ ID NO: 3090504 - RNA, 17 nt, Molluscum contagiosum virus
cugcgcgcuagggucca

SEQ ID NO: 3090505 - RNA, 13 nt, Molluscum contagiosum virus
gggaacgaggaaa

SEQ ID NO: 3090506 - RNA, 18 nt, Molluscum contagiosum virus
cgccauccggcacugcgu

SEQ ID NO: 3090507 - RNA, 18 nt, Molluscum contagiosum virus
accgggagcauagcaaga

SEQ ID NO: 3090508 - RNA, 15 nt, Molluscum contagiosum virus
cggcgaacaccccga

SEQ ID NO: 3090509 - RNA, 22 nt, Molluscum contagiosum virus
ggaacgcuuggcgggcagcggc

SEQ ID NO: 3090510 - RNA, 17 nt, Molluscum contagiosum virus
acuaagccgcgugcugg

SEQ ID NO: 3090511 - RNA, 17 nt, Molluscum contagiosum virus
gcucgaucugcgccucc

SEQ ID NO: 3090512 - RNA, 16 nt, Molluscum contagiosum virus
acggagaccuggucac

SEQ ID NO: 3090513 - RNA, 16 nt, Molluscum contagiosum virus
augcagauuggaggag

SEQ ID NO: 3090514 - RNA, 22 nt, Molluscum contagiosum virus
uccuuccggagacaccagcucc

SEQ ID NO: 3090515 - RNA, 20 nt, Molluscum contagiosum virus
cgaggccuacagcgcgcugc

SEQ ID NO: 3090516 - RNA, 22 nt, Molluscum contagiosum virus
cccuggagcgcagucccagcac

SEQ ID NO: 3090517 - RNA, 17 nt, Molluscum contagiosum virus
cccgcggaagugcgagc

SEQ ID NO: 3090518 - RNA, 22 nt, Molluscum contagiosum virus
cacagccauuaacgaagagugg

SEQ ID NO: 3090519 - RNA, 20 nt, Molluscum contagiosum virus
cgcucggcguggugcuggcc

SEQ ID NO: 3090520 - RNA, 22 nt, Molluscum contagiosum virus
cggucgccuucuugcuggcgcu

SEQ ID NO: 3090521 - RNA, 18 nt, Molluscum contagiosum virus
cccacguacgagcagcug

SEQ ID NO: 3090522 - RNA, 21 nt, Molluscum contagiosum virus
ugucccugcauacacuuccug

SEQ ID NO: 3090523 - RNA, 17 nt, Molluscum contagiosum virus
gcgcgugagcacgggcg

SEQ ID NO: 3090524 - RNA, 22 nt, Molluscum contagiosum virus
caugucgagaccuuccuccagg

SEQ ID NO: 3090525 - RNA, 16 nt, Molluscum contagiosum virus
aaccuacgcuaccuga

SEQ ID NO: 3090526 - RNA, 13 nt, Molluscum contagiosum virus
gugggccgcggcg

SEQ ID NO: 3090527 - RNA, 14 nt, Molluscum contagiosum virus
caaacagccugugu

SEQ ID NO: 3090528 - RNA, 14 nt, Molluscum contagiosum virus
cgcgcgcgccucgc

SEQ ID NO: 3090529 - RNA, 15 nt, Molluscum contagiosum virus
gcggcgcucgcagca

SEQ ID NO: 3090530 - RNA, 21 nt, Molluscum contagiosum virus
ccgcgcgcucucacgcuucgu

SEQ ID NO: 3090531 - RNA, 16 nt, Molluscum contagiosum virus
gaugaaguuggucacc

SEQ ID NO: 3090532 - RNA, 16 nt, Molluscum contagiosum virus
gaagcuugcucagcag

SEQ ID NO: 3090533 - RNA, 14 nt, Molluscum contagiosum virus
cucauagcccaugc

SEQ ID NO: 3090534 - RNA, 21 nt, Molluscum contagiosum virus
ccuggcgagcgcucugcauug

SEQ ID NO: 3090535 - RNA, 23 nt, Molluscum contagiosum virus
acgcucuacggcgccuucgucgc

SEQ ID NO: 3090536 - RNA, 14 nt, Molluscum contagiosum virus
gcuugagcagcaaa

SEQ ID NO: 3090537 - RNA, 15 nt, Molluscum contagiosum virus
guacuacuuccgcaa

SEQ ID NO: 3090538 - RNA, 14 nt, Molluscum contagiosum virus
gcacauugcugcug

SEQ ID NO: 3090539 - RNA, 19 nt, Molluscum contagiosum virus
cgaggagggcagccucaac

SEQ ID NO: 3090540 - RNA, 19 nt, Molluscum contagiosum virus
auggcgcgcaaccagcugg

SEQ ID NO: 3090541 - RNA, 21 nt, Molluscum contagiosum virus
ucagccgagcgccgccagcuc

SEQ ID NO: 3090542 - RNA, 16 nt, Molluscum contagiosum virus
guucacggcgcucgcc

SEQ ID NO: 3090543 - RNA, 20 nt, Molluscum contagiosum virus
ggcgacuggcgacacauugc

SEQ ID NO: 3090544 - RNA, 22 nt, Molluscum contagiosum virus
aaagcugcuggcggagacacuc

SEQ ID NO: 3090545 - RNA, 15 nt, Molluscum contagiosum virus
gcgugccgcugcgcg

SEQ ID NO: 3090546 - RNA, 16 nt, Molluscum contagiosum virus
gucagcagcgcgagcu

SEQ ID NO: 3090547 - RNA, 15 nt, Molluscum contagiosum virus
cagccguggagucca

SEQ ID NO: 3090548 - RNA, 20 nt, Molluscum contagiosum virus
gcgcacgcgcgagcaugccg

SEQ ID NO: 3090549 - RNA, 21 nt, Molluscum contagiosum virus
gcucggugucgguaccugcag

SEQ ID NO: 3090550 - RNA, 17 nt, Molluscum contagiosum virus
gcaggacgacgacacag

SEQ ID NO: 3090551 - RNA, 21 nt, Molluscum contagiosum virus
ccuacguggcgucgcgccgcu

SEQ ID NO: 3090552 - RNA, 22 nt, Molluscum contagiosum virus
gccuccaagaagaggccagcac

SEQ ID NO: 3090553 - RNA, 14 nt, Molluscum contagiosum virus
cugaaccugggcgc

SEQ ID NO: 3090554 - RNA, 14 nt, Molluscum contagiosum virus
cgcgcguccacaag

SEQ ID NO: 3090555 - RNA, 23 nt, Molluscum contagiosum virus
cgcggcaaaugcgucccagcagc

SEQ ID NO: 3090556 - RNA, 22 nt, Molluscum contagiosum virus
ugcaacucgcgcugcagcaccu

SEQ ID NO: 3090557 - RNA, 17 nt, Molluscum contagiosum virus
cucauccucccugcggg

SEQ ID NO: 3090558 - RNA, 17 nt, Molluscum contagiosum virus
caggaagcgcgucauga

SEQ ID NO: 3090559 - RNA, 15 nt, Molluscum contagiosum virus
ugcgcgugugcagca

SEQ ID NO: 3090560 - RNA, 20 nt, Molluscum contagiosum virus
caugcagucacgacuguguu

SEQ ID NO: 3090561 - RNA, 17 nt, Molluscum contagiosum virus
gcaaguaccagccgcug

SEQ ID NO: 3090562 - RNA, 16 nt, Molluscum contagiosum virus
gagcugugcgagccag

SEQ ID NO: 3090563 - RNA, 19 nt, Molluscum contagiosum virus
caacaaggaaaggcacccg

SEQ ID NO: 3090564 - RNA, 13 nt, Molluscum contagiosum virus
uccguugcacgug

SEQ ID NO: 3090565 - RNA, 21 nt, Molluscum contagiosum virus
cacggcacgugcguacgcggc

SEQ ID NO: 3090566 - RNA, 15 nt, Molluscum contagiosum virus
cauagcgccacgagc

SEQ ID NO: 3090567 - RNA, 18 nt, Molluscum contagiosum virus
aucaggcagcugcugcgc

SEQ ID NO: 3090568 - RNA, 18 nt, Molluscum contagiosum virus
uuugacacgcucaucucg

SEQ ID NO: 3090569 - RNA, 19 nt, Molluscum contagiosum virus
cuacacgccgcuggagcac

SEQ ID NO: 3090570 - RNA, 16 nt, Molluscum contagiosum virus
ggagcccgugcuggag

SEQ ID NO: 3090571 - RNA, 14 nt, Molluscum contagiosum virus
ccccgagcugcggc

SEQ ID NO: 3090572 - RNA, 17 nt, Molluscum contagiosum virus
guucgcggagcugugcc

SEQ ID NO: 3090573 - RNA, 22 nt, Molluscum contagiosum virus
gcacguccucggucaccacucc

SEQ ID NO: 3090574 - RNA, 18 nt, Molluscum contagiosum virus
cagccgagcgccgccagc

SEQ ID NO: 3090575 - RNA, 16 nt, Molluscum contagiosum virus
cucagcacgcgcacag

SEQ ID NO: 3090576 - RNA, 21 nt, Molluscum contagiosum virus
gaaagguaccccgcaggaaag

SEQ ID NO: 3090577 - RNA, 11 nt, Molluscum contagiosum virus
cgccagcacca

SEQ ID NO: 3090578 - RNA, 20 nt, Molluscum contagiosum virus
ucgauggcgccguuggccac

SEQ ID NO: 3090579 - RNA, 17 nt, Molluscum contagiosum virus
acgcucuccaugcgcgc

SEQ ID NO: 3090580 - RNA, 15 nt, Molluscum contagiosum virus
acggagauggacaca

SEQ ID NO: 3090581 - RNA, 22 nt, Molluscum contagiosum virus
ccaagugcgcgugucuggagcc

SEQ ID NO: 3090582 - RNA, 20 nt, Molluscum contagiosum virus
auguacuucuacgagcagcg

SEQ ID NO: 3090583 - RNA, 18 nt, Molluscum contagiosum virus
ccucaccucugcgcggcc

SEQ ID NO: 3090584 - RNA, 22 nt, Molluscum contagiosum virus
cacggaaacgaacgcugcagcu

SEQ ID NO: 3090585 - RNA, 23 nt, Molluscum contagiosum virus
agcuuugugcgaccugcugcgag

SEQ ID NO: 3090586 - RNA, 21 nt, Molluscum contagiosum virus
gcuccacgcgcagcuucucug

SEQ ID NO: 3090587 - RNA, 22 nt, Molluscum contagiosum virus
aggcaccugcaggaaaggcacc

SEQ ID NO: 3090588 - RNA, 13 nt, Molluscum contagiosum virus
cgcucugccgccc

SEQ ID NO: 3090589 - RNA, 13 nt, Molluscum contagiosum virus
augcucgccagca

SEQ ID NO: 3090590 - RNA, 20 nt, Molluscum contagiosum virus
cggugugcuacugcacugca

SEQ ID NO: 3090591 - RNA, 23 nt, Molluscum contagiosum virus
ccgcgcugaugcuagcgugugcc

SEQ ID NO: 3090592 - RNA, 11 nt, Molluscum contagiosum virus
cuugcuuccag

SEQ ID NO: 3090593 - RNA, 19 nt, Molluscum contagiosum virus
cuuuggccucgcgagggcu

SEQ ID NO: 3090594 - RNA, 21 nt, Molluscum contagiosum virus
ugacaggcgcgcaagugcgug

SEQ ID NO: 3090595 - RNA, 18 nt, Molluscum contagiosum virus
gaaggcauaccugugcca

SEQ ID NO: 3090596 - RNA, 18 nt, Molluscum contagiosum virus
acgcuguacaugccgcag

SEQ ID NO: 3090597 - RNA, 16 nt, Molluscum contagiosum virus
gagcgcgcgcacgcga

SEQ ID NO: 3090598 - RNA, 21 nt, Molluscum contagiosum virus
ccucaagaagacgcagagcga

SEQ ID NO: 3090599 - RNA, 21 nt, Molluscum contagiosum virus
agggcgaguccccgagcagcg

SEQ ID NO: 3090600 - RNA, 16 nt, Molluscum contagiosum virus
cccgccgcgugcccgu

SEQ ID NO: 3090601 - RNA, 21 nt, Molluscum contagiosum virus
cacgccgcagcgcuggagcug

SEQ ID NO: 3090602 - RNA, 20 nt, Molluscum contagiosum virus
gacgugaucgcgcaggcgcg

SEQ ID NO: 3090603 - RNA, 23 nt, Molluscum contagiosum virus
cgcaccuuuggugcagaucucgc

SEQ ID NO: 3090604 - RNA, 15 nt, Molluscum contagiosum virus
aagcacgagcugcug

SEQ ID NO: 3090605 - RNA, 17 nt, Molluscum contagiosum virus
uacgcggcgggguccuc

SEQ ID NO: 3090606 - RNA, 23 nt, Molluscum contagiosum virus
gugggcgccgcggcgggggcagc

SEQ ID NO: 3090607 - RNA, 14 nt, Molluscum contagiosum virus
gcugcgcugcaacc

SEQ ID NO: 3090608 - RNA, 21 nt, Molluscum contagiosum virus
aucgagauggaggcccaggcc

SEQ ID NO: 3090609 - RNA, 12 nt, Molluscum contagiosum virus
cucgcugcuggg

SEQ ID NO: 3090610 - RNA, 23 nt, Molluscum contagiosum virus
cugccauggcagcucggaggcgc

SEQ ID NO: 3090611 - RNA, 16 nt, Molluscum contagiosum virus
cccagguucagcgcuc

SEQ ID NO: 3090612 - RNA, 15 nt, Molluscum contagiosum virus
acgacgugcugcugc

SEQ ID NO: 3090613 - RNA, 21 nt, Molluscum contagiosum virus
aagcagcgugucaagcggcac

SEQ ID NO: 3090614 - RNA, 14 nt, Molluscum contagiosum virus
caccuuccugggcg

SEQ ID NO: 3090615 - RNA, 20 nt, Molluscum contagiosum virus
cugcacgacguacgagugcu

SEQ ID NO: 3090616 - RNA, 14 nt, Molluscum contagiosum virus
gccgcggaggacuc

SEQ ID NO: 3090617 - RNA, 20 nt, Molluscum contagiosum virus
cgggggcucggaagagcguc

SEQ ID NO: 3090618 - RNA, 18 nt, Molluscum contagiosum virus
gaauaaaauagcagagca

SEQ ID NO: 3090619 - RNA, 17 nt, Molluscum contagiosum virus
acggcgugacggugcug

SEQ ID NO: 3090620 - RNA, 23 nt, Molluscum contagiosum virus
gauacacauugcguguggggcau

SEQ ID NO: 3090621 - RNA, 14 nt, Molluscum contagiosum virus
ggcgcgccgccggu

SEQ ID NO: 3090622 - RNA, 23 nt, Molluscum contagiosum virus
agugcauccgcaacguggcgcug

SEQ ID NO: 3090623 - RNA, 15 nt, Molluscum contagiosum virus
cggcuuccggcacca

SEQ ID NO: 3090624 - RNA, 19 nt, Molluscum contagiosum virus
cagggcgugcuugccugga

SEQ ID NO: 3090625 - RNA, 15 nt, Molluscum contagiosum virus
aaagggcggccgcag

SEQ ID NO: 3090626 - RNA, 15 nt, Molluscum contagiosum virus
ugacucggacacugg

SEQ ID NO: 3090627 - RNA, 20 nt, Molluscum contagiosum virus
caccgggguccgcuccuucu

SEQ ID NO: 3090628 - RNA, 21 nt, Molluscum contagiosum virus
ccgccgagauggagcucacgc

SEQ ID NO: 3090629 - RNA, 20 nt, Molluscum contagiosum virus
uggucgagggcgaggccaag

SEQ ID NO: 3090630 - RNA, 19 nt, Molluscum contagiosum virus
guagguacccgcaaccccg

SEQ ID NO: 3090631 - RNA, 15 nt, Molluscum contagiosum virus
cugcugcugcaaagc

SEQ ID NO: 3090632 - RNA, 15 nt, Molluscum contagiosum virus
cgaguccagcuucuc

SEQ ID NO: 3090633 - RNA, 21 nt, Molluscum contagiosum virus
cagcuggcgcgcgccgagccc

SEQ ID NO: 3090634 - RNA, 17 nt, Molluscum contagiosum virus
ugggcagcuucugcucg

SEQ ID NO: 3090635 - RNA, 15 nt, Molluscum contagiosum virus
gcaagcuuugugcuc

SEQ ID NO: 3090636 - RNA, 15 nt, Molluscum contagiosum virus
gacgacacagcccug

SEQ ID NO: 3090637 - RNA, 16 nt, Molluscum contagiosum virus
cagcggauagcuuuuc

SEQ ID NO: 3090638 - RNA, 23 nt, Molluscum contagiosum virus
ccaacacguuuucuuucauggcu

SEQ ID NO: 3090639 - RNA, 18 nt, Molluscum contagiosum virus
caggaaaggcacccgcaa

SEQ ID NO: 3090640 - RNA, 22 nt, Molluscum contagiosum virus
cuccgcgaccgcgaacugcaac

SEQ ID NO: 3090641 - RNA, 19 nt, Molluscum contagiosum virus
ucaguacaugcccggccuc

SEQ ID NO: 3090642 - RNA, 17 nt, Molluscum contagiosum virus
gcacgcuguccaggcgc

SEQ ID NO: 3090643 - RNA, 20 nt, Molluscum contagiosum virus
gucgucaaaggcaaagccug

SEQ ID NO: 3090644 - RNA, 18 nt, Molluscum contagiosum virus
cgcuggcgcgcgcgcugc

SEQ ID NO: 3090645 - RNA, 13 nt, Molluscum contagiosum virus
gucaucgggcugc

SEQ ID NO: 3090646 - RNA, 19 nt, Molluscum contagiosum virus
cuucacggagaucaggcag

SEQ ID NO: 3090647 - RNA, 15 nt, Molluscum contagiosum virus
accgcguugccgccc

SEQ ID NO: 3090648 - RNA, 14 nt, Molluscum contagiosum virus
accgccgcggccgc

SEQ ID NO: 3090649 - RNA, 14 nt, Molluscum contagiosum virus
agccccgcgccggc

SEQ ID NO: 3090650 - RNA, 23 nt, Molluscum contagiosum virus
gcuucccgaguacuacuacacug

SEQ ID NO: 3090651 - RNA, 14 nt, Molluscum contagiosum virus
ccgcgccagcaguc

SEQ ID NO: 3090652 - RNA, 15 nt, Molluscum contagiosum virus
acucugugaccugcg

SEQ ID NO: 3090653 - RNA, 16 nt, Molluscum contagiosum virus
cucguguguccgcacg

SEQ ID NO: 3090654 - RNA, 16 nt, Molluscum contagiosum virus
cacgagcacugccugc

SEQ ID NO: 3090655 - RNA, 15 nt, Molluscum contagiosum virus
uccuucuucagcagg

SEQ ID NO: 3090656 - RNA, 12 nt, Molluscum contagiosum virus
gaaaaaguucuu

SEQ ID NO: 3090657 - RNA, 22 nt, Molluscum contagiosum virus
acgcucaacgugggcaccugca

SEQ ID NO: 3090658 - RNA, 17 nt, Molluscum contagiosum virus
ggccgccauccgcgagc

SEQ ID NO: 3090659 - RNA, 17 nt, Molluscum contagiosum virus
ggccgccgcccgcgaau

SEQ ID NO: 3090660 - RNA, 23 nt, Molluscum contagiosum virus
cgcaacaaaagagcgcgccucuc

SEQ ID NO: 3090661 - RNA, 22 nt, Molluscum contagiosum virus
guuccgccuaccccuugcuuca

SEQ ID NO: 3090662 - RNA, 17 nt, Molluscum contagiosum virus
cgcagcccacgugccag

SEQ ID NO: 3090663 - RNA, 19 nt, Molluscum contagiosum virus
cacgaucaaggugcagaac

SEQ ID NO: 3090664 - RNA, 21 nt, Molluscum contagiosum virus
gccugcgcaacgcgggccagg

SEQ ID NO: 3090665 - RNA, 14 nt, Molluscum contagiosum virus
ggcacagucuggga

SEQ ID NO: 3090666 - RNA, 18 nt, Molluscum contagiosum virus
ucuuguugcuggggccug

SEQ ID NO: 3090667 - RNA, 15 nt, Molluscum contagiosum virus
accagauccgggcgc

SEQ ID NO: 3090668 - RNA, 23 nt, Molluscum contagiosum virus
cgcucgcgcgugcucgacucgga

SEQ ID NO: 3090669 - RNA, 16 nt, Molluscum contagiosum virus
uggacagcaagcagcg

SEQ ID NO: 3090670 - RNA, 17 nt, Molluscum contagiosum virus
agacccgaaagcugccc

SEQ ID NO: 3090671 - RNA, 23 nt, Molluscum contagiosum virus
gcaccuacgcgccgacaugcgca

SEQ ID NO: 3090672 - RNA, 15 nt, Molluscum contagiosum virus
ggagcccgugcugga

SEQ ID NO: 3090673 - RNA, 22 nt, Molluscum contagiosum virus
ccgccauuuccgagcgcgcacg

SEQ ID NO: 3090674 - RNA, 17 nt, Molluscum contagiosum virus
caaggaaaaggcacacc

SEQ ID NO: 3090675 - RNA, 19 nt, Molluscum contagiosum virus
aagaucgcgguggcaggcg

SEQ ID NO: 3090676 - RNA, 17 nt, Molluscum contagiosum virus
gcucgcgagugugcaug

SEQ ID NO: 3090677 - RNA, 14 nt, Molluscum contagiosum virus
cacgugguccacca

SEQ ID NO: 3090678 - RNA, 20 nt, Molluscum contagiosum virus
caggggccguucgcgcgcca

SEQ ID NO: 3090679 - RNA, 15 nt, Molluscum contagiosum virus
uaguugcgagccagc

SEQ ID NO: 3090680 - RNA, 22 nt, Molluscum contagiosum virus
gggccaggcacuggcccugcuu

SEQ ID NO: 3090681 - RNA, 17 nt, Molluscum contagiosum virus
uucuggucuggaaacac

SEQ ID NO: 3090682 - RNA, 19 nt, Molluscum contagiosum virus
ugacucggacacuggaggu

SEQ ID NO: 3090683 - RNA, 18 nt, Molluscum contagiosum virus
gagucacgcuugcagaca

SEQ ID NO: 3090684 - RNA, 21 nt, Molluscum contagiosum virus
ugccgggcgccggcucugccu

SEQ ID NO: 3090685 - RNA, 19 nt, Molluscum contagiosum virus
cguggacgagcgcuaccug

SEQ ID NO: 3090686 - RNA, 18 nt, Molluscum contagiosum virus
gaguacgacgcggagguc

SEQ ID NO: 3090687 - RNA, 14 nt, Molluscum contagiosum virus
gcaccgcggcgacg

SEQ ID NO: 3090688 - RNA, 22 nt, Molluscum contagiosum virus
guugccgcgcgcugcucuggag

SEQ ID NO: 3090689 - RNA, 18 nt, Molluscum contagiosum virus
cgcgucugcgaguggcgc

SEQ ID NO: 3090690 - RNA, 15 nt, Molluscum contagiosum virus
cagcuucugcucgcg

SEQ ID NO: 3090691 - RNA, 20 nt, Molluscum contagiosum virus
ugcgcgcgcucgcgcagguc

SEQ ID NO: 3090692 - RNA, 20 nt, Molluscum contagiosum virus
auggcgauagcgauggcugu

SEQ ID NO: 3090693 - RNA, 13 nt, Molluscum contagiosum virus
gcaaacgcacugu

SEQ ID NO: 3090694 - RNA, 20 nt, Molluscum contagiosum virus
gccgcucggcacugcuggcg

SEQ ID NO: 3090695 - RNA, 20 nt, Molluscum contagiosum virus
ccacggcgcgccgccggugc

SEQ ID NO: 3090696 - RNA, 14 nt, Molluscum contagiosum virus
ccgacuccaaggag

SEQ ID NO: 3090697 - RNA, 18 nt, Molluscum contagiosum virus
gcucucgcugcugcccau

SEQ ID NO: 3090698 - RNA, 20 nt, Molluscum contagiosum virus
gggccgcggcgcggcggaag

SEQ ID NO: 3090699 - RNA, 21 nt, Molluscum contagiosum virus
gcaccgcgacaggggccacaa

SEQ ID NO: 3090700 - RNA, 16 nt, Molluscum contagiosum virus
cgcacgugccgugcug

SEQ ID NO: 3090701 - RNA, 18 nt, Molluscum contagiosum virus
gugguggccaagauccug

SEQ ID NO: 3090702 - RNA, 20 nt, Molluscum contagiosum virus
cgcccguguucgcggagcug

SEQ ID NO: 3090703 - RNA, 19 nt, Molluscum contagiosum virus
ggaggcgcuagugcagaug

SEQ ID NO: 3090704 - RNA, 14 nt, Molluscum contagiosum virus
gcgggcgcgcgcca

SEQ ID NO: 3090705 - RNA, 18 nt, Molluscum contagiosum virus
aggcccacuuccgugagc

SEQ ID NO: 3090706 - RNA, 14 nt, Molluscum contagiosum virus
uccuggccaacagg

SEQ ID NO: 3090707 - RNA, 22 nt, Molluscum contagiosum virus
agcaccaagaagcggcccugca

SEQ ID NO: 3090708 - RNA, 18 nt, Molluscum contagiosum virus
ugaagaaggagcccuugc

SEQ ID NO: 3090709 - RNA, 14 nt, Molluscum contagiosum virus
cuccgaguccagcu

SEQ ID NO: 3090710 - RNA, 16 nt, Molluscum contagiosum virus
gcgcagucccagcacc

SEQ ID NO: 3090711 - RNA, 21 nt, Molluscum contagiosum virus
ccaguagcgaaugcagugccc

SEQ ID NO: 3090712 - RNA, 21 nt, Molluscum contagiosum virus
cuagcgggcaagcgcuucccu

SEQ ID NO: 3090713 - RNA, 20 nt, Molluscum contagiosum virus
ugaaaggcaccugcggcucg

SEQ ID NO: 3090714 - RNA, 17 nt, Molluscum contagiosum virus
cgcacaguaccagauua

SEQ ID NO: 3090715 - RNA, 19 nt, Molluscum contagiosum virus
cggcagcgucgcggagcgc

SEQ ID NO: 3090716 - RNA, 12 nt, Molluscum contagiosum virus
cgaguaccgcgc

SEQ ID NO: 3090717 - RNA, 16 nt, Molluscum contagiosum virus
ggcagcucggaggcgc

SEQ ID NO: 3090718 - RNA, 20 nt, Molluscum contagiosum virus
ugccacggccgcgcgcgacu

SEQ ID NO: 3090719 - RNA, 16 nt, Molluscum contagiosum virus
uugccgcgccuugagc

SEQ ID NO: 3090720 - RNA, 20 nt, Molluscum contagiosum virus
cccguaaagaagcggugcag

SEQ ID NO: 3090721 - RNA, 23 nt, Molluscum contagiosum virus
ugccgccaggaaaacggaaacag

SEQ ID NO: 3090722 - RNA, 23 nt, Molluscum contagiosum virus
cagagaaaggcacccaccaggaa

SEQ ID NO: 3090723 - RNA, 20 nt, Molluscum contagiosum virus
cuucuuuacgggcgccagcu

SEQ ID NO: 3090724 - RNA, 16 nt, Molluscum contagiosum virus
gggguguuuccuugcc

SEQ ID NO: 3090725 - RNA, 16 nt, Molluscum contagiosum virus
ggcgccggcucugccu

SEQ ID NO: 3090726 - RNA, 14 nt, Molluscum contagiosum virus
agaacugccugguc

SEQ ID NO: 3090727 - RNA, 14 nt, Molluscum contagiosum virus
gcgcgcgugccggg

SEQ ID NO: 3090728 - RNA, 15 nt, Molluscum contagiosum virus
gucaaugacacgagc

SEQ ID NO: 3090729 - RNA, 18 nt, Molluscum contagiosum virus
ccgcgcccgcggcgcacg

SEQ ID NO: 3090730 - RNA, 18 nt, Molluscum contagiosum virus
agcuucuuggagcccuug

SEQ ID NO: 3090731 - RNA, 17 nt, Molluscum contagiosum virus
gcacgccuccaagaaga

SEQ ID NO: 3090732 - RNA, 21 nt, Molluscum contagiosum virus
accgcgcgcgcaagcgccgcu

SEQ ID NO: 3090733 - RNA, 20 nt, Molluscum contagiosum virus
cugcugcaaagcgcggccgc

SEQ ID NO: 3090734 - RNA, 18 nt, Molluscum contagiosum virus
cgcgcucgggaagcacgu

SEQ ID NO: 3090735 - RNA, 16 nt, Molluscum contagiosum virus
ggcgccgcuaccagcu

SEQ ID NO: 3090736 - RNA, 15 nt, Molluscum contagiosum virus
cugcgggcggcacac

SEQ ID NO: 3090737 - RNA, 21 nt, Molluscum contagiosum virus
uccacaugccgcgcugcuccg

SEQ ID NO: 3090738 - RNA, 14 nt, Molluscum contagiosum virus
ggaggacacgcgca

SEQ ID NO: 3090739 - RNA, 15 nt, Molluscum contagiosum virus
gagcgugucagcagc

SEQ ID NO: 3090740 - RNA, 19 nt, Molluscum contagiosum virus
acguacgagugcuggagca

SEQ ID NO: 3090741 - RNA, 14 nt, Molluscum contagiosum virus
gcucaggccagcau

SEQ ID NO: 3090742 - RNA, 21 nt, Molluscum contagiosum virus
acugcacugcagcgagcucgc

SEQ ID NO: 3090743 - RNA, 17 nt, Molluscum contagiosum virus
cugcgcacgggcgcgcg

SEQ ID NO: 3090744 - RNA, 19 nt, Molluscum contagiosum virus
cgcugcgcgugcugggccc

SEQ ID NO: 3090745 - RNA, 14 nt, Molluscum contagiosum virus
ccaacagcagcugg

SEQ ID NO: 3090746 - RNA, 23 nt, Molluscum contagiosum virus
ugcuaacggacgcggccaugcuc

SEQ ID NO: 3090747 - RNA, 18 nt, Molluscum contagiosum virus
gucuuaacucagcgggca

SEQ ID NO: 3090748 - RNA, 13 nt, Molluscum contagiosum virus
ugcacgagccggc

SEQ ID NO: 3090749 - RNA, 22 nt, Molluscum contagiosum virus
ccaacccucgcaagcugagcgc

SEQ ID NO: 3090750 - RNA, 17 nt, Molluscum contagiosum virus
guuaaauggacgugcuc

SEQ ID NO: 3090751 - RNA, 11 nt, Molluscum contagiosum virus
ugucaagcacu

SEQ ID NO: 3090752 - RNA, 15 nt, Molluscum contagiosum virus
uucgcggagcugugc

SEQ ID NO: 3090753 - RNA, 18 nt, Molluscum contagiosum virus
gucacgcuagcgggccug

SEQ ID NO: 3090754 - RNA, 14 nt, Molluscum contagiosum virus
cgucauggagcagg

SEQ ID NO: 3090755 - RNA, 23 nt, Molluscum contagiosum virus
ccuuugcggcgagcgcuaucucu

SEQ ID NO: 3090756 - RNA, 18 nt, Molluscum contagiosum virus
cucugauuacauccugcc

SEQ ID NO: 3090757 - RNA, 21 nt, Molluscum contagiosum virus
caacaagcucgaacagagcgc

SEQ ID NO: 3090758 - RNA, 14 nt, Molluscum contagiosum virus
cuccuuagacaaaa

SEQ ID NO: 3090759 - RNA, 15 nt, Molluscum contagiosum virus
gcugaagaaggagcc

SEQ ID NO: 3090760 - RNA, 21 nt, Molluscum contagiosum virus
gugcugaagacgcuggccgug

SEQ ID NO: 3090761 - RNA, 18 nt, Molluscum contagiosum virus
ggugcuguccuucugguu

SEQ ID NO: 3090762 - RNA, 17 nt, Molluscum contagiosum virus
agcagcgcgacuagccu

SEQ ID NO: 3090763 - RNA, 15 nt, Molluscum contagiosum virus
ccccgcacaagggca

SEQ ID NO: 3090764 - RNA, 17 nt, Molluscum contagiosum virus
ggagcugguccagggcu

SEQ ID NO: 3090765 - RNA, 15 nt, Molluscum contagiosum virus
cguccggcaugcgcg

SEQ ID NO: 3090766 - RNA, 13 nt, Molluscum contagiosum virus
gcaggaugcuggg

SEQ ID NO: 3090767 - RNA, 19 nt, Molluscum contagiosum virus
aucgcgugcuugcugcgcu

SEQ ID NO: 3090768 - RNA, 18 nt, Molluscum contagiosum virus
ccgaggacgacgccgagc

SEQ ID NO: 3090769 - RNA, 14 nt, Molluscum contagiosum virus
caugcgcgcagugc

SEQ ID NO: 3090770 - RNA, 15 nt, Molluscum contagiosum virus
ggcaccccgaaggaa

SEQ ID NO: 3090771 - RNA, 22 nt, Molluscum contagiosum virus
acgaugucggaacccagaaaga

SEQ ID NO: 3090772 - RNA, 23 nt, Molluscum contagiosum virus
cacggagacgucuggggauggcc

SEQ ID NO: 3090773 - RNA, 20 nt, Molluscum contagiosum virus
ggacacgggugagcucgcca

SEQ ID NO: 3090774 - RNA, 16 nt, Molluscum contagiosum virus
cgagauugagcucuuu

SEQ ID NO: 3090775 - RNA, 21 nt, Molluscum contagiosum virus
cugcgcugccagcucgacacu

SEQ ID NO: 3090776 - RNA, 13 nt, Molluscum contagiosum virus
gcucuacgugcug

SEQ ID NO: 3090777 - RNA, 16 nt, Molluscum contagiosum virus
gcgcggugcugcgcca

SEQ ID NO: 3090778 - RNA, 21 nt, Molluscum contagiosum virus
gcacaugugcgugcaccucaa

SEQ ID NO: 3090779 - RNA, 16 nt, Molluscum contagiosum virus
gacgccguccgcgcag

SEQ ID NO: 3090780 - RNA, 13 nt, Molluscum contagiosum virus
cguagagcagcgc

SEQ ID NO: 3090781 - RNA, 16 nt, Molluscum contagiosum virus
guuccuggugugccag

SEQ ID NO: 3090782 - RNA, 16 nt, Molluscum contagiosum virus
gagaaaggcacccacc

SEQ ID NO: 3090783 - RNA, 13 nt, Molluscum contagiosum virus
cgagcgcaucagc

SEQ ID NO: 3090784 - RNA, 24 nt, Molluscum contagiosum virus
gcugcucgagauucguggcgagca

SEQ ID NO: 3090785 - RNA, 16 nt, Molluscum contagiosum virus
gccgaguacugcugcg

SEQ ID NO: 3090786 - RNA, 19 nt, Molluscum contagiosum virus
cgcgagcgacggcaggccc

SEQ ID NO: 3090787 - RNA, 22 nt, Molluscum contagiosum virus
ugcucuacuuccacgagcugac

SEQ ID NO: 3090788 - RNA, 14 nt, Molluscum contagiosum virus
accaguaccugcug

SEQ ID NO: 3090789 - RNA, 12 nt, Molluscum contagiosum virus
gcaggcuguguu

SEQ ID NO: 3090790 - RNA, 17 nt, Molluscum contagiosum virus
ugcgcaccgcgggcugg

SEQ ID NO: 3090791 - RNA, 19 nt, Molluscum contagiosum virus
gcucgccuccuugcccgag

SEQ ID NO: 3090792 - RNA, 12 nt, Molluscum contagiosum virus
ggcacgcagacc

SEQ ID NO: 3090793 - RNA, 15 nt, Molluscum contagiosum virus
cucacggacucgccg

SEQ ID NO: 3090794 - RNA, 14 nt, Molluscum contagiosum virus
cggagggcgaggcc

SEQ ID NO: 3090795 - RNA, 22 nt, Molluscum contagiosum virus
aggccccccgcaacaaggaaag

SEQ ID NO: 3090796 - RNA, 22 nt, Molluscum contagiosum virus
gcaucaugaaagaacgacucgc

SEQ ID NO: 3090797 - RNA, 14 nt, Molluscum contagiosum virus
cuucuuggagcccu

SEQ ID NO: 3090798 - RNA, 13 nt, Molluscum contagiosum virus
cacgaggagcccc

SEQ ID NO: 3090799 - RNA, 13 nt, Molluscum contagiosum virus
gacgauggccacg

SEQ ID NO: 3090800 - RNA, 19 nt, Molluscum contagiosum virus
gacaaaggcauuuuccugu

SEQ ID NO: 3090801 - RNA, 15 nt, Molluscum contagiosum virus
cucgcgcgcagcucg

SEQ ID NO: 3090802 - RNA, 16 nt, Molluscum contagiosum virus
cuccucgcacgggcgc

SEQ ID NO: 3090803 - RNA, 14 nt, Molluscum contagiosum virus
cuccgcgcaccgcg

SEQ ID NO: 3090804 - RNA, 21 nt, Molluscum contagiosum virus
aagcacgcaacgucgcacugg

SEQ ID NO: 3090805 - RNA, 20 nt, Molluscum contagiosum virus
gucacgacuguguucccggc

SEQ ID NO: 3090806 - RNA, 16 nt, Molluscum contagiosum virus
gcucgcuugcccggag

SEQ ID NO: 3090807 - RNA, 19 nt, Molluscum contagiosum virus
cucgcgcguccgcaaagac

SEQ ID NO: 3090808 - RNA, 13 nt, Molluscum contagiosum virus
acagccguggagu

SEQ ID NO: 3090809 - RNA, 13 nt, Molluscum contagiosum virus
uccccaagaccug

SEQ ID NO: 3090810 - RNA, 21 nt, Molluscum contagiosum virus
cagacccgaaagcugcccugc

SEQ ID NO: 3090811 - RNA, 17 nt, Molluscum contagiosum virus
gguggccaacggcgcca

SEQ ID NO: 3090812 - RNA, 12 nt, Molluscum contagiosum virus
aagcagccgcag

SEQ ID NO: 3090813 - RNA, 18 nt, Molluscum contagiosum virus
gcgcuuuuuuuguccugu

SEQ ID NO: 3090814 - RNA, 13 nt, Molluscum contagiosum virus
gcgagugugcgug

SEQ ID NO: 3090815 - RNA, 22 nt, Molluscum contagiosum virus
aggcacaccccuguaacaagga

SEQ ID NO: 3090816 - RNA, 14 nt, Molluscum contagiosum virus
ccuggagcgcaguc

SEQ ID NO: 3090817 - RNA, 20 nt, Molluscum contagiosum virus
gacauggagcgcaucauguu

SEQ ID NO: 3090818 - RNA, 12 nt, Molluscum contagiosum virus
aagccugcugcg

SEQ ID NO: 3090819 - RNA, 12 nt, Molluscum contagiosum virus
acgcgggccugu

SEQ ID NO: 3090820 - RNA, 16 nt, Molluscum contagiosum virus
acagcaucgggcuguc

SEQ ID NO: 3090821 - RNA, 13 nt, Molluscum contagiosum virus
cggcgcgaagcag

SEQ ID NO: 3090822 - RNA, 21 nt, Molluscum contagiosum virus
aguggcucuagaguacuaggu

SEQ ID NO: 3090823 - RNA, 21 nt, Molluscum contagiosum virus
gcgccggaacucgcgcgcgcc

SEQ ID NO: 3090824 - RNA, 13 nt, Molluscum contagiosum virus
ugucgacagagaa

SEQ ID NO: 3090825 - RNA, 18 nt, Molluscum contagiosum virus
ccaagaacaagcucgagg

SEQ ID NO: 3090826 - RNA, 14 nt, Molluscum contagiosum virus
accucaucaagccc

SEQ ID NO: 3090827 - RNA, 14 nt, Molluscum contagiosum virus
cucgcuugcccgga

SEQ ID NO: 3090828 - RNA, 15 nt, Molluscum contagiosum virus
gcucggcguggugcu

SEQ ID NO: 3090829 - RNA, 13 nt, Molluscum contagiosum virus
cgcaucagcacac

SEQ ID NO: 3090830 - RNA, 14 nt, Molluscum contagiosum virus
cguggccaggccgc

SEQ ID NO: 3090831 - RNA, 21 nt, Molluscum contagiosum virus
cgccuaccaccgggcacuucu

SEQ ID NO: 3090832 - RNA, 16 nt, Molluscum contagiosum virus
cuguccgcggaugcag

SEQ ID NO: 3090833 - RNA, 16 nt, Molluscum contagiosum virus
guguuggccaggcgcg

SEQ ID NO: 3090834 - RNA, 11 nt, Molluscum contagiosum virus
gcggagcuggc

SEQ ID NO: 3090835 - RNA, 19 nt, Molluscum contagiosum virus
agcgcgugacgcucacggc

SEQ ID NO: 3090836 - RNA, 21 nt, Molluscum contagiosum virus
cgggcuucgcugcgcaggugc

SEQ ID NO: 3090837 - RNA, 16 nt, Molluscum contagiosum virus
ucagaggauucuugca

SEQ ID NO: 3090838 - RNA, 17 nt, Molluscum contagiosum virus
cgugcgcaccaucuuca

SEQ ID NO: 3090839 - RNA, 13 nt, Molluscum contagiosum virus
gacgagcugugcg

SEQ ID NO: 3090840 - RNA, 14 nt, Molluscum contagiosum virus
cuuaugcauccuga

SEQ ID NO: 3090841 - RNA, 17 nt, Molluscum contagiosum virus
gcugugccgcagcaacc

SEQ ID NO: 3090842 - RNA, 14 nt, Molluscum contagiosum virus
guguacaaagagcu

SEQ ID NO: 3090843 - RNA, 10 nt, Molluscum contagiosum virus
uuccgggccc

SEQ ID NO: 3090844 - RNA, 19 nt, Molluscum contagiosum virus
aaagaagcggugcagcgcc

SEQ ID NO: 3090845 - RNA, 18 nt, Molluscum contagiosum virus
cgcgcugcgcgccgcgcc

SEQ ID NO: 3090846 - RNA, 13 nt, Molluscum contagiosum virus
cgacugccagcca

SEQ ID NO: 3090847 - RNA, 13 nt, Molluscum contagiosum virus
cuacaccagcugg

SEQ ID NO: 3090848 - RNA, 13 nt, Molluscum contagiosum virus
gaagcggaacucu

SEQ ID NO: 3090849 - RNA, 15 nt, Molluscum contagiosum virus
caugcacagcugcuc

SEQ ID NO: 3090850 - RNA, 21 nt, Molluscum contagiosum virus
gcaccgcguugccgcccgccg

SEQ ID NO: 3090851 - RNA, 15 nt, Molluscum contagiosum virus
gccugcccgugugcg

SEQ ID NO: 3090852 - RNA, 15 nt, Molluscum contagiosum virus
agcuagacuggagca

SEQ ID NO: 3090853 - RNA, 17 nt, Molluscum contagiosum virus
agagcguccagccgcag

SEQ ID NO: 3090854 - RNA, 14 nt, Molluscum contagiosum virus
acagcucuucgucu

SEQ ID NO: 3090855 - RNA, 13 nt, Molluscum contagiosum virus
gcguccggugcuc

SEQ ID NO: 3090856 - RNA, 21 nt, Molluscum contagiosum virus
gugucaacuucgcgcuguacc

SEQ ID NO: 3090857 - RNA, 20 nt, Molluscum contagiosum virus
guacgugcgccagcucuggg

SEQ ID NO: 3090858 - RNA, 16 nt, Molluscum contagiosum virus
gcccccgagcugcgug

SEQ ID NO: 3090859 - RNA, 15 nt, Molluscum contagiosum virus
aacgugcugcgccgc

SEQ ID NO: 3090860 - RNA, 20 nt, Molluscum contagiosum virus
gugagcucgccaauggagcc

SEQ ID NO: 3090861 - RNA, 19 nt, Molluscum contagiosum virus
cgaggucacucgcuacugc

SEQ ID NO: 3090862 - RNA, 23 nt, Molluscum contagiosum virus
gcggcacguuugcgucugcgagg

SEQ ID NO: 3090863 - RNA, 21 nt, Molluscum contagiosum virus
gucuccacgcgugcgcgccag

SEQ ID NO: 3090864 - RNA, 18 nt, Molluscum contagiosum virus
cggaagaauuccuucccg

SEQ ID NO: 3090865 - RNA, 19 nt, Molluscum contagiosum virus
guacagcgggcgcugcucg

SEQ ID NO: 3090866 - RNA, 19 nt, Molluscum contagiosum virus
gccccacugugccagcagc

SEQ ID NO: 3090867 - RNA, 17 nt, Molluscum contagiosum virus
gcguguuugugcugucc

SEQ ID NO: 3090868 - RNA, 21 nt, Molluscum contagiosum virus
cguagacagugcggcgcggcu

SEQ ID NO: 3090869 - RNA, 21 nt, Molluscum contagiosum virus
aggcaggccccgcaccagugc

SEQ ID NO: 3090870 - RNA, 17 nt, Molluscum contagiosum virus
acucucaucgagcaccu

SEQ ID NO: 3090871 - RNA, 17 nt, Molluscum contagiosum virus
cugcgcaagcucagccu

SEQ ID NO: 3090872 - RNA, 15 nt, Molluscum contagiosum virus
cuuuuuuuguccugu

SEQ ID NO: 3090873 - RNA, 16 nt, Molluscum contagiosum virus
ccugugcccuggaagc

SEQ ID NO: 3090874 - RNA, 20 nt, Molluscum contagiosum virus
ccagcgcgcccaccagcagc

SEQ ID NO: 3090875 - RNA, 19 nt, Molluscum contagiosum virus
cacgugcugcugcggcugc

SEQ ID NO: 3090876 - RNA, 21 nt, Molluscum contagiosum virus
gcacgcucauacuccugcugg

SEQ ID NO: 3090877 - RNA, 15 nt, Molluscum contagiosum virus
cacaaguccgcggcu

SEQ ID NO: 3090878 - RNA, 22 nt, Molluscum contagiosum virus
gcuuagcacacgcgcgcgcagg

SEQ ID NO: 3090879 - RNA, 21 nt, Molluscum contagiosum virus
gcgucuuugucacaauguuug

SEQ ID NO: 3090880 - RNA, 22 nt, Molluscum contagiosum virus
cccgugcucaggccagcaucuu

SEQ ID NO: 3090881 - RNA, 14 nt, Molluscum contagiosum virus
accacgagcacugc

SEQ ID NO: 3090882 - RNA, 15 nt, Molluscum contagiosum virus
agcaggaucggagcg

SEQ ID NO: 3090883 - RNA, 23 nt, Molluscum contagiosum virus
cagcucgcgccgccgcgccgcug

SEQ ID NO: 3090884 - RNA, 18 nt, Molluscum contagiosum virus
cacgagcaguccgccucg

SEQ ID NO: 3090885 - RNA, 21 nt, Molluscum contagiosum virus
uggacauccucaccuuccugg

SEQ ID NO: 3090886 - RNA, 15 nt, Molluscum contagiosum virus
cgcauguccacggac

SEQ ID NO: 3090887 - RNA, 20 nt, Molluscum contagiosum virus
gcuccagcguuuccucuggc

SEQ ID NO: 3090888 - RNA, 17 nt, Molluscum contagiosum virus
ccucuuuuugcgccgca

SEQ ID NO: 3090889 - RNA, 23 nt, Molluscum contagiosum virus
ggcgcucggcguggugcuggcca

SEQ ID NO: 3090890 - RNA, 22 nt, Molluscum contagiosum virus
cuuuucgcgccgcgggcacaug

SEQ ID NO: 3090891 - RNA, 19 nt, Molluscum contagiosum virus
gcacacgcgcgcgugcugc

SEQ ID NO: 3090892 - RNA, 17 nt, Molluscum contagiosum virus
cgccgucaauacucugu

SEQ ID NO: 3090893 - RNA, 16 nt, Molluscum contagiosum virus
ugccagcggcgccgca

SEQ ID NO: 3090894 - RNA, 14 nt, Molluscum contagiosum virus
ggcgcagagccugc

SEQ ID NO: 3090895 - RNA, 21 nt, Molluscum contagiosum virus
accagcgugcccuucuccgag

SEQ ID NO: 3090896 - RNA, 13 nt, Molluscum contagiosum virus
gcgccgcagaaca

SEQ ID NO: 3090897 - RNA, 17 nt, Molluscum contagiosum virus
acgccuggcggcagcac

SEQ ID NO: 3090898 - RNA, 20 nt, Molluscum contagiosum virus
ucuucacuccgcacagcuuc

SEQ ID NO: 3090899 - RNA, 13 nt, Molluscum contagiosum virus
cuccaugcugccg

SEQ ID NO: 3090900 - RNA, 18 nt, Molluscum contagiosum virus
aacgcgcgcgugcugucc

SEQ ID NO: 3090901 - RNA, 16 nt, Molluscum contagiosum virus
caaaaacugaaaagcg

SEQ ID NO: 3090902 - RNA, 14 nt, Molluscum contagiosum virus
ccgcuccagagccg

SEQ ID NO: 3090903 - RNA, 20 nt, Molluscum contagiosum virus
cacgcaggacuggcaccugc

SEQ ID NO: 3090904 - RNA, 17 nt, Molluscum contagiosum virus
cgacgccuuccugcugg

SEQ ID NO: 3090905 - RNA, 16 nt, Molluscum contagiosum virus
ccgugacgcugcggcg

SEQ ID NO: 3090906 - RNA, 15 nt, Molluscum contagiosum virus
gccccacugugccag

SEQ ID NO: 3090907 - RNA, 21 nt, Molluscum contagiosum virus
cagugcgugcucgguagcgug

SEQ ID NO: 3090908 - RNA, 19 nt, Molluscum contagiosum virus
ggcaccccgaaggaaaggc

SEQ ID NO: 3090909 - RNA, 21 nt, Molluscum contagiosum virus
aagcgcguucgcgcgugcugg

SEQ ID NO: 3090910 - RNA, 12 nt, Molluscum contagiosum virus
gccugcccugcu

SEQ ID NO: 3090911 - RNA, 15 nt, Molluscum contagiosum virus
ccaaccgccugcucu

SEQ ID NO: 3090912 - RNA, 15 nt, Molluscum contagiosum virus
ggcauggagggcgag

SEQ ID NO: 3090913 - RNA, 19 nt, Molluscum contagiosum virus
guccagcggcugcccgcgg

SEQ ID NO: 3090914 - RNA, 14 nt, Molluscum contagiosum virus
cacaaaucguccga

SEQ ID NO: 3090915 - RNA, 18 nt, Molluscum contagiosum virus
cgguggugcgccugcacu

SEQ ID NO: 3090916 - RNA, 16 nt, Molluscum contagiosum virus
uguugccuggagggca

SEQ ID NO: 3090917 - RNA, 18 nt, Molluscum contagiosum virus
gacgacuucggcgcaacg

SEQ ID NO: 3090918 - RNA, 14 nt, Molluscum contagiosum virus
ggcuccgcuggacc

SEQ ID NO: 3090919 - RNA, 16 nt, Molluscum contagiosum virus
gcaaguacaacccaaa

SEQ ID NO: 3090920 - RNA, 17 nt, Molluscum contagiosum virus
gcuucuuccggcagcug

SEQ ID NO: 3090921 - RNA, 17 nt, Molluscum contagiosum virus
cugcgcgugcugggccc

SEQ ID NO: 3090922 - RNA, 16 nt, Molluscum contagiosum virus
cagcucggaggcgcag

SEQ ID NO: 3090923 - RNA, 20 nt, Molluscum contagiosum virus
guccgccucgagcacgccuc

SEQ ID NO: 3090924 - RNA, 14 nt, Molluscum contagiosum virus
gcccuccucgaccu

SEQ ID NO: 3090925 - RNA, 16 nt, Molluscum contagiosum virus
ucaagaacaccaagag

SEQ ID NO: 3090926 - RNA, 20 nt, Molluscum contagiosum virus
gccggcgaaccgacugcccg

SEQ ID NO: 3090927 - RNA, 13 nt, Molluscum contagiosum virus
ccgugccccugcu

SEQ ID NO: 3090928 - RNA, 13 nt, Molluscum contagiosum virus
ccugccagcagag

SEQ ID NO: 3090929 - RNA, 19 nt, Molluscum contagiosum virus
uccugcugccgggagagga

SEQ ID NO: 3090930 - RNA, 19 nt, Molluscum contagiosum virus
cguacucgcguccgcgcag

SEQ ID NO: 3090931 - RNA, 23 nt, Molluscum contagiosum virus
gaggaacucgaggcucuguucug

SEQ ID NO: 3090932 - RNA, 14 nt, Molluscum contagiosum virus
gcaaugcgugcgug

SEQ ID NO: 3090933 - RNA, 17 nt, Molluscum contagiosum virus
ccggcggcaagcgagau

SEQ ID NO: 3090934 - RNA, 12 nt, Molluscum contagiosum virus
cacagcacaggc

SEQ ID NO: 3090935 - RNA, 11 nt, Molluscum contagiosum virus
guggccacagc

SEQ ID NO: 3090936 - RNA, 18 nt, Molluscum contagiosum virus
ucucgcggugacaggcag

SEQ ID NO: 3090937 - RNA, 22 nt, Molluscum contagiosum virus
aacaagcugcuggcacaaaucg

SEQ ID NO: 3090938 - RNA, 17 nt, Molluscum contagiosum virus
cugguucugcgcugcca

SEQ ID NO: 3090939 - RNA, 14 nt, Molluscum contagiosum virus
uccggcgcucgccu

SEQ ID NO: 3090940 - RNA, 19 nt, Molluscum contagiosum virus
uccgcccccagguggagcu

SEQ ID NO: 3090941 - RNA, 21 nt, Molluscum contagiosum virus
cuggccgcauuuucucuggag

SEQ ID NO: 3090942 - RNA, 13 nt, Molluscum contagiosum virus
gccuucucggugu

SEQ ID NO: 3090943 - RNA, 14 nt, Molluscum contagiosum virus
ggucaucgggcugc

SEQ ID NO: 3090944 - RNA, 19 nt, Molluscum contagiosum virus
ccaggcacacgcagugcca

SEQ ID NO: 3090945 - RNA, 16 nt, Molluscum contagiosum virus
cacaaagacgggcccg

SEQ ID NO: 3090946 - RNA, 20 nt, Molluscum contagiosum virus
cagcuggacggugcuggugc

SEQ ID NO: 3090947 - RNA, 14 nt, Molluscum contagiosum virus
caccgcaugggccc

SEQ ID NO: 3090948 - RNA, 18 nt, Molluscum contagiosum virus
ggaugccacgcagcuggc

SEQ ID NO: 3090949 - RNA, 17 nt, Molluscum contagiosum virus
ugaacgcgcugcgccac

SEQ ID NO: 3090950 - RNA, 16 nt, Molluscum contagiosum virus
aagcuaaaagagcugc

SEQ ID NO: 3090951 - RNA, 20 nt, Molluscum contagiosum virus
guagcagcgccugcacgcac

SEQ ID NO: 3090952 - RNA, 19 nt, Molluscum contagiosum virus
uuggcgcccgugccgccgg

SEQ ID NO: 3090953 - RNA, 13 nt, Molluscum contagiosum virus
cacagagggacag

SEQ ID NO: 3090954 - RNA, 22 nt, Molluscum contagiosum virus
cgccgagugcgacgcgcgucac

SEQ ID NO: 3090955 - RNA, 14 nt, Molluscum contagiosum virus
ucgagacaggccgg

SEQ ID NO: 3090956 - RNA, 24 nt, Molluscum contagiosum virus
gcgggccuguccgcgggcgcacgc

SEQ ID NO: 3090957 - RNA, 13 nt, Molluscum contagiosum virus
cccguuccugggc

SEQ ID NO: 3090958 - RNA, 14 nt, Molluscum contagiosum virus
ggugcaaccgcugc

SEQ ID NO: 3090959 - RNA, 23 nt, Molluscum contagiosum virus
gcaagcccgcgcgcgagcuggag

SEQ ID NO: 3090960 - RNA, 16 nt, Molluscum contagiosum virus
ccuugcucuggcucuc

SEQ ID NO: 3090961 - RNA, 12 nt, Molluscum contagiosum virus
ggcgcgugccgc

SEQ ID NO: 3090962 - RNA, 18 nt, Molluscum contagiosum virus
guaaagguacacuuuccg

SEQ ID NO: 3090963 - RNA, 17 nt, Molluscum contagiosum virus
cacgggaaggcucucaa

SEQ ID NO: 3090964 - RNA, 15 nt, Molluscum contagiosum virus
uaccggcucaagaac

SEQ ID NO: 3090965 - RNA, 19 nt, Molluscum contagiosum virus
cucccggcuuccgacaacu

SEQ ID NO: 3090966 - RNA, 23 nt, Molluscum contagiosum virus
auucuugcacgggcaugcacagc

SEQ ID NO: 3090967 - RNA, 20 nt, Molluscum contagiosum virus
guaccugcucgggcugcgcg

SEQ ID NO: 3090968 - RNA, 14 nt, Molluscum contagiosum virus
cgacagcgccgcca

SEQ ID NO: 3090969 - RNA, 14 nt, Molluscum contagiosum virus
agacugagucucca

SEQ ID NO: 3090970 - RNA, 16 nt, Molluscum contagiosum virus
cgcugaguuacguggc

SEQ ID NO: 3090971 - RNA, 14 nt, Molluscum contagiosum virus
cgcgcgugccgggc

SEQ ID NO: 3090972 - RNA, 14 nt, Molluscum contagiosum virus
gcaugucgcggugc

SEQ ID NO: 3090973 - RNA, 23 nt, Molluscum contagiosum virus
caccgcgccgaaacacggccucc

SEQ ID NO: 3090974 - RNA, 14 nt, Molluscum contagiosum virus
gcucgccgcgcgcc

SEQ ID NO: 3090975 - RNA, 20 nt, Molluscum contagiosum virus
uaaagaccgugucuggugua

SEQ ID NO: 3090976 - RNA, 22 nt, Molluscum contagiosum virus
cgcacggcuaggcgcggcgggc

SEQ ID NO: 3090977 - RNA, 20 nt, Molluscum contagiosum virus
gauacacauugcgugugggg

SEQ ID NO: 3090978 - RNA, 13 nt, Molluscum contagiosum virus
ccgcgccgcgccg

SEQ ID NO: 3090979 - RNA, 15 nt, Molluscum contagiosum virus
gagguggcacccugg

SEQ ID NO: 3090980 - RNA, 16 nt, Molluscum contagiosum virus
gccugcgcgagcaagc

SEQ ID NO: 3090981 - RNA, 12 nt, Molluscum contagiosum virus
cugcucuggagc

SEQ ID NO: 3090982 - RNA, 15 nt, Molluscum contagiosum virus
cgagcguugucuuga

SEQ ID NO: 3090983 - RNA, 12 nt, Molluscum contagiosum virus
ggaguccaugcc

SEQ ID NO: 3090984 - RNA, 19 nt, Molluscum contagiosum virus
agcacggccgccaccgcgc

SEQ ID NO: 3090985 - RNA, 15 nt, Molluscum contagiosum virus
cuggcuucuccaccu

SEQ ID NO: 3090986 - RNA, 14 nt, Molluscum contagiosum virus
ccaccagcgcggcc

SEQ ID NO: 3090987 - RNA, 14 nt, Molluscum contagiosum virus
gaagccgccagcca

SEQ ID NO: 3090988 - RNA, 19 nt, Molluscum contagiosum virus
agcacguuaaucacgauga

SEQ ID NO: 3090989 - RNA, 15 nt, Molluscum contagiosum virus
aacaggcacuucgca

SEQ ID NO: 3090990 - RNA, 21 nt, Molluscum contagiosum virus
cgcgggccuguccgcgggcgc

SEQ ID NO: 3090991 - RNA, 18 nt, Molluscum contagiosum virus
gccacgcggagcucgcca

SEQ ID NO: 3090992 - RNA, 23 nt, Molluscum contagiosum virus
ucacgcgcgauggcgccugcuuc

SEQ ID NO: 3090993 - RNA, 22 nt, Molluscum contagiosum virus
gacugcggacgggaagcuuuca

SEQ ID NO: 3090994 - RNA, 16 nt, Molluscum contagiosum virus
acauugccuuuugcac

SEQ ID NO: 3090995 - RNA, 22 nt, Molluscum contagiosum virus
gcuuccccgcacaagggcagcu

SEQ ID NO: 3090996 - RNA, 17 nt, Molluscum contagiosum virus
uagcagcuucuuggagc

SEQ ID NO: 3090997 - RNA, 21 nt, Molluscum contagiosum virus
ccgagcagaaggaagggcccg

SEQ ID NO: 3090998 - RNA, 18 nt, Molluscum contagiosum virus
accuccugcaccugcugg

SEQ ID NO: 3090999 - RNA, 18 nt, Molluscum contagiosum virus
ccacgcucgcgcgcaugc

SEQ ID NO: 3091000 - RNA, 15 nt, Molluscum contagiosum virus
gaccggcgucggcaa

SEQ ID NO: 3091001 - RNA, 20 nt, Molluscum contagiosum virus
gcagcuaccgcgcgcgcaag

SEQ ID NO: 3091002 - RNA, 21 nt, Molluscum contagiosum virus
gaagcaagacccagcaaggcc

SEQ ID NO: 3091003 - RNA, 23 nt, Molluscum contagiosum virus
agaaguugccgcaggaaccgcgu

SEQ ID NO: 3091004 - RNA, 15 nt, Molluscum contagiosum virus
ugcagcagcacaggu

SEQ ID NO: 3091005 - RNA, 22 nt, Molluscum contagiosum virus
acggagaucaggcagcugcugc

SEQ ID NO: 3091006 - RNA, 21 nt, Molluscum contagiosum virus
ugcacagccgcuuucugggcg

SEQ ID NO: 3091007 - RNA, 21 nt, Molluscum contagiosum virus
ccuagcuucugcguugccagc

SEQ ID NO: 3091008 - RNA, 15 nt, Molluscum contagiosum virus
ccgucccccgcggag

SEQ ID NO: 3091009 - RNA, 16 nt, Molluscum contagiosum virus
aggccuccuucccuga

SEQ ID NO: 3091010 - RNA, 19 nt, Molluscum contagiosum virus
cccgugcuggagggcacgc

SEQ ID NO: 3091011 - RNA, 22 nt, Molluscum contagiosum virus
acaagggcagcucaagcugcuc

SEQ ID NO: 3091012 - RNA, 15 nt, Molluscum contagiosum virus
agcuaaaagagcugc

SEQ ID NO: 3091013 - RNA, 15 nt, Molluscum contagiosum virus
gagacacgaguuucu

SEQ ID NO: 3091014 - RNA, 15 nt, Molluscum contagiosum virus
cugcgcgcggacuuc

SEQ ID NO: 3091015 - RNA, 13 nt, Molluscum contagiosum virus
gcggcugcuggag

SEQ ID NO: 3091016 - RNA, 16 nt, Molluscum contagiosum virus
gcugagcccuuugaug

SEQ ID NO: 3091017 - RNA, 16 nt, Molluscum contagiosum virus
ugcccgcgcccugcac

SEQ ID NO: 3091018 - RNA, 14 nt, Molluscum contagiosum virus
cgcacggaccucaa

SEQ ID NO: 3091019 - RNA, 17 nt, Molluscum contagiosum virus
gcauucucggacagugc

SEQ ID NO: 3091020 - RNA, 21 nt, Molluscum contagiosum virus
agcaccgccugcugcagcucc

SEQ ID NO: 3091021 - RNA, 12 nt, Molluscum contagiosum virus
cccacgagcgcc

SEQ ID NO: 3091022 - RNA, 23 nt, Molluscum contagiosum virus
cacuacucgucuugcgcgccacu

SEQ ID NO: 3091023 - RNA, 22 nt, Molluscum contagiosum virus
gcuggcgcuaccuaccggcagc

SEQ ID NO: 3091024 - RNA, 13 nt, Molluscum contagiosum virus
cguggugggccgc

SEQ ID NO: 3091025 - RNA, 14 nt, Molluscum contagiosum virus
ggcaccccgcagga

SEQ ID NO: 3091026 - RNA, 19 nt, Molluscum contagiosum virus
ggcgagacgugcggcacgc

SEQ ID NO: 3091027 - RNA, 16 nt, Molluscum contagiosum virus
cacccaccaggaacga

SEQ ID NO: 3091028 - RNA, 23 nt, Molluscum contagiosum virus
gcacgcugcuguccuucaagaac

SEQ ID NO: 3091029 - RNA, 19 nt, Molluscum contagiosum virus
gguggcacccuggcugcug

SEQ ID NO: 3091030 - RNA, 21 nt, Molluscum contagiosum virus
acggagcuacaaaacugaaaa

SEQ ID NO: 3091031 - RNA, 13 nt, Molluscum contagiosum virus
ccucugcgcggcc

SEQ ID NO: 3091032 - RNA, 22 nt, Molluscum contagiosum virus
ggagcccgaccccaagaagaac

SEQ ID NO: 3091033 - RNA, 20 nt, Molluscum contagiosum virus
cgcaggaaaggucgggcccg

SEQ ID NO: 3091034 - RNA, 20 nt, Molluscum contagiosum virus
aagcauccaggccuucgggc

SEQ ID NO: 3091035 - RNA, 20 nt, Molluscum contagiosum virus
acgaggucuuccauugcaug

SEQ ID NO: 3091036 - RNA, 19 nt, Molluscum contagiosum virus
gaagucguuaggcggcucc

SEQ ID NO: 3091037 - RNA, 21 nt, Molluscum contagiosum virus
ugcgcuacguuccgcgcgggg

SEQ ID NO: 3091038 - RNA, 13 nt, Molluscum contagiosum virus
cacgcgcacacgc

SEQ ID NO: 3091039 - RNA, 19 nt, Molluscum contagiosum virus
cuccuccugaugcccgcga

SEQ ID NO: 3091040 - RNA, 15 nt, Molluscum contagiosum virus
ucaagcaggcaugca

SEQ ID NO: 3091041 - RNA, 15 nt, Molluscum contagiosum virus
cgcaccagcugcaaa

SEQ ID NO: 3091042 - RNA, 16 nt, Molluscum contagiosum virus
gacuggcuucggggac

SEQ ID NO: 3091043 - RNA, 12 nt, Molluscum contagiosum virus
cgcggagcugug

SEQ ID NO: 3091044 - RNA, 13 nt, Molluscum contagiosum virus
gcuggcggugcuc

SEQ ID NO: 3091045 - RNA, 22 nt, Molluscum contagiosum virus
cagagaaaucccaagagccaug

SEQ ID NO: 3091046 - RNA, 14 nt, Molluscum contagiosum virus
cggcagcuggagcu

SEQ ID NO: 3091047 - RNA, 13 nt, Molluscum contagiosum virus
aggauggacaaag

SEQ ID NO: 3091048 - RNA, 22 nt, Molluscum contagiosum virus
augcugcucauggucgucuccg

SEQ ID NO: 3091049 - RNA, 20 nt, Molluscum contagiosum virus
ccaagggcguagagcaauac

SEQ ID NO: 3091050 - RNA, 20 nt, Molluscum contagiosum virus
agggaggcucgagcgcgcgc

SEQ ID NO: 3091051 - RNA, 17 nt, Molluscum contagiosum virus
cccgcgucccgacagca

SEQ ID NO: 3091052 - RNA, 23 nt, Molluscum contagiosum virus
gcggagccggccuagagcuggca

SEQ ID NO: 3091053 - RNA, 22 nt, Molluscum contagiosum virus
gugcucggugucgguaccugca

SEQ ID NO: 3091054 - RNA, 14 nt, Molluscum contagiosum virus
cgagaacggcucaa

SEQ ID NO: 3091055 - RNA, 19 nt, Molluscum contagiosum virus
ccggcagcgcgccuagcuc

SEQ ID NO: 3091056 - RNA, 13 nt, Molluscum contagiosum virus
aagugcuccgcac

SEQ ID NO: 3091057 - RNA, 18 nt, Molluscum contagiosum virus
ccaugcccgaccacgugc

SEQ ID NO: 3091058 - RNA, 19 nt, Molluscum contagiosum virus
cgagaccuacgucaagcag

SEQ ID NO: 3091059 - RNA, 20 nt, Molluscum contagiosum virus
gccaggcggucuuccagcac

SEQ ID NO: 3091060 - RNA, 19 nt, Molluscum contagiosum virus
cggaugcagaacagcacgu

SEQ ID NO: 3091061 - RNA, 16 nt, Molluscum contagiosum virus
gcggcggggcugcugg

SEQ ID NO: 3091062 - RNA, 14 nt, Molluscum contagiosum virus
gcucauagcccaug

SEQ ID NO: 3091063 - RNA, 22 nt, Molluscum contagiosum virus
gcgccacuagcaaggcgccgcg

SEQ ID NO: 3091064 - RNA, 15 nt, Molluscum contagiosum virus
acaucuaugcacggc

SEQ ID NO: 3091065 - RNA, 13 nt, Molluscum contagiosum virus
cgccuagcuccag

SEQ ID NO: 3091066 - RNA, 14 nt, Molluscum contagiosum virus
ccugcaccugcugg

SEQ ID NO: 3091067 - RNA, 14 nt, Molluscum contagiosum virus
ggcgggggcagcag

SEQ ID NO: 3091068 - RNA, 18 nt, Molluscum contagiosum virus
gcucaaucucgcccagca

SEQ ID NO: 3091069 - RNA, 19 nt, Molluscum contagiosum virus
caagcaccgccugcugcag

SEQ ID NO: 3091070 - RNA, 17 nt, Molluscum contagiosum virus
gcacgcggcucuggagc

SEQ ID NO: 3091071 - RNA, 15 nt, Molluscum contagiosum virus
cuuccgucugcugcu

SEQ ID NO: 3091072 - RNA, 19 nt, Molluscum contagiosum virus
cacccgagggcgugcgcuu

SEQ ID NO: 3091073 - RNA, 15 nt, Molluscum contagiosum virus
cgcgauucugcucuu

SEQ ID NO: 3091074 - RNA, 14 nt, Molluscum contagiosum virus
gcguucgacagcuc

SEQ ID NO: 3091075 - RNA, 22 nt, Molluscum contagiosum virus
gcucguuuucggauagccccuc

SEQ ID NO: 3091076 - RNA, 18 nt, Molluscum contagiosum virus
cgacgugccugccaucua

SEQ ID NO: 3091077 - RNA, 22 nt, Molluscum contagiosum virus
cgccgugggcagcuucugcucg

SEQ ID NO: 3091078 - RNA, 20 nt, Molluscum contagiosum virus
cgaacguuauccccuccaag

SEQ ID NO: 3091079 - RNA, 17 nt, Molluscum contagiosum virus
gcugcggcaacugccug

SEQ ID NO: 3091080 - RNA, 17 nt, Molluscum contagiosum virus
aagcaucaugaaagaac

SEQ ID NO: 3091081 - RNA, 19 nt, Molluscum contagiosum virus
cgcgccgcgggcgcagagc

SEQ ID NO: 3091082 - RNA, 17 nt, Molluscum contagiosum virus
accugcguucgcuccgu

SEQ ID NO: 3091083 - RNA, 21 nt, Molluscum contagiosum virus
gcggagcgcgcacggcagcgg

SEQ ID NO: 3091084 - RNA, 16 nt, Molluscum contagiosum virus
gacgagagggcgcgcg

SEQ ID NO: 3091085 - RNA, 19 nt, Molluscum contagiosum virus
caggaaagguaccccgcag

SEQ ID NO: 3091086 - RNA, 13 nt, Molluscum contagiosum virus
cgcggaccgcgcc

SEQ ID NO: 3091087 - RNA, 13 nt, Molluscum contagiosum virus
gugugcguacugg

SEQ ID NO: 3091088 - RNA, 18 nt, Molluscum contagiosum virus
caaauuccucgagaggga

SEQ ID NO: 3091089 - RNA, 15 nt, Molluscum contagiosum virus
cgcucuuacugcagc

SEQ ID NO: 3091090 - RNA, 18 nt, Molluscum contagiosum virus
gcccaggcgcgcgcucag

SEQ ID NO: 3091091 - RNA, 20 nt, Molluscum contagiosum virus
gacggcugcucgcugccugg

SEQ ID NO: 3091092 - RNA, 22 nt, Molluscum contagiosum virus
aggaaaggcaccugcaggaaag

SEQ ID NO: 3091093 - RNA, 22 nt, Molluscum contagiosum virus
ccggcgcgcgcgcgcaggcucg

SEQ ID NO: 3091094 - RNA, 16 nt, Molluscum contagiosum virus
gacagcuugcugcugu

SEQ ID NO: 3091095 - RNA, 21 nt, Molluscum contagiosum virus
uuccucgacgaggccuacagc

SEQ ID NO: 3091096 - RNA, 17 nt, Molluscum contagiosum virus
gcagaggacagcuccuu

SEQ ID NO: 3091097 - RNA, 18 nt, Molluscum contagiosum virus
augucuccccuugggcuc

SEQ ID NO: 3091098 - RNA, 16 nt, Molluscum contagiosum virus
cacccgugcgcgcgcu

SEQ ID NO: 3091099 - RNA, 16 nt, Molluscum contagiosum virus
cccacgugccagcuca

SEQ ID NO: 3091100 - RNA, 14 nt, Molluscum contagiosum virus
gaccgucacgacuc

SEQ ID NO: 3091101 - RNA, 16 nt, Molluscum contagiosum virus
gcgugcaugcccagca

SEQ ID NO: 3091102 - RNA, 14 nt, Molluscum contagiosum virus
uagcgccacgagca

SEQ ID NO: 3091103 - RNA, 18 nt, Molluscum contagiosum virus
ccguguccgguacugcug

SEQ ID NO: 3091104 - RNA, 22 nt, Molluscum contagiosum virus
gcaugcucacguacgacugcuu

SEQ ID NO: 3091105 - RNA, 12 nt, Molluscum contagiosum virus
ugugcgagcgca

SEQ ID NO: 3091106 - RNA, 21 nt, Molluscum contagiosum virus
acgaacggacgccuuuugugc

SEQ ID NO: 3091107 - RNA, 13 nt, Molluscum contagiosum virus
aucgacgagcacg

SEQ ID NO: 3091108 - RNA, 13 nt, Molluscum contagiosum virus
cccgggcggcgcg

SEQ ID NO: 3091109 - RNA, 18 nt, Molluscum contagiosum virus
gcugcccgcgcacgagcu

SEQ ID NO: 3091110 - RNA, 23 nt, Molluscum contagiosum virus
cgacaacacgcuguugcugcugc

SEQ ID NO: 3091111 - RNA, 13 nt, Molluscum contagiosum virus
ccgugcuugcuag

SEQ ID NO: 3091112 - RNA, 17 nt, Molluscum contagiosum virus
cgcguucgacagcucuu

SEQ ID NO: 3091113 - RNA, 13 nt, Molluscum contagiosum virus
acagagccccguu

SEQ ID NO: 3091114 - RNA, 19 nt, Molluscum contagiosum virus
ugcgcgugccucugccagc

SEQ ID NO: 3091115 - RNA, 16 nt, Molluscum contagiosum virus
caucuucaagccgcag

SEQ ID NO: 3091116 - RNA, 21 nt, Molluscum contagiosum virus
agcagcgugcauagugggcuu

SEQ ID NO: 3091117 - RNA, 17 nt, Molluscum contagiosum virus
ggcugcucccucucgag

SEQ ID NO: 3091118 - RNA, 21 nt, Molluscum contagiosum virus
cuuggcaauggcgcgcagcuc

SEQ ID NO: 3091119 - RNA, 22 nt, Molluscum contagiosum virus
gacgcugccggcaacgcugccg

SEQ ID NO: 3091120 - RNA, 16 nt, Molluscum contagiosum virus
ggcgcgccggccagcg

SEQ ID NO: 3091121 - RNA, 22 nt, Molluscum contagiosum virus
ggcaccccgaaaggcacccgca

SEQ ID NO: 3091122 - RNA, 21 nt, Molluscum contagiosum virus
gagcccgggcccgugcccgag

SEQ ID NO: 3091123 - RNA, 21 nt, Molluscum contagiosum virus
agcugcacgugcagcggcgcc

SEQ ID NO: 3091124 - RNA, 15 nt, Molluscum contagiosum virus
gcacgcgccgcgcgg

SEQ ID NO: 3091125 - RNA, 20 nt, Molluscum contagiosum virus
cgccucggacggaggucugc

SEQ ID NO: 3091126 - RNA, 16 nt, Molluscum contagiosum virus
agccgcucguccagcu

SEQ ID NO: 3091127 - RNA, 22 nt, Molluscum contagiosum virus
uccgcgggcgcgcgccagcagc

SEQ ID NO: 3091128 - RNA, 17 nt, Molluscum contagiosum virus
cagccugacggcagcaa

SEQ ID NO: 3091129 - RNA, 17 nt, Molluscum contagiosum virus
uuccuugcgcuuguccu

SEQ ID NO: 3091130 - RNA, 19 nt, Molluscum contagiosum virus
cgcgcccaccagcagccag

SEQ ID NO: 3091131 - RNA, 15 nt, Molluscum contagiosum virus
ccgcugagcgcagca

SEQ ID NO: 3091132 - RNA, 14 nt, Molluscum contagiosum virus
cgggcacgcagcuc

SEQ ID NO: 3091133 - RNA, 14 nt, Molluscum contagiosum virus
acgcacgaccucac

SEQ ID NO: 3091134 - RNA, 21 nt, Molluscum contagiosum virus
gcauugcgucuuacugcugca

SEQ ID NO: 3091135 - RNA, 13 nt, Molluscum contagiosum virus
cagccuguuuuua

SEQ ID NO: 3091136 - RNA, 13 nt, Molluscum contagiosum virus
cucugccugcaag

SEQ ID NO: 3091137 - RNA, 23 nt, Molluscum contagiosum virus
aggcgcacccucacaccuagagc

SEQ ID NO: 3091138 - RNA, 18 nt, Molluscum contagiosum virus
cggcuuccggcaccacgu

SEQ ID NO: 3091139 - RNA, 14 nt, Molluscum contagiosum virus
gcgcagucccagca

SEQ ID NO: 3091140 - RNA, 17 nt, Molluscum contagiosum virus
gccugugcccuggaagc

SEQ ID NO: 3091141 - RNA, 21 nt, Molluscum contagiosum virus
uggccaagcgcuccaacuucc

SEQ ID NO: 3091142 - RNA, 16 nt, Molluscum contagiosum virus
cugccgggagagccgc

SEQ ID NO: 3091143 - RNA, 20 nt, Molluscum contagiosum virus
gagcauguugucgaagaaca

SEQ ID NO: 3091144 - RNA, 13 nt, Molluscum contagiosum virus
guugccuggaggg

SEQ ID NO: 3091145 - RNA, 15 nt, Molluscum contagiosum virus
ugguaacaagagcuu

SEQ ID NO: 3091146 - RNA, 17 nt, Molluscum contagiosum virus
gcugugagcgcgccgcu

SEQ ID NO: 3091147 - RNA, 13 nt, Molluscum contagiosum virus
gcucgaggcgccg

SEQ ID NO: 3091148 - RNA, 21 nt, Molluscum contagiosum virus
accgggguccgcuccuucuca

SEQ ID NO: 3091149 - RNA, 21 nt, Molluscum contagiosum virus
uggcaugcgcccucacgugcu

SEQ ID NO: 3091150 - RNA, 17 nt, Molluscum contagiosum virus
cgcaguuuuuuuccgca

SEQ ID NO: 3091151 - RNA, 19 nt, Molluscum contagiosum virus
agaggccagcacaagccgu

SEQ ID NO: 3091152 - RNA, 16 nt, Molluscum contagiosum virus
ugauccuugccaagcc

SEQ ID NO: 3091153 - RNA, 17 nt, Molluscum contagiosum virus
gggcgcgaccggcgugc

SEQ ID NO: 3091154 - RNA, 13 nt, Molluscum contagiosum virus
gcgcgccagcacg

SEQ ID NO: 3091155 - RNA, 23 nt, Molluscum contagiosum virus
gcgaccagcucuuggcgggcacc

SEQ ID NO: 3091156 - RNA, 20 nt, Molluscum contagiosum virus
gagcgaaccgcggcagccuu

SEQ ID NO: 3091157 - RNA, 21 nt, Molluscum contagiosum virus
accuccuucgcguaccaagcc

SEQ ID NO: 3091158 - RNA, 22 nt, Molluscum contagiosum virus
uguuccacgaccgcaagugcac

SEQ ID NO: 3091159 - RNA, 17 nt, Molluscum contagiosum virus
guaagucgaagaggguc

SEQ ID NO: 3091160 - RNA, 17 nt, Molluscum contagiosum virus
gcugaguuacguggccg

SEQ ID NO: 3091161 - RNA, 16 nt, Molluscum contagiosum virus
cgauggacgccagcuu

SEQ ID NO: 3091162 - RNA, 13 nt, Molluscum contagiosum virus
gcugcgugugccg

SEQ ID NO: 3091163 - RNA, 17 nt, Molluscum contagiosum virus
ggcgcacaaucucgccg

SEQ ID NO: 3091164 - RNA, 22 nt, Molluscum contagiosum virus
gcguagcggacgaagcugugca

SEQ ID NO: 3091165 - RNA, 21 nt, Molluscum contagiosum virus
cgcggccacgcacucgcuggc

SEQ ID NO: 3091166 - RNA, 20 nt, Molluscum contagiosum virus
ccugcgggcggcacacacuu

SEQ ID NO: 3091167 - RNA, 20 nt, Molluscum contagiosum virus
gacugacgccgauguccugc

SEQ ID NO: 3091168 - RNA, 19 nt, Molluscum contagiosum virus
gcugagagacuucuugcac

SEQ ID NO: 3091169 - RNA, 16 nt, Molluscum contagiosum virus
uuuguguuggccaggc

SEQ ID NO: 3091170 - RNA, 22 nt, Molluscum contagiosum virus
ccgugcccgccgacugccgccg

SEQ ID NO: 3091171 - RNA, 22 nt, Molluscum contagiosum virus
ggcgcgccgucucgcggggcaa

SEQ ID NO: 3091172 - RNA, 12 nt, Molluscum contagiosum virus
cggcgcgcaccu

SEQ ID NO: 3091173 - RNA, 21 nt, Molluscum contagiosum virus
gcgcgcugguuaccaagggca

SEQ ID NO: 3091174 - RNA, 13 nt, Molluscum contagiosum virus
cuggcggugcucu

SEQ ID NO: 3091175 - RNA, 13 nt, Molluscum contagiosum virus
ccuccgcucugag

SEQ ID NO: 3091176 - RNA, 17 nt, Molluscum contagiosum virus
ccgcagcaagcagccgc

SEQ ID NO: 3091177 - RNA, 13 nt, Molluscum contagiosum virus
caacaugccuuuc

SEQ ID NO: 3091178 - RNA, 16 nt, Molluscum contagiosum virus
cgcgcccaccagcagc

SEQ ID NO: 3091179 - RNA, 17 nt, Molluscum contagiosum virus
cuccgacuccgagcgcg

SEQ ID NO: 3091180 - RNA, 15 nt, Molluscum contagiosum virus
gcaccgagugcuggc

SEQ ID NO: 3091181 - RNA, 18 nt, Molluscum contagiosum virus
caagcgcuacuugcuggc

SEQ ID NO: 3091182 - RNA, 20 nt, Molluscum contagiosum virus
agguggccaacggcgccauc

SEQ ID NO: 3091183 - RNA, 17 nt, Molluscum contagiosum virus
cagcggucucggcagca

SEQ ID NO: 3091184 - RNA, 15 nt, Molluscum contagiosum virus
gccgcaaccucuucc

SEQ ID NO: 3091185 - RNA, 21 nt, Molluscum contagiosum virus
ggagccucccccgcgcacugc

SEQ ID NO: 3091186 - RNA, 12 nt, Molluscum contagiosum virus
cgcggccugggc

SEQ ID NO: 3091187 - RNA, 18 nt, Molluscum contagiosum virus
ccgcgcggcgcucugcca

SEQ ID NO: 3091188 - RNA, 18 nt, Molluscum contagiosum virus
gaguggcucacagccgug

SEQ ID NO: 3091189 - RNA, 17 nt, Molluscum contagiosum virus
aagcgucgugcuccacg

SEQ ID NO: 3091190 - RNA, 16 nt, Molluscum contagiosum virus
cgacgguuuccgcgcc

SEQ ID NO: 3091191 - RNA, 21 nt, Molluscum contagiosum virus
cugccaccaugcgcacagcac

SEQ ID NO: 3091192 - RNA, 20 nt, Molluscum contagiosum virus
ccuuguucaccauccagccg

SEQ ID NO: 3091193 - RNA, 13 nt, Molluscum contagiosum virus
gcgcuucuauugc

SEQ ID NO: 3091194 - RNA, 15 nt, Molluscum contagiosum virus
uuauugaaaauaaag

SEQ ID NO: 3091195 - RNA, 18 nt, Molluscum contagiosum virus
cagccgcagaugcgcagc

SEQ ID NO: 3091196 - RNA, 15 nt, Molluscum contagiosum virus
ggaaggcgaccagcu

SEQ ID NO: 3091197 - RNA, 19 nt, Molluscum contagiosum virus
cugccgcgagcacuggcug

SEQ ID NO: 3091198 - RNA, 22 nt, Molluscum contagiosum virus
gcgggcgcgcgccagcagcgcc

SEQ ID NO: 3091199 - RNA, 16 nt, Molluscum contagiosum virus
aguugcgagccagcca

SEQ ID NO: 3091200 - RNA, 14 nt, Molluscum contagiosum virus
gcgcggcaagcagc

SEQ ID NO: 3091201 - RNA, 14 nt, Molluscum contagiosum virus
ggaagucguggccg

SEQ ID NO: 3091202 - RNA, 22 nt, Molluscum contagiosum virus
cgacugcgccuucugccugccc

SEQ ID NO: 3091203 - RNA, 18 nt, Molluscum contagiosum virus
accccgcaggaaaggcac

SEQ ID NO: 3091204 - RNA, 20 nt, Molluscum contagiosum virus
agguagugguccaccagcug

SEQ ID NO: 3091205 - RNA, 15 nt, Molluscum contagiosum virus
cggcuguggacauga

SEQ ID NO: 3091206 - RNA, 14 nt, Molluscum contagiosum virus
ugcgaguggcgcgc

SEQ ID NO: 3091207 - RNA, 17 nt, Molluscum contagiosum virus
cgaguugcgucucccgc

SEQ ID NO: 3091208 - RNA, 12 nt, Molluscum contagiosum virus
ccuuguccuggc

SEQ ID NO: 3091209 - RNA, 18 nt, Molluscum contagiosum virus
cugccgcgcaugcuggag

SEQ ID NO: 3091210 - RNA, 12 nt, Molluscum contagiosum virus
ucgcagugcccg

SEQ ID NO: 3091211 - RNA, 14 nt, Molluscum contagiosum virus
ggcgacuuguagug

SEQ ID NO: 3091212 - RNA, 21 nt, Molluscum contagiosum virus
acagacgaugacgaggagcug

SEQ ID NO: 3091213 - RNA, 21 nt, Molluscum contagiosum virus
gaauaccggagacaccagcuc

SEQ ID NO: 3091214 - RNA, 17 nt, Molluscum contagiosum virus
cgcgcgccgugccuggc

SEQ ID NO: 3091215 - RNA, 19 nt, Molluscum contagiosum virus
cuggcgaaaccugggcgcc

SEQ ID NO: 3091216 - RNA, 17 nt, Molluscum contagiosum virus
gcgcugcagcaccugca

SEQ ID NO: 3091217 - RNA, 17 nt, Molluscum contagiosum virus
ccgugggcagcuucugc

SEQ ID NO: 3091218 - RNA, 14 nt, Molluscum contagiosum virus
agcugcugcggcuc

SEQ ID NO: 3091219 - RNA, 14 nt, Molluscum contagiosum virus
cggacucgagcccc

SEQ ID NO: 3091220 - RNA, 19 nt, Molluscum contagiosum virus
cuagugccgagcucgccuc

SEQ ID NO: 3091221 - RNA, 17 nt, Molluscum contagiosum virus
cagcagccaggcuaggc

SEQ ID NO: 3091222 - RNA, 15 nt, Molluscum contagiosum virus
uacgcuacagcagcc

SEQ ID NO: 3091223 - RNA, 22 nt, Molluscum contagiosum virus
aggucaucaccagccugcucac

SEQ ID NO: 3091224 - RNA, 23 nt, Molluscum contagiosum virus
cucugcgaucgcgggcacgagca

SEQ ID NO: 3091225 - RNA, 21 nt, Molluscum contagiosum virus
accgugcccuggaccuccauc

SEQ ID NO: 3091226 - RNA, 16 nt, Molluscum contagiosum virus
cgcggacucgugcacc

SEQ ID NO: 3091227 - RNA, 19 nt, Molluscum contagiosum virus
ccacguugccgcgcgcugc

SEQ ID NO: 3091228 - RNA, 14 nt, Molluscum contagiosum virus
gagcagugccgccg

SEQ ID NO: 3091229 - RNA, 20 nt, Molluscum contagiosum virus
ugcuggcgcgcggagagcag

SEQ ID NO: 3091230 - RNA, 12 nt, Molluscum contagiosum virus
cgcggcgcagug

SEQ ID NO: 3091231 - RNA, 21 nt, Molluscum contagiosum virus
cgaguacgcucuccaugcgcg

SEQ ID NO: 3091232 - RNA, 15 nt, Molluscum contagiosum virus
ggccccuacgugguc

SEQ ID NO: 3091233 - RNA, 17 nt, Molluscum contagiosum virus
uagcagcgugcgcacca

SEQ ID NO: 3091234 - RNA, 19 nt, Molluscum contagiosum virus
acguccccgaacugcuggg

SEQ ID NO: 3091235 - RNA, 23 nt, Molluscum contagiosum virus
acaagcagccgcaguaccaguac

SEQ ID NO: 3091236 - RNA, 12 nt, Molluscum contagiosum virus
cgacagcucuuc

SEQ ID NO: 3091237 - RNA, 16 nt, Molluscum contagiosum virus
ccgcugcccgcgcacg

SEQ ID NO: 3091238 - RNA, 14 nt, Molluscum contagiosum virus
gcgagacgggcacg

SEQ ID NO: 3091239 - RNA, 19 nt, Molluscum contagiosum virus
gcacaguucacggcgcucg

SEQ ID NO: 3091240 - RNA, 18 nt, Molluscum contagiosum virus
acgagcugugcgagccag

SEQ ID NO: 3091241 - RNA, 15 nt, Molluscum contagiosum virus
gcagcagcuccucca

SEQ ID NO: 3091242 - RNA, 17 nt, Molluscum contagiosum virus
ccaugcgcacagcacuu

SEQ ID NO: 3091243 - RNA, 22 nt, Molluscum contagiosum virus
gugcucgcgagcguuucugccg

SEQ ID NO: 3091244 - RNA, 13 nt, Molluscum contagiosum virus
gcgcggcgcgccg

SEQ ID NO: 3091245 - RNA, 18 nt, Molluscum contagiosum virus
uccuucugguuccugcgc

SEQ ID NO: 3091246 - RNA, 19 nt, Molluscum contagiosum virus
gcccgaguuucggaagagc

SEQ ID NO: 3091247 - RNA, 16 nt, Molluscum contagiosum virus
acgagcacugccugcc

SEQ ID NO: 3091248 - RNA, 15 nt, Molluscum contagiosum virus
acggcgugcgccgcu

SEQ ID NO: 3091249 - RNA, 16 nt, Molluscum contagiosum virus
gcuccggucaccgcgu

SEQ ID NO: 3091250 - RNA, 21 nt, Molluscum contagiosum virus
ccugcugguucagguagcgcg

SEQ ID NO: 3091251 - RNA, 19 nt, Molluscum contagiosum virus
aaggauuuaaauggcgcgc

SEQ ID NO: 3091252 - RNA, 17 nt, Molluscum contagiosum virus
guggcgccgcugcugga

SEQ ID NO: 3091253 - RNA, 21 nt, Molluscum contagiosum virus
gcuccggcuuuauuuccggcu

SEQ ID NO: 3091254 - RNA, 22 nt, Molluscum contagiosum virus
cugcggagcgccuucugcaagc

SEQ ID NO: 3091255 - RNA, 22 nt, Molluscum contagiosum virus
gcagacgacucgcugccagaga

SEQ ID NO: 3091256 - RNA, 17 nt, Molluscum contagiosum virus
cacgcgcgcgugcugcu

SEQ ID NO: 3091257 - RNA, 22 nt, Molluscum contagiosum virus
uaaacaaacgugcaugcacaua

SEQ ID NO: 3091258 - RNA, 19 nt, Molluscum contagiosum virus
ugcucgcuugccgcuugag

SEQ ID NO: 3091259 - RNA, 13 nt, Molluscum contagiosum virus
gccggccgccggc

SEQ ID NO: 3091260 - RNA, 14 nt, Molluscum contagiosum virus
gcggcacuugcagg

SEQ ID NO: 3091261 - RNA, 20 nt, Molluscum contagiosum virus
aagagcacgaugcccagcag

SEQ ID NO: 3091262 - RNA, 18 nt, Molluscum contagiosum virus
acggcgaguucugccggc

SEQ ID NO: 3091263 - RNA, 12 nt, Molluscum contagiosum virus
cggucagacuuu

SEQ ID NO: 3091264 - RNA, 17 nt, Molluscum contagiosum virus
cggucggguacacgugc

SEQ ID NO: 3091265 - RNA, 18 nt, Molluscum contagiosum virus
ccugcugccgagcuucgu

SEQ ID NO: 3091266 - RNA, 19 nt, Molluscum contagiosum virus
ccgcgggcgcacgcuuguc

SEQ ID NO: 3091267 - RNA, 17 nt, Molluscum contagiosum virus
ucaccccgcugggccgc

SEQ ID NO: 3091268 - RNA, 17 nt, Molluscum contagiosum virus
gugccgaggcgcugccg

SEQ ID NO: 3091269 - RNA, 15 nt, Molluscum contagiosum virus
guucgcagugcccgg

SEQ ID NO: 3091270 - RNA, 20 nt, Molluscum contagiosum virus
cgccgacuuccgacgggccg

SEQ ID NO: 3091271 - RNA, 20 nt, Molluscum contagiosum virus
gcugcuuccgcaccuggucg

SEQ ID NO: 3091272 - RNA, 19 nt, Molluscum contagiosum virus
cagugcggccagcaccgcg

SEQ ID NO: 3091273 - RNA, 12 nt, Molluscum contagiosum virus
cuuccugcuggc

SEQ ID NO: 3091274 - RNA, 21 nt, Molluscum contagiosum virus
ccgcggcgugcagggcgugcu

SEQ ID NO: 3091275 - RNA, 18 nt, Molluscum contagiosum virus
gcgaaccgcggcagccuu

SEQ ID NO: 3091276 - RNA, 12 nt, Molluscum contagiosum virus
gaaguggccguc

SEQ ID NO: 3091277 - RNA, 15 nt, Molluscum contagiosum virus
cugcgcccauuccug

SEQ ID NO: 3091278 - RNA, 19 nt, Molluscum contagiosum virus
cgcgggcguguccgcgggc

SEQ ID NO: 3091279 - RNA, 20 nt, Molluscum contagiosum virus
ucguccgcucgugccacugc

SEQ ID NO: 3091280 - RNA, 15 nt, Molluscum contagiosum virus
cauggacgugcugcu

SEQ ID NO: 3091281 - RNA, 23 nt, Molluscum contagiosum virus
cugcacgcucuucgagacgcugc

SEQ ID NO: 3091282 - RNA, 21 nt, Molluscum contagiosum virus
cgcacacgcgcgcgugcugcu

SEQ ID NO: 3091283 - RNA, 19 nt, Molluscum contagiosum virus
cccgccgcguacaugcgug

SEQ ID NO: 3091284 - RNA, 16 nt, Molluscum contagiosum virus
cgcgagcgccacuagc

SEQ ID NO: 3091285 - RNA, 16 nt, Molluscum contagiosum virus
gagcaauggcggccug

SEQ ID NO: 3091286 - RNA, 18 nt, Molluscum contagiosum virus
gccgggcuugcucccucg

SEQ ID NO: 3091287 - RNA, 14 nt, Molluscum contagiosum virus
cuggcggagacacu

SEQ ID NO: 3091288 - RNA, 22 nt, Molluscum contagiosum virus
gcgcugcucgccgucgcagaag

SEQ ID NO: 3091289 - RNA, 16 nt, Molluscum contagiosum virus
cgcgggccgccgggcc

SEQ ID NO: 3091290 - RNA, 12 nt, Molluscum contagiosum virus
uaacuauguucu

SEQ ID NO: 3091291 - RNA, 13 nt, Molluscum contagiosum virus
acgagcagcugcu

SEQ ID NO: 3091292 - RNA, 22 nt, Molluscum contagiosum virus
cacgggcaugcacagcugcucg

SEQ ID NO: 3091293 - RNA, 13 nt, Molluscum contagiosum virus
cgggcgcaggccc

SEQ ID NO: 3091294 - RNA, 13 nt, Molluscum contagiosum virus
cccgcgcagcgcc

SEQ ID NO: 3091295 - RNA, 21 nt, Molluscum contagiosum virus
cgcugcguuuccagggcagua

SEQ ID NO: 3091296 - RNA, 21 nt, Molluscum contagiosum virus
ugcugucccaagacucugccg

SEQ ID NO: 3091297 - RNA, 14 nt, Molluscum contagiosum virus
ggagaacggacaaa

SEQ ID NO: 3091298 - RNA, 19 nt, Molluscum contagiosum virus
guaugaaucuacggcuguu

SEQ ID NO: 3091299 - RNA, 13 nt, Molluscum contagiosum virus
cugacugcugccc

SEQ ID NO: 3091300 - RNA, 18 nt, Molluscum contagiosum virus
acggucguccuggagccu

SEQ ID NO: 3091301 - RNA, 15 nt, Molluscum contagiosum virus
aggaaaggcacccgc

SEQ ID NO: 3091302 - RNA, 22 nt, Molluscum contagiosum virus
ggccuguccgcggaugcaggca

SEQ ID NO: 3091303 - RNA, 20 nt, Molluscum contagiosum virus
ucgagaccucgcgcuuccgg

SEQ ID NO: 3091304 - RNA, 15 nt, Molluscum contagiosum virus
cugucgcgcagcugc

SEQ ID NO: 3091305 - RNA, 19 nt, Molluscum contagiosum virus
gcgcgcucauggcgcgcaa

SEQ ID NO: 3091306 - RNA, 17 nt, Molluscum contagiosum virus
cgggugcauacgcagag

SEQ ID NO: 3091307 - RNA, 17 nt, Molluscum contagiosum virus
cgccuucgucgcgcgcu

SEQ ID NO: 3091308 - RNA, 19 nt, Molluscum contagiosum virus
gaacgcgcaagugugcgca

SEQ ID NO: 3091309 - RNA, 19 nt, Molluscum contagiosum virus
caaugcgcacgugcucgcg

SEQ ID NO: 3091310 - RNA, 16 nt, Molluscum contagiosum virus
gcaagccagcccgcug

SEQ ID NO: 3091311 - RNA, 19 nt, Molluscum contagiosum virus
cuaccacgagcacugccug

SEQ ID NO: 3091312 - RNA, 23 nt, Molluscum contagiosum virus
guuggggcggcggggcugcuggc

SEQ ID NO: 3091313 - RNA, 14 nt, Molluscum contagiosum virus
ugcgggcuguucca

SEQ ID NO: 3091314 - RNA, 13 nt, Molluscum contagiosum virus
uugagagcgcugg

SEQ ID NO: 3091315 - RNA, 21 nt, Molluscum contagiosum virus
uguaccuggugcgcccgcggc

SEQ ID NO: 3091316 - RNA, 14 nt, Molluscum contagiosum virus
acaugcagcugcag

SEQ ID NO: 3091317 - RNA, 18 nt, Molluscum contagiosum virus
gcaagagccgccggggcc

SEQ ID NO: 3091318 - RNA, 19 nt, Molluscum contagiosum virus
auacugcgggcuguuccaa

SEQ ID NO: 3091319 - RNA, 20 nt, Molluscum contagiosum virus
aaccacagcucuccgagaca

SEQ ID NO: 3091320 - RNA, 16 nt, Molluscum contagiosum virus
agcguuucugccggag

SEQ ID NO: 3091321 - RNA, 15 nt, Molluscum contagiosum virus
gcccgccgacugccg

SEQ ID NO: 3091322 - RNA, 22 nt, Molluscum contagiosum virus
gcgggcuguuccaagaagacua

SEQ ID NO: 3091323 - RNA, 17 nt, Molluscum contagiosum virus
ccagcuucaucaagcac

SEQ ID NO: 3091324 - RNA, 22 nt, Molluscum contagiosum virus
cuagcugugcgcuacguggcgc

SEQ ID NO: 3091325 - RNA, 13 nt, Molluscum contagiosum virus
aggguguggccua

SEQ ID NO: 3091326 - RNA, 17 nt, Molluscum contagiosum virus
cugacccccuccccagc

SEQ ID NO: 3091327 - RNA, 19 nt, Molluscum contagiosum virus
aacccguggccgagccgcu

SEQ ID NO: 3091328 - RNA, 15 nt, Molluscum contagiosum virus
acuacuacacugucg

SEQ ID NO: 3091329 - RNA, 14 nt, Molluscum contagiosum virus
ugccuguggcgcac

SEQ ID NO: 3091330 - RNA, 13 nt, Molluscum contagiosum virus
cgcguccaugcug

SEQ ID NO: 3091331 - RNA, 13 nt, Molluscum contagiosum virus
gcgcgcucugccg

SEQ ID NO: 3091332 - RNA, 14 nt, Molluscum contagiosum virus
cugaacaagcugca

SEQ ID NO: 3091333 - RNA, 18 nt, Molluscum contagiosum virus
gacgcaggaugcuggggc

SEQ ID NO: 3091334 - RNA, 22 nt, Molluscum contagiosum virus
gcccgaguagaagagcguggac

SEQ ID NO: 3091335 - RNA, 14 nt, Molluscum contagiosum virus
ccuccgagcgcgcg

SEQ ID NO: 3091336 - RNA, 14 nt, Molluscum contagiosum virus
gugggcaccugcau

SEQ ID NO: 3091337 - RNA, 12 nt, Molluscum contagiosum virus
cgagccagccag

SEQ ID NO: 3091338 - RNA, 17 nt, Molluscum contagiosum virus
gaaagcagcaaacugug

SEQ ID NO: 3091339 - RNA, 23 nt, Molluscum contagiosum virus
cuggugguaauggguaugggcuu

SEQ ID NO: 3091340 - RNA, 19 nt, Molluscum contagiosum virus
gucaucgggcugcagcccu

SEQ ID NO: 3091341 - RNA, 12 nt, Molluscum contagiosum virus
cgcaggacgcgg

SEQ ID NO: 3091342 - RNA, 19 nt, Molluscum contagiosum virus
cagcggaagaaacagccau

SEQ ID NO: 3091343 - RNA, 13 nt, Molluscum contagiosum virus
ggggcccaugcuc

SEQ ID NO: 3091344 - RNA, 13 nt, Molluscum contagiosum virus
ccucgagcacgcc

SEQ ID NO: 3091345 - RNA, 16 nt, Molluscum contagiosum virus
gcccggcggcccgcgg

SEQ ID NO: 3091346 - RNA, 14 nt, Molluscum contagiosum virus
gcaccugcuggaac

SEQ ID NO: 3091347 - RNA, 21 nt, Molluscum contagiosum virus
gcgggcauguccuuggcggug

SEQ ID NO: 3091348 - RNA, 21 nt, Molluscum contagiosum virus
cgcaccuggucgagcaccugu

SEQ ID NO: 3091349 - RNA, 20 nt, Molluscum contagiosum virus
agaauuucgacagcauccug

SEQ ID NO: 3091350 - RNA, 19 nt, Molluscum contagiosum virus
ucgcgagaaguucugcaca

SEQ ID NO: 3091351 - RNA, 21 nt, Molluscum contagiosum virus
ccccgcaggaaaggcaccccg

SEQ ID NO: 3091352 - RNA, 17 nt, Molluscum contagiosum virus
augcgcgguccuguccg

SEQ ID NO: 3091353 - RNA, 23 nt, Molluscum contagiosum virus
cguggcgccauugcucgcggugc

SEQ ID NO: 3091354 - RNA, 15 nt, Molluscum contagiosum virus
gcugauucugcuugc

SEQ ID NO: 3091355 - RNA, 22 nt, Molluscum contagiosum virus
ccgccggcgccgcuaccagcuc

SEQ ID NO: 3091356 - RNA, 23 nt, Molluscum contagiosum virus
aacuaagcuaaaagagcugcugc

SEQ ID NO: 3091357 - RNA, 20 nt, Molluscum contagiosum virus
cgcgacgacguugugcuccu

SEQ ID NO: 3091358 - RNA, 23 nt, Molluscum contagiosum virus
uacaacucgguggugcgccugca

SEQ ID NO: 3091359 - RNA, 16 nt, Molluscum contagiosum virus
ccgcgagauugagagc

SEQ ID NO: 3091360 - RNA, 17 nt, Molluscum contagiosum virus
agcucuucguggccaaa

SEQ ID NO: 3091361 - RNA, 18 nt, Molluscum contagiosum virus
ccugcaggaaaggcaccc

SEQ ID NO: 3091362 - RNA, 17 nt, Molluscum contagiosum virus
cuucucgccgcaccaca

SEQ ID NO: 3091363 - RNA, 18 nt, Molluscum contagiosum virus
guacucgcugcuccccgc

SEQ ID NO: 3091364 - RNA, 19 nt, Molluscum contagiosum virus
gucucgaugugacaacaug

SEQ ID NO: 3091365 - RNA, 20 nt, Molluscum contagiosum virus
agcauguccgacuccaagga

SEQ ID NO: 3091366 - RNA, 13 nt, Molluscum contagiosum virus
cacgcgcacgggc

SEQ ID NO: 3091367 - RNA, 15 nt, Molluscum contagiosum virus
cugcuugcggcacac

SEQ ID NO: 3091368 - RNA, 14 nt, Molluscum contagiosum virus
ucaccauccagccg

SEQ ID NO: 3091369 - RNA, 17 nt, Molluscum contagiosum virus
cggcguggccaggccgc

SEQ ID NO: 3091370 - RNA, 20 nt, Molluscum contagiosum virus
ccugucggcacaucucucag

SEQ ID NO: 3091371 - RNA, 12 nt, Molluscum contagiosum virus
ucucgaggccgg

SEQ ID NO: 3091372 - RNA, 19 nt, Molluscum contagiosum virus
cgcacgauguacuccacca

SEQ ID NO: 3091373 - RNA, 22 nt, Molluscum contagiosum virus
acagguagugguccaccagcug

SEQ ID NO: 3091374 - RNA, 12 nt, Molluscum contagiosum virus
cgcgccgcggcg

SEQ ID NO: 3091375 - RNA, 22 nt, Molluscum contagiosum virus
gcgggaccucuuucucgcgccg

SEQ ID NO: 3091376 - RNA, 19 nt, Molluscum contagiosum virus
gucgcccggcaggcucccg

SEQ ID NO: 3091377 - RNA, 14 nt, Molluscum contagiosum virus
gcaagcucccgcug

SEQ ID NO: 3091378 - RNA, 23 nt, Molluscum contagiosum virus
acaugcuagcgggcaagcgcuuc

SEQ ID NO: 3091379 - RNA, 19 nt, Molluscum contagiosum virus
gucaacagugcgugccagg

SEQ ID NO: 3091380 - RNA, 16 nt, Molluscum contagiosum virus
gacgccuuccugcugg

SEQ ID NO: 3091381 - RNA, 14 nt, Molluscum contagiosum virus
gcgcgcgugccgcc

SEQ ID NO: 3091382 - RNA, 16 nt, Molluscum contagiosum virus
gauaugcgccugugcc

SEQ ID NO: 3091383 - RNA, 13 nt, Molluscum contagiosum virus
ggcugcagcccuu

SEQ ID NO: 3091384 - RNA, 20 nt, Molluscum contagiosum virus
gauacccuuggcagcaacug

SEQ ID NO: 3091385 - RNA, 19 nt, Molluscum contagiosum virus
gcgcgccugccgccugcag

SEQ ID NO: 3091386 - RNA, 18 nt, Molluscum contagiosum virus
ggcgcaacgcuggccgcc

SEQ ID NO: 3091387 - RNA, 14 nt, Molluscum contagiosum virus
caccccgcagcuca

SEQ ID NO: 3091388 - RNA, 23 nt, Molluscum contagiosum virus
gaagggcgggaagaaggugcuca

SEQ ID NO: 3091389 - RNA, 14 nt, Molluscum contagiosum virus
auugccccugggcu

SEQ ID NO: 3091390 - RNA, 19 nt, Molluscum contagiosum virus
agcaacugcacagggauuc

SEQ ID NO: 3091391 - RNA, 16 nt, Molluscum contagiosum virus
acaagcugcuggcaca

SEQ ID NO: 3091392 - RNA, 16 nt, Molluscum contagiosum virus
agaucaggcagcugcu

SEQ ID NO: 3091393 - RNA, 19 nt, Molluscum contagiosum virus
ggcaacaugcggagacugu

SEQ ID NO: 3091394 - RNA, 14 nt, Molluscum contagiosum virus
gcuccaacagcagc

SEQ ID NO: 3091395 - RNA, 13 nt, Molluscum contagiosum virus
cuuugcggacgcg

SEQ ID NO: 3091396 - RNA, 18 nt, Molluscum contagiosum virus
caacguggcgccgcugcu

SEQ ID NO: 3091397 - RNA, 16 nt, Molluscum contagiosum virus
cacucguggcaacaac

SEQ ID NO: 3091398 - RNA, 15 nt, Molluscum contagiosum virus
cgcucgcgcugcuuc

SEQ ID NO: 3091399 - RNA, 20 nt, Molluscum contagiosum virus
gccugcaccgagugcuggcc

SEQ ID NO: 3091400 - RNA, 11 nt, Molluscum contagiosum virus
cgcgcucugcc

SEQ ID NO: 3091401 - RNA, 21 nt, Molluscum contagiosum virus
acagacggcgcgcucggagac

SEQ ID NO: 3091402 - RNA, 16 nt, Molluscum contagiosum virus
uugcgagccagccagg

SEQ ID NO: 3091403 - RNA, 20 nt, Molluscum contagiosum virus
cccagcgguggucuccgcgg

SEQ ID NO: 3091404 - RNA, 14 nt, Molluscum contagiosum virus
cauccugccacacc

SEQ ID NO: 3091405 - RNA, 21 nt, Molluscum contagiosum virus
ccuagcgcgcgugugcauggc

SEQ ID NO: 3091406 - RNA, 18 nt, Molluscum contagiosum virus
ccccuguaacaaggaaaa

SEQ ID NO: 3091407 - RNA, 16 nt, Molluscum contagiosum virus
cccauuccuguugcuc

SEQ ID NO: 3091408 - RNA, 20 nt, Molluscum contagiosum virus
cuaacggacgcggccaugcu

SEQ ID NO: 3091409 - RNA, 20 nt, Molluscum contagiosum virus
cggcaugcgcgcgcugccag

SEQ ID NO: 3091410 - RNA, 15 nt, Molluscum contagiosum virus
cguccgcgcagcucg

SEQ ID NO: 3091411 - RNA, 21 nt, Molluscum contagiosum virus
cggcguccgcagcggcgccac

SEQ ID NO: 3091412 - RNA, 16 nt, Molluscum contagiosum virus
cguauggaucuucuca

SEQ ID NO: 3091413 - RNA, 16 nt, Molluscum contagiosum virus
caaaagcacagcagga

SEQ ID NO: 3091414 - RNA, 13 nt, Molluscum contagiosum virus
accagaggguggc

SEQ ID NO: 3091415 - RNA, 16 nt, Molluscum contagiosum virus
ccgcacgugcugcgcu

SEQ ID NO: 3091416 - RNA, 21 nt, Molluscum contagiosum virus
ccgucucgcggaagaauuccu

SEQ ID NO: 3091417 - RNA, 19 nt, Molluscum contagiosum virus
gcggcgcgccgcccgggaa

SEQ ID NO: 3091418 - RNA, 17 nt, Molluscum contagiosum virus
gccgccgcaggcccggc

SEQ ID NO: 3091419 - RNA, 18 nt, Molluscum contagiosum virus
gcaguuccaccucgagcu

SEQ ID NO: 3091420 - RNA, 20 nt, Molluscum contagiosum virus
cccgcgguguccuugcgccg

SEQ ID NO: 3091421 - RNA, 14 nt, Molluscum contagiosum virus
gcuucggcucccag

SEQ ID NO: 3091422 - RNA, 19 nt, Molluscum contagiosum virus
augaaaagcauccaggccu

SEQ ID NO: 3091423 - RNA, 13 nt, Molluscum contagiosum virus
augcacagcugcu

SEQ ID NO: 3091424 - RNA, 13 nt, Molluscum contagiosum virus
acucgcugcuccc

SEQ ID NO: 3091425 - RNA, 15 nt, Molluscum contagiosum virus
cugcugcaaucugcg

SEQ ID NO: 3091426 - RNA, 12 nt, Molluscum contagiosum virus
ucgcggagcugu

SEQ ID NO: 3091427 - RNA, 15 nt, Molluscum contagiosum virus
agcaccgcacgccag

SEQ ID NO: 3091428 - RNA, 19 nt, Molluscum contagiosum virus
ccugcugguggugcuggag

SEQ ID NO: 3091429 - RNA, 17 nt, Molluscum contagiosum virus
gccggggcgcgcgcugc

SEQ ID NO: 3091430 - RNA, 15 nt, Molluscum contagiosum virus
uccgcaauuacgugc

SEQ ID NO: 3091431 - RNA, 17 nt, Molluscum contagiosum virus
gugcugcucugcgugcu

SEQ ID NO: 3091432 - RNA, 17 nt, Molluscum contagiosum virus
ccgacuccuuccggaga

SEQ ID NO: 3091433 - RNA, 16 nt, Molluscum contagiosum virus
cgcucauacuccugcu

SEQ ID NO: 3091434 - RNA, 22 nt, Molluscum contagiosum virus
ccgcccgggcguagccuagcca

SEQ ID NO: 3091435 - RNA, 13 nt, Molluscum contagiosum virus
cgcgcaucagcac

SEQ ID NO: 3091436 - RNA, 20 nt, Molluscum contagiosum virus
gucagcggcggccccugccu

SEQ ID NO: 3091437 - RNA, 17 nt, Molluscum contagiosum virus
guacgagcagcugcugc

SEQ ID NO: 3091438 - RNA, 20 nt, Molluscum contagiosum virus
gcucugauuacauccugccc

SEQ ID NO: 3091439 - RNA, 21 nt, Molluscum contagiosum virus
ugagaauaaaauagcagagca

SEQ ID NO: 3091440 - RNA, 16 nt, Molluscum contagiosum virus
ucaagcacgagcugcu

SEQ ID NO: 3091441 - RNA, 22 nt, Molluscum contagiosum virus
ggccgcggaggacucggaggcc

SEQ ID NO: 3091442 - RNA, 20 nt, Molluscum contagiosum virus
acgaggccuacgugcugcgc

SEQ ID NO: 3091443 - RNA, 17 nt, Molluscum contagiosum virus
cgcgguccagccgcacc

SEQ ID NO: 3091444 - RNA, 16 nt, Molluscum contagiosum virus
ggcgugcugugccugc

SEQ ID NO: 3091445 - RNA, 18 nt, Molluscum contagiosum virus
gcacccuggcugcugcgc

SEQ ID NO: 3091446 - RNA, 15 nt, Molluscum contagiosum virus
agcgugccgcggcac

SEQ ID NO: 3091447 - RNA, 21 nt, Molluscum contagiosum virus
gugccgcaagaaaggcggugc

SEQ ID NO: 3091448 - RNA, 14 nt, Molluscum contagiosum virus
ccgugcucaggcca

SEQ ID NO: 3091449 - RNA, 18 nt, Molluscum contagiosum virus
ccugccacaccagcuggc

SEQ ID NO: 3091450 - RNA, 23 nt, Molluscum contagiosum virus
ggaccuuggcgcgccgcugcccg

SEQ ID NO: 3091451 - RNA, 19 nt, Molluscum contagiosum virus
gcaacgacaaggaaaggca

SEQ ID NO: 3091452 - RNA, 13 nt, Molluscum contagiosum virus
agugcggaugugc

SEQ ID NO: 3091453 - RNA, 20 nt, Molluscum contagiosum virus
gcuggaccugcgccagcgcc

SEQ ID NO: 3091454 - RNA, 23 nt, Molluscum contagiosum virus
ccccaaaagugaagaucaagcac

SEQ ID NO: 3091455 - RNA, 21 nt, Molluscum contagiosum virus
cgcugcggcaacugccugcgc

SEQ ID NO: 3091456 - RNA, 14 nt, Molluscum contagiosum virus
ggccucgccuccgg

SEQ ID NO: 3091457 - RNA, 20 nt, Molluscum contagiosum virus
cagcgacagacaccggccuu

SEQ ID NO: 3091458 - RNA, 16 nt, Molluscum contagiosum virus
agagcacggacagcac

SEQ ID NO: 3091459 - RNA, 23 nt, Molluscum contagiosum virus
gccaccucgcacgugugcaggaa

SEQ ID NO: 3091460 - RNA, 17 nt, Molluscum contagiosum virus
cagucucgcgcuuccag

SEQ ID NO: 3091461 - RNA, 15 nt, Molluscum contagiosum virus
auguagccuacgugg

SEQ ID NO: 3091462 - RNA, 21 nt, Molluscum contagiosum virus
ggcaggcggccgcguugcagc

SEQ ID NO: 3091463 - RNA, 19 nt, Molluscum contagiosum virus
cgcugcgccggcugcgcca

SEQ ID NO: 3091464 - RNA, 20 nt, Molluscum contagiosum virus
agcacggcuugccgcucggc

SEQ ID NO: 3091465 - RNA, 17 nt, Molluscum contagiosum virus
ccgccgggccugcggcg

SEQ ID NO: 3091466 - RNA, 13 nt, Molluscum contagiosum virus
ggccggcgcgccg

SEQ ID NO: 3091467 - RNA, 16 nt, Molluscum contagiosum virus
gcgagaugcgcggaca

SEQ ID NO: 3091468 - RNA, 21 nt, Molluscum contagiosum virus
gccgcguacgcacgugccgug

SEQ ID NO: 3091469 - RNA, 23 nt, Molluscum contagiosum virus
cuacgaggccuacgugcugcgca

SEQ ID NO: 3091470 - RNA, 23 nt, Molluscum contagiosum virus
gcgccgccaugcugcgcgagcgc

SEQ ID NO: 3091471 - RNA, 22 nt, Molluscum contagiosum virus
cgcggcgcucugccaccgcggc

SEQ ID NO: 3091472 - RNA, 16 nt, Molluscum contagiosum virus
guguucccggcugccg

SEQ ID NO: 3091473 - RNA, 22 nt, Molluscum contagiosum virus
cguccacaaagcccuccugaga

SEQ ID NO: 3091474 - RNA, 18 nt, Molluscum contagiosum virus
cacgcugacgcgcagugc

SEQ ID NO: 3091475 - RNA, 17 nt, Molluscum contagiosum virus
cacaugccgcgcugcuc

SEQ ID NO: 3091476 - RNA, 21 nt, Molluscum contagiosum virus
cuucggcgcaacgcuggccgc

SEQ ID NO: 3091477 - RNA, 14 nt, Molluscum contagiosum virus
ccaacgccagcugu

SEQ ID NO: 3091478 - RNA, 18 nt, Molluscum contagiosum virus
gcugcgcuccaugcugcc

SEQ ID NO: 3091479 - RNA, 15 nt, Molluscum contagiosum virus
acauggaccgcguca

SEQ ID NO: 3091480 - RNA, 19 nt, Molluscum contagiosum virus
caucucgagacgcugccug

SEQ ID NO: 3091481 - RNA, 14 nt, Molluscum contagiosum virus
aaccacagcucucc

SEQ ID NO: 3091482 - RNA, 20 nt, Molluscum contagiosum virus
uucaagacuggcacuugcgc

SEQ ID NO: 3091483 - RNA, 21 nt, Molluscum contagiosum virus
cgaacaccuccugcuuugcac

SEQ ID NO: 3091484 - RNA, 17 nt, Molluscum contagiosum virus
cgcgcuucugccccguc

SEQ ID NO: 3091485 - RNA, 14 nt, Molluscum contagiosum virus
cuggaccugcgcca

SEQ ID NO: 3091486 - RNA, 21 nt, Molluscum contagiosum virus
gcucacgagauggcugcucuc

SEQ ID NO: 3091487 - RNA, 19 nt, Molluscum contagiosum virus
gacgcaggaugcuggggcu

SEQ ID NO: 3091488 - RNA, 23 nt, Molluscum contagiosum virus
aagcgcgcucgggcuagcaagca

SEQ ID NO: 3091489 - RNA, 21 nt, Molluscum contagiosum virus
agcucgguuggcggcgccgcg

SEQ ID NO: 3091490 - RNA, 20 nt, Molluscum contagiosum virus
cacgaggcagccgcggcgcc

SEQ ID NO: 3091491 - RNA, 17 nt, Molluscum contagiosum virus
uggcgcgccgcugcccg

SEQ ID NO: 3091492 - RNA, 14 nt, Molluscum contagiosum virus
augcgccugcacuu

SEQ ID NO: 3091493 - RNA, 19 nt, Molluscum contagiosum virus
agguaguuugcggagcaga

SEQ ID NO: 3091494 - RNA, 18 nt, Molluscum contagiosum virus
cuagccgugcgcgcacac

SEQ ID NO: 3091495 - RNA, 20 nt, Molluscum contagiosum virus
cccuucuuuccggcgcggcc

SEQ ID NO: 3091496 - RNA, 13 nt, Molluscum contagiosum virus
agccgcggaggcc

SEQ ID NO: 3091497 - RNA, 14 nt, Molluscum contagiosum virus
gacgacggcugcuc

SEQ ID NO: 3091498 - RNA, 19 nt, Molluscum contagiosum virus
cgggcgaaagcgccgcgcg

SEQ ID NO: 3091499 - RNA, 23 nt, Molluscum contagiosum virus
ccgcuggggcggagagcuccggc

SEQ ID NO: 3091500 - RNA, 17 nt, Molluscum contagiosum virus
cugcggcgcgugcugag

SEQ ID NO: 3091501 - RNA, 15 nt, Molluscum contagiosum virus
ugaucccggaacgca

SEQ ID NO: 3091502 - RNA, 21 nt, Molluscum contagiosum virus
gguggugggcgggugucuggg

SEQ ID NO: 3091503 - RNA, 23 nt, Molluscum contagiosum virus
cgcaacgucgcacuggccugcaa

SEQ ID NO: 3091504 - RNA, 23 nt, Molluscum contagiosum virus
ccuuguccgagcgaaccgcggca

SEQ ID NO: 3091505 - RNA, 13 nt, Molluscum contagiosum virus
cccgcgcugcgcg

SEQ ID NO: 3091506 - RNA, 14 nt, Molluscum contagiosum virus
ggcucguacugcug

SEQ ID NO: 3091507 - RNA, 14 nt, Molluscum contagiosum virus
uccccagcgccgcc

SEQ ID NO: 3091508 - RNA, 23 nt, Molluscum contagiosum virus
gcacgaggcagccgcggcgcccg

SEQ ID NO: 3091509 - RNA, 17 nt, Molluscum contagiosum virus
gccaaccuccugcaccu

SEQ ID NO: 3091510 - RNA, 21 nt, Molluscum contagiosum virus
acggcaagacgacacgagggc

SEQ ID NO: 3091511 - RNA, 19 nt, Molluscum contagiosum virus
acguggauaccaugcucuc

SEQ ID NO: 3091512 - RNA, 14 nt, Molluscum contagiosum virus
cucugcgagcgccu

SEQ ID NO: 3091513 - RNA, 16 nt, Molluscum contagiosum virus
cgcagcugccggggcc

SEQ ID NO: 3091514 - RNA, 13 nt, Molluscum contagiosum virus
ggcuaagcucugc

SEQ ID NO: 3091515 - RNA, 23 nt, Molluscum contagiosum virus
uacgcuacagcagccgcagccca

SEQ ID NO: 3091516 - RNA, 17 nt, Molluscum contagiosum virus
uucuacgggaagcugca

SEQ ID NO: 3091517 - RNA, 18 nt, Molluscum contagiosum virus
cgcugagcgcggagcugg

SEQ ID NO: 3091518 - RNA, 19 nt, Molluscum contagiosum virus
uggccggcaaggggccagc

SEQ ID NO: 3091519 - RNA, 19 nt, Molluscum contagiosum virus
uggugcucguggaaaagca

SEQ ID NO: 3091520 - RNA, 13 nt, Molluscum contagiosum virus
cgccgcgggccgc

SEQ ID NO: 3091521 - RNA, 16 nt, Molluscum contagiosum virus
gccucucucggagaag

SEQ ID NO: 3091522 - RNA, 14 nt, Molluscum contagiosum virus
gaacaccuccugcu

SEQ ID NO: 3091523 - RNA, 22 nt, Molluscum contagiosum virus
aaagacggggccgcgaaagagg

SEQ ID NO: 3091524 - RNA, 18 nt, Molluscum contagiosum virus
agcacgggcggaagcucc

SEQ ID NO: 3091525 - RNA, 18 nt, Molluscum contagiosum virus
cucuggcuucuccaccuu

SEQ ID NO: 3091526 - RNA, 21 nt, Molluscum contagiosum virus
cccgugccgccggcgccgcua

SEQ ID NO: 3091527 - RNA, 17 nt, Molluscum contagiosum virus
aucaggcagcugcugcg

SEQ ID NO: 3091528 - RNA, 16 nt, Molluscum contagiosum virus
cucacaccuagagcac

SEQ ID NO: 3091529 - RNA, 19 nt, Molluscum contagiosum virus
gcgcccgcguacacgugca

SEQ ID NO: 3091530 - RNA, 14 nt, Molluscum contagiosum virus
aucccccgccagga

SEQ ID NO: 3091531 - RNA, 13 nt, Molluscum contagiosum virus
gccagccuggagu

SEQ ID NO: 3091532 - RNA, 14 nt, Molluscum contagiosum virus
guuaaucacgauga

SEQ ID NO: 3091533 - RNA, 20 nt, Molluscum contagiosum virus
agcgcgcccaccagcagcca

SEQ ID NO: 3091534 - RNA, 14 nt, Molluscum contagiosum virus
cggcggcccgcggc

SEQ ID NO: 3091535 - RNA, 21 nt, Molluscum contagiosum virus
ccuaguucgagaagacggggc

SEQ ID NO: 3091536 - RNA, 13 nt, Molluscum contagiosum virus
ggcagccgcugga

SEQ ID NO: 3091537 - RNA, 16 nt, Molluscum contagiosum virus
cucgcggugacaggca

SEQ ID NO: 3091538 - RNA, 13 nt, Molluscum contagiosum virus
gcaguuggucacc

SEQ ID NO: 3091539 - RNA, 22 nt, Molluscum contagiosum virus
ggagccgcggcaguccgagcug

SEQ ID NO: 3091540 - RNA, 20 nt, Molluscum contagiosum virus
gcaggaaagguacccgcagg

SEQ ID NO: 3091541 - RNA, 21 nt, Molluscum contagiosum virus
ugcacuuucaacucucuaccu

SEQ ID NO: 3091542 - RNA, 19 nt, Molluscum contagiosum virus
cgcaugaaaggcaccugcg

SEQ ID NO: 3091543 - RNA, 17 nt, Molluscum contagiosum virus
cgcgcggugcugcgcca

SEQ ID NO: 3091544 - RNA, 12 nt, Molluscum contagiosum virus
aacgaaaagcca

SEQ ID NO: 3091545 - RNA, 17 nt, Molluscum contagiosum virus
cgccguuggccaccugg

SEQ ID NO: 3091546 - RNA, 13 nt, Molluscum contagiosum virus
cuccgaggcaggu

SEQ ID NO: 3091547 - RNA, 14 nt, Molluscum contagiosum virus
cgucgccgggcccc

SEQ ID NO: 3091548 - RNA, 16 nt, Molluscum contagiosum virus
uacgagcagcugcugc

SEQ ID NO: 3091549 - RNA, 20 nt, Molluscum contagiosum virus
aguugcgagccagccaggcg

SEQ ID NO: 3091550 - RNA, 18 nt, Molluscum contagiosum virus
gcugcugcggcugcugga

SEQ ID NO: 3091551 - RNA, 18 nt, Molluscum contagiosum virus
agcagcucggggcuguca

SEQ ID NO: 3091552 - RNA, 22 nt, Molluscum contagiosum virus
cgcgcgagugugugcaucccuc

SEQ ID NO: 3091553 - RNA, 21 nt, Molluscum contagiosum virus
gccacugccacggcugcaagc

SEQ ID NO: 3091554 - RNA, 13 nt, Molluscum contagiosum virus
cagugcaccagca

SEQ ID NO: 3091555 - RNA, 15 nt, Molluscum contagiosum virus
cacgcgggcgccggc

SEQ ID NO: 3091556 - RNA, 19 nt, Molluscum contagiosum virus
cugccgcgcaugcuggaga

SEQ ID NO: 3091557 - RNA, 21 nt, Molluscum contagiosum virus
ccagcgggaaacugcugcccg

SEQ ID NO: 3091558 - RNA, 21 nt, Molluscum contagiosum virus
cacgugccccgcgcgugcagu

SEQ ID NO: 3091559 - RNA, 17 nt, Molluscum contagiosum virus
cgcgacggugugccgcu

SEQ ID NO: 3091560 - RNA, 14 nt, Molluscum contagiosum virus
cuggcggcgcacgc

SEQ ID NO: 3091561 - RNA, 16 nt, Molluscum contagiosum virus
ccacggguagcagcgc

SEQ ID NO: 3091562 - RNA, 17 nt, Molluscum contagiosum virus
gucucggagaagaacag

SEQ ID NO: 3091563 - RNA, 18 nt, Molluscum contagiosum virus
cccgcugcgcauggccac

SEQ ID NO: 3091564 - RNA, 16 nt, Molluscum contagiosum virus
cuccaagaagaggccg

SEQ ID NO: 3091565 - RNA, 18 nt, Molluscum contagiosum virus
cgaggaaaggcaccccga

SEQ ID NO: 3091566 - RNA, 18 nt, Molluscum contagiosum virus
cuucucgagugcacguaa

SEQ ID NO: 3091567 - RNA, 16 nt, Molluscum contagiosum virus
cgcggaacugacugcu

SEQ ID NO: 3091568 - RNA, 18 nt, Molluscum contagiosum virus
uuccugaacaagcugcac

SEQ ID NO: 3091569 - RNA, 15 nt, Molluscum contagiosum virus
acacucuucgcaggc

SEQ ID NO: 3091570 - RNA, 14 nt, Molluscum contagiosum virus
gcgcgcgagcacag

SEQ ID NO: 3091571 - RNA, 23 nt, Molluscum contagiosum virus
cgugcgcaucccugcgcaccugc

SEQ ID NO: 3091572 - RNA, 15 nt, Molluscum contagiosum virus
gcagcaggcacucca

SEQ ID NO: 3091573 - RNA, 20 nt, Molluscum contagiosum virus
gcucaaggacuaccagcucu

SEQ ID NO: 3091574 - RNA, 19 nt, Molluscum contagiosum virus
augguugugcuuguucucu

SEQ ID NO: 3091575 - RNA, 17 nt, Molluscum contagiosum virus
cucacgcccucucgagg

SEQ ID NO: 3091576 - RNA, 20 nt, Molluscum contagiosum virus
agcucugcgcaaccuggauu

SEQ ID NO: 3091577 - RNA, 21 nt, Molluscum contagiosum virus
gggcugccggcgcgugagcgc

SEQ ID NO: 3091578 - RNA, 14 nt, Molluscum contagiosum virus
ccacgugcgcuggc

SEQ ID NO: 3091579 - RNA, 12 nt, Molluscum contagiosum virus
cugcuguuucug

SEQ ID NO: 3091580 - RNA, 13 nt, Molluscum contagiosum virus
uucccgugcaagg

SEQ ID NO: 3091581 - RNA, 18 nt, Molluscum contagiosum virus
gagcgcgcccccgagcug

SEQ ID NO: 3091582 - RNA, 19 nt, Molluscum contagiosum virus
agccgcguagcuagcucug

SEQ ID NO: 3091583 - RNA, 15 nt, Molluscum contagiosum virus
gccauccacgugggc

SEQ ID NO: 3091584 - RNA, 14 nt, Molluscum contagiosum virus
caggcagcugcugc

SEQ ID NO: 3091585 - RNA, 16 nt, Molluscum contagiosum virus
uagagcaauacguggc

SEQ ID NO: 3091586 - RNA, 16 nt, Molluscum contagiosum virus
ccacaugccgcgcugc

SEQ ID NO: 3091587 - RNA, 12 nt, Molluscum contagiosum virus
gccccucgagca

SEQ ID NO: 3091588 - RNA, 20 nt, Molluscum contagiosum virus
cgccauugcucgcggugccg

SEQ ID NO: 3091589 - RNA, 17 nt, Molluscum contagiosum virus
ccucgacgcgcugcucu

SEQ ID NO: 3091590 - RNA, 14 nt, Molluscum contagiosum virus
ggagccgcugcugc

SEQ ID NO: 3091591 - RNA, 14 nt, Molluscum contagiosum virus
gcuagcugcgugcg

SEQ ID NO: 3091592 - RNA, 18 nt, Molluscum contagiosum virus
ccagcgccucugcgagau

SEQ ID NO: 3091593 - RNA, 17 nt, Molluscum contagiosum virus
cucaagaucguuuugca

SEQ ID NO: 3091594 - RNA, 13 nt, Molluscum contagiosum virus
agcugugccaucu

SEQ ID NO: 3091595 - RNA, 16 nt, Molluscum contagiosum virus
cuggaggcaaucuguc

SEQ ID NO: 3091596 - RNA, 18 nt, Molluscum contagiosum virus
cggacaugagcuugcgca

SEQ ID NO: 3091597 - RNA, 13 nt, Molluscum contagiosum virus
aggguggcuugcu

SEQ ID NO: 3091598 - RNA, 23 nt, Molluscum contagiosum virus
gaccugauuuucccgggcggcgc

SEQ ID NO: 3091599 - RNA, 19 nt, Molluscum contagiosum virus
ggggaacucggcuucugcu

SEQ ID NO: 3091600 - RNA, 23 nt, Molluscum contagiosum virus
cugcacgucgaagaccaccagca

SEQ ID NO: 3091601 - RNA, 14 nt, Molluscum contagiosum virus
auggucucgcugcu

SEQ ID NO: 3091602 - RNA, 23 nt, Molluscum contagiosum virus
cugagcgggguacaggcgcggca

SEQ ID NO: 3091603 - RNA, 14 nt, Molluscum contagiosum virus
gggcgccgcggccu

SEQ ID NO: 3091604 - RNA, 14 nt, Molluscum contagiosum virus
gaccgucaaccugc

SEQ ID NO: 3091605 - RNA, 14 nt, Molluscum contagiosum virus
agcaccaagaagcg

SEQ ID NO: 3091606 - RNA, 15 nt, Molluscum contagiosum virus
aggugcugcgccacg

SEQ ID NO: 3091607 - RNA, 15 nt, Molluscum contagiosum virus
cgugcgcgcugcgcg

SEQ ID NO: 3091608 - RNA, 22 nt, Molluscum contagiosum virus
cuucgacuuacggacgcccucc

SEQ ID NO: 3091609 - RNA, 23 nt, Molluscum contagiosum virus
uggacgccggggggcgccaaguc

SEQ ID NO: 3091610 - RNA, 15 nt, Molluscum contagiosum virus
gcgcucggaggggcu

SEQ ID NO: 3091611 - RNA, 17 nt, Molluscum contagiosum virus
gugcugcgccacgugcg

SEQ ID NO: 3091612 - RNA, 15 nt, Molluscum contagiosum virus
gcagcugcuucucuu

SEQ ID NO: 3091613 - RNA, 20 nt, Molluscum contagiosum virus
gccagcgacgagcagcugcu

SEQ ID NO: 3091614 - RNA, 15 nt, Molluscum contagiosum virus
ucggacuuggccccu

SEQ ID NO: 3091615 - RNA, 18 nt, Molluscum contagiosum virus
acgcgcuugcgcggaaga

SEQ ID NO: 3091616 - RNA, 18 nt, Molluscum contagiosum virus
cagccacgacucgcgucu

SEQ ID NO: 3091617 - RNA, 18 nt, Molluscum contagiosum virus
uggacgagcgcuaccuga

SEQ ID NO: 3091618 - RNA, 21 nt, Molluscum contagiosum virus
gcucugacaacacgagccucg

SEQ ID NO: 3091619 - RNA, 19 nt, Molluscum contagiosum virus
gcacuagcacgggcgggac

SEQ ID NO: 3091620 - RNA, 22 nt, Molluscum contagiosum virus
cugcgccacgugcgcaucccug

SEQ ID NO: 3091621 - RNA, 23 nt, Molluscum contagiosum virus
ugcagcguuacguacagcgggcg

SEQ ID NO: 3091622 - RNA, 20 nt, Molluscum contagiosum virus
uccuggaguaccggcucaag

SEQ ID NO: 3091623 - RNA, 13 nt, Molluscum contagiosum virus
cgcaggaaaggca

SEQ ID NO: 3091624 - RNA, 14 nt, Molluscum contagiosum virus
gcgagcaggcgcag

SEQ ID NO: 3091625 - RNA, 12 nt, Molluscum contagiosum virus
acgcgagacugu

SEQ ID NO: 3091626 - RNA, 15 nt, Molluscum contagiosum virus
ggcgcagcgcggccu

SEQ ID NO: 3091627 - RNA, 16 nt, Molluscum contagiosum virus
gcaggaaaggcacccg

SEQ ID NO: 3091628 - RNA, 20 nt, Molluscum contagiosum virus
ucacgcugcucgugcugcuc

SEQ ID NO: 3091629 - RNA, 17 nt, Molluscum contagiosum virus
cacgggcccgcgcguga

SEQ ID NO: 3091630 - RNA, 13 nt, Molluscum contagiosum virus
agccugaggccgc

SEQ ID NO: 3091631 - RNA, 15 nt, Molluscum contagiosum virus
agcgccgcgcgcggc

SEQ ID NO: 3091632 - RNA, 13 nt, Molluscum contagiosum virus
ggcgcgcgcucag

SEQ ID NO: 3091633 - RNA, 22 nt, Molluscum contagiosum virus
gccgcgcccgcgucgcgcgccg

SEQ ID NO: 3091634 - RNA, 14 nt, Molluscum contagiosum virus
agaagaacagcacg

SEQ ID NO: 3091635 - RNA, 13 nt, Molluscum contagiosum virus
ggcggcacugcua

SEQ ID NO: 3091636 - RNA, 21 nt, Molluscum contagiosum virus
gccccguccucgcucgugcuc

SEQ ID NO: 3091637 - RNA, 19 nt, Molluscum contagiosum virus
cuuuccccuccuagcccag

SEQ ID NO: 3091638 - RNA, 21 nt, Molluscum contagiosum virus
gccagcgacaccgacgaggug

SEQ ID NO: 3091639 - RNA, 16 nt, Molluscum contagiosum virus
ucauacuccugcuggc

SEQ ID NO: 3091640 - RNA, 19 nt, Molluscum contagiosum virus
ggcucugucguugucgccg

SEQ ID NO: 3091641 - RNA, 16 nt, Molluscum contagiosum virus
cggacacgggugagcu

SEQ ID NO: 3091642 - RNA, 17 nt, Molluscum contagiosum virus
acgagcagcccgugcgc

SEQ ID NO: 3091643 - RNA, 23 nt, Molluscum contagiosum virus
uuuccggacgauaaauggaccuc

SEQ ID NO: 3091644 - RNA, 13 nt, Molluscum contagiosum virus
gacagcaucccug

SEQ ID NO: 3091645 - RNA, 13 nt, Molluscum contagiosum virus
acgaggacuggga

SEQ ID NO: 3091646 - RNA, 18 nt, Molluscum contagiosum virus
gcgcaucggcggcagcgc

SEQ ID NO: 3091647 - RNA, 23 nt, Molluscum contagiosum virus
ggcugcucgcugccuggugcaca

SEQ ID NO: 3091648 - RNA, 22 nt, Molluscum contagiosum virus
guggccgcgccgggcgccagaa

SEQ ID NO: 3091649 - RNA, 21 nt, Molluscum contagiosum virus
gcaagucugcgcaggacauga

SEQ ID NO: 3091650 - RNA, 18 nt, Molluscum contagiosum virus
accuuggugcucauccuc

SEQ ID NO: 3091651 - RNA, 15 nt, Molluscum contagiosum virus
gcacggacagcaccc

SEQ ID NO: 3091652 - RNA, 24 nt, Molluscum contagiosum virus
gcacgcacacgacgacggcugcuc

SEQ ID NO: 3091653 - RNA, 15 nt, Molluscum contagiosum virus
ugcagaugaggcugc

SEQ ID NO: 3091654 - RNA, 20 nt, Molluscum contagiosum virus
cccgugcuggagggcacgcu

SEQ ID NO: 3091655 - RNA, 13 nt, Molluscum contagiosum virus
gcagagcugcccg

SEQ ID NO: 3091656 - RNA, 21 nt, Molluscum contagiosum virus
gcggcguguuccggcagcgcc

SEQ ID NO: 3091657 - RNA, 16 nt, Molluscum contagiosum virus
auggcugcgaccaaga

SEQ ID NO: 3091658 - RNA, 16 nt, Molluscum contagiosum virus
cucgggcuagcaagca

SEQ ID NO: 3091659 - RNA, 12 nt, Molluscum contagiosum virus
gucucgcgcgcc

SEQ ID NO: 3091660 - RNA, 12 nt, Molluscum contagiosum virus
gccucgagcagg

SEQ ID NO: 3091661 - RNA, 15 nt, Molluscum contagiosum virus
cacugugccagcagc

SEQ ID NO: 3091662 - RNA, 22 nt, Molluscum contagiosum virus
ucauuguaaaacgacagacccc

SEQ ID NO: 3091663 - RNA, 16 nt, Molluscum contagiosum virus
ggcgcgacggcgacgc

SEQ ID NO: 3091664 - RNA, 19 nt, Molluscum contagiosum virus
ggacacgggugagcucgcc

SEQ ID NO: 3091665 - RNA, 22 nt, Molluscum contagiosum virus
agcggcugcccgcggagaccac

SEQ ID NO: 3091666 - RNA, 15 nt, Molluscum contagiosum virus
cgggucgcggggccc

SEQ ID NO: 3091667 - RNA, 20 nt, Molluscum contagiosum virus
uucacgcaaggaagcaacaa

SEQ ID NO: 3091668 - RNA, 17 nt, Molluscum contagiosum virus
cauagcgcaccagcugc

SEQ ID NO: 3091669 - RNA, 14 nt, Molluscum contagiosum virus
gcggccacucuccc

SEQ ID NO: 3091670 - RNA, 16 nt, Molluscum contagiosum virus
gcacgagccggcgccg

SEQ ID NO: 3091671 - RNA, 17 nt, Molluscum contagiosum virus
uccacuuucucuauuca

SEQ ID NO: 3091672 - RNA, 15 nt, Molluscum contagiosum virus
agccgcaggccaggu

SEQ ID NO: 3091673 - RNA, 13 nt, Molluscum contagiosum virus
gaagcccucaggg

SEQ ID NO: 3091674 - RNA, 19 nt, Molluscum contagiosum virus
cgcgucguucucuaccagc

SEQ ID NO: 3091675 - RNA, 19 nt, Molluscum contagiosum virus
ccagcgccagccugcuggc

SEQ ID NO: 3091676 - RNA, 18 nt, Molluscum contagiosum virus
gacuucuccgaccgugcc

SEQ ID NO: 3091677 - RNA, 19 nt, Molluscum contagiosum virus
gaauaaaauagcagagcac

SEQ ID NO: 3091678 - RNA, 19 nt, Molluscum contagiosum virus
aggcgccgucgacgcugac

SEQ ID NO: 3091679 - RNA, 17 nt, Molluscum contagiosum virus
acggcugcucgcugccu

SEQ ID NO: 3091680 - RNA, 14 nt, Molluscum contagiosum virus
gugcuugccuggaa

SEQ ID NO: 3091681 - RNA, 14 nt, Molluscum contagiosum virus
gacgugcggcacgc

SEQ ID NO: 3091682 - RNA, 19 nt, Molluscum contagiosum virus
cacugcgcgcgcggcgcag

SEQ ID NO: 3091683 - RNA, 20 nt, Molluscum contagiosum virus
ggcagaccccuugcuacagg

SEQ ID NO: 3091684 - RNA, 16 nt, Molluscum contagiosum virus
cgccgcggccugggcc

SEQ ID NO: 3091685 - RNA, 13 nt, Molluscum contagiosum virus
cgcguucuccagg

SEQ ID NO: 3091686 - RNA, 12 nt, Molluscum contagiosum virus
gcuaagcucugc

SEQ ID NO: 3091687 - RNA, 19 nt, Molluscum contagiosum virus
gcgggcccgugcucaggcc

SEQ ID NO: 3091688 - RNA, 19 nt, Molluscum contagiosum virus
gugccuuguacgggugcau

SEQ ID NO: 3091689 - RNA, 19 nt, Molluscum contagiosum virus
gcugcccgcggagaccacc

SEQ ID NO: 3091690 - RNA, 17 nt, Molluscum contagiosum virus
gcucgaaguagccuccg

SEQ ID NO: 3091691 - RNA, 17 nt, Molluscum contagiosum virus
caggaaagguaccccgc

SEQ ID NO: 3091692 - RNA, 16 nt, Molluscum contagiosum virus
cugcgccgcuuccugg

SEQ ID NO: 3091693 - RNA, 12 nt, Molluscum contagiosum virus
aagguggggcgc

SEQ ID NO: 3091694 - RNA, 15 nt, Molluscum contagiosum virus
acugcgccaaggugg

SEQ ID NO: 3091695 - RNA, 14 nt, Molluscum contagiosum virus
caacacggcggugc

SEQ ID NO: 3091696 - RNA, 18 nt, Molluscum contagiosum virus
caggcggugggcgccgcg

SEQ ID NO: 3091697 - RNA, 12 nt, Molluscum contagiosum virus
cucccgucgagc

SEQ ID NO: 3091698 - RNA, 16 nt, Molluscum contagiosum virus
ugccgcaguacgugac

SEQ ID NO: 3091699 - RNA, 15 nt, Molluscum contagiosum virus
cggugcagccgcugc

SEQ ID NO: 3091700 - RNA, 15 nt, Molluscum contagiosum virus
cacuguguccccuga

SEQ ID NO: 3091701 - RNA, 14 nt, Molluscum contagiosum virus
cagcgccgccaccu

SEQ ID NO: 3091702 - RNA, 14 nt, Molluscum contagiosum virus
acgacaugcacacg

SEQ ID NO: 3091703 - RNA, 15 nt, Molluscum contagiosum virus
ccucgcgcgccgccg

SEQ ID NO: 3091704 - RNA, 15 nt, Molluscum contagiosum virus
uugcuccaugacaga

SEQ ID NO: 3091705 - RNA, 20 nt, Molluscum contagiosum virus
accuggcgagcgcucugcau

SEQ ID NO: 3091706 - RNA, 14 nt, Molluscum contagiosum virus
gcugcgccugcagg

SEQ ID NO: 3091707 - RNA, 19 nt, Molluscum contagiosum virus
cgcguguuugugcuguccc

SEQ ID NO: 3091708 - RNA, 13 nt, Molluscum contagiosum virus
gugcgugcccagc

SEQ ID NO: 3091709 - RNA, 23 nt, Molluscum contagiosum virus
gccaacgcggacgcgcagcucga

SEQ ID NO: 3091710 - RNA, 17 nt, Molluscum contagiosum virus
gcggcgugcugcagccc

SEQ ID NO: 3091711 - RNA, 22 nt, Molluscum contagiosum virus
agcgccgccagcuccgcgcggc

SEQ ID NO: 3091712 - RNA, 14 nt, Molluscum contagiosum virus
ccuucgcggagcgc

SEQ ID NO: 3091713 - RNA, 22 nt, Molluscum contagiosum virus
acccgcgcucgacgcgugcaug

SEQ ID NO: 3091714 - RNA, 16 nt, Molluscum contagiosum virus
agcgcgcgccugcugg

SEQ ID NO: 3091715 - RNA, 15 nt, Molluscum contagiosum virus
aaaacggccgucucc

SEQ ID NO: 3091716 - RNA, 15 nt, Molluscum contagiosum virus
gccgcccguguacaa

SEQ ID NO: 3091717 - RNA, 18 nt, Molluscum contagiosum virus
gacuuuguccugagccuu

SEQ ID NO: 3091718 - RNA, 17 nt, Molluscum contagiosum virus
uccgcucgcgcugcuuc

SEQ ID NO: 3091719 - RNA, 22 nt, Molluscum contagiosum virus
ccacggcgagcugccauggcag

SEQ ID NO: 3091720 - RNA, 14 nt, Molluscum contagiosum virus
cagcacuucgcaga

SEQ ID NO: 3091721 - RNA, 20 nt, Molluscum contagiosum virus
acagugcggcgcggcugcuc

SEQ ID NO: 3091722 - RNA, 16 nt, Molluscum contagiosum virus
ggcgcgcgagcugcua

SEQ ID NO: 3091723 - RNA, 15 nt, Molluscum contagiosum virus
cuccgaguccagcuu

SEQ ID NO: 3091724 - RNA, 19 nt, Molluscum contagiosum virus
cugugcccuggaagcuucc

SEQ ID NO: 3091725 - RNA, 17 nt, Molluscum contagiosum virus
gaugcucaagcacugcc

SEQ ID NO: 3091726 - RNA, 14 nt, Molluscum contagiosum virus
ugaaucccacaaau

SEQ ID NO: 3091727 - RNA, 20 nt, Molluscum contagiosum virus
acgggcgugcgcagcagcuc

SEQ ID NO: 3091728 - RNA, 17 nt, Molluscum contagiosum virus
cgcggagggcgaggccu

SEQ ID NO: 3091729 - RNA, 17 nt, Molluscum contagiosum virus
gccgucgcgcgcugugg

SEQ ID NO: 3091730 - RNA, 21 nt, Molluscum contagiosum virus
gcacacgcgcgcgugcugcug

SEQ ID NO: 3091731 - RNA, 18 nt, Molluscum contagiosum virus
ggcugcucuccgaagaag

SEQ ID NO: 3091732 - RNA, 18 nt, Molluscum contagiosum virus
ccuccacguccaggccgc

SEQ ID NO: 3091733 - RNA, 14 nt, Molluscum contagiosum virus
cgucucgcucuucc

SEQ ID NO: 3091734 - RNA, 20 nt, Molluscum contagiosum virus
gcaccgcguugccgcccgcc

SEQ ID NO: 3091735 - RNA, 14 nt, Molluscum contagiosum virus
aguaccagccgcug

SEQ ID NO: 3091736 - RNA, 21 nt, Molluscum contagiosum virus
caaggccgcgcccaagaagaa

SEQ ID NO: 3091737 - RNA, 19 nt, Molluscum contagiosum virus
gauggcgcgcgugggcucg

SEQ ID NO: 3091738 - RNA, 15 nt, Molluscum contagiosum virus
gucucgcgcucgccu

SEQ ID NO: 3091739 - RNA, 17 nt, Molluscum contagiosum virus
augggcacggcaacgag

SEQ ID NO: 3091740 - RNA, 19 nt, Molluscum contagiosum virus
aaaaaucccccgccaggaa

SEQ ID NO: 3091741 - RNA, 18 nt, Molluscum contagiosum virus
gccuguaccugcucgggc

SEQ ID NO: 3091742 - RNA, 20 nt, Molluscum contagiosum virus
uguauaguccccggcgccgg

SEQ ID NO: 3091743 - RNA, 16 nt, Molluscum contagiosum virus
ccccgcgcguugcugc

SEQ ID NO: 3091744 - RNA, 14 nt, Molluscum contagiosum virus
uguccgcacgcaca

SEQ ID NO: 3091745 - RNA, 22 nt, Molluscum contagiosum virus
cuccaagaagaggccagcacaa

SEQ ID NO: 3091746 - RNA, 14 nt, Molluscum contagiosum virus
ggacgagcagagcc

SEQ ID NO: 3091747 - RNA, 18 nt, Molluscum contagiosum virus
aucgcagcagugccagca

SEQ ID NO: 3091748 - RNA, 14 nt, Molluscum contagiosum virus
gggcccugugccuc

SEQ ID NO: 3091749 - RNA, 22 nt, Molluscum contagiosum virus
cgcuccggucaccgcguccgcu

SEQ ID NO: 3091750 - RNA, 17 nt, Molluscum contagiosum virus
uccggaugaacagcuuc

SEQ ID NO: 3091751 - RNA, 13 nt, Molluscum contagiosum virus
ggccguccccgga

SEQ ID NO: 3091752 - RNA, 14 nt, Molluscum contagiosum virus
ccagccgcagccgc

SEQ ID NO: 3091753 - RNA, 20 nt, Molluscum contagiosum virus
aaagacggacccgcgaacga

SEQ ID NO: 3091754 - RNA, 19 nt, Molluscum contagiosum virus
caccgccuggugcugcgcg

SEQ ID NO: 3091755 - RNA, 23 nt, Molluscum contagiosum virus
gcacacuugcgcguccacaaagg

SEQ ID NO: 3091756 - RNA, 14 nt, Molluscum contagiosum virus
cgcaccugcuagag

SEQ ID NO: 3091757 - RNA, 20 nt, Molluscum contagiosum virus
aaggcaccugcaggaaaggc

SEQ ID NO: 3091758 - RNA, 16 nt, Molluscum contagiosum virus
agcugcaaacauugcc

SEQ ID NO: 3091759 - RNA, 20 nt, Molluscum contagiosum virus
uggacgaugguggcgcugcu

SEQ ID NO: 3091760 - RNA, 16 nt, Molluscum contagiosum virus
ccgaagaagaaaagac

SEQ ID NO: 3091761 - RNA, 16 nt, Molluscum contagiosum virus
cgcaggaccuggcugg

SEQ ID NO: 3091762 - RNA, 16 nt, Molluscum contagiosum virus
ggcaucaugagccagu

SEQ ID NO: 3091763 - RNA, 16 nt, Molluscum contagiosum virus
cucuggcuccagggga

SEQ ID NO: 3091764 - RNA, 13 nt, Molluscum contagiosum virus
ugugccagcagca

SEQ ID NO: 3091765 - RNA, 21 nt, Molluscum contagiosum virus
gcaccgcggcgacgucaaccg

SEQ ID NO: 3091766 - RNA, 19 nt, Molluscum contagiosum virus
cucggagaagaacagcacg

SEQ ID NO: 3091767 - RNA, 19 nt, Molluscum contagiosum virus
gcgggccuuugccgcugcc

SEQ ID NO: 3091768 - RNA, 14 nt, Molluscum contagiosum virus
guagcagcgccugc

SEQ ID NO: 3091769 - RNA, 17 nt, Molluscum contagiosum virus
gcccgucggggcaggga

SEQ ID NO: 3091770 - RNA, 16 nt, Molluscum contagiosum virus
ccccacgagagaggcu

SEQ ID NO: 3091771 - RNA, 21 nt, Molluscum contagiosum virus
cccgagcaggacgugcacgug

SEQ ID NO: 3091772 - RNA, 20 nt, Molluscum contagiosum virus
uggcgaaaccugggcgccgc

SEQ ID NO: 3091773 - RNA, 18 nt, Molluscum contagiosum virus
gccuuccgcgcgggcaug

SEQ ID NO: 3091774 - RNA, 23 nt, Molluscum contagiosum virus
ggugccggaguuuguagcucuag

SEQ ID NO: 3091775 - RNA, 15 nt, Molluscum contagiosum virus
accgggcacuucucg

SEQ ID NO: 3091776 - RNA, 19 nt, Molluscum contagiosum virus
gcggagcgccuucugcaag

SEQ ID NO: 3091777 - RNA, 20 nt, Molluscum contagiosum virus
cacaagauggcgcagcacuu

SEQ ID NO: 3091778 - RNA, 22 nt, Molluscum contagiosum virus
gcgggcacggcuaccacgagca

SEQ ID NO: 3091779 - RNA, 20 nt, Molluscum contagiosum virus
cuucgcguuccggcggcugg

SEQ ID NO: 3091780 - RNA, 14 nt, Molluscum contagiosum virus
gcgcgagcugugca

SEQ ID NO: 3091781 - RNA, 14 nt, Molluscum contagiosum virus
gcaaccagcuggcg

SEQ ID NO: 3091782 - RNA, 19 nt, Molluscum contagiosum virus
ggcgccgcugcuggaacag

SEQ ID NO: 3091783 - RNA, 16 nt, Molluscum contagiosum virus
ugcucacgcugcgcuc

SEQ ID NO: 3091784 - RNA, 23 nt, Molluscum contagiosum virus
ccggaccagauccgggcgcugca

SEQ ID NO: 3091785 - RNA, 14 nt, Molluscum contagiosum virus
cgcgccgcugcccg

SEQ ID NO: 3091786 - RNA, 13 nt, Molluscum contagiosum virus
cucgcggcagugc

SEQ ID NO: 3091787 - RNA, 13 nt, Molluscum contagiosum virus
aggugcugggcga

SEQ ID NO: 3091788 - RNA, 23 nt, Molluscum contagiosum virus
ugccgcugcgcuggaugcugcuc

SEQ ID NO: 3091789 - RNA, 17 nt, Molluscum contagiosum virus
gugaccauuacuucugu

SEQ ID NO: 3091790 - RNA, 15 nt, Molluscum contagiosum virus
gcaugaacucgcugc

SEQ ID NO: 3091791 - RNA, 13 nt, Molluscum contagiosum virus
agcccacgugcca

SEQ ID NO: 3091792 - RNA, 18 nt, Molluscum contagiosum virus
cuacugcaacguggcgcc

SEQ ID NO: 3091793 - RNA, 20 nt, Molluscum contagiosum virus
cguccgcucgugccacugcc

SEQ ID NO: 3091794 - RNA, 17 nt, Molluscum contagiosum virus
cgcuggcgugcgcagug

SEQ ID NO: 3091795 - RNA, 12 nt, Molluscum contagiosum virus
gagcagugccgc

SEQ ID NO: 3091796 - RNA, 16 nt, Molluscum contagiosum virus
cucugauuacauccug

SEQ ID NO: 3091797 - RNA, 14 nt, Molluscum contagiosum virus
cugcagcccuucca

SEQ ID NO: 3091798 - RNA, 16 nt, Molluscum contagiosum virus
cgcgcugcagcaccug

SEQ ID NO: 3091799 - RNA, 17 nt, Molluscum contagiosum virus
cugcugcagaacugccu

SEQ ID NO: 3091800 - RNA, 17 nt, Molluscum contagiosum virus
ggcauccggccgaggca

SEQ ID NO: 3091801 - RNA, 16 nt, Molluscum contagiosum virus
gugcugcgcgcccagg

SEQ ID NO: 3091802 - RNA, 14 nt, Molluscum contagiosum virus
caaggaaaggcacc

SEQ ID NO: 3091803 - RNA, 14 nt, Molluscum contagiosum virus
aacgagcagcccgu

SEQ ID NO: 3091804 - RNA, 21 nt, Molluscum contagiosum virus
cuucgguuucuaugcccagcc

SEQ ID NO: 3091805 - RNA, 19 nt, Molluscum contagiosum virus
cuuccccaagaccugcuuc

SEQ ID NO: 3091806 - RNA, 12 nt, Molluscum contagiosum virus
ccgacgggcccc

SEQ ID NO: 3091807 - RNA, 14 nt, Molluscum contagiosum virus
gcgccuagcuccag

SEQ ID NO: 3091808 - RNA, 17 nt, Molluscum contagiosum virus
ucucggacagugccucc

SEQ ID NO: 3091809 - RNA, 15 nt, Molluscum contagiosum virus
gcggcagcagccucg

SEQ ID NO: 3091810 - RNA, 17 nt, Molluscum contagiosum virus
gcugcuggcggugcucu

SEQ ID NO: 3091811 - RNA, 21 nt, Molluscum contagiosum virus
gccuguaccccgaacggcgug

SEQ ID NO: 3091812 - RNA, 13 nt, Molluscum contagiosum virus
agacguagagcag

SEQ ID NO: 3091813 - RNA, 23 nt, Molluscum contagiosum virus
cuguaggggagggcggcaagcuu

SEQ ID NO: 3091814 - RNA, 17 nt, Molluscum contagiosum virus
cgcaaggucuuccacgc

SEQ ID NO: 3091815 - RNA, 19 nt, Molluscum contagiosum virus
ucggcgagacgugcggcac

SEQ ID NO: 3091816 - RNA, 17 nt, Molluscum contagiosum virus
ugccucugccagccgcu

SEQ ID NO: 3091817 - RNA, 14 nt, Molluscum contagiosum virus
gcuguaccuggugc

SEQ ID NO: 3091818 - RNA, 17 nt, Molluscum contagiosum virus
cucgucgccgggccccu

SEQ ID NO: 3091819 - RNA, 23 nt, Molluscum contagiosum virus
agcgcgcccaccagcagccaggc

SEQ ID NO: 3091820 - RNA, 16 nt, Molluscum contagiosum virus
cggcacgcugcagaac

SEQ ID NO: 3091821 - RNA, 14 nt, Molluscum contagiosum virus
gucucgcugcuggg

SEQ ID NO: 3091822 - RNA, 17 nt, Molluscum contagiosum virus
cugcuggugcucgccug

SEQ ID NO: 3091823 - RNA, 20 nt, Molluscum contagiosum virus
ucgcgcgccugcgcgagcaa

SEQ ID NO: 3091824 - RNA, 21 nt, Molluscum contagiosum virus
cggagcggaucgugcuggaga

SEQ ID NO: 3091825 - RNA, 17 nt, Molluscum contagiosum virus
cgggcgccggcucugcc

SEQ ID NO: 3091826 - RNA, 20 nt, Molluscum contagiosum virus
gcacgccagguguuccugcc

SEQ ID NO: 3091827 - RNA, 20 nt, Molluscum contagiosum virus
acagucgcgcgccugccgcc

SEQ ID NO: 3091828 - RNA, 18 nt, Molluscum contagiosum virus
acgcgacggugugccgcu

SEQ ID NO: 3091829 - RNA, 15 nt, Molluscum contagiosum virus
cccgagcccgggccc

SEQ ID NO: 3091830 - RNA, 18 nt, Molluscum contagiosum virus
cucgcgucugcaaggccu

SEQ ID NO: 3091831 - RNA, 19 nt, Molluscum contagiosum virus
caacccgcggcgcgccgca

SEQ ID NO: 3091832 - RNA, 15 nt, Molluscum contagiosum virus
auggcggccugcccu

SEQ ID NO: 3091833 - RNA, 21 nt, Molluscum contagiosum virus
ucgcagacgcagcgcgagcug

SEQ ID NO: 3091834 - RNA, 18 nt, Molluscum contagiosum virus
cgcggcgugugcgggcuc

SEQ ID NO: 3091835 - RNA, 14 nt, Molluscum contagiosum virus
cuccuccaaucugc

SEQ ID NO: 3091836 - RNA, 17 nt, Molluscum contagiosum virus
cccguaggcgggccugc

SEQ ID NO: 3091837 - RNA, 14 nt, Molluscum contagiosum virus
ggcggaagcuccug

SEQ ID NO: 3091838 - RNA, 14 nt, Molluscum contagiosum virus
cgcggcuagcaccg

SEQ ID NO: 3091839 - RNA, 14 nt, Molluscum contagiosum virus
cucggcaacgccag

SEQ ID NO: 3091840 - RNA, 22 nt, Molluscum contagiosum virus
gcacgcccuggcccucggggcu

SEQ ID NO: 3091841 - RNA, 17 nt, Molluscum contagiosum virus
gccagcauggcgagccc

SEQ ID NO: 3091842 - RNA, 17 nt, Molluscum contagiosum virus
cacucacaugugcugcc

SEQ ID NO: 3091843 - RNA, 14 nt, Molluscum contagiosum virus
cuaccuggugcugg

SEQ ID NO: 3091844 - RNA, 23 nt, Molluscum contagiosum virus
ccgcugcgcuggaugcugcucga

SEQ ID NO: 3091845 - RNA, 12 nt, Molluscum contagiosum virus
ccuuucuuccag

SEQ ID NO: 3091846 - RNA, 18 nt, Molluscum contagiosum virus
cucgcgcgccagcacgcg

SEQ ID NO: 3091847 - RNA, 23 nt, Molluscum contagiosum virus
cgagcagcccgugcgccugccgc

SEQ ID NO: 3091848 - RNA, 14 nt, Molluscum contagiosum virus
ugcaaucugcgcuc

SEQ ID NO: 3091849 - RNA, 22 nt, Molluscum contagiosum virus
cuucaggcaagaggggagccag

SEQ ID NO: 3091850 - RNA, 23 nt, Molluscum contagiosum virus
cuuuucgggcaaacgccagugcu

SEQ ID NO: 3091851 - RNA, 20 nt, Molluscum contagiosum virus
aguggcuuguugucgagcag

SEQ ID NO: 3091852 - RNA, 13 nt, Molluscum contagiosum virus
uccaguggcgccc

SEQ ID NO: 3091853 - RNA, 20 nt, Molluscum contagiosum virus
cgucggucaccaccaccucc

SEQ ID NO: 3091854 - RNA, 16 nt, Molluscum contagiosum virus
ggcggccaaccgccug

SEQ ID NO: 3091855 - RNA, 16 nt, Molluscum contagiosum virus
agucagcggcggcccc

SEQ ID NO: 3091856 - RNA, 20 nt, Molluscum contagiosum virus
ggcucacagccguggagucc

SEQ ID NO: 3091857 - RNA, 22 nt, Molluscum contagiosum virus
ccgggcagauagcaaccucggg

SEQ ID NO: 3091858 - RNA, 16 nt, Molluscum contagiosum virus
agucgcuagaggagau

SEQ ID NO: 3091859 - RNA, 14 nt, Molluscum contagiosum virus
cuuggcgggcaccg

SEQ ID NO: 3091860 - RNA, 19 nt, Molluscum contagiosum virus
gcuugcccgaccuuggugc

SEQ ID NO: 3091861 - RNA, 16 nt, Molluscum contagiosum virus
gcgcgacaugcugccc

SEQ ID NO: 3091862 - RNA, 17 nt, Molluscum contagiosum virus
gcucccgcgccacgagc

SEQ ID NO: 3091863 - RNA, 22 nt, Molluscum contagiosum virus
cagauaguuuggacgagcugcu

SEQ ID NO: 3091864 - RNA, 17 nt, Molluscum contagiosum virus
cucucccgggcucuguc

SEQ ID NO: 3091865 - RNA, 21 nt, Molluscum contagiosum virus
gcugccagagauccgcccgcg

SEQ ID NO: 3091866 - RNA, 19 nt, Molluscum contagiosum virus
gaggccggccgugcagagc

SEQ ID NO: 3091867 - RNA, 13 nt, Molluscum contagiosum virus
ccgccagcaccau

SEQ ID NO: 3091868 - RNA, 22 nt, Molluscum contagiosum virus
gcccgacacguugcacugcgcg

SEQ ID NO: 3091869 - RNA, 18 nt, Molluscum contagiosum virus
gcacaccucgagcccgag

SEQ ID NO: 3091870 - RNA, 13 nt, Molluscum contagiosum virus
agcugugccgcag

SEQ ID NO: 3091871 - RNA, 17 nt, Molluscum contagiosum virus
gcacacgcgcgcgcagg

SEQ ID NO: 3091872 - RNA, 22 nt, Molluscum contagiosum virus
gcggcggccacgcucgcgcgca

SEQ ID NO: 3091873 - RNA, 21 nt, Molluscum contagiosum virus
accaugcucucgcugcugccc

SEQ ID NO: 3091874 - RNA, 21 nt, Molluscum contagiosum virus
acggucuugccgaagccgcag

SEQ ID NO: 3091875 - RNA, 22 nt, Molluscum contagiosum virus
gccaugaacaacauggugcugg

SEQ ID NO: 3091876 - RNA, 19 nt, Molluscum contagiosum virus
cgaguucugccggcucagc

SEQ ID NO: 3091877 - RNA, 16 nt, Molluscum contagiosum virus
caccugcacgagccgg

SEQ ID NO: 3091878 - RNA, 15 nt, Molluscum contagiosum virus
cugcuggcggugcuc

SEQ ID NO: 3091879 - RNA, 14 nt, Molluscum contagiosum virus
gcgccggaaguaga

SEQ ID NO: 3091880 - RNA, 20 nt, Molluscum contagiosum virus
aaaugguguacgaaaguacu

SEQ ID NO: 3091881 - RNA, 20 nt, Molluscum contagiosum virus
cgcggaggucgagcgcgccg

SEQ ID NO: 3091882 - RNA, 21 nt, Molluscum contagiosum virus
guuaaaaaugagaauaaaaua

SEQ ID NO: 3091883 - RNA, 16 nt, Molluscum contagiosum virus
cgagcugcugcgcgcc

SEQ ID NO: 3091884 - RNA, 20 nt, Molluscum contagiosum virus
cuuccggagacaccagcucc

SEQ ID NO: 3091885 - RNA, 23 nt, Molluscum contagiosum virus
gcguucaccuuggcgcugcacag

SEQ ID NO: 3091886 - RNA, 22 nt, Molluscum contagiosum virus
gcguccgcaaagccggccccgc

SEQ ID NO: 3091887 - RNA, 12 nt, Molluscum contagiosum virus
cugcgcgccgcu

SEQ ID NO: 3091888 - RNA, 17 nt, Molluscum contagiosum virus
gguccgggugcgagucu

SEQ ID NO: 3091889 - RNA, 11 nt, Molluscum contagiosum virus
cgcgcagcagc

SEQ ID NO: 3091890 - RNA, 16 nt, Molluscum contagiosum virus
caagccguccgccucg

SEQ ID NO: 3091891 - RNA, 13 nt, Molluscum contagiosum virus
gcgaccagcuggu

SEQ ID NO: 3091892 - RNA, 19 nt, Molluscum contagiosum virus
cuggugcucgccugcaucu

SEQ ID NO: 3091893 - RNA, 22 nt, Molluscum contagiosum virus
gccggcuguaaauggacccgcu

SEQ ID NO: 3091894 - RNA, 19 nt, Molluscum contagiosum virus
gcuucgucuucaccugcau

SEQ ID NO: 3091895 - RNA, 16 nt, Molluscum contagiosum virus
uguuggcgcgguccgc

SEQ ID NO: 3091896 - RNA, 18 nt, Molluscum contagiosum virus
cucaucggcgagcucuuu

SEQ ID NO: 3091897 - RNA, 21 nt, Molluscum contagiosum virus
accacuggacacgugccuucu

SEQ ID NO: 3091898 - RNA, 12 nt, Molluscum contagiosum virus
gaaacugcugcc

SEQ ID NO: 3091899 - RNA, 19 nt, Molluscum contagiosum virus
aaauggcugcgaccaagac

SEQ ID NO: 3091900 - RNA, 18 nt, Molluscum contagiosum virus
gcacugcucacggugcgc

SEQ ID NO: 3091901 - RNA, 21 nt, Molluscum contagiosum virus
cacugucucugcgcgagcagc

SEQ ID NO: 3091902 - RNA, 12 nt, Molluscum contagiosum virus
cccgagcccgcg

SEQ ID NO: 3091903 - RNA, 12 nt, Molluscum contagiosum virus
cagaccaagaag

SEQ ID NO: 3091904 - RNA, 16 nt, Molluscum contagiosum virus
acgccuagccugcagu

SEQ ID NO: 3091905 - RNA, 17 nt, Molluscum contagiosum virus
uggugcgcccgcggcac

SEQ ID NO: 3091906 - RNA, 19 nt, Molluscum contagiosum virus
cccacguacgagcagcugc

SEQ ID NO: 3091907 - RNA, 16 nt, Molluscum contagiosum virus
cacgacguacgagugc

SEQ ID NO: 3091908 - RNA, 18 nt, Molluscum contagiosum virus
gcgaucgcggccaugcgc

SEQ ID NO: 3091909 - RNA, 12 nt, Molluscum contagiosum virus
ccggacagagcc

SEQ ID NO: 3091910 - RNA, 22 nt, Molluscum contagiosum virus
ccucggacuucgacgcgcggca

SEQ ID NO: 3091911 - RNA, 16 nt, Molluscum contagiosum virus
cccgagcuacugcgcg

SEQ ID NO: 3091912 - RNA, 14 nt, Molluscum contagiosum virus
gcaguccgccucga

SEQ ID NO: 3091913 - RNA, 19 nt, Molluscum contagiosum virus
ccuggaguaccggcucaag

SEQ ID NO: 3091914 - RNA, 15 nt, Molluscum contagiosum virus
aucgcgagaggagac

SEQ ID NO: 3091915 - RNA, 16 nt, Molluscum contagiosum virus
acccuggcugcugcgc

SEQ ID NO: 3091916 - RNA, 19 nt, Molluscum contagiosum virus
cugcguugucuccuccuga

SEQ ID NO: 3091917 - RNA, 15 nt, Molluscum contagiosum virus
cauggagcaggagaa

SEQ ID NO: 3091918 - RNA, 14 nt, Molluscum contagiosum virus
ggagcugccgcugc

SEQ ID NO: 3091919 - RNA, 16 nt, Molluscum contagiosum virus
uguccugcgugcuucc

SEQ ID NO: 3091920 - RNA, 20 nt, Molluscum contagiosum virus
gcgggcgucaagacucgccc

SEQ ID NO: 3091921 - RNA, 16 nt, Molluscum contagiosum virus
cgcugcuccugcucug

SEQ ID NO: 3091922 - RNA, 20 nt, Molluscum contagiosum virus
ugccaccaugcgcacagcac

SEQ ID NO: 3091923 - RNA, 13 nt, Molluscum contagiosum virus
ugccuacucgcga

SEQ ID NO: 3091924 - RNA, 22 nt, Molluscum contagiosum virus
acugcugcaaucugcgcuccac

SEQ ID NO: 3091925 - RNA, 17 nt, Molluscum contagiosum virus
ucgagcgcgcuggacuu

SEQ ID NO: 3091926 - RNA, 15 nt, Molluscum contagiosum virus
gcucugccgcccgcg

SEQ ID NO: 3091927 - RNA, 14 nt, Molluscum contagiosum virus
aggaugcuggggcu

SEQ ID NO: 3091928 - RNA, 15 nt, Molluscum contagiosum virus
gcgcugguggaggag

SEQ ID NO: 3091929 - RNA, 19 nt, Molluscum contagiosum virus
cuucaaguuccuggagccc

SEQ ID NO: 3091930 - RNA, 18 nt, Molluscum contagiosum virus
ggacgucgcggccacgca

SEQ ID NO: 3091931 - RNA, 12 nt, Molluscum contagiosum virus
cggaagcuccug

SEQ ID NO: 3091932 - RNA, 20 nt, Molluscum contagiosum virus
ggcgugcagggcgugcuugc

SEQ ID NO: 3091933 - RNA, 16 nt, Molluscum contagiosum virus
gcccgccgcccaaggg

SEQ ID NO: 3091934 - RNA, 13 nt, Molluscum contagiosum virus
cgaucgcagcagu

SEQ ID NO: 3091935 - RNA, 14 nt, Molluscum contagiosum virus
gauggucucgcugc

SEQ ID NO: 3091936 - RNA, 15 nt, Molluscum contagiosum virus
ggcucgucguggacg

SEQ ID NO: 3091937 - RNA, 21 nt, Molluscum contagiosum virus
caggccgcccacgcucaacca

SEQ ID NO: 3091938 - RNA, 14 nt, Molluscum contagiosum virus
aucaucgcgcugcu

SEQ ID NO: 3091939 - RNA, 14 nt, Molluscum contagiosum virus
ccggagcgcggggc

SEQ ID NO: 3091940 - RNA, 17 nt, Molluscum contagiosum virus
gcuggagcugccgcugc

SEQ ID NO: 3091941 - RNA, 23 nt, Molluscum contagiosum virus
gcucauggucgucuccgggggcg

SEQ ID NO: 3091942 - RNA, 13 nt, Molluscum contagiosum virus
gcgcucgcgcagg

SEQ ID NO: 3091943 - RNA, 13 nt, Molluscum contagiosum virus
cgcgcgcgcgccg

SEQ ID NO: 3091944 - RNA, 22 nt, Molluscum contagiosum virus
gucgcaguacccgagcugugcc

SEQ ID NO: 3091945 - RNA, 17 nt, Molluscum contagiosum virus
cguuuucgucauggagc

SEQ ID NO: 3091946 - RNA, 19 nt, Molluscum contagiosum virus
gcgugggcagccgccuggc

SEQ ID NO: 3091947 - RNA, 14 nt, Molluscum contagiosum virus
ccaucggugggcuc

SEQ ID NO: 3091948 - RNA, 20 nt, Molluscum contagiosum virus
gccguguacaugcucaagca

SEQ ID NO: 3091949 - RNA, 12 nt, Molluscum contagiosum virus
cgccgaugcagu

SEQ ID NO: 3091950 - RNA, 19 nt, Molluscum contagiosum virus
ccucagccgagcgccgcca

SEQ ID NO: 3091951 - RNA, 22 nt, Molluscum contagiosum virus
cacaacuugggcccgccuccgg

SEQ ID NO: 3091952 - RNA, 22 nt, Molluscum contagiosum virus
ugcgcauggccacgcccgggcc

SEQ ID NO: 3091953 - RNA, 14 nt, Molluscum contagiosum virus
cgagcaggcgcagc

SEQ ID NO: 3091954 - RNA, 14 nt, Molluscum contagiosum virus
guugcgagccagcc

SEQ ID NO: 3091955 - RNA, 18 nt, Molluscum contagiosum virus
gcuggggccugugcugug

SEQ ID NO: 3091956 - RNA, 15 nt, Molluscum contagiosum virus
gagguucuccagaau

SEQ ID NO: 3091957 - RNA, 22 nt, Molluscum contagiosum virus
cgguagggugccgaggcgcugc

SEQ ID NO: 3091958 - RNA, 21 nt, Molluscum contagiosum virus
ccacgcagcuggcgggcgugc

SEQ ID NO: 3091959 - RNA, 22 nt, Molluscum contagiosum virus
cggccugcccugcucaugcgca

SEQ ID NO: 3091960 - RNA, 15 nt, Molluscum contagiosum virus
gcgccggcugcgcca

SEQ ID NO: 3091961 - RNA, 22 nt, Molluscum contagiosum virus
cgaaagaggaaagcgcacacuu

SEQ ID NO: 3091962 - RNA, 23 nt, Molluscum contagiosum virus
agagcccaaggggagacauaugu

SEQ ID NO: 3091963 - RNA, 23 nt, Molluscum contagiosum virus
gcgagauugagagcgcuggcuuc

SEQ ID NO: 3091964 - RNA, 15 nt, Molluscum contagiosum virus
cccucgcaagcugag

SEQ ID NO: 3091965 - RNA, 14 nt, Molluscum contagiosum virus
gucucggggcuccg

SEQ ID NO: 3091966 - RNA, 13 nt, Molluscum contagiosum virus
gcuccuucuucag

SEQ ID NO: 3091967 - RNA, 15 nt, Molluscum contagiosum virus
gagcgcaugccgggg

SEQ ID NO: 3091968 - RNA, 16 nt, Molluscum contagiosum virus
cugcgcgagcagcugc

SEQ ID NO: 3091969 - RNA, 15 nt, Molluscum contagiosum virus
cgcaaagccggcccc

SEQ ID NO: 3091970 - RNA, 13 nt, Molluscum contagiosum virus
gccuaggaggaga

SEQ ID NO: 3091971 - RNA, 15 nt, Molluscum contagiosum virus
ccggcgcggccuggc

SEQ ID NO: 3091972 - RNA, 16 nt, Molluscum contagiosum virus
gaguugcgcgagaacu

SEQ ID NO: 3091973 - RNA, 16 nt, Molluscum contagiosum virus
acgcgcacgggccugc

SEQ ID NO: 3091974 - RNA, 14 nt, Molluscum contagiosum virus
gccgcaaaagcaag

SEQ ID NO: 3091975 - RNA, 16 nt, Molluscum contagiosum virus
ugacaaggauggacaa

SEQ ID NO: 3091976 - RNA, 19 nt, Molluscum contagiosum virus
gcggaggucgagcgcgccg

SEQ ID NO: 3091977 - RNA, 13 nt, Molluscum contagiosum virus
cgcacccucacac

SEQ ID NO: 3091978 - RNA, 21 nt, Molluscum contagiosum virus
cuacauggacgugcugcuggc

SEQ ID NO: 3091979 - RNA, 19 nt, Molluscum contagiosum virus
cacgccgcucggcacugcu

SEQ ID NO: 3091980 - RNA, 22 nt, Molluscum contagiosum virus
ucgcauuaaacaacacgcgcga

SEQ ID NO: 3091981 - RNA, 13 nt, Molluscum contagiosum virus
cuccaagaacgag

SEQ ID NO: 3091982 - RNA, 22 nt, Molluscum contagiosum virus
gggaaaaaucccccgccaggaa

SEQ ID NO: 3091983 - RNA, 19 nt, Molluscum contagiosum virus
gccgcagcccgagcgcgcg

SEQ ID NO: 3091984 - RNA, 23 nt, Molluscum contagiosum virus
gcucaagacgcugcuggcgcaca

SEQ ID NO: 3091985 - RNA, 13 nt, Molluscum contagiosum virus
acuggcaccugcg

SEQ ID NO: 3091986 - RNA, 23 nt, Molluscum contagiosum virus
ugcuggaacgcuuggcgggcagc

SEQ ID NO: 3091987 - RNA, 18 nt, Molluscum contagiosum virus
ccuugauaaaagcacagu

SEQ ID NO: 3091988 - RNA, 13 nt, Molluscum contagiosum virus
gugcaccuggagc

SEQ ID NO: 3091989 - RNA, 13 nt, Molluscum contagiosum virus
gcaccgggcgccg

SEQ ID NO: 3091990 - RNA, 18 nt, Molluscum contagiosum virus
aaaggcacccaccaggaa

SEQ ID NO: 3091991 - RNA, 16 nt, Molluscum contagiosum virus
uggcacccuggcugcu

SEQ ID NO: 3091992 - RNA, 15 nt, Molluscum contagiosum virus
gucaagcaggcaugc

SEQ ID NO: 3091993 - RNA, 11 nt, Molluscum contagiosum virus
caacugccugc

SEQ ID NO: 3091994 - RNA, 14 nt, Molluscum contagiosum virus
uggaguacuucaag

SEQ ID NO: 3091995 - RNA, 14 nt, Molluscum contagiosum virus
ccgagcaagcgggc

SEQ ID NO: 3091996 - RNA, 14 nt, Molluscum contagiosum virus
gacucgucgagcac

SEQ ID NO: 3091997 - RNA, 17 nt, Molluscum contagiosum virus
aaacuccguacagcucc

SEQ ID NO: 3091998 - RNA, 15 nt, Molluscum contagiosum virus
ggcaggggccgccgc

SEQ ID NO: 3091999 - RNA, 21 nt, Molluscum contagiosum virus
guccgcccccagguggagcug

SEQ ID NO: 3092000 - RNA, 15 nt, Molluscum contagiosum virus
ugaacucgcugcugc

SEQ ID NO: 3092001 - RNA, 14 nt, Molluscum contagiosum virus
acugugccagcagc

SEQ ID NO: 3092002 - RNA, 16 nt, Molluscum contagiosum virus
agagccugcugcucuu

SEQ ID NO: 3092003 - RNA, 15 nt, Molluscum contagiosum virus
gagcgagugccgagc

SEQ ID NO: 3092004 - RNA, 18 nt, Molluscum contagiosum virus
agcucacggcuguggaca

SEQ ID NO: 3092005 - RNA, 16 nt, Molluscum contagiosum virus
cucgggccggcgcgcc

SEQ ID NO: 3092006 - RNA, 21 nt, Molluscum contagiosum virus
agccggccuagagcuggcacc

SEQ ID NO: 3092007 - RNA, 13 nt, Molluscum contagiosum virus
ggcgcuuggcgag

SEQ ID NO: 3092008 - RNA, 14 nt, Molluscum contagiosum virus
agaaugacuuagcc

SEQ ID NO: 3092009 - RNA, 15 nt, Molluscum contagiosum virus
ugccgcuggugggcg

SEQ ID NO: 3092010 - RNA, 14 nt, Molluscum contagiosum virus
gcggccguggcugc

SEQ ID NO: 3092011 - RNA, 23 nt, Molluscum contagiosum virus
cacgccagcagcagaggaguagc

SEQ ID NO: 3092012 - RNA, 13 nt, Molluscum contagiosum virus
agcacgccuggcg

SEQ ID NO: 3092013 - RNA, 18 nt, Molluscum contagiosum virus
gucgaguucgcucgcucg

SEQ ID NO: 3092014 - RNA, 17 nt, Molluscum contagiosum virus
uucgccggaggaaggac

SEQ ID NO: 3092015 - RNA, 19 nt, Molluscum contagiosum virus
gcagcggcgccacgagcgc

SEQ ID NO: 3092016 - RNA, 23 nt, Molluscum contagiosum virus
ugcaggccgagaugagcggcgcc

SEQ ID NO: 3092017 - RNA, 23 nt, Molluscum contagiosum virus
uugugcaauuccguccagugaaa

SEQ ID NO: 3092018 - RNA, 21 nt, Molluscum contagiosum virus
gcgagcgcgucugcucucggc

SEQ ID NO: 3092019 - RNA, 22 nt, Molluscum contagiosum virus
caaccgcugcuauuaccugaga

SEQ ID NO: 3092020 - RNA, 15 nt, Molluscum contagiosum virus
acgaacgacagcgcc

SEQ ID NO: 3092021 - RNA, 15 nt, Molluscum contagiosum virus
ggcgcgcccagcgcc

SEQ ID NO: 3092022 - RNA, 15 nt, Molluscum contagiosum virus
caacuguugccugga

SEQ ID NO: 3092023 - RNA, 23 nt, Molluscum contagiosum virus
gacuuugacuacuacguggugcg

SEQ ID NO: 3092024 - RNA, 13 nt, Molluscum contagiosum virus
acgaacuggcaau

SEQ ID NO: 3092025 - RNA, 18 nt, Molluscum contagiosum virus
ccggcaguagcagcgccg

SEQ ID NO: 3092026 - RNA, 15 nt, Molluscum contagiosum virus
cuuuggcgugaccau

SEQ ID NO: 3092027 - RNA, 18 nt, Molluscum contagiosum virus
cgggcaugcacagcugcu

SEQ ID NO: 3092028 - RNA, 22 nt, Molluscum contagiosum virus
agacuggagcacggacugggag

SEQ ID NO: 3092029 - RNA, 14 nt, Molluscum contagiosum virus
gcgcguggcucgcg

SEQ ID NO: 3092030 - RNA, 18 nt, Molluscum contagiosum virus
aaauccugguuccucucc

SEQ ID NO: 3092031 - RNA, 19 nt, Molluscum contagiosum virus
cuggccgcgauucugcucu

SEQ ID NO: 3092032 - RNA, 11 nt, Molluscum contagiosum virus
acaagcugcac

SEQ ID NO: 3092033 - RNA, 22 nt, Molluscum contagiosum virus
gcucgaagccuucgcagagacc

SEQ ID NO: 3092034 - RNA, 23 nt, Molluscum contagiosum virus
caaaguacuugccgucacggccg

SEQ ID NO: 3092035 - RNA, 16 nt, Molluscum contagiosum virus
gccgaacggcagaccc

SEQ ID NO: 3092036 - RNA, 21 nt, Molluscum contagiosum virus
gcgcugucgcgcaggcucugg

SEQ ID NO: 3092037 - RNA, 14 nt, Molluscum contagiosum virus
cuccuggccaacag

SEQ ID NO: 3092038 - RNA, 15 nt, Molluscum contagiosum virus
agacacgcuggucag

SEQ ID NO: 3092039 - RNA, 21 nt, Molluscum contagiosum virus
cguacucaacaagcugcuggc

SEQ ID NO: 3092040 - RNA, 15 nt, Molluscum contagiosum virus
cugcugaagaaggag

SEQ ID NO: 3092041 - RNA, 21 nt, Molluscum contagiosum virus
ggcacccgcaggaaagguacc

SEQ ID NO: 3092042 - RNA, 21 nt, Molluscum contagiosum virus
uuguccucuuggccccucccg

SEQ ID NO: 3092043 - RNA, 14 nt, Molluscum contagiosum virus
aacaugugccugcu

SEQ ID NO: 3092044 - RNA, 21 nt, Molluscum contagiosum virus
gcuaccacgggcccgcgcgug

SEQ ID NO: 3092045 - RNA, 17 nt, Molluscum contagiosum virus
cuggcaccugcggcugc

SEQ ID NO: 3092046 - RNA, 20 nt, Molluscum contagiosum virus
ccugaugacggcagacggca

SEQ ID NO: 3092047 - RNA, 15 nt, Molluscum contagiosum virus
ugcgcgccgcgccgc

SEQ ID NO: 3092048 - RNA, 14 nt, Molluscum contagiosum virus
gcugcugcggcucc

SEQ ID NO: 3092049 - RNA, 18 nt, Molluscum contagiosum virus
gcugaagaaggagcccuu

SEQ ID NO: 3092050 - RNA, 21 nt, Molluscum contagiosum virus
cggcgagacgugcggcacgcu

SEQ ID NO: 3092051 - RNA, 15 nt, Molluscum contagiosum virus
cagcgcgagcugugc

SEQ ID NO: 3092052 - RNA, 16 nt, Molluscum contagiosum virus
gcuuuuuuuguccugu

SEQ ID NO: 3092053 - RNA, 14 nt, Molluscum contagiosum virus
cggccgccaccgcg

SEQ ID NO: 3092054 - RNA, 18 nt, Molluscum contagiosum virus
acgccgggcacgcccgcg

SEQ ID NO: 3092055 - RNA, 13 nt, Molluscum contagiosum virus
ccaaggggagaca

SEQ ID NO: 3092056 - RNA, 14 nt, Molluscum contagiosum virus
guccgcggcgcgcc

SEQ ID NO: 3092057 - RNA, 22 nt, Molluscum contagiosum virus
gacaagcgcgucugcaucgugg

SEQ ID NO: 3092058 - RNA, 14 nt, Molluscum contagiosum virus
cgcuucggcuccca

SEQ ID NO: 3092059 - RNA, 19 nt, Molluscum contagiosum virus
cucgcgcaaguccagcgcg

SEQ ID NO: 3092060 - RNA, 19 nt, Molluscum contagiosum virus
ccguccucgcucgugcucu

SEQ ID NO: 3092061 - RNA, 14 nt, Molluscum contagiosum virus
cgaggagcacggca

SEQ ID NO: 3092062 - RNA, 23 nt, Molluscum contagiosum virus
cguguacaugaugcccuggugaa

SEQ ID NO: 3092063 - RNA, 21 nt, Molluscum contagiosum virus
accccgaaggaaaggcccccc

SEQ ID NO: 3092064 - RNA, 21 nt, Molluscum contagiosum virus
caacucgcgcugcagcaccug

SEQ ID NO: 3092065 - RNA, 21 nt, Molluscum contagiosum virus
ccgcgcgcgagcuggagcgcg

SEQ ID NO: 3092066 - RNA, 18 nt, Molluscum contagiosum virus
ucgcgacgacgagcacua

SEQ ID NO: 3092067 - RNA, 21 nt, Molluscum contagiosum virus
gccgcgcaugacagccauggc

SEQ ID NO: 3092068 - RNA, 13 nt, Molluscum contagiosum virus
cgcgagcaccacu

SEQ ID NO: 3092069 - RNA, 21 nt, Molluscum contagiosum virus
cgaccugcacgacccucuucg

SEQ ID NO: 3092070 - RNA, 16 nt, Molluscum contagiosum virus
caagcgcccucgugua

SEQ ID NO: 3092071 - RNA, 14 nt, Molluscum contagiosum virus
gccgugcagagcaa

SEQ ID NO: 3092072 - RNA, 21 nt, Molluscum contagiosum virus
cacgggcaugcacagcugcuc

SEQ ID NO: 3092073 - RNA, 16 nt, Molluscum contagiosum virus
agaucgcgagaggaga

SEQ ID NO: 3092074 - RNA, 18 nt, Molluscum contagiosum virus
ggagaacgcgaggccggc

SEQ ID NO: 3092075 - RNA, 13 nt, Molluscum contagiosum virus
gcggacgcgcagc

SEQ ID NO: 3092076 - RNA, 16 nt, Molluscum contagiosum virus
ggaucagccccgcgcc

SEQ ID NO: 3092077 - RNA, 14 nt, Molluscum contagiosum virus
ucguacucaacaag

SEQ ID NO: 3092078 - RNA, 14 nt, Molluscum contagiosum virus
gagugcuggagcag

SEQ ID NO: 3092079 - RNA, 23 nt, Molluscum contagiosum virus
gcccgcgcacgagcugcugcccg

SEQ ID NO: 3092080 - RNA, 16 nt, Molluscum contagiosum virus
acggagagcgcgcggc

SEQ ID NO: 3092081 - RNA, 18 nt, Molluscum contagiosum virus
cggcggggaugcuucccc

SEQ ID NO: 3092082 - RNA, 14 nt, Molluscum contagiosum virus
cuguaccggcucag

SEQ ID NO: 3092083 - RNA, 19 nt, Molluscum contagiosum virus
gagccauucuuaauccagu

SEQ ID NO: 3092084 - RNA, 14 nt, Molluscum contagiosum virus
gacaugcacacuca

SEQ ID NO: 3092085 - RNA, 11 nt, Molluscum contagiosum virus
ccaccaccagc

SEQ ID NO: 3092086 - RNA, 19 nt, Molluscum contagiosum virus
ucgaggagggcguccguaa

SEQ ID NO: 3092087 - RNA, 17 nt, Molluscum contagiosum virus
ggcgccgaugcagugcg

SEQ ID NO: 3092088 - RNA, 19 nt, Molluscum contagiosum virus
cuggcacaaaucgaggcgc

SEQ ID NO: 3092089 - RNA, 13 nt, Molluscum contagiosum virus
ggcaccacgugcg

SEQ ID NO: 3092090 - RNA, 19 nt, Molluscum contagiosum virus
gcguggcgcgcgagcugcu

SEQ ID NO: 3092091 - RNA, 18 nt, Molluscum contagiosum virus
agugccgcugagagacuu

SEQ ID NO: 3092092 - RNA, 21 nt, Molluscum contagiosum virus
gcacgcuugccuuggcgcccg

SEQ ID NO: 3092093 - RNA, 18 nt, Molluscum contagiosum virus
gcucacggcggcgcucaa

SEQ ID NO: 3092094 - RNA, 14 nt, Molluscum contagiosum virus
cugcgcaccugcac

SEQ ID NO: 3092095 - RNA, 15 nt, Molluscum contagiosum virus
ugaagcuggacgugg

SEQ ID NO: 3092096 - RNA, 17 nt, Molluscum contagiosum virus
gaacgaggcugcugccg

SEQ ID NO: 3092097 - RNA, 14 nt, Molluscum contagiosum virus
cgccagccugcugg

SEQ ID NO: 3092098 - RNA, 13 nt, Molluscum contagiosum virus
cggcacugcuggc

SEQ ID NO: 3092099 - RNA, 14 nt, Molluscum contagiosum virus
agagccgcuccugg

SEQ ID NO: 3092100 - RNA, 19 nt, Molluscum contagiosum virus
ucgcgcucuucaagaacag

SEQ ID NO: 3092101 - RNA, 16 nt, Molluscum contagiosum virus
cuccacgcgcagcuuc

SEQ ID NO: 3092102 - RNA, 19 nt, Molluscum contagiosum virus
gcgcgcgccaagugcuccg

SEQ ID NO: 3092103 - RNA, 16 nt, Molluscum contagiosum virus
cggcggggcugcuggc

SEQ ID NO: 3092104 - RNA, 18 nt, Molluscum contagiosum virus
cgugccgcggcacugggu

SEQ ID NO: 3092105 - RNA, 17 nt, Molluscum contagiosum virus
gaggcacgggcucgauc

SEQ ID NO: 3092106 - RNA, 16 nt, Molluscum contagiosum virus
ggcggcguaggccugc

SEQ ID NO: 3092107 - RNA, 15 nt, Molluscum contagiosum virus
accugcucgggcugc

SEQ ID NO: 3092108 - RNA, 19 nt, Molluscum contagiosum virus
ggccaaagccgcggaggcc

SEQ ID NO: 3092109 - RNA, 20 nt, Molluscum contagiosum virus
ucgcagccuccgugcgccag

SEQ ID NO: 3092110 - RNA, 19 nt, Molluscum contagiosum virus
caggcgauaggacaugacu

SEQ ID NO: 3092111 - RNA, 14 nt, Molluscum contagiosum virus
caaugaggagagga

SEQ ID NO: 3092112 - RNA, 14 nt, Molluscum contagiosum virus
auguccggcgcugg

SEQ ID NO: 3092113 - RNA, 13 nt, Molluscum contagiosum virus
gcucaacgugggc

SEQ ID NO: 3092114 - RNA, 17 nt, Molluscum contagiosum virus
cacggcgcccaggaaca

SEQ ID NO: 3092115 - RNA, 13 nt, Molluscum contagiosum virus
cgcgcgacuacgc

SEQ ID NO: 3092116 - RNA, 14 nt, Molluscum contagiosum virus
cggacagcucagca

SEQ ID NO: 3092117 - RNA, 14 nt, Molluscum contagiosum virus
cucgugcugggccu

SEQ ID NO: 3092118 - RNA, 14 nt, Molluscum contagiosum virus
aguggcaagggccu

SEQ ID NO: 3092119 - RNA, 14 nt, Molluscum contagiosum virus
ucucucgagagaca

SEQ ID NO: 3092120 - RNA, 14 nt, Molluscum contagiosum virus
acgaagcugugcaa

SEQ ID NO: 3092121 - RNA, 22 nt, Molluscum contagiosum virus
cccuucgcuugucgugcuuccu

SEQ ID NO: 3092122 - RNA, 15 nt, Molluscum contagiosum virus
gagacaggggggaga

SEQ ID NO: 3092123 - RNA, 14 nt, Molluscum contagiosum virus
agcaaggggucugc

SEQ ID NO: 3092124 - RNA, 21 nt, Molluscum contagiosum virus
ugcacuucggacaccucaccu

SEQ ID NO: 3092125 - RNA, 17 nt, Molluscum contagiosum virus
gcacccaccaggaacga

SEQ ID NO: 3092126 - RNA, 20 nt, Molluscum contagiosum virus
guucuccacguccgacucgg

SEQ ID NO: 3092127 - RNA, 19 nt, Molluscum contagiosum virus
ugcgucccagcagcugcuc

SEQ ID NO: 3092128 - RNA, 12 nt, Molluscum contagiosum virus
cuuagccacugu

SEQ ID NO: 3092129 - RNA, 23 nt, Molluscum contagiosum virus
gccuccaagaagaggccagcaca

SEQ ID NO: 3092130 - RNA, 19 nt, Molluscum contagiosum virus
ccaaggugaacgaccucaa

SEQ ID NO: 3092131 - RNA, 15 nt, Molluscum contagiosum virus
gcgaccgcgaacugc

SEQ ID NO: 3092132 - RNA, 16 nt, Molluscum contagiosum virus
uaauugaaaggcagaa

SEQ ID NO: 3092133 - RNA, 21 nt, Molluscum contagiosum virus
ccgcuuccuggcacuggcgcg

SEQ ID NO: 3092134 - RNA, 21 nt, Molluscum contagiosum virus
gcgccgcgcgcgcgcgagggc

SEQ ID NO: 3092135 - RNA, 14 nt, Molluscum contagiosum virus
gaucgcgcucuucc

SEQ ID NO: 3092136 - RNA, 15 nt, Molluscum contagiosum virus
gcaagcgggccagua

SEQ ID NO: 3092137 - RNA, 20 nt, Molluscum contagiosum virus
augccagacccgaaagcugc

SEQ ID NO: 3092138 - RNA, 12 nt, Molluscum contagiosum virus
cggcggcgcaac

SEQ ID NO: 3092139 - RNA, 17 nt, Molluscum contagiosum virus
cgccgucggccucgggc

SEQ ID NO: 3092140 - RNA, 22 nt, Molluscum contagiosum virus
ugucucugcgcgagcagcugcu

SEQ ID NO: 3092141 - RNA, 16 nt, Molluscum contagiosum virus
gacgcugcggcggcgc

SEQ ID NO: 3092142 - RNA, 17 nt, Molluscum contagiosum virus
gugcucgcacacgugca

SEQ ID NO: 3092143 - RNA, 16 nt, Molluscum contagiosum virus
gucugaccgcgggcac

SEQ ID NO: 3092144 - RNA, 17 nt, Molluscum contagiosum virus
aagucucucagcggcac

SEQ ID NO: 3092145 - RNA, 21 nt, Molluscum contagiosum virus
uccccgcacaagggcagcuca

SEQ ID NO: 3092146 - RNA, 11 nt, Molluscum contagiosum virus
uccugcugccg

SEQ ID NO: 3092147 - RNA, 21 nt, Molluscum contagiosum virus
cgugcagacgcucaacguggg

SEQ ID NO: 3092148 - RNA, 21 nt, Molluscum contagiosum virus
cuuguuuuuguacccuugcuc

SEQ ID NO: 3092149 - RNA, 12 nt, Molluscum contagiosum virus
uggacuucagga

SEQ ID NO: 3092150 - RNA, 19 nt, Molluscum contagiosum virus
cggcccgcggacgcgcagc

SEQ ID NO: 3092151 - RNA, 15 nt, Molluscum contagiosum virus
acgacggucacgcaa

SEQ ID NO: 3092152 - RNA, 18 nt, Molluscum contagiosum virus
cgcgcggcaagccuggcu

SEQ ID NO: 3092153 - RNA, 18 nt, Molluscum contagiosum virus
cggcgcccgugagcaugg

SEQ ID NO: 3092154 - RNA, 20 nt, Molluscum contagiosum virus
acgacacgagggccuuggcg

SEQ ID NO: 3092155 - RNA, 20 nt, Molluscum contagiosum virus
cuugguguucugcgcgccgc

SEQ ID NO: 3092156 - RNA, 19 nt, Molluscum contagiosum virus
ccuucucgucgagagcgcg

SEQ ID NO: 3092157 - RNA, 15 nt, Molluscum contagiosum virus
cgcgcucgucaaugc

SEQ ID NO: 3092158 - RNA, 18 nt, Molluscum contagiosum virus
agaaguucugcacagcac

SEQ ID NO: 3092159 - RNA, 14 nt, Molluscum contagiosum virus
gcgcccuuccugga

SEQ ID NO: 3092160 - RNA, 20 nt, Molluscum contagiosum virus
gcagcaaacugugcuccuga

SEQ ID NO: 3092161 - RNA, 23 nt, Molluscum contagiosum virus
guguuuuuuuuguuuggacccau

SEQ ID NO: 3092162 - RNA, 17 nt, Molluscum contagiosum virus
cuuggcgcccgugccgc

SEQ ID NO: 3092163 - RNA, 18 nt, Molluscum contagiosum virus
ccuggugcgcccgcggca

SEQ ID NO: 3092164 - RNA, 15 nt, Molluscum contagiosum virus
gcugcugcucgcacc

SEQ ID NO: 3092165 - RNA, 20 nt, Molluscum contagiosum virus
gcugcucgugcugcucugcg

SEQ ID NO: 3092166 - RNA, 13 nt, Molluscum contagiosum virus
cgauugccccugg

SEQ ID NO: 3092167 - RNA, 22 nt, Molluscum contagiosum virus
ggcccuaaauaaugaaccugca

SEQ ID NO: 3092168 - RNA, 13 nt, Molluscum contagiosum virus
gcugcgagagcau

SEQ ID NO: 3092169 - RNA, 19 nt, Molluscum contagiosum virus
ugugugcuuauaccaugga

SEQ ID NO: 3092170 - RNA, 14 nt, Molluscum contagiosum virus
ccugcgcgagcagu

SEQ ID NO: 3092171 - RNA, 11 nt, Molluscum contagiosum virus
ugccugcgcuu

SEQ ID NO: 3092172 - RNA, 15 nt, Molluscum contagiosum virus
caggcagcugcugcg

SEQ ID NO: 3092173 - RNA, 17 nt, Molluscum contagiosum virus
ccgcgggcgcacgcuug

SEQ ID NO: 3092174 - RNA, 15 nt, Molluscum contagiosum virus
cguugcugcccgugc

SEQ ID NO: 3092175 - RNA, 18 nt, Molluscum contagiosum virus
cuugcgcguccgcaaagc

SEQ ID NO: 3092176 - RNA, 12 nt, Molluscum contagiosum virus
cccgcgccagca

SEQ ID NO: 3092177 - RNA, 18 nt, Molluscum contagiosum virus
cgcugugagcgcgccgcu

SEQ ID NO: 3092178 - RNA, 21 nt, Molluscum contagiosum virus
cgagcacgccaaccaccacgu

SEQ ID NO: 3092179 - RNA, 17 nt, Molluscum contagiosum virus
cuucggggacacaagga

SEQ ID NO: 3092180 - RNA, 14 nt, Molluscum contagiosum virus
ucgcgggcgccgcg

SEQ ID NO: 3092181 - RNA, 23 nt, Molluscum contagiosum virus
ccgagcgcguccaugagcaucuc

SEQ ID NO: 3092182 - RNA, 14 nt, Molluscum contagiosum virus
cgaagaaggggccg

SEQ ID NO: 3092183 - RNA, 14 nt, Molluscum contagiosum virus
cgucuuacugcugc

SEQ ID NO: 3092184 - RNA, 22 nt, Molluscum contagiosum virus
gcaacaaggaaaggcaccugca

SEQ ID NO: 3092185 - RNA, 18 nt, Molluscum contagiosum virus
cguaacaauggacacgca

SEQ ID NO: 3092186 - RNA, 19 nt, Molluscum contagiosum virus
aggcaccugcggcucgcac

SEQ ID NO: 3092187 - RNA, 23 nt, Molluscum contagiosum virus
gagcggcgcgcgcugagcgcgga

SEQ ID NO: 3092188 - RNA, 19 nt, Molluscum contagiosum virus
cgaggcgcuugggcacugc

SEQ ID NO: 3092189 - RNA, 22 nt, Molluscum contagiosum virus
acugcgaucgcagcagugccag

SEQ ID NO: 3092190 - RNA, 17 nt, Molluscum contagiosum virus
gguagagcgugaugugc

SEQ ID NO: 3092191 - RNA, 16 nt, Molluscum contagiosum virus
uacugcagcagcuccu

SEQ ID NO: 3092192 - RNA, 20 nt, Molluscum contagiosum virus
guccuguguuuucagggcuc

SEQ ID NO: 3092193 - RNA, 14 nt, Molluscum contagiosum virus
agcugcgccugcag

SEQ ID NO: 3092194 - RNA, 14 nt, Molluscum contagiosum virus
gcgcgcgcgcaggc

SEQ ID NO: 3092195 - RNA, 16 nt, Molluscum contagiosum virus
acgcagcucuuccacg

SEQ ID NO: 3092196 - RNA, 16 nt, Molluscum contagiosum virus
cucgcgcgcgcacgcc

SEQ ID NO: 3092197 - RNA, 20 nt, Molluscum contagiosum virus
ucuacggcgugcugugccug

SEQ ID NO: 3092198 - RNA, 10 nt, Molluscum contagiosum virus
accagcagcc

SEQ ID NO: 3092199 - RNA, 14 nt, Molluscum contagiosum virus
agguugcgcagagc

SEQ ID NO: 3092200 - RNA, 17 nt, Molluscum contagiosum virus
gcuuccgucugcugcuc

SEQ ID NO: 3092201 - RNA, 17 nt, Molluscum contagiosum virus
ugcgcgugcugggcccc

SEQ ID NO: 3092202 - RNA, 21 nt, Molluscum contagiosum virus
ggagucaggcaaaagccgccg

SEQ ID NO: 3092203 - RNA, 19 nt, Molluscum contagiosum virus
ucgaaggagcccgucuaca

SEQ ID NO: 3092204 - RNA, 14 nt, Molluscum contagiosum virus
gcagcugcgccugc

SEQ ID NO: 3092205 - RNA, 22 nt, Molluscum contagiosum virus
uaccagaggguggcuugcugca

SEQ ID NO: 3092206 - RNA, 13 nt, Molluscum contagiosum virus
aggaggagaacuc

SEQ ID NO: 3092207 - RNA, 13 nt, Molluscum contagiosum virus
cgcaggagcaguc

SEQ ID NO: 3092208 - RNA, 15 nt, Molluscum contagiosum virus
gccuucuugcuggcg

SEQ ID NO: 3092209 - RNA, 15 nt, Molluscum contagiosum virus
aggcagugcuugagc

SEQ ID NO: 3092210 - RNA, 15 nt, Molluscum contagiosum virus
gccuucguggagccc

SEQ ID NO: 3092211 - RNA, 18 nt, Molluscum contagiosum virus
gaauccuuuacugcaaga

SEQ ID NO: 3092212 - RNA, 13 nt, Molluscum contagiosum virus
gccagccaggcgc

SEQ ID NO: 3092213 - RNA, 12 nt, Molluscum contagiosum virus
gaagcugcacgu

SEQ ID NO: 3092214 - RNA, 13 nt, Molluscum contagiosum virus
cagccucuacucc

SEQ ID NO: 3092215 - RNA, 22 nt, Molluscum contagiosum virus
gcacgcgaugagcgucucggug

SEQ ID NO: 3092216 - RNA, 15 nt, Molluscum contagiosum virus
aggaacugcccgcgu

SEQ ID NO: 3092217 - RNA, 21 nt, Molluscum contagiosum virus
cccgcggcgcgcagcucgccg

SEQ ID NO: 3092218 - RNA, 17 nt, Molluscum contagiosum virus
gccucccccgcgcacug

SEQ ID NO: 3092219 - RNA, 15 nt, Molluscum contagiosum virus
acccucagaccagag

SEQ ID NO: 3092220 - RNA, 17 nt, Molluscum contagiosum virus
aucgucacgugaacucc

SEQ ID NO: 3092221 - RNA, 19 nt, Molluscum contagiosum virus
gcgagcaggcgcaggccgc

SEQ ID NO: 3092222 - RNA, 23 nt, Molluscum contagiosum virus
ccagcgugacaaucucugcgccg

SEQ ID NO: 3092223 - RNA, 22 nt, Molluscum contagiosum virus
cacggccuucgcgcugcccgcg

SEQ ID NO: 3092224 - RNA, 13 nt, Molluscum contagiosum virus
cgcgccugcucuc

SEQ ID NO: 3092225 - RNA, 23 nt, Molluscum contagiosum virus
ggcccuucuugacgcgagacugu

SEQ ID NO: 3092226 - RNA, 20 nt, Molluscum contagiosum virus
uagcagcgugcgcaccagcu

SEQ ID NO: 3092227 - RNA, 17 nt, Molluscum contagiosum virus
uccaggcgccgcaccuc

SEQ ID NO: 3092228 - RNA, 15 nt, Molluscum contagiosum virus
gcgagcgcgucugcu

SEQ ID NO: 3092229 - RNA, 21 nt, Molluscum contagiosum virus
caggucaucgacgagcacgag

SEQ ID NO: 3092230 - RNA, 20 nt, Molluscum contagiosum virus
cgcgggccuguccgcgggcg

SEQ ID NO: 3092231 - RNA, 11 nt, Molluscum contagiosum virus
aucaugagcca

SEQ ID NO: 3092232 - RNA, 18 nt, Molluscum contagiosum virus
uagacuggcuucggggac

SEQ ID NO: 3092233 - RNA, 24 nt, Molluscum contagiosum virus
uugugaugauuugauggcugcuca

SEQ ID NO: 3092234 - RNA, 17 nt, Molluscum contagiosum virus
uggcgaucugcucgcag

SEQ ID NO: 3092235 - RNA, 18 nt, Molluscum contagiosum virus
caccgcaugggcccuggc

SEQ ID NO: 3092236 - RNA, 17 nt, Molluscum contagiosum virus
gacuuguguugagccuu

SEQ ID NO: 3092237 - RNA, 15 nt, Molluscum contagiosum virus
ggcggugggcgccgc

SEQ ID NO: 3092238 - RNA, 15 nt, Molluscum contagiosum virus
gcugcgcgcccaggc

SEQ ID NO: 3092239 - RNA, 18 nt, Molluscum contagiosum virus
cgcagggacgcgcuuuuc

SEQ ID NO: 3092240 - RNA, 12 nt, Molluscum contagiosum virus
ccccgccagcac

SEQ ID NO: 3092241 - RNA, 18 nt, Molluscum contagiosum virus
acuuccgcgcgcucuugc

SEQ ID NO: 3092242 - RNA, 23 nt, Molluscum contagiosum virus
ccgcaguuggucaccgccuguac

SEQ ID NO: 3092243 - RNA, 17 nt, Molluscum contagiosum virus
caguaaauagccaugcu

SEQ ID NO: 3092244 - RNA, 14 nt, Molluscum contagiosum virus
ccccugucgcgcac

SEQ ID NO: 3092245 - RNA, 16 nt, Molluscum contagiosum virus
cgcaccgccuggugcu

SEQ ID NO: 3092246 - RNA, 17 nt, Molluscum contagiosum virus
ccugugaacgcaccgcc

SEQ ID NO: 3092247 - RNA, 23 nt, Molluscum contagiosum virus
cccucccugguaguccugcuagc

SEQ ID NO: 3092248 - RNA, 16 nt, Molluscum contagiosum virus
guuggcccgcaaacac

SEQ ID NO: 3092249 - RNA, 18 nt, Molluscum contagiosum virus
acucuuguuuguuguccc

SEQ ID NO: 3092250 - RNA, 14 nt, Molluscum contagiosum virus
ccuuuacugcaaga

SEQ ID NO: 3092251 - RNA, 19 nt, Molluscum contagiosum virus
uccgcgcggcgcucugcca

SEQ ID NO: 3092252 - RNA, 22 nt, Molluscum contagiosum virus
caccgcgacaugccucgcggcc

SEQ ID NO: 3092253 - RNA, 22 nt, Molluscum contagiosum virus
gcagccuccgaacaaugaggag

SEQ ID NO: 3092254 - RNA, 13 nt, Molluscum contagiosum virus
ccaucguggugga

SEQ ID NO: 3092255 - RNA, 14 nt, Molluscum contagiosum virus
cuccgcgggcagcc

SEQ ID NO: 3092256 - RNA, 17 nt, Molluscum contagiosum virus
ugugggucucgagccgc

SEQ ID NO: 3092257 - RNA, 20 nt, Molluscum contagiosum virus
gcuuggacuccgaggcaggu

SEQ ID NO: 3092258 - RNA, 13 nt, Molluscum contagiosum virus
acgcucacggccu

SEQ ID NO: 3092259 - RNA, 16 nt, Molluscum contagiosum virus
ugccggcgcgugagcg

SEQ ID NO: 3092260 - RNA, 19 nt, Molluscum contagiosum virus
cccgcgcgcgagcuggagc

SEQ ID NO: 3092261 - RNA, 17 nt, Molluscum contagiosum virus
cgcguucuccaggaacg

SEQ ID NO: 3092262 - RNA, 22 nt, Molluscum contagiosum virus
gaacaguaacugcugcagugug

SEQ ID NO: 3092263 - RNA, 21 nt, Molluscum contagiosum virus
uuguccgcggacgcgggccug

SEQ ID NO: 3092264 - RNA, 21 nt, Molluscum contagiosum virus
guacaugcccggccucgccuc

SEQ ID NO: 3092265 - RNA, 16 nt, Molluscum contagiosum virus
cuucaaguuccuggag

SEQ ID NO: 3092266 - RNA, 13 nt, Molluscum contagiosum virus
cggagcugugcca

SEQ ID NO: 3092267 - RNA, 16 nt, Molluscum contagiosum virus
gcgcgagugcaaggag

SEQ ID NO: 3092268 - RNA, 12 nt, Molluscum contagiosum virus
cagcagcugcuc

SEQ ID NO: 3092269 - RNA, 15 nt, Molluscum contagiosum virus
cgugcaccucaagaa

SEQ ID NO: 3092270 - RNA, 15 nt, Molluscum contagiosum virus
agcggagaaaaggaa

SEQ ID NO: 3092271 - RNA, 21 nt, Molluscum contagiosum virus
ggcgcucggcguggugcuggc

SEQ ID NO: 3092272 - RNA, 19 nt, Molluscum contagiosum virus
gucacugcuagugcuggcc

SEQ ID NO: 3092273 - RNA, 14 nt, Molluscum contagiosum virus
ggcgucgcgcacag

SEQ ID NO: 3092274 - RNA, 11 nt, Molluscum contagiosum virus
ugcugcagcuc

SEQ ID NO: 3092275 - RNA, 20 nt, Molluscum contagiosum virus
gcucuacggcgugcugugcc

SEQ ID NO: 3092276 - RNA, 15 nt, Molluscum contagiosum virus
ugaaggcgcggcuac

SEQ ID NO: 3092277 - RNA, 13 nt, Molluscum contagiosum virus
aggacgcgugcaa

SEQ ID NO: 3092278 - RNA, 19 nt, Molluscum contagiosum virus
gguccugcgcgguggcuua

SEQ ID NO: 3092279 - RNA, 17 nt, Molluscum contagiosum virus
caggcgccgcaccucac

SEQ ID NO: 3092280 - RNA, 17 nt, Molluscum contagiosum virus
gcucauacuccugcugg

SEQ ID NO: 3092281 - RNA, 14 nt, Molluscum contagiosum virus
gugccgccgugggc

SEQ ID NO: 3092282 - RNA, 19 nt, Molluscum contagiosum virus
uacugcugcaggcaaagcg

SEQ ID NO: 3092283 - RNA, 21 nt, Molluscum contagiosum virus
agccgcuccuggucuucccgc

SEQ ID NO: 3092284 - RNA, 12 nt, Molluscum contagiosum virus
ggccgcuccaga

SEQ ID NO: 3092285 - RNA, 16 nt, Molluscum contagiosum virus
gccagcaccaugcgug

SEQ ID NO: 3092286 - RNA, 18 nt, Molluscum contagiosum virus
cgcacgcggaaacaagca

SEQ ID NO: 3092287 - RNA, 18 nt, Molluscum contagiosum virus
agagcccgccgggcaccg

SEQ ID NO: 3092288 - RNA, 14 nt, Molluscum contagiosum virus
gcgagcgcgccccc

SEQ ID NO: 3092289 - RNA, 20 nt, Molluscum contagiosum virus
ugcgcaacgcgggccaggca

SEQ ID NO: 3092290 - RNA, 15 nt, Molluscum contagiosum virus
cggccuuagugccgu

SEQ ID NO: 3092291 - RNA, 18 nt, Molluscum contagiosum virus
gcuuggugcgcucgagcu

SEQ ID NO: 3092292 - RNA, 19 nt, Molluscum contagiosum virus
ugccuuucgaguccccaga

SEQ ID NO: 3092293 - RNA, 21 nt, Molluscum contagiosum virus
accgcgcgaacgaggagggca

SEQ ID NO: 3092294 - RNA, 23 nt, Molluscum contagiosum virus
cacgagcgaguugagcaggucgg

SEQ ID NO: 3092295 - RNA, 13 nt, Molluscum contagiosum virus
gucaugugcgugg

SEQ ID NO: 3092296 - RNA, 13 nt, Molluscum contagiosum virus
cgcacggcuaggc

SEQ ID NO: 3092297 - RNA, 15 nt, Molluscum contagiosum virus
gucgcaaccccgcgc

SEQ ID NO: 3092298 - RNA, 17 nt, Molluscum contagiosum virus
caucucgauggcgccgu

SEQ ID NO: 3092299 - RNA, 15 nt, Molluscum contagiosum virus
cugcgccgccagcgu

SEQ ID NO: 3092300 - RNA, 13 nt, Molluscum contagiosum virus
gcaagcauggucu

SEQ ID NO: 3092301 - RNA, 14 nt, Molluscum contagiosum virus
gcgugcugggcccc

SEQ ID NO: 3092302 - RNA, 19 nt, Molluscum contagiosum virus
gccgcgugcaugcccagca

SEQ ID NO: 3092303 - RNA, 16 nt, Molluscum contagiosum virus
agcagugccagcagcc

SEQ ID NO: 3092304 - RNA, 15 nt, Molluscum contagiosum virus
uggcgcgcgagcugc

SEQ ID NO: 3092305 - RNA, 16 nt, Molluscum contagiosum virus
cgugcucguguguccg

SEQ ID NO: 3092306 - RNA, 14 nt, Molluscum contagiosum virus
cggcuucugcugca

SEQ ID NO: 3092307 - RNA, 15 nt, Molluscum contagiosum virus
gcaacgucgcacugg

SEQ ID NO: 3092308 - RNA, 17 nt, Molluscum contagiosum virus
gacccaucggagaagug

SEQ ID NO: 3092309 - RNA, 19 nt, Molluscum contagiosum virus
cauccugccacaccagcug

SEQ ID NO: 3092310 - RNA, 14 nt, Molluscum contagiosum virus
ggcaugcuugaggc

SEQ ID NO: 3092311 - RNA, 17 nt, Molluscum contagiosum virus
uggcuucggggacacaa

SEQ ID NO: 3092312 - RNA, 19 nt, Molluscum contagiosum virus
caagggacugcgcccgugc

SEQ ID NO: 3092313 - RNA, 14 nt, Molluscum contagiosum virus
gcgccgcgugcaug

SEQ ID NO: 3092314 - RNA, 16 nt, Molluscum contagiosum virus
auguugcucuaccugg

SEQ ID NO: 3092315 - RNA, 14 nt, Molluscum contagiosum virus
gcagaccccuugcu

SEQ ID NO: 3092316 - RNA, 16 nt, Molluscum contagiosum virus
acggcccaccuucuug

SEQ ID NO: 3092317 - RNA, 13 nt, Molluscum contagiosum virus
gcgcgccugcugg

SEQ ID NO: 3092318 - RNA, 13 nt, Molluscum contagiosum virus
gcacgagcugcug

SEQ ID NO: 3092319 - RNA, 17 nt, Molluscum contagiosum virus
cgcaugcacagccgcuu

SEQ ID NO: 3092320 - RNA, 13 nt, Molluscum contagiosum virus
agcaguaguugcu

SEQ ID NO: 3092321 - RNA, 19 nt, Molluscum contagiosum virus
ucaagcuggcaacgcagau

SEQ ID NO: 3092322 - RNA, 21 nt, Molluscum contagiosum virus
aacgcaaguacaacccaaaca

SEQ ID NO: 3092323 - RNA, 21 nt, Molluscum contagiosum virus
cagaguccgacccgugcugcu

SEQ ID NO: 3092324 - RNA, 21 nt, Molluscum contagiosum virus
cagcagcgcgacuagccugug

SEQ ID NO: 3092325 - RNA, 23 nt, Molluscum contagiosum virus
cucgagccugccagcgccagccu

SEQ ID NO: 3092326 - RNA, 21 nt, Molluscum contagiosum virus
cgcuguuuggaauugugcugc

SEQ ID NO: 3092327 - RNA, 20 nt, Molluscum contagiosum virus
gcuuuuugccgcucacagcu

SEQ ID NO: 3092328 - RNA, 14 nt, Molluscum contagiosum virus
gaagaccaccagca

SEQ ID NO: 3092329 - RNA, 17 nt, Molluscum contagiosum virus
ugcguguuggcuucugc

SEQ ID NO: 3092330 - RNA, 23 nt, Molluscum contagiosum virus
agcugcucaucggcgagcucuuu

SEQ ID NO: 3092331 - RNA, 13 nt, Molluscum contagiosum virus
uacccgcaggaaa

SEQ ID NO: 3092332 - RNA, 21 nt, Molluscum contagiosum virus
aagaacagucgcgcgccugcc

SEQ ID NO: 3092333 - RNA, 17 nt, Molluscum contagiosum virus
auucucucgagagacaa

SEQ ID NO: 3092334 - RNA, 19 nt, Molluscum contagiosum virus
ugcuuugugcgucucccag

SEQ ID NO: 3092335 - RNA, 19 nt, Molluscum contagiosum virus
agcgccgucucgcggaaga

SEQ ID NO: 3092336 - RNA, 16 nt, Molluscum contagiosum virus
guccccgaacugcugg

SEQ ID NO: 3092337 - RNA, 20 nt, Molluscum contagiosum virus
guccgcacgcacggagcaca

SEQ ID NO: 3092338 - RNA, 14 nt, Molluscum contagiosum virus
cagcgugccgcggc

SEQ ID NO: 3092339 - RNA, 17 nt, Molluscum contagiosum virus
cgcgugacuaccuugug

SEQ ID NO: 3092340 - RNA, 17 nt, Molluscum contagiosum virus
ucuuucacgcugcacga

SEQ ID NO: 3092341 - RNA, 14 nt, Molluscum contagiosum virus
uggcaaaggcaggg

SEQ ID NO: 3092342 - RNA, 22 nt, Molluscum contagiosum virus
gcuugaaggacgcguucuccag

SEQ ID NO: 3092343 - RNA, 20 nt, Molluscum contagiosum virus
uggcgcccuuuggcuagcac

SEQ ID NO: 3092344 - RNA, 19 nt, Molluscum contagiosum virus
ugcgcgcugcgggcgccgg

SEQ ID NO: 3092345 - RNA, 24 nt, Molluscum contagiosum virus
gccauggaggcgcuagugcagaug

SEQ ID NO: 3092346 - RNA, 20 nt, Molluscum contagiosum virus
cacgccgggaaacgcacagc

SEQ ID NO: 3092347 - RNA, 19 nt, Molluscum contagiosum virus
ccuggagggcagugccaag

SEQ ID NO: 3092348 - RNA, 15 nt, Molluscum contagiosum virus
agccagacgcagagc

SEQ ID NO: 3092349 - RNA, 22 nt, Molluscum contagiosum virus
gccaggcuaggcgcgacugcac

SEQ ID NO: 3092350 - RNA, 15 nt, Molluscum contagiosum virus
uguguuuugugccug

SEQ ID NO: 3092351 - RNA, 14 nt, Molluscum contagiosum virus
gcgcccaaggccgc

SEQ ID NO: 3092352 - RNA, 20 nt, Molluscum contagiosum virus
gcguccggcgcuugccccuc

SEQ ID NO: 3092353 - RNA, 19 nt, Molluscum contagiosum virus
ccugucgcgcacgagcgcg

SEQ ID NO: 3092354 - RNA, 20 nt, Molluscum contagiosum virus
cgagcacguggacagcaucc

SEQ ID NO: 3092355 - RNA, 23 nt, Molluscum contagiosum virus
acuggcaaugagggcgaggccgc

SEQ ID NO: 3092356 - RNA, 16 nt, Molluscum contagiosum virus
ccgugccuggcagugc

SEQ ID NO: 3092357 - RNA, 19 nt, Molluscum contagiosum virus
ucgaacaccuccugcuuug

SEQ ID NO: 3092358 - RNA, 14 nt, Molluscum contagiosum virus
cuguaccuggugcg

SEQ ID NO: 3092359 - RNA, 21 nt, Molluscum contagiosum virus
ggggaaugaucgacucgagca

SEQ ID NO: 3092360 - RNA, 21 nt, Molluscum contagiosum virus
gagcaagcgagagaggaguga

SEQ ID NO: 3092361 - RNA, 14 nt, Molluscum contagiosum virus
cuccgggcgcacaa

SEQ ID NO: 3092362 - RNA, 22 nt, Molluscum contagiosum virus
agcuggagcugccgcugcgcga

SEQ ID NO: 3092363 - RNA, 19 nt, Molluscum contagiosum virus
ccgccggugcgugcccagc

SEQ ID NO: 3092364 - RNA, 21 nt, Molluscum contagiosum virus
cagagaaaggcacccaccagg

SEQ ID NO: 3092365 - RNA, 17 nt, Molluscum contagiosum virus
gguucccggugcugcug

SEQ ID NO: 3092366 - RNA, 15 nt, Molluscum contagiosum virus
gcccgcggcgcacgg

SEQ ID NO: 3092367 - RNA, 16 nt, Molluscum contagiosum virus
auguagaacgccagga

SEQ ID NO: 3092368 - RNA, 19 nt, Molluscum contagiosum virus
cuagcagcgugcgcaccag

SEQ ID NO: 3092369 - RNA, 18 nt, Molluscum contagiosum virus
ggcgcguuuucgcggccu

SEQ ID NO: 3092370 - RNA, 22 nt, Molluscum contagiosum virus
uccuggcucgcgagugugcaug

SEQ ID NO: 3092371 - RNA, 22 nt, Molluscum contagiosum virus
guacggcccgaaggccaccucg

SEQ ID NO: 3092372 - RNA, 20 nt, Molluscum contagiosum virus
acucgcgcgcgccgggccgc

SEQ ID NO: 3092373 - RNA, 11 nt, Molluscum contagiosum virus
acagcaucccu

SEQ ID NO: 3092374 - RNA, 15 nt, Molluscum contagiosum virus
gagcacuuuggccuc

SEQ ID NO: 3092375 - RNA, 16 nt, Molluscum contagiosum virus
gccacgauggccggca

SEQ ID NO: 3092376 - RNA, 20 nt, Molluscum contagiosum virus
aaacgcacagccccugcugc

SEQ ID NO: 3092377 - RNA, 18 nt, Molluscum contagiosum virus
caaggaaaggcacccgca

SEQ ID NO: 3092378 - RNA, 19 nt, Molluscum contagiosum virus
ggccuucuaccacagguuu

SEQ ID NO: 3092379 - RNA, 20 nt, Molluscum contagiosum virus
augcucaagcaccugcgcuu

SEQ ID NO: 3092380 - RNA, 16 nt, Molluscum contagiosum virus
ggcacugcguacacau

SEQ ID NO: 3092381 - RNA, 23 nt, Molluscum contagiosum virus
gagcaagcgagagaggagugaag

SEQ ID NO: 3092382 - RNA, 17 nt, Molluscum contagiosum virus
gccgugcgcgcacacga

SEQ ID NO: 3092383 - RNA, 14 nt, Molluscum contagiosum virus
gcgcggagcucgcg

SEQ ID NO: 3092384 - RNA, 23 nt, Molluscum contagiosum virus
ggcugcccgcggagaccaccgcu

SEQ ID NO: 3092385 - RNA, 16 nt, Molluscum contagiosum virus
uuccggccuguaaaug

SEQ ID NO: 3092386 - RNA, 17 nt, Molluscum contagiosum virus
gcaaagcggggcgcgcg

SEQ ID NO: 3092387 - RNA, 14 nt, Molluscum contagiosum virus
ccagcgccagccug

SEQ ID NO: 3092388 - RNA, 18 nt, Molluscum contagiosum virus
cagcucgaugggcuccag

SEQ ID NO: 3092389 - RNA, 18 nt, Molluscum contagiosum virus
ccgcccgcggacucgugc

SEQ ID NO: 3092390 - RNA, 19 nt, Molluscum contagiosum virus
cucgccaaagcgcgccuuc

SEQ ID NO: 3092391 - RNA, 15 nt, Molluscum contagiosum virus
cgccguuggccaccu

SEQ ID NO: 3092392 - RNA, 14 nt, Molluscum contagiosum virus
cgcggucgggcccc

SEQ ID NO: 3092393 - RNA, 14 nt, Molluscum contagiosum virus
gacgccuuccugcu

SEQ ID NO: 3092394 - RNA, 17 nt, Molluscum contagiosum virus
ccucgagcacgccucca

SEQ ID NO: 3092395 - RNA, 17 nt, Molluscum contagiosum virus
ugagaggaccucccggc

SEQ ID NO: 3092396 - RNA, 17 nt, Molluscum contagiosum virus
gcucagccucuacucca

SEQ ID NO: 3092397 - RNA, 20 nt, Molluscum contagiosum virus
gccaucucgcacacugcagc

SEQ ID NO: 3092398 - RNA, 17 nt, Molluscum contagiosum virus
gcucugauuacauccug

SEQ ID NO: 3092399 - RNA, 19 nt, Molluscum contagiosum virus
cucgaacuccaggcgcacc

SEQ ID NO: 3092400 - RNA, 19 nt, Molluscum contagiosum virus
ggcuggaccugcgccagcg

SEQ ID NO: 3092401 - RNA, 16 nt, Molluscum contagiosum virus
cugguggagcacuucc

SEQ ID NO: 3092402 - RNA, 21 nt, Molluscum contagiosum virus
caugucgagaccuuccuccag

SEQ ID NO: 3092403 - RNA, 13 nt, Molluscum contagiosum virus
ccuguucuuccag

SEQ ID NO: 3092404 - RNA, 16 nt, Molluscum contagiosum virus
cacaguucacggcgcu

SEQ ID NO: 3092405 - RNA, 17 nt, Molluscum contagiosum virus
agcgacuacgcgcugcu

SEQ ID NO: 3092406 - RNA, 22 nt, Molluscum contagiosum virus
cggcgccccuccuaucucaaag

SEQ ID NO: 3092407 - RNA, 12 nt, Molluscum contagiosum virus
cgggaagcugca

SEQ ID NO: 3092408 - RNA, 19 nt, Molluscum contagiosum virus
cggcucaccgcgcagaagc

SEQ ID NO: 3092409 - RNA, 18 nt, Molluscum contagiosum virus
ggauacagcgcggagaga

SEQ ID NO: 3092410 - RNA, 15 nt, Molluscum contagiosum virus
gugguccaccagcac

SEQ ID NO: 3092411 - RNA, 20 nt, Molluscum contagiosum virus
gagaagcaaugcgcaaggcc

SEQ ID NO: 3092412 - RNA, 21 nt, Molluscum contagiosum virus
gagcaauggcggccugcccug

SEQ ID NO: 3092413 - RNA, 23 nt, Molluscum contagiosum virus
cggcgcgccgcgggccgccgggc

SEQ ID NO: 3092414 - RNA, 21 nt, Molluscum contagiosum virus
ugcagagcaaggcgagucaau

SEQ ID NO: 3092415 - RNA, 22 nt, Molluscum contagiosum virus
cagggcccgcgcucgccgcacg

SEQ ID NO: 3092416 - RNA, 17 nt, Molluscum contagiosum virus
ccgugcucaggccagca

SEQ ID NO: 3092417 - RNA, 18 nt, Molluscum contagiosum virus
gcugcaagauuguagaga

SEQ ID NO: 3092418 - RNA, 15 nt, Molluscum contagiosum virus
cauuccuuguccugg

SEQ ID NO: 3092419 - RNA, 22 nt, Molluscum contagiosum virus
ccuguucggcaugcagcgcagg

SEQ ID NO: 3092420 - RNA, 14 nt, Molluscum contagiosum virus
ucaccagccugcuc

SEQ ID NO: 3092421 - RNA, 18 nt, Molluscum contagiosum virus
gccucagccgagcgccgc

SEQ ID NO: 3092422 - RNA, 13 nt, Molluscum contagiosum virus
ucaagaagaacaa

SEQ ID NO: 3092423 - RNA, 20 nt, Molluscum contagiosum virus
gagcagguucucgcacagua

SEQ ID NO: 3092424 - RNA, 13 nt, Molluscum contagiosum virus
gagugcugagcca

SEQ ID NO: 3092425 - RNA, 21 nt, Molluscum contagiosum virus
cuugauuucgcgcagcaggca

SEQ ID NO: 3092426 - RNA, 17 nt, Molluscum contagiosum virus
gccgcgcuucgagcacg

SEQ ID NO: 3092427 - RNA, 13 nt, Molluscum contagiosum virus
cggccgcggacca

SEQ ID NO: 3092428 - RNA, 16 nt, Molluscum contagiosum virus
ccucccaagcagcgcg

SEQ ID NO: 3092429 - RNA, 14 nt, Molluscum contagiosum virus
ccuucuugcuggcg

SEQ ID NO: 3092430 - RNA, 22 nt, Molluscum contagiosum virus
ggcucgcucaucaccgacacgc

SEQ ID NO: 3092431 - RNA, 17 nt, Molluscum contagiosum virus
gagcuccgcgcaugcca

SEQ ID NO: 3092432 - RNA, 15 nt, Molluscum contagiosum virus
ggcgacacggagacg

SEQ ID NO: 3092433 - RNA, 21 nt, Molluscum contagiosum virus
ucuucgggaaggaacaaugcu

SEQ ID NO: 3092434 - RNA, 12 nt, Molluscum contagiosum virus
gaggugugccug

SEQ ID NO: 3092435 - RNA, 18 nt, Molluscum contagiosum virus
ggugugcacaugcccgug

SEQ ID NO: 3092436 - RNA, 12 nt, Molluscum contagiosum virus
gagagccuucgu

SEQ ID NO: 3092437 - RNA, 13 nt, Molluscum contagiosum virus
uccggagccaagc

SEQ ID NO: 3092438 - RNA, 18 nt, Molluscum contagiosum virus
accucaccgcgcacaucu

SEQ ID NO: 3092439 - RNA, 21 nt, Molluscum contagiosum virus
ucccgcggccgccacuguugc

SEQ ID NO: 3092440 - RNA, 21 nt, Molluscum contagiosum virus
cugcugcacagcuuccuggag

SEQ ID NO: 3092441 - RNA, 16 nt, Molluscum contagiosum virus
gaaaucgcaaagcacg

SEQ ID NO: 3092442 - RNA, 16 nt, Molluscum contagiosum virus
cgcugggccgcaugca

SEQ ID NO: 3092443 - RNA, 18 nt, Molluscum contagiosum virus
gcaccgcaugggcccugg

SEQ ID NO: 3092444 - RNA, 14 nt, Molluscum contagiosum virus
cccacugugccagc

SEQ ID NO: 3092445 - RNA, 21 nt, Molluscum contagiosum virus
cggccgggaucggacgcagac

SEQ ID NO: 3092446 - RNA, 17 nt, Molluscum contagiosum virus
uacacgcacgaccucac

SEQ ID NO: 3092447 - RNA, 20 nt, Molluscum contagiosum virus
cgcccgccagcauggcgagc

SEQ ID NO: 3092448 - RNA, 19 nt, Molluscum contagiosum virus
cucgcuggugugcacugau

SEQ ID NO: 3092449 - RNA, 15 nt, Molluscum contagiosum virus
uggacgugcugcugg

SEQ ID NO: 3092450 - RNA, 21 nt, Molluscum contagiosum virus
gaacagagaaaggcacccacc

SEQ ID NO: 3092451 - RNA, 15 nt, Molluscum contagiosum virus
cgccggcucugccuc

SEQ ID NO: 3092452 - RNA, 16 nt, Molluscum contagiosum virus
ggcucaagucgcccuu

SEQ ID NO: 3092453 - RNA, 22 nt, Molluscum contagiosum virus
ccguguauccaagaggccguca

SEQ ID NO: 3092454 - RNA, 22 nt, Molluscum contagiosum virus
cuccggcgucgaaacacugcgg

SEQ ID NO: 3092455 - RNA, 13 nt, Molluscum contagiosum virus
aucagagaagugc

SEQ ID NO: 3092456 - RNA, 17 nt, Molluscum contagiosum virus
gagacgugcggcacgcu

SEQ ID NO: 3092457 - RNA, 18 nt, Molluscum contagiosum virus
cgggcugcgcggcggugu

SEQ ID NO: 3092458 - RNA, 18 nt, Molluscum contagiosum virus
cggaauuccuugugcaau

SEQ ID NO: 3092459 - RNA, 20 nt, Molluscum contagiosum virus
ccgacccaucggagaagugc

SEQ ID NO: 3092460 - RNA, 14 nt, Molluscum contagiosum virus
ggacagcggaagaa

SEQ ID NO: 3092461 - RNA, 14 nt, Molluscum contagiosum virus
ugcgagcggcgcgc

SEQ ID NO: 3092462 - RNA, 14 nt, Molluscum contagiosum virus
cucuaccuggugcu

SEQ ID NO: 3092463 - RNA, 23 nt, Molluscum contagiosum virus
ucaguuuuguccuccccacgaga

SEQ ID NO: 3092464 - RNA, 14 nt, Molluscum contagiosum virus
gugguccaccagcu

SEQ ID NO: 3092465 - RNA, 18 nt, Molluscum contagiosum virus
cgcaaggaaaacugcauc

SEQ ID NO: 3092466 - RNA, 20 nt, Molluscum contagiosum virus
cagguagugguccaccagcu

SEQ ID NO: 3092467 - RNA, 16 nt, Molluscum contagiosum virus
gcacaagauggcgcag

SEQ ID NO: 3092468 - RNA, 22 nt, Molluscum contagiosum virus
cugcgcccgcaaaccuuggccc

SEQ ID NO: 3092469 - RNA, 23 nt, Molluscum contagiosum virus
cugagaggaccucccggcggcaa

SEQ ID NO: 3092470 - RNA, 16 nt, Molluscum contagiosum virus
cagacgcagagccaug

SEQ ID NO: 3092471 - RNA, 15 nt, Molluscum contagiosum virus
acggacccgcgaacg

SEQ ID NO: 3092472 - RNA, 18 nt, Molluscum contagiosum virus
caacguggcgcugaccuc

SEQ ID NO: 3092473 - RNA, 15 nt, Molluscum contagiosum virus
gcacggccggcgccg

SEQ ID NO: 3092474 - RNA, 16 nt, Molluscum contagiosum virus
gagcgaguugagcagg

SEQ ID NO: 3092475 - RNA, 16 nt, Molluscum contagiosum virus
acaguggcugugcgcc

SEQ ID NO: 3092476 - RNA, 13 nt, Molluscum contagiosum virus
cacaugugcugcc

SEQ ID NO: 3092477 - RNA, 13 nt, Molluscum contagiosum virus
uguacuugcuucc

SEQ ID NO: 3092478 - RNA, 22 nt, Molluscum contagiosum virus
ccugccgcgagcacuggcuggc

SEQ ID NO: 3092479 - RNA, 15 nt, Molluscum contagiosum virus
gcacauucucaacca

SEQ ID NO: 3092480 - RNA, 17 nt, Molluscum contagiosum virus
gugcauacgcagaggcg

SEQ ID NO: 3092481 - RNA, 17 nt, Molluscum contagiosum virus
guccgagccggacgcgc

SEQ ID NO: 3092482 - RNA, 15 nt, Molluscum contagiosum virus
cugcucgugcugcuc

SEQ ID NO: 3092483 - RNA, 15 nt, Molluscum contagiosum virus
cucgucgccgggccc

SEQ ID NO: 3092484 - RNA, 19 nt, Molluscum contagiosum virus
ccucgccaaagaggacgug

SEQ ID NO: 3092485 - RNA, 18 nt, Molluscum contagiosum virus
gccgucgcgagcuuggcc

SEQ ID NO: 3092486 - RNA, 16 nt, Molluscum contagiosum virus
cuugagcaccaagaag

SEQ ID NO: 3092487 - RNA, 17 nt, Molluscum contagiosum virus
gcgcgaguacaagcucg

SEQ ID NO: 3092488 - RNA, 14 nt, Molluscum contagiosum virus
ugcgcacagacggc

SEQ ID NO: 3092489 - RNA, 15 nt, Molluscum contagiosum virus
gccugccaucuacga

SEQ ID NO: 3092490 - RNA, 17 nt, Molluscum contagiosum virus
gcuggccgugcccgccg

SEQ ID NO: 3092491 - RNA, 18 nt, Molluscum contagiosum virus
gagacgugcggcacgcug

SEQ ID NO: 3092492 - RNA, 23 nt, Molluscum contagiosum virus
gccggcguucacggacucgagcc

SEQ ID NO: 3092493 - RNA, 21 nt, Molluscum contagiosum virus
ugcgcgucaugcgacugccag

SEQ ID NO: 3092494 - RNA, 19 nt, Molluscum contagiosum virus
ccgaugugagcaagcugca

SEQ ID NO: 3092495 - RNA, 15 nt, Molluscum contagiosum virus
uguugcguagagcaa

SEQ ID NO: 3092496 - RNA, 21 nt, Molluscum contagiosum virus
agacuuucugcagucagauug

SEQ ID NO: 3092497 - RNA, 22 nt, Molluscum contagiosum virus
gccaggcacacgcagugccacg

SEQ ID NO: 3092498 - RNA, 15 nt, Molluscum contagiosum virus
uggaaggcgaccagc

SEQ ID NO: 3092499 - RNA, 17 nt, Molluscum contagiosum virus
cugcacgacguacgagu

SEQ ID NO: 3092500 - RNA, 18 nt, Molluscum contagiosum virus
cggcaagccgugcuuugc

SEQ ID NO: 3092501 - RNA, 16 nt, Molluscum contagiosum virus
uguucuggucuggaaa

SEQ ID NO: 3092502 - RNA, 17 nt, Molluscum contagiosum virus
ccgcgggcgcagagccu

SEQ ID NO: 3092503 - RNA, 20 nt, Molluscum contagiosum virus
ggucguguacacgccgggaa

SEQ ID NO: 3092504 - RNA, 19 nt, Molluscum contagiosum virus
guccgcggacgcgggccug

SEQ ID NO: 3092505 - RNA, 17 nt, Molluscum contagiosum virus
gacaacucgcgggcaug

SEQ ID NO: 3092506 - RNA, 13 nt, Molluscum contagiosum virus
gcugcgcuaccac

SEQ ID NO: 3092507 - RNA, 18 nt, Molluscum contagiosum virus
agaaugacuuagccacug

SEQ ID NO: 3092508 - RNA, 17 nt, Molluscum contagiosum virus
ggcgcgaagcaggcgcc

SEQ ID NO: 3092509 - RNA, 17 nt, Molluscum contagiosum virus
gggaugcgcacacuugc

SEQ ID NO: 3092510 - RNA, 21 nt, Molluscum contagiosum virus
ggcggcacccgccgcggugcc

SEQ ID NO: 3092511 - RNA, 18 nt, Molluscum contagiosum virus
ucaaaggcaaagccugcu

SEQ ID NO: 3092512 - RNA, 21 nt, Molluscum contagiosum virus
gcgacuccuuugcgagcacug

SEQ ID NO: 3092513 - RNA, 21 nt, Molluscum contagiosum virus
cgugucacaauggcacuagcc

SEQ ID NO: 3092514 - RNA, 16 nt, Molluscum contagiosum virus
ccacuccgucgcgcuc

SEQ ID NO: 3092515 - RNA, 15 nt, Molluscum contagiosum virus
gaggacacgcgcacg

SEQ ID NO: 3092516 - RNA, 15 nt, Molluscum contagiosum virus
ugcgugcccagcagg

SEQ ID NO: 3092517 - RNA, 13 nt, Molluscum contagiosum virus
gcgcccgacucgc

SEQ ID NO: 3092518 - RNA, 21 nt, Molluscum contagiosum virus
ggaugaacaccauccugcgcu

SEQ ID NO: 3092519 - RNA, 17 nt, Molluscum contagiosum virus
gcgaacgccagaaaaca

SEQ ID NO: 3092520 - RNA, 23 nt, Molluscum contagiosum virus
gaaugacuuagccacugugcuga

SEQ ID NO: 3092521 - RNA, 15 nt, Molluscum contagiosum virus
ggacgcacagggcug

SEQ ID NO: 3092522 - RNA, 20 nt, Molluscum contagiosum virus
uggaccgguuccgugcgcuc

SEQ ID NO: 3092523 - RNA, 19 nt, Molluscum contagiosum virus
acgcgccucgagcagguca

SEQ ID NO: 3092524 - RNA, 22 nt, Molluscum contagiosum virus
cggcgccacgagcgccgcgacg

SEQ ID NO: 3092525 - RNA, 15 nt, Molluscum contagiosum virus
acgacggcugcucgc

SEQ ID NO: 3092526 - RNA, 16 nt, Molluscum contagiosum virus
ugcgcgugccucugcc

SEQ ID NO: 3092527 - RNA, 12 nt, Molluscum contagiosum virus
gucgcacuggcc

SEQ ID NO: 3092528 - RNA, 17 nt, Molluscum contagiosum virus
ggugcuggugcugguca

SEQ ID NO: 3092529 - RNA, 14 nt, Molluscum contagiosum virus
aagaccaccagcac

SEQ ID NO: 3092530 - RNA, 19 nt, Molluscum contagiosum virus
gggaacgaggaaaggcacc

SEQ ID NO: 3092531 - RNA, 22 nt, Molluscum contagiosum virus
gcuggcgcucggcguggugcug

SEQ ID NO: 3092532 - RNA, 19 nt, Molluscum contagiosum virus
caaggaaaggcaccugcag

SEQ ID NO: 3092533 - RNA, 19 nt, Molluscum contagiosum virus
gccuggccgaacugcucug

SEQ ID NO: 3092534 - RNA, 14 nt, Molluscum contagiosum virus
caccgcacgccagc

SEQ ID NO: 3092535 - RNA, 17 nt, Molluscum contagiosum virus
cggacgcgggccugucc

SEQ ID NO: 3092536 - RNA, 17 nt, Molluscum contagiosum virus
cugagccgcaagcacac

SEQ ID NO: 3092537 - RNA, 17 nt, Molluscum contagiosum virus
agcgccacgagcagugc

SEQ ID NO: 3092538 - RNA, 19 nt, Molluscum contagiosum virus
gcagagugaaucuugccug

SEQ ID NO: 3092539 - RNA, 18 nt, Molluscum contagiosum virus
ccgcaugggcccuggcgg

SEQ ID NO: 3092540 - RNA, 20 nt, Molluscum contagiosum virus
acccguggccgagccgcugg

SEQ ID NO: 3092541 - RNA, 18 nt, Molluscum contagiosum virus
gccugcacuacugcucca

SEQ ID NO: 3092542 - RNA, 18 nt, Molluscum contagiosum virus
gcacgcgaaguuccugca

SEQ ID NO: 3092543 - RNA, 16 nt, Molluscum contagiosum virus
augcgacugccagcca

SEQ ID NO: 3092544 - RNA, 14 nt, Molluscum contagiosum virus
aggcgcgugcccug

SEQ ID NO: 3092545 - RNA, 19 nt, Molluscum contagiosum virus
agcgguguugcuguuucca

SEQ ID NO: 3092546 - RNA, 21 nt, Molluscum contagiosum virus
cgugagagcaaagaaugcaug

SEQ ID NO: 3092547 - RNA, 16 nt, Molluscum contagiosum virus
gcgucaucgcugcacg

SEQ ID NO: 3092548 - RNA, 18 nt, Molluscum contagiosum virus
ggacacguugcagcagca

SEQ ID NO: 3092549 - RNA, 17 nt, Molluscum contagiosum virus
ucagcgcgcgcagcacc

SEQ ID NO: 3092550 - RNA, 15 nt, Molluscum contagiosum virus
cucgacaaugagcac

SEQ ID NO: 3092551 - RNA, 20 nt, Molluscum contagiosum virus
ucgggugcccggacagagcc

SEQ ID NO: 3092552 - RNA, 12 nt, Molluscum contagiosum virus
guugcugcugcc

SEQ ID NO: 3092553 - RNA, 20 nt, Molluscum contagiosum virus
agcuucgucuucaccugcau

SEQ ID NO: 3092554 - RNA, 12 nt, Molluscum contagiosum virus
cgagcucuccga

SEQ ID NO: 3092555 - RNA, 16 nt, Molluscum contagiosum virus
gucgugcaccuggagc

SEQ ID NO: 3092556 - RNA, 23 nt, Molluscum contagiosum virus
agugcuuugucgcaaccccgcgc

SEQ ID NO: 3092557 - RNA, 20 nt, Molluscum contagiosum virus
uccucuacaccagcuggacg

SEQ ID NO: 3092558 - RNA, 12 nt, Molluscum contagiosum virus
uaacaaggaaaa

SEQ ID NO: 3092559 - RNA, 20 nt, Molluscum contagiosum virus
uguuccguucgucagaggga

SEQ ID NO: 3092560 - RNA, 18 nt, Molluscum contagiosum virus
ccucgagaaagucaugcu

SEQ ID NO: 3092561 - RNA, 14 nt, Molluscum contagiosum virus
cggcgcgaaaaguc

SEQ ID NO: 3092562 - RNA, 13 nt, Molluscum contagiosum virus
aucgcgcugcugg

SEQ ID NO: 3092563 - RNA, 12 nt, Molluscum contagiosum virus
gagaaaggcacc

SEQ ID NO: 3092564 - RNA, 16 nt, Molluscum contagiosum virus
cucgucuugcgcgcca

SEQ ID NO: 3092565 - RNA, 23 nt, Molluscum contagiosum virus
ccuccgguuuucgcgggagcggc

SEQ ID NO: 3092566 - RNA, 20 nt, Molluscum contagiosum virus
cgcgggcgcgcgccagcagc

SEQ ID NO: 3092567 - RNA, 15 nt, Molluscum contagiosum virus
gcaauggcgcgcagc

SEQ ID NO: 3092568 - RNA, 20 nt, Molluscum contagiosum virus
gcucgaggaccucgcgcgcc

SEQ ID NO: 3092569 - RNA, 12 nt, Molluscum contagiosum virus
uggacacgugcg

SEQ ID NO: 3092570 - RNA, 17 nt, Molluscum contagiosum virus
ucgccgcgcgcgccagc

SEQ ID NO: 3092571 - RNA, 13 nt, Molluscum contagiosum virus
cgguacugcugca

SEQ ID NO: 3092572 - RNA, 14 nt, Molluscum contagiosum virus
aguaccugcugccg

SEQ ID NO: 3092573 - RNA, 11 nt, Molluscum contagiosum virus
gaaggcggcga

SEQ ID NO: 3092574 - RNA, 18 nt, Molluscum contagiosum virus
acacuugcacgcgcacgc

SEQ ID NO: 3092575 - RNA, 20 nt, Molluscum contagiosum virus
ccagugcgccucggacuucg

SEQ ID NO: 3092576 - RNA, 15 nt, Molluscum contagiosum virus
gcccggcgcccgcag

SEQ ID NO: 3092577 - RNA, 12 nt, Molluscum contagiosum virus
cggccuggccac

SEQ ID NO: 3092578 - RNA, 15 nt, Molluscum contagiosum virus
gcgagcgcgcgcugc

SEQ ID NO: 3092579 - RNA, 17 nt, Molluscum contagiosum virus
gcuucgccgcgcgcgcc

SEQ ID NO: 3092580 - RNA, 13 nt, Molluscum contagiosum virus
agcgcuggagcug

SEQ ID NO: 3092581 - RNA, 22 nt, Molluscum contagiosum virus
aguguugugaaguccucucucc

SEQ ID NO: 3092582 - RNA, 16 nt, Molluscum contagiosum virus
cguguuccggcagcgc

SEQ ID NO: 3092583 - RNA, 13 nt, Molluscum contagiosum virus
gaggaaaggcaca

SEQ ID NO: 3092584 - RNA, 20 nt, Molluscum contagiosum virus
ugccgcucgcuguccuuccg

SEQ ID NO: 3092585 - RNA, 22 nt, Molluscum contagiosum virus
ccagcgcgcgccuugcagcgca

SEQ ID NO: 3092586 - RNA, 12 nt, Molluscum contagiosum virus
gcugucucuguc

SEQ ID NO: 3092587 - RNA, 20 nt, Molluscum contagiosum virus
uccgaggaaacgcagcacuu

SEQ ID NO: 3092588 - RNA, 22 nt, Molluscum contagiosum virus
agcgcuggagcuggcugggcac

SEQ ID NO: 3092589 - RNA, 21 nt, Molluscum contagiosum virus
gcgcaccugcacgagccggcg

SEQ ID NO: 3092590 - RNA, 22 nt, Molluscum contagiosum virus
ugcacgacguacgagugcugga

SEQ ID NO: 3092591 - RNA, 23 nt, Molluscum contagiosum virus
acugucucugcgcgagcagcugc

SEQ ID NO: 3092592 - RNA, 23 nt, Molluscum contagiosum virus
gccacgcgggcccgugcucaggc

SEQ ID NO: 3092593 - RNA, 12 nt, Molluscum contagiosum virus
gagacggcagug

SEQ ID NO: 3092594 - RNA, 16 nt, Molluscum contagiosum virus
gcuugcuuccggugcc

SEQ ID NO: 3092595 - RNA, 14 nt, Molluscum contagiosum virus
cuaccugaagcugg

SEQ ID NO: 3092596 - RNA, 16 nt, Molluscum contagiosum virus
agacugacgccgaugu

SEQ ID NO: 3092597 - RNA, 15 nt, Molluscum contagiosum virus
gucgugcaggccgug

SEQ ID NO: 3092598 - RNA, 21 nt, Molluscum contagiosum virus
gccgcacaaccacagcucucc

SEQ ID NO: 3092599 - RNA, 12 nt, Molluscum contagiosum virus
agaauagcuggg

SEQ ID NO: 3092600 - RNA, 11 nt, Molluscum contagiosum virus
caccaggaaca

SEQ ID NO: 3092601 - RNA, 20 nt, Molluscum contagiosum virus
gcauguccuuggcggugcgc

SEQ ID NO: 3092602 - RNA, 18 nt, Molluscum contagiosum virus
cauccuggggaaccgcug

SEQ ID NO: 3092603 - RNA, 17 nt, Molluscum contagiosum virus
cucgggccggcgcgccg

SEQ ID NO: 3092604 - RNA, 23 nt, Molluscum contagiosum virus
caggagccucuguccugcgugcu

SEQ ID NO: 3092605 - RNA, 15 nt, Molluscum contagiosum virus
ggaacugacugcugc

SEQ ID NO: 3092606 - RNA, 15 nt, Molluscum contagiosum virus
ucgcagugcccgggg

SEQ ID NO: 3092607 - RNA, 23 nt, Molluscum contagiosum virus
cagagcgugcuggucaacagcua

SEQ ID NO: 3092608 - RNA, 21 nt, Molluscum contagiosum virus
ucgugccgccugcgcgcaccc

SEQ ID NO: 3092609 - RNA, 15 nt, Molluscum contagiosum virus
caguaccagauuagc

SEQ ID NO: 3092610 - RNA, 18 nt, Molluscum contagiosum virus
gcgccuuuuccgcgaagu

SEQ ID NO: 3092611 - RNA, 20 nt, Molluscum contagiosum virus
ugcggacgcaggaugcuggg

SEQ ID NO: 3092612 - RNA, 15 nt, Molluscum contagiosum virus
cgcggcacugggugc

SEQ ID NO: 3092613 - RNA, 15 nt, Molluscum contagiosum virus
agcaggcacuccagc

SEQ ID NO: 3092614 - RNA, 14 nt, Molluscum contagiosum virus
gaacucgcugcugc

SEQ ID NO: 3092615 - RNA, 17 nt, Molluscum contagiosum virus
ccgcgugcgccgccgca

SEQ ID NO: 3092616 - RNA, 21 nt, Molluscum contagiosum virus
acccuuaacucguagcuagcg

SEQ ID NO: 3092617 - RNA, 14 nt, Molluscum contagiosum virus
ccgcaccagugccg

SEQ ID NO: 3092618 - RNA, 19 nt, Molluscum contagiosum virus
cugcgcaucugcgagcgcg

SEQ ID NO: 3092619 - RNA, 21 nt, Molluscum contagiosum virus
cgcgcacgcggcgcucguggc

SEQ ID NO: 3092620 - RNA, 22 nt, Molluscum contagiosum virus
ggagagguugcgcggggcaggc

SEQ ID NO: 3092621 - RNA, 12 nt, Molluscum contagiosum virus
aggcccaggcca

SEQ ID NO: 3092622 - RNA, 15 nt, Molluscum contagiosum virus
cucgugccacugccg

SEQ ID NO: 3092623 - RNA, 14 nt, Molluscum contagiosum virus
auccugguuccucu

SEQ ID NO: 3092624 - RNA, 17 nt, Molluscum contagiosum virus
gcgaguucugccggcuc

SEQ ID NO: 3092625 - RNA, 20 nt, Molluscum contagiosum virus
gcaacaaggaaaggcacccg

SEQ ID NO: 3092626 - RNA, 20 nt, Molluscum contagiosum virus
aggaugccugccagcagagc

SEQ ID NO: 3092627 - RNA, 17 nt, Molluscum contagiosum virus
ggccucugccugcaagg

SEQ ID NO: 3092628 - RNA, 17 nt, Molluscum contagiosum virus
aaaagcacaguccaacc

SEQ ID NO: 3092629 - RNA, 16 nt, Molluscum contagiosum virus
guccaggcgcugcacg

SEQ ID NO: 3092630 - RNA, 21 nt, Molluscum contagiosum virus
gcugcccgcgcgcgacuacgc

SEQ ID NO: 3092631 - RNA, 15 nt, Molluscum contagiosum virus
cgagcaguccgccuc

SEQ ID NO: 3092632 - RNA, 13 nt, Molluscum contagiosum virus
cuccggggcgcaa

SEQ ID NO: 3092633 - RNA, 15 nt, Molluscum contagiosum virus
gccgccgcuggggcg

SEQ ID NO: 3092634 - RNA, 18 nt, Molluscum contagiosum virus
cacgcuacggcugccggc

SEQ ID NO: 3092635 - RNA, 13 nt, Molluscum contagiosum virus
cgccgcuggagca

SEQ ID NO: 3092636 - RNA, 16 nt, Molluscum contagiosum virus
caccgcguggcgcgcg

SEQ ID NO: 3092637 - RNA, 23 nt, Molluscum contagiosum virus
guacgcaacuugugcgcccccgc

SEQ ID NO: 3092638 - RNA, 18 nt, Molluscum contagiosum virus
cgaggaauuugcccccac

SEQ ID NO: 3092639 - RNA, 17 nt, Molluscum contagiosum virus
caugucgcggugcgugc

SEQ ID NO: 3092640 - RNA, 19 nt, Molluscum contagiosum virus
gcaggucaucgacgagcac

SEQ ID NO: 3092641 - RNA, 20 nt, Molluscum contagiosum virus
accaugcucucgcugcugcc

SEQ ID NO: 3092642 - RNA, 15 nt, Molluscum contagiosum virus
cgcacgaggagcccc

SEQ ID NO: 3092643 - RNA, 16 nt, Molluscum contagiosum virus
ugcugcugcagaacug

SEQ ID NO: 3092644 - RNA, 21 nt, Molluscum contagiosum virus
uggaguccaugcccacgcgca

SEQ ID NO: 3092645 - RNA, 20 nt, Molluscum contagiosum virus
guggcacccuggcugcugcg

SEQ ID NO: 3092646 - RNA, 19 nt, Molluscum contagiosum virus
agccucaucgugagccugg

SEQ ID NO: 3092647 - RNA, 16 nt, Molluscum contagiosum virus
accacgguccugggcg

SEQ ID NO: 3092648 - RNA, 23 nt, Molluscum contagiosum virus
aucaccagcuacgagccgcugcu

SEQ ID NO: 3092649 - RNA, 22 nt, Molluscum contagiosum virus
gacacguugcagcagcacaggu

SEQ ID NO: 3092650 - RNA, 17 nt, Molluscum contagiosum virus
cgggcccgccuuugugg

SEQ ID NO: 3092651 - RNA, 21 nt, Molluscum contagiosum virus
cagcggcgccaccggcagugc

SEQ ID NO: 3092652 - RNA, 16 nt, Molluscum contagiosum virus
gcgagcagaggcaugc

SEQ ID NO: 3092653 - RNA, 12 nt, Molluscum contagiosum virus
ugggcccgccuc

SEQ ID NO: 3092654 - RNA, 22 nt, Molluscum contagiosum virus
cugcuacaagcggugcagcuac

SEQ ID NO: 3092655 - RNA, 16 nt, Molluscum contagiosum virus
gggaccucuuucucgc

SEQ ID NO: 3092656 - RNA, 23 nt, Molluscum contagiosum virus
cccgcaggaaagguacccgcagg

SEQ ID NO: 3092657 - RNA, 22 nt, Molluscum contagiosum virus
gccgccggugcgugcccagcag

SEQ ID NO: 3092658 - RNA, 14 nt, Molluscum contagiosum virus
guagcgugcgccug

SEQ ID NO: 3092659 - RNA, 21 nt, Molluscum contagiosum virus
gugugccuguuugccacggcc

SEQ ID NO: 3092660 - RNA, 21 nt, Molluscum contagiosum virus
ugcgcucggaggggcuccggg

SEQ ID NO: 3092661 - RNA, 16 nt, Molluscum contagiosum virus
cgcgcaaaagcacagc

SEQ ID NO: 3092662 - RNA, 18 nt, Molluscum contagiosum virus
aagcuucgggccgcugcc

SEQ ID NO: 3092663 - RNA, 13 nt, Molluscum contagiosum virus
ggaggcgcuagug

SEQ ID NO: 3092664 - RNA, 15 nt, Molluscum contagiosum virus
gaagcccagcuucag

SEQ ID NO: 3092665 - RNA, 20 nt, Molluscum contagiosum virus
cgggugcccggacagagccc

SEQ ID NO: 3092666 - RNA, 16 nt, Molluscum contagiosum virus
gcgagcacgccugcac

SEQ ID NO: 3092667 - RNA, 19 nt, Molluscum contagiosum virus
acaugcgugcuagcccgca

SEQ ID NO: 3092668 - RNA, 22 nt, Molluscum contagiosum virus
gcaccugcuagagcauauccug

SEQ ID NO: 3092669 - RNA, 20 nt, Molluscum contagiosum virus
gggcagcucaagcugcucau

SEQ ID NO: 3092670 - RNA, 13 nt, Molluscum contagiosum virus
cagcaagcucgau

SEQ ID NO: 3092671 - RNA, 14 nt, Molluscum contagiosum virus
cagguggagcuguc

SEQ ID NO: 3092672 - RNA, 15 nt, Molluscum contagiosum virus
ccagucucgcgcuuc

SEQ ID NO: 3092673 - RNA, 21 nt, Molluscum contagiosum virus
aaaaagcugucgcgcagcagc

SEQ ID NO: 3092674 - RNA, 23 nt, Molluscum contagiosum virus
ggcaagaccaucaucgcgcugcu

SEQ ID NO: 3092675 - RNA, 15 nt, Molluscum contagiosum virus
ccgcgcgcucgcgcu

SEQ ID NO: 3092676 - RNA, 10 nt, Molluscum contagiosum virus
uuggccaggc

SEQ ID NO: 3092677 - RNA, 12 nt, Molluscum contagiosum virus
ggaugcgcacac

SEQ ID NO: 3092678 - RNA, 19 nt, Molluscum contagiosum virus
ccugcgccauccacguggg

SEQ ID NO: 3092679 - RNA, 17 nt, Molluscum contagiosum virus
gauaaaguccucugaag

SEQ ID NO: 3092680 - RNA, 17 nt, Molluscum contagiosum virus
gacuggccucguccugg

SEQ ID NO: 3092681 - RNA, 16 nt, Molluscum contagiosum virus
ggcgcgugcugagcua

SEQ ID NO: 3092682 - RNA, 21 nt, Molluscum contagiosum virus
gccagcucgacacugugcugg

SEQ ID NO: 3092683 - RNA, 14 nt, Molluscum contagiosum virus
ucgcagcguuccag

SEQ ID NO: 3092684 - RNA, 23 nt, Molluscum contagiosum virus
caaccgccugcucucgcgcgcca

SEQ ID NO: 3092685 - RNA, 18 nt, Molluscum contagiosum virus
gugggcagccgccuggcc

SEQ ID NO: 3092686 - RNA, 16 nt, Molluscum contagiosum virus
uucuaggccucagccg

SEQ ID NO: 3092687 - RNA, 17 nt, Molluscum contagiosum virus
acucucccgggcucugu

SEQ ID NO: 3092688 - RNA, 11 nt, Molluscum contagiosum virus
gcgguggugca

SEQ ID NO: 3092689 - RNA, 19 nt, Molluscum contagiosum virus
ggcgcaccugcuagagcau

SEQ ID NO: 3092690 - RNA, 19 nt, Molluscum contagiosum virus
ugcgcaacgcgggccaggc

SEQ ID NO: 3092691 - RNA, 16 nt, Molluscum contagiosum virus
uggaauugugcugcug

SEQ ID NO: 3092692 - RNA, 18 nt, Molluscum contagiosum virus
cgcguggcgaucugcucg

SEQ ID NO: 3092693 - RNA, 16 nt, Molluscum contagiosum virus
cugcgcuccgacgcgg

SEQ ID NO: 3092694 - RNA, 17 nt, Molluscum contagiosum virus
gcuacccguugcugcgc

SEQ ID NO: 3092695 - RNA, 18 nt, Molluscum contagiosum virus
cgucuuccccaagaccug

SEQ ID NO: 3092696 - RNA, 20 nt, Molluscum contagiosum virus
cgggcucgaggugugccugu

SEQ ID NO: 3092697 - RNA, 15 nt, Molluscum contagiosum virus
cugugcggagggugc

SEQ ID NO: 3092698 - RNA, 15 nt, Molluscum contagiosum virus
cggcucuggagcggc

SEQ ID NO: 3092699 - RNA, 23 nt, Molluscum contagiosum virus
cagcguguugcuguuccacauca

SEQ ID NO: 3092700 - RNA, 23 nt, Molluscum contagiosum virus
cuggcgcuaccuaccggcagcau

SEQ ID NO: 3092701 - RNA, 20 nt, Molluscum contagiosum virus
cugcucgcugccuggugcac

SEQ ID NO: 3092702 - RNA, 22 nt, Molluscum contagiosum virus
cuccgagcgcgcgcgcugcugg

SEQ ID NO: 3092703 - RNA, 19 nt, Molluscum contagiosum virus
cucgcgugccgcggacgcc

SEQ ID NO: 3092704 - RNA, 15 nt, Molluscum contagiosum virus
gcaccacgugcgcug

SEQ ID NO: 3092705 - RNA, 12 nt, Molluscum contagiosum virus
gugcucggcgug

SEQ ID NO: 3092706 - RNA, 24 nt, Molluscum contagiosum virus
ggcgacgcguacguguccaugcac

SEQ ID NO: 3092707 - RNA, 14 nt, Molluscum contagiosum virus
cggcuagaccuccu

SEQ ID NO: 3092708 - RNA, 19 nt, Molluscum contagiosum virus
gcgcuucuauugccgcgug

SEQ ID NO: 3092709 - RNA, 19 nt, Molluscum contagiosum virus
acuccgcgaggagauucgc

SEQ ID NO: 3092710 - RNA, 13 nt, Molluscum contagiosum virus
gcucgcuugcccg

SEQ ID NO: 3092711 - RNA, 13 nt, Molluscum contagiosum virus
acugcagcagcuc

SEQ ID NO: 3092712 - RNA, 14 nt, Molluscum contagiosum virus
cuccauggagcgcc

SEQ ID NO: 3092713 - RNA, 18 nt, Molluscum contagiosum virus
cgacaggaacgcaccacg

SEQ ID NO: 3092714 - RNA, 13 nt, Molluscum contagiosum virus
agcucggguucca

SEQ ID NO: 3092715 - RNA, 19 nt, Molluscum contagiosum virus
cguacgagcaggcgcagcg

SEQ ID NO: 3092716 - RNA, 15 nt, Molluscum contagiosum virus
ucguccuggagccua

SEQ ID NO: 3092717 - RNA, 14 nt, Molluscum contagiosum virus
gacgggcacgagca

SEQ ID NO: 3092718 - RNA, 16 nt, Molluscum contagiosum virus
cccccagguggagcug

SEQ ID NO: 3092719 - RNA, 10 nt, Molluscum contagiosum virus
gcacaccccu

SEQ ID NO: 3092720 - RNA, 19 nt, Molluscum contagiosum virus
caggcgcgaacucgcggca

SEQ ID NO: 3092721 - RNA, 16 nt, Molluscum contagiosum virus
agcgcagcacacuugu

SEQ ID NO: 3092722 - RNA, 22 nt, Molluscum contagiosum virus
cgcgcccccgugucggcgaaga

SEQ ID NO: 3092723 - RNA, 15 nt, Molluscum contagiosum virus
cagcuguuucugccg

SEQ ID NO: 3092724 - RNA, 15 nt, Molluscum contagiosum virus
cgaccuggaagccgc

SEQ ID NO: 3092725 - RNA, 15 nt, Molluscum contagiosum virus
aaaugcgcacacuug

SEQ ID NO: 3092726 - RNA, 19 nt, Molluscum contagiosum virus
cugccguuuuacacagggc

SEQ ID NO: 3092727 - RNA, 23 nt, Molluscum contagiosum virus
gucgcagcagcggucucggcagc

SEQ ID NO: 3092728 - RNA, 17 nt, Molluscum contagiosum virus
ccugcucgggcugcgcg

SEQ ID NO: 3092729 - RNA, 20 nt, Molluscum contagiosum virus
gacaaggaaaggcacccacc

SEQ ID NO: 3092730 - RNA, 22 nt, Molluscum contagiosum virus
cucaguugcgacggaaccgugg

SEQ ID NO: 3092731 - RNA, 14 nt, Molluscum contagiosum virus
uacuugcugguugc

SEQ ID NO: 3092732 - RNA, 18 nt, Molluscum contagiosum virus
agcaggcgccaucgcgcg

SEQ ID NO: 3092733 - RNA, 19 nt, Molluscum contagiosum virus
accgcguccgcuaccgcag

SEQ ID NO: 3092734 - RNA, 19 nt, Molluscum contagiosum virus
acuaccgcaaccagcugcu

SEQ ID NO: 3092735 - RNA, 14 nt, Molluscum contagiosum virus
cgacguggagccug

SEQ ID NO: 3092736 - RNA, 18 nt, Molluscum contagiosum virus
cugcgcgcacugcucgcg

SEQ ID NO: 3092737 - RNA, 18 nt, Molluscum contagiosum virus
cuucuucgcgagccacuc

SEQ ID NO: 3092738 - RNA, 13 nt, Molluscum contagiosum virus
ucucugcauguuu

SEQ ID NO: 3092739 - RNA, 19 nt, Molluscum contagiosum virus
caagaucaccccgcagcuc

SEQ ID NO: 3092740 - RNA, 21 nt, Molluscum contagiosum virus
agcgucgugugcgcgcacggc

SEQ ID NO: 3092741 - RNA, 15 nt, Molluscum contagiosum virus
cgagcagcugcugcg

SEQ ID NO: 3092742 - RNA, 20 nt, Molluscum contagiosum virus
gcacuucgcagacgacucgc

SEQ ID NO: 3092743 - RNA, 17 nt, Molluscum contagiosum virus
cgcuggcucgcgccugc

SEQ ID NO: 3092744 - RNA, 23 nt, Molluscum contagiosum virus
aucugacggucguccuggagccu

SEQ ID NO: 3092745 - RNA, 15 nt, Molluscum contagiosum virus
cucaggggcucuccu

SEQ ID NO: 3092746 - RNA, 14 nt, Molluscum contagiosum virus
ucuagccuccuugu

SEQ ID NO: 3092747 - RNA, 16 nt, Molluscum contagiosum virus
cgcgcgcaugcucgcg

SEQ ID NO: 3092748 - RNA, 13 nt, Molluscum contagiosum virus
ucaccuuccuggg

SEQ ID NO: 3092749 - RNA, 17 nt, Molluscum contagiosum virus
cgugaacuccaaggucg

SEQ ID NO: 3092750 - RNA, 20 nt, Molluscum contagiosum virus
ggaaggacagugucuuguca

SEQ ID NO: 3092751 - RNA, 22 nt, Molluscum contagiosum virus
cugcuggugcucgccugcaucu

SEQ ID NO: 3092752 - RNA, 20 nt, Molluscum contagiosum virus
cggcgcgggcaagcagggcc

SEQ ID NO: 3092753 - RNA, 16 nt, Molluscum contagiosum virus
gucucggggcuccgcc

SEQ ID NO: 3092754 - RNA, 15 nt, Molluscum contagiosum virus
gacuuccgacgggcc

SEQ ID NO: 3092755 - RNA, 19 nt, Molluscum contagiosum virus
ucaggcaagaggggagcca

SEQ ID NO: 3092756 - RNA, 21 nt, Molluscum contagiosum virus
caggccauggagcgcccgcug

SEQ ID NO: 3092757 - RNA, 21 nt, Molluscum contagiosum virus
cagcaggagcacgccuggcgg

SEQ ID NO: 3092758 - RNA, 17 nt, Molluscum contagiosum virus
cggaggucugcuuuguc

SEQ ID NO: 3092759 - RNA, 17 nt, Molluscum contagiosum virus
ccccgagcugcggcgcg

SEQ ID NO: 3092760 - RNA, 13 nt, Molluscum contagiosum virus
ugcgucccagcag

SEQ ID NO: 3092761 - RNA, 18 nt, Molluscum contagiosum virus
aagaggccagcacaagcc

SEQ ID NO: 3092762 - RNA, 16 nt, Molluscum contagiosum virus
caagacgcugcuggcg

SEQ ID NO: 3092763 - RNA, 19 nt, Molluscum contagiosum virus
cgugaggaggcggcacugc

SEQ ID NO: 3092764 - RNA, 18 nt, Molluscum contagiosum virus
ccgcucggcacugcuggc

SEQ ID NO: 3092765 - RNA, 20 nt, Molluscum contagiosum virus
uauuggacguccacaaagcc

SEQ ID NO: 3092766 - RNA, 22 nt, Molluscum contagiosum virus
cgagcacgccuccaagaagagg

SEQ ID NO: 3092767 - RNA, 13 nt, Molluscum contagiosum virus
aaccacagcucuc

SEQ ID NO: 3092768 - RNA, 16 nt, Molluscum contagiosum virus
acugcagcagcuccuc

SEQ ID NO: 3092769 - RNA, 15 nt, Molluscum contagiosum virus
guccgcacgcacgga

SEQ ID NO: 3092770 - RNA, 14 nt, Molluscum contagiosum virus
cgcgcacgagcugc

SEQ ID NO: 3092771 - RNA, 16 nt, Molluscum contagiosum virus
guccuucaagaacgac

SEQ ID NO: 3092772 - RNA, 16 nt, Molluscum contagiosum virus
cuccaacagcagcugg

SEQ ID NO: 3092773 - RNA, 21 nt, Molluscum contagiosum virus
cgcggcaccugucgcgcgccg

SEQ ID NO: 3092774 - RNA, 13 nt, Molluscum contagiosum virus
gccacgcccgggc

SEQ ID NO: 3092775 - RNA, 16 nt, Molluscum contagiosum virus
acgcaccgccuggugc

SEQ ID NO: 3092776 - RNA, 22 nt, Molluscum contagiosum virus
ccgagcgcuacgacgacaugca

SEQ ID NO: 3092777 - RNA, 20 nt, Molluscum contagiosum virus
gccagccucaucgugagccu

SEQ ID NO: 3092778 - RNA, 12 nt, Molluscum contagiosum virus
cuacuacacugu

SEQ ID NO: 3092779 - RNA, 18 nt, Molluscum contagiosum virus
ccacgaugaacggcuccu

SEQ ID NO: 3092780 - RNA, 19 nt, Molluscum contagiosum virus
gcucagcgccgcgugcaug

SEQ ID NO: 3092781 - RNA, 15 nt, Molluscum contagiosum virus
gcgcgcuaccugcgc

SEQ ID NO: 3092782 - RNA, 15 nt, Molluscum contagiosum virus
cggcagcucugcagc

SEQ ID NO: 3092783 - RNA, 16 nt, Molluscum contagiosum virus
guucccgcucaaccuc

SEQ ID NO: 3092784 - RNA, 15 nt, Molluscum contagiosum virus
gguuccagcuccggc

SEQ ID NO: 3092785 - RNA, 19 nt, Molluscum contagiosum virus
cccaugcucaccgccgaga

SEQ ID NO: 3092786 - RNA, 21 nt, Molluscum contagiosum virus
cgcggcaaaugcgucccagca

SEQ ID NO: 3092787 - RNA, 16 nt, Molluscum contagiosum virus
cgggcccgagcagaag

SEQ ID NO: 3092788 - RNA, 17 nt, Molluscum contagiosum virus
ccggcacgagcaguccg

SEQ ID NO: 3092789 - RNA, 14 nt, Molluscum contagiosum virus
gugcuccacgcgca

SEQ ID NO: 3092790 - RNA, 23 nt, Molluscum contagiosum virus
cagcagccgcagcccacgugcca

SEQ ID NO: 3092791 - RNA, 14 nt, Molluscum contagiosum virus
uggugcccaugcuc

SEQ ID NO: 3092792 - RNA, 15 nt, Molluscum contagiosum virus
gcgccgaugcagugc

SEQ ID NO: 3092793 - RNA, 23 nt, Molluscum contagiosum virus
gcgggugccgccgugggcgccgc

SEQ ID NO: 3092794 - RNA, 14 nt, Molluscum contagiosum virus
guugcagcccacca

SEQ ID NO: 3092795 - RNA, 20 nt, Molluscum contagiosum virus
gguugcccgccugccgcgag

SEQ ID NO: 3092796 - RNA, 13 nt, Molluscum contagiosum virus
uagaccuccuugc

SEQ ID NO: 3092797 - RNA, 20 nt, Molluscum contagiosum virus
gaacaguacuuugucgcacg

SEQ ID NO: 3092798 - RNA, 21 nt, Molluscum contagiosum virus
gcauggagagcguacucgggc

SEQ ID NO: 3092799 - RNA, 18 nt, Molluscum contagiosum virus
caccugcggcucgcacuu

SEQ ID NO: 3092800 - RNA, 15 nt, Molluscum contagiosum virus
ugcaugcccagcaug

SEQ ID NO: 3092801 - RNA, 19 nt, Molluscum contagiosum virus
acuggagcacggacuggga

SEQ ID NO: 3092802 - RNA, 16 nt, Molluscum contagiosum virus
uacaaaacaugcugua

SEQ ID NO: 3092803 - RNA, 16 nt, Molluscum contagiosum virus
uaaauggaccucaaga

SEQ ID NO: 3092804 - RNA, 13 nt, Molluscum contagiosum virus
cacgcuugccuug

SEQ ID NO: 3092805 - RNA, 20 nt, Molluscum contagiosum virus
acuccuuugcgagcacugua

SEQ ID NO: 3092806 - RNA, 18 nt, Molluscum contagiosum virus
cgcgcaguucgagcugcu

SEQ ID NO: 3092807 - RNA, 12 nt, Molluscum contagiosum virus
ucguccacaggc

SEQ ID NO: 3092808 - RNA, 17 nt, Molluscum contagiosum virus
gcagcacggacaugagc

SEQ ID NO: 3092809 - RNA, 13 nt, Molluscum contagiosum virus
acagagggacagc

SEQ ID NO: 3092810 - RNA, 18 nt, Molluscum contagiosum virus
acucggcuucugcugcac

SEQ ID NO: 3092811 - RNA, 12 nt, Molluscum contagiosum virus
gccccugggcuu

SEQ ID NO: 3092812 - RNA, 16 nt, Molluscum contagiosum virus
caugcggagcuggccg

SEQ ID NO: 3092813 - RNA, 15 nt, Molluscum contagiosum virus
ggggugauggcggug

SEQ ID NO: 3092814 - RNA, 19 nt, Molluscum contagiosum virus
gcagucacggucuugccga

SEQ ID NO: 3092815 - RNA, 16 nt, Molluscum contagiosum virus
cgucuuaugcauccug

SEQ ID NO: 3092816 - RNA, 21 nt, Molluscum contagiosum virus
cacgguucgcggcgcgcggcg

SEQ ID NO: 3092817 - RNA, 21 nt, Molluscum contagiosum virus
cccguaggcgggccugcgccc

SEQ ID NO: 3092818 - RNA, 17 nt, Molluscum contagiosum virus
augcacacgcaccgccu

SEQ ID NO: 3092819 - RNA, 24 nt, Molluscum contagiosum virus
guaugcguaguaguagcgcucgcc

SEQ ID NO: 3092820 - RNA, 20 nt, Molluscum contagiosum virus
acuaagaacguaaaaaagag

SEQ ID NO: 3092821 - RNA, 21 nt, Molluscum contagiosum virus
uucagagugacgcugcaagac

SEQ ID NO: 3092822 - RNA, 21 nt, Molluscum contagiosum virus
aacaagcguuuucgucaugga

SEQ ID NO: 3092823 - RNA, 15 nt, Molluscum contagiosum virus
ugccgugagcacgag

SEQ ID NO: 3092824 - RNA, 18 nt, Molluscum contagiosum virus
gacagcaagcagcgcgcg

SEQ ID NO: 3092825 - RNA, 18 nt, Molluscum contagiosum virus
ggcaccacgugcgcuggc

SEQ ID NO: 3092826 - RNA, 22 nt, Molluscum contagiosum virus
cccgcuaaagaucgugcgcuuc

SEQ ID NO: 3092827 - RNA, 14 nt, Molluscum contagiosum virus
ucgugcugugccua

SEQ ID NO: 3092828 - RNA, 18 nt, Molluscum contagiosum virus
gaagaguggcucacagcc

SEQ ID NO: 3092829 - RNA, 19 nt, Molluscum contagiosum virus
gagaugacgggcacgcuca

SEQ ID NO: 3092830 - RNA, 22 nt, Molluscum contagiosum virus
cugccgguggaagagcccgcac

SEQ ID NO: 3092831 - RNA, 14 nt, Molluscum contagiosum virus
accgcgcagaagcc

SEQ ID NO: 3092832 - RNA, 14 nt, Molluscum contagiosum virus
cuucaagcacgagc

SEQ ID NO: 3092833 - RNA, 15 nt, Molluscum contagiosum virus
caugcggcaggcgcu

SEQ ID NO: 3092834 - RNA, 22 nt, Molluscum contagiosum virus
ugcgcgaccgcaccgagcccgc

SEQ ID NO: 3092835 - RNA, 12 nt, Molluscum contagiosum virus
gccuggcuugcg

SEQ ID NO: 3092836 - RNA, 17 nt, Molluscum contagiosum virus
gcucgacgggcgcagcc

SEQ ID NO: 3092837 - RNA, 20 nt, Molluscum contagiosum virus
gugcugcgcgcccaggcgcg

SEQ ID NO: 3092838 - RNA, 16 nt, Molluscum contagiosum virus
caggccaggugcagcg

SEQ ID NO: 3092839 - RNA, 22 nt, Molluscum contagiosum virus
gcagcgucgcggagcgcgcacg

SEQ ID NO: 3092840 - RNA, 15 nt, Molluscum contagiosum virus
agaaggagcccuugc

SEQ ID NO: 3092841 - RNA, 13 nt, Molluscum contagiosum virus
uuacggagcuaca

SEQ ID NO: 3092842 - RNA, 14 nt, Molluscum contagiosum virus
cgugcaguugagag

SEQ ID NO: 3092843 - RNA, 13 nt, Molluscum contagiosum virus
ugucguggaggaa

SEQ ID NO: 3092844 - RNA, 20 nt, Molluscum contagiosum virus
cauuucacaaguggucuuug

SEQ ID NO: 3092845 - RNA, 16 nt, Molluscum contagiosum virus
cuggcguggcaaaggc

SEQ ID NO: 3092846 - RNA, 13 nt, Molluscum contagiosum virus
cugcagcagcccc

SEQ ID NO: 3092847 - RNA, 18 nt, Molluscum contagiosum virus
cgcgucggucaccaccac

SEQ ID NO: 3092848 - RNA, 22 nt, Molluscum contagiosum virus
cgcgcaggaccgucaccgcagu

SEQ ID NO: 3092849 - RNA, 20 nt, Molluscum contagiosum virus
cuuaacucagcgggcagaca

SEQ ID NO: 3092850 - RNA, 11 nt, Molluscum contagiosum virus
ugcgcauggug

SEQ ID NO: 3092851 - RNA, 22 nt, Molluscum contagiosum virus
uacacguggaauugcggccagg

SEQ ID NO: 3092852 - RNA, 20 nt, Molluscum contagiosum virus
gccauggagcgcccgcugcu

SEQ ID NO: 3092853 - RNA, 22 nt, Molluscum contagiosum virus
ggggaacucggcuucugcugca

SEQ ID NO: 3092854 - RNA, 20 nt, Molluscum contagiosum virus
ggcggagaugacgggcacgc

SEQ ID NO: 3092855 - RNA, 12 nt, Molluscum contagiosum virus
gcacgcacacga

SEQ ID NO: 3092856 - RNA, 15 nt, Molluscum contagiosum virus
gugcgcgcagacgug

SEQ ID NO: 3092857 - RNA, 17 nt, Molluscum contagiosum virus
guccgcaucggcgccgc

SEQ ID NO: 3092858 - RNA, 17 nt, Molluscum contagiosum virus
caugaacucgcugcugc

SEQ ID NO: 3092859 - RNA, 17 nt, Molluscum contagiosum virus
cugagcgcggagcuggc

SEQ ID NO: 3092860 - RNA, 12 nt, Molluscum contagiosum virus
ccggugccuggc

SEQ ID NO: 3092861 - RNA, 13 nt, Molluscum contagiosum virus
cggagagcagugc

SEQ ID NO: 3092862 - RNA, 12 nt, Molluscum contagiosum virus
cgcaaacacugu

SEQ ID NO: 3092863 - RNA, 17 nt, Molluscum contagiosum virus
cugagcaagcucaagaa

SEQ ID NO: 3092864 - RNA, 18 nt, Molluscum contagiosum virus
acaagcuagacuggagca

SEQ ID NO: 3092865 - RNA, 17 nt, Molluscum contagiosum virus
gcucgcgcgcgcacgcc

SEQ ID NO: 3092866 - RNA, 13 nt, Molluscum contagiosum virus
ugugcgagccagu

SEQ ID NO: 3092867 - RNA, 13 nt, Molluscum contagiosum virus
aggcagaagcuca

SEQ ID NO: 3092868 - RNA, 14 nt, Molluscum contagiosum virus
gugcgcuacguggc

SEQ ID NO: 3092869 - RNA, 20 nt, Molluscum contagiosum virus
ugcuggacacucgcggcaag

SEQ ID NO: 3092870 - RNA, 14 nt, Molluscum contagiosum virus
ugggagaacacgag

SEQ ID NO: 3092871 - RNA, 19 nt, Molluscum contagiosum virus
gcggcacgggcucgagcuc

SEQ ID NO: 3092872 - RNA, 19 nt, Molluscum contagiosum virus
aaacgcugacggcgcugcg

SEQ ID NO: 3092873 - RNA, 14 nt, Molluscum contagiosum virus
ccggugccagcucu

SEQ ID NO: 3092874 - RNA, 15 nt, Molluscum contagiosum virus
accucgcgcgccgcc

SEQ ID NO: 3092875 - RNA, 19 nt, Molluscum contagiosum virus
ccaagaggccgucacaugc

SEQ ID NO: 3092876 - RNA, 13 nt, Molluscum contagiosum virus
cgcugcuccugcu

SEQ ID NO: 3092877 - RNA, 22 nt, Molluscum contagiosum virus
cccuccuaucucaaagaacgcg

SEQ ID NO: 3092878 - RNA, 22 nt, Molluscum contagiosum virus
ccagccuggcggccaaccgccu

SEQ ID NO: 3092879 - RNA, 19 nt, Molluscum contagiosum virus
aacugcgucucaagacaag

SEQ ID NO: 3092880 - RNA, 14 nt, Molluscum contagiosum virus
uccccgccagcacc

SEQ ID NO: 3092881 - RNA, 20 nt, Molluscum contagiosum virus
acgagcugcugcgcgccgcc

SEQ ID NO: 3092882 - RNA, 14 nt, Molluscum contagiosum virus
cgcgcgcucacccu

SEQ ID NO: 3092883 - RNA, 13 nt, Molluscum contagiosum virus
gcacggcuaccac

SEQ ID NO: 3092884 - RNA, 11 nt, Molluscum contagiosum virus
aagcucagccu

SEQ ID NO: 3092885 - RNA, 17 nt, Molluscum contagiosum virus
ggagcuagcgcgcgccg

SEQ ID NO: 3092886 - RNA, 23 nt, Molluscum contagiosum virus
guuuccagggcaguacgcgcgug

SEQ ID NO: 3092887 - RNA, 21 nt, Molluscum contagiosum virus
acgcacagccccugcugcucg

SEQ ID NO: 3092888 - RNA, 17 nt, Molluscum contagiosum virus
gcucgugguugcgcacg

SEQ ID NO: 3092889 - RNA, 15 nt, Molluscum contagiosum virus
cucgcggucaauguu

SEQ ID NO: 3092890 - RNA, 17 nt, Molluscum contagiosum virus
auggacacgcacuggcg

SEQ ID NO: 3092891 - RNA, 18 nt, Molluscum contagiosum virus
gauuugauggcugcucau

SEQ ID NO: 3092892 - RNA, 18 nt, Molluscum contagiosum virus
gcggaugcuggcgagcac

SEQ ID NO: 3092893 - RNA, 19 nt, Molluscum contagiosum virus
aaagguaccccgcaggaaa

SEQ ID NO: 3092894 - RNA, 18 nt, Molluscum contagiosum virus
gcgauguacgcgugcagg

SEQ ID NO: 3092895 - RNA, 15 nt, Molluscum contagiosum virus
gccugccagcagagc

SEQ ID NO: 3092896 - RNA, 21 nt, Molluscum contagiosum virus
ggucgcccgccgagcucuucc

SEQ ID NO: 3092897 - RNA, 20 nt, Molluscum contagiosum virus
aggccugcugaagaaggagc

SEQ ID NO: 3092898 - RNA, 19 nt, Molluscum contagiosum virus
guguggcuugcgggacaga

SEQ ID NO: 3092899 - RNA, 14 nt, Molluscum contagiosum virus
acuuccgcaacgag

SEQ ID NO: 3092900 - RNA, 21 nt, Molluscum contagiosum virus
cgcgcgcuagccgccgcugcc

SEQ ID NO: 3092901 - RNA, 12 nt, Molluscum contagiosum virus
gcuccugcucug

SEQ ID NO: 3092902 - RNA, 22 nt, Molluscum contagiosum virus
ggcacgugcugcugcggcugcu

SEQ ID NO: 3092903 - RNA, 13 nt, Molluscum contagiosum virus
gcgcacgugcguc

SEQ ID NO: 3092904 - RNA, 21 nt, Molluscum contagiosum virus
cuuccacgaaaucgccgcgcg

SEQ ID NO: 3092905 - RNA, 21 nt, Molluscum contagiosum virus
ggccaggcgcggucgcccgcc

SEQ ID NO: 3092906 - RNA, 14 nt, Molluscum contagiosum virus
cccacgcuguacau

SEQ ID NO: 3092907 - RNA, 20 nt, Molluscum contagiosum virus
agcagcucggggcugucaga

SEQ ID NO: 3092908 - RNA, 16 nt, Molluscum contagiosum virus
ccgcggcgcccacggc

SEQ ID NO: 3092909 - RNA, 20 nt, Molluscum contagiosum virus
cgauacaaaacaugcuguau

SEQ ID NO: 3092910 - RNA, 20 nt, Molluscum contagiosum virus
cgggauggucucgcugcugg

SEQ ID NO: 3092911 - RNA, 17 nt, Molluscum contagiosum virus
acgcgcgcacaucggca

SEQ ID NO: 3092912 - RNA, 21 nt, Molluscum contagiosum virus
accagagugacgucuuccaga

SEQ ID NO: 3092913 - RNA, 14 nt, Molluscum contagiosum virus
ggugcgugcgggag

SEQ ID NO: 3092914 - RNA, 14 nt, Molluscum contagiosum virus
gcggcaaaggcccg

SEQ ID NO: 3092915 - RNA, 17 nt, Molluscum contagiosum virus
cguggccguagugcuca

SEQ ID NO: 3092916 - RNA, 16 nt, Molluscum contagiosum virus
gcacggacugggagca

SEQ ID NO: 3092917 - RNA, 21 nt, Molluscum contagiosum virus
cuacacauuccucggcgcaca

SEQ ID NO: 3092918 - RNA, 23 nt, Molluscum contagiosum virus
cuuagcuucagaacggaggacag

SEQ ID NO: 3092919 - RNA, 15 nt, Molluscum contagiosum virus
ccggggcccaugcuc

SEQ ID NO: 3092920 - RNA, 16 nt, Molluscum contagiosum virus
ucguccgcucgugcca

SEQ ID NO: 3092921 - RNA, 13 nt, Molluscum contagiosum virus
gcacaagggcagc

SEQ ID NO: 3092922 - RNA, 12 nt, Molluscum contagiosum virus
gcuggcccugcu

SEQ ID NO: 3092923 - RNA, 16 nt, Molluscum contagiosum virus
cacagccccugcugcu

SEQ ID NO: 3092924 - RNA, 21 nt, Molluscum contagiosum virus
gcaucgcaguucggcgacacg

SEQ ID NO: 3092925 - RNA, 18 nt, Molluscum contagiosum virus
ggcuccggcuuggacucc

SEQ ID NO: 3092926 - RNA, 13 nt, Molluscum contagiosum virus
agcauggccgcgu

SEQ ID NO: 3092927 - RNA, 17 nt, Molluscum contagiosum virus
gcccgcaaugcagugca

SEQ ID NO: 3092928 - RNA, 16 nt, Molluscum contagiosum virus
cgcugggcgcgccgcg

SEQ ID NO: 3092929 - RNA, 22 nt, Molluscum contagiosum virus
aacagagaaaggcacccaccag

SEQ ID NO: 3092930 - RNA, 20 nt, Molluscum contagiosum virus
cgggcgcuccgagcggcugc

SEQ ID NO: 3092931 - RNA, 15 nt, Molluscum contagiosum virus
cacgcacgaccucac

SEQ ID NO: 3092932 - RNA, 12 nt, Molluscum contagiosum virus
cuuucccccaca

SEQ ID NO: 3092933 - RNA, 14 nt, Molluscum contagiosum virus
cacacacggaagcu

SEQ ID NO: 3092934 - RNA, 21 nt, Molluscum contagiosum virus
gugccaucucgcacacugcag

SEQ ID NO: 3092935 - RNA, 14 nt, Molluscum contagiosum virus
cacgugcugcagcu

SEQ ID NO: 3092936 - RNA, 15 nt, Molluscum contagiosum virus
cugggcacaagcuuu

SEQ ID NO: 3092937 - RNA, 17 nt, Molluscum contagiosum virus
gacggugcuggugcugg

SEQ ID NO: 3092938 - RNA, 18 nt, Molluscum contagiosum virus
agucguuugcucggggcu

SEQ ID NO: 3092939 - RNA, 18 nt, Molluscum contagiosum virus
cgacaauacggugcagcc

SEQ ID NO: 3092940 - RNA, 17 nt, Molluscum contagiosum virus
gcucgcggugcagcugc

SEQ ID NO: 3092941 - RNA, 22 nt, Molluscum contagiosum virus
aaggacuaccagcucuucgugg

SEQ ID NO: 3092942 - RNA, 15 nt, Molluscum contagiosum virus
ccgcucggaauuccu

SEQ ID NO: 3092943 - RNA, 15 nt, Molluscum contagiosum virus
agacgcugcugcaca

SEQ ID NO: 3092944 - RNA, 18 nt, Molluscum contagiosum virus
gucacucgcgagacggaa

SEQ ID NO: 3092945 - RNA, 12 nt, Molluscum contagiosum virus
cuacgaggugcu

SEQ ID NO: 3092946 - RNA, 18 nt, Molluscum contagiosum virus
cgcccaccagcagccagg

SEQ ID NO: 3092947 - RNA, 16 nt, Molluscum contagiosum virus
gaacuagugcugcugg

SEQ ID NO: 3092948 - RNA, 17 nt, Molluscum contagiosum virus
accggagacaccagcuc

SEQ ID NO: 3092949 - RNA, 21 nt, Molluscum contagiosum virus
agcgcgcgccgucggccucgg

SEQ ID NO: 3092950 - RNA, 15 nt, Molluscum contagiosum virus
caguagcagcgccgg

SEQ ID NO: 3092951 - RNA, 16 nt, Molluscum contagiosum virus
cagcccugugcccgag

SEQ ID NO: 3092952 - RNA, 21 nt, Molluscum contagiosum virus
gcgaagagcacgaugcccagc

SEQ ID NO: 3092953 - RNA, 15 nt, Molluscum contagiosum virus
cguguuggcuucugc

SEQ ID NO: 3092954 - RNA, 16 nt, Molluscum contagiosum virus
gcagcagugccagcag

SEQ ID NO: 3092955 - RNA, 13 nt, Molluscum contagiosum virus
aggaacaaggcca

SEQ ID NO: 3092956 - RNA, 22 nt, Molluscum contagiosum virus
gaaaggccccccgcaacaagga

SEQ ID NO: 3092957 - RNA, 17 nt, Molluscum contagiosum virus
gcugcaaucugcgcucc

SEQ ID NO: 3092958 - RNA, 17 nt, Molluscum contagiosum virus
ggcauaccugugccagc

SEQ ID NO: 3092959 - RNA, 14 nt, Molluscum contagiosum virus
cgguguccucuuca

SEQ ID NO: 3092960 - RNA, 14 nt, Molluscum contagiosum virus
ggagcggaccccgg

SEQ ID NO: 3092961 - RNA, 14 nt, Molluscum contagiosum virus
agcgcggccguggc

SEQ ID NO: 3092962 - RNA, 20 nt, Molluscum contagiosum virus
cgcgaaacuggacugagccg

SEQ ID NO: 3092963 - RNA, 14 nt, Molluscum contagiosum virus
ccuccaagaagagg

SEQ ID NO: 3092964 - RNA, 14 nt, Molluscum contagiosum virus
cccgcggcgcgccg

SEQ ID NO: 3092965 - RNA, 21 nt, Molluscum contagiosum virus
cacgcuuguccgcggacgcgg

SEQ ID NO: 3092966 - RNA, 14 nt, Molluscum contagiosum virus
cagcccgcggugcg

SEQ ID NO: 3092967 - RNA, 18 nt, Molluscum contagiosum virus
cgcuaggggugccgcugc

SEQ ID NO: 3092968 - RNA, 17 nt, Molluscum contagiosum virus
ugcgcugucucuccgag

SEQ ID NO: 3092969 - RNA, 22 nt, Molluscum contagiosum virus
gugcuugcuucggcggcugugc

SEQ ID NO: 3092970 - RNA, 20 nt, Molluscum contagiosum virus
gccgagcgccgccagcuccg

SEQ ID NO: 3092971 - RNA, 17 nt, Molluscum contagiosum virus
cuugguggugaccgaga

SEQ ID NO: 3092972 - RNA, 21 nt, Molluscum contagiosum virus
gcucaugcgcgggaugcugga

SEQ ID NO: 3092973 - RNA, 20 nt, Molluscum contagiosum virus
aggaucggagcgcagcugcc

SEQ ID NO: 3092974 - RNA, 16 nt, Molluscum contagiosum virus
gccgcacucgccgcgg

SEQ ID NO: 3092975 - RNA, 16 nt, Molluscum contagiosum virus
gcccgcgucgcgcacg

SEQ ID NO: 3092976 - RNA, 19 nt, Molluscum contagiosum virus
gcgcugcgcggcggcagcu

SEQ ID NO: 3092977 - RNA, 14 nt, Molluscum contagiosum virus
gccgcggcgggggc

SEQ ID NO: 3092978 - RNA, 19 nt, Molluscum contagiosum virus
ucccgggcggcgcgccgcg

SEQ ID NO: 3092979 - RNA, 16 nt, Molluscum contagiosum virus
cugcccgcgcacgagc

SEQ ID NO: 3092980 - RNA, 16 nt, Molluscum contagiosum virus
ggcgcgaaaagucggg

SEQ ID NO: 3092981 - RNA, 22 nt, Molluscum contagiosum virus
aacauccugccacaccagcugg

SEQ ID NO: 3092982 - RNA, 20 nt, Molluscum contagiosum virus
ggcaccugcaucgcgccgcc

SEQ ID NO: 3092983 - RNA, 13 nt, Molluscum contagiosum virus
gcgaaggagagag

SEQ ID NO: 3092984 - RNA, 15 nt, Molluscum contagiosum virus
ccgcgacccagaagc

SEQ ID NO: 3092985 - RNA, 13 nt, Molluscum contagiosum virus
caggaccuggcug

SEQ ID NO: 3092986 - RNA, 13 nt, Molluscum contagiosum virus
cuuuccccggcgu

SEQ ID NO: 3092987 - RNA, 20 nt, Molluscum contagiosum virus
gggaccugguucaugcuggc

SEQ ID NO: 3092988 - RNA, 17 nt, Molluscum contagiosum virus
cgacggcacgggcacgc

SEQ ID NO: 3092989 - RNA, 23 nt, Molluscum contagiosum virus
cugcacgacggucacgcaagcuu

SEQ ID NO: 3092990 - RNA, 18 nt, Molluscum contagiosum virus
agucggcguggccaggcc

SEQ ID NO: 3092991 - RNA, 19 nt, Molluscum contagiosum virus
caacgcgcgcgugcugucc

SEQ ID NO: 3092992 - RNA, 19 nt, Molluscum contagiosum virus
acaugcagcugcaggaccu

SEQ ID NO: 3092993 - RNA, 16 nt, Molluscum contagiosum virus
gcuaccgcagccacgg

SEQ ID NO: 3092994 - RNA, 17 nt, Molluscum contagiosum virus
cgccggggcccaugcuc

SEQ ID NO: 3092995 - RNA, 13 nt, Molluscum contagiosum virus
ccggugucagccc

SEQ ID NO: 3092996 - RNA, 20 nt, Molluscum contagiosum virus
gcccgccagcauggcgagcc

SEQ ID NO: 3092997 - RNA, 20 nt, Molluscum contagiosum virus
ccugucaagacgggcacgcc

SEQ ID NO: 3092998 - RNA, 18 nt, Molluscum contagiosum virus
guuguugcaucuucuugc

SEQ ID NO: 3092999 - RNA, 20 nt, Molluscum contagiosum virus
cugcugcccccgccgcggcg

SEQ ID NO: 3093000 - RNA, 12 nt, Molluscum contagiosum virus
ucgcugccuggu

SEQ ID NO: 3093001 - RNA, 13 nt, Molluscum contagiosum virus
accgccugcucuc

SEQ ID NO: 3093002 - RNA, 17 nt, Molluscum contagiosum virus
gaacuucuacgccaaga

SEQ ID NO: 3093003 - RNA, 16 nt, Molluscum contagiosum virus
cguuccgggcccgggc

SEQ ID NO: 3093004 - RNA, 19 nt, Molluscum contagiosum virus
aggccaacuaccuggggcu

SEQ ID NO: 3093005 - RNA, 13 nt, Molluscum contagiosum virus
gcgugaccagugc

SEQ ID NO: 3093006 - RNA, 15 nt, Molluscum contagiosum virus
agcacgcgugugcga

SEQ ID NO: 3093007 - RNA, 21 nt, Molluscum contagiosum virus
ggacagagcccgcggcgcacg

SEQ ID NO: 3093008 - RNA, 14 nt, Molluscum contagiosum virus
cgcugcgcgccgcg

SEQ ID NO: 3093009 - RNA, 15 nt, Molluscum contagiosum virus
gcgccagcaagcucg

SEQ ID NO: 3093010 - RNA, 18 nt, Molluscum contagiosum virus
gcccgcugcgcgcucugg

SEQ ID NO: 3093011 - RNA, 14 nt, Molluscum contagiosum virus
ggagcggcauucga

SEQ ID NO: 3093012 - RNA, 17 nt, Molluscum contagiosum virus
cggagcugugccgcagc

SEQ ID NO: 3093013 - RNA, 11 nt, Molluscum contagiosum virus
gcaaccccgcg

SEQ ID NO: 3093014 - RNA, 16 nt, Molluscum contagiosum virus
caugaggggcggagac

SEQ ID NO: 3093015 - RNA, 23 nt, Molluscum contagiosum virus
gcagcguugcuauuaccugaccg

SEQ ID NO: 3093016 - RNA, 16 nt, Molluscum contagiosum virus
cugcgcgugcugggcc

SEQ ID NO: 3093017 - RNA, 19 nt, Molluscum contagiosum virus
gagcuccgugcugcggcaa

SEQ ID NO: 3093018 - RNA, 13 nt, Molluscum contagiosum virus
ucauggcgccgcu

SEQ ID NO: 3093019 - RNA, 15 nt, Molluscum contagiosum virus
gagggucgugcaggu

SEQ ID NO: 3093020 - RNA, 13 nt, Molluscum contagiosum virus
gcgugcucggugu

SEQ ID NO: 3093021 - RNA, 21 nt, Molluscum contagiosum virus
gcugcgcaucugcgagcgcga

SEQ ID NO: 3093022 - RNA, 13 nt, Molluscum contagiosum virus
acucgggugcccg

SEQ ID NO: 3093023 - RNA, 13 nt, Molluscum contagiosum virus
cuagccccagcac

SEQ ID NO: 3093024 - RNA, 23 nt, Molluscum contagiosum virus
gccgccugcgcgcacccgagggc

SEQ ID NO: 3093025 - RNA, 16 nt, Molluscum contagiosum virus
gccagugcgugcacug

SEQ ID NO: 3093026 - RNA, 18 nt, Molluscum contagiosum virus
ccgcugcgcaucugcgag

SEQ ID NO: 3093027 - RNA, 17 nt, Molluscum contagiosum virus
cgcgccgcgcugcuggc

SEQ ID NO: 3093028 - RNA, 23 nt, Molluscum contagiosum virus
ugggcaucgucucgcucuuccgc

SEQ ID NO: 3093029 - RNA, 13 nt, Molluscum contagiosum virus
cgcccuggagcgc

SEQ ID NO: 3093030 - RNA, 21 nt, Molluscum contagiosum virus
cgcccgcggcuuucucgcacu

SEQ ID NO: 3093031 - RNA, 15 nt, Molluscum contagiosum virus
cuguaacaaggaaaa

SEQ ID NO: 3093032 - RNA, 16 nt, Molluscum contagiosum virus
cgcucucucagggugg

SEQ ID NO: 3093033 - RNA, 21 nt, Molluscum contagiosum virus
gaaaggcaccccgaaggaaag

SEQ ID NO: 3093034 - RNA, 14 nt, Molluscum contagiosum virus
gcgcucgugucuag

SEQ ID NO: 3093035 - RNA, 22 nt, Molluscum contagiosum virus
acacucggcaugugcgcaccgc

SEQ ID NO: 3093036 - RNA, 22 nt, Molluscum contagiosum virus
gcucaccgccgagauggagcuc

SEQ ID NO: 3093037 - RNA, 20 nt, Molluscum contagiosum virus
cuggcggggcuggcagaaga

SEQ ID NO: 3093038 - RNA, 23 nt, Molluscum contagiosum virus
gcgccgaaguacuuuccucuucg

SEQ ID NO: 3093039 - RNA, 21 nt, Molluscum contagiosum virus
cgaggaacucuacgacaugcu

SEQ ID NO: 3093040 - RNA, 18 nt, Molluscum contagiosum virus
cuagugcgcgccaagaac

SEQ ID NO: 3093041 - RNA, 14 nt, Molluscum contagiosum virus
cacgcuguccaggc

SEQ ID NO: 3093042 - RNA, 22 nt, Molluscum contagiosum virus
gcaaccucgggaagcccucagg

SEQ ID NO: 3093043 - RNA, 18 nt, Molluscum contagiosum virus
cagcucgccgcgcgccgc

SEQ ID NO: 3093044 - RNA, 18 nt, Molluscum contagiosum virus
guacuaucagagacaggg

SEQ ID NO: 3093045 - RNA, 20 nt, Molluscum contagiosum virus
acgcgcugcgccacugccac

SEQ ID NO: 3093046 - RNA, 15 nt, Molluscum contagiosum virus
cgcguucggaacgcg

SEQ ID NO: 3093047 - RNA, 13 nt, Molluscum contagiosum virus
gcggagcugugcc

SEQ ID NO: 3093048 - RNA, 16 nt, Molluscum contagiosum virus
ucggcguuggccacga

SEQ ID NO: 3093049 - RNA, 15 nt, Molluscum contagiosum virus
gcucucgcugcugcc

SEQ ID NO: 3093050 - RNA, 16 nt, Molluscum contagiosum virus
cgggaaggggugaugg

SEQ ID NO: 3093051 - RNA, 20 nt, Molluscum contagiosum virus
gcccgcgcacgagcugcugc

SEQ ID NO: 3093052 - RNA, 16 nt, Molluscum contagiosum virus
ggucaagggugugggc

SEQ ID NO: 3093053 - RNA, 12 nt, Molluscum contagiosum virus
cggauugccgca

SEQ ID NO: 3093054 - RNA, 20 nt, Molluscum contagiosum virus
gcagccgcggcgcccggugc

SEQ ID NO: 3093055 - RNA, 15 nt, Molluscum contagiosum virus
ugccgcuugagcagc

SEQ ID NO: 3093056 - RNA, 14 nt, Molluscum contagiosum virus
gcgcgcccaggcgc

SEQ ID NO: 3093057 - RNA, 18 nt, Molluscum contagiosum virus
gcgccgcggcgggggcag

SEQ ID NO: 3093058 - RNA, 19 nt, Molluscum contagiosum virus
cuccuacacauuccucggc

SEQ ID NO: 3093059 - RNA, 16 nt, Molluscum contagiosum virus
ggagaugacgggcacg

SEQ ID NO: 3093060 - RNA, 19 nt, Molluscum contagiosum virus
cacguggaauugcggccag

SEQ ID NO: 3093061 - RNA, 15 nt, Molluscum contagiosum virus
cuccgcgggcagccg

SEQ ID NO: 3093062 - RNA, 19 nt, Molluscum contagiosum virus
acaaggagggagagcugcc

SEQ ID NO: 3093063 - RNA, 19 nt, Molluscum contagiosum virus
cgcagaccacggcgcgccg

SEQ ID NO: 3093064 - RNA, 15 nt, Molluscum contagiosum virus
gagcucguggacagc

SEQ ID NO: 3093065 - RNA, 18 nt, Molluscum contagiosum virus
cuccagaaucgcuuugcc

SEQ ID NO: 3093066 - RNA, 22 nt, Molluscum contagiosum virus
gcguccguaagucgaagagggu

SEQ ID NO: 3093067 - RNA, 16 nt, Molluscum contagiosum virus
gcgcuacgacgacaug

SEQ ID NO: 3093068 - RNA, 14 nt, Molluscum contagiosum virus
ugccgcggcagugg

SEQ ID NO: 3093069 - RNA, 19 nt, Molluscum contagiosum virus
acugcuagugcuggccgcc

SEQ ID NO: 3093070 - RNA, 16 nt, Molluscum contagiosum virus
gucaugcgacugccag

SEQ ID NO: 3093071 - RNA, 16 nt, Molluscum contagiosum virus
caugaccgcucgcgga

SEQ ID NO: 3093072 - RNA, 15 nt, Molluscum contagiosum virus
agcgcgcgccuugca

SEQ ID NO: 3093073 - RNA, 15 nt, Molluscum contagiosum virus
cacuggcccugcuug

SEQ ID NO: 3093074 - RNA, 13 nt, Molluscum contagiosum virus
ggcacgugccccg

SEQ ID NO: 3093075 - RNA, 14 nt, Molluscum contagiosum virus
cgcggcgguugccc

SEQ ID NO: 3093076 - RNA, 22 nt, Molluscum contagiosum virus
cuggagaccugucgugcaaugg

SEQ ID NO: 3093077 - RNA, 20 nt, Molluscum contagiosum virus
ccgcaguaccaguaccugcu

SEQ ID NO: 3093078 - RNA, 22 nt, Molluscum contagiosum virus
gcacaagggcagcucaagcugc

SEQ ID NO: 3093079 - RNA, 16 nt, Molluscum contagiosum virus
acgcacuucacggcgu

SEQ ID NO: 3093080 - RNA, 13 nt, Molluscum contagiosum virus
cguugcugcugcg

SEQ ID NO: 3093081 - RNA, 15 nt, Molluscum contagiosum virus
caccaccagcacgcu

SEQ ID NO: 3093082 - RNA, 14 nt, Molluscum contagiosum virus
ccugagcuucuuug

SEQ ID NO: 3093083 - RNA, 18 nt, Molluscum contagiosum virus
ugugcuccuuguccgagc

SEQ ID NO: 3093084 - RNA, 18 nt, Molluscum contagiosum virus
cuucgcguagucagggcc

SEQ ID NO: 3093085 - RNA, 15 nt, Molluscum contagiosum virus
gcacccgcaggaaag

SEQ ID NO: 3093086 - RNA, 20 nt, Molluscum contagiosum virus
ucguuugcucggggcugucg

SEQ ID NO: 3093087 - RNA, 18 nt, Molluscum contagiosum virus
ccgcugagcgcagcacac

SEQ ID NO: 3093088 - RNA, 16 nt, Molluscum contagiosum virus
agcgcgcuagcuccac

SEQ ID NO: 3093089 - RNA, 17 nt, Molluscum contagiosum virus
ucgacgagugcgccgcg

SEQ ID NO: 3093090 - RNA, 23 nt, Molluscum contagiosum virus
ugcuggacgcgcacgcgggacgc

SEQ ID NO: 3093091 - RNA, 18 nt, Molluscum contagiosum virus
ccgccgcaacauagucaa

SEQ ID NO: 3093092 - RNA, 18 nt, Molluscum contagiosum virus
gacgcguucuccaggaac

SEQ ID NO: 3093093 - RNA, 15 nt, Molluscum contagiosum virus
cggcgccgcgcaaga

SEQ ID NO: 3093094 - RNA, 16 nt, Molluscum contagiosum virus
cagucggugccagauu

SEQ ID NO: 3093095 - RNA, 24 nt, Molluscum contagiosum virus
ggacgcggugaccggagcggcgga

SEQ ID NO: 3093096 - RNA, 22 nt, Molluscum contagiosum virus
ugcccgccugccgcgagcacug

SEQ ID NO: 3093097 - RNA, 23 nt, Molluscum contagiosum virus
gugcacccuccgcacagagggac

SEQ ID NO: 3093098 - RNA, 23 nt, Molluscum contagiosum virus
cgcaggccgggcacccagcccug

SEQ ID NO: 3093099 - RNA, 14 nt, Molluscum contagiosum virus
cggacgcgcagcug

SEQ ID NO: 3093100 - RNA, 17 nt, Molluscum contagiosum virus
gauuucgcgcagcaggc

SEQ ID NO: 3093101 - RNA, 18 nt, Molluscum contagiosum virus
accuggcgagcgcucugc

SEQ ID NO: 3093102 - RNA, 16 nt, Molluscum contagiosum virus
accugagccucuggaa

SEQ ID NO: 3093103 - RNA, 19 nt, Molluscum contagiosum virus
cgucaugcgacugccagcc

SEQ ID NO: 3093104 - RNA, 21 nt, Molluscum contagiosum virus
cgaaaggcacccgcaggaaag

SEQ ID NO: 3093105 - RNA, 16 nt, Molluscum contagiosum virus
caggagcagucucugc

SEQ ID NO: 3093106 - RNA, 19 nt, Molluscum contagiosum virus
ugucugggcgagagcuuuu

SEQ ID NO: 3093107 - RNA, 20 nt, Molluscum contagiosum virus
cuggaguuuaaugacgcgca

SEQ ID NO: 3093108 - RNA, 14 nt, Molluscum contagiosum virus
ccgguccugacucc

SEQ ID NO: 3093109 - RNA, 15 nt, Molluscum contagiosum virus
gccgccgccgcgagg

SEQ ID NO: 3093110 - RNA, 23 nt, Molluscum contagiosum virus
gaagugcuccgcacguggaguca

SEQ ID NO: 3093111 - RNA, 12 nt, Molluscum contagiosum virus
gcagugccuugu

SEQ ID NO: 3093112 - RNA, 19 nt, Molluscum contagiosum virus
cugcgcgcucuggagccuc

SEQ ID NO: 3093113 - RNA, 15 nt, Molluscum contagiosum virus
gcucgcgcgcagcuc

SEQ ID NO: 3093114 - RNA, 14 nt, Molluscum contagiosum virus
cuggaggugaguca

SEQ ID NO: 3093115 - RNA, 19 nt, Molluscum contagiosum virus
gcgcaagcaccggcagcgc

SEQ ID NO: 3093116 - RNA, 19 nt, Molluscum contagiosum virus
gcgcugaucaccgaggagc

SEQ ID NO: 3093117 - RNA, 18 nt, Molluscum contagiosum virus
gacgcgaauacgcgcucc

SEQ ID NO: 3093118 - RNA, 15 nt, Molluscum contagiosum virus
cacccaccaggaaca

SEQ ID NO: 3093119 - RNA, 19 nt, Molluscum contagiosum virus
cguauccucgacgcgcugc

SEQ ID NO: 3093120 - RNA, 19 nt, Molluscum contagiosum virus
agcggauaugcgccugugc

SEQ ID NO: 3093121 - RNA, 22 nt, Molluscum contagiosum virus
cuuuugcgcgagagcuacagca

SEQ ID NO: 3093122 - RNA, 20 nt, Molluscum contagiosum virus
ucucugauaguaccacugug

SEQ ID NO: 3093123 - RNA, 22 nt, Molluscum contagiosum virus
cgacguguguccgagaucacgg

SEQ ID NO: 3093124 - RNA, 16 nt, Molluscum contagiosum virus
cagcagugccagcagc

SEQ ID NO: 3093125 - RNA, 12 nt, Molluscum contagiosum virus
agaagaggccgg

SEQ ID NO: 3093126 - RNA, 16 nt, Molluscum contagiosum virus
gcugucagaggauucu

SEQ ID NO: 3093127 - RNA, 17 nt, Molluscum contagiosum virus
gcgggccaggcacuggc

SEQ ID NO: 3093128 - RNA, 12 nt, Molluscum contagiosum virus
gcccgccagcau

SEQ ID NO: 3093129 - RNA, 15 nt, Molluscum contagiosum virus
augugaacacgacau

SEQ ID NO: 3093130 - RNA, 19 nt, Molluscum contagiosum virus
ucugcgcccgcggagaaag

SEQ ID NO: 3093131 - RNA, 23 nt, Molluscum contagiosum virus
gcacgccgccagcgacgagcagc

SEQ ID NO: 3093132 - RNA, 21 nt, Molluscum contagiosum virus
gcgagugugcgugucucucgu

SEQ ID NO: 3093133 - RNA, 22 nt, Molluscum contagiosum virus
augcgcgccgcgcugcuggcca

SEQ ID NO: 3093134 - RNA, 15 nt, Molluscum contagiosum virus
ccucgagcgccgccg

SEQ ID NO: 3093135 - RNA, 22 nt, Molluscum contagiosum virus
ugcagcuguccaaggugaacga

SEQ ID NO: 3093136 - RNA, 18 nt, Molluscum contagiosum virus
ccgcgugcaugcccagca

SEQ ID NO: 3093137 - RNA, 20 nt, Molluscum contagiosum virus
gccggcgcuucuacugcgca

SEQ ID NO: 3093138 - RNA, 13 nt, Molluscum contagiosum virus
ugguacagaugag

SEQ ID NO: 3093139 - RNA, 20 nt, Molluscum contagiosum virus
ggcgcacgccgaagagccgc

SEQ ID NO: 3093140 - RNA, 19 nt, Molluscum contagiosum virus
acgggcucugugcggacau

SEQ ID NO: 3093141 - RNA, 20 nt, Molluscum contagiosum virus
ggcuugcggcacgcacggcc

SEQ ID NO: 3093142 - RNA, 12 nt, Molluscum contagiosum virus
cacgccgcagcg

SEQ ID NO: 3093143 - RNA, 18 nt, Molluscum contagiosum virus
cgccaucgugguggagga

SEQ ID NO: 3093144 - RNA, 18 nt, Molluscum contagiosum virus
cuccaagaagaggccggc

SEQ ID NO: 3093145 - RNA, 17 nt, Molluscum contagiosum virus
ugcuccugcucuguugc

SEQ ID NO: 3093146 - RNA, 19 nt, Molluscum contagiosum virus
cagcaaacugugcuccuga

SEQ ID NO: 3093147 - RNA, 12 nt, Molluscum contagiosum virus
uggaggagccgc

SEQ ID NO: 3093148 - RNA, 18 nt, Molluscum contagiosum virus
caccgcgacaugccucgc

SEQ ID NO: 3093149 - RNA, 15 nt, Molluscum contagiosum virus
gccgucgggcgccaa

SEQ ID NO: 3093150 - RNA, 19 nt, Molluscum contagiosum virus
ccucaaggaggcgugcguu

SEQ ID NO: 3093151 - RNA, 13 nt, Molluscum contagiosum virus
gggccaggcacug

SEQ ID NO: 3093152 - RNA, 17 nt, Molluscum contagiosum virus
cgcucuuacugcagcag

SEQ ID NO: 3093153 - RNA, 17 nt, Molluscum contagiosum virus
auccacgcgugcugcgc

SEQ ID NO: 3093154 - RNA, 19 nt, Molluscum contagiosum virus
gcugcugcucuuccaggag

SEQ ID NO: 3093155 - RNA, 14 nt, Molluscum contagiosum virus
ccgggccugcggcg

SEQ ID NO: 3093156 - RNA, 20 nt, Molluscum contagiosum virus
acguacucgcugcuccccgc

SEQ ID NO: 3093157 - RNA, 21 nt, Molluscum contagiosum virus
accggcgcucacugcgaucgc

SEQ ID NO: 3093158 - RNA, 15 nt, Molluscum contagiosum virus
accgcgcgguccgcc

SEQ ID NO: 3093159 - RNA, 17 nt, Molluscum contagiosum virus
caguacaugcccggccu

SEQ ID NO: 3093160 - RNA, 22 nt, Molluscum contagiosum virus
ccuccacguccaggccgcggca

SEQ ID NO: 3093161 - RNA, 22 nt, Molluscum contagiosum virus
augcuuuuguuacucucagagc

SEQ ID NO: 3093162 - RNA, 13 nt, Molluscum contagiosum virus
ugguugccaggca

SEQ ID NO: 3093163 - RNA, 23 nt, Molluscum contagiosum virus
ggaaacgcacagccccugcugcu

SEQ ID NO: 3093164 - RNA, 14 nt, Molluscum contagiosum virus
ggcagaagcucauu

SEQ ID NO: 3093165 - RNA, 20 nt, Molluscum contagiosum virus
ucgcccguguucgcggagcu

SEQ ID NO: 3093166 - RNA, 21 nt, Molluscum contagiosum virus
ccuuggcggcgcggcuagcac

SEQ ID NO: 3093167 - RNA, 19 nt, Molluscum contagiosum virus
gcuaggauccugcucaaga

SEQ ID NO: 3093168 - RNA, 14 nt, Molluscum contagiosum virus
cgcuggagcacgac

SEQ ID NO: 3093169 - RNA, 19 nt, Molluscum contagiosum virus
cguggcgcgcgagcugcua

SEQ ID NO: 3093170 - RNA, 13 nt, Molluscum contagiosum virus
ucauggugcccau

SEQ ID NO: 3093171 - RNA, 20 nt, Molluscum contagiosum virus
cgcgcggggcacugcgcacg

SEQ ID NO: 3093172 - RNA, 16 nt, Molluscum contagiosum virus
ugcauggacauccuca

SEQ ID NO: 3093173 - RNA, 21 nt, Molluscum contagiosum virus
cgggcgccgcgcaauagcgcc

SEQ ID NO: 3093174 - RNA, 23 nt, Molluscum contagiosum virus
uugccgugcccaucuccuugucu

SEQ ID NO: 3093175 - RNA, 17 nt, Molluscum contagiosum virus
ccagcggcgccgcagcu

SEQ ID NO: 3093176 - RNA, 22 nt, Molluscum contagiosum virus
gccuccaagaagaggccggcac

SEQ ID NO: 3093177 - RNA, 23 nt, Molluscum contagiosum virus
cucgguagcguggagcuggucca

SEQ ID NO: 3093178 - RNA, 17 nt, Molluscum contagiosum virus
gcugagcaagcucaaga

SEQ ID NO: 3093179 - RNA, 22 nt, Molluscum contagiosum virus
cggcaagcgagaucccuccgag

SEQ ID NO: 3093180 - RNA, 13 nt, Molluscum contagiosum virus
gcaagccuggcuc

SEQ ID NO: 3093181 - RNA, 13 nt, Molluscum contagiosum virus
ccccgaaggaaag

SEQ ID NO: 3093182 - RNA, 22 nt, Molluscum contagiosum virus
gacgcggaugccacgcagcugg

SEQ ID NO: 3093183 - RNA, 14 nt, Molluscum contagiosum virus
gcugcgcgcggacu

SEQ ID NO: 3093184 - RNA, 17 nt, Molluscum contagiosum virus
gcgcuggagcuggcugg

SEQ ID NO: 3093185 - RNA, 15 nt, Molluscum contagiosum virus
gcugcggcugcugga

SEQ ID NO: 3093186 - RNA, 12 nt, Molluscum contagiosum virus
cagcuucugcuc

SEQ ID NO: 3093187 - RNA, 19 nt, Molluscum contagiosum virus
ccccuagaagaccacaucc

SEQ ID NO: 3093188 - RNA, 16 nt, Molluscum contagiosum virus
aggaaauguaguucuc

SEQ ID NO: 3093189 - RNA, 13 nt, Molluscum contagiosum virus
cggcgcgcagcuc

SEQ ID NO: 3093190 - RNA, 14 nt, Molluscum contagiosum virus
ggcacccgccagcu

SEQ ID NO: 3093191 - RNA, 14 nt, Molluscum contagiosum virus
cgucugcaaggccu

SEQ ID NO: 3093192 - RNA, 16 nt, Molluscum contagiosum virus
guugucuugaugcugu

SEQ ID NO: 3093193 - RNA, 13 nt, Molluscum contagiosum virus
gugcgugcacagc

SEQ ID NO: 3093194 - RNA, 18 nt, Molluscum contagiosum virus
ucccgaggcguccagcgg

SEQ ID NO: 3093195 - RNA, 15 nt, Molluscum contagiosum virus
aggaaaggcacccac

SEQ ID NO: 3093196 - RNA, 20 nt, Molluscum contagiosum virus
gcugugcccgcggcguuccc

SEQ ID NO: 3093197 - RNA, 20 nt, Molluscum contagiosum virus
ggugcccgccaagagcuggu

SEQ ID NO: 3093198 - RNA, 21 nt, Molluscum contagiosum virus
acaaucucgccggcuguaaau

SEQ ID NO: 3093199 - RNA, 18 nt, Molluscum contagiosum virus
ugcggagggugcacgcgg

SEQ ID NO: 3093200 - RNA, 19 nt, Molluscum contagiosum virus
ucaacagugcgugccaggc

SEQ ID NO: 3093201 - RNA, 19 nt, Molluscum contagiosum virus
ccgugagcagucccgagga

SEQ ID NO: 3093202 - RNA, 14 nt, Molluscum contagiosum virus
cgagagaauggagc

SEQ ID NO: 3093203 - RNA, 22 nt, Molluscum contagiosum virus
ccacgcucgcgcgcaugcucgc

SEQ ID NO: 3093204 - RNA, 13 nt, Molluscum contagiosum virus
aggccauggagcg

SEQ ID NO: 3093205 - RNA, 22 nt, Molluscum contagiosum virus
ccguuccacuacaagcagccgc

SEQ ID NO: 3093206 - RNA, 21 nt, Molluscum contagiosum virus
cuucguggccaaagucuuccu

SEQ ID NO: 3093207 - RNA, 20 nt, Molluscum contagiosum virus
gaagaggccagcacaagccg

SEQ ID NO: 3093208 - RNA, 16 nt, Molluscum contagiosum virus
aggcugcucccucucg

SEQ ID NO: 3093209 - RNA, 16 nt, Molluscum contagiosum virus
gaaacgggagucacuu

SEQ ID NO: 3093210 - RNA, 16 nt, Molluscum contagiosum virus
acaaggugcuguccuu

SEQ ID NO: 3093211 - RNA, 17 nt, Molluscum contagiosum virus
gacaagcuagacuggag

SEQ ID NO: 3093212 - RNA, 16 nt, Molluscum contagiosum virus
acgguagcuagcucug

SEQ ID NO: 3093213 - RNA, 22 nt, Molluscum contagiosum virus
cuggccgaugccuaugccgagg

SEQ ID NO: 3093214 - RNA, 18 nt, Molluscum contagiosum virus
ccggcucaagaacaccaa

SEQ ID NO: 3093215 - RNA, 18 nt, Molluscum contagiosum virus
cugcugguggugcuggag

SEQ ID NO: 3093216 - RNA, 17 nt, Molluscum contagiosum virus
cgcgcgccuugcagcgc

SEQ ID NO: 3093217 - RNA, 19 nt, Molluscum contagiosum virus
cccgacuuuucgcgccgcg

SEQ ID NO: 3093218 - RNA, 16 nt, Molluscum contagiosum virus
gacgacgccgagcccg

SEQ ID NO: 3093219 - RNA, 17 nt, Molluscum contagiosum virus
acgcgcgcgccucgcca

SEQ ID NO: 3093220 - RNA, 19 nt, Molluscum contagiosum virus
augcucaagcaccugcgcu

SEQ ID NO: 3093221 - RNA, 14 nt, Molluscum contagiosum virus
acgacgccgagccc

SEQ ID NO: 3093222 - RNA, 21 nt, Molluscum contagiosum virus
cuuccggagacaccagcuccg

SEQ ID NO: 3093223 - RNA, 13 nt, Molluscum contagiosum virus
ucgugucuguguu

SEQ ID NO: 3093224 - RNA, 12 nt, Molluscum contagiosum virus
ccgauguccugc

SEQ ID NO: 3093225 - RNA, 15 nt, Molluscum contagiosum virus
gcacgagcugcugcc

SEQ ID NO: 3093226 - RNA, 13 nt, Molluscum contagiosum virus
gacgugggcgacg

SEQ ID NO: 3093227 - RNA, 18 nt, Molluscum contagiosum virus
acacccgugcccgcuccg

SEQ ID NO: 3093228 - RNA, 20 nt, Molluscum contagiosum virus
gcccuccucgaccugcacga

SEQ ID NO: 3093229 - RNA, 20 nt, Molluscum contagiosum virus
gauuccgcuguacgugcugc

SEQ ID NO: 3093230 - RNA, 21 nt, Molluscum contagiosum virus
gugcacgcuguccaggcgcug

SEQ ID NO: 3093231 - RNA, 21 nt, Molluscum contagiosum virus
ugcgaaguuggucaacaacac

SEQ ID NO: 3093232 - RNA, 20 nt, Molluscum contagiosum virus
gcccgcgagcacgggcgcca

SEQ ID NO: 3093233 - RNA, 13 nt, Molluscum contagiosum virus
cgacgagcagcug

SEQ ID NO: 3093234 - RNA, 16 nt, Molluscum contagiosum virus
gcucgcucgcgcgcag

SEQ ID NO: 3093235 - RNA, 15 nt, Molluscum contagiosum virus
acagccccugcugcu

SEQ ID NO: 3093236 - RNA, 22 nt, Molluscum contagiosum virus
ccgacaucgugccgaagagcgu

SEQ ID NO: 3093237 - RNA, 20 nt, Molluscum contagiosum virus
cgcgcucgcucgcgcuccgc

SEQ ID NO: 3093238 - RNA, 22 nt, Molluscum contagiosum virus
augcuucccccuugcgucuccg

SEQ ID NO: 3093239 - RNA, 17 nt, Molluscum contagiosum virus
gcggaucgugcuggaga

SEQ ID NO: 3093240 - RNA, 18 nt, Molluscum contagiosum virus
ugcugccaauaccaggcc

SEQ ID NO: 3093241 - RNA, 23 nt, Molluscum contagiosum virus
agugaaggguguggccuacgugg

SEQ ID NO: 3093242 - RNA, 22 nt, Molluscum contagiosum virus
cgugcuccucgcguagcagcgc

SEQ ID NO: 3093243 - RNA, 17 nt, Molluscum contagiosum virus
cuggcgcucgcgcgcac

SEQ ID NO: 3093244 - RNA, 23 nt, Molluscum contagiosum virus
cgauuuguuugcaccggcaacag

SEQ ID NO: 3093245 - RNA, 13 nt, Molluscum contagiosum virus
gacagcucagcag

SEQ ID NO: 3093246 - RNA, 16 nt, Molluscum contagiosum virus
accggagacaccagcu

SEQ ID NO: 3093247 - RNA, 22 nt, Molluscum contagiosum virus
cccaagugcgcgugucuggagc

SEQ ID NO: 3093248 - RNA, 17 nt, Molluscum contagiosum virus
uguuuccuugccuucuc

SEQ ID NO: 3093249 - RNA, 16 nt, Molluscum contagiosum virus
guacuuucacgacugu

SEQ ID NO: 3093250 - RNA, 15 nt, Molluscum contagiosum virus
guucgcaacaaaaga

SEQ ID NO: 3093251 - RNA, 23 nt, Molluscum contagiosum virus
cgacgucgucaaggauguagccu

SEQ ID NO: 3093252 - RNA, 13 nt, Molluscum contagiosum virus
cuugugacccgca

SEQ ID NO: 3093253 - RNA, 18 nt, Molluscum contagiosum virus
cugccgcgagcacuggcu

SEQ ID NO: 3093254 - RNA, 15 nt, Molluscum contagiosum virus
agcuucgcgagcccg

SEQ ID NO: 3093255 - RNA, 15 nt, Molluscum contagiosum virus
ccgcgcgaacaaaaa

SEQ ID NO: 3093256 - RNA, 14 nt, Molluscum contagiosum virus
gaccgugcccugga

SEQ ID NO: 3093257 - RNA, 16 nt, Molluscum contagiosum virus
gcgcugcugcuucugc

SEQ ID NO: 3093258 - RNA, 16 nt, Molluscum contagiosum virus
ggcccgcggcgcgccg

SEQ ID NO: 3093259 - RNA, 18 nt, Molluscum contagiosum virus
gcaacgugcugcgccgcc

SEQ ID NO: 3093260 - RNA, 16 nt, Molluscum contagiosum virus
cucgugcugggccugc

SEQ ID NO: 3093261 - RNA, 14 nt, Molluscum contagiosum virus
ggaacagggaaaaa

SEQ ID NO: 3093262 - RNA, 23 nt, Molluscum contagiosum virus
ucgaccucugcuucacgcugcuc

SEQ ID NO: 3093263 - RNA, 22 nt, Molluscum contagiosum virus
gcacaccccuguaacaaggaaa

SEQ ID NO: 3093264 - RNA, 21 nt, Molluscum contagiosum virus
agggcuccuucuucagcaggc

SEQ ID NO: 3093265 - RNA, 23 nt, Molluscum contagiosum virus
ccggggaugaacgcgcugcgcca

SEQ ID NO: 3093266 - RNA, 17 nt, Molluscum contagiosum virus
gugaaucugacacuugc

SEQ ID NO: 3093267 - RNA, 17 nt, Molluscum contagiosum virus
gcccagcguggccagcu

SEQ ID NO: 3093268 - RNA, 12 nt, Molluscum contagiosum virus
uguuccugccgg

SEQ ID NO: 3093269 - RNA, 13 nt, Molluscum contagiosum virus
cugcugagcgggg

SEQ ID NO: 3093270 - RNA, 23 nt, Molluscum contagiosum virus
cuccugugucgcgcgagcaaaga

SEQ ID NO: 3093271 - RNA, 19 nt, Molluscum contagiosum virus
gcucuacgagacucuggaa

SEQ ID NO: 3093272 - RNA, 13 nt, Molluscum contagiosum virus
ggcgggugccgug

SEQ ID NO: 3093273 - RNA, 15 nt, Molluscum contagiosum virus
ugccgcgcgcgccgc

SEQ ID NO: 3093274 - RNA, 16 nt, Molluscum contagiosum virus
cucucgagcucacagg

SEQ ID NO: 3093275 - RNA, 13 nt, Molluscum contagiosum virus
cugggcaggccgc

SEQ ID NO: 3093276 - RNA, 22 nt, Molluscum contagiosum virus
uaucccagaaaacgcacugucg

SEQ ID NO: 3093277 - RNA, 21 nt, Molluscum contagiosum virus
gagcuugcgcgcggugcgggc

SEQ ID NO: 3093278 - RNA, 17 nt, Molluscum contagiosum virus
gaacuggcgcagcagga

SEQ ID NO: 3093279 - RNA, 14 nt, Molluscum contagiosum virus
agcuagugcacacc

SEQ ID NO: 3093280 - RNA, 17 nt, Molluscum contagiosum virus
aguacgauggaugcugg

SEQ ID NO: 3093281 - RNA, 15 nt, Molluscum contagiosum virus
ggcgggcggcgucgc

SEQ ID NO: 3093282 - RNA, 13 nt, Molluscum contagiosum virus
cuccgagcgcgcg

SEQ ID NO: 3093283 - RNA, 13 nt, Molluscum contagiosum virus
gccgccgcccgcg

SEQ ID NO: 3093284 - RNA, 16 nt, Molluscum contagiosum virus
cgggugccgugccccu

SEQ ID NO: 3093285 - RNA, 14 nt, Molluscum contagiosum virus
gaggaccccgccgc

SEQ ID NO: 3093286 - RNA, 23 nt, Molluscum contagiosum virus
cagcucgccgcgcgccgcugcuc

SEQ ID NO: 3093287 - RNA, 21 nt, Molluscum contagiosum virus
ccagcucgacacugugcuggc

SEQ ID NO: 3093288 - RNA, 19 nt, Molluscum contagiosum virus
agccucccccgcgcacugc

SEQ ID NO: 3093289 - RNA, 16 nt, Molluscum contagiosum virus
caaggaaaaggcacac

SEQ ID NO: 3093290 - RNA, 16 nt, Molluscum contagiosum virus
acaacucugcucgugc

SEQ ID NO: 3093291 - RNA, 18 nt, Molluscum contagiosum virus
ccugccgcgagcacuggc

SEQ ID NO: 3093292 - RNA, 18 nt, Molluscum contagiosum virus
gaacgucuucgagagccu

SEQ ID NO: 3093293 - RNA, 16 nt, Molluscum contagiosum virus
ugguccggcgugagcu

SEQ ID NO: 3093294 - RNA, 20 nt, Molluscum contagiosum virus
gccggucuccacguggccag

SEQ ID NO: 3093295 - RNA, 18 nt, Molluscum contagiosum virus
acagccgcuuucugggcg

SEQ ID NO: 3093296 - RNA, 21 nt, Molluscum contagiosum virus
cgucuuuuugcggcgccgccg

SEQ ID NO: 3093297 - RNA, 14 nt, Molluscum contagiosum virus
gcggcgccgcagcu

SEQ ID NO: 3093298 - RNA, 16 nt, Molluscum contagiosum virus
cgcgcguugccugaga

SEQ ID NO: 3093299 - RNA, 17 nt, Molluscum contagiosum virus
gcacgucuuugacccca

SEQ ID NO: 3093300 - RNA, 18 nt, Molluscum contagiosum virus
cggcguccggugcucgcc

SEQ ID NO: 3093301 - RNA, 16 nt, Molluscum contagiosum virus
cguuccacuacaagca

SEQ ID NO: 3093302 - RNA, 14 nt, Molluscum contagiosum virus
cgccgcgggcacau

SEQ ID NO: 3093303 - RNA, 15 nt, Molluscum contagiosum virus
gacaccagcggcagg

SEQ ID NO: 3093304 - RNA, 18 nt, Molluscum contagiosum virus
ccagcguuuccucuggcu

SEQ ID NO: 3093305 - RNA, 14 nt, Molluscum contagiosum virus
cuggccaacacuac

SEQ ID NO: 3093306 - RNA, 23 nt, Molluscum contagiosum virus
cuguugccuggagggcagugcca

SEQ ID NO: 3093307 - RNA, 14 nt, Molluscum contagiosum virus
ucccaggaagacgu

SEQ ID NO: 3093308 - RNA, 14 nt, Molluscum contagiosum virus
gcgcgcgccagcag

SEQ ID NO: 3093309 - RNA, 16 nt, Molluscum contagiosum virus
accacagucggugcca

SEQ ID NO: 3093310 - RNA, 20 nt, Molluscum contagiosum virus
uugcucgcgcuccugcguga

SEQ ID NO: 3093311 - RNA, 21 nt, Molluscum contagiosum virus
cucgagcgcgcgccugcuggc

SEQ ID NO: 3093312 - RNA, 19 nt, Molluscum contagiosum virus
cguggucgcgcgcgcucug

SEQ ID NO: 3093313 - RNA, 16 nt, Molluscum contagiosum virus
gccccgacgccagcgc

SEQ ID NO: 3093314 - RNA, 14 nt, Molluscum contagiosum virus
cuuacugcugcaau

SEQ ID NO: 3093315 - RNA, 18 nt, Molluscum contagiosum virus
guacgagcagcugcugcg

SEQ ID NO: 3093316 - RNA, 15 nt, Molluscum contagiosum virus
ccgcggccugggcca

SEQ ID NO: 3093317 - RNA, 13 nt, Molluscum contagiosum virus
ggcaacugccugc

SEQ ID NO: 3093318 - RNA, 18 nt, Molluscum contagiosum virus
ccuccugcaccugcugga

SEQ ID NO: 3093319 - RNA, 14 nt, Molluscum contagiosum virus
cacacgcaccgccu

SEQ ID NO: 3093320 - RNA, 19 nt, Molluscum contagiosum virus
ggacgcgcuugcgcggaag

SEQ ID NO: 3093321 - RNA, 13 nt, Molluscum contagiosum virus
caagcacugccuc

SEQ ID NO: 3093322 - RNA, 15 nt, Molluscum contagiosum virus
gagacgcugcugcac

SEQ ID NO: 3093323 - RNA, 18 nt, Molluscum contagiosum virus
ccgucuugcgcacacacu

SEQ ID NO: 3093324 - RNA, 19 nt, Molluscum contagiosum virus
cagagcugcccgccagaag

SEQ ID NO: 3093325 - RNA, 16 nt, Molluscum contagiosum virus
agggagccucgcuggu

SEQ ID NO: 3093326 - RNA, 20 nt, Molluscum contagiosum virus
gcagcacaugcaggccgaga

SEQ ID NO: 3093327 - RNA, 20 nt, Molluscum contagiosum virus
gaggcccaggccauggagcg

SEQ ID NO: 3093328 - RNA, 17 nt, Molluscum contagiosum virus
acaugccgcgcugcucc

SEQ ID NO: 3093329 - RNA, 17 nt, Molluscum contagiosum virus
uacuccacuaccaacuc

SEQ ID NO: 3093330 - RNA, 17 nt, Molluscum contagiosum virus
aguaucggcaacauuua

SEQ ID NO: 3093331 - RNA, 21 nt, Molluscum contagiosum virus
guccccguccgugucgagcug

SEQ ID NO: 3093332 - RNA, 22 nt, Molluscum contagiosum virus
ccuugucgagacaggccggggc

SEQ ID NO: 3093333 - RNA, 23 nt, Molluscum contagiosum virus
ggcacgcugcguuuccagggcag

SEQ ID NO: 3093334 - RNA, 17 nt, Molluscum contagiosum virus
gccugcacuacugcucc

SEQ ID NO: 3093335 - RNA, 15 nt, Molluscum contagiosum virus
ccgcggcgacgucaa

SEQ ID NO: 3093336 - RNA, 13 nt, Molluscum contagiosum virus
cgcccgugccgcc

SEQ ID NO: 3093337 - RNA, 22 nt, Molluscum contagiosum virus
cguguacaugaugcccugguga

SEQ ID NO: 3093338 - RNA, 15 nt, Molluscum contagiosum virus
aacaugaaggaaagu

SEQ ID NO: 3093339 - RNA, 11 nt, Molluscum contagiosum virus
ucccucugugc

SEQ ID NO: 3093340 - RNA, 22 nt, Molluscum contagiosum virus
cgggaaggggugauggcgguga

SEQ ID NO: 3093341 - RNA, 15 nt, Molluscum contagiosum virus
gacgcagcgcgagcu

SEQ ID NO: 3093342 - RNA, 22 nt, Molluscum contagiosum virus
ccagcgacaccgacgaggugcg

SEQ ID NO: 3093343 - RNA, 21 nt, Molluscum contagiosum virus
ccgcaaggaaaacugcauccu

SEQ ID NO: 3093344 - RNA, 14 nt, Molluscum contagiosum virus
cgcucgcgugccgc

SEQ ID NO: 3093345 - RNA, 19 nt, Molluscum contagiosum virus
gugcgugcccagcagguag

SEQ ID NO: 3093346 - RNA, 20 nt, Molluscum contagiosum virus
gccacugccacggcugcaag

SEQ ID NO: 3093347 - RNA, 15 nt, Molluscum contagiosum virus
uggcuucgcaagcau

SEQ ID NO: 3093348 - RNA, 21 nt, Molluscum contagiosum virus
ugcgcgagacgcugcugcaca

SEQ ID NO: 3093349 - RNA, 16 nt, Molluscum contagiosum virus
cgcgccgcgccgcacg

SEQ ID NO: 3093350 - RNA, 15 nt, Molluscum contagiosum virus
ugcccgcgcgcgacu

SEQ ID NO: 3093351 - RNA, 22 nt, Molluscum contagiosum virus
gcgugacccucuucgacuuacg

SEQ ID NO: 3093352 - RNA, 17 nt, Molluscum contagiosum virus
acccaucggagaagugc

SEQ ID NO: 3093353 - RNA, 14 nt, Molluscum contagiosum virus
cuagacuggagcac

SEQ ID NO: 3093354 - RNA, 12 nt, Molluscum contagiosum virus
cucgcagccucc

SEQ ID NO: 3093355 - RNA, 20 nt, Molluscum contagiosum virus
gccugcgcgagcaagcgccc

SEQ ID NO: 3093356 - RNA, 13 nt, Molluscum contagiosum virus
cgucgcgcaggcg

SEQ ID NO: 3093357 - RNA, 15 nt, Molluscum contagiosum virus
ugccgcgggacgaga

SEQ ID NO: 3093358 - RNA, 22 nt, Molluscum contagiosum virus
ggcgagcaagauggugucgccg

SEQ ID NO: 3093359 - RNA, 15 nt, Molluscum contagiosum virus
ccucggucaacggca

SEQ ID NO: 3093360 - RNA, 20 nt, Molluscum contagiosum virus
cuacgcgagcacugcgcgcg

SEQ ID NO: 3093361 - RNA, 12 nt, Molluscum contagiosum virus
ccgcgcgcgccg

SEQ ID NO: 3093362 - RNA, 13 nt, Molluscum contagiosum virus
cgcaauucccggc

SEQ ID NO: 3093363 - RNA, 18 nt, Molluscum contagiosum virus
caucuagccuccuugucu

SEQ ID NO: 3093364 - RNA, 12 nt, Molluscum contagiosum virus
ugcggcggcucg

SEQ ID NO: 3093365 - RNA, 15 nt, Molluscum contagiosum virus
ugacggcagcaagcg

SEQ ID NO: 3093366 - RNA, 19 nt, Molluscum contagiosum virus
caccguugccgcggcagug

SEQ ID NO: 3093367 - RNA, 18 nt, Molluscum contagiosum virus
cuagcgugagagcaaaga

SEQ ID NO: 3093368 - RNA, 12 nt, Molluscum contagiosum virus
cagcaccugcag

SEQ ID NO: 3093369 - RNA, 16 nt, Molluscum contagiosum virus
acgaaagcaaaggagu

SEQ ID NO: 3093370 - RNA, 14 nt, Molluscum contagiosum virus
aggcacccaccagg

SEQ ID NO: 3093371 - RNA, 15 nt, Molluscum contagiosum virus
caccucgagcucguu

SEQ ID NO: 3093372 - RNA, 17 nt, Molluscum contagiosum virus
uguggcgccgaugcagu

SEQ ID NO: 3093373 - RNA, 15 nt, Molluscum contagiosum virus
ccgacucggugcuca

SEQ ID NO: 3093374 - RNA, 18 nt, Molluscum contagiosum virus
ggccgcauuuucucugga

SEQ ID NO: 3093375 - RNA, 21 nt, Molluscum contagiosum virus
ggccguguacaugcucaagca

SEQ ID NO: 3093376 - RNA, 18 nt, Molluscum contagiosum virus
gcugguucugcucgcagg

SEQ ID NO: 3093377 - RNA, 20 nt, Molluscum contagiosum virus
cgcacgauguacuccaccau

SEQ ID NO: 3093378 - RNA, 12 nt, Molluscum contagiosum virus
ggacagcaaaca

SEQ ID NO: 3093379 - RNA, 20 nt, Molluscum contagiosum virus
cacgugcucaagugcgucga

SEQ ID NO: 3093380 - RNA, 16 nt, Molluscum contagiosum virus
gcugcgcuggaugcug

SEQ ID NO: 3093381 - RNA, 21 nt, Molluscum contagiosum virus
uggccuguaguagcagcuucu

SEQ ID NO: 3093382 - RNA, 14 nt, Molluscum contagiosum virus
gcgcgcgcgaacgc

SEQ ID NO: 3093383 - RNA, 17 nt, Molluscum contagiosum virus
uccaaaagacagaggcc

SEQ ID NO: 3093384 - RNA, 19 nt, Molluscum contagiosum virus
cagucgccuuccugcgccc

SEQ ID NO: 3093385 - RNA, 19 nt, Molluscum contagiosum virus
ggggcugucagaggauucu

SEQ ID NO: 3093386 - RNA, 17 nt, Molluscum contagiosum virus
ugcaguuccaccucgag

SEQ ID NO: 3093387 - RNA, 20 nt, Molluscum contagiosum virus
gccgcuccuucgaagagguc

SEQ ID NO: 3093388 - RNA, 21 nt, Molluscum contagiosum virus
caagaaacgggagucacuucu

SEQ ID NO: 3093389 - RNA, 16 nt, Molluscum contagiosum virus
aggcgccgaagagugc

SEQ ID NO: 3093390 - RNA, 18 nt, Molluscum contagiosum virus
cagggcggcgccugcgcc

SEQ ID NO: 3093391 - RNA, 17 nt, Molluscum contagiosum virus
auccaugucgagcccug

SEQ ID NO: 3093392 - RNA, 18 nt, Molluscum contagiosum virus
gcgcugcugacacgcucu

SEQ ID NO: 3093393 - RNA, 23 nt, Molluscum contagiosum virus
gaguacgagcgcguaagaccaug

SEQ ID NO: 3093394 - RNA, 22 nt, Molluscum contagiosum virus
uccacgaugaacggcuccuuga

SEQ ID NO: 3093395 - RNA, 18 nt, Molluscum contagiosum virus
gcacuguguccccugagc

SEQ ID NO: 3093396 - RNA, 18 nt, Molluscum contagiosum virus
acugcggacaccagaacc

SEQ ID NO: 3093397 - RNA, 16 nt, Molluscum contagiosum virus
gcucucgcugcugccc

SEQ ID NO: 3093398 - RNA, 12 nt, Molluscum contagiosum virus
agccugcucacg

SEQ ID NO: 3093399 - RNA, 17 nt, Molluscum contagiosum virus
cugaggaagcaagaccc

SEQ ID NO: 3093400 - RNA, 14 nt, Molluscum contagiosum virus
cccacgugccaaga

SEQ ID NO: 3093401 - RNA, 20 nt, Molluscum contagiosum virus
agcugacccucgcggcucug

SEQ ID NO: 3093402 - RNA, 20 nt, Molluscum contagiosum virus
caggucaucgacgagcacga

SEQ ID NO: 3093403 - RNA, 14 nt, Molluscum contagiosum virus
gcccccgagcgcuu

SEQ ID NO: 3093404 - RNA, 21 nt, Molluscum contagiosum virus
guccggcaugcgcgcgcugcc

SEQ ID NO: 3093405 - RNA, 14 nt, Molluscum contagiosum virus
uaccccgcaggaaa

SEQ ID NO: 3093406 - RNA, 17 nt, Molluscum contagiosum virus
cgcagccuccgugcgcc

SEQ ID NO: 3093407 - RNA, 11 nt, Molluscum contagiosum virus
guguuucucgc

SEQ ID NO: 3093408 - RNA, 14 nt, Molluscum contagiosum virus
cgcugcgccacugc

SEQ ID NO: 3093409 - RNA, 21 nt, Molluscum contagiosum virus
ggccugcugaagaaggagccc

SEQ ID NO: 3093410 - RNA, 19 nt, Molluscum contagiosum virus
ugccagcgccagccugcug

SEQ ID NO: 3093411 - RNA, 23 nt, Molluscum contagiosum virus
gccgaugccuaugccgagguggc

SEQ ID NO: 3093412 - RNA, 18 nt, Molluscum contagiosum virus
auggacaaagaugcagcc

SEQ ID NO: 3093413 - RNA, 16 nt, Molluscum contagiosum virus
gccuacgugcugcgca

SEQ ID NO: 3093414 - RNA, 16 nt, Molluscum contagiosum virus
gcgcgggagcucacgg

SEQ ID NO: 3093415 - RNA, 15 nt, Molluscum contagiosum virus
ccccggcgccggcac

SEQ ID NO: 3093416 - RNA, 23 nt, Molluscum contagiosum virus
ugcgcaucccugcgcaccugcac

SEQ ID NO: 3093417 - RNA, 14 nt, Molluscum contagiosum virus
gcgcgugcuggacg

SEQ ID NO: 3093418 - RNA, 22 nt, Molluscum contagiosum virus
uguucaccaccaccagcacgcu

SEQ ID NO: 3093419 - RNA, 16 nt, Molluscum contagiosum virus
cugcgcuacauguaug

SEQ ID NO: 3093420 - RNA, 21 nt, Molluscum contagiosum virus
auugcccgcgcgcggacagcc

SEQ ID NO: 3093421 - RNA, 20 nt, Molluscum contagiosum virus
gagacggaaauguuguuuga

SEQ ID NO: 3093422 - RNA, 14 nt, Molluscum contagiosum virus
ccaggaacagggaa

SEQ ID NO: 3093423 - RNA, 15 nt, Molluscum contagiosum virus
ccaugcgcagugccu

SEQ ID NO: 3093424 - RNA, 20 nt, Molluscum contagiosum virus
agucaggcaaaagccgccgc

SEQ ID NO: 3093425 - RNA, 19 nt, Molluscum contagiosum virus
acagucuagugcguccgcc

SEQ ID NO: 3093426 - RNA, 13 nt, Molluscum contagiosum virus
cgaagagcagaag

SEQ ID NO: 3093427 - RNA, 22 nt, Molluscum contagiosum virus
gccagccgcucguccagcugcg

SEQ ID NO: 3093428 - RNA, 19 nt, Molluscum contagiosum virus
gcgccggaaacggaccugg

SEQ ID NO: 3093429 - RNA, 22 nt, Molluscum contagiosum virus
ggucaagaacaugugcuccgcc

SEQ ID NO: 3093430 - RNA, 14 nt, Molluscum contagiosum virus
gauggacgccagcu

SEQ ID NO: 3093431 - RNA, 18 nt, Molluscum contagiosum virus
agucgccuuccugcgccc

SEQ ID NO: 3093432 - RNA, 23 nt, Molluscum contagiosum virus
gauggcgccugcuucgcgccgcc

SEQ ID NO: 3093433 - RNA, 22 nt, Molluscum contagiosum virus
cccgcaggaaagguaccccgca

SEQ ID NO: 3093434 - RNA, 21 nt, Molluscum contagiosum virus
cuggacugagccgcaagcaca

SEQ ID NO: 3093435 - RNA, 14 nt, Molluscum contagiosum virus
aacgcgggccaggc

SEQ ID NO: 3093436 - RNA, 19 nt, Molluscum contagiosum virus
ggaaccguggugcgcgacc

SEQ ID NO: 3093437 - RNA, 21 nt, Molluscum contagiosum virus
gcgcgcgucgagggcgccggg

SEQ ID NO: 3093438 - RNA, 14 nt, Molluscum contagiosum virus
ggcgcgcugugagc

SEQ ID NO: 3093439 - RNA, 12 nt, Molluscum contagiosum virus
gccgcgggcaca

SEQ ID NO: 3093440 - RNA, 13 nt, Molluscum contagiosum virus
gacagcauccugg

SEQ ID NO: 3093441 - RNA, 14 nt, Molluscum contagiosum virus
cugccgggagagcc

SEQ ID NO: 3093442 - RNA, 16 nt, Molluscum contagiosum virus
gggcuccuucuucuuu

SEQ ID NO: 3093443 - RNA, 15 nt, Molluscum contagiosum virus
uguaguuaaaugacg

SEQ ID NO: 3093444 - RNA, 18 nt, Molluscum contagiosum virus
acacgcugcgcgugcugg

SEQ ID NO: 3093445 - RNA, 22 nt, Molluscum contagiosum virus
ucucgauggcgccguuggccac

SEQ ID NO: 3093446 - RNA, 12 nt, Molluscum contagiosum virus
ugaacaagcugc

SEQ ID NO: 3093447 - RNA, 22 nt, Molluscum contagiosum virus
guggcgcgaagugaacucuucc

SEQ ID NO: 3093448 - RNA, 18 nt, Molluscum contagiosum virus
cgcacgcgcgggcaucaa

SEQ ID NO: 3093449 - RNA, 14 nt, Molluscum contagiosum virus
ccgguacugcugca

SEQ ID NO: 3093450 - RNA, 12 nt, Molluscum contagiosum virus
cccagguggagc

SEQ ID NO: 3093451 - RNA, 21 nt, Molluscum contagiosum virus
gcuuagcuuccgucugcugcu

SEQ ID NO: 3093452 - RNA, 20 nt, Molluscum contagiosum virus
augcgguguguguucucaaa

SEQ ID NO: 3093453 - RNA, 20 nt, Molluscum contagiosum virus
cggcagcgacuacgcgcugc

SEQ ID NO: 3093454 - RNA, 15 nt, Molluscum contagiosum virus
cuagugcugcugggc

SEQ ID NO: 3093455 - RNA, 21 nt, Molluscum contagiosum virus
cguacgagcaggcgcagcgcg

SEQ ID NO: 3093456 - RNA, 15 nt, Molluscum contagiosum virus
cggcgcccgugagca

SEQ ID NO: 3093457 - RNA, 13 nt, Molluscum contagiosum virus
ccguccgcgcagc

SEQ ID NO: 3093458 - RNA, 15 nt, Molluscum contagiosum virus
gcagcguuccaggaa

SEQ ID NO: 3093459 - RNA, 14 nt, Molluscum contagiosum virus
gcgcuggagaaaga

SEQ ID NO: 3093460 - RNA, 15 nt, Molluscum contagiosum virus
cgccggacagcucag

SEQ ID NO: 3093461 - RNA, 13 nt, Molluscum contagiosum virus
agaucaggcagcu

SEQ ID NO: 3093462 - RNA, 20 nt, Molluscum contagiosum virus
auuucguucgacuacacgcg

SEQ ID NO: 3093463 - RNA, 20 nt, Molluscum contagiosum virus
agacauuucuccuccggggc

SEQ ID NO: 3093464 - RNA, 17 nt, Molluscum contagiosum virus
cgcgcaguucgagcugc

SEQ ID NO: 3093465 - RNA, 13 nt, Molluscum contagiosum virus
uggacagcaagca

SEQ ID NO: 3093466 - RNA, 15 nt, Molluscum contagiosum virus
ggcacccaccaggaa

SEQ ID NO: 3093467 - RNA, 14 nt, Molluscum contagiosum virus
ggagggagagcugc

SEQ ID NO: 3093468 - RNA, 13 nt, Molluscum contagiosum virus
cuuuucuaggccu

SEQ ID NO: 3093469 - RNA, 16 nt, Molluscum contagiosum virus
caacauggugcuggcc

SEQ ID NO: 3093470 - RNA, 23 nt, Molluscum contagiosum virus
cagccauggccuguaguagcagc

SEQ ID NO: 3093471 - RNA, 14 nt, Molluscum contagiosum virus
cgggcccgcgaacg

SEQ ID NO: 3093472 - RNA, 15 nt, Molluscum contagiosum virus
agcaccgcaugggcc

SEQ ID NO: 3093473 - RNA, 16 nt, Molluscum contagiosum virus
caaugaggagaggaac

SEQ ID NO: 3093474 - RNA, 18 nt, Molluscum contagiosum virus
acucgcugcugcucuucc

SEQ ID NO: 3093475 - RNA, 13 nt, Molluscum contagiosum virus
cucagaccagagu

SEQ ID NO: 3093476 - RNA, 22 nt, Molluscum contagiosum virus
ccugguacgcgcgcgcgcucac

SEQ ID NO: 3093477 - RNA, 18 nt, Molluscum contagiosum virus
acgcugcacgagcugcug

SEQ ID NO: 3093478 - RNA, 17 nt, Molluscum contagiosum virus
cguggccaggccgcgcc

SEQ ID NO: 3093479 - RNA, 11 nt, Molluscum contagiosum virus
gcacaguucac

SEQ ID NO: 3093480 - RNA, 18 nt, Molluscum contagiosum virus
ggucguccuggagccuag

SEQ ID NO: 3093481 - RNA, 23 nt, Molluscum contagiosum virus
gccaccagcgcggccguggcugc

SEQ ID NO: 3093482 - RNA, 17 nt, Molluscum contagiosum virus
uccccgaacugcugggc

SEQ ID NO: 3093483 - RNA, 14 nt, Molluscum contagiosum virus
ugauuugcgcacca

SEQ ID NO: 3093484 - RNA, 21 nt, Molluscum contagiosum virus
cugcgugugccggugcugcgg

SEQ ID NO: 3093485 - RNA, 19 nt, Molluscum contagiosum virus
gcucguuuucggauagccc

SEQ ID NO: 3093486 - RNA, 18 nt, Molluscum contagiosum virus
acgucauuguaaaacgac

SEQ ID NO: 3093487 - RNA, 22 nt, Molluscum contagiosum virus
acgcugccggcaacgcugccgc

SEQ ID NO: 3093488 - RNA, 21 nt, Molluscum contagiosum virus
gugcaugacggcgcgagccag

SEQ ID NO: 3093489 - RNA, 20 nt, Molluscum contagiosum virus
cguguacgacgugcugcugc

SEQ ID NO: 3093490 - RNA, 16 nt, Molluscum contagiosum virus
cccgcgcccgcgccgc

SEQ ID NO: 3093491 - RNA, 18 nt, Molluscum contagiosum virus
acgugcuuccccgccauc

SEQ ID NO: 3093492 - RNA, 19 nt, Molluscum contagiosum virus
ccuggucuucccgcuggcg

SEQ ID NO: 3093493 - RNA, 14 nt, Molluscum contagiosum virus
ggaugccugccagc

SEQ ID NO: 3093494 - RNA, 19 nt, Molluscum contagiosum virus
acaggcgcggcagccgcag

SEQ ID NO: 3093495 - RNA, 21 nt, Molluscum contagiosum virus
gcaccguaccgcgcccgccag

SEQ ID NO: 3093496 - RNA, 18 nt, Molluscum contagiosum virus
gcuccgcggaggccaagc

SEQ ID NO: 3093497 - RNA, 14 nt, Molluscum contagiosum virus
agcgccgccagcuc

SEQ ID NO: 3093498 - RNA, 14 nt, Molluscum contagiosum virus
cgcgugccuguggc

SEQ ID NO: 3093499 - RNA, 20 nt, Molluscum contagiosum virus
caggaacgaggaaaggcaca

SEQ ID NO: 3093500 - RNA, 14 nt, Molluscum contagiosum virus
cuugcauguucucu

SEQ ID NO: 3093501 - RNA, 14 nt, Molluscum contagiosum virus
gcacacgcaccgcc

SEQ ID NO: 3093502 - RNA, 21 nt, Molluscum contagiosum virus
ucacaagcaccgccugcugca

SEQ ID NO: 3093503 - RNA, 15 nt, Molluscum contagiosum virus
gcaaccgcgugcgug

SEQ ID NO: 3093504 - RNA, 12 nt, Molluscum contagiosum virus
cgcgcccacggg

SEQ ID NO: 3093505 - RNA, 14 nt, Molluscum contagiosum virus
uacgcuacagcagc

SEQ ID NO: 3093506 - RNA, 20 nt, Molluscum contagiosum virus
gcucuacggcgaguucugcc

SEQ ID NO: 3093507 - RNA, 21 nt, Molluscum contagiosum virus
gaacaccuccugcuuugcacg

SEQ ID NO: 3093508 - RNA, 23 nt, Molluscum contagiosum virus
guccccgagcagcggggacucuc

SEQ ID NO: 3093509 - RNA, 17 nt, Molluscum contagiosum virus
ggccuguucggcaugca

SEQ ID NO: 3093510 - RNA, 15 nt, Molluscum contagiosum virus
accuggcggcgcugg

SEQ ID NO: 3093511 - RNA, 13 nt, Molluscum contagiosum virus
uucguggcgcugg

SEQ ID NO: 3093512 - RNA, 22 nt, Molluscum contagiosum virus
gauggaggcccaggccauggag

SEQ ID NO: 3093513 - RNA, 20 nt, Molluscum contagiosum virus
cgcgcgcuagccgccgcugc

SEQ ID NO: 3093514 - RNA, 14 nt, Molluscum contagiosum virus
gcgugcugcagccc

SEQ ID NO: 3093515 - RNA, 22 nt, Molluscum contagiosum virus
ggaacgaggaaaggcacacccc

SEQ ID NO: 3093516 - RNA, 23 nt, Molluscum contagiosum virus
ucagaaauacaccggcuuggcca

SEQ ID NO: 3093517 - RNA, 14 nt, Molluscum contagiosum virus
uccagcgcgcucga

SEQ ID NO: 3093518 - RNA, 16 nt, Molluscum contagiosum virus
uggauaccaugcucuc

SEQ ID NO: 3093519 - RNA, 16 nt, Molluscum contagiosum virus
gaacgcgcaagugugc

SEQ ID NO: 3093520 - RNA, 21 nt, Molluscum contagiosum virus
cguucgcaacaaaagagcgcg

SEQ ID NO: 3093521 - RNA, 14 nt, Molluscum contagiosum virus
acgcgcgugguaca

SEQ ID NO: 3093522 - RNA, 16 nt, Molluscum contagiosum virus
cgauguacuccaccau

SEQ ID NO: 3093523 - RNA, 23 nt, Molluscum contagiosum virus
gugcugcugcggcugcuggagcu

SEQ ID NO: 3093524 - RNA, 22 nt, Molluscum contagiosum virus
cgacacgagcgaguugagcagg

SEQ ID NO: 3093525 - RNA, 15 nt, Molluscum contagiosum virus
ugcagagcgugcugg

SEQ ID NO: 3093526 - RNA, 19 nt, Molluscum contagiosum virus
ucguucgcggggccggcuu

SEQ ID NO: 3093527 - RNA, 22 nt, Molluscum contagiosum virus
uccauugcauggacauccucac

SEQ ID NO: 3093528 - RNA, 21 nt, Molluscum contagiosum virus
cuguucggcaugcagcgcagg

SEQ ID NO: 3093529 - RNA, 21 nt, Molluscum contagiosum virus
cgccuccaagaagaggccggc

SEQ ID NO: 3093530 - RNA, 20 nt, Molluscum contagiosum virus
acgaggucgcguccacgcag

SEQ ID NO: 3093531 - RNA, 19 nt, Molluscum contagiosum virus
gcaacgcacaaaacacaaa

SEQ ID NO: 3093532 - RNA, 10 nt, Molluscum contagiosum virus
ccggcugccc

SEQ ID NO: 3093533 - RNA, 23 nt, Molluscum contagiosum virus
acgggcacgccgugggcagcuuc

SEQ ID NO: 3093534 - RNA, 13 nt, Molluscum contagiosum virus
ugcagcagcacag

SEQ ID NO: 3093535 - RNA, 15 nt, Molluscum contagiosum virus
cgcgccugccgccug

SEQ ID NO: 3093536 - RNA, 20 nt, Molluscum contagiosum virus
aguggcguccgcacgaggag

SEQ ID NO: 3093537 - RNA, 22 nt, Molluscum contagiosum virus
gcaccgcgccccacugugccag

SEQ ID NO: 3093538 - RNA, 19 nt, Molluscum contagiosum virus
aguagcgcucgcccagcuc

SEQ ID NO: 3093539 - RNA, 14 nt, Molluscum contagiosum virus
cggacgcgggccgc

SEQ ID NO: 3093540 - RNA, 11 nt, Molluscum contagiosum virus
agcucuucccc

SEQ ID NO: 3093541 - RNA, 19 nt, Molluscum contagiosum virus
gccuccgguacguacagug

SEQ ID NO: 3093542 - RNA, 17 nt, Molluscum contagiosum virus
cccgcugcacgcucuuc

SEQ ID NO: 3093543 - RNA, 21 nt, Molluscum contagiosum virus
ggcaccugcaggaaaggcacc

SEQ ID NO: 3093544 - RNA, 14 nt, Molluscum contagiosum virus
accuuccugggcgg

SEQ ID NO: 3093545 - RNA, 12 nt, Molluscum contagiosum virus
ccacuggugugu

SEQ ID NO: 3093546 - RNA, 13 nt, Molluscum contagiosum virus
ccucgagcagcgg

SEQ ID NO: 3093547 - RNA, 18 nt, Molluscum contagiosum virus
ccuggcagugccgggcgc

SEQ ID NO: 3093548 - RNA, 23 nt, Molluscum contagiosum virus
uguguacgacgcgcccacgugcc

SEQ ID NO: 3093549 - RNA, 19 nt, Molluscum contagiosum virus
augcgcgggcuacuuuucg

SEQ ID NO: 3093550 - RNA, 14 nt, Molluscum contagiosum virus
agaccaccagcacc

SEQ ID NO: 3093551 - RNA, 23 nt, Molluscum contagiosum virus
cuuccgcgagcacguggacagca

SEQ ID NO: 3093552 - RNA, 14 nt, Molluscum contagiosum virus
gggcgcgggccugu

SEQ ID NO: 3093553 - RNA, 22 nt, Molluscum contagiosum virus
guaguugcgagccagccaggcg

SEQ ID NO: 3093554 - RNA, 21 nt, Molluscum contagiosum virus
ggcacgggcucgagcucuucu

SEQ ID NO: 3093555 - RNA, 14 nt, Molluscum contagiosum virus
ugagugcugagcca

SEQ ID NO: 3093556 - RNA, 17 nt, Molluscum contagiosum virus
cgcgugaguccgcggcg

SEQ ID NO: 3093557 - RNA, 14 nt, Molluscum contagiosum virus
aggccuugcuccca

SEQ ID NO: 3093558 - RNA, 21 nt, Molluscum contagiosum virus
cugcuggccaacccucgcaag

SEQ ID NO: 3093559 - RNA, 17 nt, Molluscum contagiosum virus
guagcgcucgcccagcu

SEQ ID NO: 3093560 - RNA, 13 nt, Molluscum contagiosum virus
gagcgcagcugcc

SEQ ID NO: 3093561 - RNA, 18 nt, Molluscum contagiosum virus
gcaagcuucgggccgcug

SEQ ID NO: 3093562 - RNA, 21 nt, Molluscum contagiosum virus
cguggcgcgcgacgugugcuc

SEQ ID NO: 3093563 - RNA, 17 nt, Molluscum contagiosum virus
agagcauuagcagcgag

SEQ ID NO: 3093564 - RNA, 14 nt, Molluscum contagiosum virus
aaugcgcacacuug

SEQ ID NO: 3093565 - RNA, 17 nt, Molluscum contagiosum virus
aggagacguagagcagc

SEQ ID NO: 3093566 - RNA, 22 nt, Molluscum contagiosum virus
cagcaggugcacgugcugcagc

SEQ ID NO: 3093567 - RNA, 12 nt, Molluscum contagiosum virus
gcacgggcgcag

SEQ ID NO: 3093568 - RNA, 16 nt, Molluscum contagiosum virus
aggucuuccacaugcc

SEQ ID NO: 3093569 - RNA, 12 nt, Molluscum contagiosum virus
acucgcugcugc

SEQ ID NO: 3093570 - RNA, 20 nt, Molluscum contagiosum virus
ccguguaagcccgcuaugaa

SEQ ID NO: 3093571 - RNA, 17 nt, Molluscum contagiosum virus
ugcucgccagcagguuc

SEQ ID NO: 3093572 - RNA, 18 nt, Molluscum contagiosum virus
cagcugcgcgagccgcug

SEQ ID NO: 3093573 - RNA, 16 nt, Molluscum contagiosum virus
guacaggcgcggcagc

SEQ ID NO: 3093574 - RNA, 23 nt, Molluscum contagiosum virus
cgccgcgcaugacagccauggcc

SEQ ID NO: 3093575 - RNA, 14 nt, Molluscum contagiosum virus
gcgcaccugcuaga

SEQ ID NO: 3093576 - RNA, 20 nt, Molluscum contagiosum virus
gucaauggcgcgcgagcaca

SEQ ID NO: 3093577 - RNA, 16 nt, Molluscum contagiosum virus
guccucgacaaugagc

SEQ ID NO: 3093578 - RNA, 14 nt, Molluscum contagiosum virus
cgcgcgcaccugca

SEQ ID NO: 3093579 - RNA, 22 nt, Molluscum contagiosum virus
cccguggccgagccgcuggccg

SEQ ID NO: 3093580 - RNA, 13 nt, Molluscum contagiosum virus
uagccuacguggc

SEQ ID NO: 3093581 - RNA, 17 nt, Molluscum contagiosum virus
cgggccuuugccgcugc

SEQ ID NO: 3093582 - RNA, 23 nt, Molluscum contagiosum virus
caguaccgugucaaacugcuugu

SEQ ID NO: 3093583 - RNA, 14 nt, Molluscum contagiosum virus
ggcgccgcugcugg

SEQ ID NO: 3093584 - RNA, 14 nt, Molluscum contagiosum virus
cugcucgcgcacgc

SEQ ID NO: 3093585 - RNA, 15 nt, Molluscum contagiosum virus
auguacgucgucauc

SEQ ID NO: 3093586 - RNA, 12 nt, Molluscum contagiosum virus
cucacgcuguuu

SEQ ID NO: 3093587 - RNA, 14 nt, Molluscum contagiosum virus
acggacgcccuccu

SEQ ID NO: 3093588 - RNA, 20 nt, Molluscum contagiosum virus
ccgcuuucgcaaacaagcau

SEQ ID NO: 3093589 - RNA, 16 nt, Molluscum contagiosum virus
cagucgcgacgcgcuu

SEQ ID NO: 3093590 - RNA, 21 nt, Molluscum contagiosum virus
gccugcacgcgcacuugccug

SEQ ID NO: 3093591 - RNA, 20 nt, Molluscum contagiosum virus
cgaggcacucgucgcgcugc

SEQ ID NO: 3093592 - RNA, 22 nt, Molluscum contagiosum virus
cgacucggacacguugcagcag

SEQ ID NO: 3093593 - RNA, 18 nt, Molluscum contagiosum virus
augaagaugucgccgcgu

SEQ ID NO: 3093594 - RNA, 14 nt, Molluscum contagiosum virus
accucgcgcgccgc

SEQ ID NO: 3093595 - RNA, 22 nt, Molluscum contagiosum virus
guuuccugcggcgcugcuacaa

SEQ ID NO: 3093596 - RNA, 19 nt, Molluscum contagiosum virus
cgaggcguccagcggcugc

SEQ ID NO: 3093597 - RNA, 15 nt, Molluscum contagiosum virus
guaagcgacagguca

SEQ ID NO: 3093598 - RNA, 21 nt, Molluscum contagiosum virus
uuugcaaguucgcugcuggca

SEQ ID NO: 3093599 - RNA, 17 nt, Molluscum contagiosum virus
cgcggucgggccccugc

SEQ ID NO: 3093600 - RNA, 16 nt, Molluscum contagiosum virus
gcugcgaccaagacag

SEQ ID NO: 3093601 - RNA, 13 nt, Molluscum contagiosum virus
accuccuucgcgu

SEQ ID NO: 3093602 - RNA, 14 nt, Molluscum contagiosum virus
agccugcugcucuu

SEQ ID NO: 3093603 - RNA, 17 nt, Molluscum contagiosum virus
gagaagaacagcacgaa

SEQ ID NO: 3093604 - RNA, 18 nt, Molluscum contagiosum virus
ugcgucgacguggagccu

SEQ ID NO: 3093605 - RNA, 13 nt, Molluscum contagiosum virus
ugaaccugggcau

SEQ ID NO: 3093606 - RNA, 22 nt, Molluscum contagiosum virus
gacggcccccuuacgcuacagc

SEQ ID NO: 3093607 - RNA, 18 nt, Molluscum contagiosum virus
gcacaguccagcccgcgg

SEQ ID NO: 3093608 - RNA, 22 nt, Molluscum contagiosum virus
ccggacgauaaauggaccucaa

SEQ ID NO: 3093609 - RNA, 12 nt, Molluscum contagiosum virus
cacacucgcucu

SEQ ID NO: 3093610 - RNA, 16 nt, Molluscum contagiosum virus
cgaccgcgcacgcagc

SEQ ID NO: 3093611 - RNA, 12 nt, Molluscum contagiosum virus
gcuccgccugca

SEQ ID NO: 3093612 - RNA, 16 nt, Molluscum contagiosum virus
acugcguugucuccuc

SEQ ID NO: 3093613 - RNA, 13 nt, Molluscum contagiosum virus
ugguccaccagcu

SEQ ID NO: 3093614 - RNA, 17 nt, Molluscum contagiosum virus
gcgcugccagcucgaca

SEQ ID NO: 3093615 - RNA, 13 nt, Molluscum contagiosum virus
acgugcugcugcg

SEQ ID NO: 3093616 - RNA, 14 nt, Molluscum contagiosum virus
cacaagcaccgccu

SEQ ID NO: 3093617 - RNA, 15 nt, Molluscum contagiosum virus
agucuucaagacugg

SEQ ID NO: 3093618 - RNA, 13 nt, Molluscum contagiosum virus
cgggccuguccgc

SEQ ID NO: 3093619 - RNA, 20 nt, Molluscum contagiosum virus
ccgcuaccgcagccacggcc

SEQ ID NO: 3093620 - RNA, 13 nt, Molluscum contagiosum virus
uccuccagggcac

SEQ ID NO: 3093621 - RNA, 14 nt, Molluscum contagiosum virus
gcgcucgagcuccg

SEQ ID NO: 3093622 - RNA, 22 nt, Molluscum contagiosum virus
gaaagcgucgugugcgcgcacg

SEQ ID NO: 3093623 - RNA, 13 nt, Molluscum contagiosum virus
gcgccauccacgu

SEQ ID NO: 3093624 - RNA, 18 nt, Molluscum contagiosum virus
cacaucucucagggcagc

SEQ ID NO: 3093625 - RNA, 19 nt, Molluscum contagiosum virus
cgcaggcccggcggcccgc

SEQ ID NO: 3093626 - RNA, 22 nt, Molluscum contagiosum virus
caccgcguccgcuaccgcagcc

SEQ ID NO: 3093627 - RNA, 19 nt, Molluscum contagiosum virus
cggcggcugugcccgcggc

SEQ ID NO: 3093628 - RNA, 19 nt, Molluscum contagiosum virus
agggcuccuucuucagcag

SEQ ID NO: 3093629 - RNA, 21 nt, Molluscum contagiosum virus
caagcacuacauggacgugcu

SEQ ID NO: 3093630 - RNA, 11 nt, Molluscum contagiosum virus
ugcgccgccgc

SEQ ID NO: 3093631 - RNA, 16 nt, Molluscum contagiosum virus
cuggaaggagcugggc

SEQ ID NO: 3093632 - RNA, 20 nt, Molluscum contagiosum virus
cguacgcgccggggcgcgcg

SEQ ID NO: 3093633 - RNA, 18 nt, Molluscum contagiosum virus
gccuguaccugcgacagc

SEQ ID NO: 3093634 - RNA, 16 nt, Molluscum contagiosum virus
gcggacgcgggccugu

SEQ ID NO: 3093635 - RNA, 15 nt, Molluscum contagiosum virus
caggccuccuucccu

SEQ ID NO: 3093636 - RNA, 17 nt, Molluscum contagiosum virus
cgcggucgcgcccuugc

SEQ ID NO: 3093637 - RNA, 20 nt, Molluscum contagiosum virus
gcagcauuuuggugggcacg

SEQ ID NO: 3093638 - RNA, 20 nt, Molluscum contagiosum virus
cgagggagccucgcuggugu

SEQ ID NO: 3093639 - RNA, 22 nt, Molluscum contagiosum virus
ggacgcgugcaagcccagcagc

SEQ ID NO: 3093640 - RNA, 20 nt, Molluscum contagiosum virus
ggcuccuucuucagcaggcc

SEQ ID NO: 3093641 - RNA, 14 nt, Molluscum contagiosum virus
gucuuacugcugca

SEQ ID NO: 3093642 - RNA, 14 nt, Molluscum contagiosum virus
cuggagcagguucu

SEQ ID NO: 3093643 - RNA, 17 nt, Molluscum contagiosum virus
cggugggcgccgcggcc

SEQ ID NO: 3093644 - RNA, 23 nt, Molluscum contagiosum virus
ccggcgccgacagcgcgcgcacg

SEQ ID NO: 3093645 - RNA, 18 nt, Molluscum contagiosum virus
cagagcccgggagagugg

SEQ ID NO: 3093646 - RNA, 22 nt, Molluscum contagiosum virus
ucgugguggaggacgacaauac

SEQ ID NO: 3093647 - RNA, 21 nt, Molluscum contagiosum virus
cuccgaggaaacgcagcacuu

SEQ ID NO: 3093648 - RNA, 12 nt, Molluscum contagiosum virus
acaugccgcgcu

SEQ ID NO: 3093649 - RNA, 16 nt, Molluscum contagiosum virus
cccugguaguccugcu

SEQ ID NO: 3093650 - RNA, 18 nt, Molluscum contagiosum virus
gcggcuccaacagcagcu

SEQ ID NO: 3093651 - RNA, 22 nt, Molluscum contagiosum virus
ggagggugcacgcgggcgccgg

SEQ ID NO: 3093652 - RNA, 12 nt, Molluscum contagiosum virus
uggacagcaucc

SEQ ID NO: 3093653 - RNA, 17 nt, Molluscum contagiosum virus
acgcggaugccacgcag

SEQ ID NO: 3093654 - RNA, 13 nt, Molluscum contagiosum virus
gaugcgcaugcgg

SEQ ID NO: 3093655 - RNA, 18 nt, Molluscum contagiosum virus
cgggauggucucgcugcu

SEQ ID NO: 3093656 - RNA, 17 nt, Molluscum contagiosum virus
gcugcaggaccugcugg

SEQ ID NO: 3093657 - RNA, 22 nt, Molluscum contagiosum virus
ccuuccggagacaccagcuccg

SEQ ID NO: 3093658 - RNA, 14 nt, Molluscum contagiosum virus
gcgcucgccucugg

SEQ ID NO: 3093659 - RNA, 13 nt, Molluscum contagiosum virus
gggaucuugcgug

SEQ ID NO: 3093660 - RNA, 17 nt, Molluscum contagiosum virus
ugcgcuggaugcugcuc

SEQ ID NO: 3093661 - RNA, 20 nt, Molluscum contagiosum virus
cgagccgcugcuccugcucu

SEQ ID NO: 3093662 - RNA, 17 nt, Molluscum contagiosum virus
gucgugcaccuggagca

SEQ ID NO: 3093663 - RNA, 12 nt, Molluscum contagiosum virus
acucagcgggca

SEQ ID NO: 3093664 - RNA, 23 nt, Molluscum contagiosum virus
cuauucucguggcguugcugcug

SEQ ID NO: 3093665 - RNA, 20 nt, Molluscum contagiosum virus
aacuacuuccugcagcuguc

SEQ ID NO: 3093666 - RNA, 14 nt, Molluscum contagiosum virus
cggcgugcugugcc

SEQ ID NO: 3093667 - RNA, 14 nt, Molluscum contagiosum virus
gcgccgcgggcaca

SEQ ID NO: 3093668 - RNA, 13 nt, Molluscum contagiosum virus
gcggaugcucgcu

SEQ ID NO: 3093669 - RNA, 18 nt, Molluscum contagiosum virus
gcugcgcacgugcgcgcc

SEQ ID NO: 3093670 - RNA, 12 nt, Molluscum contagiosum virus
uucguggccaaa

SEQ ID NO: 3093671 - RNA, 12 nt, Molluscum contagiosum virus
cggaggcagcgc

SEQ ID NO: 3093672 - RNA, 13 nt, Molluscum contagiosum virus
agcgcucugcauu

SEQ ID NO: 3093673 - RNA, 16 nt, Molluscum contagiosum virus
cuucgugcugugccua

SEQ ID NO: 3093674 - RNA, 23 nt, Molluscum contagiosum virus
caugcucgcggucgggccccugc

SEQ ID NO: 3093675 - RNA, 17 nt, Molluscum contagiosum virus
cuggugcgcccgcggca

SEQ ID NO: 3093676 - RNA, 16 nt, Molluscum contagiosum virus
gcuccugaucugcgug

SEQ ID NO: 3093677 - RNA, 13 nt, Molluscum contagiosum virus
acggaggucugcu

SEQ ID NO: 3093678 - RNA, 13 nt, Molluscum contagiosum virus
caaauggagauga

SEQ ID NO: 3093679 - RNA, 19 nt, Molluscum contagiosum virus
ccgucuugcgcacacacuu

SEQ ID NO: 3093680 - RNA, 17 nt, Molluscum contagiosum virus
ggagaagugcuccgcac

SEQ ID NO: 3093681 - RNA, 19 nt, Molluscum contagiosum virus
agacgcguaccagcgccug

SEQ ID NO: 3093682 - RNA, 13 nt, Molluscum contagiosum virus
cgcgaaacuggac

SEQ ID NO: 3093683 - RNA, 22 nt, Molluscum contagiosum virus
gccgcggaccacgacgggcuca

SEQ ID NO: 3093684 - RNA, 10 nt, Molluscum contagiosum virus
gggggcagca

SEQ ID NO: 3093685 - RNA, 18 nt, Molluscum contagiosum virus
ugcggcuccaacagcagc

SEQ ID NO: 3093686 - RNA, 17 nt, Molluscum contagiosum virus
acuguguucccggcugc

SEQ ID NO: 3093687 - RNA, 15 nt, Molluscum contagiosum virus
cggcccgagcaggac

SEQ ID NO: 3093688 - RNA, 17 nt, Molluscum contagiosum virus
cuagcucgcgcgcggca

SEQ ID NO: 3093689 - RNA, 18 nt, Molluscum contagiosum virus
cgcgcgagggcgcgcugg

SEQ ID NO: 3093690 - RNA, 13 nt, Molluscum contagiosum virus
acccuggcugcug

SEQ ID NO: 3093691 - RNA, 14 nt, Molluscum contagiosum virus
uucaccugcauuga

SEQ ID NO: 3093692 - RNA, 21 nt, Molluscum contagiosum virus
gccgccggggcccaugcucac

SEQ ID NO: 3093693 - RNA, 16 nt, Molluscum contagiosum virus
cugccacggcugcaag

SEQ ID NO: 3093694 - RNA, 17 nt, Molluscum contagiosum virus
gccgcgcgucugcgagu

SEQ ID NO: 3093695 - RNA, 16 nt, Molluscum contagiosum virus
agcucaagacgcugcu

SEQ ID NO: 3093696 - RNA, 20 nt, Molluscum contagiosum virus
ggcgcacgcuuguccgcgga

SEQ ID NO: 3093697 - RNA, 14 nt, Molluscum contagiosum virus
ccugagaagcugua

SEQ ID NO: 3093698 - RNA, 20 nt, Molluscum contagiosum virus
cacgcgggcccgugcucagg

SEQ ID NO: 3093699 - RNA, 21 nt, Molluscum contagiosum virus
guagucuggccgggcucgggc

SEQ ID NO: 3093700 - RNA, 22 nt, Molluscum contagiosum virus
cacguccguugcacgugcgugc

SEQ ID NO: 3093701 - RNA, 13 nt, Molluscum contagiosum virus
uucucaaauaaag

SEQ ID NO: 3093702 - RNA, 13 nt, Molluscum contagiosum virus
caaagccugcugc

SEQ ID NO: 3093703 - RNA, 13 nt, Molluscum contagiosum virus
gcguugcugcugc

SEQ ID NO: 3093704 - RNA, 22 nt, Molluscum contagiosum virus
cugcuagugcgcgccaagaaca

SEQ ID NO: 3093705 - RNA, 17 nt, Molluscum contagiosum virus
cgccgccgcgccgcugc

SEQ ID NO: 3093706 - RNA, 17 nt, Molluscum contagiosum virus
gaggucaugaccaagga

SEQ ID NO: 3093707 - RNA, 19 nt, Molluscum contagiosum virus
ucuacggcgugcugugccu

SEQ ID NO: 3093708 - RNA, 18 nt, Molluscum contagiosum virus
caacguaguacugcagca

SEQ ID NO: 3093709 - RNA, 14 nt, Molluscum contagiosum virus
gccaguggccagcg

SEQ ID NO: 3093710 - RNA, 23 nt, Molluscum contagiosum virus
uuccagcucggguuccagcuccg

SEQ ID NO: 3093711 - RNA, 18 nt, Molluscum contagiosum virus
gcagcgcuugcgcgccaa

SEQ ID NO: 3093712 - RNA, 21 nt, Molluscum contagiosum virus
cgagucguacacgcagagcca

SEQ ID NO: 3093713 - RNA, 17 nt, Molluscum contagiosum virus
cgccucucgaggccggc

SEQ ID NO: 3093714 - RNA, 14 nt, Molluscum contagiosum virus
uacucaugcugcuc

SEQ ID NO: 3093715 - RNA, 21 nt, Molluscum contagiosum virus
cucucgaagcagugcucggga

SEQ ID NO: 3093716 - RNA, 15 nt, Molluscum contagiosum virus
ccgggcuugcucccu

SEQ ID NO: 3093717 - RNA, 20 nt, Molluscum contagiosum virus
gacgagcugugcgagccagu

SEQ ID NO: 3093718 - RNA, 19 nt, Molluscum contagiosum virus
gcauagugggcuugcggca

SEQ ID NO: 3093719 - RNA, 21 nt, Molluscum contagiosum virus
cucuucucgcagcguuccagg

SEQ ID NO: 3093720 - RNA, 12 nt, Molluscum contagiosum virus
ucggcacugcuc

SEQ ID NO: 3093721 - RNA, 22 nt, Molluscum contagiosum virus
cuacgcuccguaaccaugaaga

SEQ ID NO: 3093722 - RNA, 17 nt, Molluscum contagiosum virus
cgcgaccuacuccuggc

SEQ ID NO: 3093723 - RNA, 23 nt, Molluscum contagiosum virus
caaggaaaggcaccugcaggaaa

SEQ ID NO: 3093724 - RNA, 19 nt, Molluscum contagiosum virus
gacaagcuagacuggagca

SEQ ID NO: 3093725 - RNA, 16 nt, Molluscum contagiosum virus
ccugcaccaccagugc

SEQ ID NO: 3093726 - RNA, 20 nt, Molluscum contagiosum virus
agcggacuacaucgcucucu

SEQ ID NO: 3093727 - RNA, 22 nt, Molluscum contagiosum virus
agcgccacgcccucgccugcga

SEQ ID NO: 3093728 - RNA, 15 nt, Molluscum contagiosum virus
gaugccugccagcag

SEQ ID NO: 3093729 - RNA, 21 nt, Molluscum contagiosum virus
cgcauccucaaccgcugcaau

SEQ ID NO: 3093730 - RNA, 20 nt, Molluscum contagiosum virus
ccgggagagccgcuccuggu

SEQ ID NO: 3093731 - RNA, 15 nt, Molluscum contagiosum virus
guucgagcugcugcg

SEQ ID NO: 3093732 - RNA, 15 nt, Molluscum contagiosum virus
auccugguuccucuc

SEQ ID NO: 3093733 - RNA, 18 nt, Molluscum contagiosum virus
cggcaaaugcgucccagc

SEQ ID NO: 3093734 - RNA, 13 nt, Molluscum contagiosum virus
gaguggcucacag

SEQ ID NO: 3093735 - RNA, 12 nt, Molluscum contagiosum virus
cugccuggugca

SEQ ID NO: 3093736 - RNA, 14 nt, Molluscum contagiosum virus
cagcgcgcagaagc

SEQ ID NO: 3093737 - RNA, 20 nt, Molluscum contagiosum virus
cugccaauaccaggccacgu

SEQ ID NO: 3093738 - RNA, 23 nt, Molluscum contagiosum virus
cccgcguccgugcgcagggcaau

SEQ ID NO: 3093739 - RNA, 23 nt, Molluscum contagiosum virus
uggaucaccacuggacacgugcc

SEQ ID NO: 3093740 - RNA, 23 nt, Molluscum contagiosum virus
cuacuggccgcgauucugcucuu

SEQ ID NO: 3093741 - RNA, 15 nt, Molluscum contagiosum virus
uccuggggcuggaca

SEQ ID NO: 3093742 - RNA, 15 nt, Molluscum contagiosum virus
ggaagacgucgggaa

SEQ ID NO: 3093743 - RNA, 14 nt, Molluscum contagiosum virus
gcacguggcgcaca

SEQ ID NO: 3093744 - RNA, 15 nt, Molluscum contagiosum virus
guccgcggggcuccu

SEQ ID NO: 3093745 - RNA, 16 nt, Molluscum contagiosum virus
agaacaugcucgccag

SEQ ID NO: 3093746 - RNA, 20 nt, Molluscum contagiosum virus
ugcagcugcaggaccugcug

SEQ ID NO: 3093747 - RNA, 17 nt, Molluscum contagiosum virus
gguggugggcggguguc

SEQ ID NO: 3093748 - RNA, 22 nt, Molluscum contagiosum virus
aguaccagccgcugcgccgcca

SEQ ID NO: 3093749 - RNA, 9 nt, Molluscum contagiosum virus
cagugucuu

SEQ ID NO: 3093750 - RNA, 18 nt, Molluscum contagiosum virus
cacugccacggcugcaag

SEQ ID NO: 3093751 - RNA, 22 nt, Molluscum contagiosum virus
ucuuuguggucaagacuggccu

SEQ ID NO: 3093752 - RNA, 23 nt, Molluscum contagiosum virus
ccuggcgcgugcgagcagaggca

SEQ ID NO: 3093753 - RNA, 14 nt, Molluscum contagiosum virus
gcgccgaugcagug

SEQ ID NO: 3093754 - RNA, 18 nt, Molluscum contagiosum virus
ccaugcucucgcugcugc

SEQ ID NO: 3093755 - RNA, 16 nt, Molluscum contagiosum virus
cgcgugccucugccag

SEQ ID NO: 3093756 - RNA, 14 nt, Molluscum contagiosum virus
gacacgcgugucug

SEQ ID NO: 3093757 - RNA, 19 nt, Molluscum contagiosum virus
gagcagcgcuagccccagc

SEQ ID NO: 3093758 - RNA, 21 nt, Molluscum contagiosum virus
cccgagcucgacugcguuguc

SEQ ID NO: 3093759 - RNA, 18 nt, Molluscum contagiosum virus
acuccaaggagggcaaga

SEQ ID NO: 3093760 - RNA, 16 nt, Molluscum contagiosum virus
agaagcggcccugcac

SEQ ID NO: 3093761 - RNA, 13 nt, Molluscum contagiosum virus
ccaucgagcuucc

SEQ ID NO: 3093762 - RNA, 20 nt, Molluscum contagiosum virus
ggagcucgacucgagcgagc

SEQ ID NO: 3093763 - RNA, 15 nt, Molluscum contagiosum virus
cuuguugucugcgga

SEQ ID NO: 3093764 - RNA, 15 nt, Molluscum contagiosum virus
gcaccgccuggugcu

SEQ ID NO: 3093765 - RNA, 20 nt, Molluscum contagiosum virus
uacaccagcuggacggugcu

SEQ ID NO: 3093766 - RNA, 21 nt, Molluscum contagiosum virus
cacgucgacaaguccaccuuc

SEQ ID NO: 3093767 - RNA, 18 nt, Molluscum contagiosum virus
cggcgcgggcaagcaggg

SEQ ID NO: 3093768 - RNA, 13 nt, Molluscum contagiosum virus
cucgcccagcucg

SEQ ID NO: 3093769 - RNA, 18 nt, Molluscum contagiosum virus
ggcgcacgccgaagagcc

SEQ ID NO: 3093770 - RNA, 13 nt, Molluscum contagiosum virus
ugcacccuccgca

SEQ ID NO: 3093771 - RNA, 22 nt, Molluscum contagiosum virus
cgacaugcacacgcaccgccug

SEQ ID NO: 3093772 - RNA, 12 nt, Molluscum contagiosum virus
ggcagcugcugc

SEQ ID NO: 3093773 - RNA, 18 nt, Molluscum contagiosum virus
caggucaucgggcugcag

SEQ ID NO: 3093774 - RNA, 16 nt, Molluscum contagiosum virus
cccgcugagcgcagca

SEQ ID NO: 3093775 - RNA, 16 nt, Molluscum contagiosum virus
gacgccggcgcccgcg

SEQ ID NO: 3093776 - RNA, 21 nt, Molluscum contagiosum virus
ggcgcgugagcgccuaccgca

SEQ ID NO: 3093777 - RNA, 13 nt, Molluscum contagiosum virus
cguucuccaggaa

SEQ ID NO: 3093778 - RNA, 20 nt, Molluscum contagiosum virus
uucgccccgagaauaccguc

SEQ ID NO: 3093779 - RNA, 12 nt, Molluscum contagiosum virus
guccuggagccu

SEQ ID NO: 3093780 - RNA, 21 nt, Molluscum contagiosum virus
gcgaccaguacaucaccgcca

SEQ ID NO: 3093781 - RNA, 22 nt, Molluscum contagiosum virus
ccgccuacggggcugcuccggc

SEQ ID NO: 3093782 - RNA, 22 nt, Molluscum contagiosum virus
cgaccgcuuucgcaaacaagca

SEQ ID NO: 3093783 - RNA, 15 nt, Molluscum contagiosum virus
aggaugcuggggcuc

SEQ ID NO: 3093784 - RNA, 20 nt, Molluscum contagiosum virus
ugaaucaugccuuuccgagc

SEQ ID NO: 3093785 - RNA, 18 nt, Molluscum contagiosum virus
aaagccagacgcagagcc

SEQ ID NO: 3093786 - RNA, 23 nt, Molluscum contagiosum virus
cgaccuggaagccgccagccacg

SEQ ID NO: 3093787 - RNA, 15 nt, Molluscum contagiosum virus
uguaucaugcacaug

SEQ ID NO: 3093788 - RNA, 18 nt, Molluscum contagiosum virus
caucucgcacacugcagc

SEQ ID NO: 3093789 - RNA, 12 nt, Molluscum contagiosum virus
uccggcagcgcc

SEQ ID NO: 3093790 - RNA, 17 nt, Molluscum contagiosum virus
acgccugcuagcggccu

SEQ ID NO: 3093791 - RNA, 16 nt, Molluscum contagiosum virus
ggcuuguagucgcccc

SEQ ID NO: 3093792 - RNA, 14 nt, Molluscum contagiosum virus
gcucaagcacugcc

SEQ ID NO: 3093793 - RNA, 14 nt, Molluscum contagiosum virus
guucuagcagcgug

SEQ ID NO: 3093794 - RNA, 18 nt, Molluscum contagiosum virus
cgugcugcgcuaccacga

SEQ ID NO: 3093795 - RNA, 21 nt, Molluscum contagiosum virus
gcaggcgcugcgcggcgcgcg

SEQ ID NO: 3093796 - RNA, 16 nt, Molluscum contagiosum virus
gugcauggcggcggcc

SEQ ID NO: 3093797 - RNA, 18 nt, Molluscum contagiosum virus
cugcuuccgcaccugguc

SEQ ID NO: 3093798 - RNA, 15 nt, Molluscum contagiosum virus
cagcgcuagccccag

SEQ ID NO: 3093799 - RNA, 15 nt, Molluscum contagiosum virus
acgcgcgcggcaagc

SEQ ID NO: 3093800 - RNA, 21 nt, Molluscum contagiosum virus
cugcgauacccuuggcagcaa

SEQ ID NO: 3093801 - RNA, 13 nt, Molluscum contagiosum virus
cugcagcagcugg

SEQ ID NO: 3093802 - RNA, 20 nt, Molluscum contagiosum virus
cucgcagcguuccaggaacg

SEQ ID NO: 3093803 - RNA, 20 nt, Molluscum contagiosum virus
cacgugccagagucgccgcu

SEQ ID NO: 3093804 - RNA, 21 nt, Molluscum contagiosum virus
gaaggagcccgucuacauuuu

SEQ ID NO: 3093805 - RNA, 21 nt, Molluscum contagiosum virus
ucucagagcuccgcgcaugcc

SEQ ID NO: 3093806 - RNA, 20 nt, Molluscum contagiosum virus
cgcggagaagugcgcagcuu

SEQ ID NO: 3093807 - RNA, 16 nt, Molluscum contagiosum virus
acgccagguguuccug

SEQ ID NO: 3093808 - RNA, 11 nt, Molluscum contagiosum virus
agugcucuuua

SEQ ID NO: 3093809 - RNA, 19 nt, Molluscum contagiosum virus
cgcguccacgaacgacagc

SEQ ID NO: 3093810 - RNA, 18 nt, Molluscum contagiosum virus
acaagcguguucgugccg

SEQ ID NO: 3093811 - RNA, 21 nt, Molluscum contagiosum virus
gucugaaaggacaugggcaca

SEQ ID NO: 3093812 - RNA, 18 nt, Molluscum contagiosum virus
gccgcagaacacgggggc

SEQ ID NO: 3093813 - RNA, 17 nt, Molluscum contagiosum virus
cgugcccgccgacugcc

SEQ ID NO: 3093814 - RNA, 15 nt, Molluscum contagiosum virus
gaacuagugcugcug

SEQ ID NO: 3093815 - RNA, 21 nt, Molluscum contagiosum virus
ggcguccggugcucgccccuc

SEQ ID NO: 3093816 - RNA, 18 nt, Molluscum contagiosum virus
gcugagcgcgcugcgccg

SEQ ID NO: 3093817 - RNA, 20 nt, Molluscum contagiosum virus
ccggcgcgagaugcucgccg

SEQ ID NO: 3093818 - RNA, 14 nt, Molluscum contagiosum virus
uugcgcguccacaa

SEQ ID NO: 3093819 - RNA, 22 nt, Molluscum contagiosum virus
cagcucggguuccagcuccggc

SEQ ID NO: 3093820 - RNA, 21 nt, Molluscum contagiosum virus
acguucgagaccagccgcgag

SEQ ID NO: 3093821 - RNA, 21 nt, Molluscum contagiosum virus
cagcuucuuggagcccuugau

SEQ ID NO: 3093822 - RNA, 17 nt, Molluscum contagiosum virus
cacggcgcucgccucug

SEQ ID NO: 3093823 - RNA, 11 nt, Molluscum contagiosum virus
aucuuacaggc

SEQ ID NO: 3093824 - RNA, 22 nt, Molluscum contagiosum virus
cgggcucuuccaccggcagcgc

SEQ ID NO: 3093825 - RNA, 21 nt, Molluscum contagiosum virus
cccguguucgcggagcugugc

SEQ ID NO: 3093826 - RNA, 23 nt, Molluscum contagiosum virus
acccugcacgcuacggcugccgg

SEQ ID NO: 3093827 - RNA, 23 nt, Molluscum contagiosum virus
aucugacggugcaaccgcugcuc

SEQ ID NO: 3093828 - RNA, 21 nt, Molluscum contagiosum virus
agcaccggcggguccgcaggc

SEQ ID NO: 3093829 - RNA, 23 nt, Molluscum contagiosum virus
aaugugcuggucaagaacaugug

SEQ ID NO: 3093830 - RNA, 22 nt, Molluscum contagiosum virus
cacgagcaguccgccucgagca

SEQ ID NO: 3093831 - RNA, 16 nt, Molluscum contagiosum virus
ucgcgcugcucuucgc

SEQ ID NO: 3093832 - RNA, 17 nt, Molluscum contagiosum virus
ccgugugcgaagggcuu

SEQ ID NO: 3093833 - RNA, 20 nt, Molluscum contagiosum virus
gucacggccuucgcgcugcc

SEQ ID NO: 3093834 - RNA, 14 nt, Molluscum contagiosum virus
gcauggagggcgag

SEQ ID NO: 3093835 - RNA, 15 nt, Molluscum contagiosum virus
gucucucugucuccc

SEQ ID NO: 3093836 - RNA, 20 nt, Molluscum contagiosum virus
uggcucuagaguacuaggug

SEQ ID NO: 3093837 - RNA, 12 nt, Molluscum contagiosum virus
gcaggccucuuu

SEQ ID NO: 3093838 - RNA, 20 nt, Molluscum contagiosum virus
cugcuccgcggaggccaagc

SEQ ID NO: 3093839 - RNA, 18 nt, Molluscum contagiosum virus
cguuuucgcggccuuaaa

SEQ ID NO: 3093840 - RNA, 14 nt, Molluscum contagiosum virus
gcucacgcugcccg

SEQ ID NO: 3093841 - RNA, 14 nt, Molluscum contagiosum virus
acggcgcucgccuc

SEQ ID NO: 3093842 - RNA, 21 nt, Molluscum contagiosum virus
gggcuucgcugcgcaggugca

SEQ ID NO: 3093843 - RNA, 16 nt, Molluscum contagiosum virus
ugagucacgcuugcag

SEQ ID NO: 3093844 - RNA, 19 nt, Molluscum contagiosum virus
gcugggcgguugccugcac

SEQ ID NO: 3093845 - RNA, 23 nt, Molluscum contagiosum virus
ggccgagcgugaccagugcgugc

SEQ ID NO: 3093846 - RNA, 14 nt, Molluscum contagiosum virus
gcuccggcugcucc

SEQ ID NO: 3093847 - RNA, 12 nt, Molluscum contagiosum virus
uccgcucucgag

SEQ ID NO: 3093848 - RNA, 22 nt, Molluscum contagiosum virus
gcggccacucucccgggcucug

SEQ ID NO: 3093849 - RNA, 13 nt, Molluscum contagiosum virus
ugcugcaggcgua

SEQ ID NO: 3093850 - RNA, 17 nt, Molluscum contagiosum virus
gcccgcgcgcgacuacg

SEQ ID NO: 3093851 - RNA, 13 nt, Molluscum contagiosum virus
gcacggacagcac

SEQ ID NO: 3093852 - RNA, 13 nt, Molluscum contagiosum virus
gaaacaagcgugu

SEQ ID NO: 3093853 - RNA, 18 nt, Molluscum contagiosum virus
ggucuccgcgggcagccg

SEQ ID NO: 3093854 - RNA, 12 nt, Molluscum contagiosum virus
gcuccucuucag

SEQ ID NO: 3093855 - RNA, 16 nt, Molluscum contagiosum virus
cgugcgcagcagcucg

SEQ ID NO: 3093856 - RNA, 18 nt, Molluscum contagiosum virus
cguaaugauugucaagca

SEQ ID NO: 3093857 - RNA, 20 nt, Molluscum contagiosum virus
cgggcgcagagccugcugcu

SEQ ID NO: 3093858 - RNA, 14 nt, Molluscum contagiosum virus
gaagccgcaggcca

SEQ ID NO: 3093859 - RNA, 16 nt, Molluscum contagiosum virus
cgcgcaaccagcuggc

SEQ ID NO: 3093860 - RNA, 12 nt, Molluscum contagiosum virus
cgccgcgcggcu

SEQ ID NO: 3093861 - RNA, 13 nt, Molluscum contagiosum virus
gaaaaaaacugcg

SEQ ID NO: 3093862 - RNA, 21 nt, Molluscum contagiosum virus
ccccaugcccgaccacgugcc

SEQ ID NO: 3093863 - RNA, 16 nt, Molluscum contagiosum virus
aacaagacgaacaugu

SEQ ID NO: 3093864 - RNA, 21 nt, Molluscum contagiosum virus
cggaacucgcgcgcgccgggc

SEQ ID NO: 3093865 - RNA, 14 nt, Molluscum contagiosum virus
cugcugcucgaagc

SEQ ID NO: 3093866 - RNA, 15 nt, Molluscum contagiosum virus
cgccgggcgccagaa

SEQ ID NO: 3093867 - RNA, 21 nt, Molluscum contagiosum virus
cuuccggcccgacacacuccu

SEQ ID NO: 3093868 - RNA, 16 nt, Molluscum contagiosum virus
cugcggcgcgugccgc

SEQ ID NO: 3093869 - RNA, 20 nt, Molluscum contagiosum virus
agccgcgugcuggcggggcu

SEQ ID NO: 3093870 - RNA, 20 nt, Molluscum contagiosum virus
gaacaccccgagcuggugau

SEQ ID NO: 3093871 - RNA, 17 nt, Molluscum contagiosum virus
caagaagcgcuucuuug

SEQ ID NO: 3093872 - RNA, 22 nt, Molluscum contagiosum virus
agagguugagcuuggugcagcg

SEQ ID NO: 3093873 - RNA, 22 nt, Molluscum contagiosum virus
ugucgucaaaggcaaagccugc

SEQ ID NO: 3093874 - RNA, 13 nt, Molluscum contagiosum virus
cgcccgcgccgca

SEQ ID NO: 3093875 - RNA, 15 nt, Molluscum contagiosum virus
gugcucaggccagca

SEQ ID NO: 3093876 - RNA, 18 nt, Molluscum contagiosum virus
aacucggcuucugcugca

SEQ ID NO: 3093877 - RNA, 18 nt, Molluscum contagiosum virus
gccgcacgcugcugcgug

SEQ ID NO: 3093878 - RNA, 21 nt, Molluscum contagiosum virus
ggccaaagucuuccuggggcu

SEQ ID NO: 3093879 - RNA, 19 nt, Molluscum contagiosum virus
ucgaacgacggcccccuua

SEQ ID NO: 3093880 - RNA, 22 nt, Molluscum contagiosum virus
caugagguacuccacgcccggc

SEQ ID NO: 3093881 - RNA, 20 nt, Molluscum contagiosum virus
auagcgccacgagcagugcc

SEQ ID NO: 3093882 - RNA, 19 nt, Molluscum contagiosum virus
cgcaggaaagguacccgca

SEQ ID NO: 3093883 - RNA, 15 nt, Molluscum contagiosum virus
cgcggcagacgccag

SEQ ID NO: 3093884 - RNA, 19 nt, Molluscum contagiosum virus
cgcggaugccacgcagcug

SEQ ID NO: 3093885 - RNA, 17 nt, Molluscum contagiosum virus
ugaccauggacacgcug

SEQ ID NO: 3093886 - RNA, 13 nt, Molluscum contagiosum virus
gcgacccagaagc

SEQ ID NO: 3093887 - RNA, 18 nt, Molluscum contagiosum virus
gcuucaaguuccuggagc

SEQ ID NO: 3093888 - RNA, 16 nt, Molluscum contagiosum virus
ucgccggcaccacggu

SEQ ID NO: 3093889 - RNA, 15 nt, Molluscum contagiosum virus
gccacgcagcuggcg

SEQ ID NO: 3093890 - RNA, 19 nt, Molluscum contagiosum virus
agcgcggaggcgcuaccuc

SEQ ID NO: 3093891 - RNA, 17 nt, Molluscum contagiosum virus
guuccggugucagcccc

SEQ ID NO: 3093892 - RNA, 23 nt, Molluscum contagiosum virus
cgcgauugcguguuggcuucugc

SEQ ID NO: 3093893 - RNA, 17 nt, Molluscum contagiosum virus
gcgccggcugcgccacc

SEQ ID NO: 3093894 - RNA, 13 nt, Molluscum contagiosum virus
cccagcaaggccc

SEQ ID NO: 3093895 - RNA, 12 nt, Molluscum contagiosum virus
uacgcgagcacu

SEQ ID NO: 3093896 - RNA, 19 nt, Molluscum contagiosum virus
cucgucgcugcggacaaga

SEQ ID NO: 3093897 - RNA, 12 nt, Molluscum contagiosum virus
guacccuggcag

SEQ ID NO: 3093898 - RNA, 14 nt, Molluscum contagiosum virus
gacuccaaggaggu

SEQ ID NO: 3093899 - RNA, 19 nt, Molluscum contagiosum virus
cuuugugcgaccugcugcg

SEQ ID NO: 3093900 - RNA, 14 nt, Molluscum contagiosum virus
gcgcgcgcucugcc

SEQ ID NO: 3093901 - RNA, 24 nt, Molluscum contagiosum virus
ucugcgcgcgguaacgcgcgcgcc

SEQ ID NO: 3093902 - RNA, 19 nt, Molluscum contagiosum virus
uaguagcgcucgcccagcu

SEQ ID NO: 3093903 - RNA, 14 nt, Molluscum contagiosum virus
gagugacgccucga

SEQ ID NO: 3093904 - RNA, 18 nt, Molluscum contagiosum virus
gggcgucgugcaccugga

SEQ ID NO: 3093905 - RNA, 15 nt, Molluscum contagiosum virus
gcuugcugcaguaug

SEQ ID NO: 3093906 - RNA, 14 nt, Molluscum contagiosum virus
ugcgucccagcagc

SEQ ID NO: 3093907 - RNA, 23 nt, Molluscum contagiosum virus
cgggcguggggagcuggagcgag

SEQ ID NO: 3093908 - RNA, 16 nt, Molluscum contagiosum virus
cggcgcgugccgcugc

SEQ ID NO: 3093909 - RNA, 15 nt, Molluscum contagiosum virus
uucccaagcaaagcc

SEQ ID NO: 3093910 - RNA, 20 nt, Molluscum contagiosum virus
gcgacgcaaaagaggccugc

SEQ ID NO: 3093911 - RNA, 19 nt, Molluscum contagiosum virus
acgugcuucacgaccuggu

SEQ ID NO: 3093912 - RNA, 17 nt, Molluscum contagiosum virus
ggcaccccgaaggaaag

SEQ ID NO: 3093913 - RNA, 17 nt, Molluscum contagiosum virus
gcagucacgacuguguu

SEQ ID NO: 3093914 - RNA, 16 nt, Molluscum contagiosum virus
gcccgcgucccgacag

SEQ ID NO: 3093915 - RNA, 19 nt, Molluscum contagiosum virus
ugcacuucggacaccucac

SEQ ID NO: 3093916 - RNA, 20 nt, Molluscum contagiosum virus
caaagcugugcguacaccua

SEQ ID NO: 3093917 - RNA, 13 nt, Molluscum contagiosum virus
gcgaccagcucuu

SEQ ID NO: 3093918 - RNA, 23 nt, Molluscum contagiosum virus
cuacagcgcgcugcacaccgagc

SEQ ID NO: 3093919 - RNA, 19 nt, Molluscum contagiosum virus
uggccgcauuuucucugga

SEQ ID NO: 3093920 - RNA, 21 nt, Molluscum contagiosum virus
gcgguucacuagcgcaggcag

SEQ ID NO: 3093921 - RNA, 21 nt, Molluscum contagiosum virus
agugcgagccgugaccuucgu

SEQ ID NO: 3093922 - RNA, 22 nt, Molluscum contagiosum virus
cagggcacgaucgcgagacccc

SEQ ID NO: 3093923 - RNA, 16 nt, Molluscum contagiosum virus
guacacgcagagccag

SEQ ID NO: 3093924 - RNA, 17 nt, Molluscum contagiosum virus
cagacaaagacaguccg

SEQ ID NO: 3093925 - RNA, 17 nt, Molluscum contagiosum virus
ugcggcacgggcucgag

SEQ ID NO: 3093926 - RNA, 14 nt, Molluscum contagiosum virus
ccgccggcgccgcu

SEQ ID NO: 3093927 - RNA, 19 nt, Molluscum contagiosum virus
agccaugaggacagcuugc

SEQ ID NO: 3093928 - RNA, 11 nt, Molluscum contagiosum virus
cgaaguuucac

SEQ ID NO: 3093929 - RNA, 18 nt, Molluscum contagiosum virus
gcccgucuuuccuggcuc

SEQ ID NO: 3093930 - RNA, 14 nt, Molluscum contagiosum virus
cggccgcgcucguc

SEQ ID NO: 3093931 - RNA, 18 nt, Molluscum contagiosum virus
aauggacacgcacuggcg

SEQ ID NO: 3093932 - RNA, 19 nt, Molluscum contagiosum virus
gcucgcaggcggugggcgc

SEQ ID NO: 3093933 - RNA, 23 nt, Molluscum contagiosum virus
aucgccuuugugacaaggaugga

SEQ ID NO: 3093934 - RNA, 23 nt, Molluscum contagiosum virus
ggagacgucguggauggcguccu

SEQ ID NO: 3093935 - RNA, 21 nt, Molluscum contagiosum virus
caaggcgcgcaucgcgggcac

SEQ ID NO: 3093936 - RNA, 14 nt, Molluscum contagiosum virus
cucugcgccgcgcg

SEQ ID NO: 3093937 - RNA, 18 nt, Molluscum contagiosum virus
aucgagcuucccgagguc

SEQ ID NO: 3093938 - RNA, 16 nt, Molluscum contagiosum virus
uuaggcaucucgugca

SEQ ID NO: 3093939 - RNA, 16 nt, Molluscum contagiosum virus
ccaugucgaacaccuc

SEQ ID NO: 3093940 - RNA, 22 nt, Molluscum contagiosum virus
ugcucguggaaaagcagggccc

SEQ ID NO: 3093941 - RNA, 13 nt, Molluscum contagiosum virus
ggagcugugccgc

SEQ ID NO: 3093942 - RNA, 16 nt, Molluscum contagiosum virus
gcaacucgcgcugcag

SEQ ID NO: 3093943 - RNA, 17 nt, Molluscum contagiosum virus
cacguggagucacgacc

SEQ ID NO: 3093944 - RNA, 14 nt, Molluscum contagiosum virus
ccgcggcgcccacg

SEQ ID NO: 3093945 - RNA, 19 nt, Molluscum contagiosum virus
ugcuggccaucgagcuucc

SEQ ID NO: 3093946 - RNA, 15 nt, Molluscum contagiosum virus
gagcaggagaacuac

SEQ ID NO: 3093947 - RNA, 19 nt, Molluscum contagiosum virus
ggugguuggcgugcucgcu

SEQ ID NO: 3093948 - RNA, 15 nt, Molluscum contagiosum virus
agcaagcucaagaag

SEQ ID NO: 3093949 - RNA, 16 nt, Molluscum contagiosum virus
agggugccgaggcgcu

SEQ ID NO: 3093950 - RNA, 19 nt, Molluscum contagiosum virus
caaaacugaaaaaggauca

SEQ ID NO: 3093951 - RNA, 22 nt, Molluscum contagiosum virus
ccgcgggcagccgcuggacgcc

SEQ ID NO: 3093952 - RNA, 16 nt, Molluscum contagiosum virus
agacgugcugcgcgcc

SEQ ID NO: 3093953 - RNA, 21 nt, Molluscum contagiosum virus
cugaggaagcaagacccagca

SEQ ID NO: 3093954 - RNA, 18 nt, Molluscum contagiosum virus
cacgugcgcuggcccacg

SEQ ID NO: 3093955 - RNA, 20 nt, Molluscum contagiosum virus
ucuuugcgcgcggggcacug

SEQ ID NO: 3093956 - RNA, 18 nt, Molluscum contagiosum virus
uucacuccgcacagcuuc

SEQ ID NO: 3093957 - RNA, 23 nt, Molluscum contagiosum virus
gaaaaggcacaccccgggaacga

SEQ ID NO: 3093958 - RNA, 18 nt, Molluscum contagiosum virus
gcucggguuccagcuccg

SEQ ID NO: 3093959 - RNA, 19 nt, Molluscum contagiosum virus
cgcgggcgcagagccugcu

SEQ ID NO: 3093960 - RNA, 17 nt, Molluscum contagiosum virus
ggacagcuugcugcugu

SEQ ID NO: 3093961 - RNA, 15 nt, Molluscum contagiosum virus
cgagauggagcucac

SEQ ID NO: 3093962 - RNA, 17 nt, Molluscum contagiosum virus
gacguacgagugcugga

SEQ ID NO: 3093963 - RNA, 19 nt, Molluscum contagiosum virus
gcccacggcggcacccgcc

SEQ ID NO: 3093964 - RNA, 21 nt, Molluscum contagiosum virus
cgggcacgcgcgcgccuuucc

SEQ ID NO: 3093965 - RNA, 14 nt, Molluscum contagiosum virus
aacucguaggacaa

SEQ ID NO: 3093966 - RNA, 13 nt, Molluscum contagiosum virus
agccagccaggcg

SEQ ID NO: 3093967 - RNA, 14 nt, Molluscum contagiosum virus
cgcgagcugcugcg

SEQ ID NO: 3093968 - RNA, 14 nt, Molluscum contagiosum virus
gaagcuccugcugg

SEQ ID NO: 3093969 - RNA, 16 nt, Molluscum contagiosum virus
cuuggccccucccggu

SEQ ID NO: 3093970 - RNA, 13 nt, Molluscum contagiosum virus
cugcgcaagcgcu

SEQ ID NO: 3093971 - RNA, 17 nt, Molluscum contagiosum virus
ggaucggagcgcagcug

SEQ ID NO: 3093972 - RNA, 23 nt, Molluscum contagiosum virus
cgggaugcuggacgggcacgagc

SEQ ID NO: 3093973 - RNA, 20 nt, Molluscum contagiosum virus
ugguggccaagauccuguac

SEQ ID NO: 3093974 - RNA, 21 nt, Molluscum contagiosum virus
ucgagcauuugcucgcucgga

SEQ ID NO: 3093975 - RNA, 18 nt, Molluscum contagiosum virus
ggcgagucgcgggcgcgc

SEQ ID NO: 3093976 - RNA, 18 nt, Molluscum contagiosum virus
ucugcgcgagcagcugcu

SEQ ID NO: 3093977 - RNA, 16 nt, Molluscum contagiosum virus
cugcagcccuuccacg

SEQ ID NO: 3093978 - RNA, 21 nt, Molluscum contagiosum virus
gcguggggagcuggagcgagu

SEQ ID NO: 3093979 - RNA, 19 nt, Molluscum contagiosum virus
ggacaugagcuugcgcacg

SEQ ID NO: 3093980 - RNA, 16 nt, Molluscum contagiosum virus
ucugugaccugcgcca

SEQ ID NO: 3093981 - RNA, 15 nt, Molluscum contagiosum virus
ccucgugcugggccu

SEQ ID NO: 3093982 - RNA, 14 nt, Molluscum contagiosum virus
cgaaguccugggcg

SEQ ID NO: 3093983 - RNA, 17 nt, Molluscum contagiosum virus
ggcgcaucagagaagug

SEQ ID NO: 3093984 - RNA, 17 nt, Molluscum contagiosum virus
cguccagccgcagccgc

SEQ ID NO: 3093985 - RNA, 21 nt, Molluscum contagiosum virus
agcgccggaaacggaccugga

SEQ ID NO: 3093986 - RNA, 16 nt, Molluscum contagiosum virus
cgcggaagaagcugcg

SEQ ID NO: 3093987 - RNA, 15 nt, Molluscum contagiosum virus
cgcgccgcugcgccg

SEQ ID NO: 3093988 - RNA, 18 nt, Molluscum contagiosum virus
gcacggcacccgccagcu

SEQ ID NO: 3093989 - RNA, 13 nt, Molluscum contagiosum virus
gcucguccagcug

SEQ ID NO: 3093990 - RNA, 13 nt, Molluscum contagiosum virus
acugcagcagccc

SEQ ID NO: 3093991 - RNA, 16 nt, Molluscum contagiosum virus
cacgugccaagaccug

SEQ ID NO: 3093992 - RNA, 21 nt, Molluscum contagiosum virus
ugcacgcgugugguugcuugc

SEQ ID NO: 3093993 - RNA, 16 nt, Molluscum contagiosum virus
gcgcgcauuuaccggc

SEQ ID NO: 3093994 - RNA, 14 nt, Molluscum contagiosum virus
guucgacaaggacg

SEQ ID NO: 3093995 - RNA, 16 nt, Molluscum contagiosum virus
auacaaaguugaccac

SEQ ID NO: 3093996 - RNA, 17 nt, Molluscum contagiosum virus
gcgccgggcgccagaac

SEQ ID NO: 3093997 - RNA, 18 nt, Molluscum contagiosum virus
gugcagggcgugcuugcc

SEQ ID NO: 3093998 - RNA, 15 nt, Molluscum contagiosum virus
cuccucgcucugcuc

SEQ ID NO: 3093999 - RNA, 17 nt, Molluscum contagiosum virus
caugaguuucuggugcc

SEQ ID NO: 3094000 - RNA, 16 nt, Molluscum contagiosum virus
acuugcuuccucuccc

SEQ ID NO: 3094001 - RNA, 23 nt, Molluscum contagiosum virus
ccgagguggcacccuggcugcug

SEQ ID NO: 3094002 - RNA, 19 nt, Molluscum contagiosum virus
cgacucggaugcgcugccg

SEQ ID NO: 3094003 - RNA, 18 nt, Molluscum contagiosum virus
cccucaggggcucuccua

SEQ ID NO: 3094004 - RNA, 20 nt, Molluscum contagiosum virus
cugcacagcuuccuggagua

SEQ ID NO: 3094005 - RNA, 23 nt, Molluscum contagiosum virus
ccaugaggacagcuugcugcugu

SEQ ID NO: 3094006 - RNA, 18 nt, Molluscum contagiosum virus
uggccguagugcucaucg

SEQ ID NO: 3094007 - RNA, 19 nt, Molluscum contagiosum virus
cgagcaauugcugggcaca

SEQ ID NO: 3094008 - RNA, 19 nt, Molluscum contagiosum virus
cagcuccuagcgcgcgugu

SEQ ID NO: 3094009 - RNA, 21 nt, Molluscum contagiosum virus
aguccucgacaaugagcacuu

SEQ ID NO: 3094010 - RNA, 18 nt, Molluscum contagiosum virus
cgucuccgggggcgcgcu

SEQ ID NO: 3094011 - RNA, 18 nt, Molluscum contagiosum virus
gcccgacacguugcacug

SEQ ID NO: 3094012 - RNA, 13 nt, Molluscum contagiosum virus
caaacgccagugc

SEQ ID NO: 3094013 - RNA, 16 nt, Molluscum contagiosum virus
cugcucgcgcucgcgg

SEQ ID NO: 3094014 - RNA, 22 nt, Molluscum contagiosum virus
gccuacucgcgacgcguccgcc

SEQ ID NO: 3094015 - RNA, 21 nt, Molluscum contagiosum virus
ggcugccgcugccugugccca

SEQ ID NO: 3094016 - RNA, 21 nt, Molluscum contagiosum virus
agccucccccgcgcacugcca

SEQ ID NO: 3094017 - RNA, 19 nt, Molluscum contagiosum virus
cggagaccuggucacacug

SEQ ID NO: 3094018 - RNA, 16 nt, Molluscum contagiosum virus
ugcggacgcgggccgc

SEQ ID NO: 3094019 - RNA, 16 nt, Molluscum contagiosum virus
gcccgcgaacgagaga

SEQ ID NO: 3094020 - RNA, 12 nt, Molluscum contagiosum virus
ggacgcacuaga

SEQ ID NO: 3094021 - RNA, 20 nt, Molluscum contagiosum virus
ccgacgcgggcgcgcacccc

SEQ ID NO: 3094022 - RNA, 18 nt, Molluscum contagiosum virus
cacgcgcacuugccuggc

SEQ ID NO: 3094023 - RNA, 14 nt, Molluscum contagiosum virus
gcugcggcugcugc

SEQ ID NO: 3094024 - RNA, 14 nt, Molluscum contagiosum virus
caggaaagguaccc

SEQ ID NO: 3094025 - RNA, 16 nt, Molluscum contagiosum virus
cgcuguugcugcugcc

SEQ ID NO: 3094026 - RNA, 20 nt, Molluscum contagiosum virus
ucucaaccaccugagccucu

SEQ ID NO: 3094027 - RNA, 16 nt, Molluscum contagiosum virus
gaggcggcacugcuag

SEQ ID NO: 3094028 - RNA, 13 nt, Molluscum contagiosum virus
ccucugccagccg

SEQ ID NO: 3094029 - RNA, 22 nt, Molluscum contagiosum virus
gcuggccaacacuaccacagcc

SEQ ID NO: 3094030 - RNA, 21 nt, Molluscum contagiosum virus
ggcgcugucgcgcaggcucug

SEQ ID NO: 3094031 - RNA, 18 nt, Molluscum contagiosum virus
acuaccuggcggcgcugg

SEQ ID NO: 3094032 - RNA, 20 nt, Molluscum contagiosum virus
gcaucgcgggcacgcagcuc

SEQ ID NO: 3094033 - RNA, 21 nt, Molluscum contagiosum virus
ugcuuugucugcaggcagaag

SEQ ID NO: 3094034 - RNA, 11 nt, Molluscum contagiosum virus
gcaaggcccac

SEQ ID NO: 3094035 - RNA, 20 nt, Molluscum contagiosum virus
uggucgcgcgcgcucugccg

SEQ ID NO: 3094036 - RNA, 14 nt, Molluscum contagiosum virus
gucucgcgcucgcc

SEQ ID NO: 3094037 - RNA, 16 nt, Molluscum contagiosum virus
ccgaagucuaggcagc

SEQ ID NO: 3094038 - RNA, 15 nt, Molluscum contagiosum virus
acagaugccacgacc

SEQ ID NO: 3094039 - RNA, 13 nt, Molluscum contagiosum virus
agcagcgccugca

SEQ ID NO: 3094040 - RNA, 22 nt, Molluscum contagiosum virus
ccaacacgcaaucgcgcgcgca

SEQ ID NO: 3094041 - RNA, 13 nt, Molluscum contagiosum virus
ugcuccaugacag

SEQ ID NO: 3094042 - RNA, 22 nt, Molluscum contagiosum virus
gccucgcguuagcgcuggcccg

SEQ ID NO: 3094043 - RNA, 20 nt, Molluscum contagiosum virus
ccgcgagcuaaucagcgcca

SEQ ID NO: 3094044 - RNA, 11 nt, Molluscum contagiosum virus
ccuagcuccag

SEQ ID NO: 3094045 - RNA, 12 nt, Molluscum contagiosum virus
ccucacgugcug

SEQ ID NO: 3094046 - RNA, 17 nt, Molluscum contagiosum virus
acggguguacaaagagc

SEQ ID NO: 3094047 - RNA, 21 nt, Molluscum contagiosum virus
cagccaugaggacagcuugcu

SEQ ID NO: 3094048 - RNA, 20 nt, Molluscum contagiosum virus
gcuucgcuggcggggacagc

SEQ ID NO: 3094049 - RNA, 22 nt, Molluscum contagiosum virus
cagcacgggccggggccucgcg

SEQ ID NO: 3094050 - RNA, 15 nt, Molluscum contagiosum virus
agcaccaagaagcgg

SEQ ID NO: 3094051 - RNA, 16 nt, Molluscum contagiosum virus
agaggggagccagccu

SEQ ID NO: 3094052 - RNA, 14 nt, Molluscum contagiosum virus
cgguggcggcucug

SEQ ID NO: 3094053 - RNA, 19 nt, Molluscum contagiosum virus
gugcgcgugucuggagccc

SEQ ID NO: 3094054 - RNA, 17 nt, Molluscum contagiosum virus
cgcaggcgucaugcgcg

SEQ ID NO: 3094055 - RNA, 18 nt, Molluscum contagiosum virus
aucgcgcucaggaccagu

SEQ ID NO: 3094056 - RNA, 11 nt, Molluscum contagiosum virus
caagacuggcc

SEQ ID NO: 3094057 - RNA, 13 nt, Molluscum contagiosum virus
uacugcacugcag

SEQ ID NO: 3094058 - RNA, 21 nt, Molluscum contagiosum virus
cgagagaggagugaagggugu

SEQ ID NO: 3094059 - RNA, 19 nt, Molluscum contagiosum virus
ggaagcaacgacaaggaaa

SEQ ID NO: 3094060 - RNA, 14 nt, Molluscum contagiosum virus
agcacgccuccaag

SEQ ID NO: 3094061 - RNA, 14 nt, Molluscum contagiosum virus
gcgggaagggguga

SEQ ID NO: 3094062 - RNA, 15 nt, Molluscum contagiosum virus
cccgcgcccgcgccg

SEQ ID NO: 3094063 - RNA, 22 nt, Molluscum contagiosum virus
ggcucgagcgcgcgccugcugg

SEQ ID NO: 3094064 - RNA, 13 nt, Molluscum contagiosum virus
uaugcccagccug

SEQ ID NO: 3094065 - RNA, 13 nt, Molluscum contagiosum virus
accugcugcugag

SEQ ID NO: 3094066 - RNA, 23 nt, Molluscum contagiosum virus
gccucggacggaggucugcuuug

SEQ ID NO: 3094067 - RNA, 20 nt, Molluscum contagiosum virus
cauccuugauaaaagcacag

SEQ ID NO: 3094068 - RNA, 13 nt, Molluscum contagiosum virus
guggacgagcaga

SEQ ID NO: 3094069 - RNA, 15 nt, Molluscum contagiosum virus
guucugcgcgccgcu

SEQ ID NO: 3094070 - RNA, 15 nt, Molluscum contagiosum virus
uugcuacaggacguc

SEQ ID NO: 3094071 - RNA, 18 nt, Molluscum contagiosum virus
cgacgggcgcgcuucuca

SEQ ID NO: 3094072 - RNA, 17 nt, Molluscum contagiosum virus
gugcucgccugcaucuu

SEQ ID NO: 3094073 - RNA, 16 nt, Molluscum contagiosum virus
gcgcggccuggccacg

SEQ ID NO: 3094074 - RNA, 16 nt, Molluscum contagiosum virus
aucacggcgugcgcga

SEQ ID NO: 3094075 - RNA, 23 nt, Molluscum contagiosum virus
aggggugccgcugcgcuggaugc

SEQ ID NO: 3094076 - RNA, 14 nt, Molluscum contagiosum virus
gccgcggcagcucu

SEQ ID NO: 3094077 - RNA, 21 nt, Molluscum contagiosum virus
gugcagcugccgcagagccgc

SEQ ID NO: 3094078 - RNA, 18 nt, Molluscum contagiosum virus
gccaagcguuggcgcccg

SEQ ID NO: 3094079 - RNA, 22 nt, Molluscum contagiosum virus
ggguaaugcagauuggaggagg

SEQ ID NO: 3094080 - RNA, 21 nt, Molluscum contagiosum virus
ccgccaacgcggacgcgcagc

SEQ ID NO: 3094081 - RNA, 18 nt, Molluscum contagiosum virus
gcacgcgccgcgcggcuc

SEQ ID NO: 3094082 - RNA, 19 nt, Molluscum contagiosum virus
aguugcgagccagccaggc

SEQ ID NO: 3094083 - RNA, 13 nt, Molluscum contagiosum virus
ccccgugagcgcg

SEQ ID NO: 3094084 - RNA, 23 nt, Molluscum contagiosum virus
ccgcagcacgcgugugcgagcac

SEQ ID NO: 3094085 - RNA, 22 nt, Molluscum contagiosum virus
gcucgcgagcguuucugccgga

SEQ ID NO: 3094086 - RNA, 19 nt, Molluscum contagiosum virus
ccggccuuguucgcgcuuc

SEQ ID NO: 3094087 - RNA, 13 nt, Molluscum contagiosum virus
gcgugcgcuggcg

SEQ ID NO: 3094088 - RNA, 17 nt, Molluscum contagiosum virus
ggagcggccacucuccc

SEQ ID NO: 3094089 - RNA, 18 nt, Molluscum contagiosum virus
cagugcgccucggacuuc

SEQ ID NO: 3094090 - RNA, 15 nt, Molluscum contagiosum virus
agagccgcgugcgcc

SEQ ID NO: 3094091 - RNA, 12 nt, Molluscum contagiosum virus
ugcggcugcugg

SEQ ID NO: 3094092 - RNA, 19 nt, Molluscum contagiosum virus
ugcccgccagaagugaaau

SEQ ID NO: 3094093 - RNA, 17 nt, Molluscum contagiosum virus
cuggcacuggcgcgcac

SEQ ID NO: 3094094 - RNA, 13 nt, Molluscum contagiosum virus
gacgugcugcugc

SEQ ID NO: 3094095 - RNA, 23 nt, Molluscum contagiosum virus
cagauccgggcgcugcaccgcuu

SEQ ID NO: 3094096 - RNA, 17 nt, Molluscum contagiosum virus
cgcggcgccuugcuagu

SEQ ID NO: 3094097 - RNA, 13 nt, Molluscum contagiosum virus
aggcugcugccgc

SEQ ID NO: 3094098 - RNA, 23 nt, Molluscum contagiosum virus
uggaacgagagugugcaugcugu

SEQ ID NO: 3094099 - RNA, 19 nt, Molluscum contagiosum virus
gcuccgcacguggagucac

SEQ ID NO: 3094100 - RNA, 17 nt, Molluscum contagiosum virus
cggagacaccagcuccg

SEQ ID NO: 3094101 - RNA, 13 nt, Molluscum contagiosum virus
cugcgcgagccgc

SEQ ID NO: 3094102 - RNA, 16 nt, Molluscum contagiosum virus
gacgugaucgcgcagg

SEQ ID NO: 3094103 - RNA, 23 nt, Molluscum contagiosum virus
gugcaaaucgcguacgguguccu

SEQ ID NO: 3094104 - RNA, 14 nt, Molluscum contagiosum virus
cgacgagcacgagc

SEQ ID NO: 3094105 - RNA, 22 nt, Molluscum contagiosum virus
gucggcaccgcgccgaaacacg

SEQ ID NO: 3094106 - RNA, 11 nt, Molluscum contagiosum virus
ugcuugcuucc

SEQ ID NO: 3094107 - RNA, 14 nt, Molluscum contagiosum virus
cgcgagugugcgug

SEQ ID NO: 3094108 - RNA, 21 nt, Molluscum contagiosum virus
uccaguaagcgacaggucagg

SEQ ID NO: 3094109 - RNA, 23 nt, Molluscum contagiosum virus
cguguacaugcucaagcaccugc

SEQ ID NO: 3094110 - RNA, 21 nt, Molluscum contagiosum virus
ccgcguagcuagcucugcgcg

SEQ ID NO: 3094111 - RNA, 16 nt, Molluscum contagiosum virus
gcgcgugcugucagug

SEQ ID NO: 3094112 - RNA, 21 nt, Molluscum contagiosum virus
gagaaaggcacccaccaggaa

SEQ ID NO: 3094113 - RNA, 15 nt, Molluscum contagiosum virus
gccugcaaggagguc

SEQ ID NO: 3094114 - RNA, 18 nt, Molluscum contagiosum virus
cgcggcaagccuggcucc

SEQ ID NO: 3094115 - RNA, 20 nt, Molluscum contagiosum virus
cgugcugcucugcgugcuug

SEQ ID NO: 3094116 - RNA, 17 nt, Molluscum contagiosum virus
cuuccggugccggccgc

SEQ ID NO: 3094117 - RNA, 15 nt, Molluscum contagiosum virus
ccucgagcgcgcugg

SEQ ID NO: 3094118 - RNA, 17 nt, Molluscum contagiosum virus
ccugcuuccuccuccaa

SEQ ID NO: 3094119 - RNA, 21 nt, Molluscum contagiosum virus
agccugugcccuggaagcuuc

SEQ ID NO: 3094120 - RNA, 15 nt, Molluscum contagiosum virus
cugugcuucccgaaa

SEQ ID NO: 3094121 - RNA, 23 nt, Molluscum contagiosum virus
ggccaaggucucgagcuccaggg

SEQ ID NO: 3094122 - RNA, 19 nt, Molluscum contagiosum virus
gugcuggggcuagcgcugc

SEQ ID NO: 3094123 - RNA, 22 nt, Molluscum contagiosum virus
gccagcgggaaacugcugcccg

SEQ ID NO: 3094124 - RNA, 22 nt, Molluscum contagiosum virus
uggccucugccugcaaggaggu

SEQ ID NO: 3094125 - RNA, 14 nt, Molluscum contagiosum virus
guugccggagcuga

SEQ ID NO: 3094126 - RNA, 16 nt, Molluscum contagiosum virus
ccuggcagugccgggc

SEQ ID NO: 3094127 - RNA, 22 nt, Molluscum contagiosum virus
agcagcaaacugugcuccugag

SEQ ID NO: 3094128 - RNA, 22 nt, Molluscum contagiosum virus
cgcuggggcgugacucggccgc

SEQ ID NO: 3094129 - RNA, 18 nt, Molluscum contagiosum virus
cccgcgcguugcugcccg

SEQ ID NO: 3094130 - RNA, 17 nt, Molluscum contagiosum virus
cggcguguuccggcagc

SEQ ID NO: 3094131 - RNA, 19 nt, Molluscum contagiosum virus
gccgcaggaaccgcgugcg

SEQ ID NO: 3094132 - RNA, 14 nt, Molluscum contagiosum virus
ccugcugcgcagca

SEQ ID NO: 3094133 - RNA, 14 nt, Molluscum contagiosum virus
cgugcugcagcugc

SEQ ID NO: 3094134 - RNA, 13 nt, Molluscum contagiosum virus
ugaaggcauaccu

SEQ ID NO: 3094135 - RNA, 16 nt, Molluscum contagiosum virus
gugcgccuucgucacg

SEQ ID NO: 3094136 - RNA, 14 nt, Molluscum contagiosum virus
gagggacacgcacu

SEQ ID NO: 3094137 - RNA, 21 nt, Molluscum contagiosum virus
gcaagcccggaagcuugcuca

SEQ ID NO: 3094138 - RNA, 12 nt, Molluscum contagiosum virus
cgcugcgggcgc

SEQ ID NO: 3094139 - RNA, 16 nt, Molluscum contagiosum virus
cugcagcccgacgcgg

SEQ ID NO: 3094140 - RNA, 16 nt, Molluscum contagiosum virus
cgaggccgcgcucuuc

SEQ ID NO: 3094141 - RNA, 15 nt, Molluscum contagiosum virus
cacagccccugcugc

SEQ ID NO: 3094142 - RNA, 22 nt, Molluscum contagiosum virus
gugcucguggaaaagcagggcc

SEQ ID NO: 3094143 - RNA, 11 nt, Molluscum contagiosum virus
aggcggcuccu

SEQ ID NO: 3094144 - RNA, 13 nt, Molluscum contagiosum virus
acaaagucgcgcg

SEQ ID NO: 3094145 - RNA, 21 nt, Molluscum contagiosum virus
ugguguauccaggaucacgau

SEQ ID NO: 3094146 - RNA, 14 nt, Molluscum contagiosum virus
cacggacagcaccc

SEQ ID NO: 3094147 - RNA, 16 nt, Molluscum contagiosum virus
gcuguugcugcugccg

SEQ ID NO: 3094148 - RNA, 14 nt, Molluscum contagiosum virus
ggagguuggaagca

SEQ ID NO: 3094149 - RNA, 16 nt, Molluscum contagiosum virus
accgcgcgcgcuccga

SEQ ID NO: 3094150 - RNA, 14 nt, Molluscum contagiosum virus
cgugcgagcggcgc

SEQ ID NO: 3094151 - RNA, 15 nt, Molluscum contagiosum virus
cagcucaagcugcuc

SEQ ID NO: 3094152 - RNA, 19 nt, Molluscum contagiosum virus
gccccgacgccagcgcgcc

SEQ ID NO: 3094153 - RNA, 18 nt, Molluscum contagiosum virus
gcuggcgcgcgccgagcc

SEQ ID NO: 3094154 - RNA, 19 nt, Molluscum contagiosum virus
cagcgcgcccaccagcagc

SEQ ID NO: 3094155 - RNA, 15 nt, Molluscum contagiosum virus
cgcagcaagcagccg

SEQ ID NO: 3094156 - RNA, 18 nt, Molluscum contagiosum virus
uacgcgcgcgugcugcua

SEQ ID NO: 3094157 - RNA, 13 nt, Molluscum contagiosum virus
gucuaccccgcgu

SEQ ID NO: 3094158 - RNA, 16 nt, Molluscum contagiosum virus
cagcaaacagccugug

SEQ ID NO: 3094159 - RNA, 15 nt, Molluscum contagiosum virus
cagggcgugcuugcc

SEQ ID NO: 3094160 - RNA, 23 nt, Molluscum contagiosum virus
ccggcaucgcgcugcuggugcuc

SEQ ID NO: 3094161 - RNA, 21 nt, Molluscum contagiosum virus
ccuggugcugcgcgacaugcu

SEQ ID NO: 3094162 - RNA, 13 nt, Molluscum contagiosum virus
cccacguacgagc

SEQ ID NO: 3094163 - RNA, 18 nt, Molluscum contagiosum virus
acggagcuacaaaacuga

SEQ ID NO: 3094164 - RNA, 22 nt, Molluscum contagiosum virus
gcacaacgggcucgugcuggag

SEQ ID NO: 3094165 - RNA, 20 nt, Molluscum contagiosum virus
cuucgucaagcagcgcgcca

SEQ ID NO: 3094166 - RNA, 17 nt, Molluscum contagiosum virus
guggcacccuggcugcu

SEQ ID NO: 3094167 - RNA, 21 nt, Molluscum contagiosum virus
ggcacaggguuccgcgccugc

SEQ ID NO: 3094168 - RNA, 17 nt, Molluscum contagiosum virus
ggcggcgcaaggacacc

SEQ ID NO: 3094169 - RNA, 17 nt, Molluscum contagiosum virus
cgcugagcaagcucaag

SEQ ID NO: 3094170 - RNA, 19 nt, Molluscum contagiosum virus
caccucaccgcgcacaucu

SEQ ID NO: 3094171 - RNA, 17 nt, Molluscum contagiosum virus
ggcguccggcgcuugcc

SEQ ID NO: 3094172 - RNA, 19 nt, Molluscum contagiosum virus
cuggagaccugucgugcaa

SEQ ID NO: 3094173 - RNA, 11 nt, Molluscum contagiosum virus
cccaccaggaa

SEQ ID NO: 3094174 - RNA, 14 nt, Molluscum contagiosum virus
caccagcugccgcu

SEQ ID NO: 3094175 - RNA, 13 nt, Molluscum contagiosum virus
cgcuuccgcggcc

SEQ ID NO: 3094176 - RNA, 21 nt, Molluscum contagiosum virus
gacaacugcgucucaagacaa

SEQ ID NO: 3094177 - RNA, 15 nt, Molluscum contagiosum virus
gcagcagugccagca

SEQ ID NO: 3094178 - RNA, 17 nt, Molluscum contagiosum virus
uccacgugguccaccag

SEQ ID NO: 3094179 - RNA, 23 nt, Molluscum contagiosum virus
ucccaagcaaagccucucucgug

SEQ ID NO: 3094180 - RNA, 12 nt, Molluscum contagiosum virus
gccgcuccagag

SEQ ID NO: 3094181 - RNA, 22 nt, Molluscum contagiosum virus
acgggcccgcguggcaagggcu

SEQ ID NO: 3094182 - RNA, 22 nt, Molluscum contagiosum virus
ugcgagggagccucgcuggugu

SEQ ID NO: 3094183 - RNA, 15 nt, Molluscum contagiosum virus
gaugcgcggacagag

SEQ ID NO: 3094184 - RNA, 23 nt, Molluscum contagiosum virus
cccauacucgaacgcaaggugug

SEQ ID NO: 3094185 - RNA, 17 nt, Molluscum contagiosum virus
cucgcggggcaagcgcg

SEQ ID NO: 3094186 - RNA, 17 nt, Molluscum contagiosum virus
acccgcaggaaaggcac

SEQ ID NO: 3094187 - RNA, 14 nt, Molluscum contagiosum virus
gcgccgccagcucc

SEQ ID NO: 3094188 - RNA, 22 nt, Molluscum contagiosum virus
cugccagcucgacacugugcug

SEQ ID NO: 3094189 - RNA, 16 nt, Molluscum contagiosum virus
caccccgcugggccgc

SEQ ID NO: 3094190 - RNA, 16 nt, Molluscum contagiosum virus
ugcgcuggcccacgcu

SEQ ID NO: 3094191 - RNA, 13 nt, Molluscum contagiosum virus
cccugcugcucgc

SEQ ID NO: 3094192 - RNA, 18 nt, Molluscum contagiosum virus
ucgccgaacggcagaccc

SEQ ID NO: 3094193 - RNA, 20 nt, Molluscum contagiosum virus
gccucgcgcgcacugcggga

SEQ ID NO: 3094194 - RNA, 20 nt, Molluscum contagiosum virus
acggcgacuuguagugcccg

SEQ ID NO: 3094195 - RNA, 16 nt, Molluscum contagiosum virus
cuacgaguucugcauc

SEQ ID NO: 3094196 - RNA, 22 nt, Molluscum contagiosum virus
gugcucuuuaguacaacgcgcu

SEQ ID NO: 3094197 - RNA, 22 nt, Molluscum contagiosum virus
ggugcugcgcgacaugcugccc

SEQ ID NO: 3094198 - RNA, 15 nt, Molluscum contagiosum virus
cgcgcugcagcaccu

SEQ ID NO: 3094199 - RNA, 13 nt, Molluscum contagiosum virus
uugggcacugcua

SEQ ID NO: 3094200 - RNA, 21 nt, Molluscum contagiosum virus
cgcucgggccggcgcgccgcg

SEQ ID NO: 3094201 - RNA, 21 nt, Molluscum contagiosum virus
uccaggaacgccgccacgccg

SEQ ID NO: 3094202 - RNA, 14 nt, Molluscum contagiosum virus
gcguggacaacagc

SEQ ID NO: 3094203 - RNA, 14 nt, Molluscum contagiosum virus
caaaggugcucacc

SEQ ID NO: 3094204 - RNA, 20 nt, Molluscum contagiosum virus
ccgcgcgcggugcugcgcca

SEQ ID NO: 3094205 - RNA, 15 nt, Molluscum contagiosum virus
aagaagcccaaggag

SEQ ID NO: 3094206 - RNA, 20 nt, Molluscum contagiosum virus
cauggucgcauccgaccucu

SEQ ID NO: 3094207 - RNA, 19 nt, Molluscum contagiosum virus
ccagcgcgcucgaggcgcc

SEQ ID NO: 3094208 - RNA, 16 nt, Molluscum contagiosum virus
cgcagcgcggccuggu

SEQ ID NO: 3094209 - RNA, 21 nt, Molluscum contagiosum virus
ggcccgcguggcaagggcucc

SEQ ID NO: 3094210 - RNA, 15 nt, Molluscum contagiosum virus
cggcggggcugcugg

SEQ ID NO: 3094211 - RNA, 16 nt, Molluscum contagiosum virus
cguccuagagcagaag

SEQ ID NO: 3094212 - RNA, 22 nt, Molluscum contagiosum virus
gaaaggcacccaccaggaacga

SEQ ID NO: 3094213 - RNA, 15 nt, Molluscum contagiosum virus
cugugagcgcgccgc

SEQ ID NO: 3094214 - RNA, 16 nt, Molluscum contagiosum virus
acuugugcgcccccgc

SEQ ID NO: 3094215 - RNA, 16 nt, Molluscum contagiosum virus
cggacgcggccaugcu

SEQ ID NO: 3094216 - RNA, 19 nt, Molluscum contagiosum virus
cgugggcggcauccugaug

SEQ ID NO: 3094217 - RNA, 21 nt, Molluscum contagiosum virus
gcucggaggcuugccccgcgc

SEQ ID NO: 3094218 - RNA, 19 nt, Molluscum contagiosum virus
ucgaagaccaccagcacca

SEQ ID NO: 3094219 - RNA, 22 nt, Molluscum contagiosum virus
acgcggcguacaucgacuacgc

SEQ ID NO: 3094220 - RNA, 13 nt, Molluscum contagiosum virus
cuggcgcagcagg

SEQ ID NO: 3094221 - RNA, 20 nt, Molluscum contagiosum virus
ccgcgcccgcggcgcacggc

SEQ ID NO: 3094222 - RNA, 22 nt, Molluscum contagiosum virus
ccgagcggcaagccgugcuuug

SEQ ID NO: 3094223 - RNA, 12 nt, Molluscum contagiosum virus
cccgcgggccgc

SEQ ID NO: 3094224 - RNA, 21 nt, Molluscum contagiosum virus
aacagcauuagcgccaaggcg

SEQ ID NO: 3094225 - RNA, 22 nt, Molluscum contagiosum virus
cugcaggaaaggcacccgcagg

SEQ ID NO: 3094226 - RNA, 20 nt, Molluscum contagiosum virus
ggacgccagcuugagcacac

SEQ ID NO: 3094227 - RNA, 18 nt, Molluscum contagiosum virus
gcacgcgcgacaucuucc

SEQ ID NO: 3094228 - RNA, 18 nt, Molluscum contagiosum virus
acgcgcugcuagagaacc

SEQ ID NO: 3094229 - RNA, 21 nt, Molluscum contagiosum virus
ggaagucggcguggccaggcc

SEQ ID NO: 3094230 - RNA, 14 nt, Molluscum contagiosum virus
gcugugcgagccag

SEQ ID NO: 3094231 - RNA, 15 nt, Molluscum contagiosum virus
uggaggauucuugua

SEQ ID NO: 3094232 - RNA, 18 nt, Molluscum contagiosum virus
cuucuucgugcugugccu

SEQ ID NO: 3094233 - RNA, 13 nt, Molluscum contagiosum virus
gcgagugugcaug

SEQ ID NO: 3094234 - RNA, 14 nt, Molluscum contagiosum virus
gcauguccuuggcg

SEQ ID NO: 3094235 - RNA, 20 nt, Molluscum contagiosum virus
gcugcgccggcugcgccacc

SEQ ID NO: 3094236 - RNA, 15 nt, Molluscum contagiosum virus
cgacagagcccggga

SEQ ID NO: 3094237 - RNA, 16 nt, Molluscum contagiosum virus
cgacauguacauagcc

SEQ ID NO: 3094238 - RNA, 19 nt, Molluscum contagiosum virus
cgguugcgcgugugcagca

SEQ ID NO: 3094239 - RNA, 13 nt, Molluscum contagiosum virus
cgagcauuccgag

SEQ ID NO: 3094240 - RNA, 22 nt, Molluscum contagiosum virus
cucucgggcucgcgggacgacg

SEQ ID NO: 3094241 - RNA, 16 nt, Molluscum contagiosum virus
agcagcuggccggcuc

SEQ ID NO: 3094242 - RNA, 21 nt, Molluscum contagiosum virus
cacagcaggagcacgccuggc

SEQ ID NO: 3094243 - RNA, 14 nt, Molluscum contagiosum virus
ccacgcgggcccgu

SEQ ID NO: 3094244 - RNA, 16 nt, Molluscum contagiosum virus
cggccaaccgccugcu

SEQ ID NO: 3094245 - RNA, 12 nt, Molluscum contagiosum virus
ccgcugcuggaa

SEQ ID NO: 3094246 - RNA, 13 nt, Molluscum contagiosum virus
cgcggcgcagugc

SEQ ID NO: 3094247 - RNA, 13 nt, Molluscum contagiosum virus
acuuccgcgcgcu

SEQ ID NO: 3094248 - RNA, 14 nt, Molluscum contagiosum virus
uucgcgagccacuc

SEQ ID NO: 3094249 - RNA, 12 nt, Molluscum contagiosum virus
agcccccucaga

SEQ ID NO: 3094250 - RNA, 17 nt, Molluscum contagiosum virus
gcgacguucgagaccag

SEQ ID NO: 3094251 - RNA, 18 nt, Molluscum contagiosum virus
acugcgccuucugccugc

SEQ ID NO: 3094252 - RNA, 22 nt, Molluscum contagiosum virus
ucagugggcguuacagcaccuu

SEQ ID NO: 3094253 - RNA, 19 nt, Molluscum contagiosum virus
cuacauggacgugcugcug

SEQ ID NO: 3094254 - RNA, 17 nt, Molluscum contagiosum virus
cccggcacgugccccgc

SEQ ID NO: 3094255 - RNA, 14 nt, Molluscum contagiosum virus
ugcuggagcggcau

SEQ ID NO: 3094256 - RNA, 19 nt, Molluscum contagiosum virus
ccugcgggagauccuggcg

SEQ ID NO: 3094257 - RNA, 23 nt, Molluscum contagiosum virus
cgcgaacuacuuccugcagcugu

SEQ ID NO: 3094258 - RNA, 18 nt, Molluscum contagiosum virus
gggcgccggcucugccuc

SEQ ID NO: 3094259 - RNA, 13 nt, Molluscum contagiosum virus
cguucaccuuggc

SEQ ID NO: 3094260 - RNA, 15 nt, Molluscum contagiosum virus
ucgacgccaacuucg

SEQ ID NO: 3094261 - RNA, 17 nt, Molluscum contagiosum virus
gcagagcgagggcgacg

SEQ ID NO: 3094262 - RNA, 20 nt, Molluscum contagiosum virus
agcggcgacuugcugcggag

SEQ ID NO: 3094263 - RNA, 16 nt, Molluscum contagiosum virus
ucgcgucacguccuca

SEQ ID NO: 3094264 - RNA, 17 nt, Molluscum contagiosum virus
gagcucgguagccaggc

SEQ ID NO: 3094265 - RNA, 15 nt, Molluscum contagiosum virus
cgacccguaccccga

SEQ ID NO: 3094266 - RNA, 21 nt, Molluscum contagiosum virus
uacucgagcacggccgccacc

SEQ ID NO: 3094267 - RNA, 18 nt, Molluscum contagiosum virus
accgcaaccagcugcugu

SEQ ID NO: 3094268 - RNA, 20 nt, Molluscum contagiosum virus
ugcccggcggcaagcccgga

SEQ ID NO: 3094269 - RNA, 16 nt, Molluscum contagiosum virus
aggucaucaccagccu

SEQ ID NO: 3094270 - RNA, 20 nt, Molluscum contagiosum virus
ccacaaagcccuccugagaa

SEQ ID NO: 3094271 - RNA, 13 nt, Molluscum contagiosum virus
gcugcgcgccgcc

SEQ ID NO: 3094272 - RNA, 22 nt, Molluscum contagiosum virus
ccuacgcuaccugaagcuggac

SEQ ID NO: 3094273 - RNA, 15 nt, Molluscum contagiosum virus
acgcgaaacuggacu

SEQ ID NO: 3094274 - RNA, 16 nt, Molluscum contagiosum virus
agcgugcccuucuccg

SEQ ID NO: 3094275 - RNA, 16 nt, Molluscum contagiosum virus
cucauccucccugcgg

SEQ ID NO: 3094276 - RNA, 15 nt, Molluscum contagiosum virus
ccgccuguaccugcu

SEQ ID NO: 3094277 - RNA, 20 nt, Molluscum contagiosum virus
ccggcggcaagcccggaagc

SEQ ID NO: 3094278 - RNA, 15 nt, Molluscum contagiosum virus
accuguaugaucugc

SEQ ID NO: 3094279 - RNA, 16 nt, Molluscum contagiosum virus
cgcgugcgugcugcgc

SEQ ID NO: 3094280 - RNA, 20 nt, Molluscum contagiosum virus
cccgcaaaccuuggcccuuu

SEQ ID NO: 3094281 - RNA, 14 nt, Molluscum contagiosum virus
ugcacgcgggcgcc

SEQ ID NO: 3094282 - RNA, 23 nt, Molluscum contagiosum virus
caccagugccgacgugugccgcu

SEQ ID NO: 3094283 - RNA, 12 nt, Molluscum contagiosum virus
cggacagcaccc

SEQ ID NO: 3094284 - RNA, 20 nt, Molluscum contagiosum virus
ucuuccacgccuucguggag

SEQ ID NO: 3094285 - RNA, 13 nt, Molluscum contagiosum virus
ccguccucgcucg

SEQ ID NO: 3094286 - RNA, 23 nt, Molluscum contagiosum virus
agcugacucggacacuggaggug

SEQ ID NO: 3094287 - RNA, 17 nt, Molluscum contagiosum virus
gcaguccgccucgagca

SEQ ID NO: 3094288 - RNA, 21 nt, Molluscum contagiosum virus
uagcaggaucggagcgcagcu

SEQ ID NO: 3094289 - RNA, 17 nt, Molluscum contagiosum virus
gacccucgcggcucugg

SEQ ID NO: 3094290 - RNA, 20 nt, Molluscum contagiosum virus
cgucugcucucggcggccgg

SEQ ID NO: 3094291 - RNA, 19 nt, Molluscum contagiosum virus
cgcgugcaugcgagcgcgg

SEQ ID NO: 3094292 - RNA, 15 nt, Molluscum contagiosum virus
cgcgucgagggcgcc

SEQ ID NO: 3094293 - RNA, 11 nt, Molluscum contagiosum virus
agcguggagcu

SEQ ID NO: 3094294 - RNA, 15 nt, Molluscum contagiosum virus
ggcgccgcugcugga

SEQ ID NO: 3094295 - RNA, 22 nt, Molluscum contagiosum virus
ugcuggcgcgcgcgcgccggaa

SEQ ID NO: 3094296 - RNA, 21 nt, Molluscum contagiosum virus
ugccacguacuugcugguugc

SEQ ID NO: 3094297 - RNA, 17 nt, Molluscum contagiosum virus
ggcgcguuucggccugc

SEQ ID NO: 3094298 - RNA, 23 nt, Molluscum contagiosum virus
cgcaaggugugcgcgcugcacgc

SEQ ID NO: 3094299 - RNA, 16 nt, Molluscum contagiosum virus
aagacuggcucagaac

SEQ ID NO: 3094300 - RNA, 15 nt, Molluscum contagiosum virus
cgccagaagugaaau

SEQ ID NO: 3094301 - RNA, 12 nt, Molluscum contagiosum virus
augaccaaggag

SEQ ID NO: 3094302 - RNA, 12 nt, Molluscum contagiosum virus
ggaccugcgcca

SEQ ID NO: 3094303 - RNA, 16 nt, Molluscum contagiosum virus
cagcgggcgcugcucg

SEQ ID NO: 3094304 - RNA, 15 nt, Molluscum contagiosum virus
gacggcgacgacagc

SEQ ID NO: 3094305 - RNA, 13 nt, Molluscum contagiosum virus
gggguccgcuccu

SEQ ID NO: 3094306 - RNA, 20 nt, Molluscum contagiosum virus
gggccuguucggcaugcagc

SEQ ID NO: 3094307 - RNA, 20 nt, Molluscum contagiosum virus
ggcgcgccgccggugcgugc

SEQ ID NO: 3094308 - RNA, 23 nt, Molluscum contagiosum virus
cggcgcguccucggccagagccu

SEQ ID NO: 3094309 - RNA, 12 nt, Molluscum contagiosum virus
gcgccgccgcag

SEQ ID NO: 3094310 - RNA, 13 nt, Molluscum contagiosum virus
aagucgaagaggg

SEQ ID NO: 3094311 - RNA, 23 nt, Molluscum contagiosum virus
cagauaguuuggacgagcugcuu

SEQ ID NO: 3094312 - RNA, 20 nt, Molluscum contagiosum virus
cggugcaaccgcugcucgac

SEQ ID NO: 3094313 - RNA, 16 nt, Molluscum contagiosum virus
ggagaagugcuccgca

SEQ ID NO: 3094314 - RNA, 16 nt, Molluscum contagiosum virus
accgcuagagugcgcg

SEQ ID NO: 3094315 - RNA, 22 nt, Molluscum contagiosum virus
gaacaaugcugcaucuagccuc

SEQ ID NO: 3094316 - RNA, 22 nt, Molluscum contagiosum virus
cgcauggggaacagcuuggcac

SEQ ID NO: 3094317 - RNA, 23 nt, Molluscum contagiosum virus
acgcgucgcgcaggcgcccaacg

SEQ ID NO: 3094318 - RNA, 21 nt, Molluscum contagiosum virus
gacguguguccgagaucacgg

SEQ ID NO: 3094319 - RNA, 16 nt, Molluscum contagiosum virus
acgagcagcugcugcg

SEQ ID NO: 3094320 - RNA, 16 nt, Molluscum contagiosum virus
auuccucgagagggag

SEQ ID NO: 3094321 - RNA, 17 nt, Molluscum contagiosum virus
agaagaggccagcacaa

SEQ ID NO: 3094322 - RNA, 19 nt, Molluscum contagiosum virus
augcggauccuccggauga

SEQ ID NO: 3094323 - RNA, 14 nt, Molluscum contagiosum virus
ugggcuucaaguuc

SEQ ID NO: 3094324 - RNA, 20 nt, Molluscum contagiosum virus
acaugucguaccugguggcc

SEQ ID NO: 3094325 - RNA, 18 nt, Molluscum contagiosum virus
ccuggugugccagcggcg

SEQ ID NO: 3094326 - RNA, 22 nt, Molluscum contagiosum virus
ccucgcgggaggcuccugccgu

SEQ ID NO: 3094327 - RNA, 16 nt, Molluscum contagiosum virus
aggcgaggucacacuc

SEQ ID NO: 3094328 - RNA, 17 nt, Molluscum contagiosum virus
ggagacagggugccuac

SEQ ID NO: 3094329 - RNA, 20 nt, Molluscum contagiosum virus
cucuggucgagaugcucuac

SEQ ID NO: 3094330 - RNA, 15 nt, Molluscum contagiosum virus
ucgcggacggcgcgc

SEQ ID NO: 3094331 - RNA, 18 nt, Molluscum contagiosum virus
gcuccgagcggcugcucg

SEQ ID NO: 3094332 - RNA, 18 nt, Molluscum contagiosum virus
ugccaggcggucuuccag

SEQ ID NO: 3094333 - RNA, 14 nt, Molluscum contagiosum virus
ccgcaaccagcugc

SEQ ID NO: 3094334 - RNA, 15 nt, Molluscum contagiosum virus
ccaagaagacuacca

SEQ ID NO: 3094335 - RNA, 20 nt, Molluscum contagiosum virus
ggaccugcgccagcgccugu

SEQ ID NO: 3094336 - RNA, 21 nt, Molluscum contagiosum virus
cgcgcccaggcgcgcgcucag

SEQ ID NO: 3094337 - RNA, 12 nt, Molluscum contagiosum virus
gagcuggccacu

SEQ ID NO: 3094338 - RNA, 15 nt, Molluscum contagiosum virus
cgguggugcauccug

SEQ ID NO: 3094339 - RNA, 22 nt, Molluscum contagiosum virus
gguggagguuuuccuguggccg

SEQ ID NO: 3094340 - RNA, 15 nt, Molluscum contagiosum virus
gcacgacccucuucu

SEQ ID NO: 3094341 - RNA, 19 nt, Molluscum contagiosum virus
cacuaccgcaaccagcugc

SEQ ID NO: 3094342 - RNA, 12 nt, Molluscum contagiosum virus
uucguggccaac

SEQ ID NO: 3094343 - RNA, 17 nt, Molluscum contagiosum virus
gacgcgcgcggcaagca

SEQ ID NO: 3094344 - RNA, 19 nt, Molluscum contagiosum virus
acgacgcgcccacgugcca

SEQ ID NO: 3094345 - RNA, 18 nt, Molluscum contagiosum virus
ccagcuuggugcgcucga

SEQ ID NO: 3094346 - RNA, 12 nt, Molluscum contagiosum virus
gcgcgugcaguu

SEQ ID NO: 3094347 - RNA, 21 nt, Molluscum contagiosum virus
ccuaucccggagcgcggggca

SEQ ID NO: 3094348 - RNA, 21 nt, Molluscum contagiosum virus
cgccgcagcgcuggagcuggc

SEQ ID NO: 3094349 - RNA, 19 nt, Molluscum contagiosum virus
cccgccagcaccaugcgug

SEQ ID NO: 3094350 - RNA, 15 nt, Molluscum contagiosum virus
ucgucgagcacgaag

SEQ ID NO: 3094351 - RNA, 18 nt, Molluscum contagiosum virus
aggccccgcaccagugcc

SEQ ID NO: 3094352 - RNA, 21 nt, Molluscum contagiosum virus
ggcugcccuguuacggacggc

SEQ ID NO: 3094353 - RNA, 22 nt, Molluscum contagiosum virus
cacgcugcgcgugcugggcccc

SEQ ID NO: 3094354 - RNA, 14 nt, Molluscum contagiosum virus
guacccgcaggaaa

SEQ ID NO: 3094355 - RNA, 19 nt, Molluscum contagiosum virus
aacaggggccguucgcgcg

SEQ ID NO: 3094356 - RNA, 12 nt, Molluscum contagiosum virus
cucgcgcacgcg

SEQ ID NO: 3094357 - RNA, 17 nt, Molluscum contagiosum virus
cucaaucucgcccagca

SEQ ID NO: 3094358 - RNA, 16 nt, Molluscum contagiosum virus
acacgagggccuuggc

SEQ ID NO: 3094359 - RNA, 23 nt, Molluscum contagiosum virus
cuucgcagaggacagcuccuucu

SEQ ID NO: 3094360 - RNA, 13 nt, Molluscum contagiosum virus
cuggagcgcaaau

SEQ ID NO: 3094361 - RNA, 17 nt, Molluscum contagiosum virus
cagcucaagcugcucau

SEQ ID NO: 3094362 - RNA, 19 nt, Molluscum contagiosum virus
caucccgcacgugggcuac

SEQ ID NO: 3094363 - RNA, 16 nt, Molluscum contagiosum virus
guggcaugcgcccuca

SEQ ID NO: 3094364 - RNA, 12 nt, Molluscum contagiosum virus
agcucagccucu

SEQ ID NO: 3094365 - RNA, 23 nt, Molluscum contagiosum virus
gccgcgaaagaggaaagcgcaca

SEQ ID NO: 3094366 - RNA, 13 nt, Molluscum contagiosum virus
gaacugcagcagc

SEQ ID NO: 3094367 - RNA, 20 nt, Molluscum contagiosum virus
cgucuuucccagaagggcuu

SEQ ID NO: 3094368 - RNA, 21 nt, Molluscum contagiosum virus
ggcccacgcuggcgcucggcg

SEQ ID NO: 3094369 - RNA, 16 nt, Molluscum contagiosum virus
acaaggaaaggcaccc

SEQ ID NO: 3094370 - RNA, 18 nt, Molluscum contagiosum virus
ugcagcagguugaagcuc

SEQ ID NO: 3094371 - RNA, 17 nt, Molluscum contagiosum virus
gcgccgcacgugcugcg

SEQ ID NO: 3094372 - RNA, 14 nt, Molluscum contagiosum virus
accccgagcugcgg

SEQ ID NO: 3094373 - RNA, 15 nt, Molluscum contagiosum virus
acgaggaaaggcacc

SEQ ID NO: 3094374 - RNA, 23 nt, Molluscum contagiosum virus
cggcacccgugcgcgcgcugaga

SEQ ID NO: 3094375 - RNA, 16 nt, Molluscum contagiosum virus
ccgcagcaagcagccg

SEQ ID NO: 3094376 - RNA, 16 nt, Molluscum contagiosum virus
ugggcguggcgcaccu

SEQ ID NO: 3094377 - RNA, 18 nt, Molluscum contagiosum virus
acgcuaccugaagcugga

SEQ ID NO: 3094378 - RNA, 19 nt, Molluscum contagiosum virus
ugcuccgcacguggaguca

SEQ ID NO: 3094379 - RNA, 18 nt, Molluscum contagiosum virus
gccacggcgagcugccau

SEQ ID NO: 3094380 - RNA, 21 nt, Molluscum contagiosum virus
ggagccggccuagagcuggca

SEQ ID NO: 3094381 - RNA, 23 nt, Molluscum contagiosum virus
acggcgcgcgcgcuagccgccgc

SEQ ID NO: 3094382 - RNA, 17 nt, Molluscum contagiosum virus
gcgcgauggcgccugcu

SEQ ID NO: 3094383 - RNA, 22 nt, Molluscum contagiosum virus
cgcggcgagugcggccaccagc

SEQ ID NO: 3094384 - RNA, 14 nt, Molluscum contagiosum virus
gcucggcccgcgga

SEQ ID NO: 3094385 - RNA, 19 nt, Molluscum contagiosum virus
ggucgacgggaacgagguc

SEQ ID NO: 3094386 - RNA, 23 nt, Molluscum contagiosum virus
ucaauggcgcgcgagcacagcgc

SEQ ID NO: 3094387 - RNA, 14 nt, Molluscum contagiosum virus
uggcggggcuggca

SEQ ID NO: 3094388 - RNA, 18 nt, Molluscum contagiosum virus
gacgcgcaagugugcgca

SEQ ID NO: 3094389 - RNA, 15 nt, Molluscum contagiosum virus
cggcaggcucccgcu

SEQ ID NO: 3094390 - RNA, 15 nt, Molluscum contagiosum virus
cggccgugcagagca

SEQ ID NO: 3094391 - RNA, 21 nt, Molluscum contagiosum virus
gccucagccgagcgccgccag

SEQ ID NO: 3094392 - RNA, 14 nt, Molluscum contagiosum virus
cgcgagcgcaugcg

SEQ ID NO: 3094393 - RNA, 22 nt, Molluscum contagiosum virus
cugcgcgcguugccugagaagc

SEQ ID NO: 3094394 - RNA, 19 nt, Molluscum contagiosum virus
gcgagcuaaucagcgccau

SEQ ID NO: 3094395 - RNA, 13 nt, Molluscum contagiosum virus
ccgucccccgcgg

SEQ ID NO: 3094396 - RNA, 19 nt, Molluscum contagiosum virus
ucaaucucgcccagcaccu

SEQ ID NO: 3094397 - RNA, 15 nt, Molluscum contagiosum virus
ggaucacggcucugc

SEQ ID NO: 3094398 - RNA, 16 nt, Molluscum contagiosum virus
gcucaccgccgagaug

SEQ ID NO: 3094399 - RNA, 18 nt, Molluscum contagiosum virus
ccugcggcucgcacuugc

SEQ ID NO: 3094400 - RNA, 15 nt, Molluscum contagiosum virus
cagcaucccugccac

SEQ ID NO: 3094401 - RNA, 20 nt, Molluscum contagiosum virus
gagcgcauucgcgcgccccc

SEQ ID NO: 3094402 - RNA, 19 nt, Molluscum contagiosum virus
cgcaggaaccgcgugcgca

SEQ ID NO: 3094403 - RNA, 17 nt, Molluscum contagiosum virus
gcguccacgaugcgcuc

SEQ ID NO: 3094404 - RNA, 15 nt, Molluscum contagiosum virus
gcgagcaugccgccg

SEQ ID NO: 3094405 - RNA, 21 nt, Molluscum contagiosum virus
accagcuacgagccgcugcuc

SEQ ID NO: 3094406 - RNA, 18 nt, Molluscum contagiosum virus
cggcaagcuucgggccgc

SEQ ID NO: 3094407 - RNA, 12 nt, Molluscum contagiosum virus
gugcuggggcua

SEQ ID NO: 3094408 - RNA, 14 nt, Molluscum contagiosum virus
ugccauggcagcuc

SEQ ID NO: 3094409 - RNA, 15 nt, Molluscum contagiosum virus
cgagcgaaccgcggc

SEQ ID NO: 3094410 - RNA, 14 nt, Molluscum contagiosum virus
gcgcacugcucgcg

SEQ ID NO: 3094411 - RNA, 15 nt, Molluscum contagiosum virus
aaagagcguccagcc

SEQ ID NO: 3094412 - RNA, 17 nt, Molluscum contagiosum virus
cgcgcaccugcacgagc

SEQ ID NO: 3094413 - RNA, 15 nt, Molluscum contagiosum virus
cagccgagcgccgcc

SEQ ID NO: 3094414 - RNA, 18 nt, Molluscum contagiosum virus
cauaguacgauggaugcu

SEQ ID NO: 3094415 - RNA, 20 nt, Molluscum contagiosum virus
gugcgucgacguggagccug

SEQ ID NO: 3094416 - RNA, 15 nt, Molluscum contagiosum virus
cgacucucaacgagc

SEQ ID NO: 3094417 - RNA, 13 nt, Molluscum contagiosum virus
cuugcggcacaca

SEQ ID NO: 3094418 - RNA, 23 nt, Molluscum contagiosum virus
ccuuuugcgcgcugcgggcgccg

SEQ ID NO: 3094419 - RNA, 12 nt, Molluscum contagiosum virus
cgcggcguuccc

SEQ ID NO: 3094420 - RNA, 12 nt, Molluscum contagiosum virus
ucgcggagggcg

SEQ ID NO: 3094421 - RNA, 23 nt, Molluscum contagiosum virus
guugccaggcacacgcagugcca

SEQ ID NO: 3094422 - RNA, 10 nt, Molluscum contagiosum virus
agcaugucac

SEQ ID NO: 3094423 - RNA, 13 nt, Molluscum contagiosum virus
cuacuccuggcca

SEQ ID NO: 3094424 - RNA, 18 nt, Molluscum contagiosum virus
ugcugguucugcucgcag

SEQ ID NO: 3094425 - RNA, 15 nt, Molluscum contagiosum virus
cgcaacauguccgca

SEQ ID NO: 3094426 - RNA, 14 nt, Molluscum contagiosum virus
guagcuggcaguca

SEQ ID NO: 3094427 - RNA, 15 nt, Molluscum contagiosum virus
ccgcagaugcgcagc

SEQ ID NO: 3094428 - RNA, 19 nt, Molluscum contagiosum virus
ugcugcgcgcgccaugguu

SEQ ID NO: 3094429 - RNA, 16 nt, Molluscum contagiosum virus
cuucgugcugaagacg

SEQ ID NO: 3094430 - RNA, 15 nt, Molluscum contagiosum virus
acgacagaccccuga

SEQ ID NO: 3094431 - RNA, 17 nt, Molluscum contagiosum virus
gcccgccugccgcgagc

SEQ ID NO: 3094432 - RNA, 14 nt, Molluscum contagiosum virus
cgcaccagcugcaa

SEQ ID NO: 3094433 - RNA, 16 nt, Molluscum contagiosum virus
cgagcaacaggggccg

SEQ ID NO: 3094434 - RNA, 19 nt, Molluscum contagiosum virus
ucgcgggaccgcccuugug

SEQ ID NO: 3094435 - RNA, 22 nt, Molluscum contagiosum virus
ccacgcaggacuggcaccugcg

SEQ ID NO: 3094436 - RNA, 23 nt, Molluscum contagiosum virus
acgacgacggcugcucgcugccu

SEQ ID NO: 3094437 - RNA, 20 nt, Molluscum contagiosum virus
gaaacugcugcccgcgcagc

SEQ ID NO: 3094438 - RNA, 17 nt, Molluscum contagiosum virus
cucccugguaguccugc

SEQ ID NO: 3094439 - RNA, 14 nt, Molluscum contagiosum virus
ggcgagcgcugccg

SEQ ID NO: 3094440 - RNA, 21 nt, Molluscum contagiosum virus
cacgacucgcgucugcaaggc

SEQ ID NO: 3094441 - RNA, 22 nt, Molluscum contagiosum virus
cuccgagcgcgacuuguccuca

SEQ ID NO: 3094442 - RNA, 23 nt, Molluscum contagiosum virus
cccgcaggaaaggcaccccgcag

SEQ ID NO: 3094443 - RNA, 20 nt, Molluscum contagiosum virus
cagccgcaguaccaguaccu

SEQ ID NO: 3094444 - RNA, 23 nt, Molluscum contagiosum virus
aagucguuugcucggggcugucg

SEQ ID NO: 3094445 - RNA, 15 nt, Molluscum contagiosum virus
gugcaccuggagcag

SEQ ID NO: 3094446 - RNA, 15 nt, Molluscum contagiosum virus
ucggaggcugcuccc

SEQ ID NO: 3094447 - RNA, 21 nt, Molluscum contagiosum virus
gcuacgcuggacuuccugcug

SEQ ID NO: 3094448 - RNA, 18 nt, Molluscum contagiosum virus
cagcguguucggggccgc

SEQ ID NO: 3094449 - RNA, 14 nt, Molluscum contagiosum virus
cuccgcacguggaa

SEQ ID NO: 3094450 - RNA, 16 nt, Molluscum contagiosum virus
ugcgcaagcucagccu

SEQ ID NO: 3094451 - RNA, 20 nt, Molluscum contagiosum virus
cguuccggcggcuggaccug

SEQ ID NO: 3094452 - RNA, 19 nt, Molluscum contagiosum virus
acuggccgcgauucugcuc

SEQ ID NO: 3094453 - RNA, 17 nt, Molluscum contagiosum virus
cgcggcgcuacuggccg

SEQ ID NO: 3094454 - RNA, 23 nt, Molluscum contagiosum virus
ccaagaacaauacaaacaacaac

SEQ ID NO: 3094455 - RNA, 19 nt, Molluscum contagiosum virus
ccggcgaaccgacugcccg

SEQ ID NO: 3094456 - RNA, 19 nt, Molluscum contagiosum virus
caccgcgggcgugcccggc

SEQ ID NO: 3094457 - RNA, 19 nt, Molluscum contagiosum virus
gugcgccgccgcaggcccg

SEQ ID NO: 3094458 - RNA, 15 nt, Molluscum contagiosum virus
gacgucaaccgggcu

SEQ ID NO: 3094459 - RNA, 21 nt, Molluscum contagiosum virus
acguacuggugcccaccccgc

SEQ ID NO: 3094460 - RNA, 12 nt, Molluscum contagiosum virus
guaccagccgcu

SEQ ID NO: 3094461 - RNA, 23 nt, Molluscum contagiosum virus
uaagaguccacugccaaagcuau

SEQ ID NO: 3094462 - RNA, 13 nt, Molluscum contagiosum virus
ugcaucgugggca

SEQ ID NO: 3094463 - RNA, 14 nt, Molluscum contagiosum virus
gcgcgcggcaagca

SEQ ID NO: 3094464 - RNA, 22 nt, Molluscum contagiosum virus
agcgucgcggagcgcgcacggc

SEQ ID NO: 3094465 - RNA, 13 nt, Molluscum contagiosum virus
gaccugcuggugg

SEQ ID NO: 3094466 - RNA, 15 nt, Molluscum contagiosum virus
cgggcagacaggcuc

SEQ ID NO: 3094467 - RNA, 22 nt, Molluscum contagiosum virus
ccgucuccacaaagacgggccc

SEQ ID NO: 3094468 - RNA, 14 nt, Molluscum contagiosum virus
acgcgcugcgccac

SEQ ID NO: 3094469 - RNA, 16 nt, Molluscum contagiosum virus
gcuuggccauggugga

SEQ ID NO: 3094470 - RNA, 19 nt, Molluscum contagiosum virus
gcgcagugcggccagcacc

SEQ ID NO: 3094471 - RNA, 14 nt, Molluscum contagiosum virus
cugcaggaccugcu

SEQ ID NO: 3094472 - RNA, 17 nt, Molluscum contagiosum virus
gucacgcgucgcgcgcc

SEQ ID NO: 3094473 - RNA, 21 nt, Molluscum contagiosum virus
cuugcgagcgcugccugugcu

SEQ ID NO: 3094474 - RNA, 14 nt, Molluscum contagiosum virus
cguugugcuccuug

SEQ ID NO: 3094475 - RNA, 15 nt, Molluscum contagiosum virus
gacacguacacgcug

SEQ ID NO: 3094476 - RNA, 15 nt, Molluscum contagiosum virus
caucuacagccgccu

SEQ ID NO: 3094477 - RNA, 17 nt, Molluscum contagiosum virus
acaugaccaagcacauu

SEQ ID NO: 3094478 - RNA, 13 nt, Molluscum contagiosum virus
ucgucgccgggcc

SEQ ID NO: 3094479 - RNA, 17 nt, Molluscum contagiosum virus
gguuccgcgccugccca

SEQ ID NO: 3094480 - RNA, 14 nt, Molluscum contagiosum virus
gacgugcugcgcaa

SEQ ID NO: 3094481 - RNA, 14 nt, Molluscum contagiosum virus
ugcuauuaccugac

SEQ ID NO: 3094482 - RNA, 22 nt, Molluscum contagiosum virus
caucggagaagugcuccgcacg

SEQ ID NO: 3094483 - RNA, 23 nt, Molluscum contagiosum virus
gagcucgccaugugcgaagacga

SEQ ID NO: 3094484 - RNA, 18 nt, Molluscum contagiosum virus
agacauaguaccaugacg

SEQ ID NO: 3094485 - RNA, 20 nt, Molluscum contagiosum virus
gcgcaugguggcgauccugu

SEQ ID NO: 3094486 - RNA, 20 nt, Molluscum contagiosum virus
caucgagaugcucaagcacu

SEQ ID NO: 3094487 - RNA, 15 nt, Molluscum contagiosum virus
cuaccugaagcugga

SEQ ID NO: 3094488 - RNA, 15 nt, Molluscum contagiosum virus
cagaggacuuuaucu

SEQ ID NO: 3094489 - RNA, 21 nt, Molluscum contagiosum virus
agaucaggcagcugcugcgcu

SEQ ID NO: 3094490 - RNA, 16 nt, Molluscum contagiosum virus
gccucgaugccaacag

SEQ ID NO: 3094491 - RNA, 19 nt, Molluscum contagiosum virus
gccaucgagaugcucaagc

SEQ ID NO: 3094492 - RNA, 20 nt, Molluscum contagiosum virus
ccuucgcuugucgugcuucc

SEQ ID NO: 3094493 - RNA, 22 nt, Molluscum contagiosum virus
uugaggaacuagugcugcuggg

SEQ ID NO: 3094494 - RNA, 19 nt, Molluscum contagiosum virus
ucgggcugcagcccuucca

SEQ ID NO: 3094495 - RNA, 23 nt, Molluscum contagiosum virus
gcuuguucaccaccaccagcacg

SEQ ID NO: 3094496 - RNA, 14 nt, Molluscum contagiosum virus
gucccgcgcuccga

SEQ ID NO: 3094497 - RNA, 17 nt, Molluscum contagiosum virus
cucugccggcgcaaucu

SEQ ID NO: 3094498 - RNA, 23 nt, Molluscum contagiosum virus
aaggaugccugccagcagagcug

SEQ ID NO: 3094499 - RNA, 16 nt, Molluscum contagiosum virus
aggaaaggccccccgc

SEQ ID NO: 3094500 - RNA, 16 nt, Molluscum contagiosum virus
agggcggagccccgag

SEQ ID NO: 3094501 - RNA, 19 nt, Molluscum contagiosum virus
gacgugguacuggcgcccg

SEQ ID NO: 3094502 - RNA, 15 nt, Molluscum contagiosum virus
cucaagcacugccuc

SEQ ID NO: 3094503 - RNA, 17 nt, Molluscum contagiosum virus
cuugauaaaagcacagu

SEQ ID NO: 3094504 - RNA, 14 nt, Molluscum contagiosum virus
acggcgcccaggaa

SEQ ID NO: 3094505 - RNA, 17 nt, Molluscum contagiosum virus
uacccuuggcagcaacu

SEQ ID NO: 3094506 - RNA, 15 nt, Molluscum contagiosum virus
gggcaaugggcacgc

SEQ ID NO: 3094507 - RNA, 17 nt, Molluscum contagiosum virus
cguuccaggaacgccgc

SEQ ID NO: 3094508 - RNA, 17 nt, Molluscum contagiosum virus
ucgacagcauccuggag

SEQ ID NO: 3094509 - RNA, 15 nt, Molluscum contagiosum virus
cucugucgacagucu

SEQ ID NO: 3094510 - RNA, 16 nt, Molluscum contagiosum virus
caagcgccgcucggua

SEQ ID NO: 3094511 - RNA, 22 nt, Molluscum contagiosum virus
ccaugcucgagccugccagcgc

SEQ ID NO: 3094512 - RNA, 18 nt, Molluscum contagiosum virus
ucuccggaggccgcuccc

SEQ ID NO: 3094513 - RNA, 13 nt, Molluscum contagiosum virus
cugacggcgcugc

SEQ ID NO: 3094514 - RNA, 17 nt, Molluscum contagiosum virus
accgacgaggugcgcgc

SEQ ID NO: 3094515 - RNA, 22 nt, Molluscum contagiosum virus
aguuggcgcgcaagcgcugcuc

SEQ ID NO: 3094516 - RNA, 15 nt, Molluscum contagiosum virus
cagccucaaccugaa

SEQ ID NO: 3094517 - RNA, 13 nt, Molluscum contagiosum virus
gaaagaaaacgug

SEQ ID NO: 3094518 - RNA, 18 nt, Molluscum contagiosum virus
gcuccgggcgcuccgagc

SEQ ID NO: 3094519 - RNA, 18 nt, Molluscum contagiosum virus
agccgcuggacgccucgg

SEQ ID NO: 3094520 - RNA, 19 nt, Molluscum contagiosum virus
ugcugguggugcuggagcg

SEQ ID NO: 3094521 - RNA, 20 nt, Molluscum contagiosum virus
cgaacgagggacacgcacuu

SEQ ID NO: 3094522 - RNA, 15 nt, Molluscum contagiosum virus
gccgcggcagcucug

SEQ ID NO: 3094523 - RNA, 18 nt, Molluscum contagiosum virus
ccgcaagaagcgaaacac

SEQ ID NO: 3094524 - RNA, 17 nt, Molluscum contagiosum virus
ccguaggcgggccugcg

SEQ ID NO: 3094525 - RNA, 18 nt, Molluscum contagiosum virus
gacgcggaugccacgcag

SEQ ID NO: 3094526 - RNA, 21 nt, Molluscum contagiosum virus
caccggcggguccgcaggcuc

SEQ ID NO: 3094527 - RNA, 23 nt, Molluscum contagiosum virus
ucgugguugcgcacguuggccac

SEQ ID NO: 3094528 - RNA, 17 nt, Molluscum contagiosum virus
guggcguugcugcugcg

SEQ ID NO: 3094529 - RNA, 12 nt, Molluscum contagiosum virus
cucgagggcgcc

SEQ ID NO: 3094530 - RNA, 19 nt, Molluscum contagiosum virus
gcgcccuuugcggcacggg

SEQ ID NO: 3094531 - RNA, 20 nt, Molluscum contagiosum virus
gcagcgcgugacgcucacgg

SEQ ID NO: 3094532 - RNA, 14 nt, Molluscum contagiosum virus
ccggcgcgugagcg

SEQ ID NO: 3094533 - RNA, 18 nt, Molluscum contagiosum virus
uaccugcaggaggaccgc

SEQ ID NO: 3094534 - RNA, 15 nt, Molluscum contagiosum virus
gcgcggcgcgccgcc

SEQ ID NO: 3094535 - RNA, 17 nt, Molluscum contagiosum virus
auggccgagaaaaagcu

SEQ ID NO: 3094536 - RNA, 18 nt, Molluscum contagiosum virus
gcagcucggcgagagcgc

SEQ ID NO: 3094537 - RNA, 23 nt, Molluscum contagiosum virus
cggcgcccgcgugcacccuccgc

SEQ ID NO: 3094538 - RNA, 19 nt, Molluscum contagiosum virus
ucgacgugcagacgcucaa

SEQ ID NO: 3094539 - RNA, 18 nt, Molluscum contagiosum virus
gcuucggcggcugugccc

SEQ ID NO: 3094540 - RNA, 17 nt, Molluscum contagiosum virus
ggcacgagcaguccgcc

SEQ ID NO: 3094541 - RNA, 22 nt, Molluscum contagiosum virus
gaagacauugccuuuugcacag

SEQ ID NO: 3094542 - RNA, 12 nt, Molluscum contagiosum virus
gacucgcagcuc

SEQ ID NO: 3094543 - RNA, 16 nt, Molluscum contagiosum virus
cgacuagccugugccc

SEQ ID NO: 3094544 - RNA, 22 nt, Molluscum contagiosum virus
cgccacuggaagaacaggccgc

SEQ ID NO: 3094545 - RNA, 15 nt, Molluscum contagiosum virus
ccucagccgagcgcc

SEQ ID NO: 3094546 - RNA, 21 nt, Molluscum contagiosum virus
ucgcggagcugugccgcagca

SEQ ID NO: 3094547 - RNA, 14 nt, Molluscum contagiosum virus
gcggggagcucugc

SEQ ID NO: 3094548 - RNA, 23 nt, Molluscum contagiosum virus
gacgcgcguucuuugugcggcuc

SEQ ID NO: 3094549 - RNA, 22 nt, Molluscum contagiosum virus
uacgagccgcuguccgaggacu

SEQ ID NO: 3094550 - RNA, 17 nt, Molluscum contagiosum virus
aacucacggaugcgcgc

SEQ ID NO: 3094551 - RNA, 13 nt, Molluscum contagiosum virus
gcacccuggcugc

SEQ ID NO: 3094552 - RNA, 15 nt, Molluscum contagiosum virus
aaacacugucucugc

SEQ ID NO: 3094553 - RNA, 12 nt, Molluscum contagiosum virus
gcgcgcugugag

SEQ ID NO: 3094554 - RNA, 14 nt, Molluscum contagiosum virus
guuccugccgggag

SEQ ID NO: 3094555 - RNA, 13 nt, Molluscum contagiosum virus
accuggaguacuu

SEQ ID NO: 3094556 - RNA, 23 nt, Molluscum contagiosum virus
gcucgcgcuguauucggcguacg

SEQ ID NO: 3094557 - RNA, 19 nt, Molluscum contagiosum virus
gucccgcgaacgagggaca

SEQ ID NO: 3094558 - RNA, 16 nt, Molluscum contagiosum virus
aaggacguccuguagc

SEQ ID NO: 3094559 - RNA, 19 nt, Molluscum contagiosum virus
ccaagguuugcgggcgcag

SEQ ID NO: 3094560 - RNA, 17 nt, Molluscum contagiosum virus
acauugcugcugcaggc

SEQ ID NO: 3094561 - RNA, 11 nt, Molluscum contagiosum virus
ucuuucucuag

SEQ ID NO: 3094562 - RNA, 12 nt, Molluscum contagiosum virus
uucgagcugcug

SEQ ID NO: 3094563 - RNA, 17 nt, Molluscum contagiosum virus
acagagcccgcggcgca

SEQ ID NO: 3094564 - RNA, 11 nt, Molluscum contagiosum virus
gagucgcgccu

SEQ ID NO: 3094565 - RNA, 19 nt, Molluscum contagiosum virus
gcgcaguucgagcugcugc

SEQ ID NO: 3094566 - RNA, 15 nt, Molluscum contagiosum virus
caacagcgcaagcug

SEQ ID NO: 3094567 - RNA, 13 nt, Molluscum contagiosum virus
cgccgcgugcaug

SEQ ID NO: 3094568 - RNA, 12 nt, Molluscum contagiosum virus
cagugacagacu

SEQ ID NO: 3094569 - RNA, 21 nt, Molluscum contagiosum virus
gucgagagcgcguucacaaag

SEQ ID NO: 3094570 - RNA, 16 nt, Molluscum contagiosum virus
auccucaaccgcugca

SEQ ID NO: 3094571 - RNA, 12 nt, Molluscum contagiosum virus
uguccucucgag

SEQ ID NO: 3094572 - RNA, 13 nt, Molluscum contagiosum virus
aggcgcuggugga

SEQ ID NO: 3094573 - RNA, 20 nt, Molluscum contagiosum virus
acugggaacccguggccgag

SEQ ID NO: 3094574 - RNA, 23 nt, Molluscum contagiosum virus
auagcgcgcuagcuccacgugcc

SEQ ID NO: 3094575 - RNA, 23 nt, Molluscum contagiosum virus
gcccgggagaguggccgcuccag

SEQ ID NO: 3094576 - RNA, 15 nt, Molluscum contagiosum virus
caggaugcugguguc

SEQ ID NO: 3094577 - RNA, 13 nt, Molluscum contagiosum virus
aggcaaaguucuc

SEQ ID NO: 3094578 - RNA, 14 nt, Molluscum contagiosum virus
gcgcgcaccugcac

SEQ ID NO: 3094579 - RNA, 14 nt, Molluscum contagiosum virus
accgcggcagccuu

SEQ ID NO: 3094580 - RNA, 22 nt, Molluscum contagiosum virus
gcggcauugugguguucgcagg

SEQ ID NO: 3094581 - RNA, 23 nt, Molluscum contagiosum virus
gcagcgcccgcguacacgugcac

SEQ ID NO: 3094582 - RNA, 20 nt, Molluscum contagiosum virus
uacgacgcgcccacgugcca

SEQ ID NO: 3094583 - RNA, 13 nt, Molluscum contagiosum virus
cgccuucugccug

SEQ ID NO: 3094584 - RNA, 15 nt, Molluscum contagiosum virus
cggacuucucgcuca

SEQ ID NO: 3094585 - RNA, 13 nt, Molluscum contagiosum virus
cgcgccugcuggc

SEQ ID NO: 3094586 - RNA, 20 nt, Molluscum contagiosum virus
acaagggcagcucaagcugc

SEQ ID NO: 3094587 - RNA, 11 nt, Molluscum contagiosum virus
gggccgcgagg

SEQ ID NO: 3094588 - RNA, 21 nt, Molluscum contagiosum virus
cacacgcaccgccuggugcug

SEQ ID NO: 3094589 - RNA, 19 nt, Molluscum contagiosum virus
agcauauccugauuucguu

SEQ ID NO: 3094590 - RNA, 20 nt, Molluscum contagiosum virus
guacacguagaggaaguaga

SEQ ID NO: 3094591 - RNA, 15 nt, Molluscum contagiosum virus
ugagcuagugccgag

SEQ ID NO: 3094592 - RNA, 22 nt, Molluscum contagiosum virus
gaccagcugguccugaacagca

SEQ ID NO: 3094593 - RNA, 14 nt, Molluscum contagiosum virus
gacacguugcacug

SEQ ID NO: 3094594 - RNA, 15 nt, Molluscum contagiosum virus
ggggcuggcagaaga

SEQ ID NO: 3094595 - RNA, 21 nt, Molluscum contagiosum virus
gagcggcgccgacaacgugcu

SEQ ID NO: 3094596 - RNA, 14 nt, Molluscum contagiosum virus
acggcgugcgcgag

SEQ ID NO: 3094597 - RNA, 19 nt, Molluscum contagiosum virus
agcguugucuugaugcugu

SEQ ID NO: 3094598 - RNA, 16 nt, Molluscum contagiosum virus
acaguaggacaugucc

SEQ ID NO: 3094599 - RNA, 22 nt, Molluscum contagiosum virus
gaccugcgccauccacgugggc

SEQ ID NO: 3094600 - RNA, 15 nt, Molluscum contagiosum virus
gcgugacccucuucg

SEQ ID NO: 3094601 - RNA, 12 nt, Molluscum contagiosum virus
ggcgcggcagcc

SEQ ID NO: 3094602 - RNA, 19 nt, Molluscum contagiosum virus
gccgagcucuuccccgcgg

SEQ ID NO: 3094603 - RNA, 15 nt, Molluscum contagiosum virus
cgcugcgccgcuucc

SEQ ID NO: 3094604 - RNA, 20 nt, Molluscum contagiosum virus
cgcgaacgaggagggcagcc

SEQ ID NO: 3094605 - RNA, 21 nt, Molluscum contagiosum virus
cuggaguacuucaagcacgag

SEQ ID NO: 3094606 - RNA, 15 nt, Molluscum contagiosum virus
caagccguccgccuc

SEQ ID NO: 3094607 - RNA, 14 nt, Molluscum contagiosum virus
ccgcaagcacggaa

SEQ ID NO: 3094608 - RNA, 15 nt, Molluscum contagiosum virus
gaccgucaccgcagu

SEQ ID NO: 3094609 - RNA, 13 nt, Molluscum contagiosum virus
agacacgagcgcg

SEQ ID NO: 3094610 - RNA, 17 nt, Molluscum contagiosum virus
guaccgcgcgcacgcgg

SEQ ID NO: 3094611 - RNA, 17 nt, Molluscum contagiosum virus
ggucucggggcuccgcc

SEQ ID NO: 3094612 - RNA, 21 nt, Molluscum contagiosum virus
cgacggucacgcaagcuuugu

SEQ ID NO: 3094613 - RNA, 21 nt, Molluscum contagiosum virus
ccgcccgcgcuucugccugcu

SEQ ID NO: 3094614 - RNA, 14 nt, Molluscum contagiosum virus
cggcgcucgccccu

SEQ ID NO: 3094615 - RNA, 19 nt, Molluscum contagiosum virus
ccucuggaaggagcugggc

SEQ ID NO: 3094616 - RNA, 14 nt, Molluscum contagiosum virus
acgcaaaagaggcc

SEQ ID NO: 3094617 - RNA, 20 nt, Molluscum contagiosum virus
guccacggcgcgcaccuaca

SEQ ID NO: 3094618 - RNA, 18 nt, Molluscum contagiosum virus
ucuccgcgggcagccgcu

SEQ ID NO: 3094619 - RNA, 19 nt, Molluscum contagiosum virus
caaggaaaacugcauccug

SEQ ID NO: 3094620 - RNA, 18 nt, Molluscum contagiosum virus
gcaacgcgcgcgcgcugg

SEQ ID NO: 3094621 - RNA, 18 nt, Molluscum contagiosum virus
ggaggaccacgccgacca

SEQ ID NO: 3094622 - RNA, 12 nt, Molluscum contagiosum virus
uacuccugcugg

SEQ ID NO: 3094623 - RNA, 14 nt, Molluscum contagiosum virus
cagcugcugcgcuu

SEQ ID NO: 3094624 - RNA, 17 nt, Molluscum contagiosum virus
gggcuucgccgccggag

SEQ ID NO: 3094625 - RNA, 13 nt, Molluscum contagiosum virus
cgucucggagaag

SEQ ID NO: 3094626 - RNA, 13 nt, Molluscum contagiosum virus
acgguccugggcg

SEQ ID NO: 3094627 - RNA, 22 nt, Molluscum contagiosum virus
cgcacggccugcggcaggaagc

SEQ ID NO: 3094628 - RNA, 16 nt, Molluscum contagiosum virus
cagcgcgaaccauuuu

SEQ ID NO: 3094629 - RNA, 15 nt, Molluscum contagiosum virus
gccagguguuccugc

SEQ ID NO: 3094630 - RNA, 23 nt, Molluscum contagiosum virus
cgcgcucgcgggagcgggagggc

SEQ ID NO: 3094631 - RNA, 13 nt, Molluscum contagiosum virus
agggcgagucucc

SEQ ID NO: 3094632 - RNA, 14 nt, Molluscum contagiosum virus
cacguacgagcagc

SEQ ID NO: 3094633 - RNA, 14 nt, Molluscum contagiosum virus
cucagcaaggaggg

SEQ ID NO: 3094634 - RNA, 17 nt, Molluscum contagiosum virus
cgcuugcccggagccgg

SEQ ID NO: 3094635 - RNA, 15 nt, Molluscum contagiosum virus
cuccagguccuccag

SEQ ID NO: 3094636 - RNA, 17 nt, Molluscum contagiosum virus
gcaacgcgggccaggca

SEQ ID NO: 3094637 - RNA, 21 nt, Molluscum contagiosum virus
gaugcugaacgaucucugacc

SEQ ID NO: 3094638 - RNA, 12 nt, Molluscum contagiosum virus
cggcugcgccac

SEQ ID NO: 3094639 - RNA, 18 nt, Molluscum contagiosum virus
cucuucggggacggcgug

SEQ ID NO: 3094640 - RNA, 22 nt, Molluscum contagiosum virus
ucgcgcacgaccacgugcagga

SEQ ID NO: 3094641 - RNA, 13 nt, Molluscum contagiosum virus
cagcuguuucugc

SEQ ID NO: 3094642 - RNA, 13 nt, Molluscum contagiosum virus
cgagaugcucgcc

SEQ ID NO: 3094643 - RNA, 23 nt, Molluscum contagiosum virus
augaagcucucgcgcgcagggcg

SEQ ID NO: 3094644 - RNA, 21 nt, Molluscum contagiosum virus
augucgccgcguagccgccgc

SEQ ID NO: 3094645 - RNA, 20 nt, Molluscum contagiosum virus
acgcugcucgugcugcucug

SEQ ID NO: 3094646 - RNA, 13 nt, Molluscum contagiosum virus
cucggaggcgcag

SEQ ID NO: 3094647 - RNA, 14 nt, Molluscum contagiosum virus
cgucuuaacucagc

SEQ ID NO: 3094648 - RNA, 17 nt, Molluscum contagiosum virus
gucaucaccagccugcu

SEQ ID NO: 3094649 - RNA, 13 nt, Molluscum contagiosum virus
cagcgccgccucg

SEQ ID NO: 3094650 - RNA, 19 nt, Molluscum contagiosum virus
ccagcccgcugcgcauggc

SEQ ID NO: 3094651 - RNA, 13 nt, Molluscum contagiosum virus
cgccacugccacg

SEQ ID NO: 3094652 - RNA, 17 nt, Molluscum contagiosum virus
acagucuugcgcagcgc

SEQ ID NO: 3094653 - RNA, 18 nt, Molluscum contagiosum virus
guucgcggagcugugccg

SEQ ID NO: 3094654 - RNA, 19 nt, Molluscum contagiosum virus
ccacguccaggccgcggca

SEQ ID NO: 3094655 - RNA, 16 nt, Molluscum contagiosum virus
cugcggcugcuggagc

SEQ ID NO: 3094656 - RNA, 18 nt, Molluscum contagiosum virus
gcgugaacaauacaugcu

SEQ ID NO: 3094657 - RNA, 17 nt, Molluscum contagiosum virus
gcacuggccugcaaacg

SEQ ID NO: 3094658 - RNA, 15 nt, Molluscum contagiosum virus
agcagccgcagccca

SEQ ID NO: 3094659 - RNA, 17 nt, Molluscum contagiosum virus
guuccgcgccugcccau

SEQ ID NO: 3094660 - RNA, 21 nt, Molluscum contagiosum virus
ccuugcgagcgcugccugugc

SEQ ID NO: 3094661 - RNA, 13 nt, Molluscum contagiosum virus
ccgcagccacggc

SEQ ID NO: 3094662 - RNA, 13 nt, Molluscum contagiosum virus
ugccgcagcccga

SEQ ID NO: 3094663 - RNA, 14 nt, Molluscum contagiosum virus
acucgcugcugcuc

SEQ ID NO: 3094664 - RNA, 15 nt, Molluscum contagiosum virus
cagcagcgccagcuu

SEQ ID NO: 3094665 - RNA, 21 nt, Molluscum contagiosum virus
ccaagaagaagcagcagacca

SEQ ID NO: 3094666 - RNA, 17 nt, Molluscum contagiosum virus
ccgccgucggcgugccg

SEQ ID NO: 3094667 - RNA, 23 nt, Molluscum contagiosum virus
cagcuugguaaugagcagcacgc

SEQ ID NO: 3094668 - RNA, 15 nt, Molluscum contagiosum virus
cggauaugcgccugu

SEQ ID NO: 3094669 - RNA, 16 nt, Molluscum contagiosum virus
cugucccuugauccag

SEQ ID NO: 3094670 - RNA, 22 nt, Molluscum contagiosum virus
cugcgcauggccacgcccgggc

SEQ ID NO: 3094671 - RNA, 17 nt, Molluscum contagiosum virus
ucgaagcccagcuucag

SEQ ID NO: 3094672 - RNA, 15 nt, Molluscum contagiosum virus
ggacgcccuccucga

SEQ ID NO: 3094673 - RNA, 15 nt, Molluscum contagiosum virus
cguccccggaaagca

SEQ ID NO: 3094674 - RNA, 24 nt, Molluscum contagiosum virus
ggcagaaacucuccgacgugcugc

SEQ ID NO: 3094675 - RNA, 20 nt, Molluscum contagiosum virus
aacacugacgcucgggccgg

SEQ ID NO: 3094676 - RNA, 17 nt, Molluscum contagiosum virus
gccccgcgcgugcaguu

SEQ ID NO: 3094677 - RNA, 19 nt, Molluscum contagiosum virus
ggcgcaccuuuggugcaga

SEQ ID NO: 3094678 - RNA, 14 nt, Molluscum contagiosum virus
uggacgaggccaac

SEQ ID NO: 3094679 - RNA, 14 nt, Molluscum contagiosum virus
auacucuguagcau

SEQ ID NO: 3094680 - RNA, 19 nt, Molluscum contagiosum virus
cccgcgcucuuacugcagc

SEQ ID NO: 3094681 - RNA, 21 nt, Molluscum contagiosum virus
ccccguccgugucgagcugcc

SEQ ID NO: 3094682 - RNA, 15 nt, Molluscum contagiosum virus
acgccaucaggaaug

SEQ ID NO: 3094683 - RNA, 15 nt, Molluscum contagiosum virus
cgucgcgcgccgugc

SEQ ID NO: 3094684 - RNA, 11 nt, Molluscum contagiosum virus
cccgugguggg

SEQ ID NO: 3094685 - RNA, 12 nt, Molluscum contagiosum virus
uggcgcgccgcu

SEQ ID NO: 3094686 - RNA, 16 nt, Molluscum contagiosum virus
cgcuugcucacgcugc

SEQ ID NO: 3094687 - RNA, 13 nt, Molluscum contagiosum virus
cgcagcgugccgc

SEQ ID NO: 3094688 - RNA, 14 nt, Molluscum contagiosum virus
ccgcggggcuccuc

SEQ ID NO: 3094689 - RNA, 20 nt, Molluscum contagiosum virus
agaaaggcacccaccaggaa

SEQ ID NO: 3094690 - RNA, 19 nt, Molluscum contagiosum virus
cagcucguugcgcagccgg

SEQ ID NO: 3094691 - RNA, 16 nt, Molluscum contagiosum virus
ggcccgccuccgggca

SEQ ID NO: 3094692 - RNA, 18 nt, Molluscum contagiosum virus
gaacagggaaaaaucccc

SEQ ID NO: 3094693 - RNA, 22 nt, Molluscum contagiosum virus
gacgccucgggaaaacgcgcgg

SEQ ID NO: 3094694 - RNA, 17 nt, Molluscum contagiosum virus
ccgcaccagugccgacg

SEQ ID NO: 3094695 - RNA, 13 nt, Molluscum contagiosum virus
caacaagcugcug

SEQ ID NO: 3094696 - RNA, 16 nt, Molluscum contagiosum virus
gcaugcacagcugcuc

SEQ ID NO: 3094697 - RNA, 17 nt, Molluscum contagiosum virus
cugcagcagcuccagca

SEQ ID NO: 3094698 - RNA, 20 nt, Molluscum contagiosum virus
cuaucagagacaggggggag

SEQ ID NO: 3094699 - RNA, 16 nt, Molluscum contagiosum virus
ggcuugccccgcgcgu

SEQ ID NO: 3094700 - RNA, 23 nt, Molluscum contagiosum virus
cugcagcgccgcgcgguugagcu

SEQ ID NO: 3094701 - RNA, 13 nt, Molluscum contagiosum virus
aaggaagcaacaa

SEQ ID NO: 3094702 - RNA, 14 nt, Molluscum contagiosum virus
augaacagcuucac

SEQ ID NO: 3094703 - RNA, 16 nt, Molluscum contagiosum virus
ggccaggcacuggccc

SEQ ID NO: 3094704 - RNA, 15 nt, Molluscum contagiosum virus
cacgcgcccgccgcc

SEQ ID NO: 3094705 - RNA, 19 nt, Molluscum contagiosum virus
agccugcucacggcggcgc

SEQ ID NO: 3094706 - RNA, 17 nt, Molluscum contagiosum virus
cguucccaagcaaagcc

SEQ ID NO: 3094707 - RNA, 18 nt, Molluscum contagiosum virus
gcgggacagagcucggca

SEQ ID NO: 3094708 - RNA, 15 nt, Molluscum contagiosum virus
gucaucggagagccc

SEQ ID NO: 3094709 - RNA, 12 nt, Molluscum contagiosum virus
cggccagcaccg

SEQ ID NO: 3094710 - RNA, 23 nt, Molluscum contagiosum virus
uccaagaacaauacaaacaacaa

SEQ ID NO: 3094711 - RNA, 23 nt, Molluscum contagiosum virus
uggagacggaggugguggccaag

SEQ ID NO: 3094712 - RNA, 12 nt, Molluscum contagiosum virus
ggacagugccuc

SEQ ID NO: 3094713 - RNA, 10 nt, Molluscum contagiosum virus
ggcaagccug

SEQ ID NO: 3094714 - RNA, 16 nt, Molluscum contagiosum virus
aguggcgugacagguc

SEQ ID NO: 3094715 - RNA, 14 nt, Molluscum contagiosum virus
augauugucaagca

SEQ ID NO: 3094716 - RNA, 18 nt, Molluscum contagiosum virus
cgggugccgugccccugc

SEQ ID NO: 3094717 - RNA, 12 nt, Molluscum contagiosum virus
cgggcccgccuu

SEQ ID NO: 3094718 - RNA, 14 nt, Molluscum contagiosum virus
caugcggagcuggc

SEQ ID NO: 3094719 - RNA, 17 nt, Molluscum contagiosum virus
caaagucgcgcgcggcc

SEQ ID NO: 3094720 - RNA, 18 nt, Molluscum contagiosum virus
gcgcacgcggcucuggag

SEQ ID NO: 3094721 - RNA, 19 nt, Molluscum contagiosum virus
cacagucuugcgcagcgcc

SEQ ID NO: 3094722 - RNA, 17 nt, Molluscum contagiosum virus
cccgcgagcacgggcgc

SEQ ID NO: 3094723 - RNA, 13 nt, Molluscum contagiosum virus
gcaacaggggccg

SEQ ID NO: 3094724 - RNA, 20 nt, Molluscum contagiosum virus
caugcggcaggcgcugcgcg

SEQ ID NO: 3094725 - RNA, 20 nt, Molluscum contagiosum virus
cgaguacgccaucguggugg

SEQ ID NO: 3094726 - RNA, 15 nt, Molluscum contagiosum virus
ugcgguacaugcugu

SEQ ID NO: 3094727 - RNA, 21 nt, Molluscum contagiosum virus
aaacugcugcccgcgcagcgc

SEQ ID NO: 3094728 - RNA, 21 nt, Molluscum contagiosum virus
gcacgauggggcgcucgggca

SEQ ID NO: 3094729 - RNA, 16 nt, Molluscum contagiosum virus
gggcccgcgaaggaga

SEQ ID NO: 3094730 - RNA, 12 nt, Molluscum contagiosum virus
cgccgcugcucg

SEQ ID NO: 3094731 - RNA, 14 nt, Molluscum contagiosum virus
caggcgcagcgcgg

SEQ ID NO: 3094732 - RNA, 19 nt, Molluscum contagiosum virus
ggccgcggaggacucggag

SEQ ID NO: 3094733 - RNA, 23 nt, Molluscum contagiosum virus
gcgagggcgaguccccgagcagc

SEQ ID NO: 3094734 - RNA, 17 nt, Molluscum contagiosum virus
gcgcucguacucguugc

SEQ ID NO: 3094735 - RNA, 20 nt, Molluscum contagiosum virus
gacgccagcgauugcccgcg

SEQ ID NO: 3094736 - RNA, 22 nt, Molluscum contagiosum virus
cggcgggcacauccgcuaccug

SEQ ID NO: 3094737 - RNA, 19 nt, Molluscum contagiosum virus
agugaaggguguggccuac

SEQ ID NO: 3094738 - RNA, 15 nt, Molluscum contagiosum virus
gaccaccagcaccag

SEQ ID NO: 3094739 - RNA, 23 nt, Molluscum contagiosum virus
cgauggaaggcgaccagcugguc

SEQ ID NO: 3094740 - RNA, 23 nt, Molluscum contagiosum virus
gcuaccaagaacagagaaaggca

SEQ ID NO: 3094741 - RNA, 23 nt, Molluscum contagiosum virus
gguggugcgccugcacuacugcu

SEQ ID NO: 3094742 - RNA, 12 nt, Molluscum contagiosum virus
cacugugcuggc

SEQ ID NO: 3094743 - RNA, 23 nt, Molluscum contagiosum virus
acguguacaugaugcccugguga

SEQ ID NO: 3094744 - RNA, 15 nt, Molluscum contagiosum virus
cgugaacgaggcugc

SEQ ID NO: 3094745 - RNA, 21 nt, Molluscum contagiosum virus
cccgucuccacaaagacgggc

SEQ ID NO: 3094746 - RNA, 16 nt, Molluscum contagiosum virus
ggucguccuggagccu

SEQ ID NO: 3094747 - RNA, 23 nt, Molluscum contagiosum virus
gcgccugccgcgcaugcuggaga

SEQ ID NO: 3094748 - RNA, 18 nt, Molluscum contagiosum virus
gugccgagcucgccuccu

SEQ ID NO: 3094749 - RNA, 23 nt, Molluscum contagiosum virus
ggcacgaucgcgagacccccguu

SEQ ID NO: 3094750 - RNA, 21 nt, Molluscum contagiosum virus
guacccgagcugugccaacau

SEQ ID NO: 3094751 - RNA, 22 nt, Molluscum contagiosum virus
uucuugguguucugcgcgccgc

SEQ ID NO: 3094752 - RNA, 22 nt, Molluscum contagiosum virus
gcgcggcguggcgcugaggaag

SEQ ID NO: 3094753 - RNA, 18 nt, Molluscum contagiosum virus
cuuccccgcacaagggca

SEQ ID NO: 3094754 - RNA, 23 nt, Molluscum contagiosum virus
cgagggcgggcacgugcugcugc

SEQ ID NO: 3094755 - RNA, 16 nt, Molluscum contagiosum virus
gccaacgccagcugua

SEQ ID NO: 3094756 - RNA, 16 nt, Molluscum contagiosum virus
gcuccccgccagcacc

SEQ ID NO: 3094757 - RNA, 14 nt, Molluscum contagiosum virus
gcuggacgggcacg

SEQ ID NO: 3094758 - RNA, 14 nt, Molluscum contagiosum virus
uccgggcgcuccga

SEQ ID NO: 3094759 - RNA, 15 nt, Molluscum contagiosum virus
ggccuguaccugcga

SEQ ID NO: 3094760 - RNA, 14 nt, Molluscum contagiosum virus
cgugcuccacgcgc

SEQ ID NO: 3094761 - RNA, 20 nt, Molluscum contagiosum virus
uugaacaucuaugcacggca

SEQ ID NO: 3094762 - RNA, 14 nt, Molluscum contagiosum virus
cugcugcgcgccgc

SEQ ID NO: 3094763 - RNA, 21 nt, Molluscum contagiosum virus
caguagcgaaugcagugcccg

SEQ ID NO: 3094764 - RNA, 16 nt, Molluscum contagiosum virus
ccaugugucuuguggc

SEQ ID NO: 3094765 - RNA, 17 nt, Molluscum contagiosum virus
cgggcaaugggcacgcu

SEQ ID NO: 3094766 - RNA, 14 nt, Molluscum contagiosum virus
agacgcugcugcac

SEQ ID NO: 3094767 - RNA, 11 nt, Molluscum contagiosum virus
auauccagccc

SEQ ID NO: 3094768 - RNA, 14 nt, Molluscum contagiosum virus
gccuaccugcagga

SEQ ID NO: 3094769 - RNA, 15 nt, Molluscum contagiosum virus
agagcgcgcggcgcc

SEQ ID NO: 3094770 - RNA, 19 nt, Molluscum contagiosum virus
cgaagaguuggacagccau

SEQ ID NO: 3094771 - RNA, 16 nt, Molluscum contagiosum virus
gccccugggcuucugg

SEQ ID NO: 3094772 - RNA, 19 nt, Molluscum contagiosum virus
guaccugcaggcucuaagc

SEQ ID NO: 3094773 - RNA, 14 nt, Molluscum contagiosum virus
ccccguccuugcuc

SEQ ID NO: 3094774 - RNA, 18 nt, Molluscum contagiosum virus
ugcaguugagagcagcgg

SEQ ID NO: 3094775 - RNA, 17 nt, Molluscum contagiosum virus
gucgcaguacccgagcu

SEQ ID NO: 3094776 - RNA, 17 nt, Molluscum contagiosum virus
aaccugggcgccgcgcu

SEQ ID NO: 3094777 - RNA, 17 nt, Molluscum contagiosum virus
ccguccuugcucuggcu

SEQ ID NO: 3094778 - RNA, 17 nt, Molluscum contagiosum virus
cgcgcucgcgugccgcg

SEQ ID NO: 3094779 - RNA, 22 nt, Molluscum contagiosum virus
cugcggcgcgugccgcugcgcg

SEQ ID NO: 3094780 - RNA, 19 nt, Molluscum contagiosum virus
cagcacaaacucgcagaac

SEQ ID NO: 3094781 - RNA, 19 nt, Molluscum contagiosum virus
caagcuggaggcugccccu

SEQ ID NO: 3094782 - RNA, 17 nt, Molluscum contagiosum virus
cccggcgggcucuuccu

SEQ ID NO: 3094783 - RNA, 21 nt, Molluscum contagiosum virus
cuagcauuccuucacacagac

SEQ ID NO: 3094784 - RNA, 18 nt, Molluscum contagiosum virus
uccgggcacguccgccuc

SEQ ID NO: 3094785 - RNA, 22 nt, Molluscum contagiosum virus
agcgcgcccaccagcagccagg

SEQ ID NO: 3094786 - RNA, 20 nt, Molluscum contagiosum virus
ucucguucgcgaccuggcgc

SEQ ID NO: 3094787 - RNA, 14 nt, Molluscum contagiosum virus
gcgucgccugagcu

SEQ ID NO: 3094788 - RNA, 13 nt, Molluscum contagiosum virus
cgcgagcugcugc

SEQ ID NO: 3094789 - RNA, 14 nt, Molluscum contagiosum virus
cucguacugcugca

SEQ ID NO: 3094790 - RNA, 13 nt, Molluscum contagiosum virus
acuccugcuggcg

SEQ ID NO: 3094791 - RNA, 14 nt, Molluscum contagiosum virus
agagggucgugcag

SEQ ID NO: 3094792 - RNA, 17 nt, Molluscum contagiosum virus
gcgcgggaugcuggacg

SEQ ID NO: 3094793 - RNA, 16 nt, Molluscum contagiosum virus
gcaggagcacgccugg

SEQ ID NO: 3094794 - RNA, 22 nt, Molluscum contagiosum virus
gcagccccguaggcgggccugc

SEQ ID NO: 3094795 - RNA, 19 nt, Molluscum contagiosum virus
gcccgcugcgcgcucugga

SEQ ID NO: 3094796 - RNA, 23 nt, Molluscum contagiosum virus
acggagcgcgucuauccugucag

SEQ ID NO: 3094797 - RNA, 22 nt, Molluscum contagiosum virus
cccucuaaauggccgcgccgcg

SEQ ID NO: 3094798 - RNA, 13 nt, Molluscum contagiosum virus
acacgagggccuu

SEQ ID NO: 3094799 - RNA, 15 nt, Molluscum contagiosum virus
cuuccggcagcugga

SEQ ID NO: 3094800 - RNA, 15 nt, Molluscum contagiosum virus
gccagcggcgccgca

SEQ ID NO: 3094801 - RNA, 21 nt, Molluscum contagiosum virus
gcgcgacuuguccucaagucg

SEQ ID NO: 3094802 - RNA, 15 nt, Molluscum contagiosum virus
cucuucgcaggcgug

SEQ ID NO: 3094803 - RNA, 21 nt, Molluscum contagiosum virus
guacugaacgucuucgagagc

SEQ ID NO: 3094804 - RNA, 21 nt, Molluscum contagiosum virus
ugacugugucgacuucaccuu

SEQ ID NO: 3094805 - RNA, 22 nt, Molluscum contagiosum virus
gaccugucgugcaauggcaggu

SEQ ID NO: 3094806 - RNA, 14 nt, Molluscum contagiosum virus
cucgcgagcacuuu

SEQ ID NO: 3094807 - RNA, 15 nt, Molluscum contagiosum virus
ggcacccgcaggaaa

SEQ ID NO: 3094808 - RNA, 18 nt, Molluscum contagiosum virus
cguccgcacgaggagccc

SEQ ID NO: 3094809 - RNA, 15 nt, Molluscum contagiosum virus
cgccucgagcgcgcu

SEQ ID NO: 3094810 - RNA, 17 nt, Molluscum contagiosum virus
cuguaaauggaccacaa

SEQ ID NO: 3094811 - RNA, 23 nt, Molluscum contagiosum virus
acgccaacuucgucucgagcuuc

SEQ ID NO: 3094812 - RNA, 13 nt, Molluscum contagiosum virus
gcgccacugccac

SEQ ID NO: 3094813 - RNA, 12 nt, Molluscum contagiosum virus
acgcgagcacug

SEQ ID NO: 3094814 - RNA, 14 nt, Molluscum contagiosum virus
cggcggcgcgaagc

SEQ ID NO: 3094815 - RNA, 18 nt, Molluscum contagiosum virus
cugcugccgagcuucguc

SEQ ID NO: 3094816 - RNA, 13 nt, Molluscum contagiosum virus
cguggacaacagc

SEQ ID NO: 3094817 - RNA, 19 nt, Molluscum contagiosum virus
cguacgcgcagggagcugc

SEQ ID NO: 3094818 - RNA, 22 nt, Molluscum contagiosum virus
ccccaugcccgaccacgugcca

SEQ ID NO: 3094819 - RNA, 15 nt, Molluscum contagiosum virus
gaggcggcacugcua

SEQ ID NO: 3094820 - RNA, 18 nt, Molluscum contagiosum virus
uccggucgcccuccgccg

SEQ ID NO: 3094821 - RNA, 20 nt, Molluscum contagiosum virus
gcucaugguuugcgugggug

SEQ ID NO: 3094822 - RNA, 12 nt, Molluscum contagiosum virus
gcacugcuacga

SEQ ID NO: 3094823 - RNA, 21 nt, Molluscum contagiosum virus
gcgcggcccgagcaggacgug

SEQ ID NO: 3094824 - RNA, 23 nt, Molluscum contagiosum virus
gcggcacgccgcucggcacugcu

SEQ ID NO: 3094825 - RNA, 14 nt, Molluscum contagiosum virus
gcugccgcagagcc

SEQ ID NO: 3094826 - RNA, 16 nt, Molluscum contagiosum virus
ugcgugacccucuucg

SEQ ID NO: 3094827 - RNA, 21 nt, Molluscum contagiosum virus
ccgcaaauuccguccccucuc

SEQ ID NO: 3094828 - RNA, 24 nt, Molluscum contagiosum virus
cgcgaaggcaaccgcgacgagcag

SEQ ID NO: 3094829 - RNA, 18 nt, Molluscum contagiosum virus
cgcacggugugcuacugc

SEQ ID NO: 3094830 - RNA, 19 nt, Molluscum contagiosum virus
uuguagcgguugaccagcu

SEQ ID NO: 3094831 - RNA, 21 nt, Molluscum contagiosum virus
cgugcucgcgagcguuucugc

SEQ ID NO: 3094832 - RNA, 12 nt, Molluscum contagiosum virus
ucacgcaagcuu

SEQ ID NO: 3094833 - RNA, 18 nt, Molluscum contagiosum virus
guggcgccgaugcagugc

SEQ ID NO: 3094834 - RNA, 18 nt, Molluscum contagiosum virus
cagaggcgcguccgcggc

SEQ ID NO: 3094835 - RNA, 18 nt, Molluscum contagiosum virus
ucacggcuguggacauga

SEQ ID NO: 3094836 - RNA, 23 nt, Molluscum contagiosum virus
ccaaugcuuucccguuagagaca

SEQ ID NO: 3094837 - RNA, 23 nt, Molluscum contagiosum virus
cuaccugcgcaagcucagccucu

SEQ ID NO: 3094838 - RNA, 17 nt, Molluscum contagiosum virus
cgcgggccuuugccgcu

SEQ ID NO: 3094839 - RNA, 21 nt, Molluscum contagiosum virus
ucccgcugagcgcagcacacu

SEQ ID NO: 3094840 - RNA, 17 nt, Molluscum contagiosum virus
cgagggcgggcacgugc

SEQ ID NO: 3094841 - RNA, 15 nt, Molluscum contagiosum virus
cugcgcuccaugcug

SEQ ID NO: 3094842 - RNA, 16 nt, Molluscum contagiosum virus
ccggcagcuggagcug

SEQ ID NO: 3094843 - RNA, 15 nt, Molluscum contagiosum virus
uccuuucgacgcugc

SEQ ID NO: 3094844 - RNA, 22 nt, Molluscum contagiosum virus
agcaccucaacuguugccugga

SEQ ID NO: 3094845 - RNA, 23 nt, Molluscum contagiosum virus
agcgcuucuagcucgcgcgcggc

SEQ ID NO: 3094846 - RNA, 22 nt, Molluscum contagiosum virus
cagagaccgucaaccugcugcc

SEQ ID NO: 3094847 - RNA, 20 nt, Molluscum contagiosum virus
uccgccucgagcacgccucc

SEQ ID NO: 3094848 - RNA, 19 nt, Molluscum contagiosum virus
acaggcgcgcaagugcgug

SEQ ID NO: 3094849 - RNA, 14 nt, Molluscum contagiosum virus
ccacucuccuucag

SEQ ID NO: 3094850 - RNA, 13 nt, Molluscum contagiosum virus
cgcggcgagccgc

SEQ ID NO: 3094851 - RNA, 20 nt, Molluscum contagiosum virus
ugucaucaccccgcugggcc

SEQ ID NO: 3094852 - RNA, 15 nt, Molluscum contagiosum virus
gcuggccucugccug

SEQ ID NO: 3094853 - RNA, 20 nt, Molluscum contagiosum virus
gacgcgcguggagcgcgcgg

SEQ ID NO: 3094854 - RNA, 13 nt, Molluscum contagiosum virus
augucgagcccug

SEQ ID NO: 3094855 - RNA, 17 nt, Molluscum contagiosum virus
caccaccuccagguccc

SEQ ID NO: 3094856 - RNA, 19 nt, Molluscum contagiosum virus
guacgagcagcugcugcgc

SEQ ID NO: 3094857 - RNA, 17 nt, Molluscum contagiosum virus
cgugccuggcagugccg

SEQ ID NO: 3094858 - RNA, 13 nt, Molluscum contagiosum virus
cccgcaagccaca

SEQ ID NO: 3094859 - RNA, 14 nt, Molluscum contagiosum virus
gcucgccuuucccc

SEQ ID NO: 3094860 - RNA, 13 nt, Molluscum contagiosum virus
gcucgugcuggag

SEQ ID NO: 3094861 - RNA, 20 nt, Molluscum contagiosum virus
ggcgaacaucucggcuccgc

SEQ ID NO: 3094862 - RNA, 22 nt, Molluscum contagiosum virus
aggugcagaaccugcgggugga

SEQ ID NO: 3094863 - RNA, 21 nt, Molluscum contagiosum virus
ccgcgaggacccgcgcuuugu

SEQ ID NO: 3094864 - RNA, 22 nt, Molluscum contagiosum virus
ucuucguggcgcugggcgcgcc

SEQ ID NO: 3094865 - RNA, 11 nt, Molluscum contagiosum virus
cugcaccacca

SEQ ID NO: 3094866 - RNA, 14 nt, Molluscum contagiosum virus
gcgcccaggaacag

SEQ ID NO: 3094867 - RNA, 14 nt, Molluscum contagiosum virus
ucgcaacaaaagag

SEQ ID NO: 3094868 - RNA, 18 nt, Molluscum contagiosum virus
guaccaguaccugcugcc

SEQ ID NO: 3094869 - RNA, 14 nt, Molluscum contagiosum virus
acgacucgcugcca

SEQ ID NO: 3094870 - RNA, 22 nt, Molluscum contagiosum virus
ccacgccaagcgcuugcucuuc

SEQ ID NO: 3094871 - RNA, 17 nt, Molluscum contagiosum virus
agcgauguuuugaugag

SEQ ID NO: 3094872 - RNA, 20 nt, Molluscum contagiosum virus
aaagcgaaguuugccagcgu

SEQ ID NO: 3094873 - RNA, 17 nt, Molluscum contagiosum virus
cgccggacagcucagca

SEQ ID NO: 3094874 - RNA, 19 nt, Molluscum contagiosum virus
gaugguggcgcugcugccc

SEQ ID NO: 3094875 - RNA, 16 nt, Molluscum contagiosum virus
caggaccugcuggugg

SEQ ID NO: 3094876 - RNA, 20 nt, Molluscum contagiosum virus
cccggcgcgcgcggcgcgcc

SEQ ID NO: 3094877 - RNA, 16 nt, Molluscum contagiosum virus
accacgagcacugccu

SEQ ID NO: 3094878 - RNA, 19 nt, Molluscum contagiosum virus
gcgcggggcacugcgcacg

SEQ ID NO: 3094879 - RNA, 16 nt, Molluscum contagiosum virus
acuaagcuaaaagagc

SEQ ID NO: 3094880 - RNA, 19 nt, Molluscum contagiosum virus
acucgcguccgcgcagcuc

SEQ ID NO: 3094881 - RNA, 14 nt, Molluscum contagiosum virus
ccgcugagcgcagc

SEQ ID NO: 3094882 - RNA, 22 nt, Molluscum contagiosum virus
ccaacacguuuucuuucauggc

SEQ ID NO: 3094883 - RNA, 18 nt, Molluscum contagiosum virus
cgcaaagucaucugccuc

SEQ ID NO: 3094884 - RNA, 23 nt, Molluscum contagiosum virus
acguggucgcgcgcgcucugccg

SEQ ID NO: 3094885 - RNA, 21 nt, Molluscum contagiosum virus
gagcacgagcauuccgagccg

SEQ ID NO: 3094886 - RNA, 14 nt, Molluscum contagiosum virus
ucccggcggcaagc

SEQ ID NO: 3094887 - RNA, 19 nt, Molluscum contagiosum virus
gagugcuggccgagcguga

SEQ ID NO: 3094888 - RNA, 16 nt, Molluscum contagiosum virus
acagcgcgcgugccgc

SEQ ID NO: 3094889 - RNA, 12 nt, Molluscum contagiosum virus
gcucagcgcuuc

SEQ ID NO: 3094890 - RNA, 14 nt, Molluscum contagiosum virus
ccaguacuucaucu

SEQ ID NO: 3094891 - RNA, 15 nt, Molluscum contagiosum virus
ccaggaacaguaccg

SEQ ID NO: 3094892 - RNA, 20 nt, Molluscum contagiosum virus
gcgcucgcucgcgcgcagcu

SEQ ID NO: 3094893 - RNA, 16 nt, Molluscum contagiosum virus
cagcaggccucuuuug

SEQ ID NO: 3094894 - RNA, 16 nt, Molluscum contagiosum virus
gcaagugcacaccaga

SEQ ID NO: 3094895 - RNA, 12 nt, Molluscum contagiosum virus
acagccgcgcgg

SEQ ID NO: 3094896 - RNA, 14 nt, Molluscum contagiosum virus
agagggcagaacag

SEQ ID NO: 3094897 - RNA, 21 nt, Molluscum contagiosum virus
ugugacacgagccgugugcuc

SEQ ID NO: 3094898 - RNA, 17 nt, Molluscum contagiosum virus
cgcugcgcggagcucgc

SEQ ID NO: 3094899 - RNA, 18 nt, Molluscum contagiosum virus
acgccagcagcagaggag

SEQ ID NO: 3094900 - RNA, 23 nt, Molluscum contagiosum virus
cagaaggcguaugcgccaagccu

SEQ ID NO: 3094901 - RNA, 22 nt, Molluscum contagiosum virus
cgccucugggcgucgcacaguu

SEQ ID NO: 3094902 - RNA, 20 nt, Molluscum contagiosum virus
gugacggccguguacaugcu

SEQ ID NO: 3094903 - RNA, 18 nt, Molluscum contagiosum virus
cggaagcucacaucuguc

SEQ ID NO: 3094904 - RNA, 18 nt, Molluscum contagiosum virus
gugcccaguuauucucug

SEQ ID NO: 3094905 - RNA, 22 nt, Molluscum contagiosum virus
cgcgaacgagaaaugcgcacac

SEQ ID NO: 3094906 - RNA, 16 nt, Molluscum contagiosum virus
ugcccggacagagccc

SEQ ID NO: 3094907 - RNA, 14 nt, Molluscum contagiosum virus
gccgcgcugcuggc

SEQ ID NO: 3094908 - RNA, 15 nt, Molluscum contagiosum virus
gccgcuugagcagca

SEQ ID NO: 3094909 - RNA, 14 nt, Molluscum contagiosum virus
gcggcaagccuggc

SEQ ID NO: 3094910 - RNA, 14 nt, Molluscum contagiosum virus
gcgacgacagcgac

SEQ ID NO: 3094911 - RNA, 17 nt, Molluscum contagiosum virus
gagcaauggcggccugc

SEQ ID NO: 3094912 - RNA, 19 nt, Molluscum contagiosum virus
cacaaagagcacggacagc

SEQ ID NO: 3094913 - RNA, 17 nt, Molluscum contagiosum virus
ggcacccaccaggaacg

SEQ ID NO: 3094914 - RNA, 23 nt, Molluscum contagiosum virus
gagcgcgucugcucucggcggcc

SEQ ID NO: 3094915 - RNA, 13 nt, Molluscum contagiosum virus
ccccgagcagcgg

SEQ ID NO: 3094916 - RNA, 21 nt, Molluscum contagiosum virus
cgcgugcugcgcggcgccgca

SEQ ID NO: 3094917 - RNA, 17 nt, Molluscum contagiosum virus
acgugcgcgagcucgag

SEQ ID NO: 3094918 - RNA, 12 nt, Molluscum contagiosum virus
gugcccugucca

SEQ ID NO: 3094919 - RNA, 23 nt, Molluscum contagiosum virus
aaaggcacccgcaacaaggaaag

SEQ ID NO: 3094920 - RNA, 17 nt, Molluscum contagiosum virus
gcgcaagucaccgcucc

SEQ ID NO: 3094921 - RNA, 21 nt, Molluscum contagiosum virus
cgcgcugagcgcggagcuggc

SEQ ID NO: 3094922 - RNA, 17 nt, Molluscum contagiosum virus
cugcggacgcgggccgc

SEQ ID NO: 3094923 - RNA, 18 nt, Molluscum contagiosum virus
ugcacgagccggcgccgu

SEQ ID NO: 3094924 - RNA, 20 nt, Molluscum contagiosum virus
accgcagacaaagacagucc

SEQ ID NO: 3094925 - RNA, 13 nt, Molluscum contagiosum virus
ucgucaacaacac

SEQ ID NO: 3094926 - RNA, 24 nt, Molluscum contagiosum virus
aggcgcugguggaggagccgugga

SEQ ID NO: 3094927 - RNA, 23 nt, Molluscum contagiosum virus
gcuuucagagugacgcugcaaga

SEQ ID NO: 3094928 - RNA, 19 nt, Molluscum contagiosum virus
cggccuguucuuccagugg

SEQ ID NO: 3094929 - RNA, 15 nt, Molluscum contagiosum virus
ggcuggacugugcuu

SEQ ID NO: 3094930 - RNA, 18 nt, Molluscum contagiosum virus
caacgcgacgauggccac

SEQ ID NO: 3094931 - RNA, 14 nt, Molluscum contagiosum virus
gcaugcacagcugc

SEQ ID NO: 3094932 - RNA, 14 nt, Molluscum contagiosum virus
gcuagcgugugccg

SEQ ID NO: 3094933 - RNA, 22 nt, Molluscum contagiosum virus
gcgcgcccaccagcagccaggc

SEQ ID NO: 3094934 - RNA, 23 nt, Molluscum contagiosum virus
gagcugcugcgcgaguaccuggg

SEQ ID NO: 3094935 - RNA, 16 nt, Molluscum contagiosum virus
cagcgugguguucgcc

SEQ ID NO: 3094936 - RNA, 17 nt, Molluscum contagiosum virus
cagcaccugcaguucca

SEQ ID NO: 3094937 - RNA, 12 nt, Molluscum contagiosum virus
ccggcucugccu

SEQ ID NO: 3094938 - RNA, 22 nt, Molluscum contagiosum virus
ggccauggagcgcccgcugcuc

SEQ ID NO: 3094939 - RNA, 14 nt, Molluscum contagiosum virus
uguugucucucgag

SEQ ID NO: 3094940 - RNA, 18 nt, Molluscum contagiosum virus
cucgguagcguggagcug

SEQ ID NO: 3094941 - RNA, 23 nt, Molluscum contagiosum virus
aucccacguacgagcagcugcug

SEQ ID NO: 3094942 - RNA, 18 nt, Molluscum contagiosum virus
ccgcgugcgugcacagcg

SEQ ID NO: 3094943 - RNA, 16 nt, Molluscum contagiosum virus
cgccgcacgugcugcg

SEQ ID NO: 3094944 - RNA, 21 nt, Molluscum contagiosum virus
ucaaauccugguuccucuccu

SEQ ID NO: 3094945 - RNA, 16 nt, Molluscum contagiosum virus
aguuccuggugugcca

SEQ ID NO: 3094946 - RNA, 21 nt, Molluscum contagiosum virus
ggcagcgcgauugcuggaggu

SEQ ID NO: 3094947 - RNA, 11 nt, Molluscum contagiosum virus
cguugucuuua

SEQ ID NO: 3094948 - RNA, 15 nt, Molluscum contagiosum virus
ccgcuuccuggcacu

SEQ ID NO: 3094949 - RNA, 17 nt, Molluscum contagiosum virus
gaaaggcaccccgcagg

SEQ ID NO: 3094950 - RNA, 16 nt, Molluscum contagiosum virus
gcugcgccacugccac

SEQ ID NO: 3094951 - RNA, 21 nt, Molluscum contagiosum virus
cauguugcucuaccuggugcu

SEQ ID NO: 3094952 - RNA, 18 nt, Molluscum contagiosum virus
cgagaaaugcgcacacuu

SEQ ID NO: 3094953 - RNA, 12 nt, Molluscum contagiosum virus
cgcgcaagugug

SEQ ID NO: 3094954 - RNA, 12 nt, Molluscum contagiosum virus
caacagcagcug

SEQ ID NO: 3094955 - RNA, 17 nt, Molluscum contagiosum virus
gccgguacucgugcguc

SEQ ID NO: 3094956 - RNA, 22 nt, Molluscum contagiosum virus
gcuggagaaagaagugugccug

SEQ ID NO: 3094957 - RNA, 15 nt, Molluscum contagiosum virus
agcgcgugcucuuuc

SEQ ID NO: 3094958 - RNA, 17 nt, Molluscum contagiosum virus
cuucgcgcccgacgagc

SEQ ID NO: 3094959 - RNA, 16 nt, Molluscum contagiosum virus
acgcugcggcggcgca

SEQ ID NO: 3094960 - RNA, 16 nt, Molluscum contagiosum virus
cucaagcaccugcgcu

SEQ ID NO: 3094961 - RNA, 15 nt, Molluscum contagiosum virus
gacagcgcgcgcacg

SEQ ID NO: 3094962 - RNA, 21 nt, Molluscum contagiosum virus
ggcgugugcgcgagcugaggc

SEQ ID NO: 3094963 - RNA, 12 nt, Molluscum contagiosum virus
gagacucuggaa

SEQ ID NO: 3094964 - RNA, 21 nt, Molluscum contagiosum virus
cauccacauuacgcucgugga

SEQ ID NO: 3094965 - RNA, 20 nt, Molluscum contagiosum virus
cgucuuuuugcggcgccgcc

SEQ ID NO: 3094966 - RNA, 20 nt, Molluscum contagiosum virus
cgacugcgccuucugccugc

SEQ ID NO: 3094967 - RNA, 19 nt, Molluscum contagiosum virus
gccgcggucguguacacgc

SEQ ID NO: 3094968 - RNA, 18 nt, Molluscum contagiosum virus
caccuuucauucgcuggu

SEQ ID NO: 3094969 - RNA, 21 nt, Molluscum contagiosum virus
gcgcaagcagcucggcgagag

SEQ ID NO: 3094970 - RNA, 16 nt, Molluscum contagiosum virus
cguccagccgcagccg

SEQ ID NO: 3094971 - RNA, 19 nt, Molluscum contagiosum virus
gcacaugugcgugcaccuc

SEQ ID NO: 3094972 - RNA, 22 nt, Molluscum contagiosum virus
ccacgcuguacaugccgcagua

SEQ ID NO: 3094973 - RNA, 21 nt, Molluscum contagiosum virus
ccucgcucgagggcgccgugc

SEQ ID NO: 3094974 - RNA, 20 nt, Molluscum contagiosum virus
acgccgugacggcccaccuu

SEQ ID NO: 3094975 - RNA, 12 nt, Molluscum contagiosum virus
ccaccagcacca

SEQ ID NO: 3094976 - RNA, 22 nt, Molluscum contagiosum virus
ccagagucgccgcugcgcaucu

SEQ ID NO: 3094977 - RNA, 16 nt, Molluscum contagiosum virus
uccaagaagaggccag

SEQ ID NO: 3094978 - RNA, 18 nt, Molluscum contagiosum virus
cgccugcuagcggccugu

SEQ ID NO: 3094979 - RNA, 13 nt, Molluscum contagiosum virus
ucgcgggcacgag

SEQ ID NO: 3094980 - RNA, 20 nt, Molluscum contagiosum virus
ccgcugcgcuucgagcugcc

SEQ ID NO: 3094981 - RNA, 17 nt, Molluscum contagiosum virus
gcuuggugcgcucgagc

SEQ ID NO: 3094982 - RNA, 14 nt, Molluscum contagiosum virus
gccgcgugcuggcg

SEQ ID NO: 3094983 - RNA, 16 nt, Molluscum contagiosum virus
ggaacccagaaagaag

SEQ ID NO: 3094984 - RNA, 17 nt, Molluscum contagiosum virus
aggccgcgcccaagaag

SEQ ID NO: 3094985 - RNA, 15 nt, Molluscum contagiosum virus
ggagacguagagcag

SEQ ID NO: 3094986 - RNA, 14 nt, Molluscum contagiosum virus
gcggcgcggcugcu

SEQ ID NO: 3094987 - RNA, 21 nt, Molluscum contagiosum virus
gccacgcagcuggcgggcgug

SEQ ID NO: 3094988 - RNA, 20 nt, Molluscum contagiosum virus
gucuggcucguacugcugca

SEQ ID NO: 3094989 - RNA, 19 nt, Molluscum contagiosum virus
cucgcaggcggugggcgcc

SEQ ID NO: 3094990 - RNA, 16 nt, Molluscum contagiosum virus
cagaugaggcugcucu

SEQ ID NO: 3094991 - RNA, 13 nt, Molluscum contagiosum virus
cugaaccugggcg

SEQ ID NO: 3094992 - RNA, 19 nt, Molluscum contagiosum virus
gccagcacgcgcucguccg

SEQ ID NO: 3094993 - RNA, 14 nt, Molluscum contagiosum virus
gcggacgaagcugu

SEQ ID NO: 3094994 - RNA, 13 nt, Molluscum contagiosum virus
agccugccgcgag

SEQ ID NO: 3094995 - RNA, 13 nt, Molluscum contagiosum virus
ucgcggugccgga

SEQ ID NO: 3094996 - RNA, 18 nt, Molluscum contagiosum virus
cagacgcagagccaugcc

SEQ ID NO: 3094997 - RNA, 15 nt, Molluscum contagiosum virus
cacugccacggcugc

SEQ ID NO: 3094998 - RNA, 18 nt, Molluscum contagiosum virus
gugcacauugcugcugca

SEQ ID NO: 3094999 - RNA, 18 nt, Molluscum contagiosum virus
accucuuucucgcgccgu

SEQ ID NO: 3095000 - RNA, 23 nt, Molluscum contagiosum virus
gcgcauucccguggaccucauca

SEQ ID NO: 3095001 - RNA, 19 nt, Molluscum contagiosum virus
cuugccgcuugagcagcaa

SEQ ID NO: 3095002 - RNA, 17 nt, Molluscum contagiosum virus
agcgacgagcagcugcu

SEQ ID NO: 3095003 - RNA, 19 nt, Molluscum contagiosum virus
cgggcccgugcucaggcca

SEQ ID NO: 3095004 - RNA, 13 nt, Molluscum contagiosum virus
cggcgcgcagcgc

SEQ ID NO: 3095005 - RNA, 15 nt, Molluscum contagiosum virus
cguaguccagcgcgu

SEQ ID NO: 3095006 - RNA, 21 nt, Molluscum contagiosum virus
ggcgcgccgcgggccgccggg

SEQ ID NO: 3095007 - RNA, 17 nt, Molluscum contagiosum virus
cggugcccgccaagagc

SEQ ID NO: 3095008 - RNA, 21 nt, Molluscum contagiosum virus
gcucuuggcguucgcagugcc

SEQ ID NO: 3095009 - RNA, 17 nt, Molluscum contagiosum virus
acgcuacagcagccgca

SEQ ID NO: 3095010 - RNA, 15 nt, Molluscum contagiosum virus
ugcccgcgcccugca

SEQ ID NO: 3095011 - RNA, 21 nt, Molluscum contagiosum virus
agagaacaacgaaaacugaaa

SEQ ID NO: 3095012 - RNA, 12 nt, Molluscum contagiosum virus
aggacuaccugg

SEQ ID NO: 3095013 - RNA, 15 nt, Molluscum contagiosum virus
cuggacgggcacgag

SEQ ID NO: 3095014 - RNA, 21 nt, Molluscum contagiosum virus
cgccaccucggcguuggccac

SEQ ID NO: 3095015 - RNA, 19 nt, Molluscum contagiosum virus
cgagcgcgcgcugcgcgcc

SEQ ID NO: 3095016 - RNA, 21 nt, Molluscum contagiosum virus
caagacgacacgagggccuug

SEQ ID NO: 3095017 - RNA, 17 nt, Molluscum contagiosum virus
uccccgcgggccgccgc

SEQ ID NO: 3095018 - RNA, 17 nt, Molluscum contagiosum virus
cugggcgucgugcaccu

SEQ ID NO: 3095019 - RNA, 18 nt, Molluscum contagiosum virus
agcugcaggaccugcugg

SEQ ID NO: 3095020 - RNA, 14 nt, Molluscum contagiosum virus
ugguacagaugagu

SEQ ID NO: 3095021 - RNA, 16 nt, Molluscum contagiosum virus
ugucaguggacaagcu

SEQ ID NO: 3095022 - RNA, 22 nt, Molluscum contagiosum virus
aagcuggcgggugccgugcccc

SEQ ID NO: 3095023 - RNA, 19 nt, Molluscum contagiosum virus
gcugcguucgagcugaucg

SEQ ID NO: 3095024 - RNA, 15 nt, Molluscum contagiosum virus
cgaauccuuuacugc

SEQ ID NO: 3095025 - RNA, 16 nt, Molluscum contagiosum virus
cccucgcaagcugagc

SEQ ID NO: 3095026 - RNA, 12 nt, Molluscum contagiosum virus
cagucagcggcg

SEQ ID NO: 3095027 - RNA, 16 nt, Molluscum contagiosum virus
accaguaccugcugcc

SEQ ID NO: 3095028 - RNA, 20 nt, Molluscum contagiosum virus
cgcgugcgccgccgcaggcc

SEQ ID NO: 3095029 - RNA, 15 nt, Molluscum contagiosum virus
ggugcacgugcugca

SEQ ID NO: 3095030 - RNA, 23 nt, Molluscum contagiosum virus
ggcuguagaagagcgguuccugc

SEQ ID NO: 3095031 - RNA, 14 nt, Molluscum contagiosum virus
gaacucgaggcucu

SEQ ID NO: 3095032 - RNA, 16 nt, Molluscum contagiosum virus
gcuggaugcugcucga

SEQ ID NO: 3095033 - RNA, 16 nt, Molluscum contagiosum virus
ggaauugugcugcugu

SEQ ID NO: 3095034 - RNA, 15 nt, Molluscum contagiosum virus
guuccuggugugcca

SEQ ID NO: 3095035 - RNA, 17 nt, Molluscum contagiosum virus
caggcgauaggacauga

SEQ ID NO: 3095036 - RNA, 17 nt, Molluscum contagiosum virus
gacguggugcucgugga

SEQ ID NO: 3095037 - RNA, 20 nt, Molluscum contagiosum virus
uucacgcugcacgagcugcu

SEQ ID NO: 3095038 - RNA, 19 nt, Molluscum contagiosum virus
cgcgcgagcgcuacaugca

SEQ ID NO: 3095039 - RNA, 18 nt, Molluscum contagiosum virus
gcgugcuuuuucugugcg

SEQ ID NO: 3095040 - RNA, 20 nt, Molluscum contagiosum virus
ggcagcaacugcacagggau

SEQ ID NO: 3095041 - RNA, 22 nt, Molluscum contagiosum virus
ggacgaagcugugcaagagcuc

SEQ ID NO: 3095042 - RNA, 20 nt, Molluscum contagiosum virus
gaugaguaccgcgggcgcag

SEQ ID NO: 3095043 - RNA, 21 nt, Molluscum contagiosum virus
cgcacaaccacagcucuccga

SEQ ID NO: 3095044 - RNA, 13 nt, Molluscum contagiosum virus
gccgcgcugcugg

SEQ ID NO: 3095045 - RNA, 21 nt, Molluscum contagiosum virus
gcgcaagugugcgcaucccuc

SEQ ID NO: 3095046 - RNA, 19 nt, Molluscum contagiosum virus
cgagagugacgccucgaga

SEQ ID NO: 3095047 - RNA, 16 nt, Molluscum contagiosum virus
ccgcgcuucugccugc

SEQ ID NO: 3095048 - RNA, 19 nt, Molluscum contagiosum virus
ccggagacaccagcuccgc

SEQ ID NO: 3095049 - RNA, 16 nt, Molluscum contagiosum virus
aggaaaggcaccccgc

SEQ ID NO: 3095050 - RNA, 21 nt, Molluscum contagiosum virus
uugaggaacuagugcugcugg

SEQ ID NO: 3095051 - RNA, 17 nt, Molluscum contagiosum virus
cguggcucgcgaccgca

SEQ ID NO: 3095052 - RNA, 15 nt, Molluscum contagiosum virus
uguccacgacacugg

SEQ ID NO: 3095053 - RNA, 20 nt, Molluscum contagiosum virus
acuccaaggucgagcugacu

SEQ ID NO: 3095054 - RNA, 21 nt, Molluscum contagiosum virus
cgcuggugggcgugcggcgca

SEQ ID NO: 3095055 - RNA, 14 nt, Molluscum contagiosum virus
cugcuggcccugcu

SEQ ID NO: 3095056 - RNA, 13 nt, Molluscum contagiosum virus
gguacagaugagu

SEQ ID NO: 3095057 - RNA, 16 nt, Molluscum contagiosum virus
uccccgccagcaccau

SEQ ID NO: 3095058 - RNA, 12 nt, Molluscum contagiosum virus
agcccuccugag

SEQ ID NO: 3095059 - RNA, 16 nt, Molluscum contagiosum virus
gcgugcuagcccgcac

SEQ ID NO: 3095060 - RNA, 21 nt, Molluscum contagiosum virus
cgccuccaagaagaggccagc

SEQ ID NO: 3095061 - RNA, 13 nt, Molluscum contagiosum virus
agaugcgcggaca

SEQ ID NO: 3095062 - RNA, 17 nt, Molluscum contagiosum virus
gugugcggagagccgcc

SEQ ID NO: 3095063 - RNA, 20 nt, Molluscum contagiosum virus
cagcgguggucuccgcgggc

SEQ ID NO: 3095064 - RNA, 19 nt, Molluscum contagiosum virus
ccgucaaccugcugccucc

SEQ ID NO: 3095065 - RNA, 15 nt, Molluscum contagiosum virus
cgcgcucgugccgcc

SEQ ID NO: 3095066 - RNA, 23 nt, Molluscum contagiosum virus
gagauggcugcucucggcagcgu

SEQ ID NO: 3095067 - RNA, 22 nt, Molluscum contagiosum virus
gacacucuucgcaggcgugcuc

SEQ ID NO: 3095068 - RNA, 21 nt, Molluscum contagiosum virus
cgcguccacaaaggcgggccc

SEQ ID NO: 3095069 - RNA, 18 nt, Molluscum contagiosum virus
ucggagcgcagcugccgg

SEQ ID NO: 3095070 - RNA, 22 nt, Molluscum contagiosum virus
ccagcgugcagacgaccgucac

SEQ ID NO: 3095071 - RNA, 19 nt, Molluscum contagiosum virus
cagccugcucacgcccgag

SEQ ID NO: 3095072 - RNA, 13 nt, Molluscum contagiosum virus
uggugggcacgca

SEQ ID NO: 3095073 - RNA, 19 nt, Molluscum contagiosum virus
cgcggcgagucgcgggcgc

SEQ ID NO: 3095074 - RNA, 15 nt, Molluscum contagiosum virus
gcgcgcgccagcagc

SEQ ID NO: 3095075 - RNA, 15 nt, Molluscum contagiosum virus
ccuccugaugcccgc

SEQ ID NO: 3095076 - RNA, 22 nt, Molluscum contagiosum virus
ccaguccgcggcgcgccggcca

SEQ ID NO: 3095077 - RNA, 17 nt, Molluscum contagiosum virus
gcccgagcccgagcccg

SEQ ID NO: 3095078 - RNA, 18 nt, Molluscum contagiosum virus
cagcgccagccugcuggc

SEQ ID NO: 3095079 - RNA, 18 nt, Molluscum contagiosum virus
gauuacaucgaaaccauc

SEQ ID NO: 3095080 - RNA, 21 nt, Molluscum contagiosum virus
cccgcgaaggagagagagaca

SEQ ID NO: 3095081 - RNA, 19 nt, Molluscum contagiosum virus
aggccccccgcaacaagga

SEQ ID NO: 3095082 - RNA, 19 nt, Molluscum contagiosum virus
gaccuuggugcucauccuc

SEQ ID NO: 3095083 - RNA, 20 nt, Molluscum contagiosum virus
uccuucuucaaguaccuguc

SEQ ID NO: 3095084 - RNA, 14 nt, Molluscum contagiosum virus
ucggaagagcgucc

SEQ ID NO: 3095085 - RNA, 17 nt, Molluscum contagiosum virus
gcgcugagcgcggagcu

SEQ ID NO: 3095086 - RNA, 16 nt, Molluscum contagiosum virus
ccgacgccgccaaugc

SEQ ID NO: 3095087 - RNA, 14 nt, Molluscum contagiosum virus
gcgcccccgcuugc

SEQ ID NO: 3095088 - RNA, 16 nt, Molluscum contagiosum virus
ugccgcugagagacuu

SEQ ID NO: 3095089 - RNA, 15 nt, Molluscum contagiosum virus
gcggaagacgcgagc

SEQ ID NO: 3095090 - RNA, 14 nt, Molluscum contagiosum virus
accagguagagcaa

SEQ ID NO: 3095091 - RNA, 23 nt, Molluscum contagiosum virus
cucgcugccuggugcacacacac

SEQ ID NO: 3095092 - RNA, 17 nt, Molluscum contagiosum virus
ccuucgcguccacgggu

SEQ ID NO: 3095093 - RNA, 17 nt, Molluscum contagiosum virus
cacgguccugggcgacg

SEQ ID NO: 3095094 - RNA, 20 nt, Molluscum contagiosum virus
gccaacacuaccacagccau

SEQ ID NO: 3095095 - RNA, 17 nt, Molluscum contagiosum virus
gauggaaggcgaccagc

SEQ ID NO: 3095096 - RNA, 14 nt, Molluscum contagiosum virus
gcaaggaagcaaca

SEQ ID NO: 3095097 - RNA, 16 nt, Molluscum contagiosum virus
gcaaugcgcaaggccg

SEQ ID NO: 3095098 - RNA, 21 nt, Molluscum contagiosum virus
cugcgcccgcaaaccuuggcc

SEQ ID NO: 3095099 - RNA, 20 nt, Molluscum contagiosum virus
cgugcgcgugcggcggcgcg

SEQ ID NO: 3095100 - RNA, 22 nt, Molluscum contagiosum virus
ggcaacugccugcgcuagugaa

SEQ ID NO: 3095101 - RNA, 13 nt, Molluscum contagiosum virus
gcggcgugcaggg

SEQ ID NO: 3095102 - RNA, 20 nt, Molluscum contagiosum virus
ggcaccguaccgcgcccgcc

SEQ ID NO: 3095103 - RNA, 21 nt, Molluscum contagiosum virus
uggaccacaagcaguaccugc

SEQ ID NO: 3095104 - RNA, 15 nt, Molluscum contagiosum virus
agagcccgccgggca

SEQ ID NO: 3095105 - RNA, 13 nt, Molluscum contagiosum virus
aggcacaccccgg

SEQ ID NO: 3095106 - RNA, 14 nt, Molluscum contagiosum virus
cgcgccgcgcugcu

SEQ ID NO: 3095107 - RNA, 18 nt, Molluscum contagiosum virus
cggcgcgcagcucgccgc

SEQ ID NO: 3095108 - RNA, 13 nt, Molluscum contagiosum virus
ccgucugcugcuc

SEQ ID NO: 3095109 - RNA, 19 nt, Molluscum contagiosum virus
ucuuccggcccgacacacu

SEQ ID NO: 3095110 - RNA, 17 nt, Molluscum contagiosum virus
gccggcucaagcuggca

SEQ ID NO: 3095111 - RNA, 19 nt, Molluscum contagiosum virus
gcggcgacuugcugcggag

SEQ ID NO: 3095112 - RNA, 12 nt, Molluscum contagiosum virus
cgccaacuccuu

SEQ ID NO: 3095113 - RNA, 20 nt, Molluscum contagiosum virus
gcgggcccgcgaacgagaga

SEQ ID NO: 3095114 - RNA, 17 nt, Molluscum contagiosum virus
gcguggagcgcgcggac

SEQ ID NO: 3095115 - RNA, 17 nt, Molluscum contagiosum virus
ccacugugccagcagca

SEQ ID NO: 3095116 - RNA, 14 nt, Molluscum contagiosum virus
cggcguggccaggc

SEQ ID NO: 3095117 - RNA, 21 nt, Molluscum contagiosum virus
cgcgcaaaagcacagcaggag

SEQ ID NO: 3095118 - RNA, 12 nt, Molluscum contagiosum virus
cgcgggcgcaga

SEQ ID NO: 3095119 - RNA, 22 nt, Molluscum contagiosum virus
ggaagcuggcgcgguccagccg

SEQ ID NO: 3095120 - RNA, 21 nt, Molluscum contagiosum virus
gugcgagaacuggcgcagcag

SEQ ID NO: 3095121 - RNA, 12 nt, Molluscum contagiosum virus
agacgcugcugc

SEQ ID NO: 3095122 - RNA, 16 nt, Molluscum contagiosum virus
ccucacggcgagcgcg

SEQ ID NO: 3095123 - RNA, 19 nt, Molluscum contagiosum virus
cuaccugguggagcacuuc

SEQ ID NO: 3095124 - RNA, 23 nt, Molluscum contagiosum virus
ucgcuugccggcggcgcaagcac

SEQ ID NO: 3095125 - RNA, 22 nt, Molluscum contagiosum virus
cgcgcauggggaacagcuuggc

SEQ ID NO: 3095126 - RNA, 21 nt, Molluscum contagiosum virus
gacucagcauguugcucuacc

SEQ ID NO: 3095127 - RNA, 18 nt, Molluscum contagiosum virus
gcuacgucgcggcgcacg

SEQ ID NO: 3095128 - RNA, 18 nt, Molluscum contagiosum virus
gaacguuauccccuccaa

SEQ ID NO: 3095129 - RNA, 17 nt, Molluscum contagiosum virus
cagcagugccagcagcc

SEQ ID NO: 3095130 - RNA, 17 nt, Molluscum contagiosum virus
gaaaacguagacagugc

SEQ ID NO: 3095131 - RNA, 17 nt, Molluscum contagiosum virus
gaagcugugcaagagcu

SEQ ID NO: 3095132 - RNA, 20 nt, Molluscum contagiosum virus
cuuuuuccugaacaagcugc

SEQ ID NO: 3095133 - RNA, 13 nt, Molluscum contagiosum virus
agcaggcgcaggc

SEQ ID NO: 3095134 - RNA, 19 nt, Molluscum contagiosum virus
gcacgcugagcaagcucaa

SEQ ID NO: 3095135 - RNA, 15 nt, Molluscum contagiosum virus
cacgaccgcaagugc

SEQ ID NO: 3095136 - RNA, 18 nt, Molluscum contagiosum virus
ugagcuagugccgagcuc

SEQ ID NO: 3095137 - RNA, 18 nt, Molluscum contagiosum virus
ugcagauuggaggaggaa

SEQ ID NO: 3095138 - RNA, 13 nt, Molluscum contagiosum virus
ggcgcgccgcacg

SEQ ID NO: 3095139 - RNA, 17 nt, Molluscum contagiosum virus
gcccgcgcccgcgccgc

SEQ ID NO: 3095140 - RNA, 22 nt, Molluscum contagiosum virus
cccgcgcaagagccgccggggc

SEQ ID NO: 3095141 - RNA, 13 nt, Molluscum contagiosum virus
cgcaaaucuguuc

SEQ ID NO: 3095142 - RNA, 15 nt, Molluscum contagiosum virus
gcgcgagcccaccga

SEQ ID NO: 3095143 - RNA, 16 nt, Molluscum contagiosum virus
aagugugcgcaucccu

SEQ ID NO: 3095144 - RNA, 16 nt, Molluscum contagiosum virus
agcucacggcugugga

SEQ ID NO: 3095145 - RNA, 22 nt, Molluscum contagiosum virus
ccacgugcuccgugugccaguc

SEQ ID NO: 3095146 - RNA, 19 nt, Molluscum contagiosum virus
ccagcgugcccuucuccga

SEQ ID NO: 3095147 - RNA, 21 nt, Molluscum contagiosum virus
accccgaaaggcacccgcagg

SEQ ID NO: 3095148 - RNA, 15 nt, Molluscum contagiosum virus
ccugcgcgagcaguu

SEQ ID NO: 3095149 - RNA, 14 nt, Molluscum contagiosum virus
cacgagcugcugcc

SEQ ID NO: 3095150 - RNA, 11 nt, Molluscum contagiosum virus
ccgaaggaaag

SEQ ID NO: 3095151 - RNA, 23 nt, Molluscum contagiosum virus
cucguucgcgggaccgcccuugu

SEQ ID NO: 3095152 - RNA, 23 nt, Molluscum contagiosum virus
acuguugccuggagggcagugcc

SEQ ID NO: 3095153 - RNA, 13 nt, Molluscum contagiosum virus
acgcgcacacgcu

SEQ ID NO: 3095154 - RNA, 13 nt, Molluscum contagiosum virus
cguccacaaaggc

SEQ ID NO: 3095155 - RNA, 14 nt, Molluscum contagiosum virus
acgcuacagcagcc

SEQ ID NO: 3095156 - RNA, 23 nt, Molluscum contagiosum virus
gccagugcuuugucgcaaccccg

SEQ ID NO: 3095157 - RNA, 16 nt, Molluscum contagiosum virus
gccgccaugcugcgcg

SEQ ID NO: 3095158 - RNA, 22 nt, Molluscum contagiosum virus
agauucggaggcggagcugccc

SEQ ID NO: 3095159 - RNA, 14 nt, Molluscum contagiosum virus
cuucgaagaggucu

SEQ ID NO: 3095160 - RNA, 23 nt, Molluscum contagiosum virus
uaagcucugcguuuugcgcggca

SEQ ID NO: 3095161 - RNA, 22 nt, Molluscum contagiosum virus
cucugccaccaugcgcacagca

SEQ ID NO: 3095162 - RNA, 16 nt, Molluscum contagiosum virus
gcucgcgugccgcgga

SEQ ID NO: 3095163 - RNA, 14 nt, Molluscum contagiosum virus
acacgccgcuggag

SEQ ID NO: 3095164 - RNA, 14 nt, Molluscum contagiosum virus
gcgcgagcugcugc

SEQ ID NO: 3095165 - RNA, 21 nt, Molluscum contagiosum virus
acgugcuacuacuguaaggcg

SEQ ID NO: 3095166 - RNA, 17 nt, Molluscum contagiosum virus
ccauacgccuagccugc

SEQ ID NO: 3095167 - RNA, 13 nt, Molluscum contagiosum virus
ccgagcggggacg

SEQ ID NO: 3095168 - RNA, 14 nt, Molluscum contagiosum virus
cuuucuccaugucg

SEQ ID NO: 3095169 - RNA, 22 nt, Molluscum contagiosum virus
cgcgggcugggaaagggcugcu

SEQ ID NO: 3095170 - RNA, 21 nt, Molluscum contagiosum virus
agugccacguacuugcugguu

SEQ ID NO: 3095171 - RNA, 20 nt, Molluscum contagiosum virus
cgguggucuccgcgggcagc

SEQ ID NO: 3095172 - RNA, 16 nt, Molluscum contagiosum virus
augugcgagaacuggc

SEQ ID NO: 3095173 - RNA, 22 nt, Molluscum contagiosum virus
cuagcagacaacugcgucucaa

SEQ ID NO: 3095174 - RNA, 16 nt, Molluscum contagiosum virus
gccucugugcggcgcc

SEQ ID NO: 3095175 - RNA, 12 nt, Molluscum contagiosum virus
cugcgcaauaag

SEQ ID NO: 3095176 - RNA, 17 nt, Molluscum contagiosum virus
ggggccacaagcacgca

SEQ ID NO: 3095177 - RNA, 22 nt, Molluscum contagiosum virus
cgcgaaguuccugcauuucaug

SEQ ID NO: 3095178 - RNA, 15 nt, Molluscum contagiosum virus
cgcgccauggcgagc

SEQ ID NO: 3095179 - RNA, 13 nt, Molluscum contagiosum virus
aggccugcugaag

SEQ ID NO: 3095180 - RNA, 17 nt, Molluscum contagiosum virus
ccugucggcacaucucu

SEQ ID NO: 3095181 - RNA, 17 nt, Molluscum contagiosum virus
cgcgagaugcgcggaca

SEQ ID NO: 3095182 - RNA, 21 nt, Molluscum contagiosum virus
gcccgcggacaucgacgccaa

SEQ ID NO: 3095183 - RNA, 21 nt, Molluscum contagiosum virus
cuaccuggcggcgcuggagac

SEQ ID NO: 3095184 - RNA, 11 nt, Molluscum contagiosum virus
ccuggagccua

SEQ ID NO: 3095185 - RNA, 22 nt, Molluscum contagiosum virus
cgcauggccacgcccgggcccg

SEQ ID NO: 3095186 - RNA, 19 nt, Molluscum contagiosum virus
cggcuccaacagcagcugg

SEQ ID NO: 3095187 - RNA, 17 nt, Molluscum contagiosum virus
cucguggaaaagcaggg

SEQ ID NO: 3095188 - RNA, 13 nt, Molluscum contagiosum virus
gggcacuucucgc

SEQ ID NO: 3095189 - RNA, 13 nt, Molluscum contagiosum virus
gccucccccgcgc

SEQ ID NO: 3095190 - RNA, 17 nt, Molluscum contagiosum virus
gugccgccgcgcgcgcc

SEQ ID NO: 3095191 - RNA, 15 nt, Molluscum contagiosum virus
uggcaccggaagcaa

SEQ ID NO: 3095192 - RNA, 13 nt, Molluscum contagiosum virus
uggaugcugcucg

SEQ ID NO: 3095193 - RNA, 17 nt, Molluscum contagiosum virus
gcgcggaagaagcugcg

SEQ ID NO: 3095194 - RNA, 16 nt, Molluscum contagiosum virus
cgcgagcgcgcgcugc

SEQ ID NO: 3095195 - RNA, 12 nt, Molluscum contagiosum virus
ugcgcaaggccg

SEQ ID NO: 3095196 - RNA, 15 nt, Molluscum contagiosum virus
gcaccugcaggaaag

SEQ ID NO: 3095197 - RNA, 16 nt, Molluscum contagiosum virus
gcccaugcucgagccu

SEQ ID NO: 3095198 - RNA, 13 nt, Molluscum contagiosum virus
ugagagcaaagaa

SEQ ID NO: 3095199 - RNA, 15 nt, Molluscum contagiosum virus
caugcagcugcagga

SEQ ID NO: 3095200 - RNA, 22 nt, Molluscum contagiosum virus
gacccaucggagaagugcuccg

SEQ ID NO: 3095201 - RNA, 18 nt, Molluscum contagiosum virus
gccggcaucuucggcgug

SEQ ID NO: 3095202 - RNA, 16 nt, Molluscum contagiosum virus
ccccgacgccagcgcg

SEQ ID NO: 3095203 - RNA, 20 nt, Molluscum contagiosum virus
cucgaggaccucgcgcgccg

SEQ ID NO: 3095204 - RNA, 20 nt, Molluscum contagiosum virus
ugugcggcucgagacccaca

SEQ ID NO: 3095205 - RNA, 12 nt, Molluscum contagiosum virus
cggcacugcuag

SEQ ID NO: 3095206 - RNA, 24 nt, Molluscum contagiosum virus
cgcacggugugcuacugcacugca

SEQ ID NO: 3095207 - RNA, 19 nt, Molluscum contagiosum virus
guucugcgcugccagcucg

SEQ ID NO: 3095208 - RNA, 16 nt, Molluscum contagiosum virus
cggcagcaagcgcacc

SEQ ID NO: 3095209 - RNA, 21 nt, Molluscum contagiosum virus
uaccaagaacagagaaaggca

SEQ ID NO: 3095210 - RNA, 19 nt, Molluscum contagiosum virus
acgccgcgcaccuggagua

SEQ ID NO: 3095211 - RNA, 21 nt, Molluscum contagiosum virus
cuccgccgggaauaccggaga

SEQ ID NO: 3095212 - RNA, 22 nt, Molluscum contagiosum virus
acaggccgcuagcaggcgucgc

SEQ ID NO: 3095213 - RNA, 12 nt, Molluscum contagiosum virus
uggacugagccg

SEQ ID NO: 3095214 - RNA, 14 nt, Molluscum contagiosum virus
gagucgcgccucga

SEQ ID NO: 3095215 - RNA, 14 nt, Molluscum contagiosum virus
gcuggacggugcug

SEQ ID NO: 3095216 - RNA, 14 nt, Molluscum contagiosum virus
ggcacccaccagga

SEQ ID NO: 3095217 - RNA, 18 nt, Molluscum contagiosum virus
cugcccguggugggccgc

SEQ ID NO: 3095218 - RNA, 19 nt, Molluscum contagiosum virus
ccacuacaagcagccgcag

SEQ ID NO: 3095219 - RNA, 20 nt, Molluscum contagiosum virus
cgggguaccacagucggugc

SEQ ID NO: 3095220 - RNA, 19 nt, Molluscum contagiosum virus
uggacgugcugcuggcccu

SEQ ID NO: 3095221 - RNA, 20 nt, Molluscum contagiosum virus
gugccaucucgcacacugca

SEQ ID NO: 3095222 - RNA, 18 nt, Molluscum contagiosum virus
aggcgcggcagccgcaga

SEQ ID NO: 3095223 - RNA, 14 nt, Molluscum contagiosum virus
caaccagacgugcu

SEQ ID NO: 3095224 - RNA, 21 nt, Molluscum contagiosum virus
cgcggaggucgagcgcgccgc

SEQ ID NO: 3095225 - RNA, 16 nt, Molluscum contagiosum virus
gaggccggcacaagcc

SEQ ID NO: 3095226 - RNA, 11 nt, Molluscum contagiosum virus
ccagcggcgcc

SEQ ID NO: 3095227 - RNA, 20 nt, Molluscum contagiosum virus
cgucucggagaagaacagca

SEQ ID NO: 3095228 - RNA, 14 nt, Molluscum contagiosum virus
caccgggcgccgcg

SEQ ID NO: 3095229 - RNA, 20 nt, Molluscum contagiosum virus
ggcaccgcggcgggugccgc

SEQ ID NO: 3095230 - RNA, 23 nt, Molluscum contagiosum virus
gcacugcuacgagccgcuguccg

SEQ ID NO: 3095231 - RNA, 17 nt, Molluscum contagiosum virus
cuucccguuccugggca

SEQ ID NO: 3095232 - RNA, 20 nt, Molluscum contagiosum virus
cccgcaggaaaggcaccccg

SEQ ID NO: 3095233 - RNA, 21 nt, Molluscum contagiosum virus
uagagcaaaggaagagcccgc

SEQ ID NO: 3095234 - RNA, 14 nt, Molluscum contagiosum virus
cuggagcaagcgcg

SEQ ID NO: 3095235 - RNA, 14 nt, Molluscum contagiosum virus
uucgccggaggaag

SEQ ID NO: 3095236 - RNA, 19 nt, Molluscum contagiosum virus
agcggcauucgaaccugga

SEQ ID NO: 3095237 - RNA, 20 nt, Molluscum contagiosum virus
cacgcgcgagcggagcgggc

SEQ ID NO: 3095238 - RNA, 17 nt, Molluscum contagiosum virus
ugcgcgugucuggagcc

SEQ ID NO: 3095239 - RNA, 16 nt, Molluscum contagiosum virus
guggugacucgccgug

SEQ ID NO: 3095240 - RNA, 16 nt, Molluscum contagiosum virus
gcggugacuugccgug

SEQ ID NO: 3095241 - RNA, 10 nt, Molluscum contagiosum virus
cgcaccagug

SEQ ID NO: 3095242 - RNA, 12 nt, Molluscum contagiosum virus
agagcugcugcg

SEQ ID NO: 3095243 - RNA, 16 nt, Molluscum contagiosum virus
cgcgcgcuacgcgccg

SEQ ID NO: 3095244 - RNA, 13 nt, Molluscum contagiosum virus
agccccucgagca

SEQ ID NO: 3095245 - RNA, 14 nt, Molluscum contagiosum virus
gcgaggcgcgcacg

SEQ ID NO: 3095246 - RNA, 15 nt, Molluscum contagiosum virus
cagccccugcugcuc

SEQ ID NO: 3095247 - RNA, 14 nt, Molluscum contagiosum virus
guacgcggaggcgc

SEQ ID NO: 3095248 - RNA, 20 nt, Molluscum contagiosum virus
cggaaacgaacgcugcagcu

SEQ ID NO: 3095249 - RNA, 19 nt, Molluscum contagiosum virus
gacuucuugcgcggcggcc

SEQ ID NO: 3095250 - RNA, 22 nt, Molluscum contagiosum virus
augcgcccucacgugcugauca

SEQ ID NO: 3095251 - RNA, 19 nt, Molluscum contagiosum virus
acgcccuccucgaccugca

SEQ ID NO: 3095252 - RNA, 18 nt, Molluscum contagiosum virus
agacaugucguaccuggu

SEQ ID NO: 3095253 - RNA, 19 nt, Molluscum contagiosum virus
ggcgagcgccgcucgcacg

SEQ ID NO: 3095254 - RNA, 17 nt, Molluscum contagiosum virus
aguccgcgcccaaggcc

SEQ ID NO: 3095255 - RNA, 22 nt, Molluscum contagiosum virus
cacaagccguccgccucgagca

SEQ ID NO: 3095256 - RNA, 17 nt, Molluscum contagiosum virus
cgcugcacgagcugcug

SEQ ID NO: 3095257 - RNA, 15 nt, Molluscum contagiosum virus
acuuugucgcacgag

SEQ ID NO: 3095258 - RNA, 17 nt, Molluscum contagiosum virus
cccgaggcguccagcgg

SEQ ID NO: 3095259 - RNA, 18 nt, Molluscum contagiosum virus
gcgcagugcggccagcac

SEQ ID NO: 3095260 - RNA, 15 nt, Molluscum contagiosum virus
agcuucucgccagaa

SEQ ID NO: 3095261 - RNA, 15 nt, Molluscum contagiosum virus
gcuccaacagcagcu

SEQ ID NO: 3095262 - RNA, 14 nt, Molluscum contagiosum virus
gccgguggcgcgcg

SEQ ID NO: 3095263 - RNA, 20 nt, Molluscum contagiosum virus
gccuggagggcagugccaag

SEQ ID NO: 3095264 - RNA, 18 nt, Molluscum contagiosum virus
agugugccugcugcgcuu

SEQ ID NO: 3095265 - RNA, 16 nt, Molluscum contagiosum virus
cucacaugugcugccg

SEQ ID NO: 3095266 - RNA, 16 nt, Molluscum contagiosum virus
aacagcuuggcacagu

SEQ ID NO: 3095267 - RNA, 23 nt, Molluscum contagiosum virus
aggaguuggcgcgcaagcgcugc

SEQ ID NO: 3095268 - RNA, 14 nt, Molluscum contagiosum virus
acagagugccuggc

SEQ ID NO: 3095269 - RNA, 13 nt, Molluscum contagiosum virus
cucagcaggcugu

SEQ ID NO: 3095270 - RNA, 20 nt, Molluscum contagiosum virus
cccgcggcuaccacgggccc

SEQ ID NO: 3095271 - RNA, 22 nt, Molluscum contagiosum virus
ccgccgacgccuuccugcuggc

SEQ ID NO: 3095272 - RNA, 12 nt, Molluscum contagiosum virus
gcuggccaacac

SEQ ID NO: 3095273 - RNA, 16 nt, Molluscum contagiosum virus
ucaccuuccugggcgg

SEQ ID NO: 3095274 - RNA, 15 nt, Molluscum contagiosum virus
gcuuggcgggcagcg

SEQ ID NO: 3095275 - RNA, 19 nt, Molluscum contagiosum virus
gagagccgcuccuggucuu

SEQ ID NO: 3095276 - RNA, 17 nt, Molluscum contagiosum virus
caaguucgcugcuggca

SEQ ID NO: 3095277 - RNA, 18 nt, Molluscum contagiosum virus
caaaugcgucccagcagc

SEQ ID NO: 3095278 - RNA, 15 nt, Molluscum contagiosum virus
ggcgcaucagagaag

SEQ ID NO: 3095279 - RNA, 15 nt, Molluscum contagiosum virus
cagccaggcgccggc

SEQ ID NO: 3095280 - RNA, 15 nt, Molluscum contagiosum virus
gagauugagcucuuu

SEQ ID NO: 3095281 - RNA, 19 nt, Molluscum contagiosum virus
ucgcgggcguggggagcug

SEQ ID NO: 3095282 - RNA, 16 nt, Molluscum contagiosum virus
auugcguguuggcuuc

SEQ ID NO: 3095283 - RNA, 21 nt, Molluscum contagiosum virus
caggaacgaggaaaggcacac

SEQ ID NO: 3095284 - RNA, 19 nt, Molluscum contagiosum virus
gcgggccaggcacuggccc

SEQ ID NO: 3095285 - RNA, 19 nt, Molluscum contagiosum virus
ccgcuguacgugcugcccg

SEQ ID NO: 3095286 - RNA, 15 nt, Molluscum contagiosum virus
cuccuagcccagcac

SEQ ID NO: 3095287 - RNA, 22 nt, Molluscum contagiosum virus
gucggcgauguacgcgugcagg

SEQ ID NO: 3095288 - RNA, 13 nt, Molluscum contagiosum virus
accagcagccagg

SEQ ID NO: 3095289 - RNA, 18 nt, Molluscum contagiosum virus
cucacggcggcgcucaac

SEQ ID NO: 3095290 - RNA, 16 nt, Molluscum contagiosum virus
gcuacaccgagaucau

SEQ ID NO: 3095291 - RNA, 22 nt, Molluscum contagiosum virus
cugcugguggugcuggagcggc

SEQ ID NO: 3095292 - RNA, 11 nt, Molluscum contagiosum virus
gaagcugucaa

SEQ ID NO: 3095293 - RNA, 15 nt, Molluscum contagiosum virus
gcgcgagugugcgug

SEQ ID NO: 3095294 - RNA, 23 nt, Molluscum contagiosum virus
cacuaccgcaaccagcugcuguc

SEQ ID NO: 3095295 - RNA, 18 nt, Molluscum contagiosum virus
gggcacgcccgcgguguc

SEQ ID NO: 3095296 - RNA, 15 nt, Molluscum contagiosum virus
cugcugguucugcuc

SEQ ID NO: 3095297 - RNA, 18 nt, Molluscum contagiosum virus
cuuggacagcaagcagcg

SEQ ID NO: 3095298 - RNA, 21 nt, Molluscum contagiosum virus
aagagaccuggagguacuguc

SEQ ID NO: 3095299 - RNA, 21 nt, Molluscum contagiosum virus
auccgcgcgcucucacgcuuc

SEQ ID NO: 3095300 - RNA, 13 nt, Molluscum contagiosum virus
gacggcgcgcagc

SEQ ID NO: 3095301 - RNA, 23 nt, Molluscum contagiosum virus
acgaaucgcucgcggugcagcug

SEQ ID NO: 3095302 - RNA, 15 nt, Molluscum contagiosum virus
gagaggagugaaggg

SEQ ID NO: 3095303 - RNA, 12 nt, Molluscum contagiosum virus
cgccggugcgug

SEQ ID NO: 3095304 - RNA, 20 nt, Molluscum contagiosum virus
cguccacggguagcagcgcc

SEQ ID NO: 3095305 - RNA, 12 nt, Molluscum contagiosum virus
ucuuaauccagu

SEQ ID NO: 3095306 - RNA, 20 nt, Molluscum contagiosum virus
ggcacccgcaacaaggaaag

SEQ ID NO: 3095307 - RNA, 19 nt, Molluscum contagiosum virus
ugcaccgagugcuggccga

SEQ ID NO: 3095308 - RNA, 21 nt, Molluscum contagiosum virus
ggggagcauguccgacuccaa

SEQ ID NO: 3095309 - RNA, 12 nt, Molluscum contagiosum virus
acgcgcagcugu

SEQ ID NO: 3095310 - RNA, 19 nt, Molluscum contagiosum virus
ccuucaacgcgcgugcgua

SEQ ID NO: 3095311 - RNA, 15 nt, Molluscum contagiosum virus
gcacccaccaggaac

SEQ ID NO: 3095312 - RNA, 13 nt, Molluscum contagiosum virus
cgaggaccccgcc

SEQ ID NO: 3095313 - RNA, 20 nt, Molluscum contagiosum virus
ggucugcuuugucugcaggc

SEQ ID NO: 3095314 - RNA, 12 nt, Molluscum contagiosum virus
uguuauuucagu

SEQ ID NO: 3095315 - RNA, 22 nt, Molluscum contagiosum virus
ggaggucugcuuugucugcagg

SEQ ID NO: 3095316 - RNA, 12 nt, Molluscum contagiosum virus
acaccagcugga

SEQ ID NO: 3095317 - RNA, 20 nt, Molluscum contagiosum virus
agcgcggggguguugcugau

SEQ ID NO: 3095318 - RNA, 15 nt, Molluscum contagiosum virus
cucuguucugcuugg

SEQ ID NO: 3095319 - RNA, 20 nt, Molluscum contagiosum virus
cgagaagaccuguucuuuca

SEQ ID NO: 3095320 - RNA, 16 nt, Molluscum contagiosum virus
cccggcacgugccccg

SEQ ID NO: 3095321 - RNA, 20 nt, Molluscum contagiosum virus
uaccgcaaccagcugcuguc

SEQ ID NO: 3095322 - RNA, 14 nt, Molluscum contagiosum virus
ggcccgcgagcacg

SEQ ID NO: 3095323 - RNA, 20 nt, Molluscum contagiosum virus
cgcgcuacguacucuccaac

SEQ ID NO: 3095324 - RNA, 23 nt, Molluscum contagiosum virus
gcugcgguagcggacgcggugac

SEQ ID NO: 3095325 - RNA, 16 nt, Molluscum contagiosum virus
gcgaagagccccacca

SEQ ID NO: 3095326 - RNA, 17 nt, Molluscum contagiosum virus
gacucagcauguugcuc

SEQ ID NO: 3095327 - RNA, 12 nt, Molluscum contagiosum virus
gugcaccuggag

SEQ ID NO: 3095328 - RNA, 18 nt, Molluscum contagiosum virus
cugcgccggcugcgccac

SEQ ID NO: 3095329 - RNA, 17 nt, Molluscum contagiosum virus
cguucgcgcgccaguac

SEQ ID NO: 3095330 - RNA, 18 nt, Molluscum contagiosum virus
aucucuggauugucuuuu

SEQ ID NO: 3095331 - RNA, 14 nt, Molluscum contagiosum virus
uucugcugcacaca

SEQ ID NO: 3095332 - RNA, 17 nt, Molluscum contagiosum virus
accugcugguggugcug

SEQ ID NO: 3095333 - RNA, 18 nt, Molluscum contagiosum virus
ccgggcgccggcucugcc

SEQ ID NO: 3095334 - RNA, 21 nt, Molluscum contagiosum virus
gccagcgccuguccgugggcg

SEQ ID NO: 3095335 - RNA, 18 nt, Molluscum contagiosum virus
gcgcuucuuccggcagcu

SEQ ID NO: 3095336 - RNA, 17 nt, Molluscum contagiosum virus
cggcgcucgccucuggg

SEQ ID NO: 3095337 - RNA, 15 nt, Molluscum contagiosum virus
auggccggcaacugg

SEQ ID NO: 3095338 - RNA, 21 nt, Molluscum contagiosum virus
aggcacccgcaacaaggaaag

SEQ ID NO: 3095339 - RNA, 21 nt, Molluscum contagiosum virus
ccgggccugcggcggcgcacg

SEQ ID NO: 3095340 - RNA, 16 nt, Molluscum contagiosum virus
gccgcgcugcuggcca

SEQ ID NO: 3095341 - RNA, 19 nt, Molluscum contagiosum virus
uagcccaggaacaucugca

SEQ ID NO: 3095342 - RNA, 14 nt, Molluscum contagiosum virus
ugcacgugcagcgg

SEQ ID NO: 3095343 - RNA, 20 nt, Molluscum contagiosum virus
acgcuguccaggcgcugcac

SEQ ID NO: 3095344 - RNA, 14 nt, Molluscum contagiosum virus
cucaagcacugccu

SEQ ID NO: 3095345 - RNA, 16 nt, Molluscum contagiosum virus
cggugagugcgcgcac

SEQ ID NO: 3095346 - RNA, 23 nt, Molluscum contagiosum virus
cgggcccgacacguugcacugcg

SEQ ID NO: 3095347 - RNA, 18 nt, Molluscum contagiosum virus
gcaaccagcuggcgcccg

SEQ ID NO: 3095348 - RNA, 19 nt, Molluscum contagiosum virus
gugcggccaccagcgcggc

SEQ ID NO: 3095349 - RNA, 15 nt, Molluscum contagiosum virus
aggacaucuacaucg

SEQ ID NO: 3095350 - RNA, 14 nt, Molluscum contagiosum virus
accagcaccagcac

SEQ ID NO: 3095351 - RNA, 19 nt, Molluscum contagiosum virus
guacucgcguccgcgcagc

SEQ ID NO: 3095352 - RNA, 14 nt, Molluscum contagiosum virus
ccgcucgcgcugcu

SEQ ID NO: 3095353 - RNA, 17 nt, Molluscum contagiosum virus
aagcccggaagcuugcu

SEQ ID NO: 3095354 - RNA, 22 nt, Molluscum contagiosum virus
uguuucucgcgaaucacaaaca

SEQ ID NO: 3095355 - RNA, 20 nt, Molluscum contagiosum virus
ggugagccguuccacacaga

SEQ ID NO: 3095356 - RNA, 20 nt, Molluscum contagiosum virus
gagcacuggcuggcguucga

SEQ ID NO: 3095357 - RNA, 13 nt, Molluscum contagiosum virus
cuccagcguggug

SEQ ID NO: 3095358 - RNA, 14 nt, Molluscum contagiosum virus
agcagaccaagaag

SEQ ID NO: 3095359 - RNA, 18 nt, Molluscum contagiosum virus
ucacgugcuugcccgacc

SEQ ID NO: 3095360 - RNA, 16 nt, Molluscum contagiosum virus
cggucaacggcacagu

SEQ ID NO: 3095361 - RNA, 15 nt, Molluscum contagiosum virus
gcuuacacacgcacc

SEQ ID NO: 3095362 - RNA, 18 nt, Molluscum contagiosum virus
cugcucuacuuccacgag

SEQ ID NO: 3095363 - RNA, 23 nt, Molluscum contagiosum virus
acgacaagcguaagccaccgcgc

SEQ ID NO: 3095364 - RNA, 18 nt, Molluscum contagiosum virus
gagacuuccuugcgcagg

SEQ ID NO: 3095365 - RNA, 23 nt, Molluscum contagiosum virus
cugcgcuuuuuuuguccuguguu

SEQ ID NO: 3095366 - RNA, 17 nt, Molluscum contagiosum virus
gacucgcgucugcaagg

SEQ ID NO: 3095367 - RNA, 16 nt, Molluscum contagiosum virus
accuuggcgcgccgcu

SEQ ID NO: 3095368 - RNA, 15 nt, Molluscum contagiosum virus
ugcagcugcaggacc

SEQ ID NO: 3095369 - RNA, 18 nt, Molluscum contagiosum virus
gcugccgcgggacgagag

SEQ ID NO: 3095370 - RNA, 22 nt, Molluscum contagiosum virus
cgggaggcguccugcgggagca

SEQ ID NO: 3095371 - RNA, 17 nt, Molluscum contagiosum virus
gaccugcugcgagagca

SEQ ID NO: 3095372 - RNA, 23 nt, Molluscum contagiosum virus
gcgcacaagauggcgcagcacuu

SEQ ID NO: 3095373 - RNA, 20 nt, Molluscum contagiosum virus
uggaucuucucaagagccgc

SEQ ID NO: 3095374 - RNA, 13 nt, Molluscum contagiosum virus
cgaagaggucucu

SEQ ID NO: 3095375 - RNA, 21 nt, Molluscum contagiosum virus
gacgcguucuagcagcgugcg

SEQ ID NO: 3095376 - RNA, 20 nt, Molluscum contagiosum virus
cgagggcgcgaccggcgugc

SEQ ID NO: 3095377 - RNA, 22 nt, Molluscum contagiosum virus
gguaccccgcaggaaaggcacc

SEQ ID NO: 3095378 - RNA, 14 nt, Molluscum contagiosum virus
aagcacugccucau

SEQ ID NO: 3095379 - RNA, 20 nt, Molluscum contagiosum virus
agugcgucgacguggagccu

SEQ ID NO: 3095380 - RNA, 20 nt, Molluscum contagiosum virus
ccgcauuuucucuggagagc

SEQ ID NO: 3095381 - RNA, 14 nt, Molluscum contagiosum virus
ccggcagcgccgcg

SEQ ID NO: 3095382 - RNA, 14 nt, Molluscum contagiosum virus
caagcucgaacaga

SEQ ID NO: 3095383 - RNA, 13 nt, Molluscum contagiosum virus
gaggccagcacaa

SEQ ID NO: 3095384 - RNA, 23 nt, Molluscum contagiosum virus
cgagacuugugcccauguccuuu

SEQ ID NO: 3095385 - RNA, 17 nt, Molluscum contagiosum virus
guuccuggugugccagc

SEQ ID NO: 3095386 - RNA, 16 nt, Molluscum contagiosum virus
gcuggcgggugccgug

SEQ ID NO: 3095387 - RNA, 22 nt, Molluscum contagiosum virus
ugcacagcacaggccccagcaa

SEQ ID NO: 3095388 - RNA, 15 nt, Molluscum contagiosum virus
ccgacccggcucgcu

SEQ ID NO: 3095389 - RNA, 23 nt, Molluscum contagiosum virus
acgcugcagcuaggauccugcuc

SEQ ID NO: 3095390 - RNA, 19 nt, Molluscum contagiosum virus
cccggcggcccgcggcgcg

SEQ ID NO: 3095391 - RNA, 21 nt, Molluscum contagiosum virus
cacucgcuggccucugccugc

SEQ ID NO: 3095392 - RNA, 16 nt, Molluscum contagiosum virus
cugcgcugccagcucg

SEQ ID NO: 3095393 - RNA, 11 nt, Molluscum contagiosum virus
gcgcucaucaa

SEQ ID NO: 3095394 - RNA, 15 nt, Molluscum contagiosum virus
ggccaaagccgcgga

SEQ ID NO: 3095395 - RNA, 17 nt, Molluscum contagiosum virus
aaggcacccaccaggaa

SEQ ID NO: 3095396 - RNA, 21 nt, Molluscum contagiosum virus
ccccgaaaggcacccgcagga

SEQ ID NO: 3095397 - RNA, 16 nt, Molluscum contagiosum virus
cgcguccgccucuucc

SEQ ID NO: 3095398 - RNA, 20 nt, Molluscum contagiosum virus
cagccgcacggcgcccagga

SEQ ID NO: 3095399 - RNA, 21 nt, Molluscum contagiosum virus
gcaggaucggagcgcagcugc

SEQ ID NO: 3095400 - RNA, 16 nt, Molluscum contagiosum virus
gggccgcgaaagagga

SEQ ID NO: 3095401 - RNA, 18 nt, Molluscum contagiosum virus
gacguacgagcaggcgca

SEQ ID NO: 3095402 - RNA, 16 nt, Molluscum contagiosum virus
ggacacuggcaccgga

SEQ ID NO: 3095403 - RNA, 20 nt, Molluscum contagiosum virus
gacgccgacaacagugaaga

SEQ ID NO: 3095404 - RNA, 15 nt, Molluscum contagiosum virus
cgggcggaagcuccu

SEQ ID NO: 3095405 - RNA, 17 nt, Molluscum contagiosum virus
gaccacggcgcgccgcc

SEQ ID NO: 3095406 - RNA, 17 nt, Molluscum contagiosum virus
gaaaacuuguggcgcaa

SEQ ID NO: 3095407 - RNA, 13 nt, Molluscum contagiosum virus
ugcgcggcgccgc

SEQ ID NO: 3095408 - RNA, 18 nt, Molluscum contagiosum virus
gagcagugccgcucgcug

SEQ ID NO: 3095409 - RNA, 21 nt, Molluscum contagiosum virus
ucacagguagugguccaccag

SEQ ID NO: 3095410 - RNA, 17 nt, Molluscum contagiosum virus
cugcgugcuugugcgcc

SEQ ID NO: 3095411 - RNA, 14 nt, Molluscum contagiosum virus
agaagcggcccugc

SEQ ID NO: 3095412 - RNA, 16 nt, Molluscum contagiosum virus
gccgagcaauugcugg

SEQ ID NO: 3095413 - RNA, 14 nt, Molluscum contagiosum virus
gagccugccgcgag

SEQ ID NO: 3095414 - RNA, 11 nt, Molluscum contagiosum virus
uaguccugcua

SEQ ID NO: 3095415 - RNA, 12 nt, Molluscum contagiosum virus
gggaagcacagu

SEQ ID NO: 3095416 - RNA, 24 nt, Molluscum contagiosum virus
ccgccgucgcccggcaggcucccg

SEQ ID NO: 3095417 - RNA, 18 nt, Molluscum contagiosum virus
cagccugcuggcaccgcg

SEQ ID NO: 3095418 - RNA, 17 nt, Molluscum contagiosum virus
cucaagacgcugcuggc

SEQ ID NO: 3095419 - RNA, 18 nt, Molluscum contagiosum virus
gacaaggagaugggcacg

SEQ ID NO: 3095420 - RNA, 21 nt, Molluscum contagiosum virus
caacgacaaggaaaggcaccc

SEQ ID NO: 3095421 - RNA, 22 nt, Molluscum contagiosum virus
cgugcacgugguuugcucgauc

SEQ ID NO: 3095422 - RNA, 16 nt, Molluscum contagiosum virus
gugcgcaccagcugca

SEQ ID NO: 3095423 - RNA, 15 nt, Molluscum contagiosum virus
uggcuucggggacac

SEQ ID NO: 3095424 - RNA, 14 nt, Molluscum contagiosum virus
cgagcgcgggcgcc

SEQ ID NO: 3095425 - RNA, 14 nt, Molluscum contagiosum virus
accgcaccgagccc

SEQ ID NO: 3095426 - RNA, 14 nt, Molluscum contagiosum virus
ggaacaaugcugca

SEQ ID NO: 3095427 - RNA, 21 nt, Molluscum contagiosum virus
auaccaagucuucggaguggg

SEQ ID NO: 3095428 - RNA, 14 nt, Molluscum contagiosum virus
ucaccuuccugggc

SEQ ID NO: 3095429 - RNA, 17 nt, Molluscum contagiosum virus
cugccggcucaagcugg

SEQ ID NO: 3095430 - RNA, 20 nt, Molluscum contagiosum virus
cgggcugucgcccggcagcg

SEQ ID NO: 3095431 - RNA, 14 nt, Molluscum contagiosum virus
uucugcgcagggac

SEQ ID NO: 3095432 - RNA, 22 nt, Molluscum contagiosum virus
ugcgcgcacggcuaggcgcggc

SEQ ID NO: 3095433 - RNA, 17 nt, Molluscum contagiosum virus
guccccgaacugcuggg

SEQ ID NO: 3095434 - RNA, 14 nt, Molluscum contagiosum virus
gcucaccgcgcaga

SEQ ID NO: 3095435 - RNA, 13 nt, Molluscum contagiosum virus
cugcucgggcugc

SEQ ID NO: 3095436 - RNA, 17 nt, Molluscum contagiosum virus
ggagacaccagcuccgc

SEQ ID NO: 3095437 - RNA, 18 nt, Molluscum contagiosum virus
acccuuggcagcaacugc

SEQ ID NO: 3095438 - RNA, 14 nt, Molluscum contagiosum virus
cugccagcagagcu

SEQ ID NO: 3095439 - RNA, 14 nt, Molluscum contagiosum virus
gcaugugcgagcgc

SEQ ID NO: 3095440 - RNA, 16 nt, Molluscum contagiosum virus
cagugcgugcacuguc

SEQ ID NO: 3095441 - RNA, 12 nt, Molluscum contagiosum virus
gucaccgcgucc

SEQ ID NO: 3095442 - RNA, 20 nt, Molluscum contagiosum virus
auguucucuuuguuccugcg

SEQ ID NO: 3095443 - RNA, 14 nt, Molluscum contagiosum virus
cucguggacagccu

SEQ ID NO: 3095444 - RNA, 21 nt, Molluscum contagiosum virus
cugcacgucgaagaccaccag

SEQ ID NO: 3095445 - RNA, 14 nt, Molluscum contagiosum virus
caucgcgcugcucu

SEQ ID NO: 3095446 - RNA, 19 nt, Molluscum contagiosum virus
ggcagcccgucggccacag

SEQ ID NO: 3095447 - RNA, 17 nt, Molluscum contagiosum virus
uacgagacucuggaagc

SEQ ID NO: 3095448 - RNA, 14 nt, Molluscum contagiosum virus
cgaagagcagaagg

SEQ ID NO: 3095449 - RNA, 23 nt, Molluscum contagiosum virus
gugcauggcggcggccacgcucg

SEQ ID NO: 3095450 - RNA, 15 nt, Molluscum contagiosum virus
acgccuucuuccugc

SEQ ID NO: 3095451 - RNA, 15 nt, Molluscum contagiosum virus
cccucaggggcucuc

SEQ ID NO: 3095452 - RNA, 15 nt, Molluscum contagiosum virus
gcgcgggccuguccg

SEQ ID NO: 3095453 - RNA, 22 nt, Molluscum contagiosum virus
cucgguacaacuuuuccugcgu

SEQ ID NO: 3095454 - RNA, 20 nt, Molluscum contagiosum virus
guuccguucgucagagggac

SEQ ID NO: 3095455 - RNA, 15 nt, Molluscum contagiosum virus
cgcgcgccugcuggc

SEQ ID NO: 3095456 - RNA, 19 nt, Molluscum contagiosum virus
guuugcgcucucagagcau
